United States Patent 8,541,208 (PROCESS FOR THE PRODUCTION OF FINE CHEMICALS) - sequence listing, part 12

SEQ ID NO: 55217 - protein, 396 aa, Escherichia coli
MFENITAAPADPILGLADLFRADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAYQGFARGLEEDAEGLRAFAAMHKELIVASSYSKNFGLYNERVGACTLVAADSETVDRAFSQMKAAIRANYSNPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 55218 - DNA, 1197 bp, Pseudomonas aeruginosa
  CDS (1)..(1197)
atgagtctgttttctgccgtcgaaatggcaccgcgtgatcccatccttggcctgaacgaagccttcaacgccgatacccgtccgggcaagatcaacctgggcgtgggcgtgtactacaacgaggaggggcgcattccgctgttgcgtgccgtgcaggctgccgagaaggcccgcatcgaggcccacgcgccgcgcggctacctgccgatcgaagggatcgccgcctacgaccagggcgtacagaaactgctgttcggtaacgagtccgagctgctggccgccggccgtgtggtcacgacccaggccgtcggcggcaccggcgcgctcaagctcggcgccgacttcctcaagcgcctgctgcccgacgccaccgtggccatcagcgacccgagctgggaaaaccaccgcgcactgttcgaagccgccggcttcccggtgcagaactaccgctattacgacgccgccagcaatggcgtgaaccgcgccggcctgctggaagacctgaatgccctgccggcccgctcgatcgtggttctgcacgcctgctgccataatccgaccggcgtcgatctcgagctggacgactggaaacaggtgctggacgtgctcaaggccaagggccacgtgccgttcctcgacatcgcctaccagggcttcggcaacggcatcgaggaagacgccgccgcggtgcgcctgttcgcccagtcgggcctgagcttcttcgtttccagctcgttctccaaatccttctcgctctatggcgaacgcgtcggcgccctctcgatcgtgaccgaaagccgcgatgaatcggcccgcgtgctgtcccaggtgaagcgggtgatccgcaccaactattcgaacccaccgacccacggcgccagcgtcgtctcctccgtgctcaacagcccggaactgcgggccctctgggagcaggaactgggcgagatgcgcgaccgcatccgcgacatgcgcctggcgatggtcgagcaactggcagcccacggcgccaagcgcgacttcagcttcgtcggtcgccaacgtggcatgttctcctattccggcctgaccgccgaccaggtcgagcgcctgaagaccgagttcggtatctacgccgtcagcaccggccgtatctgcgtcgccgcgctgaacaaatcgaacctggagaccatcaccaaggccatcgtccaggtcctgtag

SEQ ID NO: 55219 - protein, 398 aa, Pseudomonas aeruginosa
MSLFSAVEMAPRDPILGLNEAFNADTRPGKINLGVGVYYNEEGRIPLLRAVQAAEKARIEAHAPRGYLPIEGIAAYDQGVQKLLFGNESELLAAGRVVTTQAVGGTGALKLGADFLKRLLPDATVAISDPSWENHRALFEAAGFPVQNYRYYDAASNGVNRAGLLEDLNALPARSIVVLHACCHNPTGVDLELDDWKQVLDVLKAKGHVPFLDIAYQGFGNGIEEDAAAVRLFAQSGLSFFVSSSFSKSFSLYGERVGALSIVTESRDESARVLSQVKRVIRTNYSNPPTHGASVVSSVLNSPELRALWEQELGEMRDRIRDMRLAMVEQLAAHGAKRDFSFVGRQRGMFSYSGLTADQVERLKTEFGIYAVSTGRICVAALNKSNLETITKAIVQVL

SEQ ID NO: 55220 - DNA, 1191 bp, Salmonella typhimurium
  CDS (1)..(1191)
atgtttgagaacataaccgccgctcctgccgacccgattttgggcctggccgatctgtttcgcgccgatgaccgtccagggaaaattaaccttggcattggcgtatataaagatgaaaccggcaaaacaccggtgctcaccagcgttaaaaaagccgagcagtatttactggaaaatgaaacgacgaaaaactatctcggcattgacgggattccggaatttgctcgctgcactcaggaactgctgttcggcaaaggcagcgcgctgattaacgataagcgcgcacgcacggcgcaaacgccgggcggtaccggcgcgttacgcattgccgccgactttttggcaaaaaatactccggtaaaacgggtgtgggtgagcaaccccagctggccgaaccacaaaagcgtgtttaacgctgccggcctggaagttcgggagtacgcttactacgatgcggaaaatcacacgctggattttgaagcgctacaagccagcctgagcgaagcacaggccggcgatgtggttctgttccacggttgctgtcataacccaaccggcattgaccctactctggaacagtggcaggttctggctgagctttccgttgaaaaagggtggctgccgctattcgatttcgcttaccagggctttgcccgcggcctggaagaagatgcggaaggtctgcgcgcctttgccgcgctgcataaagagcttattgtcgccagctcctactccaaaaacttcggcttatataatgagcgcgtcggcgcctgcaccctcgttgccgccgatgcggaaaccgtggatcgcgcttttagccagatgaaatccgccattcgcgctaactactccaacccgccagcgcacggcgcgtccatcgtcgcgactatcctgagtaatgacgccctgcgcgctatctgggaacaggaactgacggacatgcgccagcgtattcagcgtatgcgtcaactgttcgtgaataccttgcaggaaaaaggcgcgaaccgtgacttcagctttattatcaagcagaacgggatgttctcattcagcggtctgaccaaagatcaggtgctgcgtctgcgtgaagagttcggcgtttatgccgtggcttctggtcgcgtgaacgtggcgggcatgaccccggataatatggcgccgctgtgcgaagccattgtcgcggtactgtaa

SEQ ID NO: 55221 - protein, 396 aa, Salmonella typhimurium
MFENITAAPADPILGLADLFRADDRPGKINLGIGVYKDETGKTPVLTSVKKAEQYLLENETTKNYLGIDGIPEFARCTQELLFGKGSALINDKRARTAQTPGGTGALRIAADFLAKNTPVKRVWVSNPSWPNHKSVFNAAGLEVREYAYYDAENHTLDFEALQASLSEAQAGDVVLFHGCCHNPTGIDPTLEQWQVLAELSVEKGWLPLFDFAYQGFARGLEEDAEGLRAFAALHKELIVASSYSKNFGLYNERVGACTLVAADAETVDRAFSQMKSAIRANYSNPPAHGASIVATILSNDALRAIWEQELTDMRQRIQRMRQLFVNTLQEKGANRDFSFIIKQNGMFSFSGLTKDQVLRLREEFGVYAVASGRVNVAGMTPDNMAPLCEAIVAVL

SEQ ID NO: 55222 - DNA, 1170 bp, Rhizobium meliloti
  CDS (1)..(1170)
atgttcgacgccctcgcccgccaagccgacgatcccttgctggccctgatcggcctgttcaggaaggatgagcgccccggaaaggtcgatctcggcgtaggagtctatcgcgacgagaccggacgcacgccgatcttccgggccgtcaaggcggcggaaaagcggcttctcgaaacacaggacagcaaggcctatatcggccccgaaggggacctcgtctttctcgatcggctctgggaactcgtcggcggcgacacgatcgagcggagccatgttgcgggcgtccagacgcccggcggctccggcgcgctccgtttggcggcggacctcatcgcccgcatgggcggccgaggcatctggctcgggctgccgagctggccgaaccacgcgccgatcttcaaggcggccgggctcgatatcgccacctacgacttcttcgacattccgtcgcagtcggtcatcttcgataatctggtgagcgcgctggaaggcgccgcatccggcgatgcggtgctgctgcatgcaagctgccacaacccgaccggcggcgtcctgagcgaagcacaatggatggagatcgccgcgctggtggccgagcgcggcctgctgccgctcgtcgatctcgcctatcaggggttcggccgcggcctcgaccaggatgtcgcgggcctccggcatcttctcggcgtggtcccggaagcgctcgtcgcggtttcctgctcgaagtccttcgggctttatcgcgagcgcgcgggcgcgatcttcgcgcggaccagctcgactgcctcggcggacagggtgcgctcaaacctcgcgggcctcgcacgcaccagctattccatgccgccggatcacggcgcagccgtcgtgcggacgatccttgacgacccggaactcaggcgcgactggacggaggagctcgagacgatgcggctcaggatgacgggcctccggcggtcgcttgccgagggactccgcacccgctggcagagcctcggcgcagtcgccgatcaggagggcatgttctccatgctgccgctttccgaagcggaggttatgcggctcaggaccgagcacggcatctatatgccggcatccggccgcatcaacatcgccgggctgaagacggcggaagccgccgagattgccggcaagttcaccagtctctga

SEQ ID NO: 55223 - protein, 389 aa, Rhizobium meliloti
MFDALARQADDPLLALIGLFRKDERPGKVDLGVGVYRDETGRTPIFRAVKAAEKRLLETQDSKAYIGPEGDLVFLDRLWELVGGDTIERSHVAGVQTPGGSGALRLAADLIARMGGRGIWLGLPSWPNHAPIFKAAGLDIATYDFFDIPSQSVIFDNLVSALEGAASGDAVLLHASCHNPTGGVLSEAQWMEIAALVAERGLLPLVDLAYQGFGRGLDQDVAGLRHLLGVVPEALVAVSCSKSFGLYRERAGAIFARTSSTASADRVRSNLAGLARTSYSMPPDHGAAVVRTILDDPELRRDWTEELETMRLRMTGLRRSLAEGLRTRWQSLGAVADQEGMFSMLPLSEAEVMRLRTEHGIYMPASGRINIAGLKTAEAAEIAGKFTSL

SEQ ID NO: 55224 - DNA, 1200 bp, Pseudomonas aeruginosa
  CDS (1)..(1200)
atgagtcatttcgccaaggtcgcccgcgtaccgggcgacccgatcctgggcctgctcgacgcctaccgcaacgatccgcgcgcggacaagctggacctcggcgtcggtgtctacaaggatgcccagggcctgaccccgatcctgcgctcggtgaaactcgccgagcagcgcctggtcgagcaggaaaccaccaagagctacgtcggcggccacggcgatgcgctgttcgccgcgcgcctggcggaactggcgctcggcgccgcctcgccgctgttgctggagcaacgcgccgacgccacccagacgcccggcggcaccggcgccttgcgcctggccggcgacttcatcgcccattgcctgcccggccgcggcatctggctgagcgacccgacctggccgatccacgagaccctgttcgccgccgccggcctgaaggtttcccactacccctacgtcagcgccgacaaccgcctggatgtcgaggcgatgcttgctggcctggagcgcattccccagggagacgtggtgctgctgcatgcctgctgccacaacccgaccggtttcgacctgagccacgacgactggcgcagggtgctcgacgtggtgcgtcgccgcgagctgctgccgctgatcgacttcgcctaccagggcttcggcgacggtctcgaggaagacgcctgggcggtacgcctgttcgccggcgaactgccggaggtgctggtcaccagttcctgctcgaagaacttcggcctgtaccgcgaccgcgtcggtgcgctgatcgtctgcgcgcagaacgccgagaagctcaccgacctgcgtagccaactggccttcctcgcccgcaacctctggtcgaccccgccggcgcatggtgccgaggtggtcgcggcgatcctcggcgacagcgagttgaagggactctggcaggaagaggtcgaaggcatgcgctcgcgcatcgccagcctgcgcatcggcctggtcgaagccctggcgccgcacggcctggccgagcgcttcgcccatgtcggcgcgcaacgcgggatgttttcctataccggactgagcccgcagcaggtcgctcggctgcgcgacgagcacgccgtttacctggtctccagcggccgggccaacgtcgccggtctcgacgcgcgccgcctcgaccgcctggcgcaagccatcgcccaggtctgcgcggactga

SEQ ID NO: 55225 - protein, 399 aa, Pseudomonas aeruginosa
MSHFAKVARVPGDPILGLLDAYRNDPRADKLDLGVGVYKDAQGLTPILRSVKLAEQRLVEQETTKSYVGGHGDALFAARLAELALGAASPLLLEQRADATQTPGGTGALRLAGDFIAHCLPGRGIWLSDPTWPIHETLFAAAGLKVSHYPYVSADNRLDVEAMLAGLERIPQGDVVLLHACCHNPTGFDLSHDDWRRVLDVVRRRELLPLIDFAYQGFGDGLEEDAWAVRLFAGELPEVLVTSSCSKNFGLYRDRVGALIVCAQNAEKLTDLRSQLAFLARNLWSTPPAHGAEVVAAILGDSELKGLWQEEVEGMRSRIASLRIGLVEALAPHGLAERFAHVGAQRGMFSYTGLSPQQVARLRDEHAVYLVSSGRANVAGLDARRLDRLAQAIAQVCAD

SEQ ID NO: 55226 - DNA, 1185 bp, Paracoccus denitrificans
  CDS (1)..(1185)
atgctgggcaatctgaaaccgcaggcccccgacaagatcctggccctgatgggcgaattcagggccgatccccgccagggcaagatcgacctgggcgtgggggtctacaaggatgccaccggccacaccccgatcatgcgggccgtccacgccgccgagcagcgcatgctggaaaccgagaccaccaagacctatgccggcctctcgggcgagcccgagttccaaaaggccatgggcgagctgatcctgggcgacggactgaaatccgagaccaccgcgacgctggcgacggtcggcggcaccggcgccctccggcaggcgctggaactggcgcgcatggcgaacccggacctgcgggtcttcgtcagcgatccgacctggccgaaccatgtctcgatcatgaatttcatgggcctgccggtgcagacctatcgctatttcgatgccgagacccgcggcgtcgatttcgagggcatgaaggccgacctcgccgccgcgaaaaagggcgacatggtgctgctgcacggctgctgccacaacccgaccggcgccaacctgacgctggatcaatgggccgagatcgcctcgatcctggaaaagaccggcgcgctgccgctgatcgacctggcctatcagggcttcggcgacgggctggaagaggacgcggccggcacccggctgatcgcctcgcgcatccccgaggtgctgatcgcggcctcgtgcagcaagaacttcggcatctaccgcgaacgcaccggctgcctgctggcgctttgcgccgatgcggcgaccagggagctggcgcagggcgccatggccttcctgaaccgccagacctattccttcccgcccttccacggcgccaagatcgtctcgaccgtgctgaccacgcccgaactgcgcgccgactggatggccgagctggaagcggtgcgcagcggcatgctgcgcctgcgcgagcaattggcgggcgagttgcgcgatctcagcggttcggaccgtttcggcttcgtggccgagcatcgcggcatgttctcgcgcctgggcgccacgcccgaacaggtcaagcgcatcaaggaagagttcggcatctacatggtgggcgattcgcgcatcaacatcgccgggctgaacgacaacaccatcccgatcctggcccgcgctatcatcgaggtgggggtctaa

SEQ ID NO: 55227 - protein, 394 aa, Paracoccus denitrificans
MLGNLKPQAPDKILALMGEFRADPRQGKIDLGVGVYKDATGHTPIMRAVHAAEQRMLETETTKTYAGLSGEPEFQKAMGELILGDGLKSETTATLATVGGTGALRQALELARMANPDLRVFVSDPTWPNHVSIMNFMGLPVQTYRYFDAETRGVDFEGMKADLAAAKKGDMVLLHGCCHNPTGANLTLDQWAEIASILEKTGALPLIDLAYQGFGDGLEEDAAGTRLIASRIPEVLIAASCSKNFGIYRERTGCLLALCADAATRELAQGAMAFLNRQTYSFPPFHGAKIVSTVLTTPELRADWMAELEAVRSGMLRLREQLAGELRDLSGSDRFGFVAEHRGMFSRLGATPEQVKRIKEEFGIYMVGDSRINIAGLNDNTIPILARAIIEVGV

SEQ ID NO: 55228 - DNA, 1194 bp, Salmonella typhimurium
  CDS (1)..(1194)
atgtttcaaaaagttgacgcctatgccggcgatccgattctttcactgatggagcgttttaaagacgactcccgtcacgacaaagtgaatctgagcattggcctgtattacaacgaagacgggattatcccacagcttaaaacggtggccgaagccgaagcccggcttaacgcgcagccgcatggcgcttcgctgtacctgccgatggaaggactcaatacttatcgccatactatcgcgcctttgctctttggcgccgatcacccggttcttcagcaacagcgcgtggccactatccagacattaggcggctccggcgcgctgaaagtaggcgcggatttcctgaagcgttatttccccgacgcaggcgtatgggtgagcgaccccacctgggaaaaccatattgcgatatttgccggggcaggattcgaagtgagtacttacccctggtatgacgacgcgactaacggcatccgttttaacgatctgctggccacgctgaatacgttacctgcgcgcagtatcgtgttgctgcacccctgttgtcacaacccgaccggggcggatttaacgccttcgcaatgggatgcggtgattgaaatagtgaaagcgcgcgatctgattccgtttcttgatattgcctatcaggggtttggcgcaggcatggacgatgatgcgtacgttattcgcgccattgccagcgctgggttacctgcgttagtcagtaattctttttcgaagattttctcgctgtacggcgagcgcgtcggcggcctgtccgtggtgtgtgaagatgctgaaatcgccgcgcgggttctgggacagctaaaagcgacggtgcgccgaatttactccagtccgccgtgtttcggcgctcaggtggtcgctacggtcctgggcgatgaggcgttaaaagcgggctggctggcggaagtcgacgcgatgcgtaaccgcattatatcgatgcgccagacgctggtgaaggagctgaaggcggagatgcctgaccgcaactttgattacttgttacagcagcgcggtatgttcagctataccgggttaagcgaggagcaggtcgatcggttgcgcgatgagtttggcgtttacctgattgccagtggccgcatgtgtgtcgccgggcttaatgcttcaaatgtacaccgcgtggcgaaggcatttgccgctgtcatgtaa

SEQ ID NO: 55229 - protein, 397 aa, Salmonella typhimurium
MFQKVDAYAGDPILSLMERFKDDSRHDKVNLSIGLYYNEDGIIPQLKTVAEAEARLNAQPHGASLYLPMEGLNTYRHTIAPLLFGADHPVLQQQRVATIQTLGGSGALKVGADFLKRYFPDAGVWVSDPTWENHIAIFAGAGFEVSTYPWYDDATNGIRFNDLLATLNTLPARSIVLLHPCCHNPTGADLTPSQWDAVIEIVKARDLIPFLDIAYQGFGAGMDDDAYVIRAIASAGLPALVSNSFSKIFSLYGERVGGLSVVCEDAEIAARVLGQLKATVRRIYSSPPCFGAQVVATVLGDEALKAGWLAEVDAMRNRIISMRQTLVKELKAEMPDRNFDYLLQQRGMFSYTGLSEEQVDRLRDEFGVYLIASGRMCVAGLNASNVHRVAKAFAAVM

SEQ ID NO: 55230 - DNA, 25 bp, Primer
atgtttcaaaaagttgacgcctacg

SEQ ID NO: 55231 - DNA, 22 bp, Primer
ttacatcaccgcagcaaacgcc

SEQ ID NO: 55232 - protein, 395 aa, consensus
  MISC_FEATURE (1)..(395): consensus for the disclosure of xaa see table XV
PXDPILXXXXXXXXDXXXXKXNLGXGXYXXXXGXXXXLXXVXXAEXXXXXXXXXXXXYLXXXGXXXXXXXXXXLXXGXXXXXXXXXRXXXXQXXXGXGALXXXAXFXXXXXXXXXXXXXXXXXXXXXPXWXNHXXXFXXAGXXXXXXYXYXDXXXXXXXXXXXXXXXXXXXXXXXXXXLHXCXHNPTGXDXXXXQWXXXXXXXXXXXXXPXXDXAYQGFXXGXXXXDAXXXRXXXXXXXXXXXXXXSXXKXXXLYXERXGXXXXXXXXXXXXXXXXXXXXXXXXQXXXXXRXXYSXPPXXGAXXXXXXLXXXXLXXXWXXEXXXMXXRIXXMRXXXXXXLXXXXXXXXXXXXXXXXXXQXGMFXXXGLXXXQVXXXLXXXXXXYXXXXGRXXXAG

SEQ ID NO: 55233 - protein, 48 aa, consensus
  MISC_FEATURE (1)..(48): consensus for the disclosure of xaa see table XV
XXXXXXXXXXXXXXXXXXXXXXXXXXXXXXXXXXXXXXXXXXXXXXXX

SEQ ID NO: 55234 - protein, 55 aa, consensus
  MISC_FEATURE (1)..(55): consensus for the disclosure of xaa see table XV
XXXXXXXNPXGXXXXXXXXXXXXXXXXXXXXXXXXXXXXXDXXYXXXXXXXXXXX

SEQ ID NO: 55235 - protein, 14 aa, consensus
  MISC_FEATURE (1)..(14): consensus for the disclosure of xaa see table XV
XXXKXXXXXXXRXG

SEQ ID NO: 55236 - protein, 132 aa, consensus
  MISC_FEATURE (1)..(132): consensus for the disclosure of xaa see table XV
KXXXXXGXYXXXXXXXXXXXXXXXXXXXXXXXXXXXXXYXXXXGXXXXXXXXXXXXXGXXXXXXXXXXXXXXXXXXGXGXXXXXXXXXXXXXXXXXXXXXXXXXXXXXPXWXXHXXXXXXXXXXXXXXXXXX

SEQ ID NO: 55237 - protein, 81 aa, consensus
  MISC_FEATURE (1)..(81): consensus for the disclosure of xaa see table XV
HXCXHXXXGXXXXXXXWXXXXXXXXXXXXXXXXDXAXQGXXXXXXXXDXXXXRXXXXXXXXXXXXXXSXXXXXXXYXXXXG

SEQ ID NO: 55238 - protein, 49 aa, consensus
  MISC_FEATURE (1)..(49): consensus for the disclosure of xaa see table XV
XXXXXXXXXXSXPXXXGXXXXXXXXXXXXXXXXWXXXXXXMXXXXXXXR

SEQ ID NO: 55239 - protein, 38 aa, consensus
  MISC_FEATURE (1)..(38): consensus for the disclosure of xaa see table XV
XXGMFXXXGXXXXXXXXXXXXXXXXYXXXXXXXXXXXX

SEQ ID NO: 55240 - DNA, 912 bp, Escherichia coli; identical to SEQ ID NO: 33057
  CDS (1)..(912)

SEQ ID NO: 55241 - protein, 303 aa, Escherichia coli; identical to SEQ ID NO: 33058

SEQ ID NO: 55242 - DNA, 885 bp, Silicibacter pomeroyi DSS-3; identical to SEQ ID NO: 33059
  CDS (1)..(885)

SEQ ID NO: 55243 - protein, 294 aa, Silicibacter pomeroyi DSS-3; identical to SEQ ID NO: 33060

SEQ ID NO: 55244 - DNA, 894 bp, Silicibacter pomeroyi DSS-3; identical to SEQ ID NO: 33061
  CDS (1)..(894)

SEQ ID NO: 55245 - protein, 297 aa, Silicibacter pomeroyi DSS-3; identical to SEQ ID NO: 33062

SEQ ID NO: 55246 - DNA, 897 bp, Francisella tularensis subsp. tularensis; identical to SEQ ID NO: 33063
  CDS (1)..(897)

SEQ ID NO: 55247 - protein, 298 aa, Francisella tularensis subsp. tularensis; identical to SEQ ID NO: 33064

SEQ ID NO: 55248 - DNA, 888 bp, Mesorhizobium loti MAFF303099; identical to SEQ ID NO: 33065
  CDS (1)..(888)

SEQ ID NO: 55249 - protein, 295 aa, Mesorhizobium loti MAFF303099; identical to SEQ ID NO: 33066

SEQ ID NO: 55250 - DNA, 948 bp, Vibrio cholerae O1 biovar eltor str. N16961; identical to SEQ ID NO: 33067
  CDS (1)..(948)

SEQ ID NO: 55251 - protein, 315 aa, Vibrio cholerae O1 biovar eltor str. N16961; identical to SEQ ID NO: 33068

SEQ ID NO: 55252 - DNA, 954 bp, Pseudomonas aeruginosa PAO1; identical to SEQ ID NO: 33069
  CDS (1)..(954)

SEQ ID NO: 55253 - protein, 317 aa, Pseudomonas aeruginosa PAO1; identical to SEQ ID NO: 33070

SEQ ID NO: 55254 - DNA, 888 bp, Pseudomonas aeruginosa PAO1; identical to SEQ ID NO: 33071
  CDS (1)..(888)

SEQ ID NO: 55255 - protein, 295 aa, Pseudomonas aeruginosa PAO1; identical to SEQ ID NO: 33072

SEQ ID NO: 55256 - DNA, 909 bp, Pseudomonas aeruginosa PAO1; identical to SEQ ID NO: 33073
  CDS (1)..(909)

SEQ ID NO: 55257 - protein, 302 aa, Pseudomonas aeruginosa PAO1; identical to SEQ ID NO: 33074

SEQ ID NO: 55258 - DNA, 900 bp, Neisseria meningitidis MC58; identical to SEQ ID NO: 33075
  CDS (1)..(900)

SEQ ID NO: 55259 - protein, 299 aa, Neisseria meningitidis MC58; identical to SEQ ID NO: 33076

SEQ ID NO: 55260 - DNA, 900 bp, Clostridium acetobutylicum ATCC 824; identical to SEQ ID NO: 33077
  CDS (1)..(900)

SEQ ID NO: 55261 - protein, 299 aa, Clostridium acetobutylicum ATCC 824; identical to SEQ ID NO: 33078

SEQ ID NO: 55262 - DNA, 903 bp, Agrobacterium tumefaciens str. C58; identical to SEQ ID NO: 33079
  CDS (1)..(903)

SEQ ID NO: 55263 - protein, 300 aa, Agrobacterium tumefaciens str. C58; identical to SEQ ID NO: 33080

SEQ ID NO: 55264 - DNA, 921 bp, Agrobacterium tumefaciens str. C58; identical to SEQ ID NO: 33081
  CDS (1)..(921)

SEQ ID NO: 55265 - protein, 306 aa, Agrobacterium tumefaciens str. C58; identical to SEQ ID NO: 33082

SEQ ID NO: 55266 - DNA, 897 bp, Agrobacterium tumefaciens str. C58; identical to SEQ ID NO: 33083
  CDS (1)..(897)

SEQ ID NO: 55267 - protein, 298 aa, Agrobacterium tumefaciens str. C58; identical to SEQ ID NO: 33084

SEQ ID NO: 55268 - DNA, 900 bp, Agrobacterium tumefaciens str. C58; identical to SEQ ID NO: 33085
  CDS (1)..(900)

SEQ ID NO: 55269 - protein, 299 aa, Agrobacterium tumefaciens str. C58; identical to SEQ ID NO: 33086

SEQ ID NO: 55270 - DNA, 909 bp, Sinorhizobium meliloti 1021; identical to SEQ ID NO: 33087
  CDS (1)..(909)

SEQ ID NO: 55271 - protein, 302 aa, Sinorhizobium meliloti 1021; identical to SEQ ID NO: 33088

SEQ ID NO: 55272 - DNA, 942 bp, Sinorhizobium meliloti 1021; identical to SEQ ID NO: 33089
  CDS (1)..(942)

SEQ ID NO: 55273 - protein, 313 aa, Sinorhizobium meliloti 1021; identical to SEQ ID NO: 33090

SEQ ID NO: 55274 - DNA, 984 bp, Salmonella typhimurium LT2; identical to SEQ ID NO: 33091
  CDS (1)..(984)

SEQ ID NO: 55275 - protein, 327 aa, Salmonella typhimurium LT2; identical to SEQ ID NO: 33092

SEQ ID NO: 55276 - DNA, 909 bp, Salmonella typhimurium LT2; identical to SEQ ID NO: 33093
  CDS (1)..(909)

SEQ ID NO: 55277 - protein, 302 aa, Salmonella typhimurium LT2; identical to SEQ ID NO: 33094

SEQ ID NO: 55278 - DNA, 945 bp, Ralstonia solanacearum GMI1000; identical to SEQ ID NO: 33095
  CDS (1)..(945)

SEQ ID NO: 55279 - protein, 314 aa, Ralstonia solanacearum GMI1000; identical to SEQ ID NO: 33096

SEQ ID NO: 55280 - DNA, 897 bp, Clostridium perfringens str. 13; identical to SEQ ID NO: 33097
  CDS (1)..(897)

SEQ ID NO: 55281 - protein, 298 aa, Clostridium perfringens str. 13; identical to SEQ ID NO: 33098

SEQ ID NO: 55282 - DNA, 873 bp, Bacillus anthracis str. A2012; identical to SEQ ID NO: 33099
  CDS (1)..(873)

SEQ ID NO: 55283 - protein, 290 aa, Bacillus anthracis str. A2012; identical to SEQ ID NO: 33100

SEQ ID NO: 55284 - DNA, 909 bp, Thermosynechococcus elongatus BP-1; identical to SEQ ID NO: 33101
  CDS (1)..(909)

SEQ ID NO: 55285 - protein, 302 aa, Thermosynechococcus elongatus BP-1; identical to SEQ ID NO: 33102

SEQ ID NO: 55286 - DNA, 876 bp, Oceanobacillus iheyensis HTE831; identical to SEQ ID NO: 33103
  CDS (1)..(876)

SEQ ID NO: 55287 - protein, 291 aa, Oceanobacillus iheyensis HTE831; identical to SEQ ID NO: 33104

SEQ ID NO: 55288 - DNA, 912 bp, Shigella flexneri 2a str. 301; identical to SEQ ID NO: 33105
  CDS (1)..(912)

SEQ ID NO: 55289 - protein, 303 aa, Shigella flexneri 2a str. 301; identical to SEQ ID NO: 33106

SEQ ID NO: 55290 - DNA, 882 bp, Shewanella oneidensis MR-1; identical to SEQ ID NO: 33107
  CDS (1)..(882)

SEQ ID NO: 55291 - protein, 293 aa, Shewanella oneidensis MR-1; identical to SEQ ID NO: 33108

SEQ ID NO: 55292 - DNA, 876 bp, Shewanella oneidensis MR-1; identical to SEQ ID NO: 33109
  CDS (1)..(876)

SEQ ID NO: 55293 - protein, 291 aa, Shewanella oneidensis MR-1; identical to SEQ ID NO: 33110

SEQ ID NO: 55294 - DNA, 894 bp, Shewanella oneidensis MR-1; identical to SEQ ID NO: 33111
  CDS (1)..(894)

SEQ ID NO: 55295 - protein, 297 aa, Shewanella oneidensis MR-1; identical to SEQ ID NO: 33112

SEQ ID NO: 55296 - DNA, 939 bp, Shewanella oneidensis MR-1; identical to SEQ ID NO: 33113
  CDS (1)..(939)

SEQ ID NO: 55297 - protein, 312 aa, Shewanella oneidensis MR-1; identical to SEQ ID NO: 33114

SEQ ID NO: 55298 - DNA, 978 bp, Shewanella oneidensis MR-1; identical to SEQ ID NO: 33115
  CDS (1)..(978)

SEQ ID NO: 55299 - protein, 325 aa, Shewanella oneidensis MR-1; identical to SEQ ID NO: 33116

SEQ ID NO: 55300 - DNA, 894 bp, Pseudomonas putida KT2440; identical to SEQ ID NO: 33117
  CDS (1)..(894)

SEQ ID NO: 55301 - protein, 297 aa, Pseudomonas putida KT2440; identical to SEQ ID NO: 33118

SEQ ID NO: 55302 - DNA, 897 bp, Pseudomonas putida KT2440; identical to SEQ ID NO: 33119
  CDS (1)..(897)

SEQ ID NO: 55303 - protein, 298 aa, Pseudomonas putida KT2440; identical to SEQ ID NO: 33120

SEQ ID NO: 55304 - DNA, 918 bp, Pseudomonas putida KT2440; identical to SEQ ID NO: 33121
  CDS (1)..(918)

SEQ ID NO: 55305 - protein, 305 aa, Pseudomonas putida KT2440; identical to SEQ ID NO: 33122

SEQ ID NO: 55306 - DNA, 972 bp, Bradyrhizobium japonicum USDA 110; identical to SEQ ID NO: 33123
  CDS (1)..(972)

SEQ ID NO: 55307 - protein, 323 aa, Bradyrhizobium japonicum USDA 110; identical to SEQ ID NO: 33124

SEQ ID NO: 55308 - DNA, 876 bp, Vibrio parahaemolyticus RIMD 2210633; identical to SEQ ID NO: 33125
  CDS (1)..(876)

SEQ ID NO: 55309 - protein, 291 aa, Vibrio parahaemolyticus RIMD 2210633; identical to SEQ ID NO: 33126

SEQ ID NO: 55310 - DNA, 924 bp, Vibrio parahaemolyticus RIMD 2210633; identical to SEQ ID NO: 33127
  CDS (1)..(924)

SEQ ID NO: 55311 - protein, 307 aa, Vibrio parahaemolyticus RIMD 2210633; identical to SEQ ID NO: 33128

SEQ ID NO: 55312 - DNA, 903 bp, Salmonella enterica subsp. enterica serovar Typhi Ty2; identical to SEQ ID NO: 33129
  CDS (1)..(903)

SEQ ID NO: 55313 - protein, 300 aa, Salmonella enterica subsp. enterica serovar Typhi Ty2; identical to SEQ ID NO: 33130

SEQ ID NO: 55314 - DNA, 867 bp, Bacillus cereus ATCC 14579; identical to SEQ ID NO: 33131
  CDS (1)..(867)

SEQ ID NO: 55315 - protein, 288 aa, Bacillus cereus ATCC 14579; identical to SEQ ID NO: 33132

SEQ ID NO: 55316 - DNA, 903 bp, Bacillus cereus ATCC 14579; identical to SEQ ID NO: 33133
  CDS (1)..(903)

SEQ ID NO: 55317 - protein, 300 aa, Bacillus cereus ATCC 14579; identical to SEQ ID NO: 33134

SEQ ID NO: 55318 - DNA, 900 bp, Bacillus cereus ATCC 14579; identical to SEQ ID NO: 33135
  CDS (1)..(900)

SEQ ID NO: 55319 - protein, 299 aa, Bacillus cereus ATCC 14579; identical to SEQ ID NO: 33136

SEQ ID NO: 55320 - DNA, 918 bp, Nitrosomonas europaea ATCC 19718; identical to SEQ ID NO: 33137
  CDS (1)..(918)

SEQ ID NO: 55321 - protein, 305 aa, Nitrosomonas europaea ATCC 19718; identical to SEQ ID NO: 33138

SEQ ID NO: 55322 - DNA, 903 bp, Bacillus anthracis str. Ames; identical to SEQ ID NO: 33139
  CDS (1)..(903)

SEQ ID NO: 55323 - protein, 300 aa, Bacillus anthracis str. Ames; identical to SEQ ID NO: 33140

SEQ ID NO: 55324 - DNA, 909 bp, Bordetella pertussis Tohama I; identical to SEQ ID NO: 33141
  CDS (1)..(909)

SEQ ID NO: 55325 - protein, 302 aa, Bordetella pertussis Tohama I; identical to SEQ ID NO: 33142

SEQ ID NO: 55326 - DNA, 957 bp, Bordetella pertussis Tohama I; identical to SEQ ID NO: 33143
  CDS (1)..(957)

SEQ ID NO: 55327 - protein, 318 aa, Bordetella pertussis Tohama I; identical to SEQ ID NO: 33144

SEQ ID NO: 55328 - DNA, 909 bp, Bordetella pertussis Tohama I; identical to SEQ ID NO: 33145
  CDS (1)..(909)

SEQ ID NO: 55329 - protein, 302 aa, Bordetella pertussis Tohama I; identical to SEQ ID NO: 33146

SEQ ID NO: 55330 - DNA, 993 bp, Bordetella parapertussis 12822; identical to SEQ ID NO: 33147
  CDS (1)..(993)

SEQ ID NO: 55331 - protein, 330 aa, Bordetella parapertussis 12822; identical to SEQ ID NO: 33148

SEQ ID NO: 55332 - DNA, 963 bp, Bordetella bronchiseptica RB50; identical to SEQ ID NO: 33149
  CDS (1)..(963)

SEQ ID NO: 55333 - protein, 320 aa, Bordetella bronchiseptica RB50; identical to SEQ ID NO: 33150

SEQ ID NO: 55334 - DNA, 951 bp, Bordetella bronchiseptica RB50; identical to SEQ ID NO: 33151
  CDS (1)..(951)

SEQ ID NO: 55335 - protein, 316 aa, Bordetella bronchiseptica RB50; identical to SEQ ID NO: 33152

SEQ ID NO: 55336 - DNA, 909 bp, Chromobacterium violaceum ATCC 12472; identical to SEQ ID NO: 33153
  CDS (1)..(909)

SEQ ID NO: 55337 - protein, 302 aa, Chromobacterium violaceum ATCC 12472; identical to SEQ ID NO: 33154

SEQ ID NO: 55338 - DNA, 945 bp, Vibrio vulnificus YJ016; identical to SEQ ID NO: 33155
  CDS (1)..(945)

SEQ ID NO: 55339 - protein, 314 aa, Vibrio vulnificus YJ016; identical to SEQ ID NO: 33156

SEQ ID NO: 55340 - DNA, 864 bp, Bdellovibrio bacteriovorus HD100; identical to SEQ ID NO: 33157
  CDS (1)..(864)

SEQ ID NO: 55341 - protein, 287 aa, Bdellovibrio bacteriovorus HD100; identical to SEQ ID NO: 33158

SEQ ID NO: 55342 - DNA, 870 bp, Bacillus cereus ATCC 10987; identical to SEQ ID NO: 33159
  CDS (1)..(870): y means t/u or c

SEQ ID NO: 55343 - protein, 289 aa, Bacillus cereus ATCC 10987; identical to SEQ ID NO: 33160
  misc_feature (150)..(150): Xaa can be Leu or Pro

SEQ ID NO: 55344 - DNA, 903 bp, Bacillus cereus ATCC 10987; identical to SEQ ID NO: 33161
  CDS (1)..(903)

SEQ ID NO: 55345 - protein, 300 aa, Bacillus cereus ATCC 10987; identical to SEQ ID NO: 33162

SEQ ID NO: 55346 - DNA, 894 bp, Bacillus thuringiensis serovar konkukian str. 97-27; identical to SEQ ID NO: 33163
  CDS (1)..(894)

SEQ ID NO: 55347 - protein, 297 aa, Bacillus thuringiensis serovar konkukian str. 97-27; identical to SEQ ID NO: 33164

SEQ ID NO: 55348 - DNA, 897 bp, Acinetobacter sp. ADP1; identical to SEQ ID NO: 33165
  CDS (1)..(897)

SEQ ID NO: 55349 - protein, 298 aa, Acinetobacter sp. ADP1; identical to SEQ ID NO: 33166

SEQ ID NO: 55350 - DNA, 891 bp, Acinetobacter sp. ADP1; identical to SEQ ID NO: 33167
  CDS (1)..(891)

SEQ ID NO: 55351 - protein, 296 aa, Acinetobacter sp. ADP1; identical to SEQ ID NO: 33168

SEQ ID NO: 55352 - DNA, 930 bp, Acinetobacter sp. ADP1; identical to SEQ ID NO: 33169
  CDS (1)..(930)

SEQ ID NO: 55353 - protein, 309 aa, Acinetobacter sp. ADP1; identical to SEQ ID NO: 33170

SEQ ID NO: 55354 - DNA, 909 bp, Acinetobacter sp. ADP1; identical to SEQ ID NO: 33171
  CDS (1)..(909)

SEQ ID NO: 55355 - protein, 302 aa, Acinetobacter sp. ADP1; identical to SEQ ID NO: 33172

SEQ ID NO: 55356 - DNA, 900 bp, Erwinia carotovora subsp. atroseptica SCRI1043; identical to SEQ ID NO: 33173
  CDS (1)..(900)

SEQ ID NO: 55357 - protein, 299 aa, Erwinia carotovora subsp. atroseptica SCRI1043; identical to SEQ ID NO: 33174

SEQ ID NO: 55358 - DNA, 933 bp, Erwinia carotovora subsp. atroseptica SCRI1043; identical to SEQ ID NO: 33175
  CDS (1)..(933)

SEQ ID NO: 55359 - protein, 310 aa, Erwinia carotovora subsp. atroseptica SCRI1043; identical to SEQ ID NO: 33176

SEQ ID NO: 55360 - DNA, 936 bp, Symbiobacterium thermophilum IAM 14863; identical to SEQ ID NO: 33177
  CDS (1)..(936)

SEQ ID NO: 55361 - protein, 311 aa, Symbiobacterium thermophilum IAM 14863; identical to SEQ ID NO: 33178

SEQ ID NO: 55362 - DNA, 873 bp, Bacillus cereus ZK; identical to SEQ ID NO: 33179
  CDS (1)..(873)

SEQ ID NO: 55363 - protein, 290 aa, Bacillus cereus ZK; identical to SEQ ID NO: 33180

SEQ ID NO: 55364 - DNA, 903 bp, Bacillus cereus ZK; identical to SEQ ID NO: 33181
  CDS (1)..(903)

SEQ ID NO: 55365 - protein, 300 aa, Bacillus cereus ZK; identical to SEQ ID NO: 33182

SEQ ID NO: 55366 - DNA, 867 bp, Mannheimia succiniciproducens MBEL55E; identical to SEQ ID NO: 33183
  CDS (1)..(867)

SEQ ID NO: 55367 - protein, 288 aa, Mannheimia succiniciproducens MBEL55E; identical to SEQ ID NO: 33184

SEQ ID NO: 55368 - DNA, 879 bp, Bacillus licheniformis DSM 13; identical to SEQ ID NO: 33185
  CDS (1)..(879)

SEQ ID NO: 55369 - protein, 292 aa, Bacillus licheniformis DSM 13; identical to SEQ ID NO: 33186

SEQ ID NO: 55370 - DNA, 909 bp, Legionella pneumophila subsp. pneumophila str. Philadelphia 1; identical to SEQ ID NO: 33187
  CDS (1)..(909)

SEQ ID NO: 55371 - protein, 302 aa, Legionella pneumophila subsp. pneumophila str. Philadelphia 1; identical to SEQ ID NO: 33188

SEQ ID NO: 55372 - DNA, 954 bp, Photobacterium profundum SS9; identical to SEQ ID NO: 33189
  CDS (1)..(954)

SEQ ID NO: 55373 - protein, 317 aa, Photobacterium profundum SS9; identical to SEQ ID NO: 33190

SEQ ID NO: 55374 - DNA, 900 bp, Photobacterium profundum SS9; identical to SEQ ID NO: 33191
  CDS (1)..(900)

SEQ ID NO: 55375 - protein, 299 aa, Photobacterium profundum SS9; identical to SEQ ID NO: 33192

SEQ ID NO: 55376 - DNA, 954 bp, Azotobacter vinelandii; identical to SEQ ID NO: 33193
  CDS (1)..(954)

SEQ ID NO: 55377 - protein, 317 aa, Azotobacter vinelandii; identical to SEQ ID NO: 33194

SEQ ID NO: 55378 - DNA, 930 bp, Haemophilus somnus 129PT; identical to SEQ ID NO: 33195
  CDS (1)..(930)

SEQ ID NO: 55379 - protein, 309 aa, Haemophilus somnus 129PT; identical to SEQ ID NO: 33196

SEQ ID NO: 55380 - DNA, 888 bp, Anabaena variabilis ATCC 29413; identical to SEQ ID NO: 33197
  CDS (1)..(888)

SEQ ID NO: 55381 - protein, 295 aa, Anabaena variabilis ATCC 29413; identical to SEQ ID NO: 33198

SEQ ID NO: 55382 - DNA, 924 bp, Exiguobacterium sp. 255-15; identical to SEQ ID NO: 33199
  CDS (1)..(924)

SEQ ID NO: 55383 - protein, 307 aa, Exiguobacterium sp. 255-15; identical to SEQ ID NO: 33200

SEQ ID NO: 55384 - DNA, 933 bp, Mesorhizobium sp. BNC1; identical to SEQ ID NO: 33201
  CDS (1)..(933)

SEQ ID NO: 55385 - protein, 310 aa, Mesorhizobium sp. BNC1; identical to SEQ ID NO: 33202

SEQ ID NO: 55386 - DNA, 909 bp, Burkholderia cepacia R18194; identical to SEQ ID NO: 33203
  CDS (1)..(909)

SEQ ID NO: 55387 - protein, 302 aa, Burkholderia cepacia R18194; identical to SEQ ID NO: 33204

SEQ ID NO: 55388 - DNA, 867 bp, Bacillus cereus G9241; identical to SEQ ID NO: 33205
  CDS (1)..(867)

SEQ ID NO: 55389 - protein, 288 aa, Bacillus cereus G9241; identical to SEQ ID NO: 33206

SEQ ID NO: 55390 - DNA, 972 bp, Rubrivivax gelatinosus PM1; identical to SEQ ID NO: 33207
  CDS (1)..(972)

SEQ ID NO: 55391 - protein, 323 aa, Rubrivivax gelatinosus PM1; identical to SEQ ID NO: 33208

SEQ ID NO: 55392 - DNA, 996 bp, Ralstonia metallidurans CH34; identical to SEQ ID NO: 33209
  CDS (1)..(996)

SEQ ID NO: 55393 - protein, 331 aa, Ralstonia metallidurans CH34; identical to SEQ ID NO: 33210

SEQ ID NO: 55394 - DNA, 939 bp, Ralstonia metallidurans CH34; identical to SEQ ID NO: 33211
  CDS (1)..(939)

SEQ ID NO: 55395 - protein, 312 aa, Ralstonia metallidurans CH34; identical to SEQ ID NO: 33212

SEQ ID NO: 55396 - DNA, 948 bp, Burkholderia fungorum LB400; identical to SEQ ID NO: 33213
  CDS (1)..(948)

SEQ ID NO: 55397 - protein, 315 aa, Burkholderia fungorum LB400; identical to SEQ ID NO: 33214

SEQ ID NO: 55398 - DNA, 903 bp, Burkholderia fungorum LB400; identical to SEQ ID NO: 33215
  CDS (1)..(903)

SEQ ID NO: 55399 - protein, 300 aa, Burkholderia fungorum LB400; identical to SEQ ID NO: 33216

SEQ ID NO: 55400 - DNA, 963 bp, Polaromonas sp. JS666; identical to SEQ ID NO: 33217
  CDS (1)..(963)

SEQ ID NO: 55401 - protein, 320 aa, Polaromonas sp. JS666; identical to SEQ ID NO: 33218

SEQ ID NO: 55402 - DNA, 903 bp, Polaromonas sp. JS666; identical to SEQ ID NO: 33219
  CDS (1)..(903)

SEQ ID NO: 55403 - protein, 300 aa, Polaromonas sp. JS666; identical to SEQ ID NO: 33220

SEQ ID NO: 55404 - DNA, 1071 bp, Collimonas fungivorans; identical to SEQ ID NO: 33221
  CDS (1)..(1071)

SEQ ID NO: 55405 - protein, 356 aa, Collimonas fungivorans; identical to SEQ ID NO: 33222

SEQ ID NO: 55406 - DNA, 915 bp, Rhizobium leguminosarum; identical to SEQ ID NO: 33223
  CDS (1)..(915)

SEQ ID NO: 55407 - protein, 304 aa, Rhizobium leguminosarum; identical to SEQ ID NO: 33224

SEQ ID NO: 55408 - DNA, 939 bp, Shigella flexneri 2a; identical to SEQ ID NO: 33225
  CDS (1)..(939)

SEQ ID NO: 55409 - protein, 312 aa, Shigella flexneri 2a; identical to SEQ ID NO: 33226

SEQ ID NO: 55410 - DNA, 867 bp, Acinetobacter sp; identical to SEQ ID NO: 33227
  CDS (1)..(867)

SEQ ID NO: 55411 - protein, 288 aa, Acinetobacter sp; identical to SEQ ID NO: 33228

SEQ ID NO: 55412 - DNA, 909 bp, Legionella pneumophila; identical to SEQ ID NO: 33229
  CDS (1)..(909)

SEQ ID NO: 55413 - protein, 302 aa, Legionella pneumophila; identical to SEQ ID NO: 33230

SEQ ID NO: 55414 - DNA, 864 bp, Oenococcus oeni; identical to SEQ ID NO: 33231
  CDS (1)..(864)

SEQ ID NO: 55415 - protein, 287 aa, Oenococcus oeni; identical to SEQ ID NO: 33232

SEQ ID NO: 55416 - DNA, 912 bp, Zymomonas mobilis; identical to SEQ ID NO: 33233
  CDS (1)..(912)

SEQ ID NO: 55417 - protein, 303 aa, Zymomonas mobilis; identical to SEQ ID NO: 33234

SEQ ID NO: 55418 - DNA, 954 bp, Brucella abortus; identical to SEQ ID NO: 33235
  CDS (1)..(954)

SEQ ID NO: 55419 - protein, 317 aa, Brucella abortus; identical to SEQ ID NO: 33236

SEQ ID NO: 55420 - DNA, 927 bp, Bacillus subtilis; identical to SEQ ID NO: 33237
  CDS (1)..(927)

SEQ ID NO: 55421 - protein, 308 aa, Bacillus subtilis; identical to SEQ ID NO: 33238

SEQ ID NO: 55422 - DNA, 24 bp, Primer
atggatgactgtggtgcgattttg

SEQ ID NO: 55423 - DNA, 25 bp, Primer
ttagctaagcacaatctccagctcg

SEQ ID NO: 55424 - protein, 56 aa, consensus; identical to SEQ ID NO: 33241
  MISC_FEATURE (1)..(56): consensus for the disclosure of xaa see table XV

SEQ ID NO: 55425 - DNA, 354 bp, Saccharomyces cerevisiae
  CDS (1)..(354)
atgatagttgaactttattcaaatatcatcgaagtaagaagatatactactaaagactccctttgctctatattcgagtcaggctccaccagtcatttcgaaattaaccagttacaggtcaaaagactaaacttactgcaaaaccaatttgcttctgttttcacttctttccaccccaaagataatacaaagggcatacatatcaattttttttcacctgtcactaggataactgaccttcaatattcctttttttatacgaatcagatactgttcggtacacgatatctaattaaaatgattcaaaactttgtaacaggtaaagttttcactagaaccaatcaatccaagtga

SEQ ID NO: 55426 - protein, 117 aa, Saccharomyces cerevisiae
MIVELYSNIIEVRRYTTKDSLCSIFESGSTSHFEINQLQVKRLNLLQNQFASVFTSFHPKDNTKGIHINFFSPVTRITDLQYSFFYTNQILFGTRYLIKMIQNFVTGKVFTRTNQSK

SEQ ID NO: 55427 - DNA, 28 bp, Primer
atgatagttgaactttattcaaatatca

SEQ ID NO: 55428 - DNA, 25 bp, Primer
tcacttggattgattggttctagtg

SEQ ID NO: 55429 - DNA, 258 bp, Escherichia coli; identical to SEQ ID NO: 44740
  CDS (1)..(258)

SEQ ID NO: 55430 - protein, 85 aa, Escherichia coli; identical to SEQ ID NO: 44741

SEQ ID NO: 55431 - DNA, 264 bp, Vibrio fischeri ES114; identical to SEQ ID NO: 44742
  CDS (1)..(264)

SEQ ID NO: 55432 - protein, 87 aa, Vibrio fischeri ES114; identical to SEQ ID NO: 44743

SEQ ID NO: 55433 - DNA, 288 bp, Vibrio fischeri ES114; identical to SEQ ID NO: 44744
  CDS (1)..(288)

SEQ ID NO: 55434 - protein, 95 aa, Vibrio fischeri ES114; identical to SEQ ID NO: 44745

SEQ ID NO: 55435 - DNA, 318 bp, Danio rerio; identical to SEQ ID NO: 44746
  CDS (1)..(318)

SEQ ID NO: 55436 - protein, 105 aa, Danio rerio; identical to SEQ ID NO: 44747

SEQ ID NO: 55437 - DNA, 393 bp, Arabidopsis thaliana; identical to SEQ ID NO: 6900
  CDS (1)..(393)

SEQ ID NO: 55438 - protein, 130 aa, Arabidopsis thaliana; identical to SEQ ID NO: 6901

SEQ ID NO: 55439 - DNA, 264 bp, Pasteurella multocida subsp. multocida str. Pm70; identical to SEQ ID NO: 44750
  CDS (1)..(264)

SEQ ID NO: 55440 - protein, 87 aa, Pasteurella multocida subsp. multocida str. Pm70; identical to SEQ ID NO: 44751

SEQ ID NO: 55441 - DNA, 309 bp, Rickettsia conorii str. Malish 7; identical to SEQ ID NO: 44752
  CDS (1)..(309)

SEQ ID NO: 55442 - protein, 102 aa, Rickettsia conorii str. Malish 7; identical to SEQ ID NO: 44753

SEQ ID NO: 55443 - DNA, 252 bp, Escherichia coli K12; identical to SEQ ID NO: 44754
  CDS (1)..(252)

SEQ ID NO: 55444 - protein, 83 aa, Escherichia coli K12; identical to SEQ ID NO: 44755

SEQ ID NO: 55445 - DNA, 255 bp, Caulobacter crescentus CB15; identical to SEQ ID NO: 44756
  CDS (1)..(255)

SEQ ID NO: 55446 - protein, 84 aa, Caulobacter crescentus CB15; identical to SEQ ID NO: 44757

SEQ ID NO: 55447 - DNA, 252 bp, Salmonella typhimurium LT2; identical to SEQ ID NO: 44758
  CDS (1)..(252)

SEQ ID NO: 55448 - protein, 83 aa, Salmonella typhimurium LT2; identical to SEQ ID NO: 44759

SEQ ID NO: 55449 - DNA, 258 bp, Ralstonia solanacearum GMI1000; identical to SEQ ID NO: 44760
  CDS (1)..(258)

SEQ ID NO: 55450 - protein, 85 aa, Ralstonia solanacearum GMI1000; identical to SEQ ID NO: 44761

SEQ ID NO: 55451 - DNA, 246 bp, Salmonella enterica subsp. enterica serovar Typhi str. CT18; identical to SEQ ID NO: 44762
  CDS (1)..(246)

SEQ ID NO: 55452 - protein, 81 aa, Salmonella enterica subsp. enterica serovar Typhi str. CT18; identical to SEQ ID NO: 44763

SEQ ID NO: 55453 - DNA, 264 bp, Yersinia pestis KIM; identical to SEQ ID NO: 44764
  CDS (1)..(264)

SEQ ID NO: 55454 - protein, 87 aa, Yersinia pestis KIM; identical to SEQ ID NO: 44765

SEQ ID NO: 55455 - DNA, 267 bp, Brucella suis 1330; identical to SEQ ID NO: 44766
  CDS (1)..(267)

SEQ ID NO: 55456 - protein, 88 aa, Brucella suis 1330; identical to SEQ ID NO: 44767

SEQ ID NO: 55457 - DNA, 252 bp, Shigella flexneri 2a str. 301; identical to SEQ ID NO: 44768
  CDS (1)..(252)

SEQ ID NO: 55458 - protein, 83 aa, Shigella flexneri 2a str. 301; identical to SEQ ID NO: 44769

SEQ ID NO: 55459 - DNA, 261 bp, Shewanella oneidensis MR-1; identical to SEQ ID NO: 44770
  CDS (1)..(261)

SEQ ID NO: 55460 - protein, 86 aa, Shewanella oneidensis MR-1; identical to SEQ ID NO: 44771

SEQ ID NO: 55461 - DNA, 255 bp, Pseudomonas putida KT2440; identical to SEQ ID NO: 44772
  CDS (1)..(255)

SEQ ID NO: 55462 - protein, 84 aa, Pseudomonas putida KT2440; identical to SEQ ID NO: 44773

SEQ ID NO: 55463 - DNA, 252 bp, Pseudomonas syringae pv. tomato str. DC3000; identical to SEQ ID NO: 44774
  CDS (1)..(252)

SEQ ID NO: 55464 - protein, 83 aa, Pseudomonas syringae pv. tomato str. DC3000; identical to SEQ ID NO: 44775

SEQ ID NO: 55465 - DNA, 258 bp, Nitrosomonas europaea ATCC 19718; identical to SEQ ID NO: 44776
  CDS (1)..(258)

SEQ ID NO: 55466 - protein, 85 aa, Nitrosomonas europaea ATCC 19718; identical to SEQ ID NO: 44777

SEQ ID NO: 55467 - DNA, 234 bp, Wigglesworthia glossinidia endosymbiont of Glossina brevipalpis; identical to SEQ ID NO: 44778
  CDS (1)..(234)

SEQ ID NO: 55468 - protein, 77 aa, Wigglesworthia glossinidia endosymbiont of Glossina brevipalpis; identical to SEQ ID NO: 44779

SEQ ID NO: 55469 - DNA, 264 bp, Haemophilus ducreyi 35000HP; identical to SEQ ID NO: 44780
  CDS (1)..(264)

SEQ ID NO: 55470 - protein, 87 aa, Haemophilus ducreyi 35000HP; identical to SEQ ID NO: 44781

SEQ ID NO: 55471 - DNA, 1803 bp, Danio rerio; identical to SEQ ID NO: 44782
  CDS (1)..(1803)

SEQ ID NO: 55472 - protein, 600 aa, Danio rerio; identical to SEQ ID NO: 44783

SEQ ID NO: 55473 - DNA, 261 bp, Photorhabdus luminescens subsp. laumondii TTO1; identical to SEQ ID NO: 44784
  CDS (1)..(261)

SEQ ID NO: 55474 - protein, 86 aa, Photorhabdus luminescens subsp. laumondii TTO1; identical to SEQ ID NO: 44785

SEQ ID NO: 55475 - DNA, 264 bp, Vibrio vulnificus YJ016; identical to SEQ ID NO: 44786
  CDS (1)..(264)

SEQ ID NO: 55476 - protein, 87 aa, Vibrio vulnificus YJ016; identical to SEQ ID NO: 44787

SEQ ID NO: 55477 - DNA, 339 bp, Wolbachia endosymbiont of Drosophila melanogaster; identical to SEQ ID NO: 44788
  CDS (1)..(339)

SEQ ID NO: 55478 - protein, 112 aa, Wolbachia endosymbiont of Drosophila melanogaster; identical to SEQ ID NO: 44789

SEQ ID NO: 55479 - DNA, 330 bp, Neurospora crassa; identical to SEQ ID NO: 6934
  CDS (1)..(330)

SEQ ID NO: 55480 - protein, 109 aa, Neurospora crassa; identical to SEQ ID NO: 6935

SEQ ID NO: 55481 - DNA, 309 bp, Magnaporthe grisea 70-15; identical to SEQ ID NO: 44792
  CDS (1)..(309)

SEQ ID NO: 55482 - protein, 102 aa, Magnaporthe grisea 70-15; identical to SEQ ID NO: 44793

SEQ ID NO: 55483 - DNA, 321 bp, Gibberella zeae PH-1; identical to SEQ ID NO: 44794
  CDS (1)..(321)

SEQ ID NO: 55484 - protein, 106 aa, Gibberella zeae PH-1; identical to SEQ ID NO: 44795

SEQ ID NO: 55485 - DNA, 309 bp, Ustilago maydis 521; identical to SEQ ID NO: 44796
  CDS (1)..(309)

SEQ ID NO: 55486 - protein, 102 aa, Ustilago maydis 521; identical to SEQ ID NO: 44797

SEQ ID NO: 55487 - DNA, 309 bp, Aspergillus nidulans FGSC A4; identical to SEQ ID NO: 44798
  CDS (1)..(309)

SEQ ID NO: 55488 - protein, 102 aa, Aspergillus nidulans FGSC A4; identical to SEQ ID NO: 44799

SEQ ID NO: 55489 - DNA, 342 bp, Debaryomyces hansenii CBS767; identical to SEQ ID NO: 44800
  CDS (1)..(342)

SEQ ID NO: 55490 - protein, 113 aa, Debaryomyces hansenii CBS767; identical to SEQ ID NO: 44801

SEQ ID NO: 55491 - DNA, 258 bp, Bartonella quintana str. Toulouse; identical to SEQ ID NO: 44802
  CDS (1)..(258)

SEQ ID NO: 55492 - protein, 85 aa, Bartonella quintana str. Toulouse; identical to SEQ ID NO: 44803

SEQ ID NO: 55493 - DNA, 258 bp, Acinetobacter sp. ADP1; identical to SEQ ID NO: 44804
  CDS (1)..(258)

SEQ ID NO: 55494 - protein, 85 aa, Acinetobacter sp. ADP1; identical to SEQ ID NO: 44805

SEQ ID NO: 55495 - DNA, 267 bp, Erwinia carotovora subsp. atroseptica SCRI1043; identical to SEQ ID NO: 44806
  CDS (1)..(267)

SEQ ID NO: 55496 - protein, 88 aa, Erwinia carotovora subsp. atroseptica SCRI1043; identical to SEQ ID NO: 44807

SEQ ID NO: 55497 - DNA, 315 bp, Rickettsia typhi str. Wilmington; identical to SEQ ID NO: 44808
  CDS (1)..(315)

SEQ ID NO: 55498 - protein, 104 aa, Rickettsia typhi str. Wilmington; identical to SEQ ID NO: 44809

SEQ ID NO: 55499 - DNA, 264 bp, Mannheimia succiniciproducens MBEL55E; identical to SEQ ID NO: 44810
  CDS (1)..(264)

SEQ ID NO: 55500 - protein, 87 aa, Mannheimia succiniciproducens MBEL55E; identical to SEQ ID NO: 44811

SEQ ID NO: 55501 - DNA, 255 bp, Legionella pneumophila subsp. pneumophila str. Philadelphia 1; identical to SEQ ID NO: 44812
  CDS (1)..(255)

SEQ ID NO: 55502 - protein, 84 aa, Legionella pneumophila subsp. pneumophila str. Philadelphia 1; identical to SEQ ID NO: 44813

SEQ ID NO: 55503 - DNA, 255 bp, Legionella pneumophila str. Lens; identical to SEQ ID NO: 44814
  CDS (1)..(255)

SEQ ID NO: 55504 - protein, 84 aa, Legionella pneumophila str. Lens; identical to SEQ ID NO: 44815

SEQ ID NO: 55505 - DNA, 279 bp, Photobacterium profundum SS9; identical to SEQ ID NO: 44816
  CDS (1)..(279)

SEQ ID NO: 55506 - protein, 92 aa, Photobacterium profundum SS9; identical to SEQ ID NO: 44817

SEQ ID NO: 55507 - DNA, 243 bp, Anaplasma marginale str. St. Maries; identical to SEQ ID NO: 44818
  CDS (1)..(243)

SEQ ID NO: 55508 - protein, 80 aa, Anaplasma marginale str. St. Maries; identical to SEQ ID NO: 44819

SEQ ID NO: 55509 - DNA, 267 bp, Idiomarina loihiensis L2TR; identical to SEQ ID NO: 44820
  CDS (1)..(267)

SEQ ID NO: 55510 - protein, 88 aa, Idiomarina loihiensis L2TR; identical to SEQ ID NO: 44821

SEQ ID NO: 55511 - DNA, 261 bp, Francisella tularensis subsp. tularensis Schu 4; identical to SEQ ID NO: 44822
  CDS (1)..(261)

SEQ ID NO: 55512 - protein, 86 aa, Francisella tularensis subsp. tularensis Schu 4; identical to SEQ ID NO: 44823

SEQ ID NO: 55513 - DNA, 264 bp, Synechococcus elongatus PCC 6301; identical to SEQ ID NO: 44824
  CDS (1)..(264)

SEQ ID NO: 55514 - protein, 87 aa, Synechococcus elongatus PCC 6301; identical to SEQ ID NO: 44825

SEQ ID NO: 55515 - DNA, 288 bp, Ehrlichia ruminantium str. Welgevonden; identical to SEQ ID NO: 44826
  CDS (1)..(288)

SEQ ID NO: 55516 - protein, 95 aa, Ehrlichia ruminantium str. Welgevonden; identical to SEQ ID NO: 44827

SEQ ID NO: 55517 - DNA, 255 bp, Azotobacter vinelandii; identical to SEQ ID NO: 44828
  CDS (1)..(255)

SEQ ID NO: 55518 - protein, 84 aa, Azotobacter vinelandii; identical to SEQ ID NO: 44829

SEQ ID NO: 55519 - DNA, 252 bp, Pseudomonas syringae pv. syringae B728a; identical to SEQ ID NO: 44830
  CDS (1)..(252)

SEQ ID NO: 55520 - protein, 83 aa, Pseudomonas syringae pv. syringae B728a; identical to SEQ ID NO: 44831

SEQ ID NO: 55521 - DNA, 264 bp, Actinobacillus pleuropneumoniae serovar 1 str. 4074; identical to SEQ ID NO: 44832
  CDS (1)..(264)

SEQ ID NO: 55522 - protein, 87 aa, Actinobacillus pleuropneumoniae serovar 1 str. 4074; identical to SEQ ID NO: 44833

SEQ ID NO: 55523 - DNA, 258 bp, Ralstonia eutropha JMP134; identical to SEQ ID NO: 44834
  CDS (1)..(258)

SEQ ID NO: 55524 - protein, 85 aa, Ralstonia eutropha JMP134; identical to SEQ ID NO: 44835

SEQ ID NO: 55525 - DNA, 246 bp, Ehrlichia canis str. Jake; identical to SEQ ID NO: 44836
  CDS (1)..(246)

SEQ ID NO: 55526 - protein, 81 aa, Ehrlichia canis str. Jake; identical to SEQ ID NO: 44837

SEQ ID NO: 55527 - DNA, 261 bp, Burkholderia cepacia R1808; identical to SEQ ID NO: 44838
  CDS (1)..(261)

SEQ ID NO: 55528 - protein, 86 aa, Burkholderia cepacia R1808; identical to SEQ ID NO: 44839

SEQ ID NO: 55529 - DNA, 267 bp, Rhodospirillum rubrum; identical to SEQ ID NO: 44840
  CDS (1)..(267)

SEQ ID NO: 55530 - protein, 88 aa, Rhodospirillum rubrum; identical to SEQ ID NO: 44841

SEQ ID NO: 55531 - DNA, 258 bp, Ralstonia metallidurans CH34; identical to SEQ ID NO: 44842
  CDS (1)..(258)

SEQ ID NO: 55532 - protein, 85 aa, Ralstonia metallidurans CH34; identical to SEQ ID NO: 44843

SEQ ID NO: 55533 - DNA, 243 bp, Novosphingobium aromaticivorans DSM 12444; identical to SEQ ID NO: 44844
  CDS (1)..(243)

SEQ ID NO: 55534 - protein, 80 aa, Novosphingobium aromaticivorans DSM 12444; identical to SEQ ID NO: 44845

SEQ ID NO: 55535 - DNA, 261 bp, Trichodesmium erythraeum IMS101; identical to SEQ ID NO: 44846
  CDS (1)..(261)

SEQ ID NO: 55536 - protein, 86 aa, Trichodesmium erythraeum IMS101; identical to SEQ ID NO: 44847

SEQ ID NO: 55537 - DNA, 294 bp, Rickettsia akari str. Hartford; identical to SEQ ID NO: 44848
  CDS (1)..(294)

SEQ ID NO: 55538 - protein, 97 aa, Rickettsia akari str. Hartford; identical to SEQ ID NO: 44849

SEQ ID NO: 55539 - DNA, 315 bp, Fritillaria agrestis; identical to SEQ ID NO: 44850
  CDS (1)..(315)

SEQ ID NO: 55540 - protein, 104 aa, Fritillaria agrestis; identical to SEQ ID NO: 6937

SEQ ID NO: 55541 - DNA, 411 bp, Oryza sativa; identical to SEQ ID NO: 44852
  CDS (1)..(411)

SEQ ID NO: 55542 - protein, 136 aa, Oryza sativa; identical to SEQ ID NO: 44853

SEQ ID NO: 55543 - DNA, 420 bp, Populus tremula x Populus tremuloides; identical to SEQ ID NO: 6960
  CDS (1)..(420)

SEQ ID NO: 55544 - protein, 139 aa, Populus tremula x Populus tremuloides; identical to SEQ ID NO: 6961

SEQ ID NO: 55545 - DNA, 342 bp, Deschampsia antarctica; identical to SEQ ID NO: 44856
  CDS (1)..(342)

SEQ ID NO: 55546 - protein, 113 aa, Deschampsia antarctica; identical to SEQ ID NO: 6967

SEQ ID NO: 55547 - DNA, 264 bp, Salmonella typhimurium; identical to SEQ ID NO: 44858
  CDS (1)..(264)

SEQ ID NO: 55548 - protein, 87 aa, Salmonella typhimurium; identical to SEQ ID NO: 44859

SEQ ID NO: 55549 - DNA, 306 bp, Schizosaccharomyces pombe; identical to SEQ ID NO: 44860
  CDS (1)..(306)

SEQ ID NO: 55550 - protein, 101 aa, Schizosaccharomyces pombe; identical to SEQ ID NO: 6925

SEQ ID NO: 55551 - DNA, 264 bp, Haemophilus influenzae; identical to SEQ ID NO: 44862
  CDS (1)..(264)

SEQ ID NO: 55552 - protein, 87 aa, Haemophilus influenzae; identical to SEQ ID NO: 44863

SEQ ID NO: 55553 - DNA, 255 bp, Pseudomonas aeruginosa; identical to SEQ ID NO: 44864
  CDS (1)..(255)

SEQ ID NO: 55554 - protein, 84 aa, Pseudomonas aeruginosa; identical to SEQ ID NO: 44865

SEQ ID NO: 55555 - DNA, 288 bp, Rickettsia prowazekii; identical to SEQ ID NO: 44866
  CDS (1)..(288)

SEQ ID NO: 55556 - protein, 95 aa, Rickettsia prowazekii; identical to SEQ ID NO: 44867

SEQ ID NO: 55557 - DNA, 264 bp, Vibrio cholerae; identical to SEQ ID NO: 44868
  CDS (1)..(264)

SEQ ID NO: 55558 - protein, 87 aa, Vibrio cholerae; identical to SEQ ID NO: 44869

SEQ ID NO: 55559 - DNA, 25 bp, Primer
atgcaaaccgttatttttggtcgtt

SEQ ID NO: 55560 - DNA, 25 bp, Primer
ttaggcgtccagattttctttcacc

SEQ ID NO: 55561 - protein, 64 aa, consensus; identical to SEQ ID NO: 44872
  MISC_FEATURE (1)..(64): consensus for the disclosure of xaa see table XV

SEQ ID NO: 55562 - protein, 73 aa, consensus; identical to SEQ ID NO: 44873
  MISC_FEATURE (1)..(73): consensus for the disclosure of xaa see table XV

SEQ ID NO: 55563 - DNA, 927 bp, Escherichia coli K12; identical to SEQ ID NO: 27377
  CDS (1)..(927)

SEQ ID NO: 55564 - protein, 308 aa, Escherichia coli K12; identical to SEQ ID NO: 27378

SEQ ID NO: 55565 - DNA, 1017 bp, Archaeoglobus fulgidus; identical to SEQ ID NO: 27379
  CDS (1)..(1017)

SEQ ID NO: 55566 - protein, 338 aa, Archaeoglobus fulgidus; identical to SEQ ID NO: 27380

SEQ ID NO: 55567 - DNA, 894 bp, Archaeoglobus fulgidus; identical to SEQ ID NO: 27381
  CDS (1)..(894)

SEQ ID NO: 55568 - protein, 297 aa, Archaeoglobus fulgidus; identical to SEQ ID NO: 27382

SEQ ID NO: 55569 - DNA, 1278 bp, Pseudomonas aeruginosa; identical to SEQ ID NO: 27383
  CDS (1)..(1278)

SEQ ID NO: 55570 - protein, 425 aa, Pseudomonas aeruginosa; identical to SEQ ID NO: 27384

SEQ ID NO: 55571 - DNA, 957 bp, Streptococcus pneumoniae; identical to SEQ ID NO: 27385
  CDS (1)..(957)

SEQ ID NO: 55572 - protein, 318 aa, Streptococcus pneumoniae; identical to SEQ ID NO: 27386

SEQ ID NO: 55573 - DNA, 999 bp, Brucella melitensis; identical to SEQ ID NO: 27387
  CDS (1)..(999)

SEQ ID NO: 55574 - protein, 332 aa, Brucella melitensis; identical to SEQ ID NO: 27388

SEQ ID NO: 55575 - DNA, 942 bp, Agrobacterium tumefaciens; identical to SEQ ID NO: 27389
  CDS (1)..(942)

SEQ ID NO: 55576 - protein, 313 aa, Agrobacterium tumefaciens; identical to SEQ ID NO: 27390

SEQ ID NO: 55577 - DNA, 897 bp, Agrobacterium tumefaciens; identical to SEQ ID NO: 27391
  CDS (1)..(897)

SEQ ID NO: 55578 - protein, 298 aa, Agrobacterium tumefaciens; identical to SEQ ID NO: 27392

SEQ ID NO: 55579 - DNA, 1035 bp, Agrobacterium tumefaciens; identical to SEQ ID NO: 27393
  CDS (1)..(1035)

SEQ ID NO: 55580 - protein, 344 aa, Agrobacterium tumefaciens; identical to SEQ ID NO: 27394

SEQ ID NO: 55581 - DNA, 864 bp, Brucella melitensis; identical to SEQ ID NO: 27395
  CDS (1)..(864)

SEQ ID NO: 55582 - protein, 287 aa, Brucella melitensis; identical to SEQ ID NO: 27396

SEQ ID NO: 55583 - DNA, 924 bp, Brucella melitensis; identical to SEQ ID NO: 27397
  CDS (1)..(924)

SEQ ID NO: 55584 - protein, 307 aa, Brucella melitensis; identical to SEQ ID NO: 27398

SEQ ID NO: 55585 - DNA, 927 bp, Yersinia pestis; identical to SEQ ID NO: 27399
  CDS (1)..(927)

SEQ ID NO: 55586 - protein, 308 aa, Yersinia pestis; identical to SEQ ID NO: 27400

SEQ ID NO: 55587 - DNA, 867 bp, Nostoc sp. PCC 7120; identical to SEQ ID NO: 27401
  CDS (1)..(867)

SEQ ID NO: 55588 - protein, 288 aa, Nostoc sp. PCC 7120; identical to SEQ ID NO: 27402

SEQ ID NO: 55589 - DNA, 951 bp, Nostoc sp. PCC 7120; identical to SEQ ID NO: 27403
  CDS (1)..(951)

SEQ ID NO: 55590 - protein, 316 aa, Nostoc sp. PCC 7120; identical to SEQ ID NO: 27404

SEQ ID NO: 55591 - DNA, 903 bp, Agrobacterium tumefaciens; identical to SEQ ID NO: 27405
  CDS (1)..(903)

SEQ ID NO: 55592 - protein, 300 aa, Agrobacterium tumefaciens; identical to SEQ ID NO: 27406

SEQ ID NO: 55593 - DNA, 924 bp, Pseudomonas aeruginosa; identical to SEQ ID NO: 27407
  CDS (1)..(924)

SEQ ID NO: 55594 - protein, 307 aa, Pseudomonas aeruginosa; identical to SEQ ID NO: 27408

SEQ ID NO: 55595 - DNA, 798 bp, Aeropyrum pernix; identical to SEQ ID NO: 27409
  CDS (1)..(798)

SEQ ID NO: 55596 - protein, 265 aa, Aeropyrum pernix; identical to SEQ ID NO: 27410

SEQ ID NO: 55597 - DNA, 885 bp, Aeropyrum pernix; identical to SEQ ID NO: 27411
  CDS (1)..(885)

SEQ ID NO: 55598 - protein, 294 aa, Aeropyrum pernix; identical to SEQ ID NO: 27412

SEQ ID NO: 55599 - DNA, 1065 bp, Aeropyrum pernix; identical to SEQ ID NO: 27413
  CDS (1)..(1065)

SEQ ID NO: 55600 - protein, 354 aa, Aeropyrum pernix; identical to SEQ ID NO: 27414

SEQ ID NO: 55601 - DNA, 1047 bp, Deinococcus radiodurans; identical to SEQ ID NO: 27415
  CDS (1)..(1047)

SEQ ID NO: 55602 - protein, 348 aa, Deinococcus radiodurans; identical to SEQ ID NO: 27416

SEQ ID NO: 55603 - DNA, 918 bp, Pseudomonas aeruginosa; identical to SEQ ID NO: 27417
  CDS (4)..(918)

SEQ ID NO: 55604 - protein, 304 aa, Pseudomonas aeruginosa; identical to SEQ ID NO: 27418

SEQ ID NO: 55605 - DNA, 954 bp, Pseudomonas aeruginosa; identical to SEQ ID NO: 27419
  CDS (1)..(954)

SEQ ID NO: 55606 - protein, 317 aa, Pseudomonas aeruginosa; identical to SEQ ID NO: 27420

SEQ ID NO: 55607 - DNA, 894 bp, Bacillus halodurans; identical to SEQ ID NO: 27421
  CDS (1)..(894)

SEQ ID NO: 55608 - protein, 297 aa, Bacillus halodurans; identical to SEQ ID NO: 27422

SEQ ID NO: 55609 - DNA, 1254 bp, Pseudomonas aeruginosa; identical to SEQ ID NO: 27423
  CDS (1)..(1254)

SEQ ID NO: 55610 - protein, 417 aa, Pseudomonas aeruginosa; identical to SEQ ID NO: 27424

SEQ ID NO: 55611 - DNA, 936 bp, Agrobacterium tumefaciens; identical to SEQ ID NO: 27425
  CDS (1)..(936)

SEQ ID NO: 55612 - protein, 311 aa, Agrobacterium tumefaciens; identical to SEQ ID NO: 27426

SEQ ID NO: 55613 - DNA, 948 bp, Methanococcus jannaschii; identical to SEQ ID NO: 27427
  CDS (1)..(948)

SEQ ID NO: 55614 - protein, 315 aa, Methanococcus jannaschii; identical to SEQ ID NO: 27428

SEQ ID NO: 55615 - DNA, 900 bp, Thermotoga maritima; identical to SEQ ID NO: 27429
  CDS (1)..(900)

SEQ ID NO: 55616 - protein, 299 aa, Thermotoga maritima; identical to SEQ ID NO: 27430

SEQ ID NO: 55617 - DNA, 1614 bp, Sinorhizobium meliloti; identical to SEQ ID NO: 27431
  CDS (1)..(1614)

SEQ ID NO: 55618 - protein, 537 aa, Sinorhizobium meliloti; identical to SEQ ID NO: 27432

SEQ ID NO: 55619 - DNA, 1080 bp, Thermotoga maritima; identical to SEQ ID NO: 27433
  CDS (1)..(1080)

SEQ ID NO: 55620 - protein, 359 aa, Thermotoga maritima; identical to SEQ ID NO: 27434

SEQ ID NO: 55621 - DNA, 858 bp, Deinococcus radiodurans; identical to SEQ ID NO: 27435
  CDS (1)..(858)

SEQ ID NO: 55622 - protein, 285 aa, Deinococcus radiodurans; identical to SEQ ID NO: 27436

SEQ ID NO: 55623 - DNA, 1053 bp, Campylobacter jejuni; identical to SEQ ID NO: 27437
  CDS (1)..(1053)

SEQ ID NO: 55624 - protein, 350 aa, Campylobacter jejuni; identical to SEQ ID NO: 27438

SEQ ID NO: 55625 - DNA, 918 bp, Sulfolobus solfataricus; identical to SEQ ID NO: 27439
  CDS (1)..(918)

SEQ ID NO: 55626 - protein, 305 aa, Sulfolobus solfataricus; identical to SEQ ID NO: 27440

SEQ ID NO: 55627 - DNA, 1050 bp, Deinococcus radiodurans; identical to SEQ ID NO: 27441
  CDS (1)..(1050)

SEQ ID NO: 55628 - protein, 349 aa, Deinococcus radiodurans; identical to SEQ ID NO: 27442

SEQ ID NO: 55629 - DNA, 903 bp, Deinococcus radiodurans; identical to SEQ ID NO: 27443
  CDS (1)..(903)

SEQ ID NO: 55630 - protein, 300 aa, Deinococcus radiodurans; identical to SEQ ID NO: 27444

SEQ ID NO: 55631 - DNA, 897 bp, Campylobacter jejuni; identical to SEQ ID NO: 27445
  CDS (1)..(897)

SEQ ID NO: 55632 - protein, 298 aa, Campylobacter jejuni; identical to SEQ ID NO: 27446

SEQ ID NO: 55633 - DNA, 939 bp, Archaeoglobus fulgidus; identical to SEQ ID NO: 27447
  CDS (1)..(939)

SEQ ID NO: 55634 - protein, 312 aa, Archaeoglobus fulgidus; identical to SEQ ID NO: 27448

SEQ ID NO: 55635 - DNA, 1071 bp, Deinococcus radiodurans; identical to SEQ ID NO: 27449
  CDS (1)..(1071)

SEQ ID NO: 55636 - protein, 356 aa, Deinococcus radiodurans; identical to SEQ ID NO: 27450

SEQ ID NO: 55637 - DNA, 864 bp, Sinorhizobium meliloti; identical to SEQ ID NO: 27451
  CDS (1)..(864)

SEQ ID NO: 55638 - protein, 287 aa, Sinorhizobium meliloti; identical to SEQ ID NO: 27452

SEQ ID NO: 55639 - DNA, 855 bp, Archaeoglobus fulgidus; identical to SEQ ID NO: 27453
  CDS (1)..(855)

SEQ ID NO: 55640 - protein, 284 aa, Archaeoglobus fulgidus; identical to SEQ ID NO: 27454

SEQ ID NO: 55641 - DNA, 972 bp, Archaeoglobus fulgidus; identical to SEQ ID NO: 27455
  CDS (1)..(972)

SEQ ID NO: 55642 - protein, 323 aa, Archaeoglobus fulgidus; identical to SEQ ID NO: 27456

SEQ ID NO: 55643 - DNA, 870 bp, Streptococcus pneumoniae; identical to SEQ ID NO: 27457
  CDS (1)..(870)

SEQ ID NO: 55644 - protein, 289 aa, Streptococcus pneumoniae; identical to SEQ ID NO: 27458

SEQ ID NO: 55645 - DNA, 888 bp, Agrobacterium tumefaciens; identical to SEQ ID NO: 27459
  CDS (1)..(888)

SEQ ID NO: 55646 - protein, 295 aa, Agrobacterium tumefaciens; identical to SEQ ID NO: 27460

SEQ ID NO: 55647 - DNA, 1278 bp, Escherichia coli; identical to SEQ ID NO: 27461
  CDS (1)..(1278)

SEQ ID NO: 55648 - protein, 425 aa, Escherichia coli; identical to SEQ ID NO: 27462

SEQ ID NO: 55649 - DNA, 861 bp, Synechocystis sp; identical to SEQ ID NO: 27463
  CDS (1)..(861)

SEQ ID NO: 55650 - protein, 286 aa, Synechocystis sp; identical to SEQ ID NO: 27464

SEQ ID NO: 55651 - DNA, 1167 bp, Synechocystis sp; identical to SEQ ID NO: 27465
  CDS (1)..(1167)

SEQ ID NO: 55652 - protein, 388 aa, Synechocystis sp; identical to SEQ ID NO: 27466

SEQ ID NO: 55653 - DNA, 1233 bp, Synechocystis sp; identical to SEQ ID NO: 27467
  CDS (1)..(1233)

SEQ ID NO: 55654 - protein, 410 aa, Synechocystis sp; identical to SEQ ID NO: 27468

SEQ ID NO: 55655 - DNA, 933 bp, Streptomyces coelicolor; identical to SEQ ID NO: 27469
  CDS (1)..(933)

SEQ ID NO: 55656 - protein, 310 aa, Streptomyces coelicolor; identical to SEQ ID NO: 27470

SEQ ID NO: 55657 - DNA, 861 bp, Rhodopseudomonas palustris; identical to SEQ ID NO: 27471
  CDS (1)..(861)

SEQ ID NO: 55658 - protein, 286 aa, Rhodopseudomonas palustris; identical to SEQ ID NO: 27472

SEQ ID NO: 55659 - DNA, 918 bp, Methylophilus methylotrophus; identical to SEQ ID NO: 27473
  CDS (1)..(918)

SEQ ID NO: 55660 - protein, 305 aa, Methylophilus methylotrophus; identical to SEQ ID NO: 27474

SEQ ID NO: 55661 - DNA, 1845 bp, Pseudomonas aeruginosa; identical to SEQ ID NO: 27475
  CDS (1)..(1845)

SEQ ID NO: 55662 - protein, 614 aa, Pseudomonas aeruginosa; identical to SEQ ID NO: 27476

SEQ ID NO: 55663 - DNA, 1860 bp, Symbiobacterium thermophilum; identical to SEQ ID NO: 27477
  CDS (1)..(1860)

SEQ ID NO: 55664 - protein, 619 aa, Symbiobacterium thermophilum; identical to SEQ ID NO: 27478

SEQ ID NO: 55665 - DNA, 1050 bp, Symbiobacterium thermophilum; identical to SEQ ID NO: 27479
  CDS (1)..(1050)

SEQ ID NO: 55666 - protein, 349 aa, Symbiobacterium thermophilum; identical to SEQ ID NO: 27480

SEQ ID NO: 55667 - DNA, 870 bp, Symbiobacterium thermophilum; identical to SEQ ID NO: 27481
  CDS (1)..(870)

SEQ ID NO: 55668 - protein, 289 aa, Symbiobacterium thermophilum; identical to SEQ ID NO: 27482

SEQ ID NO: 55669 - DNA, 1026 bp, Symbiobacterium thermophilum; identical to SEQ ID NO: 27483
  CDS (1)..(1026)

SEQ ID NO: 55670 - protein, 341 aa, Symbiobacterium thermophilum; identical to SEQ ID NO: 27484

SEQ ID NO: 55671 - DNA, 1068 bp, Desulfotalea psychrophila; identical to SEQ ID NO: 27485
  CDS (1)..(1068)

SEQ ID NO: 55672 - protein, 355 aa, Desulfotalea psychrophila; identical to SEQ ID NO: 27486

SEQ ID NO: 55673 - DNA, 891 bp, Desulfotalea psychrophila; identical to SEQ ID NO: 27487
  CDS (1)..(891)

SEQ ID NO: 55674 - protein, 296 aa, Desulfotalea psychrophila; identical to SEQ ID NO: 27488

SEQ ID NO: 55675 - DNA, 882 bp, Acinetobacter sp; identical to SEQ ID NO: 27489
  CDS (1)..(882)

SEQ ID NO: 55676 - protein, 293 aa, Acinetobacter sp; identical to SEQ ID NO: 27490

SEQ ID NO: 55677 - DNA, 1647 bp, Acinetobacter sp; identical to SEQ ID NO: 27491
  CDS (1)..(1647)

SEQ ID NO: 55678 - protein, 548 aa, Acinetobacter sp; identical to SEQ ID NO: 27492

SEQ ID NO: 55679 - DNA, 1059 bp, Bartonella quintana; identical to SEQ ID NO: 27493
  CDS (1)..(1059)

SEQ ID NO: 55680 - protein, 352 aa, Bartonella quintana; identical to SEQ ID NO: 27494

SEQ ID NO: 55681 - DNA, 1065 bp, Bartonella quintana; identical to SEQ ID NO: 27495
  CDS (1)..(1065)

SEQ ID NO: 55682 - protein, 354 aa, Bartonella quintana; identical to SEQ ID NO: 27496

SEQ ID NO: 55683 - DNA, 1065 bp, Bartonella henselae; identical to SEQ ID NO: 27497
  CDS (1)..(1065)

SEQ ID NO: 55684 - protein, 354 aa, Bartonella henselae; identical to SEQ ID NO: 27498

SEQ ID NO: 55685 - DNA, 1059 bp, Bartonella henselae; identical to SEQ ID NO: 27499
  CDS (1)..(1059)

SEQ ID NO: 55686 - protein, 352 aa, Bartonella henselae; identical to SEQ ID NO: 27500

SEQ ID NO: 55687 - DNA, 861 bp, Bacillus thuringiensis; identical to SEQ ID NO: 27501
  CDS (1)..(861)

SEQ ID NO: 55688 - protein, 286 aa, Bacillus thuringiensis; identical to SEQ ID NO: 27502

SEQ ID NO: 55689 - DNA, 972 bp, Bdellovibrio bacteriovorus; identical to SEQ ID NO: 27503
  CDS (1)..(972)

SEQ ID NO: 55690 - protein, 323 aa, Bdellovibrio bacteriovorus; identical to SEQ ID NO: 27504

SEQ ID NO: 55691 - DNA, 903 bp, Bdellovibrio bacteriovorus; identical to SEQ ID NO: 27505
  CDS (1)..(903)

SEQ ID NO: 55692 - protein, 300 aa, Bdellovibrio bacteriovorus; identical to SEQ ID NO: 27506

SEQ ID NO: 55693 - DNA, 1068 bp, Rhodopseudomonas palustris; identical to SEQ ID NO: 27507
  CDS (1)..(1068)

SEQ ID NO: 55694 - protein, 355 aa, Rhodopseudomonas palustris; identical to SEQ ID NO: 27508

SEQ ID NO: 55695 - DNA, 939 bp, Rhodopseudomonas palustris; identical to SEQ ID NO: 27509
  CDS (1)..(939)

SEQ ID NO: 55696 - protein, 312 aa, Rhodopseudomonas palustris; identical to SEQ ID NO: 27510

SEQ ID NO: 55697 - DNA, 948 bp, Rhodopseudomonas palustris; identical to SEQ ID NO: 27511
  CDS (1)..(948)

SEQ ID NO: 55698 - protein, 315 aa, Rhodopseudomonas palustris; identical to SEQ ID NO: 27512

SEQ ID NO: 55699 - DNA, 948 bp, Rhodopseudomonas palustris; identical to SEQ ID NO: 27513
  CDS (1)..(948)

SEQ ID NO: 55700 - protein, 315 aa, Rhodopseudomonas palustris; identical to SEQ ID NO: 27514

SEQ ID NO: 55701 - DNA, 873 bp, Rhodopseudomonas palustris; identical to SEQ ID NO: 27515
  CDS (1)..(873)

SEQ ID NO: 55702 - protein, 290 aa, Rhodopseudomonas palustris; identical to SEQ ID NO: 27516

SEQ ID NO: 55703 - DNA, 918 bp, Rhodopseudomonas palustris; identical to SEQ ID NO: 27517
  CDS (1)..(918)

SEQ ID NO: 55704 - protein, 305 aa, Rhodopseudomonas palustris; identical to SEQ ID NO: 27518

SEQ ID NO: 55705 - DNA, 1614 bp, Rhodopseudomonas palustris; identical to SEQ ID NO: 27519
  CDS (1)..(1614)

SEQ ID NO: 55706 - protein, 537 aa, Rhodopseudomonas palustris; identical to SEQ ID NO: 27520

SEQ ID NO: 55707 - DNA, 1008 bp, Rhodopseudomonas palustris; identical to SEQ ID NO: 27521
  CDS (1)..(1008)

SEQ ID NO: 55708 - protein, 335 aa, Rhodopseudomonas palustris; identical to SEQ ID NO: 27522

SEQ ID NO: 55709 - DNA, 873 bp, Rhodopseudomonas palustris; identical to SEQ ID NO: 27523
  CDS (1)..(873)

SEQ ID NO: 55710 - protein, 290 aa, Rhodopseudomonas palustris; identical to SEQ ID NO: 27524

SEQ ID NO: 55711 - DNA, 876 bp, Rhodopseudomonas palustris; identical to SEQ ID NO: 27525
  CDS (1)..(876)

SEQ ID NO: 55712 - protein, 291 aa, Rhodopseudomonas palustris; identical to SEQ ID NO: 27526

SEQ ID NO: 55713 - DNA, 1041 bp, Rhodopseudomonas palustris; identical to SEQ ID NO: 27527
  CDS (1)..(1041)

SEQ ID NO: 55714 - protein, 346 aa, Rhodopseudomonas palustris; identical to SEQ ID NO: 27528

SEQ ID NO: 55715 - DNA, 1773 bp, Rhodopseudomonas palustris; identical to SEQ ID NO: 27529
  CDS (1)..(1773)

SEQ ID NO: 55716 - protein, 590 aa, Rhodopseudomonas palustris; identical to SEQ ID NO: 27530

SEQ ID NO: 55717 - DNA, 834 bp, Rhodopseudomonas palustris; identical to SEQ ID NO: 27531
  CDS (1)..(834)

SEQ ID NO: 55718 - protein, 277 aa, Rhodopseudomonas palustris; identical to SEQ ID NO: 27532

SEQ ID NO: 55719 - DNA, 876 bp, Rhodopseudomonas palustris; identical to SEQ ID NO: 27533
  CDS (1)..(876)

SEQ ID NO: 55720 - protein, 291 aa, Rhodopseudomonas palustris; identical to SEQ ID NO: 27534

SEQ ID NO: 55721 - DNA, 876 bp, Rhodopseudomonas palustris; identical to SEQ ID NO: 27535
  CDS (1)..(876)

SEQ ID NO: 55722 - protein, 291 aa, Rhodopseudomonas palustris; identical to SEQ ID NO: 27536

SEQ ID NO: 55723 - DNA, 864 bp, Rhodopseudomonas palustris; identical to SEQ ID NO: 27537
  CDS (1)..(864)

SEQ ID NO: 55724 - protein, 287 aa, Rhodopseudomonas palustris; identical to SEQ ID NO: 27538

SEQ ID NO: 55725 - DNA, 927 bp, Rhodopseudomonas palustris; identical to SEQ ID NO: 27539
  CDS (1)..(927)

SEQ ID NO: 55726 - protein, 308 aa, Rhodopseudomonas palustris; identical to SEQ ID NO: 27540

SEQ ID NO: 55727 - DNA, 873 bp, Rhodopseudomonas palustris; identical to SEQ ID NO: 27541
  CDS (1)..(873)

SEQ ID NO: 55728 - protein, 290 aa, Rhodopseudomonas palustris; identical to SEQ ID NO: 27542

SEQ ID NO: 55729 - DNA, 867 bp, Rhodopseudomonas palustris; identical to SEQ ID NO: 27543
  CDS (1)..(867)

SEQ ID NO: 55730 - protein, 288 aa, Rhodopseudomonas palustris; identical to SEQ ID NO: 27544

SEQ ID NO: 55731 - DNA, 870 bp, uncultured bacterium 582; identical to SEQ ID NO: 27545
  CDS (1)..(870)

SEQ ID NO: 55732 - protein, 289 aa, uncultured bacterium 582; identical to SEQ ID NO: 27546

SEQ ID NO: 55733 - DNA, 1254 bp, symbiont bacterium of Paederus fuscipes; identical to SEQ ID NO: 27547
  CDS (1)..(1254)

SEQ ID NO: 55734 - protein, 417 aa, symbiont bacterium of Paederus fuscipes; identical to SEQ ID NO: 27548

SEQ ID NO: 55735 - DNA, 879 bp, Alcaligenes eutrophus; identical to SEQ ID NO: 27549
  CDS (1)..(879)

SEQ ID NO: 55736 - protein, 292 aa, Alcaligenes eutrophus; identical to SEQ ID NO: 27550

SEQ ID NO: 55737 - DNA, 882 bp, Rhizobium sp; identical to SEQ ID NO: 27551
  CDS (1)..(882)

SEQ ID NO: 55738 - protein, 293 aa, Rhizobium sp; identical to SEQ ID NO: 27552

SEQ ID NO: 55739 - DNA, 921 bp, Desulfovibrio vulgaris; identical to SEQ ID NO: 27553
  CDS (1)..(921)

SEQ ID NO: 55740 - protein, 306 aa, Desulfovibrio vulgaris; identical to SEQ ID NO: 27554

SEQ ID NO: 55741 - DNA, 906 bp, Desulfovibrio vulgaris; identical to SEQ ID NO: 27555
  CDS (1)..(906)

SEQ ID NO: 55742 - protein, 301 aa, Desulfovibrio vulgaris; identical to SEQ ID NO: 27556

SEQ ID NO: 55743 - DNA, 1224 bp, Desulfovibrio vulgaris; identical to SEQ ID NO: 27557
  CDS (1)..(1224)

SEQ ID NO: 55744 - protein, 407 aa, Desulfovibrio vulgaris; identical to SEQ ID NO: 27558

SEQ ID NO: 55745 - DNA, 909 bp, Desulfovibrio vulgaris; identical to SEQ ID NO: 27559
  CDS (1)..(909)

SEQ ID NO: 55746 - protein, 302 aa, Desulfovibrio vulgaris; identical to SEQ ID NO: 27560

SEQ ID NO: 55747 - DNA, 969 bp, Thermus thermophilus; identical to SEQ ID NO: 27561
  CDS (1)..(969)

SEQ ID NO: 55748 - protein, 322 aa, Thermus thermophilus; identical to SEQ ID NO: 27562

SEQ ID NO: 55749 - DNA, 978 bp, Thermus thermophilus; identical to SEQ ID NO: 27563
  CDS (1)..(978)

SEQ ID NO: 55750 - protein, 325 aa, Thermus thermophilus; identical to SEQ ID NO: 27564

SEQ ID NO: 55751 - DNA, 858 bp, Thermus thermophilus; identical to SEQ ID NO: 27565
  CDS (1)..(858)

SEQ ID NO: 55752 - protein, 285 aa, Thermus thermophilus; identical to SEQ ID NO: 27566

SEQ ID NO: 55753 - DNA, 876 bp, Thermus thermophilus; identical to SEQ ID NO: 27567
  CDS (1)..(876)

SEQ ID NO: 55754 - protein, 291 aa, Thermus thermophilus; identical to SEQ ID NO: 27568

SEQ ID NO: 55755 - DNA, 1068 bp, Thermus thermophilus; identical to SEQ ID NO: 27569
  CDS (1)..(1068)

SEQ ID NO: 55756 - protein, 355 aa, Thermus thermophilus; identical to SEQ ID NO: 27570

SEQ ID NO: 55757 - DNA, 894 bp, Thermus thermophilus; identical to SEQ ID NO: 27571
  CDS (1)..(894)

SEQ ID NO: 55758 - protein, 297 aa, Thermus thermophilus; identical to SEQ ID NO: 27572

SEQ ID NO: 55759 - DNA, 861 bp, Bacillus cereus; identical to SEQ ID NO: 27573
  CDS (1)..(861)

SEQ ID NO: 55760 - protein, 286 aa, Bacillus cereus; identical to SEQ ID NO: 27574

SEQ ID NO: 55761 - DNA, 900 bp, Treponema denticola; identical to SEQ ID NO: 27575
  CDS (1)..(900)

SEQ ID NO: 55762 - protein, 299 aa, Treponema denticola; identical to SEQ ID NO: 27576

SEQ ID NO: 55763 - DNA, 1020 bp, Treponema denticola; identical to SEQ ID NO: 27577
  CDS (1)..(1020)

SEQ ID NO: 55764 - protein, 339 aa, Treponema denticola; identical to SEQ ID NO: 27578

SEQ ID NO: 55765 - DNA, 885 bp, Geobacter sulfurreducens; identical to SEQ ID NO: 27579
  CDS (1)..(885)

SEQ ID NO: 55766 - protein, 294 aa, Geobacter sulfurreducens; identical to SEQ ID NO: 27580

SEQ ID NO: 55767 - DNA, 1158 bp, Agrobacterium tumefaciens; identical to SEQ ID NO: 27581
  CDS (1)..(1158)

SEQ ID NO: 55768 - protein, 385 aa, Agrobacterium tumefaciens; identical to SEQ ID NO: 27582

SEQ ID NO: 55769 - DNA, 903 bp, Wolinella succinogenes; identical to SEQ ID NO: 27583
  CDS (1)..(903)

SEQ ID NO: 55770 - protein, 300 aa, Wolinella succinogenes; identical to SEQ ID NO: 27584

SEQ ID NO: 55771 - DNA, 1110 bp, Gloeobacter violaceus; identical to SEQ ID NO: 27585
  CDS (1)..(1110)

SEQ ID NO: 55772 - protein, 369 aa, Gloeobacter violaceus; identical to SEQ ID NO: 27586

SEQ ID NO: 55773 - DNA, 1170 bp, Gloeobacter violaceus; identical to SEQ ID NO: 27587
  CDS (1)..(1170)

SEQ ID NO: 55774 - protein, 389 aa, Gloeobacter violaceus; identical to SEQ ID NO: 27588

SEQ ID NO: 55775 - DNA, 1092 bp, Chromobacterium violaceum; identical to SEQ ID NO: 27589
  CDS (1)..(1092)

SEQ ID NO: 55776 - protein, 363 aa, Chromobacterium violaceum; identical to SEQ ID NO: 27590

SEQ ID NO: 55777 - DNA, 930 bp, Chromobacterium violaceum; identical to SEQ ID NO: 27591
  CDS (1)..(930)

SEQ ID NO: 55778 - protein, 309 aa, Chromobacterium violaceum; identical to SEQ ID NO: 27592

SEQ ID NO: 55779 - DNA, 1155 bp, Synechococcus sp; identical to SEQ ID NO: 27593
  CDS (1)..(1155)

SEQ ID NO: 55780 - protein, 384 aa, Synechococcus sp; identical to SEQ ID NO: 27594

SEQ ID NO: 55781 - DNA, 1155 bp, Prochlorococcus marinus subsp; identical to SEQ ID NO: 27595
  CDS (1)..(1155)

SEQ ID NO: 55782 - protein, 384 aa, Prochlorococcus marinus subsp; identical to SEQ ID NO: 27596

SEQ ID NO: 55783 - DNA, 1155 bp, Prochlorococcus marinus; identical to SEQ ID NO: 27597
  CDS (1)..(1155)

SEQ ID NO: 55784 - protein, 384 aa, Prochlorococcus marinus; identical to SEQ ID NO: 27598

SEQ ID NO: 55785 - DNA, 885 bp, Bordetella pertussis; identical to SEQ ID NO: 27599
  CDS (1)..(885)

SEQ ID NO: 55786 - protein, 294 aa, Bordetella pertussis; identical to SEQ ID NO: 27600

SEQ ID NO: 55787 - DNA, 1797 bp, Bordetella pertussis; identical to SEQ ID NO: 27601
  CDS (1)..(1797)

SEQ ID NO: 55788 - protein, 598 aa, Bordetella pertussis; identical to SEQ ID NO: 27602

SEQ ID NO: 55789 - DNA, 882 bp, Bordetella pertussis; identical to SEQ ID NO: 27603
  CDS (1)..(882)

SEQ ID NO: 55790 - protein, 293 aa, Bordetella pertussis; identical to SEQ ID NO: 27604

SEQ ID NO: 55791 - DNA, 1950 bp, Bordetella pertussis; identical to SEQ ID NO: 27605
  CDS (1)..(1950)

SEQ ID NO: 55792 - protein, 649 aa, Bordetella pertussis; identical to SEQ ID NO: 27606

SEQ ID NO: 55793 - DNA, 927 bp, Bordetella pertussis; identical to SEQ ID NO: 27607
  CDS (1)..(927)

SEQ ID NO: 55794 - protein, 308 aa, Bordetella pertussis; identical to SEQ ID NO: 27608

SEQ ID NO: 55795 - DNA, 1239 bp, Bordetella pertussis; identical to SEQ ID NO: 27609
  CDS (1)..(1239)

SEQ ID NO: 55796 - protein, 412 aa, Bordetella pertussis; identical to SEQ ID NO: 27610

SEQ ID NO: 55797 - DNA, 921 bp, Bordetella pertussis; identical to SEQ ID NO: 27611
  CDS (1)..(921)

SEQ ID NO: 55798 - protein, 306 aa, Bordetella pertussis; identical to SEQ ID NO: 27612

SEQ ID NO: 55799 - DNA, 1038 bp, Bordetella parapertussis; identical to SEQ ID NO: 27613
  CDS (1)..(1038)

SEQ ID NO: 55800 - protein, 345 aa, Bordetella parapertussis; identical to SEQ ID NO: 27614

SEQ ID NO: 55801 - DNA, 1839 bp, Bordetella parapertussis; identical to SEQ ID NO: 27615
  CDS (1)..(1839)

SEQ ID NO: 55802 - protein, 612 aa, Bordetella parapertussis; identical to SEQ ID NO: 27616

SEQ ID NO: 55803 - DNA, 873 bp, Bordetella parapertussis; identical to SEQ ID NO: 27617
  CDS (1)..(873)

SEQ ID NO: 55804 - protein, 290 aa, Bordetella parapertussis; identical to SEQ ID NO: 27618

SEQ ID NO: 55805 - DNA, 930 bp, Bordetella parapertussis; identical to SEQ ID NO: 27619
  CDS (1)..(930)

SEQ ID NO: 55806 - protein, 309 aa, Bordetella parapertussis; identical to SEQ ID NO: 27620

SEQ ID NO: 55807 - DNA, 888 bp, Bordetella parapertussis; identical to SEQ ID NO: 27621
  CDS (1)..(888)

SEQ ID NO: 55808 - protein, 295 aa, Bordetella parapertussis; identical to SEQ ID NO: 27622

SEQ ID NO: 55809 - DNA, 876 bp, Bordetella parapertussis; identical to SEQ ID NO: 27623
  CDS (1)..(876)

SEQ ID NO: 55810 - protein, 291 aa, Bordetella parapertussis; identical to SEQ ID NO: 27624

SEQ ID NO: 55811 - DNA, 882 bp, Bordetella parapertussis; identical to SEQ ID NO: 27625
  CDS (1)..(882)

SEQ ID NO: 55812 - protein, 293 aa, Bordetella parapertussis; identical to SEQ ID NO: 27626

SEQ ID NO: 55813 - DNA, 876 bp, Bordetella parapertussis; identical to SEQ ID NO: 27627
  CDS (1)..(876)

SEQ ID NO: 55814 - protein, 291 aa, Bordetella parapertussis; identical to SEQ ID NO: 27628

SEQ ID NO: 55815 - DNA, 930 bp, Bordetella bronchiseptica; identical to SEQ ID NO: 27629
  CDS (1)..(930)

SEQ ID NO: 55816 - protein, 309 aa, Bordetella bronchiseptica; identical to SEQ ID NO: 27630

SEQ ID NO: 55817 - DNA, 873 bp, Bordetella bronchiseptica; identical to SEQ ID NO: 27631
  CDS (1)..(873)

SEQ ID NO: 55818 - protein, 290 aa, Bordetella bronchiseptica; identical to SEQ ID NO: 27632

SEQ ID NO: 55819 - DNA, 957 bp, Bordetella bronchiseptica; identical to SEQ ID NO: 27633
  CDS (1)..(957)

SEQ ID NO: 55820 - protein, 318 aa, Bordetella bronchiseptica; identical to SEQ ID NO: 27634

SEQ ID NO: 55821 - DNA, 1950 bp, Bordetella bronchiseptica; identical to SEQ ID NO: 27635
  CDS (1)..(1950)

SEQ ID NO: 55822 - protein, 649 aa, Bordetella bronchiseptica; identical to SEQ ID NO: 27636

SEQ ID NO: 55823 - DNA, 876 bp, Bordetella bronchiseptica; identical to SEQ ID NO: 27637
  CDS (1)..(876)

SEQ ID NO: 55824 - protein, 291 aa, Bordetella bronchiseptica; identical to SEQ ID NO: 27638

SEQ ID NO: 55825 - DNA, 888 bp, Bordetella bronchiseptica; identical to SEQ ID NO: 27639
  CDS (1)..(888)

SEQ ID NO: 55826 - protein, 295 aa, Bordetella bronchiseptica; identical to SEQ ID NO: 27640

SEQ ID NO: 55827 - DNA, 867 bp, Bordetella bronchiseptica; identical to SEQ ID NO: 27641
  CDS (1)..(867)

SEQ ID NO: 55828 - protein, 288 aa, Bordetella bronchiseptica; identical to SEQ ID NO: 27642

SEQ ID NO: 55829 - DNA, 873 bp, Bordetella bronchiseptica; identical to SEQ ID NO: 27643
  CDS (1)..(873)

SEQ ID NO: 55830 - protein, 290 aa, Bordetella bronchiseptica; identical to SEQ ID NO: 27644

SEQ ID NO: 55831 - DNA, 930 bp, Bordetella bronchiseptica; identical to SEQ ID NO: 27645
  CDS (1)..(930)

SEQ ID NO: 55832 - protein, 309 aa, Bordetella bronchiseptica; identical to SEQ ID NO: 27646

SEQ ID NO: 55833 - DNA, 942 bp, Rhizobium leguminosarum; identical to SEQ ID NO: 27647
  CDS (1)..(942)

SEQ ID NO: 55834 - protein, 313 aa, Rhizobium leguminosarum; identical to SEQ ID NO: 27648

SEQ ID NO: 55835 - DNA, 861 bp, Bacillus cereus; identical to SEQ ID NO: 27649
  CDS (1)..(861)

SEQ ID NO: 55836 - protein, 286 aa, Bacillus cereus; identical to SEQ ID NO: 27650

SEQ ID NO: 55837 - DNA, 933 bp, Streptomyces avermitilis; identical to SEQ ID NO: 27651
  CDS (1)..(933)

SEQ ID NO: 55838 - protein, 310 aa, Streptomyces avermitilis; identical to SEQ ID NO: 27652

SEQ ID NO: 55839 - DNA, 891 bp, Streptomyces avermitilis; identical to SEQ ID NO: 27653
  CDS (1)..(891)

SEQ ID NO: 55840 - protein, 296 aa, Streptomyces avermitilis; identical to SEQ ID NO: 27654

SEQ ID NO: 55841 - DNA, 897 bp, Streptomyces avermitilis; identical to SEQ ID NO: 27655
  CDS (1)..(897)

SEQ ID NO: 55842 - protein, 298 aa, Streptomyces avermitilis; identical to SEQ ID NO: 27656

SEQ ID NO: 55843 - DNA, 1005 bp, Tropheryma whipplei; identical to SEQ ID NO: 27657
  CDS (1)..(1005)

SEQ ID NO: 55844 - protein, 334 aa, Tropheryma whipplei; identical to SEQ ID NO: 27658

SEQ ID NO: 55845 - DNA, 918 bp, Pseudomonas fluorescens; identical to SEQ ID NO: 27659
  CDS (1)..(918)

SEQ ID NO: 55846 - protein, 305 aa, Pseudomonas fluorescens; identical to SEQ ID NO: 27660

SEQ ID NO: 55847 - DNA, 867 bp, Azoarcus evansii; identical to SEQ ID NO: 27661
  CDS (1)..(867)

SEQ ID NO: 55848 - protein, 288 aa, Azoarcus evansii; identical to SEQ ID NO: 27662

SEQ ID NO: 55849 - DNA, 894 bp, Vibrio parahaemolyticus; identical to SEQ ID NO: 27663
  CDS (1)..(894)

SEQ ID NO: 55850 - protein, 297 aa, Vibrio parahaemolyticus; identical to SEQ ID NO: 27664

SEQ ID NO: 55851 - DNA, 1314 bp, Pseudomonas syringae; identical to SEQ ID NO: 27665
  CDS (1)..(1314)

SEQ ID NO: 55852 - protein, 437 aa, Pseudomonas syringae; identical to SEQ ID NO: 27666

SEQ ID NO: 55853 - DNA, 1590 bp, Pseudomonas syringae; identical to SEQ ID NO: 27667
  CDS (1)..(1590)

SEQ ID NO: 55854 - protein, 529 aa, Pseudomonas syringae; identical to SEQ ID NO: 27668

SEQ ID NO: 55855 - DNA, 1266 bp, Pseudomonas syringae; identical to SEQ ID NO: 27669
  CDS (1)..(1266)

SEQ ID NO: 55856 - protein, 421 aa, Pseudomonas syringae; identical to SEQ ID NO: 27670

SEQ ID NO: 55857 - DNA, 924 bp, Pseudomonas syringae; identical to SEQ ID NO: 27671
  CDS (1)..(924)

SEQ ID NO: 55858 - protein, 307 aa, Pseudomonas syringae; identical to SEQ ID NO: 27672

SEQ ID NO: 55859 - DNA, 882 bp, Pseudomonas syringae; identical to SEQ ID NO: 27673
  CDS (1)..(882)

SEQ ID NO: 55860 - protein, 293 aa, Pseudomonas syringae; identical to SEQ ID NO: 27674

SEQ ID NO: 55861 - DNA, 882 bp, Pseudomonas syringae; identical to SEQ ID NO: 27675
  CDS (1)..(882)

SEQ ID NO: 55862 - protein, 293 aa, Pseudomonas syringae; identical to SEQ ID NO: 27676

SEQ ID NO: 55863 - DNA, 882 bp, Pseudomonas syringae; identical to SEQ ID NO: 27677
  CDS (1)..(882)

SEQ ID NO: 55864 - protein, 293 aa, Pseudomonas syringae; identical to SEQ ID NO: 27678

SEQ ID NO: 55865 - DNA, 915 bp, Pseudomonas putida; identical to SEQ ID NO: 27679
  CDS (1)..(915)

SEQ ID NO: 55866 - protein, 304 aa, Pseudomonas putida; identical to SEQ ID NO: 27680

SEQ ID NO: 55867 - DNA, 1308 bp, Pseudomonas putida; identical to SEQ ID NO: 27681
  CDS (1)..(1308)

SEQ ID NO: 55868 - protein, 435 aa, Pseudomonas putida; identical to SEQ ID NO: 27682

SEQ ID NO: 55869 - DNA, 1041 bp, Pseudomonas putida; identical to SEQ ID NO: 27683
  CDS (1)..(1041)

SEQ ID NO: 55870 - protein, 346 aa, Pseudomonas putida; identical to SEQ ID NO: 27684

SEQ ID NO: 55871 - DNA, 882 bp, Pseudomonas putida; identical to SEQ ID NO: 27685
  CDS (1)..(882)

SEQ ID NO: 55872 - protein, 293 aa, Pseudomonas putida; identical to SEQ ID NO: 27686

SEQ ID NO: 55873 - DNA, 924 bp, Pseudomonas putida; identical to SEQ ID NO: 27687
  CDS (1)..(924)

SEQ ID NO: 55874 - protein, 307 aa, Pseudomonas putida; identical to SEQ ID NO: 27688

SEQ ID NO: 55875 - DNA, 1257 bp, Pseudomonas putida; identical to SEQ ID NO: 27689
  CDS (1)..(1257)

SEQ ID NO: 55876 - protein, 418 aa, Pseudomonas putida; identical to SEQ ID NO: 27690

SEQ ID NO: 55877 - DNA, 861 bp, Pseudomonas putida; identical to SEQ ID NO: 27691
  CDS (1)..(861)

SEQ ID NO: 55878 - protein, 286 aa, Pseudomonas putida; identical to SEQ ID NO: 27692

SEQ ID NO: 55879 - DNA, 879 bp, Lactobacillus plantarum; identical to SEQ ID NO: 27693
  CDS (1)..(879)

SEQ ID NO: 55880 - protein, 292 aa, Lactobacillus plantarum; identical to SEQ ID NO: 27694

SEQ ID NO: 55881 - DNA, 963 bp, Lactobacillus plantarum; identical to SEQ ID NO: 27695
  CDS (1)..(963)

SEQ ID NO: 55882 - protein, 320 aa, Lactobacillus plantarum; identical to SEQ ID NO: 27696

SEQ ID NO: 55883 - DNA, 876 bp, Bradyrhizobium japonicum; identical to SEQ ID NO: 27697
  CDS (1)..(876)

SEQ ID NO: 55884 - protein, 291 aa, Bradyrhizobium japonicum; identical to SEQ ID NO: 27698

SEQ ID NO: 55885 - DNA, 1770 bp, Bradyrhizobium japonicum; identical to SEQ ID NO: 27699
  CDS (1)..(1770)

SEQ ID NO: 55886 - protein, 589 aa, Bradyrhizobium japonicum; identical to SEQ ID NO: 27700

SEQ ID NO: 55887 - DNA, 1026 bp, Bradyrhizobium japonicum; identical to SEQ ID NO: 27701
  CDS (1)..(1026)

SEQ ID NO: 55888 - protein, 341 aa, Bradyrhizobium japonicum; identical to SEQ ID NO: 27702

SEQ ID NO: 55889 - DNA, 879 bp, Bradyrhizobium japonicum; identical to SEQ ID NO: 27703
  CDS (1)..(879)

SEQ ID NO: 55890 - protein, 292 aa, Bradyrhizobium japonicum; identical to SEQ ID NO: 27704

SEQ ID NO: 55891 - DNA, 1665 bp, Bradyrhizobium japonicum; identical to SEQ ID NO: 27705
  CDS (1)..(1665)

SEQ ID NO: 55892 - protein, 554 aa, Bradyrhizobium japonicum; identical to SEQ ID NO: 27706

SEQ ID NO: 55893 - DNA, 882 bp, Bradyrhizobium japonicum; identical to SEQ ID NO: 27707
  CDS (1)..(882)

SEQ ID NO: 55894 - protein, 293 aa, Bradyrhizobium japonicum; identical to SEQ ID NO: 27708

SEQ ID NO: 55895 - DNA, 855 bp, Bradyrhizobium japonicum; identical to SEQ ID NO: 27709
  CDS (1)..(855)

SEQ ID NO: 55896 - protein, 284 aa, Bradyrhizobium japonicum; identical to SEQ ID NO: 27710

SEQ ID NO: 55897 - DNA, 867 bp, Bradyrhizobium japonicum; identical to SEQ ID NO: 27711
  CDS (1)..(867)

SEQ ID NO: 55898 - protein, 288 aa, Bradyrhizobium japonicum; identical to SEQ ID NO: 27712

SEQ ID NO: 55899 - DNA, 867 bp, Bradyrhizobium japonicum; identical to SEQ ID NO: 27713
  CDS (1)..(867)

SEQ ID NO: 55900 - protein, 288 aa, Bradyrhizobium japonicum; identical to SEQ ID NO: 27714

SEQ ID NO: 55901 - DNA, 882 bp, Bradyrhizobium japonicum; identical to SEQ ID NO: 27715
  CDS (1)..(882)

SEQ ID NO: 55902 - protein, 293 aa, Bradyrhizobium japonicum; identical to SEQ ID NO: 27716

SEQ ID NO: 55903 - DNA, 918 bp, Bradyrhizobium japonicum; identical to SEQ ID NO: 27717
  CDS (1)..(918)

SEQ ID NO: 55904 - protein, 305 aa, Bradyrhizobium japonicum; identical to SEQ ID NO: 27718

SEQ ID NO: 55905 - DNA, 870 bp, Bradyrhizobium japonicum; identical to SEQ ID NO: 27719
  CDS (1)..(870)

SEQ ID NO: 55906 - protein, 289 aa, Bradyrhizobium japonicum; identical to SEQ ID NO: 27720

SEQ ID NO: 55907 - DNA, 1890 bp, Bradyrhizobium japonicum; identical to SEQ ID NO: 27721
  CDS (1)..(1890)

SEQ ID NO: 55908 - protein, 629 aa, Bradyrhizobium japonicum; identical to SEQ ID NO: 27722

SEQ ID NO: 55909 - DNA, 930 bp, Bradyrhizobium japonicum; identical to SEQ ID NO: 27723
  CDS (1)..(930)

SEQ ID NO: 55910 - protein, 309 aa, Bradyrhizobium japonicum; identical to SEQ ID NO: 27724

SEQ ID NO: 55911 - DNA, 873 bp, Bradyrhizobium japonicum; identical to SEQ ID NO: 27725
  CDS (1)..(873)

SEQ ID NO: 55912 - protein, 290 aa, Bradyrhizobium japonicum; identical to SEQ ID NO: 27726

SEQ ID NO: 55913 - DNA, 1044 bp, Bradyrhizobium japonicum; identical to SEQ ID NO: 27727
  CDS (1)..(1044)

SEQ ID NO: 55914 - protein, 347 aa, Bradyrhizobium japonicum; identical to SEQ ID NO: 27728

SEQ ID NO: 55915 - DNA, 1011 bp, Bradyrhizobium japonicum; identical to SEQ ID NO: 27729
  CDS (1)..(1011)

SEQ ID NO: 55916 - protein, 336 aa, Bradyrhizobium japonicum; identical to SEQ ID NO: 27730

SEQ ID NO: 55917 - DNA, 1047 bp, Bradyrhizobium japonicum; identical to SEQ ID NO: 27731
  CDS (1)..(1047)

SEQ ID NO: 55918 - protein, 348 aa, Bradyrhizobium japonicum; identical to SEQ ID NO: 27732

SEQ ID NO: 55919 - DNA, 903 bp, Bradyrhizobium japonicum; identical to SEQ ID NO: 27733
  CDS (1)..(903)

SEQ ID NO: 55920 - protein, 300 aa, Bradyrhizobium japonicum; identical to SEQ ID NO: 27734

SEQ ID NO: 55921 - DNA, 906 bp, Bradyrhizobium japonicum; identical to SEQ ID NO: 27735
  CDS (1)..(906)

SEQ ID NO: 55922 - protein, 301 aa, Bradyrhizobium japonicum; identical to SEQ ID NO: 27736

SEQ ID NO: 55923 - DNA, 1170 bp, Bradyrhizobium japonicum; identical to SEQ ID NO: 27737
  CDS (1)..(1170)

SEQ ID NO: 55924 - protein, 389 aa, Bradyrhizobium japonicum; identical to SEQ ID NO: 27738

SEQ ID NO: 55925 - DNA, 1608 bp, Bradyrhizobium japonicum; identical to SEQ ID NO: 27739
  CDS (1)..(1608)

SEQ ID NO: 55926 - protein, 535 aa, Bradyrhizobium japonicum; identical to SEQ ID NO: 27740

SEQ ID NO: 55927 - DNA, 876 bp, Bradyrhizobium japonicum; identical to SEQ ID NO: 27741
  CDS (1)..(876)

SEQ ID NO: 55928 - protein, 291 aa, Bradyrhizobium japonicum; identical to SEQ ID NO: 27742

SEQ ID NO: 55929 - DNA, 1011 bp, Bradyrhizobium japonicum; identical to SEQ ID NO: 27743
  CDS (1)..(1011)

SEQ ID NO: 55930 - protein, 336 aa, Bradyrhizobium japonicum; identical to SEQ ID NO: 27744

SEQ ID NO: 55931 - DNA, 858 bp, Bradyrhizobium japonicum; identical to SEQ ID NO: 27745
  CDS (1)..(858)

SEQ ID NO: 55932 - protein, 285 aa, Bradyrhizobium japonicum; identical to SEQ ID NO: 27746

SEQ ID NO: 55933 - DNA, 1617 bp, Yersinia pestis; identical to SEQ ID NO: 27747
  CDS (1)..(1617)

SEQ ID NO: 55934 - protein, 538 aa, Yersinia pestis; identical to SEQ ID NO: 27748

SEQ ID NO: 55935 - DNA, 936 bp, Synechococcus elongatus; identical to SEQ ID NO: 27749
  CDS (1)..(936)

SEQ ID NO: 55936 - protein, 311 aa, Synechococcus elongatus; identical to SEQ ID NO: 27750

SEQ ID NO: 55937 - DNA, 870 bp, Synechococcus elongatus; identical to SEQ ID NO: 27751
  CDS (1)..(870)

SEQ ID NO: 55938 - protein, 289 aa, Synechococcus elongatus; identical to SEQ ID NO: 27752

SEQ ID NO: 55939 - DNA, 1170 bp, Synechococcus elongatus; identical to SEQ ID NO: 27753
  CDS (1)..(1170)

SEQ ID NO: 55940 - protein, 389 aa, Synechococcus elongatus; identical to SEQ ID NO: 27754

SEQ ID NO: 55941 - DNA, 1158 bp, Synechococcus elongatus; identical to SEQ ID NO: 27755
  CDS (1)..(1158)

SEQ ID NO: 55942 - protein, 385 aa, Synechococcus elongatus; identical to SEQ ID NO: 27756

SEQ ID NO: 55943 - DNA, 870 bp, Streptococcus mutans; identical to SEQ ID NO: 27757
  CDS (1)..(870)

SEQ ID NO: 55944 - protein, 289 aa, Streptococcus mutans; identical to SEQ ID NO: 27758

SEQ ID NO: 55945 - DNA, 957 bp, Streptococcus mutans; identical to SEQ ID NO: 27759
  CDS (1)..(957)

SEQ ID NO: 55946 - protein, 318 aa, Streptococcus mutans; identical to SEQ ID NO: 27760

SEQ ID NO: 55947 - DNA, 870 bp, Streptococcus agalactiae; identical to SEQ ID NO: 27761
  CDS (1)..(870)

SEQ ID NO: 55948 - protein, 289 aa, Streptococcus agalactiae; identical to SEQ ID NO: 27762

SEQ ID NO: 55949 - DNA, 954 bp, Streptococcus agalactiae; identical to SEQ ID NO: 27763
  CDS (1)..(954)

SEQ ID NO: 55950 - protein, 317 aa, Streptococcus agalactiae; identical to SEQ ID NO: 27764

SEQ ID NO: 55951 - DNA, 987 bp, Oceanobacillus iheyensis; identical to SEQ ID NO: 27765
  CDS (1)..(987)

SEQ ID NO: 55952 - protein, 328 aa, Oceanobacillus iheyensis; identical to SEQ ID NO: 27766

SEQ ID NO: 55953 - DNA, 864 bp, Oceanobacillus iheyensis; identical to SEQ ID NO: 27767
  CDS (1)..(864)

SEQ ID NO: 55954 - protein, 287 aa, Oceanobacillus iheyensis; identical to SEQ ID NO: 27768

SEQ ID NO: 55955 - DNA, 885 bp, Corynebacterium efficiens; identical to SEQ ID NO: 27769
  CDS (1)..(885)

SEQ ID NO: 55956 - protein, 294 aa, Corynebacterium efficiens; identical to SEQ ID NO: 27770

SEQ ID NO: 55957 - DNA, 870 bp, Brucella suis; identical to SEQ ID NO: 27771
  CDS (1)..(870)

SEQ ID NO: 55958 - protein, 289 aa, Brucella suis; identical to SEQ ID NO: 27772

SEQ ID NO: 55959 - DNA, 888 bp, Brucella suis; identical to SEQ ID NO: 27773
  CDS (1)..(888)

SEQ ID NO: 55960 - protein, 295 aa, Brucella suis; identical to SEQ ID NO: 27774

SEQ ID NO: 55961 - DNA, 870 bp, Brucella suis; identical to SEQ ID NO: 27775
  CDS (1)..(870)

SEQ ID NO: 55962 - protein, 289 aa, Brucella suis; identical to SEQ ID NO: 27776

SEQ ID NO: 55963 - DNA, 885 bp, Brucella suis; identical to SEQ ID NO: 27777
  CDS (1)..(885)

SEQ ID NO: 55964 - protein, 294 aa, Brucella suis; identical to SEQ ID NO: 27778

SEQ ID NO: 55965 - DNA, 909 bp, Brucella suis; identical to SEQ ID NO: 27779
  CDS (1)..(909)

SEQ ID NO: 55966 - protein, 302 aa, Brucella suis; identical to SEQ ID NO: 27780

SEQ ID NO: 55967 - DNA, 1077 bp, Bifidobacterium longum; identical to SEQ ID NO: 27781
  CDS (1)..(1077)

SEQ ID NO: 55968 - protein, 358 aa, Bifidobacterium longum; identical to SEQ ID NO: 27782

SEQ ID NO: 55969 - DNA, 927 bp, Bifidobacterium longum; identical to SEQ ID NO: 27783
  CDS (1)..(927)

SEQ ID NO: 55970 - protein, 308 aa, Bifidobacterium longum; identical to SEQ ID NO: 27784

SEQ ID NO: 55971 - DNA, 822 bp, Pseudomonas resinovorans; identical to SEQ ID NO: 27785
  CDS (1)..(822)

SEQ ID NO: 55972 - protein, 273 aa, Pseudomonas resinovorans; identical to SEQ ID NO: 27786

SEQ ID NO: 55973 - DNA, 1080 bp, Corynebacterium glutamicum; identical to SEQ ID NO: 27787
  CDS (1)..(1080)

SEQ ID NO: 55974 - protein, 359 aa, Corynebacterium glutamicum; identical to SEQ ID NO: 27788

SEQ ID NO: 55975 - DNA, 885 bp, Corynebacterium glutamicum; identical to SEQ ID NO: 27789
  CDS (1)..(885)

SEQ ID NO: 55976 - protein, 294 aa, Corynebacterium glutamicum; identical to SEQ ID NO: 27790

SEQ ID NO: 55977 - DNA, 927 bp, Fusobacterium nucleatum; identical to SEQ ID NO: 27791
  CDS (1)..(927)

SEQ ID NO: 55978 - protein, 308 aa, Fusobacterium nucleatum; identical to SEQ ID NO: 27792

SEQ ID NO: 55979 - DNA, 858 bp, Fusobacterium nucleatum; identical to SEQ ID NO: 27793
  CDS (1)..(858)

SEQ ID NO: 55980 - protein, 285 aa, Fusobacterium nucleatum; identical to SEQ ID NO: 27794

SEQ ID NO: 55981 - DNA, 873 bp, Rhizobium leguminosarum; identical to SEQ ID NO: 27795
  CDS (1)..(873)

SEQ ID NO: 55982 - protein, 290 aa, Rhizobium leguminosarum; identical to SEQ ID NO: 27796

SEQ ID NO: 55983 - DNA, 885 bp, Burkholderia cepacia; identical to SEQ ID NO: 27797
  CDS (1)..(885)

SEQ ID NO: 55984 - protein, 294 aa, Burkholderia cepacia; identical to SEQ ID NO: 27798

SEQ ID NO: 55985 - DNA, 1827 bp, Ralstonia solanacearum; identical to SEQ ID NO: 27799
  CDS (1)..(1827)

SEQ ID NO: 55986 - protein, 608 aa, Ralstonia solanacearum; identical to SEQ ID NO: 27800

SEQ ID NO: 55987 - DNA, 900 bp, Ralstonia solanacearum; identical to SEQ ID NO: 27801
  CDS (1)..(900)

SEQ ID NO: 55988 - protein, 299 aa, Ralstonia solanacearum; identical to SEQ ID NO: 27802

SEQ ID NO: 55989 - DNA, 882 bp, Ralstonia solanacearum; identical to SEQ ID NO: 27803
  CDS (1)..(882)

SEQ ID NO: 55990 - protein, 293 aa, Ralstonia solanacearum; identical to SEQ ID NO: 27804

SEQ ID NO: 55991 - DNA, 942 bp, Ralstonia solanacearum; identical to SEQ ID NO: 27805
  CDS (1)..(942)

SEQ ID NO: 55992 - protein, 313 aa, Ralstonia solanacearum; identical to SEQ ID NO: 27806

SEQ ID NO: 55993 - DNA, 936 bp, Ralstonia solanacearum; identical to SEQ ID NO: 27807
  CDS (1)..(936)

SEQ ID NO: 55994 - protein, 311 aa, Ralstonia solanacearum; identical to SEQ ID NO: 27808

SEQ ID NO: 55995 - DNA, 1137 bp, Ralstonia solanacearum; identical to SEQ ID NO: 27809
  CDS (1)..(1137)

SEQ ID NO: 55996 - protein, 378 aa, Ralstonia solanacearum; identical to SEQ ID NO: 27810

SEQ ID NO: 55997 - DNA, 870 bp, Ralstonia solanacearum; identical to SEQ ID NO: 27811
  CDS (1)..(870)

SEQ ID NO: 55998 - protein, 289 aa, Ralstonia solanacearum; identical to SEQ ID NO: 27812

SEQ ID NO: 55999 - DNA, 1617 bp, Ralstonia solanacearum; identical to SEQ ID NO: 27813
  CDS (1)..(1617)

SEQ ID NO: 56000 - protein, 538 aa, Ralstonia solanacearum; identical to SEQ ID NO: 27814

SEQ ID NO: 56001 - DNA, 948 bp, Ralstonia solanacearum; identical to SEQ ID NO: 27815
  CDS (1)..(948)

SEQ ID NO: 56002 - protein, 315 aa, Ralstonia solanacearum; identical to SEQ ID NO: 27816

SEQ ID NO: 56003 - DNA, 960 bp, Pyrobaculum aerophilum; identical to SEQ ID NO: 27817
  CDS (1)..(960)

SEQ ID NO: 56004 - protein, 319 aa, Pyrobaculum aerophilum; identical to SEQ ID NO: 27818

SEQ ID NO: 56005 - DNA, 960 bp, Pyrobaculum aerophilum; identical to SEQ ID NO: 27819
  CDS (1)..(960)

SEQ ID NO: 56006 - protein, 319 aa, Pyrobaculum aerophilum; identical to SEQ ID NO: 27820

SEQ ID NO: 56007 - DNA, 873 bp, Pyrobaculum aerophilum; identical to SEQ ID NO: 27821
  CDS (1)..(873)

SEQ ID NO: 56008 - protein, 290 aa, Pyrobaculum aerophilum; identical to SEQ ID NO: 27822

SEQ ID NO: 56009 - DNA, 888 bp, Rhizobium meliloti; identical to SEQ ID NO: 27823
  CDS (1)..(888)

SEQ ID NO: 56010 - protein, 295 aa, Rhizobium meliloti; identical to SEQ ID NO: 27824

SEQ ID NO: 56011 - DNA, 891 bp, Rhizobium meliloti; identical to SEQ ID NO: 27825
  CDS (1)..(891)

SEQ ID NO: 56012 - protein, 296 aa, Rhizobium meliloti; identical to SEQ ID NO: 27826

SEQ ID NO: 56013 - DNA, 903 bp, Rhizobium meliloti; identical to SEQ ID NO: 27827
  CDS (1)..(903)

SEQ ID NO: 56014 - protein, 300 aa, Rhizobium meliloti; identical to SEQ ID NO: 27828

SEQ ID NO: 56015 - DNA, 897 bp, Rhizobium meliloti; identical to SEQ ID NO: 27829
  CDS (1)..(897)

SEQ ID NO: 56016 - protein, 298 aa, Rhizobium meliloti; identical to SEQ ID NO: 27830

SEQ ID NO: 56017 - DNA, 942 bp, Synechococcus sp; identical to SEQ ID NO: 27831
  CDS (1)..(942)

SEQ ID NO: 56018 - protein, 313 aa, Synechococcus sp; identical to SEQ ID NO: 27832

SEQ ID NO: 56019 - DNA, 1011 bp, Rhizobium loti; identical to SEQ ID NO: 27833
  CDS (1)..(1011)

SEQ ID NO: 56020 - protein, 336 aa, Rhizobium loti; identical to SEQ ID NO: 27834

SEQ ID NO: 56021 - DNA, 897 bp, Rhizobium loti; identical to SEQ ID NO: 27835
  CDS (1)..(897)

SEQ ID NO: 56022 - protein, 298 aa, Rhizobium loti; identical to SEQ ID NO: 27836

SEQ ID NO: 56023 - DNA, 909 bp, Rhizobium loti; identical to SEQ ID NO: 27837
  CDS (1)..(909)

SEQ ID NO: 56024 - protein, 302 aa, Rhizobium loti; identical to SEQ ID NO: 27838

SEQ ID NO: 56025 - DNA, 900 bp, Rhizobium loti; identical to SEQ ID NO: 27839
  CDS (1)..(900)

SEQ ID NO: 56026 - protein, 299 aa, Rhizobium loti; identical to SEQ ID NO: 27840

SEQ ID NO: 56027 - DNA, 906 bp, Rhizobium loti; identical to SEQ ID NO: 27841
  CDS (1)..(906)

SEQ ID NO: 56028 - protein, 301 aa, Rhizobium loti; identical to SEQ ID NO: 27842

SEQ ID NO: 56029 - DNA, 882 bp, Rhizobium loti; identical to SEQ ID NO: 27843
  CDS (1)..(882)

SEQ ID NO: 56030 - protein, 293 aa, Rhizobium loti; identical to SEQ ID NO: 27844

SEQ ID NO: 56031 - DNA, 963 bp, Rhizobium loti; identical to SEQ ID NO: 27845
  CDS (1)..(963)

SEQ ID NO: 56032 - protein, 320 aa, Rhizobium loti; identical to SEQ ID NO: 27846

SEQ ID NO: 56033 - DNA, 867 bp, Agrobacterium tumefaciens; identical to SEQ ID NO: 27847
  CDS (1)..(867)

SEQ ID NO: 56034 - protein, 288 aa, Agrobacterium tumefaciens; identical to SEQ ID NO: 27848

SEQ ID NO: 56035 - DNA, 1716 bp, Pseudomonas resinovorans; identical to SEQ ID NO: 27849
  CDS (1)..(1716)

SEQ ID NO: 56036 - protein, 571 aa, Pseudomonas resinovorans; identical to SEQ ID NO: 27850

SEQ ID NO: 56037 - DNA, 873 bp, Streptomyces coelicolor; identical to SEQ ID NO: 27851
  CDS (1)..(873)

SEQ ID NO: 56038 - protein, 290 aa, Streptomyces coelicolor; identical to SEQ ID NO: 27852

SEQ ID NO: 56039 - DNA, 900 bp, Streptomyces coelicolor; identical to SEQ ID NO: 27853
  CDS (1)..(900)

SEQ ID NO: 56040 - protein, 299 aa, Streptomyces coelicolor; identical to SEQ ID NO: 27854

SEQ ID NO: 56041 - DNA, 26 bp, Primer
atgtctgagcagtttttgtatttctt

SEQ ID NO: 56042 - DNA, 24 bp, Primer
ttatactttctctacctccgggcg

SEQ ID NO: 56043 - protein, 43 aa, consensus; identical to SEQ ID NO: 28576
  MISC_FEATURE (1)..(43): consensus for the disclosure of xaa see table XV

SEQ ID NO: 56044 - protein, 80 aa, consensus; identical to SEQ ID NO: 28577
  MISC_FEATURE (1)..(80): consensus for the disclosure of xaa see table XV

SEQ ID NO: 56045 - DNA, 1275 bp, Escherichia coli
  CDS (1)..(1275)
atggctgtgctgatttttctgggctgtctgttgggtggtattgctatcggtttgcctattgcctgggcactgttgttgtgcggggcggcgttaatgttctggctggacatgtttgatgtccagatcatggcacaaacgctggtgaacggagccgatagcttctccctgctggcgattccgttctttgtgctggcgggtgaaatcatgaatgcgggcggcttgtcaaaacgcattgttgacctgccgatgaaactggtggggcataaaccaggcgggctgggctacgtcggcgtgctggcagctatgattatggcgagcctttctggttctgccgttgcggataccgccgccgttgccgctctactggtgccgatgatgcgcagcgccaactatccggtcaaccgggcggcggggctgattgcctctggcggcattatcgcgccaattattcccccttccattccgtttattatcttcggcgtttccagcggattatccatcagtaagctgtttatggcgggcattgcccctggcatgatgatgggcgcaacgctgatgcttacctggtggtggcaggccagtcgccttaatttaccccgccagcaaaaagcaacgatgcaggaaatctggcactcttttgtctccggtatctgggcgctgtttcttccagtcatcattattggcgggtttcgctccggcctgtttacccctaccgaagccggggccgttgctgctttctatgcgctgtttgtcgccacagttatttaccgtgaaatgaccttcgccacactttggcatgtactcattggcgcggcgaaaaccacctcagtggttatgtttctggtggcctcggcacaagtttccgcctggctgattaccattgctgaactgccgatgatggtttctgatttactgcaaccgttggtcgattcaccgcgtctgctgtttatcgtcattatggtggctatcctgattgtcggcatggtcatggatttaacgccgacggtattaattcttaccccggtattaatgcctttagttaaagaggcaggaatcgatccgatttatttcggtgtcatgtttatcattaactgctcaatcggcttaattacaccgcctatcggtaatgtacttaacgttatttcaggggtggcaaaactcaaattcgatcgatgcagtcagaggcgttttcccttacgtcctggttttatattcattattagtcgtatttgtttttattcccgatctcatcatcctccctttgaaatggattaa

SEQ ID NO: 56046 - protein, 424 aa, Escherichia coli
MAVLIFLGCLLGGIAIGLPIAWALLLCGAALMFWLDMFDVQIMAQTLVNGADSFSLLAIPFFVLAGEIMNAGGLSKRIVDLPMKLVGHKPGGLGYVGVLAAMIMASLSGSAVADTAAVAALLVPMMRSANYPVNRAAGLIASGGIIAPIIPPSIPFIIFGVSSGLSISKLFMAGIAPGMMMGATLMLTWWWQASRLNLPRQQKATMQEIWHSFVSGIWALFLPVIIIGGFRSGLFTPTEAGAVAAFYALFVATVIYREMTFATLWHVLIGAAKTTSVVMFLVASAQVSAWLITIAELPMMVSDLLQPLVDSPRLLFIVIMVAILIVGMVMDLTPTVLILTPVLMPLVKEAGIDPIYFGVMFIINCSIGLITPPIGNVLNVISGVAKLKFDRCSQRRFPLRPGFIFIISRICFYSRSHHPPFEMD

SEQ ID NO: 56047 - DNA, 1284 bp, Thermotoga maritima MSB8
  CDS (1)..(1284)
atgatcatagttctcatcgcctttgctgtttttctgatgcttggaatgcctgttgcctttgctataggaatatccgggtttctctggtttctccaacatcctgaactacctatcaccattccgatacagagactgctttctcaaacggtgaatttcacgttgcttgctattcccatgttcattgtggctggaaatgtgatgaattctgctggagtgacgagaagactcctcgattttgcctccaccctcgttggtcacatgagaggaggactcggtcaggtttcagctgttctttccacgttgatgggaggagtttccggatccagtattgcagacgcagctatggaaacaaggatgctcggtccagagatgctcaaacgaggttatccaagaggtttcgcagttgccgtgaatgtctggacgtctctgatcaccccgatcattccccctggtatcgctttcatcatttacggtacgatcggtcaggtctctatagggaggctcttcgcagcaggaataggacccggtcttcttttgatgatcgtgtacatgatcaccatatggtttgttgccaaaagattgaatcttgcacccgaacgagagagacgagcaccggtaaatgaagttttcagatctctgggaaagagcatctgggctcttatgtttccggttttgctgattgtgggtctgagaggcggtatctttaccccttcagaggttggttccttcgcggttttgtacggaatgctggtgggattcataatacacagagagatgtctcttaaaaccttttactgggaaaccctggagaattctcttggtgatatcgggagtgtgatgttcatactttcgatgtctacaattttcggttacggtatgatctgggaaagaataccggaaaagctcgcggaatttctcctgggaatatcttccaatccaaacgttctgatgataatgatctctttattcttggtttttgccggtctgtttgtcgatgcaacggctttgattctcatgctcacggcaatcttgcttcctgtggcagaacaggtgggaatagatccagttcacttcggtctggtattcattttatccgctgctatgggtaaccagacacctcctgtaggtgcttctatgtacgcaggttgctcggtactcgatgcgactatggaagagtacatacaggcatcctggcctttcttgtttgtgacgatactggcgatacttatagtcatcttcttcccacagatcgtattgttcattccgaatctcatctttggatga

SEQ ID NO: 56048 - protein, 427 aa, Thermotoga maritima MSB8
MIIVLIAFAVFLMLGMPVAFAIGISGFLWFLQHPELPITIPIQRLLSQTVNFTLLAIPMFIVAGNVMNSAGVTRRLLDFASTLVGHMRGGLGQVSAVLSTLMGGVSGSSIADAAMETRMLGPEMLKRGYPRGFAVAVNVWTSLITPIIPPGIAFIIYGTIGQVSIGRLFAAGIGPGLLLMIVYMITIWFVAKRLNLAPERERRAPVNEVFRSLGKSIWALMFPVLLIVGLRGGIFTPSEVGSFAVLYGMLVGFIIHREMSLKTFYWETLENSLGDIGSVMFILSMSTIFGYGMIWERIPEKLAEFLLGISSNPNVLMIMISLFLVFAGLFVDATALILMLTAILLPVAEQVGIDPVHFGLVFILSAAMGNQTPPVGASMYAGCSVLDATMEEYIQASWPFLFVTILAILIVIFFPQIVLFIPNLIFG

SEQ ID NO: 56049 - DNA, 1284 bp, Vibrio cholerae O1 biovar eltor str. N16961
  CDS (1)..(1284)
atggttggttcaatttttggttggttaggattgttatttgcgggcatgccagtaggtttttcacttatttttgttgcattagctttcctcattctcaccaatagtacagggattaattttgcggctcagcaaatgctgggtgggatcgacaacttcacgttgctagccgttccattttttgtgttaactggccatctaatgaatagtgccggtattacagaaagaatcttcaacttcgcgaagtctctcgttggccatattacgggcagcttgggtcatgtaaatatcatggcaagcttgttgttctctggaatgtctggctcagcattggcagatgcaggtgggttaggtcagcttgaaatcaaatccatgcgtgatgcgaagtatcacgatgatttcgcgggcgggctgacagcggcatcttgcatcattggtcctctggtgccgccatcagtaccactagtcatatacggtgtggtttccaatacctctattggcgcattatttttagcgggtgcgatacctggtttgctgtgttgtattgccttgatggtgatgagttattttatctgcaaaaagcgcggatatatgacattgcctaaagcgagcagacgtgagcaatttaaatcacttaaagaagcatttttatcgttgctgacaccagtcattatcattggtgggatcttctctggtaaatttacgccaactgaagcggctgctgtttcatctctctacgcactatttttaggtacagttgtttataacacgctcacgttacaggggttcatcgaaattctgaaagaaacggtcaataccacagccgtggttgctctgatggttatgggcgtgactgtttttgggtggattgtggctcgcgaacagttaccacagatgttggctgattatttcttaacaatcagtgataacccactcgtactgcttctgttgatcaacttgttgctcctcttcttgggcacgtttattgagtcattggccttgctgttgctgctagttccattcttggtgccagtggcttcagcggtgggtatcgatcctgttcacttcggtgttatggcgattcttaacctaatgattggcattcttaccccaccaatgggaatggctttatatgtggtttctcgagtcggagatatcccattccatacgcttacgcgtggtgttttaccactactggtgccgctattcatcgtgttggcgctggtggcggtattccctcaatttactctgctactaccggaattattcctcggatacggacagtag

SEQ ID NO: 56050 - protein, 427 aa, Vibrio cholerae O1 biovar eltor str. N16961
MVGSIFGWLGLLFAGMPVGFSLIFVALAFLILTNSTGINFAAQQMLGGIDNFTLLAVPFFVLTGHLMNSAGITERIFNFAKSLVGHITGSLGHVNIMASLLFSGMSGSALADAGGLGQLEIKSMRDAKYHDDFAGGLTAASCIIGPLVPPSVPLVIYGVVSNTSIGALFLAGAIPGLLCCIALMVMSYFICKKRGYMTLPKASRREQFKSLKEAFLSLLTPVIIIGGIFSGKFTPTEAAAVSSLYALFLGTVVYNTLTLQGFIEILKETVNTTAVVALMVMGVTVFGWIVAREQLPQMLADYFLTISDNPLVLLLLINLLLLFLGTFIESLALLLLLVPFLVPVASAVGIDPVHFGVMAILNLMIGILTPPMGMALYVVSRVGDIPFHTLTRGVLPLLVPLFIVLALVAVFPQFTLLLPELFLGYGQ

SEQ ID NO: 56051 - DNA, 1362 bp, Vibrio cholerae O1 biovar eltor str. N16961
  CDS (1)..(1362)
atggccgttgcactgttatttattctggttatcggcatgatgattgttggcgtgccgattgctatctcgctgggcttgtccagtattttgttcctattgtggcactcggatgcttctttagcttcggttgctcaaaccctgtttaacgcgtttgctggtcactacactttattggcgatcccgttttttattctcgcctcaacgtttatgtctactggcggtgtggctaaacggatcatccgttttgcgattgctatggttggctggttccgcggcggtttagcgattgcttctgtggtcgcgtgcatgatgtttgcggcgctctcgggctcatctccggcaacggtggttgccatcggcagtatcgtgattgcgggcatggtcaaaaacggctacagcaaagagtttgcggcgggggtgatttgtaacgcaggaaccttgggtattttgatccccccttcgattgtgatggtggtgtactcagcggcgaccaacgtttcggttggccgcatgttcttaggtggtgttgtcccaggcttattggctggtctaatgttgatcatcgcgatttacattaccgcgcggataaaaaatctacccaagcagccctttgttggctggaaagaagcgctgaaagcagccaaagaagcaagctggggcttattgctggtggtgattattctcggtgggatctacggagggatctttaccccaacagaagcggcagctgtggcggcggtgtactccttttttatcgccaacttcatctatcgtgatatggggccgtttgcggataagaccaataccaaaccggtactagtcaaagtagtggaaacctttgtccacaaagacaccaaagcgaccttgtatgatgcaggtaagctgaccatcatgctgatgttcatcattgctaacgcgcttatcttaaaacatgtactcaccgaagagcgcatcccgcagatgatcactgaatccatgctgtctgctgggcttgggccaattaccttcttgattgttgtgaacctgatcttgttggtgggtggtcagtttatggagccatcgggtcttctggttatcgtcgctcccttggtattcccgattgcgattgcactgggcatcgaccctatccatctcggcatcatgatggtggtgaacatggagattggcatgatcacgccgcccgtcggcttaaacctgtttgtgacctctggggtagccaagatgtcgatgatgaatgtggttaaagctgcactgccgtgggtgggcgtcatgttcctcttcctcattattgtcacttatgtgccttgggtatccacttggttaccgacgctcttgatggggccggaaatcatcactcgctag

SEQ ID NO: 56052 - protein, 453 aa, Vibrio cholerae O1 biovar eltor str. N16961
MAVALLFILVIGMMIVGVPIAISLGLSSILFLLWHSDASLASVAQTLFNAFAGHYTLLAIPFFILASTFMSTGGVAKRIIRFAIAMVGWFRGGLAIASVVACMMFAALSGSSPATVVAIGSIVIAGMVKNGYSKEFAAGVICNAGTLGILIPPSIVMVVYSAATNVSVGRMFLGGVVPGLLAGLMLIIAIYITARIKNLPKQPFVGWKEALKAAKEASWGLLLVVIILGGIYGGIFTPTEAAAVAAVYSFFIANFIYRDMGPFADKTNTKPVLVKVVETFVHKDTKATLYDAGKLTIMLMFIIANALILKHVLTEERIPQMITESMLSAGLGPITFLIVVNLILLVGGQFMEPSGLLVIVAPLVFPIAIALGIDPIHLGIMMVVNMEIGMITPPVGLNLFVTSGVAKMSMMNVVKAALPWVGVMFLFLIIVTYVPWVSTWLPTLLMGPEIITR

SEQ ID NO: 56053 - DNA, 1305 bp, Bacillus halodurans C-125
  CDS (1)..(1305)
atggagctagccacacaagccgctttcttactgttcggagtctttttcctcctacttgccatcggtgtcccgatctccatcagcatcggattagcttcccttggagccgtcatcctcgtgatgccactggagacgatcgtgtttactgctgctcaacggatggtaggtggcattaatagtttcgcattactagcggtcattttctttattttgtcaggcagcattatgaacaatggagggatcgcgttaaggcttattaatttagcaaagttaatcgcgggtaggctgcctggttcgttagcacatacgaatgtagtcggaaatatgttgttcggttcgatctcaggatctgctgttgcctcggctgcggcgattgggagcgttatggctcctttgcaagcgaaagaaggatacaacaaagcatactctgccgcggtcaatattgcttcggcacctgtcggtttgctcatccctcctagtggtgttctgatcatttattcgcttgtgagcggagggacgtcgatttctgctctgtttatggctggatatttaccgggcatattaatggggcttgcggtcatggtcgtcgcgttctttatggcgaagaaaaacgattacacagtgtcggaaaaagtgagcggaaaagaagcaatcaaaattatttggcaagcgattcctagcttgttgttagtcgtcgtcgttatcggcgggattgtcgggggcgtgttcacagcgactgaaggggcagcagtagctgttttatactcactcgccctttcactcatataccgctcgctaacgtgggcccattttccgaaaattttaaaagagacaatcgtcatgactgggatcgtgctgttccttgtgggggcctcctccatcatgtcgtgggcgatggcggtcaccggacttcctgcggcaatcagtcaagcgattttaagcatttccgatcatacagttgtcgtattgttgatcatgatgcttacgttattggtgatcgggacgtttatggatttgacaccggcagttttgattttcacaccgatttttttaccgattgcgttacagatgggcatcgatcccgttcattttggcattatgcttgtgtttaacttagcgatcggcattatgaccccgccggtaggaagctgcttattcgtcgggtgtagtgtcggaaatgtatcgattgaagaagtgattaaaccgctactgttattctttgttgccctcgtggctgccttgtttatcgtcgtctatgttccagcaattagtttatttttaccagagctgttaggattgctttag

SEQ ID NO: 56054 - protein, 434 aa, Bacillus halodurans C-125
MELATQAAFLLFGVFFLLLAIGVPISISIGLASLGAVILVMPLETIVFTAAQRMVGGINSFALLAVIFFILSGSIMNNGGIALRLINLAKLIAGRLPGSLAHTNVVGNMLFGSISGSAVASAAAIGSVMAPLQAKEGYNKAYSAAVNIASAPVGLLIPPSGVLIIYSLVSGGTSISALFMAGYLPGILMGLAVMVVAFFMAKKNDYTVSEKVSGKEAIKIIWQAIPSLLLVVVVIGGIVGGVFTATEGAAVAVLYSLALSLIYRSLTWAHFPKILKETIVMTGIVLFLVGASSIMSWAMAVTGLPAAISQAILSISDHTVVVLLIMMLTLLVIGTFMDLTPAVLIFTPIFLPIALQMGIDPVHFGIMLVFNLAIGIMTPPVGSCLFVGCSVGNVSIEEVIKPLLLFFVALVAALFIVVYVPAISLFLPELLGLL

SEQ ID NO: 56055 - DNA, 1281 bp, Bacillus halodurans C-125
  CDS (1)..(1281)
atgacggccgctgtattatttggaagctttgcattgttactacttttaagtgtaccgatcgggattgcattagggttagcgacattattagctattctttattcagggacgattccgctcgaatttttagctcagggtttgattacatcggttgattctttcccgttaatggcagttccatttttcatattagcaggcgaaatcatggcgcgtggaggtgtgacagatcgactgttcaatgtggctaatgcccttgtcggcaatcgcacaggtggttttgcgatcgcaacggtgattacgtgtatgttcttcgccgcaatttctggatccggtccagcgacggtagctgcgatcggaggaattatgattccagctatggtgaaacatggatatgacaaacggtttgctactgctttagtggctgcagctggttcgttaggtgtgatcatacccccaagtattccaatggtcatttatggtgtatcggcgagtgcatcgatcggaggtttattcgtaggaggcattattcccggtttaatgattgcgggcgctttaatggcctatgcctactattattctcgtaaaaaagggtataaaggatctaccgaaaaaacatcgttcaaacacatcctccaatcggtctgggaggctaagtgggcgttagtcattccgttcattattcttggtgggatttacggcggcgtgtttaccccgacggaggcggccgttgttgccgttgtctatagtctccttgcaggtttcattttgtatagggagctcacgatcaaacagcttcctcgtgtgttcgcagatgctgctctcacaacagcgacaatcctaatcatcgttggctcggcaacagcgttcggtcgattgcttacgatcgaacaaattccgaatcaagtggctgattggatgttaacgatatctgaaaacaaaatcatattaattttattgatcacgattctcttacttgtggtaggctgttttatggatacattggcagcgattattattttgacaccaatcttacttcccattgctgtaacgttagggtatgatccgatccattttggcatgatcatggttgtcaacctggcgattggctttatcacaccgcctttaggagtgaacttgtttgtcgggtcaggaatctcgggaataagcatcgagtcgttatcaaaagcgattgtcccgtttttccttgtgatggttctgacactctttattctcgtatttgttccacaattaacgctttatttagtagagttacgaggctaa

SEQ ID NO: 56056 - protein, 426 aa, Bacillus halodurans C-125
MTAAVLFGSFALLLLLSVPIGIALGLATLLAILYSGTIPLEFLAQGLITSVDSFPLMAVPFFILAGEIMARGGVTDRLFNVANALVGNRTGGFAIATVITCMFFAAISGSGPATVAAIGGIMIPAMVKHGYDKRFATALVAAAGSLGVIIPPSIPMVIYGVSASASIGGLFVGGIIPGLMIAGALMAYAYYYSRKKGYKGSTEKTSFKHILQSVWEAKWALVIPFIILGGIYGGVFTPTEAAVVAVVYSLLAGFILYRELTIKQLPRVFADAALTTATILIIVGSATAFGRLLTIEQIPNQVADWMLTISENKIILILLITILLLVVGCFMDTLAAIIILTPILLPIAVTLGYDPIHFGMIMVVNLAIGFITPPLGVNLFVGSGISGISIESLSKAIVPFFLVMVLTLFILVFVPQLTLYLVELRG

SEQ ID NO: 56057 - DNA, 1269 bp, Bacillus halodurans C-125
  CDS (1)..(1269)
atgattgcagtgatgttagtcatcatgtttgttttacttgcgcttggtttcccgatgatgattcctatgctggcagcttcggcgatcgtgctctttctctttttttctcacgtggatccgatgatcttgatccagcaaatgatggaagggatctcatcgtttgtgctattagcggttccgctgtttatctttgcagctgacattatgtcaaaaggaaaaacatcgaaacggctattagactttgttggagctttcgtcggtcatatccgcgggggctatgcggtgacgaccgcgattacttgcgccctgttcgggtccatttctggttcgacgcaggcgacggttgttgccatcgggaaaccgatgcgggagcggctcttatcattaggttataaagattcaaaagcgattgcgctaatcataaatgctagtgacgttgccttactcattccaccgagcatcggcatgattatctatggacttgcagcacctaacgtatcggttggtgacttgtttattgccggcattggtccagggcttctcgtcatgttcatgtttgctgcgtatagttactaccatgcgaaaaagaataacattccccttgccgaacggttttcgtgggcagcacgaggacgggcaacggcaaaagcgctgttacccctcggatttccgatcattattatcggaggtatttatgcggggatctttagcccaactgaagcggctgggatatccgtgctctatgcactaattcttgaggttatcatttatcgctcgattaaactaaaagaaatcccgagcatcgctctatcgacaggacttgtgacggcggctgtttttattcttgtcgccgcaggtcaagcgttctcttggctcatttcctttgctgacattccgcgcacgttcacggacgttgtcttcagcaatgacccatcagccttgtatgttctgttgattgttgccctgtttttctttatcggttgtatgtttgtcgatcccatcgtcgtcatcttaatattgacaccgattttttatccggtggctatgcaagcaggggtcgatccaattcacttaggggtcgtcatcgttttccaagcggcgctcggctctgcgacaccaccatttggagttgatatttttactgcaagcgcggtgtttaataaatcgtacttagacgttattcggggaacaccaccgtatattgtgatgctgattattgcttcaatattaattatcgtgtttgaggagatttccttatttttgttgtaa

SEQ ID NO: 56058 - protein, 422 aa, Bacillus halodurans C-125
MIAVMLVIMFVLLALGFPMMIPMLAASAIVLFLFFSHVDPMILIQQMMEGISSFVLLAVPLFIFAADIMSKGKTSKRLLDFVGAFVGHIRGGYAVTTAITCALFGSISGSTQATVVAIGKPMRERLLSLGYKDSKAIALIINASDVALLIPPSIGMIIYGLAAPNVSVGDLFIAGIGPGLLVMFMFAAYSYYHAKKNNIPLAERFSWAARGRATAKALLPLGFPIIIIGGIYAGIFSPTEAAGISVLYALILEVIIYRSIKLKEIPSIALSTGLVTAAVFILVAAGQAFSWLISFADIPRTFTDVVFSNDPSALYVLLIVALFFFIGCMFVDPIVVILILTPIFYPVAMQAGVDPIHLGVVIVFQAALGSATPPFGVDIFTASAVFNKSYLDVIRGTPPYIVMLIIASILIIVFEEISLFLL

SEQ ID NO: 56059 - DNA, 1284 bp, Pasteurella multocida subsp. multocida str. Pm70
  CDS (1)..(1284)
atgaccgtcattgcactttttattttacttttcttattaatgttcctaggtgtgcccattgccatttctctcgggctatctggtgccattgtcatcatgctgtttagccaagattccttgagttcattagcaatcaaattgtttgaaacctcagaacattacacgttactcgctatccccttcttcttacttgctggtgcatttatgaccaccggtggggtggcaaagcgtttaattgattttgccaatgcaactgttggacacattcgcggtggtttagcgattgcctccgtcatgtcctgcatgttatttgccgcgttatctggttcgagcccagcaacagtggcagcagtcggttcaattgcgattgctggtatggttcgctcaggctatccgattggctttggtactgggattatttgcaatgcgggcaccttagggattttaattccgccttcggtcgttatggtcgtctatgctgccgcgacagaaacctcggtaggtaaacttttcatggctggtgttgtaccgggcttattactaggggttgcattgatggtggcaatctatattgtcgcacgcattaaaaatctgcctgcccaaccgcgtgccagtgtaaaagaatggttccgagccgcacgtaaggcgatttggggtttactcttaatggtgattatcctaggcggtatttatagtggtatcttcacaccgactgaagcggctgcagtggcggcagtttattcctttgttgtcgcggtatttatctacaaagacattaaattaagtgaatgtccacgcgtgttattagaatcgggcaaattgagcgttatgctaatgttcattattgctaacgcaatgctgtttgcccatgtattaaccaccgaacagattccgcaattaattactgaaaccgtgacgaaaatggaactctcaccttggatgttcctgattgtcgtcaatatcgtgttgctgattgctggtgcctttatggagccatctgcgattattttaattcttgcaccgattttattccctattgcagtacaactcggaatcgatccgattcatttaggggttatcatggtggtgaatatggaaatcgggatgattacaccgccaatcgggctcaacctctttgttgcttctgcggtgtctaaaatgccattaaccgcggtgattcgtgcagcaacaccatggttaatgctcttactcgccttcctcatcgctattacttatatcccagcgatttcaatggcgttaccaaattggatggggattcattaa

SEQ ID NO: 56060 - protein, 427 aa, Pasteurella multocida subsp. multocida str. Pm70
MTVIALFILLFLLMFLGVPIAISLGLSGAIVIMLFSQDSLSSLAIKLFETSEHYTLLAIPFFLLAGAFMTTGGVAKRLIDFANATVGHIRGGLAIASVMSCMLFAALSGSSPATVAAVGSIAIAGMVRSGYPIGFGTGIICNAGTLGILIPPSVVMVVYAAATETSVGKLFMAGVVPGLLLGVALMVAIYIVARIKNLPAQPRASVKEWFRAARKAIWGLLLMVIILGGIYSGIFTPTEAAAVAAVYSFVVAVFIYKDIKLSECPRVLLESGKLSVMLMFIIANAMLFAHVLTTEQIPQLITETVTKMELSPWMFLIVVNIVLLIAGAFMEPSAIILILAPILFPIAVQLGIDPIHLGVIMVVNMEIGMITPPIGLNLFVASAVSKMPLTAVIRAATPWLMLLLAFLIAITYIPAISMALPNWMGIH

SEQ ID NO: 56061 - DNA, 1281 bp, Pasteurella multocida subsp. multocida str. Pm70
  CDS (1)..(1281)
atgaccgtcgttattttcctttccgtcttattaggtgccattttattaggtattcccgttgcgtttgccctattattgtgcggtgtcgcattaatgttacatttagatttatttgatgcgcaaattcttgctcaacagctcgtcagtggtgcagacagtttctcgttaatggcgattccttttttcattttagccggtgaaattatgaatgaagggggcttatcaaaacggatcatcgatctgccaatgaaattggtcggacacaaacggggtggcttaggctttgttgccatccttgcggcaatgatcatggcaagtttatccggttccgccgtcgcagatacggcagcggttgcagcgatgttactgccaatgatgaaaaccacgggttatccgcttgatcgctccgcaggattaattgggacagcgggcatcattgccccgatcattccgccttcgattccgtttattattttcggtgttgccagcggtgtgtctattaccaagttattcttagcaggtatcgcaccgggcattctcatggggatttgtttaggggcgctttggtggtggcaagcgaaacgcttaaatctgatgaccttttcaaaagccacaaaagaagaactgtgtatttcctttaaaaatagtatttgggcgttgctactacccgtcattatcattggcggattccgctccgggattttcacgccgacggaagcaggggctgtcgctgcattttatgcgctagtcgtgtccttatttatctataaagagttgaaattcagacaattatatcgagtcattctcgctgctgggaaaaccactgccgtggtcatgttcttggttgcggctgcgcaggtcacaggttggctcatcactattgcggaattaccgcaaatgatgacggaattacttgaaccattaattgacacgccaaccctattattaatcgtgattatgatctctgtcttcgtcatcggcatggtgatggatttaacacctaccgtattgattttgacgcctgtgttgatgccattagtcgaagaagccggcatcgaccctgtttattttggtgtgctctttattttgaatacgtcaattgggcttattacaccacctgtcggcaatgtattaaatgtcatcaccggtgtatctaagttaccttttgatcaagcggctaaaggcatactcccgtatttatttatgatgattattttgctgttttcattcattttcttcccatcattgattttaacgccacttagctggctacaaccttaa

SEQ ID NO: 56062 - protein, 426 aa, Pasteurella multocida subsp. multocida str. Pm70
MTVVIFLSVLLGAILLGIPVAFALLLCGVALMLHLDLFDAQILAQQLVSGADSFSLMAIPFFILAGEIMNEGGLSKRIIDLPMKLVGHKRGGLGFVAILAAMIMASLSGSAVADTAAVAAMLLPMMKTTGYPLDRSAGLIGTAGIIAPIIPPSIPFIIFGVASGVSITKLFLAGIAPGILMGICLGALWWWQAKRLNLMTFSKATKEELCISFKNSIWALLLPVIIIGGFRSGIFTPTEAGAVAAFYALVVSLFIYKELKFRQLYRVILAAGKTTAVVMFLVAAAQVTGWLITIAELPQMMTELLEPLIDTPTLLLIVIMISVFVIGMVMDLTPTVLILTPVLMPLVEEAGIDPVYFGVLFILNTSIGLITPPVGNVLNVITGVSKLPFDQAAKGILPYLFMMIILLFSFIFFPSLILTPLSWLQP

SEQ ID NO: 56063 - DNA, 1293 bp, Pasteurella multocida subsp. multocida str. Pm70
  CDS (1)..(1293)
atgtcattcattcttttattagggacaatgtttttattaacagtttttggcttgccactattttatagtattatttttgcttcaattgtgacattgttttatttcttacctaatatccctgttacgattgttgcacaacaagtgatgcaagggttagacaccaatgcattacaagcactcgcatttttctttttagccggtgaactgatgagtgtgggcggcataactaatcgtattattcgatttgtcacctcgataattggtcgttggaaaggttctctggcatatatcaatattttctccagtttattttttggttctatcagtggctccgctgtggcatctactgccgcgattggaagctcattaatccctgaaatgaaaaaaagaggttatcccgcccctttttctgcagcattaacgcagtcggcttctatcattggtcccattattccgcctagtgtgccgatgattgtatttgctgcattagcaggagcaggtgtttccgttgggaagatgtttatgtctgggattattcctgggcttatgatcgcattaacattaattttaattacgttcatcatttcaaaaattaaaggctatggtaatcattcagtagaatttagcctcaaagaagttaaagaaagcgcgaaagatgcagtatgggcgttactctgtccgattatcattctctatggcattatttcaggtatttttacggcaacagaagcaggcgcagtttcggtcgtttatgcctatttaattggtacgtttgtttataaagaattaaatctggaacgattaaagaaagcttttatttcttctttaaaaggtaccattacagtaatgttaattgttggcgcgtcttctatttttgcgtggatgattgcgcgtttgcaaatcagccatcaagtcgcaagttgggtatcttctgtgtgcagtagcccattagaggcgcttattcttattaatgtgattgttctttttattggcatgataatggatcctaccgcggcattaaccattttagttcctgtatttatgccgatcgttaatcaatttggtatttcacctattcattttggattagttgttattttaaatctgatgataggtctcattaccccgcctgtcggttatttaatattcttgtcagcaaatatcgcagagtgtgaacccattaaggtattgaaagaaagtttaccttttttactgtcattactaggtttacttattttactcattttagtacctgaatttagtacattcttacccgatttattatttaaataa

SEQ ID NO: 56064 - protein, 430 aa, Pasteurella multocida subsp. multocida str. Pm70
MSFILLLGTMFLLTVFGLPLFYSIIFASIVTLFYFLPNIPVTIVAQQVMQGLDTNALQALAFFFLAGELMSVGGITNRIIRFVTSIIGRWKGSLAYINIFSSLFFGSISGSAVASTAAIGSSLIPEMKKRGYPAPFSAALTQSASIIGPIIPPSVPMIVFAALAGAGVSVGKMFMSGIIPGLMIALTLILITFIISKIKGYGNHSVEFSLKEVKESAKDAVWALLCPIIILYGIISGIFTATEAGAVSVVYAYLIGTFVYKELNLERLKKAFISSLKGTITVMLIVGASSIFAWMIARLQISHQVASWVSSVCSSPLEALILINVIVLFIGMIMDPTAALTILVPVFMPIVNQFGISPIHFGLVVILNLMIGLITPPVGYLIFLSANIAECEPIKVLKESLPFLLSLLGLLILLILVPEFSTFLPDLLFK

SEQ ID NO: 56065 - DNA, 1281 bp, Pasteurella multocida subsp. multocida str. Pm70
  CDS (1)..(1281)
atgattgcattcttagttttaattgcacttgttctacttgttatgattaatgtgcctatcgcagtagcaattggtattgtttcactcataggtatgttaattacaaatagttttgatgcaatatataacgtcgcactgtctgtttttgatggcgcctctaatttttcattacttgctattccgcttttcattttagcaggagcattaatgaatacagggggaatatcggttaggctgattaattttgttaatgctttaatcggcttcgtccgaggtgggcttgcaatggtcaatgtgggtgtttccatgatctttgctgaaatttccggatcttctgtagcggatgttgccgcactgggttctatcctcattcctgcaatgaaaaaaagaggttataaatcaagcttttctgctgctgttacttcatcatcggcttccttagcggtgattatcccaccctcacttcccatgattatttatggtgcgatggcggatgtttctatttctaagctttttgtggcaggacttgccgcaggtggtgtagcttcgttaggtatgtttgctgtatgttattattatgcggttaaatataatttaccgagggaagaacacttcagcatgtccaaattatgcacagcattcaaaaatgcgttctgggcgttaacgttacctgttctaattttaggtgggattatttcaggttttaccactgcaacagaagcggccggcttagctgtacttttagcattaatcattggttttttcatttacaaagagctcacactcaatgcagtatataaagcattggtagaaagtgtaaatggaacatccgttgtcatgctactggttgcgacgtcagctgttttgggattgtttttaacagaacagaaagtacctcaacaaatggctgcagcaattttaaatatctcggacaataaatatatcgttttaatgatgctaaatgtcatgttatttattgttggtatgtttttacatggcgcggcggccattattttagtcgtccctattgttatgcctctgattacacaattgggcattgatccgattcattttggtatcatcttaacgttaaacattgcagtgggtcagcaaacaccaccggtggcaagtgtattaatcacagcctcatctatcgcgaaaaaagatatttggagtgtcactaaggataatgtttggtttattgttgtattattaatttctttaatgatggtcacttatattcctgcattgacggttggtatggtggacctattctattaa

SEQ ID NO: 56066 - protein, 426 aa, Pasteurella multocida subsp. multocida str. Pm70
MIAFLVLIALVLLVMINVPIAVAIGIVSLIGMLITNSFDAIYNVALSVFDGASNFSLLAIPLFILAGALMNTGGISVRLINFVNALIGFVRGGLAMVNVGVSMIFAEISGSSVADVAALGSILIPAMKKRGYKSSFSAAVTSSSASLAVIIPPSLPMIIYGAMADVSISKLFVAGLAAGGVASLGMFAVCYYYAVKYNLPREEHFSMSKLCTAFKNAFWALTLPVLILGGIISGFTTATEAAGLAVLLALIIGFFIYKELTLNAVYKALVESVNGTSVVMLLVATSAVLGLFLTEQKVPQQMAAAILNISDNKYIVLMMLNVMLFIVGMFLHGAAAIILVVPIVMPLITQLGIDPIHFGIILTLNIAVGQQTPPVASVLITASSIAKKDIWSVTKDNVWFIVVLLISLMMVTYIPALTVGMVDLFY

SEQ ID NO: 56067 - DNA, 1905 bp, Pasteurella multocida subsp. multocida str. Pm70
  CDS (1)..(1905)
ttgggttgtcttgaggtatctatgaaaataataaataaattagaagagtggattggcggtgtgctattcattggaattttcttaattctgttagcacaaattattgctcgtcaagtgtttcagtcaccgtttatttggagtgaagaactcgcaagattgctatttatctatgtcgggctacttggtatcagcatgggtatccgtagtcaacagcatgtttatattgattttttaactaactttatgcccgagaaagtgagaaaggtgacaaactcctttgttcaagttctcatctttatttccatcattattttcattcatttaggctttaaagtttggctcgactccagttttaaaatggaagcgttaactgctttcgcttcagatttaattgggcgcgagacgattgtgcctgaaaaatggatgtatgcggcattgccttttatttcttgtttaatgttattccgctttttccaagcgcaagttgaaaattatagaaataagttaagttatattcctgtcacggcatttgtgattggtgcggtcattatttttgcgattttattgattgagccagattggtataaagtcctccgtatttcaaattatgtgaaatttggtagtgatgcggtgtatatcacattagtgatttggcttgtcattatgtttgtgggaaccccggtaggttggtcattatttattgcgacgttgctttattttgcgatgacgcgttggaatattgttaactcagcatcaaccaagctcaccgacagtttaaatagtttcccattgttgagtgtaccgttctttattttaaccggtattttaatgaatacgggcggaattacagaacgtatttttgatttcgcacgtgccttgctcggtcattaccgtggtggtatgggacacgtgaatatcggggcaagtttaattttctcaggtatgtctggttctgcacttgccgatgcaggtggtttaggccagttagaaattaaagccatgcgtgatgctgggtatgacgatgacatctgtggtgggattaccgctgcctcttgtattatcggtccattagtcccaccaagtattgcgatgattatctatggggttatttctaaccaatctattgcaaaattatttattgcgggttttattcctggtgtgctcgtgaccattgcgttaatgaccatgaactattatgtggcgaaaaaacgtggttatccaagaacacctaaagcgacccttgaacaacgttgccaggcatttaaaaaagccatttgggcggtgttaaccccaattttgattatcggtggtattttctctggtctctttacaccaacagaagccgcggtgattgcagccttctattccattattatcgggatgtttgtttaccgagagttgaatttacaaatgttgttcaaaagctgtattgaagcaatggcgattacaggggtaacagcattaatggtgatgacggtcactttctttggtgacatgattgcacgtgaacaagtggctatgaaaattgcagaagtctttgttgcagtagccgattcaccaacgatggtgttagtcatgatcaacctattgctcttgttccttggtatgtttattgatgctttagcattgcaattcttggtgttaccgatgttaattccaattgcggttcactttggcattgacttaattttctttggtgtcatgaccacattaaatatgatgattggtattttgactccaccaatgggaatggcattatttgttgtggcacgtgttggtaatatgccggtgagtacagtcgcaaaaggggttttacctttcttagtaccaatttttgtgacactggtgttgattacaattttcccacaaattatcacctttataccaaatcttctgatgccataa

SEQ ID NO: 56068 - protein, 634 aa, Pasteurella multocida subsp. multocida str. Pm70
MGCLEVSMKIINKLEEWIGGVLFIGIFLILLAQIIARQVFQSPFIWSEELARLLFIYVGLLGISMGIRSQQHVYIDFLTNFMPEKVRKVTNSFVQVLIFISIIIFIHLGFKVWLDSSFKMEALTAFASDLIGRETIVPEKWMYAALPFISCLMLFRFFQAQVENYRNKLSYIPVTAFVIGAVIIFAILLIEPDWYKVLRISNYVKFGSDAVYITLVIWLVIMFVGTPVGWSLFIATLLYFAMTRWNIVNSASTKLTDSLNSFPLLSVPFFILTGILMNTGGITERIFDFARALLGHYRGGMGHVNIGASLIFSGMSGSALADAGGLGQLEIKAMRDAGYDDDICGGITAASCIIGPLVPPSIAMIIYGVISNQSIAKLFIAGFIPGVLVTIALMTMNYYVAKKRGYPRTPKATLEQRCQAFKKAIWAVLTPILIIGGIFSGLFTPTEAAVIAAFYSIIIGMFVYRELNLQMLFKSCIEAMAITGVTALMVMTVTFFGDMIAREQVAMKIAEVFVAVADSPTMVLVMINLLLLFLGMFIDALALQFLVLPMLIPIAVHFGIDLIFFGVMTTLNMMIGILTPPMGMALFVVARVGNMPVSTVAKGVLPFLVPIFVTLVLITIFPQIITFIPNLLMP

SEQ ID NO: 56069 - DNA, 1284 bp, Pseudomonas aeruginosa PAO1
  CDS (1)..(1284)
atgaccgtgctgatcctgttcctgctgctgttcctgttcatgttcatcggcgtgcccatcgccatctccctggggctgtccggcgccctgacgatcctgctgttcagcccggattcggtgcgctcgctggcgatcaagctgttcgagacctccgaggcctacaccctgctggcgatcccgttcttcctgctctccggcgcgttcatgaccaccggtggcgtggcgcggcgcctgatcgacttcgccaatgcctgcgtcgggcatatccgcggcggcctggcgatcgctgcggtgcttgcctgcatgctgttcgccgcgctgtccggttcgtcgccggcgacagtggcggcggtcggctcgatcgctgtggccggcatggtccgctccggctatccgcgcgccttcggcgcggggatcatctgcaatgccgggaccctgggcatcctcatcccgccatcgatcgtgatggtggtctacgccgccgccaccgagacctcggtgggcaagctgttcgtcgccggggtggttccggggctgctgctcggggtgatcctgatggtggtgatctacatcgtcgcgcgggtcaagaagctgccggcgcagccgcgcgccagcttccgcgagtggctggccgccgcacgccgtgcaggctggggcctgttgttgctggtgatcatcctcggcggcatctattccgggctgttcacccccaccgaggcggcggcggtggcggcggtgtattcggccttcgtcgcgctgttcgtgtacaaggacatgcgcctgcgcgactgtcccaaggtgctgctggagtcggggcggctgagcatcatgctgatgttcatcatcgccaatgccatgctcttcgcccacgtgttgaccaccgagcagatcccccagcagatcaccgaatgggtggtgcaggaaggcctgaccccgatcggcttcctgctgatggtcaacgtggtgctgctggtcgccggcagcttcatggagccctcggcgatcgtgctgatcctggcgccgatcttcttccccatcgccatgaagctgggcatcgacccgatccacctgggcatcgtcatggtggtgaacatggagatcggcctggtacacccgccggtcggcctcaacctgttcgtcacttcggcggtcaccggcatgccgctgggggcgaccatccgcgcggcgctgccgtggctgatgatcctgctgctgttcctgatcctggtgacctacgtgccgttgatctcgctgtggctgccgggcctgctgggcatgagctga

SEQ ID NO: 56070 - protein, 427 aa, Pseudomonas aeruginosa PAO1
MTVLILFLLLFLFMFIGVPIAISLGLSGALTILLFSPDSVRSLAIKLFETSEAYTLLAIPFFLLSGAFMTTGGVARRLIDFANACVGHIRGGLAIAAVLACMLFAALSGSSPATVAAVGSIAVAGMVRSGYPRAFGAGIICNAGTLGILIPPSIVMVVYAAATETSVGKLFVAGVVPGLLLGVILMVVIYIVARVKKLPAQPRASFREWLAAARRAGWGLLLLVIILGGIYSGLFTPTEAAAVAAVYSAFVALFVYKDMRLRDCPKVLLESGRLSIMLMFIIANAMLFAHVLTTEQIPQQITEWVVQEGLTPIGFLLMVNVVLLVAGSFMEPSAIVLILAPIFFPIAMKLGIDPIHLGIVMVVNMEIGLVHPPVGLNLFVTSAVTGMPLGATIRAALPWLMILLLFLILVTYVPLISLWLPGLLGMS

SEQ ID NO: 56071 - DNA, 1281 bp, Pseudomonas aeruginosa PAO1
  CDS (1)..(1281)
atgatggccatcgccatgatcgcagccttcgtggtcaacctcctgctcggcctgccgctgttcctctgcctgctgctcaccgcgctggtggggttcctcttcgtcgacccggcgctgttcgccaacaccctgccgcagcgcttcttcggcggcatggacatcttctcgctgatggcgatcccgctgttcgtgctggccggcaacctgatgaaccattccggcatgaccccgcgcctgatgcgcctggccaacgccctggtcggccacttccgcggcggcctcggccacgtcaacgtggtcgccggggtgttcttcgccggggtcaacgggtccgccgcggccgacgcttcggcactcagcaccctgctggtgccggccatggaaaaggaaggctactcgcggcgcttcgccgccgggctgaccgcgggcagctcgctgatcggtccgatcatcccgccgagcatcttcatgatcctctactcctcgctgaccaacacctcggtgggcgagctgttcctcgccggggtgattcccggcctgctgctggccgccgccttcatgctgctgaacgcggtgtacgcctaccgcaacgggctgcaggcgcgccatgcggctccggcctggggcgagatcctggcggcgctgtccggcgccctgaccgcgctgatcgcgccggtgatcatcgtcgccggaatcgtcctgggactggtcacgcccaccgagtcgggcgccctgatcgctctctacgtggcgctggtcggtatgctccagcgccaactgaacctggtcgggctgtggaactcgctgcgcgagacggtacgcctgaccgccagcatctacgtgatcatcgccgccgcttcggtggtcaactggttgctcaactacgcccaggtcgccagcgagttcgcccagttgctggagccgttcggccactcgccgaccctgatgctgttcatcatcagcgcagtgatcttcgtctgcggcatgctcatggaagaagtctcggtactgatgctgctgacgccgatagtcgctccggtggcgctggccgccggcgtggatccggtgcacctggggctgatcttcaccctgaacatcaccatcgccctgatcaccccgccaatgggcgcctgcctgttcatcgtggcgaccatcagccgcctcgatatcctggaaatgttcaagggtatctggccgttcatcctcgtggccctgggggtgctgtcgctgctgatcctgttcccgtccctgaccctgtggctgccacgcctgctcaattga

SEQ ID NO: 56072 - protein, 426 aa, Pseudomonas aeruginosa PAO1
MMAIAMIAAFVVNLLLGLPLFLCLLLTALVGFLFVDPALFANTLPQRFFGGMDIFSLMAIPLFVLAGNLMNHSGMTPRLMRLANALVGHFRGGLGHVNVVAGVFFAGVNGSAAADASALSTLLVPAMEKEGYSRRFAAGLTAGSSLIGPIIPPSIFMILYSSLTNTSVGELFLAGVIPGLLLAAAFMLLNAVYAYRNGLQARHAAPAWGEILAALSGALTALIAPVIIVAGIVLGLVTPTESGALIALYVALVGMLQRQLNLVGLWNSLRETVRLTASIYVIIAAASVVNWLLNYAQVASEFAQLLEPFGHSPTLMLFIISAVIFVCGMLMEEVSVLMLLTPIVAPVALAAGVDPVHLGLIFTLNITIALITPPMGACLFIVATISRLDILEMFKGIWPFILVALGVLSLLILFPSLTLWLPRLLN

SEQ ID NO: 56073 - DNA, 1464 bp, Agrobacterium tumefaciens str. C58
  CDS (1)..(1464)
gtggctattccgttctggaacggccagaagaattccagagcgcgggggattgatcacatgttgcttctcatcagctcattccttcttctgatgctgatcggccttccggtcgccatttccatggcctcggcttcgctgctctacatcgtcttttataatgtcgcgcctgatatcatcgcggcgcagcgcctgattgcgggtgtggaaagcttcccgctcctagcggttcccttcttcatccttgccggcaatctcatgaatacggcaggtgtaacgggacgtatctattccttcgctgtcgcgctcgtcggctggatgaagggcggcctcgcgcaggtcaacatcatcggttcggtgatcttttccggcatgtccggcaccgcactggccgatgctgccggcatcggcaccatcgaaatcaaggccatgaaggatcatggttatccggtcgaggcggccgtcggcgtcaccgccgcttccgcaacgctcgggccgatcttcccgccgtccctgcccttcgtcatctacggcatgatggcgaatgtctcgatcggtgcgctgttcatggccggcatcgttccgggcgtcgtcatgacgctgctgatgatgatcacggttgcggtctttgcctatatcaagggctggggttccgatacgccgtttaatctcaggacaatcttcggcgcatcgcttgaagtcctcgttgtcatgatggtgccgctcggcatctatatcctcacggcatttggcctgtcgctcaacctgtcgatcctgatcgtgctggtcatcctgcttgcctgcgactggtatttcgatttctccgccgtcatggcgctgatgacgccggtgatcctgatcggcggcatgacgatgggttggtttacaccgacggaggcagccgttgcggccgttctctggtcgctgttcctcggcctcgtccgttatcgcacgatgaccttcaagacgctggcgaaatcgaccttcgacaccatcgagacgaccgcatcggtgctcttcatcgttgcggcagcctcggtcttcgcatggttgctgacggtcagtcaggcggcacagcttctgtcggcggcgatcctgacgatcactgacagcaagtggattttcctcgtgctggtcaacctgttgatgctgttcgtcggctgcttcctcgacacgattgcggctatcaccatcctcgtgccgatccttctgccgctggtgctgcaattcaacatcgatccggtgcatttcggcctcatcatcacgctcaacctgatgatcgggctgctgcatccaccgctcggcatggtgctgttcgtgctctcgcgcgtggcgaaactctcggtcgagcgcacgaccatcgccatcctgccctggctggtgccgctattcgtggcgctgctgctgatcaccttcattccggcaatcaccttgtggctgccgaccgaaatgggcctgatccgctaa

SEQ ID NO: 56074 - protein, 487 aa, Agrobacterium tumefaciens str. C58
MAIPFWNGQKNSRARGIDHMLLLISSFLLLMLIGLPVAISMASASLLYIVFYNVAPDIIAAQRLIAGVESFPLLAVPFFILAGNLMNTAGVTGRIYSFAVALVGWMKGGLAQVNIIGSVIFSGMSGTALADAAGIGTIEIKAMKDHGYPVEAAVGVTAASATLGPIFPPSLPFVIYGMMANVSIGALFMAGIVPGVVMTLLMMITVAVFAYIKGWGSDTPFNLRTIFGASLEVLVVMMVPLGIYILTAFGLSLNLSILIVLVILLACDWYFDFSAVMALMTPVILIGGMTMGWFTPTEAAVAAVLWSLFLGLVRYRTMTFKTLAKSTFDTIETTASVLFIVAAASVFAWLLTVSQAAQLLSAAILTITDSKWIFLVLVNLLMLFVGCFLDTIAAITILVPILLPLVLQFNIDPVHFGLIITLNLMIGLLHPPLGMVLFVLSRVAKLSVERTTIAILPWLVPLFVALLLITFIPAITLWLPTEMGLIR

SEQ ID NO: 56075 - DNA, 1869 bp, Sinorhizobium meliloti 1021
  CDS (1)..(1869)
atgaccaccacgacggagggcgtttccgaattcgccgtgctcgcagagacgatggaggcccggccgggttcgcggctgatgcgccccgtcgaagcgctatccgccgttctgcttgtggcgatcatcgccatgctgctctccggcgtggcttttcgctatggcctgtcgagaccgatcgtctggatcgatgaagcggcgtcgatcgctttcctgtggctggccatgctgggttcggccatcgcgatcgaccgttgcgagcatctgcgtctgacaatccttctcaatgctctcggcgaaagggcgcggcagttcaccgaaacgctcggcatggtcgccatcatgtcgttccttctcgtcctgctgccggcagcttacacctatgccgccggcgaaatggacatcacttcgtcggcattgaacatcccggcgggttatcgcgccgcggccattgcagtcggcatggtcctcatggtgctgctggccgtcgctcaattgctcagaaccgccaagccgctcgacgtggtggtttcagtggcgttcgtgctcgcggttgctttggtgctctggttgctgacgcctgcgctcagcgcgttcggcaacggcaacattcttatctttctcgtcggcggtgccgccgtctgcctcgcgatgggcgttccgatcgccttctgcttcggcattgcgacgcttctgtttctcgccttcacgacatcgatgccgctggtggtcatgatcggccgcatggatgagggcatgtccagcctcattctgctttcggtcccggtcttcgtgcttctcggctgcattctggacgcgaccgggatgggcaaggcgatcgtcgatttccttgcctccatgctcggccacgtcaaggccggcatgtcctacgttctgttgggctcgctctttctcgtgtccggaatttccgggtcgaaagtctcggacatggcaacggttgccccggcgctgtttccggaaatgaagcgccgtggtcacaagccgaaggagatgatagcgctcctggcgaccggggccgccatggccgacaccgtaccgccgagcatcgtgctgatcgttctcggctcggtggccggcgtgtcgatcgcggcgctgttcaccagcggatttgccatcgcactcgtgctgctggtcgcgcttgccgcgcttgcacgcatcaaggcagcccgcgaaaatgtcgacggcgtcgtgcgcccgtcgctgaaacgcatcggcggcacggcgctgatcgcggcgccggccctggtgctgccgttcatcatccgcagcgccgtcgcgagcggtgcggcgaccgcgaccgaggtctcgaccatcgcggtcgtctacgccttcatcatcggcactgtcctttatggcggcatcggcatgcggcgaacctacaggatgctggtcgagaccgccgcgatgagcggtgcgatcctcctgatcctcggtaccgccgcggcgatggcctgggcgctcacccagaccggattcgccttcgagctcaccgacatgatgagcggcctgccgggtggatggttcaccttcatgctggtctcgatcgccctgttcatgctgctcggctgcgtgctcgaaggcctccctgcgatcgtgctcctggcgccgatcatgtttccgatcgcgcgtgcgatggggatccatgacgtccactattccatggtcatcgtcaccgcgatgaacgtcggactgatggcaccgccgatcggcatcggcttctacatcgcctgcaagatcggcaacgtttcgcccgacgaggccatgggagcgatctggccctatatcggcgcgatggtgctcggcctcttgctgatcgccgccgtgccctggttctcgctcgcattgctgtga

SEQ ID NO: 56076 - protein, 622 aa, Sinorhizobium meliloti 1021
MTTTTEGVSEFAVLAETMEARPGSRLMRPVEALSAVLLVAIIAMLLSGVAFRYGLSRPIVWIDEAASIAFLWLAMLGSAIAIDRCEHLRLTILLNALGERARQFTETLGMVAIMSFLLVLLPAAYTYAAGEMDITSSALNIPAGYRAAAIAVGMVLMVLLAVAQLLRTAKPLDVVVSVAFVLAVALVLWLLTPALSAFGNGNILIFLVGGAAVCLAMGVPIAFCFGIATLLFLAFTTSMPLVVMIGRMDEGMSSLILLSVPVFVLLGCILDATGMGKAIVDFLASMLGHVKAGMSYVLLGSLFLVSGISGSKVSDMATVAPALFPEMKRRGHKPKEMIALLATGAAMADTVPPSIVLIVLGSVAGVSIAALFTSGFAIALVLLVALAALARIKAARENVDGVVRPSLKRIGGTALIAAPALVLPFIIRSAVASGAATATEVSTIAVVYAFIIGTVLYGGIGMRRTYRMLVETAAMSGAILLILGTAAAMAWALTQTGFAFELTDMMSGLPGGWFTFMLVSIALFMLLGCVLEGLPAIVLLAPIMFPIARAMGIHDVHYSMVIVTAMNVGLMAPPIGIGFYIACKIGNVSPDEAMGAIWPYIGAMVLGLLLIAAVPWFSLALL

SEQ ID NO: 56077 - DNA, 1260 bp, Sinorhizobium meliloti 1021
  CDS (1)..(1260)
atgaccgcgatcatgaccggcctcttcgccgcattgctggccatctcggttccagtcggttacgcgctgatcatcgctgcgggcgcagcgatcctatggcagggcggaacgccaaccgtgctggcggtggtgaagctgttccagccgacccagagctttccgctgctcgcgataccctttttcatcctgtccggctcactcatgatgtcaggcacgcttggccagaaactcgtgcagttcgcggcagcactcgtcgggcggttccacggcggaatgggtcaggtcacggtcgtcggatccacgatcttcggcggtgtctccggctcggcagtcgccgaagcctccgcgctcggatcgatgctgatcccctggcagaagaaagaggggtatccggcaggctttgcggcggccgttaccgcctcttcctcgaccatcgccggcctgatcccgccgtccattcccctgatcctcttttcgacggtggcaaattcctcgatcgcatcgctgttttcggctgcagtcctgccgggattgatgctcgccggcgggatgatgatcgtttgctacctgtccgggcgcattcggaacttcccccgcctgacggatgccgggcagttgaagtccttcggccgatctatgctgtcggcactgccggcactggccatgccgttcttcatcatcctgttgctgcgggcggggattgcaacgccgaccgaagtcagcgtgatcgccgtcttctatgcgctgctggtgagcctgctgctctatcgggacctgacctgggagcggatctacgcagccctggtcggaaccgtgatcaccaccggcgtcgtcatgctggtcatcgccgcatcgagcctcgtcggccacgtcctcattaccgagcgtgtgcccaccatcgtggccaactgggcactggaaacgctcggaagcgccatcctgatcatcctcatgatgaatctcatcatgctggtggtggggatgtttctcgacctgcccgcggcaatcctgctgctcgggcccaccttcgtcgccatcggtcatgcaatcggcatggacccaatccagctcggcgtgatgatctgcatcaatctttcgatcggactgtttacgccgccgatcggaaccacgcttttcattggcgccgtgatcgcccgcgtgccgatcggggctgtggtcaaggagttgtggcccttctacatcgttgcagcagccgtcctggtgctgatgtcatatgttcccgctctgacgatctactga

SEQ ID NO: 56078 - protein, 419 aa, Sinorhizobium meliloti 1021
MTAIMTGLFAALLAISVPVGYALIIAAGAAILWQGGTPTVLAVVKLFQPTQSFPLLAIPFFILSGSLMMSGTLGQKLVQFAAALVGRFHGGMGQVTVVGSTIFGGVSGSAVAEASALGSMLIPWQKKEGYPAGFAAAVTASSSTIAGLIPPSIPLILFSTVANSSIASLFSAAVLPGLMLAGGMMIVCYLSGRIRNFPRLTDAGQLKSFGRSMLSALPALAMPFFIILLLRAGIATPTEVSVIAVFYALLVSLLLYRDLTWERIYAALVGTVITTGVVMLVIAASSLVGHVLITERVPTIVANWALETLGSAILIILMMNLIMLVVGMFLDLPAAILLLGPTFVAIGHAIGMDPIQLGVMICINLSIGLFTPPIGTTLFIGAVIARVPIGAVVKELWPFYIVAAAVLVLMSYVPALTIY

SEQ ID NO: 56079 - DNA, 1281 bp, Caulobacter crescentus CB15
  CDS (1)..(1281)
atggaactgacccttctgctcgggctgctggcccttctgctgatcatcggcgtgcccgtggccttcgctctcggcctggcgtcgcttgtgaccttcatcttcatggacatcgcaccggtggtcgccttccagcggatcgccacaggcgtgaacgtcttctcgctgatggccattccgttcttcatcttcgccggggacttgatgcagcaggcggggatcgccgaacggctggtccgggtcgccgacgccgccatgggccggattcgcggcggactgggcgtcgtcgacgtgggcgcgtcgatgatgttcggcggcgtgtcgggatcggccgtcgcctcggtctcggccctcggctcgaccctcatcccgctgatgaaggaaaaaggctatgacgccgactatgcggtgaatgtcacctccacctcggcgatcctcggtatcctgatcccgccgtcgcacaacatgatcatctatgcggcggcggccggcgtgtcggtctcggtcgcggatttgtttctggccggcgtcctgcccggcatcctgaccggtatctttctggccgccgcagcctggatcatcgccgtgaggcggggctatccgaagggcgagtttccgggctggccggccttcgccgccgccttcgcctccgccttgccgggcctgctgaccgccgtgatcatcttcggtggcgttctgggcggggtcttcaccccgaccgaaagctcggccgtcgcggtgatctacaccctcgtgatcgccgtgatcgtctatcggacgctgggcttccggggcttcacgacggccgctcagaacgcggtcaagaccaccgccatggtcatgttgatcatcggttcggcggccgccttcggctggttgctggccctgctggaagctccggaacagctggcgaccctgttgcagaccctgaccgacaatccgatcctgatcctgctgctgatcaacctgatcctgttgatcctcgggactttcatggacatggcgccgctgatcgtcatcaccagcccgatcttccttccggtcgccatggcgactgggatggacccggtccagttcggcatcatgatgatgctgaacctcgggatcggcctggtcaccccgcccgtagggtcggtgctgttcgtgggatgcgcggtcggcaagatcaaggtcgagcaggcggtccgcaccatctggcccttctacctggctctgttcgccgccttgatggcgatcaccttcgttcccgccctgaccctgaccctgccgggcctcgccggttga

SEQ ID NO: 56080 - protein, 426 aa, Caulobacter crescentus CB15
MELTLLLGLLALLLIIGVPVAFALGLASLVTFIFMDIAPVVAFQRIATGVNVFSLMAIPFFIFAGDLMQQAGIAERLVRVADAAMGRIRGGLGVVDVGASMMFGGVSGSAVASVSALGSTLIPLMKEKGYDADYAVNVTSTSAILGILIPPSHNMIIYAAAAGVSVSVADLFLAGVLPGILTGIFLAAAAWIIAVRRGYPKGEFPGWPAFAAAFASALPGLLTAVIIFGGVLGGVFTPTESSAVAVIYTLVIAVIVYRTLGFRGFTTAAQNAVKTTAMVMLIIGSAAAFGWLLALLEAPEQLATLLQTLTDNPILILLLINLILLILGTFMDMAPLIVITSPIFLPVAMATGMDPVQFGIMMMLNLGIGLVTPPVGSVLFVGCAVGKIKVEQAVRTIWPFYLALFAALMAITFVPALTLTLPGLAG

SEQ ID NO: 56081 - DNA, 2601 bp, Sinorhizobium meliloti 1021
  CDS (1)..(2601)
atgttttccggcatcgccaatctggcctatgtgtcgatcccgatgttcgtcctcatgggcgcggctgttgcctcttcgccggccggatctgatctctacacctcgctcgaccggtggctgaaccgcatcccgggggggctcattctgtccaatatcggagcttgcgccatcttctccggcatgactggctcttcgcccgcgacctgcgcggcgatcggcaaaatgggcattccggaaatgatgcggcgcggctatcccgcttcggtcgcgagcggctccatcgccgccggcggcacgctgggcattctcattcccccttcggtgacgctgatcgtctacggaatagcgaccgagacctccatcgggcggttgttcatggcggggatcctgccgggtattttgctgacgatcatgttcatgacctgggcggtcatcgattgcaaacgcaagggctacgaattcgaggcacgcctcgttcgctactcgatgaaggaacggctggccgtccttccgcgcatcctgccgttcctgctgatcatcgccggcacgctctacgtactctatggcggtatcgccacgccttctgaagcagccggtgcgggcgcgttcctgacattggcagtcgtgatcgtcgcctatcgcttgttccgctttcggcccgtcgctggcatcttcgggtcggcaatgaaggaaagcgtcatgatcatgatgatcatggctgctgccgagctcttcgccttcgcgctgtcgtcgctgttcatcacacagaccgtcgccgcagcgatcgcggacatggaggtcaaccgttgggtgctgatggcggtcatcaacgtctttctgttgatctgcggcatgttcctgccccccgtcgccgtcatcgtgatgacctcgccgatgctcttcccgatcgtcacccaggcgggtttcgacccctactggttcgcgatcgtgctgacgatcaacatggaggtcggcctgatcacgcctccgatcggcctcaacctttttgtgatcaatgccatcgcgccgcagattccgacgaaggacattctctggggctcactgccttacgtgctcgttatgttcctggcgatcattctcctctgcgtctttccagacgttgcgacgtggctgccgaaccagatgctgggggaccgtccaatgaacacgacgtcttttttcagcgacatgctgcagagcattgccgagcgcggccggcgattcctgtcgctcggtccggcccgaaacggcgatgtcaatccggtcggcaccatggaagcgctctgcgacacgctgctgtcgagccggggcgaggcgtcgggcatggcgctggccaagaacattctggatcgctggcaaggcttcgatcaggacaagcggcgcgatttcatgttggcgctgctctctcgtttcggccctgatatcgaacggctggagcgggcgatcgacgcctatcgcgccgatccgacgccgaaggcgctgctcgagatgagcatggcggcagaaccgcgccgccaggaattgatccgcaggctcaaccttgcgccgaacggcatcgcgaccctcgtccgcatgcgggcggacctcctcgaacttaaagcccaaaaccccgatctggaggcggtcgatacggacttcgcgcatctcttcggatcctggttcaatcggggcttcctcgtgctgcggccgatcagctggtcgacgccggccgacattctggaaaagatcattcgttacgaggccgtccatcatatcggcggctgggacgagttgcgccggcggcttgcgccggaggaccggcgctgcttcgccttctttcatccgcagctggtcgacgacccgctgatcttcgttgaagtggcgctgacacgcgaaatgcctcccaacatcgcggacctgctgaaggaggatcgtgctccgatccgcgctactgacgcgacgacagccgtcttctattccatttcgaactgtcaggaaggcctcaggggcatctccttcggcaacttcctgatcaaacaggtggtggaggatctgcggcgcgacctccctcgcctcgacaccttcgtgacgctgtcgccggtgccgggctttgccgattggttgtcgcgcgaacgccaggcggaaacgtccaacgccctgtcggccgccgatcgcagcaggctcgcggcgctcgacgagcctgattgggccgatcagccggagatcgcggcagccatccagccaagccttaccgctgcggccgcctggtatttcctcagggctcgcaaccgcaacggcaagacagttgatcccgttgcccggttccatctcggcaatggcgcgcggctggaacgcatcaatttcctaggcgaccggtccgaacgggccatgcgccaggcccacgggctgatggtcaactatctttacaagctcgacgacatcgagacgaaccacgaggcatttgcaacccgtggcgaggtcgtcgccgcacccgcgatccgccggctgatcccggccgacagaagttcacgtagcctcgttccgggtccgaacgtgtttcccccgggcgtccgatcagctgacgcaccaggaaggaagggtgacaaggagttcacttcatga

SEQ ID NO: 56082 - protein, 866 aa, Sinorhizobium meliloti 1021
MFSGIANLAYVSIPMFVLMGAAVASSPAGSDLYTSLDRWLNRIPGGLILSNIGACAIFSGMTGSSPATCAAIGKMGIPEMMRRGYPASVASGSIAAGGTLGILIPPSVTLIVYGIATETSIGRLFMAGILPGILLTIMFMTWAVIDCKRKGYEFEARLVRYSMKERLAVLPRILPFLLIIAGTLYVLYGGIATPSEAAGAGAFLTLAVVIVAYRLFRFRPVAGIFGSAMKESVMIMMIMAAAELFAFALSSLFITQTVAAAIADMEVNRWVLMAVINVFLLICGMFLPPVAVIVMTSPMLFPIVTQAGFDPYWFAIVLTINMEVGLITPPIGLNLFVINAIAPQIPTKDILWGSLPYVLVMFLAIILLCVFPDVATWLPNQMLGDRPMNTTSFFSDMLQSIAERGRRFLSLGPARNGDVNPVGTMEALCDTLLSSRGEASGMALAKNILDRWQGFDQDKRRDFMLALLSRFGPDIERLERAIDAYRADPTPKALLEMSMAAEPRRQELIRRLNLAPNGIATLVRMRADLLELKAQNPDLEAVDTDFAHLFGSWFNRGFLVLRPISWSTPADILEKIIRYEAVHHIGGWDELRRRLAPEDRRCFAFFHPQLVDDPLIFVEVALTREMPPNIADLLKEDRAPIRATDATTAVFYSISNCQEGLRGISFGNFLIKQVVEDLRRDLPRLDTFVTLSPVPGFADWLSRERQAETSNALSAADRSRLAALDEPDWADQPEIAAAIQPSLTAAAAWYFLRARNRNGKTVDPVARFHLGNGARLERINFLGDRSERAMRQAHGLMVNYLYKLDDIETNHEAFATRGEVVAAPAIRRLIPADRSSRSLVPGPNVFPPGVRSADAPGRKGDKEFTS

SEQ ID NO: 56083 - DNA, 1278 bp, Sinorhizobium meliloti 1021
  CDS (1)..(1278)
atgacccttgtcgtcttcatcgtttcgctgctcggcgccatggcaatcggcgtgccggttgccttctcgctgatgttctgcggcgtcgtgctcatgtggtacatgggcatgttcaatacccagatcatcgctcaaaacatgatcgcgggcgccgataccttcacgctcctcgccatcccgttctttattctcgccggtgaattgatgaacgccggcggattgtcgcggcgcatcatagatttcgcaatcgcctgtgtcggtcatatacgcggcggtctcggcatcgttgccatcatggcggccgtgatcatggcaagtatctcgggttcggcggcagccgacactgcggcacttgcggcgatcctgatcccgatgatggcgaaggccggttacaacgttccccggtccgcgggcctcatcgctgcaggtggtgttatcgcccccgtcattccgccatccatggccttcatcgtgttcggggtggcggcaaacgtctcgattacgcagctcttcatggcaggcatcgtgcccggactcatcatgggtattgcccttgtcgcaacgtggctgctggtcgtgcgcaaggatgatatccagccgcttccacgcacgccgatgaaagagcgggtcggcgccaccgggcgggcgctttgggctcttggcatgccggtgatcatcctcggcggcatcaaggccggtgtcgtgacgccgaccgaagccgccgtggtcgccgcagtctatgcactcttcgtcggcatggtcatctatcgggaactcaagccgcgtgacctgccgggtgtcatcctccaggcggcgaaaaccaccgctgtgatcatgttcctcgtttgcgctgcgcttgtttcctcgtggctgataactgcagcgaatataccatcggaaatcaccggcttcatctctccgctgatcgaccgcccgacgcttctgatgttcgtcatcatgctggtcgtattggtggtgggcacagcactcgaccttacgcccaccatcctgatcctgacgccggtgctcatgcccattatcaagcaggccggaatcgatcctgtctatttcggtgtcctgttcatcatgaatacctgcatagggctgctgaccccacccgtcggcgtcgtattgaacgtcgtcagcggcgtcggccgggttccgctcggcaaggtaattgtcggcgtgacgccattcctggtcgcccagatactcgtgcttttccttctggtcctgttcccggacatcgtcatcgtgcccgcacgctggctgcattag

SEQ ID NO: 56084 - protein, 425 aa, Sinorhizobium meliloti 1021
MTLVVFIVSLLGAMAIGVPVAFSLMFCGVVLMWYMGMFNTQIIAQNMIAGADTFTLLAIPFFILAGELMNAGGLSRRIIDFAIACVGHIRGGLGIVAIMAAVIMASISGSAAADTAALAAILIPMMAKAGYNVPRSAGLIAAGGVIAPVIPPSMAFIVFGVAANVSITQLFMAGIVPGLIMGIALVATWLLVVRKDDIQPLPRTPMKERVGATGRALWALGMPVIILGGIKAGVVTPTEAAVVAAVYALFVGMVIYRELKPRDLPGVILQAAKTTAVIMFLVCAALVSSWLITAANIPSEITGFISPLIDRPTLLMFVIMLVVLVVGTALDLTPTILILTPVLMPIIKQAGIDPVYFGVLFIMNTCIGLLTPPVGVVLNVVSGVGRVPLGKVIVGVTPFLVAQILVLFLLVLFPDIVIVPARWLH

SEQ ID NO: 56085 - DNA, 1281 bp, Sinorhizobium meliloti 1021
  CDS (1)..(1281)
atgaccatatcgatcttcctcggcgcccttctcggacccatggcgctcggcgtgccgatcgccttcgccctcattctgagcggcgtggcgctgatgctctatctcggcctgttcgatgcccagatcgtggcgcagaacgtgctgaacggagccgacagcttcccgctgatggccgttcccttcttcctgcttgccggcgaggtcatgaatacgggcggcctctcccgccgcatcgtcgcgcttgccatggccatggtcggccacatccgcggcgggctcggcttcgtcgcgatcttcgcggcctgcattctctccagtctttccggctcggcggtcgccgatgcagccgcactcggcgcactgcttctgccgatgatgctgaaaagcggccacgacccggcgcgcgccagcgggctcatcgcctccgcctcgatcatcggcccgatcataccgccctcgatcggcttcatcctcttcggcgtggtcggcggcgtctccatcaccaagcttttcctcgccggcatattcccgggactgatgatcgccgcggccctttcgatcacctggctgatcgtcgcccgcaaggagcagttcgaactaccgccgcggcagagcggcaggctgcggctcagggccttcgtcgacagcctctgggcgcttttcctgcccgtcatcatcatcgccggactgaagttcggcgtcttcacaccgacggaggcgggtgtcatcgccgccgtctattcgctcttcgtttcgatggtcgtctatcgcgagctggcgccggcgcaactcttccacgtcttcgtctcggccgcgaagatcagcgccgtcgtgatgttcctcgtcgcctgcgcggcggtttcggcctggctgatcaccgttgccgacgttcccggcgcgctcgccgcactcctcgagcccctgatgggcaaccagacggctctgcttatcgcgatcatggttttgatcgtgatcgtcggcaccgcgatggacatgacgccgacgatcctgatcatgacgccggtcctgatgccggtcatcaagcaggcggggatcgatccggtctatttcggcgtgctcttcatcatcaacaactcgatcggcctgatcaccccgccggtcggcaccgttctgaacgtcatctgcggcgtgtcgaagctttcgatggaggatctgatgaagggcgtgatgcccttcctcttcgcggaactgatcgttcttttcctgctcgtcctgttccctgaactggtgaccgttccggtctcctggttcggacgctga

SEQ ID NO: 56086 - protein, 426 aa, Sinorhizobium meliloti 1021
MTISIFLGALLGPMALGVPIAFALILSGVALMLYLGLFDAQIVAQNVLNGADSFPLMAVPFFLLAGEVMNTGGLSRRIVALAMAMVGHIRGGLGFVAIFAACILSSLSGSAVADAAALGALLLPMMLKSGHDPARASGLIASASIIGPIIPPSIGFILFGVVGGVSITKLFLAGIFPGLMIAAALSITWLIVARKEQFELPPRQSGRLRLRAFVDSLWALFLPVIIIAGLKFGVFTPTEAGVIAAVYSLFVSMVVYRELAPAQLFHVFVSAAKISAVVMFLVACAAVSAWLITVADVPGALAALLEPLMGNQTALLIAIMVLIVIVGTAMDMTPTILIMTPVLMPVIKQAGIDPVYFGVLFIINNSIGLITPPVGTVLNVICGVSKLSMEDLMKGVMPFLFAELIVLFLLVLFPELVTVPVSWFGR

SEQ ID NO: 56087 - DNA, 1281 bp, Sinorhizobium meliloti 1021
  CDS (1)..(1281)
atggcgacgctcttcgggggatggtttgcccttctgatcgccggcatgccggtcggattcacgctgatcgtggctgcgctcgcctacatgctctggcaggggacgggcctgaactttgccggccagcgcatgatcgccggcctcaacagctttccgctgcttgcggtcccctttttcatcctcaccgcacaattgatgaatctctcgggcgtgaccgagcgcattttcgacttcgccaaggcgcttgtcggccatatcaggggcgggctcggccatgtgaacatcatggcgagcgtgctgttttccggcatgtccggctcggccgtcgccgatgccgccggccttggtcagcttgagatcaaggccatgcgcgacgccggctatgacgagcagttttccggttcgatcaccgccgcatcggcaatcataggcccgctcatcccgccttccattcccctcgttgtctatggcgtgatcgccaatacctcgatcggaggccttttcctcggcgggatcgtaccgggacttctttgcgcggcctcgctcatgatcatggtctacgtgatcgcctggcgccgcaactatgcgaccgcgcagcgcgccggctttcgccgggtgtggtccaccttctggcacgcgctgcttccgctcatcacgcccttcatcatcatcggcggcatctttgcgggggtgttctcgccgaccgaggctgcggtggtcgcggccagctatgcgctgttcctcggtgtcgtcgtctaccgtgaaatcaccttcgccaaactcgtgaccgtactgcgcgagactgtcagccatacggccgccgtcggccttctcatcatgggcgtgtcgctattcggctatgtgatcgcgcgagagcaggtaccccagcacgtcgccacgttctttctcacatatgcggaagacccgctgacattcctgatcctcgtcaatctcatgctgcttgcgctcgggacctttatcgaggccctggcaatcctgctgctcatcgtaccggtgctggtcccgaccgcgctccaattcggtgtggatcccgtccacttcggcgtcatggtcgtgttcaacctgatgatcggcattttgacgccgcccatgggcgtggcgctcttcgtcgtgtccaaggtcgccgacattcccttcggcgtgctcgcacgcggtatcctgcctcttctcattccgctcgtcgtcgtcctggtgctgatcaccatctttccggcgctcgtcaccttcatccccgaccagatgctcggagccgcccgatga

SEQ ID NO: 56088 - protein, 426 aa, Sinorhizobium meliloti 1021
MATLFGGWFALLIAGMPVGFTLIVAALAYMLWQGTGLNFAGQRMIAGLNSFPLLAVPFFILTAQLMNLSGVTERIFDFAKALVGHIRGGLGHVNIMASVLFSGMSGSAVADAAGLGQLEIKAMRDAGYDEQFSGSITAASAIIGPLIPPSIPLVVYGVIANTSIGGLFLGGIVPGLLCAASLMIMVYVIAWRRNYATAQRAGFRRVWSTFWHALLPLITPFIIIGGIFAGVFSPTEAAVVAASYALFLGVVVYREITFAKLVTVLRETVSHTAAVGLLIMGVSLFGYVIAREQVPQHVATFFLTYAEDPLTFLILVNLMLLALGTFIEALAILLLIVPVLVPTALQFGVDPVHFGVMVVFNLMIGILTPPMGVALFVVSKVADIPFGVLARGILPLLIPLVVVLVLITIFPALVTFIPDQMLGAAR

SEQ ID NO: 56089 - DNA, 1266 bp, Sinorhizobium meliloti 1021
  CDS (1)..(1266)
atggtcaccaccgccgccttcctcgccttcatgctcgtcggcgttccgatcggcgtctgcctctgcctcggcagcatcgtctatatcttcgcctccggaaatcccttgcttttccagagctttccgacgcaactcttcggcggcgtcgacaattacgggctgatttccattccgctcttcgtgctaatcggcgagatcatgaacggcggcggcatcacccggcgcatcatcgacatgacgatggctttcgtcggcgcgatgcgcggcgggcttgcctatgtcaacctgctcgccaacatgttcgtcgcctcgatactcggctcggccacggcgcaggttgccgtcatggcgcagatgatggtgccggagatggagaagaagggctatgacaagacctttgccgccgggcttaccgcctattcgggcatgctcggtcccatcatccctccgtcgatcatgttcgtcgtctacagcgtactcgcgcaggttccggtaagcgatatgctggccgcaggaatcgtgcccggaattctgctgaccgtagccttctgcctcgtcatcgcggcgatgggtttcgtctacaactatccgcgcggcgagcgcatgaagctccaggagcgcgtccgtatcgtgctggatgcgctgccgacgcttctcatccccttcgtcatcgtcggctcgatcctctccggcctcgccaacgcgacggaggccgcagcagtcggggccgttgcagcggtgctcgtcggttgcttctggatcggcgagctcaaattctccgatcttcctcgaatgatgctgagagccggcatctattcggccgtggtcctcttcctcgttgcggccgccgcggtcttctcctgggtactcgtctacggcatggtgccgcagcaggttgccggctgggttcagaccgtcgcctcggatccggtcaccttcatgctgctcgtcaacgtcatcctgctcgtcatcggcacggtgatcgacggggcgcccgggctcatcatgacggtgcccatcctcctgccgatcgcgaccgaggtctacggtatcgacccgatccatttcggcgtcgtcgtggtcgtcaacctcgtcctcggcttcctctcgccgccggtcgggctctgcttcttcgtggcggccgcggtgaccggcgcaaagcccggcaagatgttcctggtgacgctgccgttcttcttcgtctcctgcctcatgctcgtgctcctgtcgctcattccctcgctctcgaccttcttcgcccgataa

SEQ ID NO: 56090 - protein, 421 aa, Sinorhizobium meliloti 1021
MVTTAAFLAFMLVGVPIGVCLCLGSIVYIFASGNPLLFQSFPTQLFGGVDNYGLISIPLFVLIGEIMNGGGITRRIIDMTMAFVGAMRGGLAYVNLLANMFVASILGSATAQVAVMAQMMVPEMEKKGYDKTFAAGLTAYSGMLGPIIPPSIMFVVYSVLAQVPVSDMLAAGIVPGILLTVAFCLVIAAMGFVYNYPRGERMKLQERVRIVLDALPTLLIPFVIVGSILSGLANATEAAAVGAVAAVLVGCFWIGELKFSDLPRMMLRAGIYSAVVLFLVAAAAVFSWVLVYGMVPQQVAGWVQTVASDPVTFMLLVNVILLVIGTVIDGAPGLIMTVPILLPIATEVYGIDPIHFGVVVVVNLVLGFLSPPVGLCFFVAAAVTGAKPGKMFLVTLPFFFVSCLMLVLLSLIPSLSTFFAR

SEQ ID NO: 56091 - DNA, 1278 bp, Sinorhizobium meliloti 1021
  CDS (1)..(1278)
atgggttttctggtcgttgcggccttcctcggtctgttcatgcttggcttcccggtggtttacgccatcctgctgccgtcaattctctacgtacttgtcgaaggcttgccgttcgggctgcttgcccagcggatcacctatgcgctggattcgtttccgctggtggccgtgcctctcttcatcttcgtcggcaacctcatgaacctttccggcattaccgatcgcatcttccgcttcgcctatacgctcgtcgggcgaatgccgggtggcctggcgcaggtcaacgtcttcggaagcctgatcttttccggaatgtccggggcggcgctggctgatatcgggggcctggggcgcatagagatcgatgccatgaagaagcgcggcttcgatccatccttcgccggcgcggtaactgccgcttccgcgacgctcgggccgatcttcccgccttccatcccgctgatcgtctacggctcggtcacgagcgtctcgatcgtccagctcctcgtagccggcatcatgcccgccgtgctgtgcaccgcgctgctaatgctcaccgtgctgatcgtcgccatccgacacggccatgcacgtgcggagcgctggccgacggcaggcgagctggtcggcacattggtgccggcgctcccggccattcttgctccggcgctcatggtcggcggcatgacggccggcgccttcacaccgaccgaggcggccgcgataacggccgtctatgtcatcttcatcagcggcgtcctgtaccgcgaactgacgccggcgcatctgtggcattcggcggttctgacggctcgcagctccagcgctattctcatcatcgtcgcctctgctgcgctttttggctggattctcgcggtcgagcaggtgcctcagacctttgccgcagcgctgcttggctggtcgaaggacccgctgatgctgctgatcatcgcaaatctgatcttcttcgtcgccggcatgttcctcgactcgacgaccgcaacgctgcttctcgttcccatcatcgccccgccgctcgtgatggccggtgtcgacccggttcaactcggcatcgtgacgatcttcaacctgatgctcggactgctgacgccgcctatgggtttgtcgctgttcctcgtgtcggatatcgccaaagtctcgatccggcagttgctgcgggcacttgtgcctttctacattccgctggtttccacgcttgtcatcctcaccctagcgaaggacttcacgctgtggctgccccgtctgatcgcccagtaa

SEQ ID NO: 56092 - protein, 425 aa, Sinorhizobium meliloti 1021
MGFLVVAAFLGLFMLGFPVVYAILLPSILYVLVEGLPFGLLAQRITYALDSFPLVAVPLFIFVGNLMNLSGITDRIFRFAYTLVGRMPGGLAQVNVFGSLIFSGMSGAALADIGGLGRIEIDAMKKRGFDPSFAGAVTAASATLGPIFPPSIPLIVYGSVTSVSIVQLLVAGIMPAVLCTALLMLTVLIVAIRHGHARAERWPTAGELVGTLVPALPAILAPALMVGGMTAGAFTPTEAAAITAVYVIFISGVLYRELTPAHLWHSAVLTARSSSAILIIVASAALFGWILAVEQVPQTFAAALLGWSKDPLMLLIIANLIFFVAGMFLDSTTATLLLVPIIAPPLVMAGVDPVQLGIVTIFNLMLGLLTPPMGLSLFLVSDIAKVSIRQLLRALVPFYIPLVSTLVILTLAKDFTLWLPRLIAQ

SEQ ID NO: 56093 - DNA, 1407 bp, Sinorhizobium meliloti 1021
  CDS (1)..(1407)
atgctcctgctcgtcggttcctttctcgtactcatgctggtcggcgtccccgtcgccatctccatggccgcagcgtcggtgctctatctggtctcctacaatgtcgcccccgacatcatcgcggcgcagcggatgattgccggcgtcgaaagctttccgctgcttgcggtgccttttttcatcctcgccggcaatctcatgaactccgccggcgtcaccggccgcatctattccttcgcggtcgccctcgtcggctggatgaagggcgggctggcacaggtcaacatcgtcggctcggtgatcttctccggcatgtcgggcaccgcgctcgcggacgccgccggcatcggcacgatcgagatcaaggccatgaaggaccatggctatccggtcgatgcggcggtcggcgtcaccgccgcgtctgcgacgcttggacccatcttcccgccgtcgctgcccttcgtcatctacggcatgatggcgaacgtctccatcggcgcgctgttcatggccggtgtcgtgccgggcgtggtcatgacggtgctgatgatgctgacggtggcgatcttcgcctacaagcgcggctggggctcggatacgcctttcgaaatgaagcggctgcttgcggcctcgctcgaggtcgtcgtcgtccttgccgttccgcttttcatctatcttctgatggcggccggactgtcgatgaaccttgcggtcggcatcgcgctcgtggtgctgcttgctctcgactggtacttcgacttttccgccgtcatggcgctgatgacgcccatcattctgatcggcggcatgaccatggggtggtttacgccgacggaagcggccgtcgccgccgtgatctggtcgctgttcctgggccttgtgcgctaccggacgatgacgatgtcgacgctcgcccgggcgactttcgacacgatcgagacgacggcatcggtgctcttcatcgtcacggcggcctcgatcttcgcatggctcctgacggtcagtcaggccgcgcagatgctctctggcgcgatcctgacgatcaccgacaacaaatgggttttcctcatcctggtgaaccttctgatgctcttcgtcggctgttttctcgatacgatcgcggcgatcaccatattggtgcccatccttctgccattgaccgcccagttcggaatcgatcccgtgcatttcggcctgatcatgacgctcaacctgatgatcggcctgcttcaccctccgctcggcatggtgctcttcgtgctgtcgcgggtggcgaagctctcggtcgaacggacgacgatggcgatcctgccatggctcgtgccgctgtttatcgccctcattctgatcaccttcgttccggccgtcgtgttgtggctgccgcagtccgtgggactgatccgctga

SEQ ID NO: 56094 - protein, 468 aa, Sinorhizobium meliloti 1021
MLLLVGSFLVLMLVGVPVAISMAAASVLYLVSYNVAPDIIAAQRMIAGVESFPLLAVPFFILAGNLMNSAGVTGRIYSFAVALVGWMKGGLAQVNIVGSVIFSGMSGTALADAAGIGTIEIKAMKDHGYPVDAAVGVTAASATLGPIFPPSLPFVIYGMMANVSIGALFMAGVVPGVVMTVLMMLTVAIFAYKRGWGSDTPFEMKRLLAASLEVVVVLAVPLFIYLLMAAGLSMNLAVGIALVVLLALDWYFDFSAVMALMTPIILIGGMTMGWFTPTEAAVAAVIWSLFLGLVRYRTMTMSTLARATFDTIETTASVLFIVTAASIFAWLLTVSQAAQMLSGAILTITDNKWVFLILVNLLMLFVGCFLDTIAAITILVPILLPLTAQFGIDPVHFGLIMTLNLMIGLLHPPLGMVLFVLSRVAKLSVERTTMAILPWLVPLFIALILITFVPAVVLWLPQSVGLIR

SEQ ID NO: 56095 - DNA, 1284 bp, Sinorhizobium meliloti 1021
  CDS (1)..(1284)
atggacatgatgatcctcttcggcgtgttcacgctgctgatgttgatcggcacgccgatcgccttctgcctcggcgtcgcgtccttcgcgacggttctttatctggggctgccgccgctggtgatctttcagcggctcaattccggcatgagcgtgttttcgctgcttgccattcccttcttcatctatgccggcgatctgatggtgcgtggcgggatcgcccagaagatcgtcgccttcgcggcttcactggtcgggcacatccggggcgggctcggtcaggtcaacatcgtcaccgcaacgctgttcggcggcatttccggctcggccgtggcggaagcggccgctgtaggcgggctcatgatcccgcagatgaaacagcgcggttacggcgcggactacgccgtcaacgttacctcgatggcggccttgatcgcgctgatgctgccgccttcgcacaacatgatcatctactcgatctcggcaggcggaaagatctcgatcgcagatctcttcaccgccggcatccttcccggcctcctttacgctgccgcactgatggccaccgcctatttcgttgcgcgccggcgcggctatccgaccgaggtcttccccgggttcgccagggtcgggcgctacctgctgatttcgacgcccggcctcctgctcatcggcatcatcttcgggggcgtacgttcgggtgtgttcaccgcgaccgagagttcctgcatcgccgttctctatgcgcttgcggtgaccgtcttcgtctatcggcagatgacctggcaggacttcgtccaggcaaccttcgcggccgtgcgcacgacggccatggtcctgctcatcatcggcatggcggccgccttctcctggttgatggcgttcctgagagtgcccgcagcgctgatcgactggatgaacacgatctcggaaaatccgatcatcatactcctattgctcaacgttctgatgttgttcctcggcaccttcatggacatgggcccgaccatcatcatctgcaccccgatcttcctgccggtcgccatggcctacggcgtcgacccggtccatttcggcgtcatcatgatcctaaacttcggcatcggactcaacacgccgcctgtgggcgccgtgcagttcgtcgcctgtgcagtcgggaagatctccgtctgggaggcgatgcgcagcatatggccgttctacctggccgggttgatcgtcctcgggctcgtcacctatgttccggccctttctctatggctgccggccgtcttcaaagggtga

SEQ ID NO: 56096 - protein, 427 aa, Sinorhizobium meliloti 1021
MDMMILFGVFTLLMLIGTPIAFCLGVASFATVLYLGLPPLVIFQRLNSGMSVFSLLAIPFFIYAGDLMVRGGIAQKIVAFAASLVGHIRGGLGQVNIVTATLFGGISGSAVAEAAAVGGLMIPQMKQRGYGADYAVNVTSMAALIALMLPPSHNMIIYSISAGGKISIADLFTAGILPGLLYAAALMATAYFVARRRGYPTEVFPGFARVGRYLLISTPGLLLIGIIFGGVRSGVFTATESSCIAVLYALAVTVFVYRQMTWQDFVQATFAAVRTTAMVLLIIGMAAAFSWLMAFLRVPAALIDWMNTISENPIIILLLLNVLMLFLGTFMDMGPTIIICTPIFLPVAMAYGVDPVHFGVIMILNFGIGLNTPPVGAVQFVACAVGKISVWEAMRSIWPFYLAGLIVLGLVTYVPALSLWLPAVFKG

SEQ ID NO: 56097 - DNA, 1314 bp, Sinorhizobium meliloti 1021
  CDS (1)..(1314)
atgaccctattccatctggccggcccctcgcttctcgtcgtcgtcctgtttctgctgtcgacgccgatcacctgggccatggcgatcggagcgttcgccttcttcctcatcaatatggacatgatcccgctcgccaatttcgcgcaggaaatggctgaaggcagtcaatccgtgtccttgttggcgctgccgctgttcgttcttgccggctgcatcatgaacgcctcgggcatcacgcggcgtctattggcgcttgcggacgtgctcgtcggccacatgacgggcgcgctggcgcagatgtgcaccgtgctcggcaccttgctcggcggacttaccgcatctgccaatgccgatgcggcgatgctcgccaaaacgctcggcgtcgagatgtcgcaacggggctacagccgggccttcgccgcggtcatcacatcgtcggcggccatcatcacgagcctcattccgccgtcgatcggccttatcgtctatggttttctggcggagacgtccatcggccggctcttcgcagcgggtgtcatacctggcctcgtgctggcgaccgggctcatggtcaccacctatttcatcgcccgcaagcgtggttacaagccgttgcgcaaggagcgtgccacccgcgcagagggcgtccgggcgctgatcgacgggctctgggcgctgtcgatcccggtggtgatcttcgccggtacgcgatacggtcttttcaccaccaccgaagccggtgcggtggtggtcgtctacgtgctcttcgtcgccgtgttcggctaccgcgaattcaccttccgccagatcccggaggttcttgccgaggccgtgcgcgattcggccgtggtcatgatcatgatctgcgcggcggcagccttcggtttctatctcgcctgggagcaggtgccgcaggccatgtccggctggctcggcgaagccaccgacaatccgctcctgatgctgctcctcatcaacgtcctgctgatcgtcatcggcacggcgatcgaggggtcggcggcgctgatcatcctgacgccgatgctgatcccgatcatcgacggcgtgggcatcgatcgcgtgcatttcggcgtcgtcttcatcacgaacctgaccatcgccggcatcacgccgccggtcgggggattgatgtacatctcgtccatggtgctgaaagtgccgatgatggcctatgcccgcgaggtgctgccttacctggcgatgatgatggtcattctcgtcatgctgagcatgttcccgcagctgtcgctttggctgccgaacctggtctatgggacgacggcggtccaatag

SEQ ID NO: 56098 - protein, 437 aa, Sinorhizobium meliloti 1021
MTLFHLAGPSLLVVVLFLLSTPITWAMAIGAFAFFLINMDMIPLANFAQEMAEGSQSVSLLALPLFVLAGCIMNASGITRRLLALADVLVGHMTGALAQMCTVLGTLLGGLTASANADAAMLAKTLGVEMSQRGYSRAFAAVITSSAAIITSLIPPSIGLIVYGFLAETSIGRLFAAGVIPGLVLATGLMVTTYFIARKRGYKPLRKERATRAEGVRALIDGLWALSIPVVIFAGTRYGLFTTTEAGAVVVVYVLFVAVFGYREFTFRQIPEVLAEAVRDSAVVMIMICAAAAFGFYLAWEQVPQAMSGWLGEATDNPLLMLLLINVLLIVIGTAIEGSAALIILTPMLIPIIDGVGIDRVHFGVVFITNLTIAGITPPVGGLMYISSMVLKVPMMAYAREVLPYLAMMMVILVMLSMFPQLSLWLPNLVYGTTAVQ

SEQ ID NO: 56099 - DNA, 1281 bp, Sinorhizobium meliloti 1021
  CDS (1)..(1281)
atgagccttgcccttctcgtcctctttgccgtcttcattctcttgctcctgatcgatgcgccgatcgcgatcgcgcttgcgctttcctcggtcgcttatctgctggtcggtgatgtattgccgctgatggtggtcgcgcagcgcatggtggcggggatcgacagcttcacgctgctggcaatcccgcttttcctgctcgccggcctgctcatggtgcatggggggctcgccccgaggatcgtcaatctttgcgcggcagtcgtgggccagcggacgggtggtctcgctatcgtgatgattgccgcctgcatgatgttcggctcgctctcgggatcgggtgtcgcggacgtggtggcgatcggttccatgctgctgccggccatgaaggagcgcggctaccatccgggtttctccgccgctggtctcggctgcgccggttcgcttggcacggtcattcctccgtccatagtcctgatcgtctacggaacggcgaccggaacgtcgatcgggcagcttttcatccactccatcggtccaggcatcctgctcggtttcgggctgatggtcgtcgcgtggtggatttcccgcaagaacggttggaagggcggagaaccgttcagctggactcggctgggcaccgctctgcgcgaatccgtgcttgccctgctcgcgccggtcatcatcgtcggcggcatccgcttcggcatcttcacgccgacggaggcggcgggcatcggcgtcgcctatgcgctgctcgtcggggccctcatctatcgccagctgacgctcgccaaggtcttcagcctcctgcgcgacacgacggaaatgaccggttccatcctcatcgtcatcgcggccgcctccgtcttcggctggatcctgacggtcgagcaggttccgcagctcgtcgtcaatgccatcaccggcgcgaccgagagcgccacagtcgcgctcatgctgatgatggtcgcggtcctggtcctcggcacgttcatggaatcgatcgccatcattctcatcctggcgcccgttttcctgccggtgctgcgggtcttcgagatcgacccggtctatttcggcgtgctgctgaccatcaacctggcgatcggcgccaatacaccgccactcggcatcgacctgatggccgcgtgccgcaccggtggcataccgatgtcggcgtccttccgctatctgctgccgttcatcggcgtcatggcgctcatcatgttcctcctcgttctctttccggggctgatgacactgatgtcgctcggaatgtga

SEQ ID NO: 56100 - protein, 426 aa, Sinorhizobium meliloti 1021
MSLALLVLFAVFILLLLIDAPIAIALALSSVAYLLVGDVLPLMVVAQRMVAGIDSFTLLAIPLFLLAGLLMVHGGLAPRIVNLCAAVVGQRTGGLAIVMIAACMMFGSLSGSGVADVVAIGSMLLPAMKERGYHPGFSAAGLGCAGSLGTVIPPSIVLIVYGTATGTSIGQLFIHSIGPGILLGFGLMVVAWWISRKNGWKGGEPFSWTRLGTALRESVLALLAPVIIVGGIRFGIFTPTEAAGIGVAYALLVGALIYRQLTLAKVFSLLRDTTEMTGSILIVIAAASVFGWILTVEQVPQLVVNAITGATESATVALMLMMVAVLVLGTFMESIAIILILAPVFLPVLRVFEIDPVYFGVLLTINLAIGANTPPLGIDLMAACRTGGIPMSASFRYLLPFIGVMALIMFLLVLFPGLMTLMSLGM

SEQ ID NO: 56101 - DNA, 1257 bp, Haemophilus influenzae Rd KW20
  CDS (1)..(1257)
ttgtgtagtttattcttattgttatttcttggtgtacctgtagcactatcaatgctgttgagtgcgagtattatgctatatcatcttgatatgtttgatacgcaattaattacagaaaactttgtgatgggaacgaataattttcctttgatggctattcctttctttatgcttactggagaaataatgaagcatggtggaatttctgagcgaatcattaattttgcaacaagtatggttggtcatattaaaggtggtttaggttatgttgcgatcatttctgggttgatatttgcagggttatctggttctgcggtagcggatacggccgcgttaggtgcaatactaattcctatgatgatttctaaaaaatatgatggtgctcgttccacaggattaatttgtgctgcaggtattatttcagttgttattcctccaagcattcctatgatcatttacggtattactgctggagcatccatcactaaattatttatggggggaactgtaccaggcttattaatggtcgttggattatgggttacttggaaaattttgtatagaaataatgatacaagtctagaaagaaaacaaactggcaaagaaagatgggttgcttttaaaaaagcattttggcctttattattacctatcattattattgtgggattaagaggagggatttttactccaacagaagcgggagttgttgctgcaatttatgctggcatagtaagtattgcttataaaggcttaacattttctaaattaaaagacgtcttcattggtaccatcaaaacaacatcaatggtaatgtttgttgctgcatcagcaatgatatctgcttttgcgattacagttgctcaaattccaacagaattagtccaaacgattaaaggattaactgatagtccgacaattttaatgtttattataatgctatttttattacttgttggatgtgtaatggatttaattcctgcggtattaatctttgttccagtcttattaccagtgttaagagcatataatattgatattgcgtattttggaatcatgatggtgattaatttatctataggattaataacaccgcctgtgggaacagttttgtatgtaggctcagggatatcaaaattagggataggagcattatccaaaggaattgctccattcttatttgtgtacgcaattattatgatgttgatcgtattttttcctgaaattgtaattgttccaatgaattggttatcttga

SEQ ID NO: 56102 - protein, 418 aa, Haemophilus influenzae Rd KW20
MCSLFLLLFLGVPVALSMLLSASIMLYHLDMFDTQLITENFVMGTNNFPLMAIPFFMLTGEIMKHGGISERIINFATSMVGHIKGGLGYVAIISGLIFAGLSGSAVADTAALGAILIPMMISKKYDGARSTGLICAAGIISVVIPPSIPMIIYGITAGASITKLFMGGTVPGLLMVVGLWVTWKILYRNNDTSLERKQTGKERWVAFKKAFWPLLLPIIIIVGLRGGIFTPTEAGVVAAIYAGIVSIAYKGLTFSKLKDVFIGTIKTTSMVMFVAASAMISAFAITVAQIPTELVQTIKGLTDSPTILMFIIMLFLLLVGCVMDLIPAVLIFVPVLLPVLRAYNIDIAYFGIMMVINLSIGLITPPVGTVLYVGSGISKLGIGALSKGIAPFLFVYAIIMMLIVFFPEIVIVPMNWLS

SEQ ID NO: 56103 - DNA, 1338 bp, Synechocystis sp. PCC 6803
  CDS (1)..(1338)
atggtggactacgattggttagggccaatgatgtttgtgggggcattggtcttcctgggctgtggctatcccgttgccttttccctggggggagtggcgattttatttgccatcatcggcgcggctttaggttcctttgaccccatattcttgtccgccatgccccaaaggatttttggcattatggccaatggtactctgctggctattccctttttcatctttttgggatccatgctggagcggtctggcattgctgagcaactattagaaaccatgggtattatcctggggcatttgcggggaggactagccctggcggtgatcctagtgggtactatgctggcggcaaccaccggagttgtggcggccaccgttgtggccatgggtttaatttccctacccattatgttgcgctatggctacagcaaagagttagcatccggtgtcattgtcgcctctggcaccctgggacaaatcattcctcctagcgtagttttgatcgttttagctgatcaattgggagtttccgtgggggacttatttatcggctccctccttccaggactaatgatggccggcagttttgccctttatgtcttgataattgcctggttaaaaccggacttagccccggctttaccggccgaagttaggaacattggcggccaggaattacgcagacgtatagtgcaggtgatgttgcccccgttagttttaattctgttggtgctggggagtattttcttcggcattgctagtcccaccgaagcaggggccgtgggttccatcggggcgatcgccttggcccattttaatcaacgtctgaactggaaagccctctgggaagtctgtgacgccaccctacgcattaccagcatggtgatgctaatcctattggggtcaactgcgtttagcttagtgttccgggggctggaaggcgatcgatttatgtttgatcttttggctaatttacccggtggccaaattggctttttagccattagtatgatcaccattttcatcctgggatttttcattgacttttttgaaattgcctttattgttctgcctctgtttaagcctgtggcagaggcactaaaccttgatttaatttggtacggtgtcattgtgggagccaatttacaaacctccttcctcacaccgccctttggttttgccctcttttacttacggggagtggcaccagctagcttgaccactggacaaatttatcggggagctgtgcccttcattggcttgcaagttttagtgttgttgttaattattattttccctgctctgattaattggttaccttctttaagtgttcaataa

SEQ ID NO: 56104 - protein, 445 aa, Synechocystis sp. PCC 6803
MVDYDWLGPMMFVGALVFLGCGYPVAFSLGGVAILFAIIGAALGSFDPIFLSAMPQRIFGIMANGTLLAIPFFIFLGSMLERSGIAEQLLETMGIILGHLRGGLALAVILVGTMLAATTGVVAATVVAMGLISLPIMLRYGYSKELASGVIVASGTLGQIIPPSVVLIVLADQLGVSVGDLFIGSLLPGLMMAGSFALYVLIIAWLKPDLAPALPAEVRNIGGQELRRRIVQVMLPPLVLILLVLGSIFFGIASPTEAGAVGSIGAIALAHFNQRLNWKALWEVCDATLRITSMVMLILLGSTAFSLVFRGLEGDRFMFDLLANLPGGQIGFLAISMITIFILGFFIDFFEIAFIVLPLFKPVAEALNLDLIWYGVIVGANLQTSFLTPPFGFALFYLRGVAPASLTTGQIYRGAVPFIGLQVLVLLLIIIFPALINWLPSLSVQ

SEQ ID NO: 56105 - DNA, 1278 bp, Salmonella typhimurium LT2
  CDS (1)..(1278)
atggccgtggtgatatttctctgctgcctgctcggcgggatcgcgataggtttacccatcgcctggtcgctgctgctttgcggcgctgctctgatggcatacctggatatgtttgacgtgcagattatggcgcaaaccctggttaacggcgcggacagtttctccctactggccattcccttttttgttttggccggtgaaatcatgaacgcgggcggcctgtcaaagcgaattgtcgacctgccgatgaagctggtcggccataagcccggcggcctgggctacgtgggcgttattgcggcaatgattatggccagcctttccggctctgcggtagcagataccgctgcggtcgccgcgctgctggtgccgatgatgcgctccgcaaactacccgatcaaccgctccgttgggttaatcgcttccggcgggatcattgcgccaattattcccccctcgattccttttattatcttcggcgtttccagcggcttgtcgatcagcaagctgtttatggccgggatcgcaccgggcatcatgatgggcgcggcgcttatgctcacctggtggtggcaggccgggcgattaaatctcccttctcagcctaaagcaacaccgcgtgaaatctggcaatcattggtttcaggtatctgggcgctgtttttaccggtgattatcatcggcggcttccgttccggacttttcacgccaacggaggcaggggcggtcgccgcgttttacgccctctttgtcgccgtggttatctatcgggaattaacgttttccagtctctaccacgtgctggtcaatgccgccaaaacgacgtcagtcgtcatgtttctggtggctgcggcccaggtatccgcctggctgattacgatcgcggaattacccatgatggtgtcagatttgctgcagccgctggtcgactctccgcgactcttatttatcgtcattatgatctcaattatggtcgtcggtatggtgatggatttgacgccaacggtgttaattcttacccctgtattattgccattagttaaagaagccaatattgacccgatttatttcggcgtcatgttcattattaactgctctattggattaatcacaccgcccgttggcaacgtcctcaacgttatttccggggtagcaaaattgaaatttgatgacgcggtaagaggcgtattcccttacgttgtcgtcctgatgtcgctgctggttttatttatttttattcccgagctaattatcacaccgcttaaatggattaattaa

SEQ ID NO: 56106 - protein, 425 aa, Salmonella typhimurium LT2
MAVVIFLCCLLGGIAIGLPIAWSLLLCGAALMAYLDMFDVQIMAQTLVNGADSFSLLAIPFFVLAGEIMNAGGLSKRIVDLPMKLVGHKPGGLGYVGVIAAMIMASLSGSAVADTAAVAALLVPMMRSANYPINRSVGLIASGGIIAPIIPPSIPFIIFGVSSGLSISKLFMAGIAPGIMMGAALMLTWWWQAGRLNLPSQPKATPREIWQSLVSGIWALFLPVIIIGGFRSGLFTPTEAGAVAAFYALFVAVVIYRELTFSSLYHVLVNAAKTTSVVMFLVAAAQVSAWLITIAELPMMVSDLLQPLVDSPRLLFIVIMISIMVVGMVMDLTPTVLILTPVLLPLVKEANIDPIYFGVMFIINCSIGLITPPVGNVLNVISGVAKLKFDDAVRGVFPYVVVLMSLLVLFIFIPELIITPLKWIN

SEQ ID NO: 56107 - DNA, 1308 bp, Salmonella typhimurium LT2
  CDS (1)..(1308)
atgattgaccctatttttgcgtcctgtacgctaattgccgtctttgttgttttactggccatgggcgcgcctatcgggatctgcatcgttatcgcctctttcagcaccatgatgctggtactgcctttcgatatttcgatgttcgccaccgcgcaaaaaatgttctccagcctggacagttttgccttgctggccgtgccgttcttcgttttgtccggggtgatcatgaatagcgggggaattgccgcccggctggtcaattttgccaaactgtttactggcaaactgcccggctcgctctcttataccaacatcgtcggcaatatgatgttcggtgcaatttccggatcggcgattgccgcctcaacctccatcggcggcgtgatggtgccgatgagcgcgcgcgaaggttacgatcgcggctttgcggccgcggtgaatatcgcctccgcgccgacgggaatgttaattccgcccaccacggcttttatcctttacgcgctggcaagcgggggaacatcgattgccgctctgttcgccggcggtctggtcgcgggagtgctgtggggcgttggctgtatgctggtcacgctggtggtcgctaagcgtcgaaattatcgggttttcttcaccgtccaaaaaggtatggcgctaaaagttgccgttgaggccattcccagcctgctgctgatcgtgattattgtcggcggcattgtgcaggggattttcaccgccattgaagcctccgcgattgccgtggtgtatacgttattgctgacgatggtgttttaccgcacgctgaaaattaaggatttgccttcgattttgctccagacagtggtaatgaccggggtcatcatgttcctgctggcaacctcttcggcgatgtccttctcgatgtcgatcaccaatattcctgcggcgctgagcgatatgatcctcggtatttccgccaataaactggttatcctgttagtcattaccgtctttttgttgattatcggcgcatttatggatattggtccggccattctgatttttaccccgattctgctgccaatcatggctaaactgggcgtcgatccggtgcatttcggcattatcatgatctataacctggcgattggcaccattacgccgccagttggcagtggtttatatgtcggggcgagcgtcggtaaggtcaaagttgaggaagtgattaaaccgttgctgcctttttacggcgcgattatcggcgttctgttattaattacctacattccggaaatcacactgttcttaccccgtctactgggcatcatgtaa

SEQ ID NO: 56108 - protein, 435 aa, Salmonella typhimurium LT2
MIDPIFASCTLIAVFVVLLAMGAPIGICIVIASFSTMMLVLPFDISMFATAQKMFSSLDSFALLAVPFFVLSGVIMNSGGIAARLVNFAKLFTGKLPGSLSYTNIVGNMMFGAISGSAIAASTSIGGVMVPMSAREGYDRGFAAAVNIASAPTGMLIPPTTAFILYALASGGTSIAALFAGGLVAGVLWGVGCMLVTLVVAKRRNYRVFFTVQKGMALKVAVEAIPSLLLIVIIVGGIVQGIFTAIEASAIAVVYTLLLTMVFYRTLKIKDLPSILLQTVVMTGVIMFLLATSSAMSFSMSITNIPAALSDMILGISANKLVILLVITVFLLIIGAFMDIGPAILIFTPILLPIMAKLGVDPVHFGIIMIYNLAIGTITPPVGSGLYVGASVGKVKVEEVIKPLLPFYGAIIGVLLLITYIPEITLFLPRLLGIM

SEQ ID NO: 56109 - DNA, 1278 bp, Agrobacterium tumefaciens str. C58
  CDS (1)..(1278)
atgacacttttcgtttttgtcggctctcttctcggagccatggcgattggcgttcccgtcgctttctcgctgatgttctgcggcgtcgtgctaatgtggtacatgggcatgttcaacacggcgatcatcgcccagaacatgatttcgggcgcggataccttcacgctgctcgccatccccttcttcattctggccggtgaactgatgaactccggtggtctttcccgccgtatcatcgattttgcgattgcgctcgtcggccatatccgtggcggcctcggcatcgtggcgatcgtcgcggccatcatcatggccagcatctccggttcggccgctgccgacaccgcagcccttgccgcaatcctcatcccgatgatggcgaaagccggttacaacattccgcgctccggcggcctgattgctgcgggcggcatcattgccccggtcattccgccctccatggccttcatcgtcttcggcgtcgccgccaacgtctcgatcacccagcttttccttgccggtatcgtacccggtattctgatgggcatttcgctgatcatcgcctggctgatcgtggtccgtaaggataacatcaagcctctgcccaagacttcgggcaaagaacgtctggttgcaacggtccgcgccggctgggcgcttggcatgccggtcatcattctgggcggcatcaaggccggcatcatgacgccgacggaagccgccgttgtcgctgccggctacgctcttttcgtcggcatggtgatctaccgcgaactgaagccggcggatctgttccacgttcttctacgcgctgccaaaagcacctcgatcatcatgtttctcgtctgcgcagcacttgtctccgcatggctcatcacggccgcgaacattccaaacgaagtcgctggttatatcgaaccgctgatcgatcgtccgatgcttctgatggttgcgatgatggtgctggtcttcatcgtcggaaccgccctcgacctgacccccaccatcctgatcctgacgcccgttctgatgcccatcgtcaagcaggcaggcatcgacccggtctatttcggcgtcctcttcatcatcaacaacgccatcggcctgattacgcctccggttggcgtcgtgctgaacgtcgtctcgggcgtcggacgcatcccgctcggcaaggtcacgatcggcgtctggccgttcctcgttgccgaaaccatcgttctggcgctgctggtgattttccccgacatcgtcatggttccgttgcagtaccttcgttaa

SEQ ID NO: 56110 - protein, 425 aa, Agrobacterium tumefaciens str. C58
MTLFVFVGSLLGAMAIGVPVAFSLMFCGVVLMWYMGMFNTAIIAQNMISGADTFTLLAIPFFILAGELMNSGGLSRRIIDFAIALVGHIRGGLGIVAIVAAIIMASISGSAAADTAALAAILIPMMAKAGYNIPRSGGLIAAGGIIAPVIPPSMAFIVFGVAANVSITQLFLAGIVPGILMGISLIIAWLIVVRKDNIKPLPKTSGKERLVATVRAGWALGMPVIILGGIKAGIMTPTEAAVVAAGYALFVGMVIYRELKPADLFHVLLRAAKSTSIIMFLVCAALVSAWLITAANIPNEVAGYIEPLIDRPMLLMVAMMVLVFIVGTALDLTPTILILTPVLMPIVKQAGIDPVYFGVLFIINNAIGLITPPVGVVLNVVSGVGRIPLGKVTIGVWPFLVAETIVLALLVIFPDIVMVPLQYLR

SEQ ID NO: 56111 - DNA, 1281 bp, Agrobacterium tumefaciens str. C58
  CDS (1)..(1281)
atggcttacaccattcttttcggtgtcttcaccctgctgatgctgatcggaacgccgatcgcattctgcctcggcatcgcctccttcgccacggttctttatctcggcctgccgcccatcgtggtgttccagcagatgaattccggcatgaatgtctttgcgatgatggcgatcccgttcttcattttcgcaggggacctgatggtgcgtggcggcatcgcccatcgcctcatccggtttgccgccggtctcgtcgggcacctgcgtggcggtcttggccaggtcaatatcgtggcctcgaccctgttcggcggcatttccggctcggccgtcgccgatgcttccgccgttggcggtttgatgatcccgcaaatggccaagcgcggttacgacaaggactatgccgtcaatgtcaccgtcaatgccgccatcatcgcgctgatgatcccgccttcgcacaacatgatcctctattcgatcgcggcgggtggcaatgtctcggtggccgatctcttcaccgccggcatcattccgggtctgctgcttgctgcggcgctgatggtgacggcctatatcgtcgcccggcgcaaaggctatccgtccgagccgttcccgggtttctccaagctgatgtattatctgctggcctcgttccccggcatcctgctgatcggcatcatctttggcggtgtgcgttcgggcatcttcaccgcgacggaaagctcgtgcatcgccgtgctctatgctttcctcgtcgccatgctggtttatcgcgagctgaactgggacggttttgtggaagctgtcatgggtgcggtccgcaccacggccatggttctgctggtcatcggcacggcggcatccttcggctggctgatggcctttctgcaggttcagacgttgatgattgcggcaatcagcgcgatttcggacaatccgatcatcgtgctgctcgtcatcaacgtcatcctgctgctgctcggcaccttcatggatatggcgccgatggtcatcatctccacgccggtgcttctgcctgtcgtgaaggccttcggcatcgaccccgtgcatttcggcgtggtgatgatcctgaacgccggtatcggcctcaacacgccgccggtgggaacggtgctctttgtcggctgcgcggtgggcggcatcacgatacgggaggcgatgcggacgatctggccgttcttcggcgccagtatcgccgtgctgctggctgttacctatattccgtctctgtccctgtggttgccgtcactgttccggtaa

SEQ ID NO: 56112 - protein, 426 aa, Agrobacterium tumefaciens str. C58
MAYTILFGVFTLLMLIGTPIAFCLGIASFATVLYLGLPPIVVFQQMNSGMNVFAMMAIPFFIFAGDLMVRGGIAHRLIRFAAGLVGHLRGGLGQVNIVASTLFGGISGSAVADASAVGGLMIPQMAKRGYDKDYAVNVTVNAAIIALMIPPSHNMILYSIAAGGNVSVADLFTAGIIPGLLLAAALMVTAYIVARRKGYPSEPFPGFSKLMYYLLASFPGILLIGIIFGGVRSGIFTATESSCIAVLYAFLVAMLVYRELNWDGFVEAVMGAVRTTAMVLLVIGTAASFGWLMAFLQVQTLMIAAISAISDNPIIVLLVINVILLLLGTFMDMAPMVIISTPVLLPVVKAFGIDPVHFGVVMILNAGIGLNTPPVGTVLFVGCAVGGITIREAMRTIWPFFGASIAVLLAVTYIPSLSLWLPSLFR

SEQ ID NO: 56113 - DNA, 1281 bp, Agrobacterium tumefaciens str. C58
  CDS (1)..(1281)
atgtcggtctttcttctcatcgcctttttcggtctcagcatgctcggtgtgccgcttgccatcgcgctggcgctcgccagcgtcggcacgctgtggctcttcacctccatgcccatggacctgctttcacagacgatgttttcgtcgatgaactctttcctcctcgtcgccgtgccgcttttcattctcgtcggcacggtcatggaacggggacgggtggcggaacgcatcttcgactttgccgaggcaatggtcggctggcttcccggcgggctgggccacgttaacgtcatctcgtcggtgatcttttccggtgtttccggctcgtccgtcgcggatatcgcctcggttggggcgatcgagatcaaggcgatggaacgccatggatttccaaagggttatgccgtcggcatgacgctctgcacgtcgacgctctcctcgatcattccgccgtcgatcctgatcgtgattgccggctccatcgccaatgtctcgatcggcaccctgctgatcgctggtctggtgcccggcctcttcatcgcgcttgcctttctggtcttcaaccacttctattcggtgcattacggctacaatccgccgaccccgttcaatttccgtctggtcgtcgtcaccggtttgcgcgccatcctgccgatgctgaccccgttgatcctgatcatcggcattgccagcggcctgttcacgccgacggaagcagcagccatcgcggtggtctatgtggcggtgctcggcgtcatcgtctatcgcacccttccggtgcgggaactgccggaaatattgatctccacggcgcgcatttccggcaccatcctgttcatcgccgccacctcgcagctcgccgcctgggtcttcaccttcgacggcctgccggaacaggtggccgaacttttgaaggcgatgaacctagggcccatgacgggaatgcttgtcatcttcgtcttcctgctgatcatcggcatcttcatggaagcgatcccggccatgttcatcctaatcccggtgctgatgccgccggtggaggcgctgggtatcgatccaatccatttcctgatcgtgaccgtcatgacgctgacgctcgggctggtgacaccgccggttggtgtctgcctgtttgccgcagcccaggtggcgaacatgaagatagaggacgtcattcgtggttcgctggcaccgatgacggtgctgacgctcgccatcttcgcactggtgctgttcccgatcctgacgctcgggccgatacggctgatgggtctttattga

SEQ ID NO: 56114 - protein, 426 aa, Agrobacterium tumefaciens str. C58
MSVFLLIAFFGLSMLGVPLAIALALASVGTLWLFTSMPMDLLSQTMFSSMNSFLLVAVPLFILVGTVMERGRVAERIFDFAEAMVGWLPGGLGHVNVISSVIFSGVSGSSVADIASVGAIEIKAMERHGFPKGYAVGMTLCTSTLSSIIPPSILIVIAGSIANVSIGTLLIAGLVPGLFIALAFLVFNHFYSVHYGYNPPTPFNFRLVVVTGLRAILPMLTPLILIIGIASGLFTPTEAAAIAVVYVAVLGVIVYRTLPVRELPEILISTARISGTILFIAATSQLAAWVFTFDGLPEQVAELLKAMNLGPMTGMLVIFVFLLIIGIFMEAIPAMFILIPVLMPPVEALGIDPIHFLIVTVMTLTLGLVTPPVGVCLFAAAQVANMKIEDVIRGSLAPMTVLTLAIFALVLFPILTLGPIRLMGLY

SEQ ID NO: 56115 - DNA, 1851 bp, Agrobacterium tumefaciens str. C58
  CDS (1)..(1851)
gtgacaccgatcacgcgcggaaggcggatcatggcggtagcggaaaagcagaggcgcaaaggcttcgagacggcggcagcggtgatgctgtcgcgcttcgatgccgtgctcggcgcggtggccgcgttgatccttgcggcccttctcttggtggtgctgatcaatgtcaccctgcgatatctgttccacaccggcttcatcggcgcggaagatctaggcatatggctcaatgtggcgatgatcgccgttggcgcaccgctcagcctcaaaagcgcattggcgatgcggcttgatgtcttcgtgcgcttcctgccgccgcggtttcatgccgccactgaaattctcgccgatgccttctcctttgttgcggcgctcatcctcgctttgggtggggtggagatcgcggcgatgctgggtggtacttcgccgacgctcggcctgccggaatgggtgcgtttcggttttcttggcgcaggcggcgcgcttatctttgtctatctgacgcttcagcgtttcagcgaaggcaagacattcgccgttctgctgtccatgaccatcgcacttgtggcctatgtcggactgccgcaaatattcgttgatacgaccctgccgcccagcctgtttctggcgctgacggcggcggtgggactggttctggcggcaccgctcgctcacgcttttcttgctgccgcttatgtggcgattgcctttggcagcaccttgcccgagccggcgatcgtttcctcgaccgtaacgggcatgtcgaaattcctgctgctcgccatccccttcttcctgctggccggaagcctgctgacaatatcgggtgtcgccaaccagctcgtccgtttcgccgcttccgtggtcggccaccgccgggcgggtctggcgcagacgacgcttttgaccagcgtgctgttttccggcgcgtccggttcatcggtcgccaacgccgccttcggcgcgtccacctttcagccggaactcgtcaaacacggctatccgccggcgcaggcgggcgcgattattgccgcgacatccgtgctcgacaatgtcattccgccgtccatcgctttcctgatcctcgccacggccaccaatctttcggtgggctcgctgctggtcggcggctttttcgccggtgggctgatggcggtctgcctcggcgtggcgatccatttgagcgtgcgcagcgtcgataccctgccacgcgccaccggggcagagcgatggcgctcggccatcgcggccataccggccttcggcctcggcgtcatcgtggtggttggcatccgtatcggcatcgtcacaaccacggaagcggcggcccttgcggcgctctatacgctgctccttggcttcggttaccggctgggcgtgggccgcattttcgcgaccttccggcaatcggctggggaggcggcagcaattggtcttctgatcggcaccgccggtcctttcgcctttctgctggcagtggacaatgtctccggcctcgtcacggattttgtcactgtgcttggcggcagcaagatcaccgtattgctgctctccaatctcatcctgctcgcggtcggtctggtgctggatatcggcgcggcgatcctgctcttcgggcccatcctgctgcccgccgccgtggcggccggcatcgatcccattcatttcggtgtcattctggtggttaatctgatgatccacggcctgacaccgccgctcggcatgctcattttcgtggtcagcggcgtgacccgtgttccggcggcagcacttttccgggcggtcattccctatctcgtctcgctgctcgttgccctcgccattttatgcctatgggccatattgttttaa

SEQ ID NO: 56116 - protein, 616 aa, Agrobacterium tumefaciens str. C58
MTPITRGRRIMAVAEKQRRKGFETAAAVMLSRFDAVLGAVAALILAALLLVVLINVTLRYLFHTGFIGAEDLGIWLNVAMIAVGAPLSLKSALAMRLDVFVRFLPPRFHAATEILADAFSFVAALILALGGVEIAAMLGGTSPTLGLPEWVRFGFLGAGGALIFVYLTLQRFSEGKTFAVLLSMTIALVAYVGLPQIFVDTTLPPSLFLALTAAVGLVLAAPLAHAFLAAAYVAIAFGSTLPEPAIVSSTVTGMSKFLLLAIPFFLLAGSLLTISGVANQLVRFAASVVGHRRAGLAQTTLLTSVLFSGASGSSVANAAFGASTFQPELVKHGYPPAQAGAIIAATSVLDNVIPPSIAFLILATATNLSVGSLLVGGFFAGGLMAVCLGVAIHLSVRSVDTLPRATGAERWRSAIAAIPAFGLGVIVVVGIRIGIVTTTEAAALAALYTLLLGFGYRLGVGRIFATFRQSAGEAAAIGLLIGTAGPFAFLLAVDNVSGLVTDFVTVLGGSKITVLLLSNLILLAVGLVLDIGAAILLFGPILLPAAVAAGIDPIHFGVILVVNLMIHGLTPPLGMLIFVVSGVTRVPAAALFRAVIPYLVSLLVALAILCLWAILF

SEQ ID NO: 56117 - DNA, 1290 bp, Agrobacterium tumefaciens str. C58
  CDS (1)..(1290)
atgctggaatccctcggcaatttaaatctggcgattttcctcggcctgttcgttgcggtatttctggtgctgggtgttccgattgccttctgcttcggccttggaacgctagcctacctgaccttcaccacctgggttccgaccattgtgatgatcgggcgcatggatgagggcatgtccggcatcattctgctgtcagtgccagtctttgtgctgctgggctgcgtgctcgatgctaccggcatgggtaaggcgattgtcgagcttctgtcgtcgatgtttggccatattcgcgcgggcatgtcctatgttctgctcggttctctgtttcttgtctccggcatttccggctccaaggtttctgatatggcaaccgtcgcaccggcgctgtttccggaaatgaagcgccgtggccacaaacccaaggaaatgatcgcgcttttggccaccggcgccgccatggccgatacggttccgccctcaatcgtgctgatcgttctgggttcggcggcaggtgtgtctattgccggcctcttcacctccggtttcatgattgcaatggtactgcttctggtgctggccgttctggcccgctggaaggcgcgggatgaaaacatggaaggcgcaaagcgcacgccatggccgcaggtcggcaaggcagccctgattgccgcaccggcgctcgttctgcccttcctcatccgcagcctggtgggcggcggtgtcgccacggcaaccgaagtatccactattgctgtgctctacgccatgatcgtcggcgcggtgctttatggcggcatcagcctcaggaagctttattcgatgctggtcgagacggcagccctttcaggggcgatcctgctgatcctcggctgtgcatcggctatggcctgggggctgacgcagagcggctttgctttccagcttaccgcgatgattaccgatcttccgggcggctggatgacctacatggtcgtgtcgatcctgattttcatgatcctgggctgcgtcctggaaggactgccagcaatcgttctgctcgcgccgatcatgtttccgatcgcccgcacgcttggcatcaatgacatccattattcgatggtcgtggtggtcgccatgaatatcggcctgatggcgccgcccatcggtatcggcttttacatcgcctgcaagatcggcaacgtgtcgccggacgaagccatgggtgccatctggccctatctcgcagccatgatcatcggcctgctgctgattgcagcaatccccggattttcgaccattctgctctga

SEQ ID NO: 56118 - protein, 429 aa, Agrobacterium tumefaciens str. C58
MLESLGNLNLAIFLGLFVAVFLVLGVPIAFCFGLGTLAYLTFTTWVPTIVMIGRMDEGMSGIILLSVPVFVLLGCVLDATGMGKAIVELLSSMFGHIRAGMSYVLLGSLFLVSGISGSKVSDMATVAPALFPEMKRRGHKPKEMIALLATGAAMADTVPPSIVLIVLGSAAGVSIAGLFTSGFMIAMVLLLVLAVLARWKARDENMEGAKRTPWPQVGKAALIAAPALVLPFLIRSLVGGGVATATEVSTIAVLYAMIVGAVLYGGISLRKLYSMLVETAALSGAILLILGCASAMAWGLTQSGFAFQLTAMITDLPGGWMTYMVVSILIFMILGCVLEGLPAIVLLAPIMFPIARTLGINDIHYSMVVVVAMNIGLMAPPIGIGFYIACKIGNVSPDEAMGAIWPYLAAMIIGLLLIAAIPGFSTILL

SEQ ID NO: 56119 - DNA, 1314 bp, Corynebacterium glutamicum ATCC 13032
  CDS (1)..(1314)
atgttgtcgccagcagctgtagcagctttaattcttgtcatcggcattgtggtgctcatcatcgcatcagtgcccgttgccattgccatcggtttgccatcactttttgccgcgatggccgtgcttggcccagaaaacgccgcgcaggccgtcgcgcagcgcatgtttaccggcacaaactcctttacactccttgccattccgttcttcgtgttggcgggtttgctgatgaactcgggtggtattgccacgcggcttatcgacgccgcgaaggtgcttgtcggccgcatgcctgcctccatggccaatacgaatatcgcagcaaatggtctcttcggagcagtttcaggggcagcggtagcatcagcttctgccgtgggaaccgtcatgacaccaaaaatgaaggaagagggctactcgcgcgcttacgcagcggccgtcaacgtggcttcagcacctgcgggcatgctgatcccgccatcaaacacttttattgtgtattccttggtgtcctcgacatcaattgcagcactatttatggccggtgttggacccggtctgctctggattctggcctgtgtcatcgtgggaacttggttagcgcgaaaggaaaactacaagcgcgagcagattcatccaacattcaagcagtcgctcgttgtgctgtggagggcgctgccttcactgctcatgatcgtcattgttgttggaggtatcttgctgggctggttcactccaactgaatccgctgctattgctgtagtgtactgcctggtcttgggctttatttaccgcacaatcaaggtgggagatctggcagatattttgctcaaggcaactcgcaccacatcaattgtcatgttgctcattgcagtttctgcagcactgtcgtgggtgatggcctttgccaagatccctcagatgatctctgatgcgcttctttcggtatccgattccaaggttgtcatcttgttgatcatgatgttcatcctgttactcatcggtaccgtaatggacccaacaccagcaattttgatcttcgtcccgatcttccttccagtggttaccgaacttggtgtggacccagtccacttcggtgcgatggtggtaatgaacctgtccgtgggcgtgattaccccaccagtaggcaacgtgttgttcgttggttcgcaagtggcagggctgcgtgtggaaactgtgatcagacgactgtggccgtatctcattgccattattgttgcgctgttcgtggttgttttcgtaccgcagatctctatctggctgcccacaacaatgggattgatgggaggctaa

SEQ ID NO: 56120 - protein, 437 aa, Corynebacterium glutamicum ATCC 13032
MLSPAAVAALILVIGIVVLIIASVPVAIAIGLPSLFAAMAVLGPENAAQAVAQRMFTGTNSFTLLAIPFFVLAGLLMNSGGIATRLIDAAKVLVGRMPASMANTNIAANGLFGAVSGAAVASASAVGTVMTPKMKEEGYSRAYAAAVNVASAPAGMLIPPSNTFIVYSLVSSTSIAALFMAGVGPGLLWILACVIVGTWLARKENYKREQIHPTFKQSLVVLWRALPSLLMIVIVVGGILLGWFTPTESAAIAVVYCLVLGFIYRTIKVGDLADILLKATRTTSIVMLLIAVSAALSWVMAFAKIPQMISDALLSVSDSKVVILLIMMFILLLIGTVMDPTPAILIFVPIFLPVVTELGVDPVHFGAMVVMNLSVGVITPPVGNVLFVGSQVAGLRVETVIRRLWPYLIAIIVALFVVVFVPQISIWLPTTMGLMGG

SEQ ID NO: 56121 - DNA, 1854 bp, Fusobacterium nucleatum subsp. nucleatum ATCC 25586
  CDS (1)..(1854)
atgaaagtatttaataaattggaagagtggctaggaggaagtctatttattggaatgtttgttatacttgttatgcaaatattttctagacaaatttttaatagccctcttatttggagtgaagagctatcaagattaatatttgtttatgttggcttacttggagtcagtatgggaataagaagtcaacaacatataatgatagattttttgtatgcaaaatttccaaaatcaatgcaaaaaattattttcacaattatacaaattttaattttagcttgtttaatattctttttatattttggttatgatttatttataaaaaaagaagaaatagagatagtttcattgggaatttcaatgaaatggatgtatttagctttaccacttattactttattgatgttagttagattttaccaagcatattcagaaaattatgctcaaaataaagtatatattaaacctatttttatattagctttaatgataatcttagtacttatagcatttataaagccagaattatttaaaattttaaaattatctaattattttgatcttggtgaaatgactatatattatgtactaatagcttggttagtaatgatattttttggagttcctgttggttggtccttacttgtagcttgtattttatattttgctcttactagatggaaagttgtatattttgcagctgataaattagtttatagtttggatagttttagtcttttaagtgttccattcttcatacttactggaattttaatgaatggagcaggaataacagaaagaattttcaactttgctaaggctatgttaggacattatacaggtggaatgggacatgttaatgttgcagcaagtttaatattttctggaatgtctggttcagctatcgctgatgcaggtggtttaggtcaacttgaaataaaggcaatgagagatgaaggctatgatgatgatatttgtggaggacttacagctgcctcttgtattataggaccattagttcctcctagcataagtatgattatatatggagttattgcaaaccaatcaatagcaaaattatttttagctggttttgttcctggcttcttaactactattgcacttatgataatgaactactttgtatgtaaaaaaagaggctataaaaaaactgctaaggcaagtcctaaggaaagatggatagcatttaaaaaatcattttgggcattattaactcctattctaataattggtggtatattctctggaatatttactcctactgaagctgctgttatagcaacattttattctataattttaggaggatttatttataaagaattaactgtaaaatcattctttaaacattgtgttgaagctgttgcaataagtggagtaactgtacttatgataatgacagtaactttctttggtgatattattgcaagagaacaagttgctatgagagttgcagaaatatttattaaatatgcaacatcacctatgatggttcttgtgatgataaacttattacttttgttcttaggaatgtttatagatgccttagctttacaatttttagtattaccaatgttgattcctattgcagaacaagttggaattgatttagtattctttggagttatgacaacattaaatatgatgattggaatattgactcctccaatgggaatggctctctttgtagttgcacaagttggaaaaatgagtgtaagtacagtagcaaaaggagttttacctttcttgttaccaatatttattactttagtaattataactatattccctcaaatcattttatttttacctaatttgatagtgggaggctaa

SEQ ID NO: 56122 - protein, 617 aa, Fusobacterium nucleatum subsp. nucleatum ATCC 25586
MKVFNKLEEWLGGSLFIGMFVILVMQIFSRQIFNSPLIWSEELSRLIFVYVGLLGVSMGIRSQQHIMIDFLYAKFPKSMQKIIFTIIQILILACLIFFLYFGYDLFIKKEEIEIVSLGISMKWMYLALPLITLLMLVRFYQAYSENYAQNKVYIKPIFILALMIILVLIAFIKPELFKILKLSNYFDLGEMTIYYVLIAWLVMIFFGVPVGWSLLVACILYFALTRWKVVYFAADKLVYSLDSFSLLSVPFFILTGILMNGAGITERIFNFAKAMLGHYTGGMGHVNVAASLIFSGMSGSAIADAGGLGQLEIKAMRDEGYDDDICGGLTAASCIIGPLVPPSISMIIYGVIANQSIAKLFLAGFVPGFLTTIALMIMNYFVCKKRGYKKTAKASPKERWIAFKKSFWALLTPILIIGGIFSGIFTPTEAAVIATFYSIILGGFIYKELTVKSFFKHCVEAVAISGVTVLMIMTVTFFGDIIAREQVAMRVAEIFIKYATSPMMVLVMINLLLLFLGMFIDALALQFLVLPMLIPIAEQVGIDLVFFGVMTTLNMMIGILTPPMGMALFVVAQVGKMSVSTVAKGVLPFLLPIFITLVIITIFPQIILFLPNLIVGG

SEQ ID NO: 56123 - DNA, 1284 bp, Xanthomonas campestris pv. campestris str. ATCC 33913
  CDS (1)..(1284)
atgggcatcgccatgttgttgggaacctttgtggtgctgctgctgatcggcgtgccggtggcctacgccctgggcgcggccgcactggccacgttgctgtatctggacctgcccacggtggtgctggtgcagcagatttccgccggtagcggctcggcgtcgttgatcgcgattccgttgtttatctttgccggcgagctgatgctgcgtggtggcatttccgaacgcctgatcgcgctggcgtcatcgctggtggggcgtgtgcgcggtggcctgggccaggtcagcgtgctgtcgtcgctgttcttcggcggcgtgtccggctcagcgattgccgatgtctcggcggttggcggcacgatgattccgcagatgatcaagcgcggctacgaccgcgattacgcggtgaacgtgagcatgaccgccgcgctggtggcgttgctggtgccgccttcgcacaacctgatcctgttctcggccgcggccggcggtggcttgtcgatcgccgatctgttcgcggccggcatcgtgcctgcgttgctgatgaccgccgccatgatggtcaccggctatgcggtggcgcgccatcgcggctacggcaccgagccgttcccgggctggcgtgcggtggccttgcgcctgttcggcgcactgccgggcctgggcctggtggcgctgatcttcatcggtatccgcgccggcatctttaccgcggtggagagtgcggccatcgcggtggtgtatgcgttgatcgtcaccgcattgctgtatcggcagctgcgctgggccgagttcttcgctgcggtgacgcatgccgcgcgcaccaccggcgtgatcctgttcgtgatcgccactgcggcagtattcggctggttgcttgcgtacctgcaagtgccggcggcggcggtgaagttcctgcaggccattgccgacagcaagaacaccgtgttgctgatgatcgtggtgatgctgctgctgctgggcatgttcatggacctggcaccgaagatcctgatctgcacgccgatcttcctgccggtggtcaaggcctacggcatcgacccgatccacttcggcttggtgatggtgctggccggcggtatcggcttgatcacgccgccgatcggctcggtgttgttcattggtacctcgatcggcgaaatcaccgtggcccaaagcatgcgcaccatctggccgttctggctggcggcgttgtgcgtgttgctgatcgtggcgttcttcccggagctgtcgctctggttgcccagggcactgcgcgcgtaa

SEQ ID NO: 56124 - protein, 427 aa, Xanthomonas campestris pv. campestris str. ATCC 33913
MGIAMLLGTFVVLLLIGVPVAYALGAAALATLLYLDLPTVVLVQQISAGSGSASLIAIPLFIFAGELMLRGGISERLIALASSLVGRVRGGLGQVSVLSSLFFGGVSGSAIADVSAVGGTMIPQMIKRGYDRDYAVNVSMTAALVALLVPPSHNLILFSAAAGGGLSIADLFAAGIVPALLMTAAMMVTGYAVARHRGYGTEPFPGWRAVALRLFGALPGLGLVALIFIGIRAGIFTAVESAAIAVVYALIVTALLYRQLRWAEFFAAVTHAARTTGVILFVIATAAVFGWLLAYLQVPAAAVKFLQAIADSKNTVLLMIVVMLLLLGMFMDLAPKILICTPIFLPVVKAYGIDPIHFGLVMVLAGGIGLITPPIGSVLFIGTSIGEITVAQSMRTIWPFWLAALCVLLIVAFFPELSLWLPRALRA

SEQ ID NO: 56125 - DNA, 1293 bp, Yersinia pestis KIM
  CDS (1)..(1293)
atggacgcatttattttagtttttaccctggcaattctattggctattggtgtccccgttgcctatgccgtgggcctcagtgccattgcaggcgcgttttggattgatttgccactggaagccgtgatgatccaaataaccagtggggtcaataaattttccctactggctattcccttctttattctggcgggtgccattatggcggagggcggtattgcacgacggctggtcaactttgcctatatcttcgtgggctttatccgcggtggcctgtcattggtgaatattgtcgcctcaacattttttggtgctatttccggctcttcggtggccgataccgcctctatcggctcagtgatgatccctgagatggataaaaaaggctaccctcgcgattttgccgctgccgtgaccgccagtggttcagtacaggcaatattgacgccacccagccataactcggtgatctattcactggcaaccggtgggacggtctccatctccgccctgttcattgcggggatcgttccaggcctgttacttagcctgaccttgatgctcatgtgtgtcggcttcgcctataagcggggttatcccaaaggtgagcgggtgccattccgtcaggcacttaaaatttttgtcgatacgctatgggggctgatgacggttgttatcatcatgggcggtatcctgtcaggggtgtttaccgcgactgagtccgcggctatcgcctgcttatggtcattcttcgtcaccatgtttgtctaccgtgattataagtggtccgaactgcccaaactgatgtatcggacggtcaaaaccgtcactattgtcatgatcctgatagggtttgccgccagtttcggtgccatcatgacctacatgcaattaccggaacgtatcactgatttctttacctctatttctgataataaatacgtcattctgatgtgcatcaacatcatgctgctgctgattggtacgctgatggatatggcaccgctgattttgatcctcacaccggtattaatgccggtaaccaattcgttgggcattgacccggtccatttcggtatgattatgttgattaatctgggaattggcctgattacgccgccagtgggatcggtcttattcgttgccagtgcggtgagtaaacaaaagatagagcaagtggtaaaagccatgttgcccttctacggtgcgttattctttgtgctgatgctggtgacctatattccggaaatctctctgtggttgccacggatgtttggaatatataacggttaa

SEQ ID NO: 56126 - protein, 430 aa, Yersinia pestis KIM
MDAFILVFTLAILLAIGVPVAYAVGLSAIAGAFWIDLPLEAVMIQITSGVNKFSLLAIPFFILAGAIMAEGGIARRLVNFAYIFVGFIRGGLSLVNIVASTFFGAISGSSVADTASIGSVMIPEMDKKGYPRDFAAAVTASGSVQAILTPPSHNSVIYSLATGGTVSISALFIAGIVPGLLLSLTLMLMCVGFAYKRGYPKGERVPFRQALKIFVDTLWGLMTVVIIMGGILSGVFTATESAAIACLWSFFVTMFVYRDYKWSELPKLMYRTVKTVTIVMILIGFAASFGAIMTYMQLPERITDFFTSISDNKYVILMCINIMLLLIGTLMDMAPLILILTPVLMPVTNSLGIDPVHFGMIMLINLGIGLITPPVGSVLFVASAVSKQKIEQVVKAMLPFYGALFFVLMLVTYIPEISLWLPRMFGIYNG

SEQ ID NO: 56127 - DNA, 1263 bp, Oceanobacillus iheyensis HTE831
  CDS (1)..(1263)
atgattattgttattttcatccttcttttgattattggtgcaccgattgctgtagcaataggtttgtccagttttgttgccatgatgcaagaaggagtttcaattgatgtattctccagaaccatttttgcaggaatagactcgtttactctcatggccatacctttttttatctttgctggagatttgatgttagccgggggcacgtcgaaaagattaatagattttgctaaaaagttagtcggctggtcaactggtggattacccattgcaggtgtaatgtcttccatgctatttgcagcactatcaggatcaagcccggccacggtagctgcaatcggtggtataatgattccttcattaaatgatgctggctattcacgaaaatttgcaataggtttaatgacgactgccggtaccttaggaattattatcccaccaagtatcacacttttagtgtatggttcatccgctgaggtgtccatcagtaatttgtttcttgctggaatcgttccaggagtttttataggattggtacttattattgtaagttatatcatctcaaaaaaggaaggatttaaaccagaaggcagggcgagcctaggagcagttggaaaatcatttatctctgccatatgggggatattacttccggttattgttttaggaggcatctattttggcgtcttcacgcctacagaagctgctgctgttgcgatcgtttatagcctaattattggattatttgtttataaggaattaacgttaagaagtttgatcgatgttacgaagaaatcagttattacttcttctatgattatgcttgttattgcagcctctaatgtgtttagctggtatctgacctttgagcaaatacctactaatcttgcatctgttttgcttaattatgcgaatacagaagtagctttcttattccttgttatagttattttattactagttggaatgttcatggatacaagtgctgcggtgttaatatttgttcctttattccttcctatggtaagtcaactgggtattgaccccattcattttggaataattatgatagtcgctctatctattggaatgattacaccaccatttggtctgaatctatttgtggcttcagggatcagtaaagtatcattagtagaagtaatcaaaagtacagcgccatttattttggttatgatattcgccttacttgttattacattcgttccagaactttccttatttttactcgggatttttgaataa

SEQ ID NO: 56128 - protein, 420 aa, Oceanobacillus iheyensis HTE831
MIIVIFILLLIIGAPIAVAIGLSSFVAMMQEGVSIDVFSRTIFAGIDSFTLMAIPFFIFAGDLMLAGGTSKRLIDFAKKLVGWSTGGLPIAGVMSSMLFAALSGSSPATVAAIGGIMIPSLNDAGYSRKFAIGLMTTAGTLGIIIPPSITLLVYGSSAEVSISNLFLAGIVPGVFIGLVLIIVSYIISKKEGFKPEGRASLGAVGKSFISAIWGILLPVIVLGGIYFGVFTPTEAAAVAIVYSLIIGLFVYKELTLRSLIDVTKKSVITSSMIMLVIAASNVFSWYLTFEQIPTNLASVLLNYANTEVAFLFLVIVILLLVGMFMDTSAAVLIFVPLFLPMVSQLGIDPIHFGIIMIVALSIGMITPPFGLNLFVASGISKVSLVEVIKSTAPFILVMIFALLVITFVPELSLFLLGIFE

SEQ ID NO: 56129 - DNA, 1287 bp, Oceanobacillus iheyensis HTE831
  CDS (1)..(1287)
atgggatttctattattagccatcttcttagtattaatggttataggtgtaccaattgcgtttgttattggaatagttgctttacttgggatcagtggaattccttatacaccagaagctacagtagcaatgaaaatggtgaatggtcttgattcctttgtcttattagctgttcctttattcattctagcagcaaacttaatgaattcaggtaaaatctcagagaagctgattgagttagcattagctattgttgggccaatacgtggagggcttgctcatgcaaatgtattggtgtctatgatgtttgctggtgtttctggagcagcacaagcggatactgctggtgtagggaaagttttaataccgagtatgttacgaaagggctatgataaagaaacggcagtaggggttactgcagcatcctcgacagttggcgttgttattcccccaagtattccgatgattatttttgctggtcttacgaatgcttctatcggtgctttatttttaggaggaattatccctggtattctaattggtgttggaatgatggttcttatttacatcattgcattgaagagaaactatccgaaagatgcaaaagtggaatttaaagtatttttaaaattgttattggaagcgattccagcattgcttactccggtaatcattattggtggaattatcaccggattttttacagcaacagaagcagctgcggtagcatcactttatacgattattatttgcatgttttactataaaactttgaaactcaaagattttccaaagatattattcgatacactagcacttagctcgttatccttatttgctttagcagctgcgagtgcattaggtgagttaatgagctattaccaattaggaacaatggctcaagaattttttgcgaataatattggggcagagtggttatttatagtaattattatcgttttcttcttatttgtagggacatttatggatgcaataccagcaatgattttatttgttcctgttattttacctactgcattggaatttggaatggatcccgtacacttgggattaattgtcgtcattacgttagcaattggattaattacaccaccatatggattatgtttattgttggctgcgaaaattgggaatatgtcgacggaacgctcttttatagcagtcatgccttatattgcgatcgttatagtagtcctgttatttattgcgtttttcccgaatatcgcattctatattccgaaacttattaatcctagcttattctaa

SEQ ID NO: 56130 - protein, 428 aa, Oceanobacillus iheyensis HTE831
MGFLLLAIFLVLMVIGVPIAFVIGIVALLGISGIPYTPEATVAMKMVNGLDSFVLLAVPLFILAANLMNSGKISEKLIELALAIVGPIRGGLAHANVLVSMMFAGVSGAAQADTAGVGKVLIPSMLRKGYDKETAVGVTAASSTVGVVIPPSIPMIIFAGLTNASIGALFLGGIIPGILIGVGMMVLIYIIALKRNYPKDAKVEFKVFLKLLLEAIPALLTPVIIIGGIITGFFTATEAAAVASLYTIIICMFYYKTLKLKDFPKILFDTLALSSLSLFALAAASALGELMSYYQLGTMAQEFFANNIGAEWLFIVIIIVFFLFVGTFMDAIPAMILFVPVILPTALEFGMDPVHLGLIVVITLAIGLITPPYGLCLLLAAKIGNMSTERSFIAVMPYIAIVIVVLLFIAFFPNIAFYIPKLINPSLF

SEQ ID NO: 56131 - DNA, 1308 bp, Oceanobacillus iheyensis HTE831
  CDS (1)..(1308)
atggatatagctgttcaggcaggattaattcttctcgtaggtattgtgtttttactcattataggggtaccaatagcaattagtgtaggagtcagttctgttcttgctatgtttacgatattagagtttgataatggtcttctcacatcagcacagcgtatgtttacaggaataaattcatttacgttactagcaatcccattctttgtattagcaggcgttattatgaataatggaggcatcgcgtcgaaattaatcaattgtgcaaaaattttaagtggaaaaatgcctggatccttagcgcatacaaatattttagctaatatgctattcggttctattagtggatcggctgttgctgcagcagctgcagtcggaagcacgatgggagagcaacaagaaaaggaaggctataaaagagagtttagtgcagctgtaaatataggctccgcaccaacgggtatgctcattccacctagtaatattatgattgtcttctcactagttagtggtggtacttctatagcagctttatttttagctggatacgtacctggacttttgtggggccttgcttgtattttggtagcccttatcattgcgaagaagagaggttataaaagccaaatagaaataagttggaaacaaaaattattagtaatactggatgcgataccaagtcttctgcttatcgtgatcgtaattggcggtatagtaggaggagtattcaccgctacggaagggtcggccatagcggtagtgtattccttgctattatcatttgtctaccggtcaattaagataagagatttaccaagtattttattagaagctactagaacaacttctatcgtggtgtttttaataggtgtttctaccattatgtcttgggtaatgtctttcacaaacattccaggactaatcgctgatttattactttccatttcggataacatgattattattttattaatcatgaatatcgttttacttattattggtacatttatggatccgactccggcagtacttatttttacaccgatttttttacctattgcattagatctaggaatggatccaattcattttgggattatgatggtattgaatttaagtattggaacgattactccccctgtaggaccggttttatttgtcggagcaagagttgctaagttaccgatagaaaatgtgattaagccactggctccattttttctagtaacgattgtgttattattactggttacttttgttccagctatatctctgttcattcctaaattatttggagtaatggaatag

SEQ ID NO: 56132 - protein, 435 aa, Oceanobacillus iheyensis HTE831
MDIAVQAGLILLVGIVFLLIIGVPIAISVGVSSVLAMFTILEFDNGLLTSAQRMFTGINSFTLLAIPFFVLAGVIMNNGGIASKLINCAKILSGKMPGSLAHTNILANMLFGSISGSAVAAAAAVGSTMGEQQEKEGYKREFSAAVNIGSAPTGMLIPPSNIMIVFSLVSGGTSIAALFLAGYVPGLLWGLACILVALIIAKKRGYKSQIEISWKQKLLVILDAIPSLLLIVIVIGGIVGGVFTATEGSAIAVVYSLLLSFVYRSIKIRDLPSILLEATRTTSIVVFLIGVSTIMSWVMSFTNIPGLIADLLLSISDNMIIILLIMNIVLLIIGTFMDPTPAVLIFTPIFLPIALDLGMDPIHFGIMMVLNLSIGTITPPVGPVLFVGARVAKLPIENVIKPLAPFFLVTIVLLLLVTFVPAISLFIPKLFGVME

SEQ ID NO: 56133 - DNA, 1305 bp, Oceanobacillus iheyensis HTE831
  CDS (1)..(1305)
atgagcccagaacttattggatttttaggtattatagctattttgatactgtttttcctgaagattccaattgctgtatctcttattcttgttagtttactaggaacaagtttcattagagggtgggaggtagcctttgcacagttggggagaaccccttttgatacatctagtaattattcactaagtgttattccgttatttattctgatgggtatgattctttcttatacaggaattggtaaagatttgtatagattggtagacacttggattggccatttacggggtggtcttgcgatggctaccattggcacggcagctatattctcatccatttcgggttctttaaatgctactactgcaacagtagcaaaaatcgcattgccagaaatggacaaatataattataaaccagggctttcgacttctagtgttgcagcaggaggcacactagggattttaatccctccaagtgtaattttaattttgtacggaattctgacaagagaacccataggtgcgttattaatttccggcattattcctggtgttttgcagatcactatatttatcattacgatttatattcttgttcgtaaagatccttccattgcaccgccaagggaagagaaagcaagtattcttgagaagttacattcgcttaaaaatatttggccgtttatggggctatttttagtaagtattggcggtatatatttaggtattttcacgccgactgaagcagctggagtaggtgcgtttggtgctctattgtttgcattaatttccagaaaacttacgtgggaaactttgaaagactcactaagtgaatctattcgcttgactgcgtttattttctttattttaattggtgccaatttatttggacaattcttggcaatcagcagaattcctgtcatgcttacgacgtatgtcggaaatcttgacttgcacgcatatatcatccttatcggtattcttgctgtgttacttgtgcttggttgtttcattgaaagtttagctttaatcgttatcacattgcccattctgtatccaattattacggaattaggatttaacggtatttggtttggagtaattatgattatggttattaatatcggtgcattaacaccaccgttaggaataagtgtctacgttattaaaggagtagctagaaatattccaatacagtcaatcttcagaggggtcgttccaatgattatcgcaatgattgtatgtgtggcaattctagttgtttttccgcagatagttactgtattgccagatttaatgaaatga

SEQ ID NO: 56134 - protein, 434 aa, Oceanobacillus iheyensis HTE831
MSPELIGFLGIIAILILFFLKIPIAVSLILVSLLGTSFIRGWEVAFAQLGRTPFDTSSNYSLSVIPLFILMGMILSYTGIGKDLYRLVDTWIGHLRGGLAMATIGTAAIFSSISGSLNATTATVAKIALPEMDKYNYKPGLSTSSVAAGGTLGILIPPSVILILYGILTREPIGALLISGIIPGVLQITIFIITIYILVRKDPSIAPPREEKASILEKLHSLKNIWPFMGLFLVSIGGIYLGIFTPTEAAGVGAFGALLFALISRKLTWETLKDSLSESIRLTAFIFFILIGANLFGQFLAISRIPVMLTTYVGNLDLHAYIILIGILAVLLVLGCFIESLALIVITLPILYPIITELGFNGIWFGVIMIMVINIGALTPPLGISVYVIKGVARNIPIQSIFRGVVPMIIAMIVCVAILVVFPQIVTVLPDLMK

SEQ ID NO: 56135 - DNA, 1275 bp, Oceanobacillus iheyensis HTE831
  CDS (1)..(1275)
atgatacttgtattagttctatcgttaattgttctatttattatcggtgtacctgtggcaatttcattagggttatcttctagtctggcgatattagtagctggagacataccgttgttaacattggcacaacgtgcttttgtctcacttgattctttccctttactagcgattccgttgtttatacttgcgggtgctttaatggaatatggggggatatcacaacgattaataaacttggctaatgcaattactggtcatgtaccaggaggcttagcgattgtaactgtagtaaccacgatgttctttgctgctatatcaggatcaagtgtagccgcaactgcggcgcttggcgcaatcttgattccagcgatgattaatcgaggttatgataaagaatttgcaggtggagtacaggctgtttctggaacgttaggaattataataccaccgagtatacctttaatattgtatgggacagctgtcggggcatctattggagatttatttatcgccggaatggtaccaggaatcatcattggtattggactcgttgtaacggtgtatatattggctaaaaagcgtaattatttaaaagaaccaaagaaatcaagcaaagatattggcaaagcattcttagaagcaattccagcattaatcatgccaattatcattctaggcggaatatatagtggaatatttactgccactgaagctgctggtgttgcggttgcttatgcatttatcgttagtgttttcgtttacaaagcaattaataaagtaaacataaaagaaatattaacccaagcatctgtaacaacttctaccattatgtttattcttgctacggctggattatttagctggatactaacaattgaaaatataccgcaacaggttgctagtctaataacatctatttcagatagtccgatggtattcttaactatagttattctagtacttttacttgtgggtatgtttatggagacaaacgcttctattatcattttagctcctattcttgtgccggttgctgtagaactcggattagacccagttcattttggtattgttatgatcgttacattagcgattggtatggtaacaccaccattagggttgaatctatttgtagtatcaaaaataggaaaagtacgtattgatcatttaacaaaagggttaattcctttctatattgctattttaattagcttaatcgttataacatatatcccttccataacaatgagcctagtggaatggatgaaataa

SEQ ID NO: 56136 - protein, 424 aa, Oceanobacillus iheyensis HTE831
MILVLVLSLIVLFIIGVPVAISLGLSSSLAILVAGDIPLLTLAQRAFVSLDSFPLLAIPLFILAGALMEYGGISQRLINLANAITGHVPGGLAIVTVVTTMFFAAISGSSVAATAALGAILIPAMINRGYDKEFAGGVQAVSGTLGIIIPPSIPLILYGTAVGASIGDLFIAGMVPGIIIGIGLVVTVYILAKKRNYLKEPKKSSKDIGKAFLEAIPALIMPIIILGGIYSGIFTATEAAGVAVAYAFIVSVFVYKAINKVNIKEILTQASVTTSTIMFILATAGLFSWILTIENIPQQVASLITSISDSPMVFLTIVILVLLLVGMFMETNASIIILAPILVPVAVELGLDPVHFGIVMIVTLAIGMVTPPLGLNLFVVSKIGKVRIDHLTKGLIPFYIAILISLIVITYIPSITMSLVEWMK

SEQ ID NO: 56137 - DNA, 1308 bp, Oceanobacillus iheyensis HTE831
  CDS (1)..(1308)
atggatgtaactgtatggacagccattatattatttggatcgtttttcttactcttatttattggcgtaccgattgccgtaagtatcactatttcttcttttgtgtctattttaattctacttcctatgacaccatccttattagcggtgtcccaacaaatcattaccgggctagatagtacggtgttattggcacttgtattctttatgctggcgggaagtattatgaataatggcgggattgccgatcggctgattaatttagcaaagttaattggtggtagaatgtccggttcactcgcacatacgaatattatcggaaatacactgtttggcgcgatatcaggttcagcaattgccgcagccgcaacaatgggacggattatgcaccctcaagagaaaaaagcaggttatgacccttcgtatgcagcagctgtaaatatcgcttccgcaccgacgggattaattatccctccaagcgggatgccgattatttactctctattaaccggtggcacatcgattggtgctttatttatcgcagggtacttacctggtctgttgatgattgcgttactcatgatcgtcgcctatatattagcgaaaaaagccaaatatcctgtatccaaaccaatcagtggcggcgaatccttcaaagtaatacttcaagcgatccctagtttattattaattattattgtcataggtggaattgccggagggatttttacagcaacagaaggagctgcagtagctgtactatatgcttctatccttagcgttatttaccgtcagttaaaactaaccgacatccctaaaatacttagagaaacgacgatttattctggtattatcatgttattaataggagcatctactgcgatgtcctgggtacttgcatacgcaggtataccacaggcaattacaagcagtctattaagcattaccgataatacaaccattctactgttgatcatgttagtgattttactagtagttggaacctttatggatattgcaccagcgctattaattttcacaccgatattcttcccggtcgcaacacaaatgggcatcgatcccgtccattttggaatgataatggctgtagctcttgctattggagtaaccactccgccaattgggaccgtgttatttatcggaagtagtgtcagcggagtacctatcgaaaaaatcataccgaagctgctcatcttctatattccattaatcgtagcgctattactcgttgcgtttattccagaaatcagcttattcttaccaaagttatttggtttattggattag

SEQ ID NO: 56138 - protein, 435 aa, Oceanobacillus iheyensis HTE831
MDVTVWTAIILFGSFFLLLFIGVPIAVSITISSFVSILILLPMTPSLLAVSQQIITGLDSTVLLALVFFMLAGSIMNNGGIADRLINLAKLIGGRMSGSLAHTNIIGNTLFGAISGSAIAAAATMGRIMHPQEKKAGYDPSYAAAVNIASAPTGLIIPPSGMPIIYSLLTGGTSIGALFIAGYLPGLLMIALLMIVAYILAKKAKYPVSKPISGGESFKVILQAIPSLLLIIIVIGGIAGGIFTATEGAAVAVLYASILSVIYRQLKLTDIPKILRETTIYSGIIMLLIGASTAMSWVLAYAGIPQAITSSLLSITDNTTILLLIMLVILLVVGTFMDIAPALLIFTPIFFPVATQMGIDPVHFGMIMAVALAIGVTTPPIGTVLFIGSSVSGVPIEKIIPKLLIFYIPLIVALLLVAFIPEISLFLPKLFGLLD

SEQ ID NO: 56139 - DNA, 1302 bp, Shigella flexneri 2a str. 301
  CDS (1)..(1302)
atggatagttatatcgcgattacactgtttggctgtttttttgtgctggtctttattggtgtgcccatttcgttctcaatcggtattgccactgtagcttcaatgcttttgatgtttccctgggatatcgcggcaatcactgtttcgcaacgactggctaatggactggataactttgccctgttggcaatcccctttttcatctttgccggaacactgatgaacagcggcggtattgcgatacgtttgattaacctcgcccaggtaatggttggccgcgttcctggttcgcttggtcatgtgaacgtcctggcgaatatgatgtttggttccatttctggttcagccgttgcggcagctgctgccgttggtggcacactgaatcccattcagaccaaagaaggttatgatccggcattttctaccgctgtaaacgtctcatcttgtattactggattactgataccgccctcaaacgtgttaattgtgttttccctgacagctggcggcgtttctgtagcatcgctgtttatggcgggatatttgccagggatcttaatgggtcttgcggtaatgatagtctgcggcattattgctaaacgccgtggctacccgctttcagaaagagcaacctttgctcaggcctgtaaagcgtttctggatgccttaccaagtttgcttctggtgttcattgtgatgggcggcattctgggcggcatttttaccgcaactgaagcgtcagcaattgccgttgtctacacatttattctctcggtgctgatttaccgggaagtaaaatggcgccatttacccaaactgattctggagtcggttgttaccacttcgattgtattactgttgatcggtttttccgtgggcatgtcctgggcaatgactaatgctgatattccttatatgatcagcgacgcattgatggggatttctgataacccactgatcatattgctgctgattaatatcgtcttattaattgtcggcatctttatggacatgacaccggctgtactaatctttacaccgatcttcttgccgattgcacaagagctgggaatggacccagtacatttcggtattatgatggtggccaacctttgtattgggctgttaacaccgccggtgggtagtgcgctatttgttggttgttctatctcgggtgtgaagattcaacatttaatcaaaccattgctgctattttatgctgcattgctagtagcgttgatgatgatcacttacattccgcaaatatccttgttcattccacagctactagggctaatgtaa

SEQ ID NO: 56140 - protein, 433 aa, Shigella flexneri 2a str. 301
MDSYIAITLFGCFFVLVFIGVPISFSIGIATVASMLLMFPWDIAAITVSQRLANGLDNFALLAIPFFIFAGTLMNSGGIAIRLINLAQVMVGRVPGSLGHVNVLANMMFGSISGSAVAAAAAVGGTLNPIQTKEGYDPAFSTAVNVSSCITGLLIPPSNVLIVFSLTAGGVSVASLFMAGYLPGILMGLAVMIVCGIIAKRRGYPLSERATFAQACKAFLDALPSLLLVFIVMGGILGGIFTATEASAIAVVYTFILSVLIYREVKWRHLPKLILESVVTTSIVLLLIGFSVGMSWAMTNADIPYMISDALMGISDNPLIILLLINIVLLIVGIFMDMTPAVLIFTPIFLPIAQELGMDPVHFGIMMVANLCIGLLTPPVGSALFVGCSISGVKIQHLIKPLLLFYAALLVALMMITYIPQISLFIPQLLGLM

SEQ ID NO: 56141 - DNA, 1293 bp, Shigella flexneri 2a str. 301
  CDS (1)..(1293)
atggctgtgctgatttttctgggctgtctgttgggtggtattgctatcggtttgcctattgcctgggcactgttgttgtgcggggcggcgttaatgttctggctggacatgtttgatgtccagatcatggcacaaacgctggtgaacggagccgatagcttctccctcctggcgattccgttctttgtgctggcgggtgaaatcatgaatgcgggcggcttgttaaaacgcattgttgacctgccgatgaaactggtggggcataaaccaggcgggctgggctacgtcggcgtgctggcagctatgattatggcgagcctttctggttctgccgttgcggataccgccgccgttgccgctctactggtgccgatgatgcgcagcgccaactacccggtcaaccgggcggcggggctgattgcctctggcggcattatcgcgccaattattcccccttccattccgtttattatcttcggtgtttccagcggattatccatcagtaagctgtttatggcgggcattgcccctggcataatgatgggcgcaacgctgatgcttacctggtggcggcaggccagtcgccttaatttaccccgccagcaaaaagcaacgatgcaggaaatctggcactcttttgtctccggtatctgggcgctgtttcttccagtcatcattattggcgggtttcgctccggtctgtttacccctaccgaagccggggccgttgctgctttctatgcgctgtttgtcgccacagttatttaccgtgaaatgaccttcgccacactttggcatgtactcattggcgcggcgaaaaccacctcagtggttatgtttctggtggcctcggcacaagtttccgcctggctgattaccattgctgaactgccgatgatggtttctgatttactgcaaccgttggtcgattcaccgcgtctgctgtttatcgtcattatggtggctatcctgattgtcggcatggtcatggatttaacgccgacggtattaattcttaccccggtattaatgcctttagttaaagaggcaggaatcgatccgatttatttcggtgtcatgtttatcattaactgctcaatcggcttaattacaccgcctatcggtaatgtacttaacgttatttcaggggtggcaaaactcaaattcgatgatgcagtcagaggcgttttcccttacgtcctggttttatattcattattagtcgtatttgtttttattcccgatctcatcatcctccctttgaaatggatggtaatgctgccaacttactga

SEQ ID NO: 56142 - protein, 430 aa, Shigella flexneri 2a str. 301
MAVLIFLGCLLGGIAIGLPIAWALLLCGAALMFWLDMFDVQIMAQTLVNGADSFSLLAIPFFVLAGEIMNAGGLLKRIVDLPMKLVGHKPGGLGYVGVLAAMIMASLSGSAVADTAAVAALLVPMMRSANYPVNRAAGLIASGGIIAPIIPPSIPFIIFGVSSGLSISKLFMAGIAPGIMMGATLMLTWWRQASRLNLPRQQKATMQEIWHSFVSGIWALFLPVIIIGGFRSGLFTPTEAGAVAAFYALFVATVIYREMTFATLWHVLIGAAKTTSVVMFLVASAQVSAWLITIAELPMMVSDLLQPLVDSPRLLFIVIMVAILIVGMVMDLTPTVLILTPVLMPLVKEAGIDPIYFGVMFIINCSIGLITPPIGNVLNVISGVAKLKFDDAVRGVFPYVLVLYSLLVVFVFIPDLIILPLKWMVMLPTY

SEQ ID NO: 56143 - DNA, 1398 bp, Shewanella oneidensis MR-1
  CDS (1)..(1398)
atggccattgcaacactattttgcgtcttattcatttgcatgtttttaggtatgcccatcgcgatagcattaggcttttccagcatgctgaccattttatttttctccaatgattcacttgcttctgtggcattaaaactttatgagtcatcgtctgagcattatacgctgctggcgatccccttctttattttgtcatcggcctttttatctaccggcggcgtagccagacggatcatcgattttgcgatggattgcgttggccatattcgtggtggcttagccatggcatcggtaatggcctgtatgctctttgccgccgtgtcaggttcttcccccgcgaccgtcgctgccattggttctatcgtgattgtcggcatggtaaaagctggttaccccgaaaaatttgcctctggcgtgatcacaacctccggcaccctcggtattctaatccccccctcgattgtgatgctggtttatgccgcagccaccgaggtttcagttgctaaaatatttatggcgggtttagttcccggtttactgctgggatttttaatcatggtcgtgatctacattgtcgcgagaattaaaaatctcccctctatccccttcccaggctttaaaaaattaggggtatccagtgccaaagccattggcggtttagcactcattttcatcgtcttaggatcaatttacggtggcgtggctagcccaacagaagcctcggccgttgcctgtgtgtacgcatactttattgcggtatttggctatcgtgatattggtccattgaaaaatgtcgcatggcgtaaccctaatgaagccattccaagcgctatcgctcgtaacttaggtcatatggtgcttgggctgattaaaacccctatcgacaaagagatccgccatgtagtgcgtgatggtgccaaggtcagcataatgctgctgtttattattgccaacgccatgttgtttgcacacgtgctcaccactgaacgtattccacatattattgccgagtacattgtgggcatgggcctaccggcttggggcttcttaatcattgttaacttactgctgttagccgccggtaactttatggaaccatctgccatcgtattgattatggcacctatcctattccccattgccacacaattgggcattgaccctattcacttaggtatcattatggtggtcaacatggaaatcggtatgctcacgccgccggtaggactcaatctatttgtgacctcaggtattactggccgtaatattggttgggtgatccagtcggtattgccatggctagtatttatgctcgccttcttgatgttgatcacctatgtaccacaaatttccctgttcttgccagaattactggacaagctcaacggatattaa

SEQ ID NO: 56144 - protein, 465 aa, Shewanella oneidensis MR-1
MAIATLFCVLFICMFLGMPIAIALGFSSMLTILFFSNDSLASVALKLYESSSEHYTLLAIPFFILSSAFLSTGGVARRIIDFAMDCVGHIRGGLAMASVMACMLFAAVSGSSPATVAAIGSIVIVGMVKAGYPEKFASGVITTSGTLGILIPPSIVMLVYAAATEVSVAKIFMAGLVPGLLLGFLIMVVIYIVARIKNLPSIPFPGFKKLGVSSAKAIGGLALIFIVLGSIYGGVASPTEASAVACVYAYFIAVFGYRDIGPLKNVAWRNPNEAIPSAIARNLGHMVLGLIKTPIDKEIRHVVRDGAKVSIMLLFIIANAMLFAHVLTTERIPHIIAEYIVGMGLPAWGFLIIVNLLLLAAGNFMEPSAIVLIMAPILFPIATQLGIDPIHLGIIMVVNMEIGMLTPPVGLNLFVTSGITGRNIGWVIQSVLPWLVFMLAFLMLITYVPQISLFLPELLDKLNGY

SEQ ID NO: 56145 - DNA, 1317 bp, Corynebacterium efficiens YS-314
  CDS (1)..(1317)
atgttgtccccagctcttgttgccgccctgatcctgctgatcggcatcgtggtgctcatcatcgcgtccgtcccggtggccatcgccatcggcctgccatcattgttcgcggccatggccgtgctcggtccggagaacgccgcccaggctgtcacccagcggatgttcaccggcaccaactccttcaccctcctggccatccccttcttcgtgctggccgggtccctgatgaactccggtggcatcgccaccaggcttatcgacgcggccaaggtgctcgtcggtcgcatgccggcctccctggccaacaccaacatcgccgccaacggcatgttcggtgcagtctccggtgcggctgtggccgctgcttcagccgtgggtacggtcatgaccccgcggatgcgggaggagggttattcccggccgtactcggccgcggtcaacgtcgcctccgccccggccggcatgctcatcccgccgtccaacaccttcatcgtctactccctggtgtcctccacctcgattgcggccttgttcatggcaggtgtcgggccgggactgctgtggctgctggcggtggcgatcgtgggtacactgctggcacgcagggagaactacaggcgggccgttgatcgtccgagtctcgcccaggcactgctgatcatctggcgtgccgccccctccctgttgatgatcttcatcgtggtcggtggtatcctcctcggctggttcaccccgaccgaatcagccgccatcgcggtggtctactgtctggtcctcggtttcgcctaccgtgccatccgggtgcaggacctgccggatatcctgctcaaggcgacccgcaccacctcgatcgtgatgatgctgatcgcggtgtcctcggcactgtcctgggtcatggcgttcgcccgcatcccgcagatgatctccgatgcgctactggcggtgtccgactcgaaggtggtcatcctgctcatcatgatggtcatcctcctgctcatcggcacggtcatggacccgaccccggcgatcctcatcttcgtgccgatcttcctgccggtggtgacggaactgggcgtggacccggtgcatttcggcgccatggtggtgatgaacctgtcgcttggcgtgattaccccacccgtgggcaatgtgctcttcgtcggttctcaggttgcgggtctgcgggtggagacggtcatcggacgcctgtggccattcctcgctgccatcctcgtcgcactgtttctggtggtattcattccgcagatctccctctggctgcccaccatcatggggttggtgggcaccggctag

SEQ ID NO: 56146 - protein, 438 aa, Corynebacterium efficiens YS-314
MLSPALVAALILLIGIVVLIIASVPVAIAIGLPSLFAAMAVLGPENAAQAVTQRMFTGTNSFTLLAIPFFVLAGSLMNSGGIATRLIDAAKVLVGRMPASLANTNIAANGMFGAVSGAAVAAASAVGTVMTPRMREEGYSRPYSAAVNVASAPAGMLIPPSNTFIVYSLVSSTSIAALFMAGVGPGLLWLLAVAIVGTLLARRENYRRAVDRPSLAQALLIIWRAAPSLLMIFIVVGGILLGWFTPTESAAIAVVYCLVLGFAYRAIRVQDLPDILLKATRTTSIVMMLIAVSSALSWVMAFARIPQMISDALLAVSDSKVVILLIMMVILLLIGTVMDPTPAILIFVPIFLPVVTELGVDPVHFGAMVVMNLSLGVITPPVGNVLFVGSQVAGLRVETVIGRLWPFLAAILVALFLVVFIPQISLWLPTIMGLVGTG

SEQ ID NO: 56147 - DNA, 1281 bp, Pseudomonas putida KT2440
  CDS (1)..(1281)
atggaagcgttcattctgttgggcagtttcatcgtgctgattctgatcggcatgccggtagcctacgccctgggcctgtcggcactgatcggcgcctggtggatcgacatcccgctgcaggcgatgatgatccaggtggccagtggtgttaacaagttctccctgctggccattccattcttcgtgctggccggcgcgatcatggccgaaggcggcatgtcgcggcggctggtggcctttgccggggtgctggtgggcttcgtgcgtggcgggctgtcgctggtcaacatcatggcctcgaccttcttcggtgcgatttccggctcgtcggtagccgataccgcctcggtgggctcggtgctgatcccggagatggagcgcaaaggctacccgcgtgaattttccaccgccgtgaccgtcagtggctcggtgcaggcgctgctgaccccgcccagccacaactcggtgctgtactcgctggcggcgggcggcacggtatccattgcctcgctgttcatggcgggtatcatgcccgggttgcttctgagcgcagtgatgatgggcctgtgcctgatcttcgcgaagaagcgcaactaccccaaaggtgaagtcatcccgctgcgcgaggcgctgaaaattgccggtgaggcgctgtggggcctgatggccatggtcatcattctcggcggtatcctgtcgggggtgttcaccgcgaccgaatcggcagccgtggcggtggtgtggtcattcttcgtgaccatgttcatctaccgcgactacaagtggcgcgacctgcccaagctgatgcaccgcacagtacggaccatctccatcgtgatgatcctgatcggctttgccgccagcttcggctacgtgatgacgctgatgcagatcccgtcgaagatcaccaccgcgttcctgaccctgtcggacaaccgctacgtgatcctgatgtgcatcaacttcatgctgatgctgctgggcacggtgatggacatggcgccgctgatcctgattcttaccccgatcctgctgccggtgattaccggtatcggcgtggacccggtgcacttcggcatgatcatgctggtgaacctggggatcgggctgataacgccaccggtgggcgccgtgctgttcgtgggctcggccattggcaaggtgagtatcgagtcgacggtgaaggcgctgatgccgttctacctggcgctgttcctggtgctgatggcagtgacttacattccagcgatctcgctgtggctgcctagcgtggtgctgtaa

SEQ ID NO: 56148 - protein, 426 aa, Pseudomonas putida KT2440
MEAFILLGSFIVLILIGMPVAYALGLSALIGAWWIDIPLQAMMIQVASGVNKFSLLAIPFFVLAGAIMAEGGMSRRLVAFAGVLVGFVRGGLSLVNIMASTFFGAISGSSVADTASVGSVLIPEMERKGYPREFSTAVTVSGSVQALLTPPSHNSVLYSLAAGGTVSIASLFMAGIMPGLLLSAVMMGLCLIFAKKRNYPKGEVIPLREALKIAGEALWGLMAMVIILGGILSGVFTATESAAVAVVWSFFVTMFIYRDYKWRDLPKLMHRTVRTISIVMILIGFAASFGYVMTLMQIPSKITTAFLTLSDNRYVILMCINFMLMLLGTVMDMAPLILILTPILLPVITGIGVDPVHFGMIMLVNLGIGLITPPVGAVLFVGSAIGKVSIESTVKALMPFYLALFLVLMAVTYIPAISLWLPSVVL

SEQ ID NO: 56149 - DNA, 1347 bp, Escherichia coli CFT073
  CDS (1)..(1347)
ttgacaactatcgtaaacggaattttcattaacgagggaaatatggactttgaatatatctaccccgtcttaattttatttggcagttttgccgtcatgctggcaataggtgtgccaattacttttgcgattggtctttcttcgctgttatctattattactgccttaccacccgatgccgccatttctgtgatttcgcaaaagatgactgtggggctggatggctttacgctattagccattcccttcttcgtgttagccggaaacattatgaataccggtggtatagccagacgactggttaacctggcgcaagcattagttgggcgtcttcctggctcactggctcattgtaatatcctcgcgaatacactgtttggtgcgatttcaggttcagccgttgcgtcagccgcagcggtaggtgggattatgtcaccactgcaagaaaaagagggatatgatccggcgttttcagcagcggttaatattgcctctgcccccattggcctgatgatcccaccgagcaatgtgttgattgtttattccctcgccagtggcgggacttctgtcgctgcgttgttcttagctggatatctgccgggcatcctcaccgctgttgccttaatgtttgtagctgcactttatgcccgacgtcaccattatccggtggccgagcgcattaattaccgtcagtttttacaggtattccgcgaatcaattcctagcctgatgcttatttttatcattattggcggtattatcgcgggggtatttacgcctacagaagcatcggcaattgcggtaatttatagtttagccctggcgatgatttaccgggaaatcactcttaagaagctcaatgatattctgttagactccgtagtaaccagttcaattgttctgttactggtaggctgctcgatggggatgtcatgggccatgacgaatgctgatgttcctgagttgatcaacgaactgattacccgcgtttcggataacaaatgggtcattctttttattatcaatatcattctgttgatcgtcggtacctttatggatatcacgccggcgatcctgatatttacacctattttcctgccgatcgcccagcatctggggattgatccgattcacttcggcatcattatggttttcaacttaaccattggcctttgcacaccacctgtcggcaccattctgtttgtggggtgcagcattggtaaggtcagtatcgacagggcaataaaaccattactgccgatgtttctggcattgtttgtagtaatggcaattatttgttatttcccgcagcttagtctgatgctgccaggattattttcgacctga

SEQ ID NO: 56150 - protein, 448 aa, Escherichia coli CFT073
MTTIVNGIFINEGNMDFEYIYPVLILFGSFAVMLAIGVPITFAIGLSSLLSIITALPPDAAISVISQKMTVGLDGFTLLAIPFFVLAGNIMNTGGIARRLVNLAQALVGRLPGSLAHCNILANTLFGAISGSAVASAAAVGGIMSPLQEKEGYDPAFSAAVNIASAPIGLMIPPSNVLIVYSLASGGTSVAALFLAGYLPGILTAVALMFVAALYARRHHYPVAERINYRQFLQVFRESIPSLMLIFIIIGGIIAGVFTPTEASAIAVIYSLALAMIYREITLKKLNDILLDSVVTSSIVLLLVGCSMGMSWAMTNADVPELINELITRVSDNKWVILFIINIILLIVGTFMDITPAILIFTPIFLPIAQHLGIDPIHFGIIMVFNLTIGLCTPPVGTILFVGCSIGKVSIDRAIKPLLPMFLALFVVMAIICYFPQLSLMLPGLFST

SEQ ID NO: 56151 - DNA, 1278 bp, Escherichia coli CFT073
  CDS (1)..(1278)
atgacaatccttatatttattgtcagtttgttaggggctatcgcaattggcgttcccatcgcctgggcattattactgtgcggcatttcattgatgttctggatggatatctttgatgtgcaaattctggcacaaacgttggtaaatggcgcagacagcttctccctgttagccatccccttctttgtactggcgggtgagatcatgaacgcgggcggcctgtcgcaacgtatcgtcgacttgccaatgaaactggtaggccacaggccaggcggtctgggttacgtgggcgtgctggcagcgatgatcatggcaagcctgtccggttctgcggttgctgataccgcagctgtcgcggcgctgctggtgccgatgatgcgccaggccaactatccggtaaaccgcgccgccgggcttatcggttccggggggattattgcggccattatcccgccttccataccactcattatcttcggcgtctccagcggactctccatcagcaaactgtttatggcgggcattgcgccaggcatcatgatgggcgtcacgctgatggttacctggtggtggcaggcaaaacgactgaatttaccttgtcagccgaaagcctcactgcgagaagtctggcaatccttagtttccggtatttgggcgctctttttaccgataattattattggcggtttccgttcggggttatttacaccgaccgaagcaggcgcggttgccgccttctacgctctgttcgtctcggtggtggtctatcgcgagatgaccttctccacgctttatcatgtgctgattaacgcggcaaaaaccacatccgtggtgatgttcctggtggcctctgctgcggtatctgcatggcttattacgatcgccgaattacccatgatggtatcggagctattacaaccgttggttgattcgcctcgcttattattcatcgtcattatgctcgctattatggtgatcagtacggtcatggacttaacgcctaccgtattaattcttacaccagtattaatgccattagtgaaagaagcgggaatagatccggtctatttcggcatcatgtttattatcaactgttcaatatcactgattacgcctccagtcggtaatgttcttaacgtggtatgcggcgtggcgaaacttaaatttgacgatgcggtaaaaggcgttgcgccttacgtcatggttttattcatgttgttagcattatttatttttataccggagctcattaccgctcctcttaaatggatgagttaa

SEQ ID NO: 56152 - protein, 425 aa, Escherichia coli CFT073
MTILIFIVSLLGAIAIGVPIAWALLLCGISLMFWMDIFDVQILAQTLVNGADSFSLLAIPFFVLAGEIMNAGGLSQRIVDLPMKLVGHRPGGLGYVGVLAAMIMASLSGSAVADTAAVAALLVPMMRQANYPVNRAAGLIGSGGIIAAIIPPSIPLIIFGVSSGLSISKLFMAGIAPGIMMGVTLMVTWWWQAKRLNLPCQPKASLREVWQSLVSGIWALFLPIIIIGGFRSGLFTPTEAGAVAAFYALFVSVVVYREMTFSTLYHVLINAAKTTSVVMFLVASAAVSAWLITIAELPMMVSELLQPLVDSPRLLFIVIMLAIMVISTVMDLTPTVLILTPVLMPLVKEAGIDPVYFGIMFIINCSISLITPPVGNVLNVVCGVAKLKFDDAVKGVAPYVMVLFMLLALFIFIPELITAPLKWMS

SEQ ID NO: 56153 - DNA, 1893 bp, Bradyrhizobium japonicum USDA 110
  CDS (1)..(1893)
atgaccagcgtgagccatacgccgcatgtggataccgggctcgcggccggcagatctcaagcgaattcgcgccgatgggtggtgacagcgaacatggtgcttggccacgctgtcgcagtcccggcggccttgctcgtgctggcggagatcgtggtgctgtccgcgggcatcgtgggcagatacgtattccgctcgccgatcgtctggtccgacgagcttgccggcattctcttcctctggctcgccatgctcgggtctgtgattgcgttccagcgcggcgagcacatgcggatgaccgccatcgtcggcgtgctcagtgcggagctccgcgcgttcctggatgtcatagcggccgcggcgtcgctggcatttctcgtgctcgtcgtttggccggcctatgaattcgccgccgacgaggccttcgtcaccactccggcgctcgagatcgtcaacacctggcgtgcggcagcgctgccgatcggcatcgggctgatgctgatcgcagccgtcctccggctcatccgcatcgcgagcctgcgcagcttgctggcctccctggcgatcgtcgcaggcatcatcggaacgttcattctgctggcgccggtcttgaaggcacttggcaatctgaatcttctgatcttcttcgttttcgtggtcggcgcgatggtctttgcggccgtgccgatcgcgtttgcatttggcctcgccacggtcggctatctcgccctgacaaccagcacgcccgacgtcgtgatgatcggacgaatggacgagggcatgagccacttgatcctgcttgccgtgcctctcttcgtctttctcggccttctgatcgagatgacgggcatggcgcgcgccatggtcagcttcctggcaagccttttgggccacgtgcgtggcggactgcactacgtgctggtcggggcgatgtatctggtctcaggcatctccggctccaaggcggcggacatggctgcggtggctccagtgctgtttcccgagatgcggcagcgtggggccaagcccggcgatctcgttgcgctcctggccgcgacgggggcgcagaccgagacgattcccccgtcactcgttctgatcacgatcggctcggtgaccggtgtgtcgatctcggcgctgttcaccggcgggttgcttccgggcgtggtgctcgcgatcatgctcgcggccgtggtgtggtggcgataccgccgcgaggacctgtctcacgtcaaacgggcgacggggcggcagattggccgcgcctttgtgatcgcgataccggccatcgcgctgccattcgtgatccggaccgccgtcgtcgaaggcgttgcgacggcaacggaggtctcgaccatcgggatcctgtactcggcctgtgcgggactcttcatctatcgccagttcgactggcgccgcatctatccgatgctggtcgagacggcttcgctgtcgggggcgatcctgctcatcatcggcgcggcgacgggcatggcctgggcgctgacccagtcgggattttctgcctctcttgcaaagttcatgaccagccttcccggcggagtacctgtcttccttgccgtgacgatcgtgaccttcgtgatcctgggcagcgttctggaagggatcccggccatcgtcttgttcggcccgctcctgttcccgatcgcgcggcaggtcggggtgcacgatgtccactacgcgatggtggtcgttctcgcgatgggcatcggcctgttcgcgccaccgttcggcgtcggctactacgcggcttgcgccatcagccgcatcaacccggacgagggcatgaagccgatcgtgggctacatgatcgcgcttttgatcggcacgctgatcgtcgcggccgtgccctggctatcgatcggcttcctttga

SEQ ID NO: 56154 - protein, 630 aa, Bradyrhizobium japonicum USDA 110
MTSVSHTPHVDTGLAAGRSQANSRRWVVTANMVLGHAVAVPAALLVLAEIVVLSAGIVGRYVFRSPIVWSDELAGILFLWLAMLGSVIAFQRGEHMRMTAIVGVLSAELRAFLDVIAAAASLAFLVLVVWPAYEFAADEAFVTTPALEIVNTWRAAALPIGIGLMLIAAVLRLIRIASLRSLLASLAIVAGIIGTFILLAPVLKALGNLNLLIFFVFVVGAMVFAAVPIAFAFGLATVGYLALTTSTPDVVMIGRMDEGMSHLILLAVPLFVFLGLLIEMTGMARAMVSFLASLLGHVRGGLHYVLVGAMYLVSGISGSKAADMAAVAPVLFPEMRQRGAKPGDLVALLAATGAQTETIPPSLVLITIGSVTGVSISALFTGGLLPGVVLAIMLAAVVWWRYRREDLSHVKRATGRQIGRAFVIAIPAIALPFVIRTAVVEGVATATEVSTIGILYSACAGLFIYRQFDWRRIYPMLVETASLSGAILLIIGAATGMAWALTQSGFSASLAKFMTSLPGGVPVFLAVTIVTFVILGSVLEGIPAIVLFGPLLFPIARQVGVHDVHYAMVVVLAMGIGLFAPPFGVGYYAACAISRINPDEGMKPIVGYMIALLIGTLIVAAVPWLSIGFL

SEQ ID NO: 56155 - DNA, 2040 bp, Bradyrhizobium japonicum USDA 110
  CDS (1)..(2040)
atgctcaatcaggcgcttaatcatctcgaagaatggttgatcgcgacgctcattgcggccgcaaccggcctgatcttcatcgcggtcatgcatcgctatggcgcgggcgagtcgattgtcctgtcgcgctgggcgaccgcgcacgggatgacctggctcgcgacgctgtcgatgacggtgttcaccttcctgtccgagctcgacctgtcatgggcgcaggaactctgcatctacatgttcatctggatggcgaagttcggcgcggcctatggcgtgcgcaccggcatccatgtcggcgtcgacctgctcgtcaaccgcctgcccgaacattcgcgcaagcacgtgatcctgttcgcgctgctgtgcggcgcgctgttcaccggcatgatcgccgccttcggcgcctccttcgtgaaggagatgttccacactgggcagcagtccaacgatctggaagcgccgatgtggttcgtctatctggcgatcccgctcggctccggcctgatgtgcttccgcttcctccaggtctcatggttctactactggaccggcgagctgccgcaccacgacgagactcatgtcgaaggcgtggaggccgacgtctcgcccgcgctgcatccgcagcccgccggcgccgagaccaaagccgccgcgcgaaaagtgtcgccgctcggcgtcatcctgatcctggcgccgatcctgatcttcgccatgtgcctcgccgagaagttcggcgtggtgctgctgccgcactggatgcgggccgcgaccgtcttcgcgctgctgatcgcgctgatgctgaccggcatcccggtctcgatcgcgctcggcctcaccgtgatgacgttcctgttcacgctgaccacggtgccgatcgaggcggtctcgatgaagctcttcacgggcatcgagggcttcgagatcatggcgatcccgttcttcatcctcgccggcaatttcctcacccatggcggcgtcgcgcgccgcatgatcaatttcgcgacctcgctgatcggccactggcacggcggtctcggccttgccggcatcgtcgcctgcgcgatgttcgcgctggtctgcggctcgagcgtcgcgaccgtcgccgcgatcggcgcgatcgtgctgcccgagatggtccgccacggctatcccatgcatttcggcgccggcatcatcacggtcgcgggctccctcggcatcctgatgctgccgtcgatcccgaagatcgtctacgccgtctcgaccaatacctcgatcggcgcgctgttcgtcgcgggcctcttgcccggcatcatgctgacgacgatgctctgtatcgtcacctggtggctcgcgcgcaagcgcgactatccgcggatgccgaaggcgagctggggcgagaccgtccgcaccttccgcgagagcatctggggattgatgctggtcgtcatcatcatcggcggcatctacagcggcctgttcaccgccaccgaggcggcggcgatggccgcggtctactccttcgtcatcgcggtgttcgtgtacaaggccatcgggctgaaggacgtgccgcgggtgctgctccgtgccgccaacaccagcgcgatgctgctctacatcgtcaccaacgcggtgctgttctccttcgtgctctccaacgagaacctgccggcgacgcttgccgactggatcgccgcgcagaacctcggctgggtcggcttcctgctggtggtcaacgtgctgctgctgctcgccggcaacttcatggagccgaactccatcatcctgatcatggcgccgatcctggcgccggcggccaagaagctcggcatcgacctcgtgcatttcggcatcgtgatggacgtcaacatggaggtcggcctttgccatccgcctgtcggcctcaacctctatgtcgcctcgatgatcgcgcgaatgcgaataaccgagctcgcggtcgcggtgctgccgtggctgatcaccatgctcggcttcctcgtcatcgtgacctactggcccgatttgacgctgtggctgccgcgggtgctggggatgcattag

SEQ ID NO: 56156 - protein, 679 aa, Bradyrhizobium japonicum USDA 110
MLNQALNHLEEWLIATLIAAATGLIFIAVMHRYGAGESIVLSRWATAHGMTWLATLSMTVFTFLSELDLSWAQELCIYMFIWMAKFGAAYGVRTGIHVGVDLLVNRLPEHSRKHVILFALLCGALFTGMIAAFGASFVKEMFHTGQQSNDLEAPMWFVYLAIPLGSGLMCFRFLQVSWFYYWTGELPHHDETHVEGVEADVSPALHPQPAGAETKAAARKVSPLGVILILAPILIFAMCLAEKFGVVLLPHWMRAATVFALLIALMLTGIPVSIALGLTVMTFLFTLTTVPIEAVSMKLFTGIEGFEIMAIPFFILAGNFLTHGGVARRMINFATSLIGHWHGGLGLAGIVACAMFALVCGSSVATVAAIGAIVLPEMVRHGYPMHFGAGIITVAGSLGILMLPSIPKIVYAVSTNTSIGALFVAGLLPGIMLTTMLCIVTWWLARKRDYPRMPKASWGETVRTFRESIWGLMLVVIIIGGIYSGLFTATEAAAMAAVYSFVIAVFVYKAIGLKDVPRVLLRAANTSAMLLYIVTNAVLFSFVLSNENLPATLADWIAAQNLGWVGFLLVVNVLLLLAGNFMEPNSIILIMAPILAPAAKKLGIDLVHFGIVMDVNMEVGLCHPPVGLNLYVASMIARMRITELAVAVLPWLITMLGFLVIVTYWPDLTLWLPRVLGMH

SEQ ID NO: 56157 - DNA, 1266 bp, Bradyrhizobium japonicum USDA 110
  CDS (1)..(1266)
atgatcacgtctgccgccttcgtcgcgatcatgctggtcggcgtgccgatcgggctctgcctgtgcctcgccggcctcgtctacatcgccgcatccggcaatccggtgctgttccagtcctatccgctccagctgttcggcggcgtcgacagctacggcctgatcgccattccgctcttcatcctgatcggcgagatcatgaacggcggcggcatcacccgccgcatcgtcgacatggcgatggccttcgtcggctcgctgaagggcggactcgcctacgtcaacatcctcgccaacatgttcatctcctcgatcctgggatctgcgaccgcgcaggtcgcgatcatggcccagatcatggtgccggagatggagaagaagggttacgacaagacctttgcggcgggactgaccgcctatggcggcatgctcggcccgatcatcccgccctcggtgatgttcgtggtctacagcgttctcgcgcaggtctcggtcagcgacatgctgatcgccggaatcgtgccgggcgtcatcctgaccgtgatgttctgcctcgtcatcgcgctgatgggatacatctacaattatccccgcgccgactatcagacgccgcgccagcgcgtcatgacgatcctgcggacgtcgcccaccctgctgatcccgatcgtcatcgtcggcaccatcctcggcggcctcgccaacgcaacggaatccgcagccgtcggcgccgtcgccgcggcgctggtgggaaaatactggaccaaagagttcgagttctcccagctgccgcagatgatgctgcgcagtgccatctattcggcaatcgtgctgttcctcgtcgccgccgccgcggtgttctcctgggtcctgatcttcggcaaggtgccgcaggagaccgccggctggatccagtcggccgccaaggacccgatcagcttcatgctgatctgcaacgtcatcctgctggtgatcggcaccgtgatcgacggcattcccggcctgatcatgacggtgccgatcctgctgccggtcgcaaccgacgtctatcacatcgacccccggcatttcggcgtcgtcgtggtgatcaacctggtgctcggcctgttgtcgccgccggtcgggctctgcttcttcgtcgcggccgccgtcaccggcgccaagcccggcaagatgttcatggtgacgctgcccttcttcgtcatctcctgcgtcctgctggtgctgctctcgctcttcccctcgctctcgctgatcctcgtcaaatag

SEQ ID NO: 56158 - protein, 421 aa, Bradyrhizobium japonicum USDA 110
MITSAAFVAIMLVGVPIGLCLCLAGLVYIAASGNPVLFQSYPLQLFGGVDSYGLIAIPLFILIGEIMNGGGITRRIVDMAMAFVGSLKGGLAYVNILANMFISSILGSATAQVAIMAQIMVPEMEKKGYDKTFAAGLTAYGGMLGPIIPPSVMFVVYSVLAQVSVSDMLIAGIVPGVILTVMFCLVIALMGYIYNYPRADYQTPRQRVMTILRTSPTLLIPIVIVGTILGGLANATESAAVGAVAAALVGKYWTKEFEFSQLPQMMLRSAIYSAIVLFLVAAAAVFSWVLIFGKVPQETAGWIQSAAKDPISFMLICNVILLVIGTVIDGIPGLIMTVPILLPVATDVYHIDPRHFGVVVVINLVLGLLSPPVGLCFFVAAAVTGAKPGKMFMVTLPFFVISCVLLVLLSLFPSLSLILVK

SEQ ID NO: 56159 - DNA, 1293 bp, Bradyrhizobium japonicum USDA 110
  CDS (1)..(1293)
atggaactgatcatcctcggcgcctccttcttcggcttcctgatcctcggcgttccggtcgccttcgcgatcggcctctcggcgatctgcaccatcctctacgaggggctgccggttgccgtcatcttccagcagatgatgtcggggatgaacatcttctcgttcctcgccattccgttcttcgtcttcagcggtgagctgatgctgcatggcggcgtcgccgacaagatcgtgcagctcgccaagaatctcgtcggacacatccgcggcgggctcggcatgtcgaacgtggtcgcctgcacgctgttcggcggcgtatccggttcgcccgtggccgacgtgtcggcgatgggcgcggtgatgatcccgatgatgaaaaaggaaggtttcgacaccgactacgccgtcaacgtcaccacccacgcctcgctggtcggagccttgatgccgaccagccacaatatgatcatctatgccctggccgccggcggcaaggtatcgatcggcgcgctgatcgccgccggcctgctgccggcgctcgtgctgatggtgtgcatgctggtcgccgcttacgcggtcgcggtgaagcgcggctatccggccggcaagtttccgggctggtccgaggttttccgttccttcgcggcggcgctgcccggcctgctgatcgtcggcatcattctggccggcatcctgtccggcgtcttcacggcaactgaatccgcagcggtcgcggtcacctacacgatcctgctgacgttcttcatctaccgcaccatgaccctgccgaacttcctgcgggccgccgccaaggcggtgaagacgacgggcgtggtgctgctgctgatcggcgtctccaccatgttccagtatctgatgggactctacgaggtggccgatttcgccggcgacctgatgagcaaggtgtccacgcagccctggatcatcttcctgctcatcaacgtcatcctgttcgtgctcggcacgttcatggacatggcggcgaccatcctgatctgcaccccgatcttcctgccgatcgcgatgaaggcgggcatggatcccgtgcagttcggcatgctgatgctgatcaactgcgcgctggggctgaacactccgccggtcggaacgacgcagttcgtgggctgcgccatcggcggcatctcggtgggcgcggtgatgcgcaccatcctgccgttctacgccgcgctgatcgcggcgctgatgttcgtcacttacgttcccgcattctcgctgtggctgccgcgcctgctgatgggatacaagggatag

SEQ ID NO: 56160 - protein, 430 aa, Bradyrhizobium japonicum USDA 110
MELIILGASFFGFLILGVPVAFAIGLSAICTILYEGLPVAVIFQQMMSGMNIFSFLAIPFFVFSGELMLHGGVADKIVQLAKNLVGHIRGGLGMSNVVACTLFGGVSGSPVADVSAMGAVMIPMMKKEGFDTDYAVNVTTHASLVGALMPTSHNMIIYALAAGGKVSIGALIAAGLLPALVLMVCMLVAAYAVAVKRGYPAGKFPGWSEVFRSFAAALPGLLIVGIILAGILSGVFTATESAAVAVTYTILLTFFIYRTMTLPNFLRAAAKAVKTTGVVLLLIGVSTMFQYLMGLYEVADFAGDLMSKVSTQPWIIFLLINVILFVLGTFMDMAATILICTPIFLPIAMKAGMDPVQFGMLMLINCALGLNTPPVGTTQFVGCAIGGISVGAVMRTILPFYAALIAALMFVTYVPAFSLWLPRLLMGYKG

SEQ ID NO: 56161 - DNA, 1860 bp, Bradyrhizobium japonicum USDA 110
  CDS (1)..(1860)
atgacgatgacagccgccgtgcccgtctcgggcggccgccacgggagcattacgctgctgcttcgcctcagcgacgcgatcgcggccatcctcctggccgccgatctcgtggtcgtctgcgcgtccgtgctgctgcgcttctgcttcaatgcgccggtcgaatggtccgacgacgtcgcgcgcggattgatggtcggctcggccttcttcggcgcggcgagcgcgcttgcgcgcggcgagaatgtcggcgtgtccttcttccgcgatctgctgcccctgcgcctgcgtacgctggtcgacgccgcgagcgccgtgctcgtcgtgctgatctccttctatgtcgcctacaacgccatcaagctgggctcgctgacggcaggccagaccaccggctccggcctgccgctggagcttaccttctatccgatgggcatcggcgcgctgttcatgacggtgttcgcgatcgatcagctctgcgcaaggccgctgcctgatatcgtcagggggctcgttgccgttgccgtcgtcaccggcctctatctcgcctgggattatctgtcgccgtcctcggtgccgtcggcgggcacgttgatgctgatcggcttcttcgcaatgctgttcggcggcctgccgatcggctttgcgctggcgctggccgcgctgatcttcatctgggtcgagggcgcgctgcccggcgtgatcttcgcccagcagatggcgcgcggcatcgacaatttcgtgctgctcgcgatccccttcttcatcctcgtcggctacctcatggaagccaacggcatgtcggtgcgcctgatcgagctgttgcagcgcggggtcggccgcatgcgcggtgggctgaacgtcgtgatggtggcctcgatggtgctgttctccggcatctcaggctcgaagatggccgacgtcgccgcggtcggctcggtgctgattccggcggcgcgccgctcgaagcagaatccgggcggcgcggtggcgctgctggcggcgtccgcggtgatggcggaaaccattccgccctgcatcaacctgatcatcctcggctttgtggcgaacctgtcgatcggcggcctgttcgtcgcggggctcctgccggcggcgctgatggcgctggtcctgatcgcggtgtccatcatcttcggcaagcggccggcggaggccgaggacgttgcgccgcagatgccggtgtcgggcctgtggagcggcgcgatcgcctcgttcggcctgatcttcatgatcttcttcggcttcaagagcggctttgccacggccaccgaaatctccgcgttcgccgtggcctatgcgctggtcgtcggcagcctggtgttccgcgagctcagcttcaaatcggccgcgcacagtttcgtgcaggccgcgacgcgcgcagggctcgtgctgttcatcgtcgccgccgcgcagtcgctcgccttcacgctgaccttgcagcaggtgccgcacgcggtcggcgacttcatgctcggactatcgaagaccagcggcgtctggctgttcatcctgctcgcgatcgccgtgctgatcgtgatgggctcggtgctggaaggcgcggccgcgctgatcatcttcgggccgctgctcttgccggtggccgtgcagctcggcatcgatcccctgcatttcggcgtggtgctggtgatcgcgatgggcatcggcctgttcgctccgccgctcgggctcggactctatggcgcctgcctgatcggcaacgtgccgatcgagcagacggtgaagccgatcatgggttatcttggcctcttgttcctctgcctgctcgtcattgccttcgtgccatggctctcgaccgcgctgccgcgggcattcggctactga

SEQ ID NO: 56162 - protein, 619 aa, Bradyrhizobium japonicum USDA 110
MTMTAAVPVSGGRHGSITLLLRLSDAIAAILLAADLVVVCASVLLRFCFNAPVEWSDDVARGLMVGSAFFGAASALARGENVGVSFFRDLLPLRLRTLVDAASAVLVVLISFYVAYNAIKLGSLTAGQTTGSGLPLELTFYPMGIGALFMTVFAIDQLCARPLPDIVRGLVAVAVVTGLYLAWDYLSPSSVPSAGTLMLIGFFAMLFGGLPIGFALALAALIFIWVEGALPGVIFAQQMARGIDNFVLLAIPFFILVGYLMEANGMSVRLIELLQRGVGRMRGGLNVVMVASMVLFSGISGSKMADVAAVGSVLIPAARRSKQNPGGAVALLAASAVMAETIPPCINLIILGFVANLSIGGLFVAGLLPAALMALVLIAVSIIFGKRPAEAEDVAPQMPVSGLWSGAIASFGLIFMIFFGFKSGFATATEISAFAVAYALVVGSLVFRELSFKSAAHSFVQAATRAGLVLFIVAAAQSLAFTLTLQQVPHAVGDFMLGLSKTSGVWLFILLAIAVLIVMGSVLEGAAALIIFGPLLLPVAVQLGIDPLHFGVVLVIAMGIGLFAPPLGLGLYGACLIGNVPIEQTVKPIMGYLGLLFLCLLVIAFVPWLSTALPRAFGY

SEQ ID NO: 56163 - DNA, 1290 bp, Bradyrhizobium japonicum USDA 110
  CDS (1)..(1290)
atgacacctttcatcgttctcgccctgctgttcggcctgctggcactcggcacgcccgtcggcttcgcaatggccttctccggttcggtcggcctcgtgatggtcggcggatggggcacattgttcggcatcctgcaaaccgcgccgctgtcgactgtctcgtcctacgagctgatcaccatcccgatgttcctactgatggcggacctcgtgctgctgtcgggtgtcgcggacgacctgttcaagacggcgtcggcctgggtcgggcgcattcccggcgggctcggcatggcgacggcactggccggcgcaggttttggcgcgatctgcggcacctcgacggcctccgccgcgacgctgtcctcgaccagccttcccgcgatgatccgccagggctatgagcccaagatggccgccggcgtggtcgcgatatcaggcacgctgtcgatgctgctgccgaccagcgtcgcgctcgtcatcttcggcctgctcgccgaggtgaacatcggcaagctcctgatcagcggcatcatccccgcgatcctcgtcaccatcaccatcatggccacgatctacttcctggtctggcaggatccttcgcgcgcccccgctgcgaaatcggtgccgtggcgcgaaaaattcgcgctgttgtggcaagtctcgccgatggtggtgctgttctcgatcgtgacgggcacgatctatctcggcgtcgccacgccgacggaggcttccgccttcggcgcgttcggcgccttcctgctcgctatcgtcaagggcaagatcacgccgtcatcgctctaccggacgctgctgcgggcctgccacggcacctgcatgatcatcatgatcctcgtcggcgcctcgatcttcggctacttctttacgctcacccacgtcacgcaggacctcgtcgcctggatcggcagtctgccgacttcgcgctgggtgatcatcacgctgatcctgtgcggctacatcgtgctcggctccttcatggaccagatcgccatcctggtgctgaccgtgccgatcgtgctgccgctgatcaagacgctcggcttcgatccgatctggttcggcgtcatcaagatcgtcaccgccgaggtcggcatgatcacgccgccggtcgggctgaactgcttcatcgtcgcccgctatgccaagcggccggtggcggaagtgttccacggcactttcccgcatttcatcgcccatctgatcgcgatcgcgatcctggtggcgtttccgagcatcattctctggctgccctcgcagatggggcgctag

SEQ ID NO: 56164 - protein, 429 aa, Bradyrhizobium japonicum USDA 110
MTPFIVLALLFGLLALGTPVGFAMAFSGSVGLVMVGGWGTLFGILQTAPLSTVSSYELITIPMFLLMADLVLLSGVADDLFKTASAWVGRIPGGLGMATALAGAGFGAICGTSTASAATLSSTSLPAMIRQGYEPKMAAGVVAISGTLSMLLPTSVALVIFGLLAEVNIGKLLISGIIPAILVTITIMATIYFLVWQDPSRAPAAKSVPWREKFALLWQVSPMVVLFSIVTGTIYLGVATPTEASAFGAFGAFLLAIVKGKITPSSLYRTLLRACHGTCMIIMILVGASIFGYFFTLTHVTQDLVAWIGSLPTSRWVIITLILCGYIVLGSFMDQIAILVLTVPIVLPLIKTLGFDPIWFGVIKIVTAEVGMITPPVGLNCFIVARYAKRPVAEVFHGTFPHFIAHLIAIAILVAFPSIILWLPSQMGR

SEQ ID NO: 56165 - DNA, 1407 bp, Bradyrhizobium japonicum USDA 110
  CDS (1)..(1407)
atgctgctgttgcttggtggttttctcctcctgatgctgctcggcgttcccgtggcgatcgccatggccgcgtcgtcgctgctctacatcctggtcagcggcgtgacgcccgacgtcacgctggcgcagcgcatgatcgccggcgtcgagagcttcccgctgctcgccgtgccgttcttcatcctggccggcaacctcatgaacatcgccggcgtcaccggccgcatctacaagttcgcggtcgcgctggtcggctggatgcgcggcggcctcggccacgtcaacatcatcggctcggtgatcttctccggcatgtcgggcaccgccatcgcggacgctgccggcctcggcaccatcgagatcaaggcgatgaaggaccacggctattcgaccgagttctcggtcggcgtcactgcggcgtccgcgacgctcggcccgatcatcccgccgtcgctgcccttcgtgatctacggcatgatggcgaacgtctcgatcggcgcactgttcctgggcggcgtcattcccggcatcgtcatgacgcttctgatgatggccaccgtcacctacttcgcgcacaagaacaaatggggcagcgacacgccgttctcctggccgcagctcggctcggccggcctcgagatcgccatcgtgctcgctttcccgctcgcgatctggctgatggtggtcgccggcatgtcgaccaacatggcggtcgtcatcgggctcggcgtgctgctcgcgatcgactggtatttcgacttctccgcggtgatggcgctgatggcgccggtgatcctgatcggcggcatgacgctgggctggttcacgccgaccgaggccgcggttgccgccgtgatctggtcgctgttcctcgggctcgtgcgctaccgcaccatgacgctgaagacggtggcgaaggcgactttcgacaccatcgagaccacggcctcggtgctgttcatcgtgacagctgcgtcgatcttcgcctggctgctgacggtgtcgcaggccgcccagatgctctcggactggatgctcagcatcacccacaacaaatgggtgttccttgcgttggccaacgtcctgatcctgttcgtcggctgcttcatcgacaccacggcggcgatcaccattctggtgccgatcctgttgccgatcgtgctcaagctcggcatcgatccgatccatttcggcctgatcatgacgctgaacctgatgatcggcctgctgcatccgccgctcggcatggtgctgttcgtgctcgcccgcgtggcaaaactctcggtcgaacgcacgacggtggcgatcctgccctggctggtgccgctgatgctcgcgctgatcgcgatcacctacatccccgaactgaccctctggctgcctaaatacatgggactctccaaatga

SEQ ID NO: 56166 - protein, 468 aa, Bradyrhizobium japonicum USDA 110
MLLLLGGFLLLMLLGVPVAIAMAASSLLYILVSGVTPDVTLAQRMIAGVESFPLLAVPFFILAGNLMNIAGVTGRIYKFAVALVGWMRGGLGHVNIIGSVIFSGMSGTAIADAAGLGTIEIKAMKDHGYSTEFSVGVTAASATLGPIIPPSLPFVIYGMMANVSIGALFLGGVIPGIVMTLLMMATVTYFAHKNKWGSDTPFSWPQLGSAGLEIAIVLAFPLAIWLMVVAGMSTNMAVVIGLGVLLAIDWYFDFSAVMALMAPVILIGGMTLGWFTPTEAAVAAVIWSLFLGLVRYRTMTLKTVAKATFDTIETTASVLFIVTAASIFAWLLTVSQAAQMLSDWMLSITHNKWVFLALANVLILFVGCFIDTTAAITILVPILLPIVLKLGIDPIHFGLIMTLNLMIGLLHPPLGMVLFVLARVAKLSVERTTVAILPWLVPLMLALIAITYIPELTLWLPKYMGLSK

SEQ ID NO: 56167 - DNA, 1305 bp, Bradyrhizobium japonicum USDA 110
  CDS (1)..(1305)
atgaccatcgaagtcgtcgccctgtttgggatcctgttcgcgctgctggcaggcggtgtctggatcggtctcacgctcgcgctcaccgccacgctgctgctggcgatgttccgctcgattccgctcgacaagctgctgccgcaatacgcctggaacattctgaccacgcaggagctgctggcgctgccgctgttcatcctgatgggcgaattgttgttccgcacccgcctgtcgcgctcgctgttccagggacttgcgccctgggccggtctgctgccgggccggctgctgcatgtgaacgtgatcggctgcaccatcttcgcggcgatctccggctcgtccgcggcgaccacgcaggtgatcggccgcatgtcgctcaacgagctcttgcgccgcggctattcgcgcgacatcgcgatcggctcgctcgcaggcgccggcacgctcggcttcctgatcccgccgtccaacatcatgatcatctacggcgtgctcggcgacgtctccattctcaagctctttacggccggcgtgctgcccggcctgctgctggcggcgaccttcatgggctgggtgatgctgcacacgaccctcaagccctcgatggtgccggagacggaagcaaaactctcgcaggtgccgtggggcgagcgttttgcggcgctcaaggatctcgcgccggcgctgttcctgatcgcctgcgtgctcggctcgatgtatggcgggctcgccacgccctcggaggccgccgccgtcggggtgctcggggcggggctggtggcctgggcgcaaggctcgatgtcgcagcaggtgatgcgcgacgtgctgatcggctcggtcgtgacctgctcgatgatcgcgctgatcgtgctcggcgcctcgatcctcggcaatgccgcggccttcctcggcattcctcaggcggtggccgccttcgtcaagggcctcggcctgtcgcccttcatgctgatcgtggtgctgatcatcttctacctgatcctcggctgctttctcgatggcttctcgatgatcgtgatgacgctgccgatcgtgctgccgatcgtgaagggcgcaggtttcgacgagatctggttcggcatcttcctggtgctcgccgttgagatggcgcagatcaccccgccggtcggcttcaacctgttcgtgatccagggcctgaccgaagacggcctcggctacatcgcgcgcgtcacgatgccgtatctcatgatcatggtcggcttcgtgctgctgctgacgctgtggcccgggatcgtcacgatcctgccgcgggtgctgtacggatag

SEQ ID NO: 56168 - protein, 434 aa, Bradyrhizobium japonicum USDA 110
MTIEVVALFGILFALLAGGVWIGLTLALTATLLLAMFRSIPLDKLLPQYAWNILTTQELLALPLFILMGELLFRTRLSRSLFQGLAPWAGLLPGRLLHVNVIGCTIFAAISGSSAATTQVIGRMSLNELLRRGYSRDIAIGSLAGAGTLGFLIPPSNIMIIYGVLGDVSILKLFTAGVLPGLLLAATFMGWVMLHTTLKPSMVPETEAKLSQVPWGERFAALKDLAPALFLIACVLGSMYGGLATPSEAAAVGVLGAGLVAWAQGSMSQQVMRDVLIGSVVTCSMIALIVLGASILGNAAAFLGIPQAVAAFVKGLGLSPFMLIVVLIIFYLILGCFLDGFSMIVMTLPIVLPIVKGAGFDEIWFGIFLVLAVEMAQITPPVGFNLFVIQGLTEDGLGYIARVTMPYLMIMVGFVLLLTLWPGIVTILPRVLYG

SEQ ID NO: 56169 - DNA, 1320 bp, Bradyrhizobium japonicum USDA 110
  CDS (1)..(1320)
atgagcaccgatgccgtcgccgtaatcggcttcgtttccctgtttgcgttgatgctgctgcgcgtgcccgtcggcatggccatgggcctcgtcggcgtctccggcttctcctatctggtcggcgccacgccggcgctgaaactggtcggccagacctcgatgcgcacggtcaccgactacacgttcggcgtcatcccgatgttcctgctgatgggctccttcgtcagcaattccggcatgagccgcgagctgttccgcgccgccaacgggttcgtcggacatttgcgcggcgggctcggcatcgccaccgtcggggcctgcggcggctttgccgcgatctgcggctcctcggttgcgaccgccgcgaccttctccgccgtcgcctaccccgagatgcgccgcttcggctatccgcagtcgttcgccaccggcgtgatcgcggccggcggcacgctcggcgcgatgctgccgccctccaccgtgctggcggtctacggcatcatcaccgagcaggacatcggaaaactcttcatcgccggcatcattccgggcctgctggcgatgaccatgtacatgatcacgatcgccctgatcggatacttccggccggacttcctgcccaagggcaaggtgctgccgtggcgcgagcgctttgccggcctgaaggagatctgggccccggtcctgctgttcgtcttcgtcatcggcggcctttacggcttgcccttcctgccgcgcttcacgccgacggaagccggcggcgtcggggccaccggcgccttcatcatcggcgtcttcaccggccggctcgaccgcgagaagattttggcctcgctgctccaggcgacgcgcaccgccgccgcggtgttcaccgtgctgatcggtgcgctgatcttcggctatttcctcacggtgacgcagacgccgcagaaggtgacggaatttttgaccggcctcggcctcggcccctacggcgtgctggcactgatcatggtgatgtatctcgtgctcggctgcctgatggacgccatggcgatgatcatcctcaccgtgccgatcatcttccccgtcatcatgcatctcggcttcgacccgatctggttcggcgtcatcatcgtgatgaccgtcgagctcggcctgatccacccgccggtcggcatgaacgtcttcgtcataaaaagcgtggtgaaggacgtctccttctccaccatcttcaagggcgtgatcccgttcgtggcgacggatctggtgcggctggtgatcctgatcgccttcccgctgctggcgacctggctgccgacgcggatgatggcgcattaa

SEQ ID NO: 56170 - protein, 439 aa, Bradyrhizobium japonicum USDA 110
MSTDAVAVIGFVSLFALMLLRVPVGMAMGLVGVSGFSYLVGATPALKLVGQTSMRTVTDYTFGVIPMFLLMGSFVSNSGMSRELFRAANGFVGHLRGGLGIATVGACGGFAAICGSSVATAATFSAVAYPEMRRFGYPQSFATGVIAAGGTLGAMLPPSTVLAVYGIITEQDIGKLFIAGIIPGLLAMTMYMITIALIGYFRPDFLPKGKVLPWRERFAGLKEIWAPVLLFVFVIGGLYGLPFLPRFTPTEAGGVGATGAFIIGVFTGRLDREKILASLLQATRTAAAVFTVLIGALIFGYFLTVTQTPQKVTEFLTGLGLGPYGVLALIMVMYLVLGCLMDAMAMIILTVPIIFPVIMHLGFDPIWFGVIIVMTVELGLIHPPVGMNVFVIKSVVKDVSFSTIFKGVIPFVATDLVRLVILIAFPLLATWLPTRMMAH

SEQ ID NO: 56171 - DNA, 1281 bp, Pseudomonas syringae pv. tomato str. DC3000
  CDS (1)..(1281)
atggacgcttttatactgttgggcagcttcatcgcactgatacttctcggcatgccggttgcctacgcgctgggcctgtcagccctgatcggtgcctggtggatcgacattccggccgacgccttgatgatccagatcgcaggcggggtgaacaagttctcgctgctggcgatcccgttcttcgtgctggccggggcaatcatggccgaaggcgggatgtcacgacggctggtcgcgttcgccgcagtactggtgggctttgtgcgcggcggcctgtcgctggtcaacatcgtggcatcgaccttcttcggcgctatctcgggttcttccgtggccgataccgcatcggtaggctcggtgctgataccggaaatggaacgcaacggctaccctcgggacttctcgaccgccgtgaccgtcagcggctcggttcaggctctgcttacgcctcccagccacaactcggtgctttattcactggccgctggcggcacggtatcgattgcctcgctgttcatggccgggatcatgccagggctgttgctcagcgcggtgatgattggcctgtgcatgattttcgcgcgccgacgcaattaccccaagggtgaagtgattccgctgcgcaaagcgctgaaaattgccggtgaagcgctctggggcatgatggccatggtcatcattctcggtggcattctgtcggggatcttcaccgccaccgagtcggctgccattgccgtgctctgggcgttcttcgtcaccatgttcatttaccgcgactacaaatggcgcgatctgcccaagctgatgcaccgggctgcgcggaccatctccatcgtgatgatcctgatcggttttgccgccagcttcggttacatcctgacgctgatggaaatcccgatgaagatcaccacggcgttcctgaccctgtcagacaaccgctacgtgatcctgatgtgcatcaacgtcatgttgctgctgttgggcactgtcatggacatggccccgctgatcctgatcctcacgccgattctgttgccggtcatcgtcggcgtcggcgtggacccggtgcacttcggcatgatcatgctggtcaatctggggatcgggctgatcacaccgccggtgggcgcagtgctgttcgtcggcgcggcggtgggcaaagtcaccatcgaagccaccgtgaaagccttgctgccgttctacgtcgcgctgtttctggtgctgatgctggtcacctacgttcctgccatctcgctgtggctgccgagcgtcgtgctctaa

SEQ ID NO: 56172 - protein, 426 aa, Pseudomonas syringae pv. tomato str. DC3000
MDAFILLGSFIALILLGMPVAYALGLSALIGAWWIDIPADALMIQIAGGVNKFSLLAIPFFVLAGAIMAEGGMSRRLVAFAAVLVGFVRGGLSLVNIVASTFFGAISGSSVADTASVGSVLIPEMERNGYPRDFSTAVTVSGSVQALLTPPSHNSVLYSLAAGGTVSIASLFMAGIMPGLLLSAVMIGLCMIFARRRNYPKGEVIPLRKALKIAGEALWGMMAMVIILGGILSGIFTATESAAIAVLWAFFVTMFIYRDYKWRDLPKLMHRAARTISIVMILIGFAASFGYILTLMEIPMKITTAFLTLSDNRYVILMCINVMLLLLGTVMDMAPLILILTPILLPVIVGVGVDPVHFGMIMLVNLGIGLITPPVGAVLFVGAAVGKVTIEATVKALLPFYVALFLVLMLVTYVPAISLWLPSVVL

SEQ ID NO: 56173 - DNA, 1362 bp, Vibrio parahaemolyticus RIMD 2210633
  CDS (1)..(1362)
atggatattttactactgtttttaatggtgattggcttcatgctcattggtgtgccaatcgcaatttctctgggtctttccagtgtacttttcttaatgctgcattccgatgcttctttggcgtcagttgctcaaacgctgtttaacgcctttgctggtcactatacattgttggcgatacctttcttcattttggcctcaagttttatgtcgacaggtggcgttgcaaagcgaatcatccgatttgcgattgccattgttggttggttccgtggtggtctcgccatggcttccgttgtggcatgtatgatgtttgcagcactgtctggctcttcaccagcaaccgtggtcgctatcggtagtatcgtcattgcggggatgatcaaaaacggttactcgaaagagtttgctgcgggtgttatctgtaacgcaggtactttggggatcttgattccgccatcgatcgtgatggtggtgtatgcggctgcgaccgatgtgtcagtcgggcgtatgttccttgggggtgtgatcccgggcttgctggctggcgtgatgttgatgatcgctatctacattgcggcgaggattaagaatctacctaagcaaccattcgtgggatggaaagaaacgtttgatgcagccaaagatgcgagttggggcttgttgctggtggtgatcatccttggcggtatctatggcggcattttcacaccaacagaggctgcggcagttgcggcggtgtactcattcttgatcgcgaactttatatataaagacatgggaccatttgctgataagcaaaacaccaaaccagcgatcgtcaaagtgattcagacctttgtccatgaagacactaagcacaccttatatgaagcgggcaagcttaccatcatgctgttgtttatcattgccaatgcactgatcttaaaacacgtactgactgaagaacgtatccctcagatgatcacggaatcgatgctgtctgcggggcttgggccaattacgttcttgatagttgtaaacttgttgctcctgatcggtggtcagtttatggagccttcgggtttattgatcatcgttgctcctttggtgttcccaattgccattgcgctgggaattgacccaattcacctcggtatcatgatggtagtgaacatggaaatcggcatgataacgccaccagtcgggttgaacctgtttgtaacggctggggtggcaagaatgtcgatgatgaatgttgtaaaagcggcattgccatgggtgggtgtcatgttcttgttcttgataattgtgacttatgtgccttgggtatcaacctggttaccaacgaccttgatggggccagaaataatcactaaataa

SEQ ID NO: 56174 - protein, 453 aa, Vibrio parahaemolyticus RIMD 2210633
MDILLLFLMVIGFMLIGVPIAISLGLSSVLFLMLHSDASLASVAQTLFNAFAGHYTLLAIPFFILASSFMSTGGVAKRIIRFAIAIVGWFRGGLAMASVVACMMFAALSGSSPATVVAIGSIVIAGMIKNGYSKEFAAGVICNAGTLGILIPPSIVMVVYAAATDVSVGRMFLGGVIPGLLAGVMLMIAIYIAARIKNLPKQPFVGWKETFDAAKDASWGLLLVVIILGGIYGGIFTPTEAAAVAAVYSFLIANFIYKDMGPFADKQNTKPAIVKVIQTFVHEDTKHTLYEAGKLTIMLLFIIANALILKHVLTEERIPQMITESMLSAGLGPITFLIVVNLLLLIGGQFMEPSGLLIIVAPLVFPIAIALGIDPIHLGIMMVVNMEIGMITPPVGLNLFVTAGVARMSMMNVVKAALPWVGVMFLFLIIVTYVPWVSTWLPTTLMGPEIITK

SEQ ID NO: 56175 - DNA, 1296 bp, Enterococcus faecalis V583
  CDS (1)..(1296)
atggctttagaagcaggcattatcttatttgtagtttttgcagtcttattggtagttggtatgccaattggtatgagcattgcggcatcttcaattgcaacattgttattagtaattccttttgaagcagctgcatttacctcagctcaaaaaatggtctctagtttaaatagtttctctctcgtagcaattccgttttttattttttctggtgtgattatgaataatgggggaattgcccaaaagttggtaaatttttctatgttatttgttggtcgtgttcccggcgcgctagcacatactaatgtgttagggaatgcattatttggttcgatttctagctctgcaattgcagcatctactgctattggtggcgtactaattccgcaacaagtaaatgagggctatgatcggaaatttgcaacggctgtaaatattgcctctgctcctacaggaatggttattccaccaagtacagcgtttattatgtattcattggtggctggtggggcctctatttcttctttatttttaggaggttatttggtaggttctttgtgggcgttaggaattatggtggtagcttatgttattgcaaaacgtcataattatcctactgtggcaaaagcaaaaaaaggagaagtcagcaaggttctgcgagaagcggttcccagtgtattgttaattgtcattattattggtggtattttgacggggttatttacagcgattgaagcatcagcaattgctgttgcatactcattattgatttcaatgttttactacaaaacagtgaaaataaacgatttacctaaaatgttaaaagaggctgtcttgatgagtggaaccattatgttcttgttggcaacttcttcaatgatgtcttttgcgatggcttttacagggataccagaagcaatcagtacagctattttaggaatcacagacaataaatacttaattctactattagtaaacgttgtcctattgtttgtgggaatgtttatggatgttggtccagctattttgatttttacgccaatctttttaccaattgttatgaatgttggggtggatccagttcattttggtttatttgcgattatgaacttgtgtgttggttcaattacaccacctgttggaacaggattatatgttggtgctagtgttgggggtgttaaagctgagcaaatgctgaaaccactagttccattttatctggtaatcttagcaattttacttttaatcacatatgtacctgaacttgtcatgtggttaccaaatctaatttcttaa

SEQ ID NO: 56176 - protein, 431 aa, Enterococcus faecalis V583
MALEAGIILFVVFAVLLVVGMPIGMSIAASSIATLLLVIPFEAAAFTSAQKMVSSLNSFSLVAIPFFIFSGVIMNNGGIAQKLVNFSMLFVGRVPGALAHTNVLGNALFGSISSSAIAASTAIGGVLIPQQVNEGYDRKFATAVNIASAPTGMVIPPSTAFIMYSLVAGGASISSLFLGGYLVGSLWALGIMVVAYVIAKRHNYPTVAKAKKGEVSKVLREAVPSVLLIVIIIGGILTGLFTAIEASAIAVAYSLLISMFYYKTVKINDLPKMLKEAVLMSGTIMFLLATSSMMSFAMAFTGIPEAISTAILGITDNKYLILLLVNVVLLFVGMFMDVGPAILIFTPIFLPIVMNVGVDPVHFGLFAIMNLCVGSITPPVGTGLYVGASVGGVKAEQMLKPLVPFYLVILAILLLITYVPELVMWLPNLIS

SEQ ID NO: 56177 - DNA, 1275 bp, Helicobacter hepaticus ATCC 51449
  CDS (1)..(1275)
atgagtgttgcatatctaatggttgctttatttggtttattgcttttaggtgttcctgtttcggttgctttaggcataagcgcaattagtgcactgtatttttttacttcatacaatattattggttcagctgaaattatgtttaatggcttaaaacctgctcttatggcaattcctatgtttattcttgcaggttctcttatgagtaaaggaagttcagctcaacgtattatcaattttgcaacctctcttgtagggcatttaccgggtggattacctataagtgcaattttagcttgtataatttttgctgccgtaagcggtagctcccctgctacggttgtagctgtaggttcagtaatgtttttagccattgctaatgcaaaatatccaaaaagttatgccataggtgctattacatcagctggaagtctagggattcttattcctccttcagttgtaatgattgtctatggtgtaacagcagaagtttccattgaaaaactttttatggcaggagtgattccggggttaatgattggcactatgatgatgctttatgcgtatgtaggtgcaaaacgactaggtttcaaagcgacaaaacctgaaagtttcaaagtgcgttttcaaaaattcagagaagcattttgggcattgcttattgtctttgttatcattggaggtatttatgggggtatatttactgctacagaagcagcaggcattagtgcagtatatgcgtttattatttctgtttttgtatataaagatattaaactcaagaatcttcattcggtatttttagatgcagctattaccacagctatgatattttttatcataggttttgcagtcgtatttgcacattttttaaccaatgagagaatccctcatcttatagctgaatttcttattgcgcagcaaatgagttggtgggtatttcttatccttgtaaatattatgctctttgttatggggcagtttatggaacctagctctgtgattatgataatgacacctctccttttgcccattgccttagctcttggtatagaccccatacattttggtgttgtaatggttgtaaatatggaactaggtatgcttacaccacctgtaggtttaaatctttttgtggcaagttcacttactgggcttagccttaaagatgtaacaacttcggtgcttccttggcttggaataatgttggtgggtttattgcttataacttatattccagatatttcgctttggttacctaataaactcaattaa

SEQ ID NO: 56178 - protein, 424 aa, Helicobacter hepaticus ATCC 51449
MSVAYLMVALFGLLLLGVPVSVALGISAISALYFFTSYNIIGSAEIMFNGLKPALMAIPMFILAGSLMSKGSSAQRIINFATSLVGHLPGGLPISAILACIIFAAVSGSSPATVVAVGSVMFLAIANAKYPKSYAIGAITSAGSLGILIPPSVVMIVYGVTAEVSIEKLFMAGVIPGLMIGTMMMLYAYVGAKRLGFKATKPESFKVRFQKFREAFWALLIVFVIIGGIYGGIFTATEAAGISAVYAFIISVFVYKDIKLKNLHSVFLDAAITTAMIFFIIGFAVVFAHFLTNERIPHLIAEFLIAQQMSWWVFLILVNIMLFVMGQFMEPSSVIMIMTPLLLPIALALGIDPIHFGVVMVVNMELGMLTPPVGLNLFVASSLTGLSLKDVTTSVLPWLGIMLVGLLLITYIPDISLWLPNKLN

SEQ ID NO: 56179 - DNA, 1194 bp, Bordetella pertussis Tohama I
  CDS (1)..(1194)
gtggcggcaacatcttattgggtaattgattatcctttgatgagtatgggattgacgtccattgattcgttaaagaactatacattcctggcagtacctttatttattgctacgggggatctactcaccgcgggcggcgtttcacaacaattgatcaaattttcgcgcgcggttatccgtgccgtgccaggtcgaacggcagccacctcggtgctggccagtggcatgttttgcgccattagtggttcgagtgcagccgctgcagcgaccatgggcaagttgatggctccggaatttaaacgggcccaaattcccatgcgacgaggaggcgcgacggtagccgccggcggaatccttggcggactcattccgccaagcaccatcatcatcatttatagcttgacggttaacgtttctccggttgagctgaatctggcagcgatattgccaggcatactcatactgctgttcatatttttcgtgtcgatcatgcgtacgcgtcagtatgagcccgcatcgaaatccacagatggctactttaaagaagtaggaacctcggtgcttggggcaaccccagcctttatcgctatcgcgcttttgtttgtcggcctgtattcgggcctgtttagcccgaccgaagccgcgggcgtcgtcacgatttactgcgcggtgatcggactatattggtctagccagtttggcattcgagacataccaaaaatacttatggaaagcgcttcggtgaccggaatcatcgggccgatcgttgttttttccatccagtttcaacagattctttccgtaatggaaattccagacttgatattggttcagttggtagaactttcatctgcttatggcgcaacggttacgctagcggtaatgatgggcattgttttgctcttcggcacgttcatggaagtcattgcagtaatactgattttggcgccgatatttgctcctatcgcaacagaaattggcatgaatggtgtgcactggggcatgatttttattattggcgcgtcgataggatttattagccctccgcatggcctgaatctgttcattacgtcgatgacaatgaaaatagattacggggagttgatggccgagattgtgagaatgattattccaattcttgttgcctggcttatcgttgccgctttcccatatatcagccttgtttttgtatag

SEQ ID NO: 56180 - protein, 397 aa, Bordetella pertussis Tohama I
MAATSYWVIDYPLMSMGLTSIDSLKNYTFLAVPLFIATGDLLTAGGVSQQLIKFSRAVIRAVPGRTAATSVLASGMFCAISGSSAAAAATMGKLMAPEFKRAQIPMRRGGATVAAGGILGGLIPPSTIIIIYSLTVNVSPVELNLAAILPGILILLFIFFVSIMRTRQYEPASKSTDGYFKEVGTSVLGATPAFIAIALLFVGLYSGLFSPTEAAGVVTIYCAVIGLYWSSQFGIRDIPKILMESASVTGIIGPIVVFSIQFQQILSVMEIPDLILVQLVELSSAYGATVTLAVMMGIVLLFGTFMEVIAVILILAPIFAPIATEIGMNGVHWGMIFIIGASIGFISPPHGLNLFITSMTMKIDYGELMAEIVRMIIPILVAWLIVAAFPYISLVFV

SEQ ID NO: 56181 - DNA, 1269 bp, Bordetella pertussis Tohama I
  CDS (1)..(1269)
atgctttcagccgttgttctgctgttgctgctgttcgccgccagcatccccgtggccctgagcctgggcatcgcgccgctgccggcgctgctggcgcgcgacgtgccgttgctggccgtgccccagaccatgttcgagtcgatggactcgttcgcgctgatggccgtgccgttcttcgtgctggccgggcgcctgatgcagaccggcggcatcgccgggcggctgatggacctgggcctggcgctgatcggctgggtcaagggcggcctgggcggcgccgcggtgctgaccaccatgttcttctcgactatctgcggctcgtcctcggccaccaccgcggccatcggctcggtgatgattcccgagatggagcggcgcggctatccgcgtccgttcgccgcgtcggtggtggcctccagcggcgagctgggcgtgatcctgccgccgtcggtgccgatgatcatctacgccatgctgaccggcacgtcggtggcgcagatgttcgtggccggcatcctgcccggcctgctgatcggcctgtcgctgatcatcaccattctcatcatgtcgcgcctgggcgattacggcggttcgcagcgcgtgagcgtgggcgaatgggcgctcaacgtctggcgcgcgctgcgccgggccagcctgtcgctgctgatgccggtgatcatcctgggcggcatctacggcgggctgttcaccgccaccgaggccgcggtcgtggcggtggcctataccttcgtggtcagcgtgttcatctaccgcgaaatcaagtggaaggacctgcccgagatcttctggtcgtcggcggtgacctccggcatcgtcctgttgatcgtgggcttcgcgtcggtgttcgcctatgtgctgtcgctctaccaggcgccgcagcaggtggccgcgctgttgctgggcgtgtccgacaacccgctggtgttcctgctgctggtcaacatcgcgctgctggtggtgggcctgttcatggagaccttcgcggcgatcctgatcctggccccggtgctggcgccggtggccgtcagcctgggcatcgacccggtgcatttcgggctgatcgtgatcgtcaacctggcggtgggcatggtcacgccgccggtcggggtgaacctgttcctggtatgcggcatagcccgcgtgtcgatggagcgcctgatgcgcccgctgtcggtattcctgggcgtgctgctgctggacctgatcatcattacctacgggccggtgctgtacgcccgctttttctga

SEQ ID NO: 56182 - protein, 422 aa, Bordetella pertussis Tohama I
MLSAVVLLLLLFAASIPVALSLGIAPLPALLARDVPLLAVPQTMFESMDSFALMAVPFFVLAGRLMQTGGIAGRLMDLGLALIGWVKGGLGGAAVLTTMFFSTICGSSSATTAAIGSVMIPEMERRGYPRPFAASVVASSGELGVILPPSVPMIIYAMLTGTSVAQMFVAGILPGLLIGLSLIITILIMSRLGDYGGSQRVSVGEWALNVWRALRRASLSLLMPVIILGGIYGGLFTATEAAVVAVAYTFVVSVFIYREIKWKDLPEIFWSSAVTSGIVLLIVGFASVFAYVLSLYQAPQQVAALLLGVSDNPLVFLLLVNIALLVVGLFMETFAAILILAPVLAPVAVSLGIDPVHFGLIVIVNLAVGMVTPPVGVNLFLVCGIARVSMERLMRPLSVFLGVLLLDLIIITYGPVLYARFF

SEQ ID NO: 56183 - DNA, 1293 bp, Bordetella parapertussis 12822
  CDS (1)..(1293)
atgctgctcggagccctttatttcggcggcctggtcctgttcctgatggccggcatccacgtggccagcgcgatcttcatgaccgcggtggtcagcgactggatgagcatgcaggtgctgcccagcatgataggcaacaccatgtggagcacgatgaacaagttcctgctggtggccatcccgctgttcatcctgctgggcgagatcctgacgcgcagcggcgtggccgaccgcatgtacaaggcgctggcggcctggctgcagtggctgcccggcggcctgctgcacaccaacatcgccacctgcgcgctgtttgccgccacctccggctccagcgtggccacttcggccacggtcggcaccgtggccctgcccacgctgcagcgcctgggctaccgggaacggctggtgctcggttcgatcgccgccggcggcacgctgggcatcctgattccgcccagcatcaacatggtggtgtacggcgcgctggccgaagtgtcggtgggcaagctgttcgccgccggcatcgttcccggcatcatcgtgctgctcctgatgatggcggtgatcgtgatcatggccctgctgggcaaggtcgccccggacaacgaaaaactgatcatccccctggcgatgcggctcaagctgctgatcgacgtgctgccggtggtgttcatcttcggcctggtgatgggcggcatctacctcggcatcgcgacgccgaccgaagccgccgcgctcggcgtggtgggcgccatcgccatcgccgcggccaaccgcacgctttcggtcgccatgctgcacgcggccttcctgtcggcgctgcgcaccaccgccatggtggtgctggtggtgaccaccgccttcgtgctgaacttctcgctcagcctggccggcatcccgcaggcgctgtccgagtacatcggccagctcggctggtcgcccaccgccaccatctgggtgctggtggcgttctacctgatactgggctgcttcctggaggccatcgccatgatggtcaccaccgtgggcgtggtggtgccgctgatcgtctcgctgggtttcgacccgctgtggttcggcatcttcatgaccatgatgatggagctggcgctgatcaccccgccggtcggcctgaacctgttcgtggcgcagaacatccgcctgtcgcgcggcggcatcagcgacgtctacatcggcgtgctgccgttcgccttcgccatgatggttttcgtcacgctgctgatctacttcccgcagatcgcgctgtggctgcccaaccgactcttctga

SEQ ID NO: 56184 - protein, 430 aa, Bordetella parapertussis 12822
MLLGALYFGGLVLFLMAGIHVASAIFMTAVVSDWMSMQVLPSMIGNTMWSTMNKFLLVAIPLFILLGEILTRSGVADRMYKALAAWLQWLPGGLLHTNIATCALFAATSGSSVATSATVGTVALPTLQRLGYRERLVLGSIAAGGTLGILIPPSINMVVYGALAEVSVGKLFAAGIVPGIIVLLLMMAVIVIMALLGKVAPDNEKLIIPLAMRLKLLIDVLPVVFIFGLVMGGIYLGIATPTEAAALGVVGAIAIAAANRTLSVAMLHAAFLSALRTTAMVVLVVTTAFVLNFSLSLAGIPQALSEYIGQLGWSPTATIWVLVAFYLILGCFLEAIAMMVTTVGVVVPLIVSLGFDPLWFGIFMTMMMELALITPPVGLNLFVAQNIRLSRGGISDVYIGVLPFAFAMMVFVTLLIYFPQIALWLPNRLF

SEQ ID NO: 56185 - DNA, 1287 bp, Bordetella parapertussis 12822
  CDS (1)..(1287)
atgcaagacgccctgttgctgttctcgctgatgttcgcgctgttcctggccggcatccccatcgccttctcgctgctgctgtgcggcgcgatcttcctgctggccaccggcctgcgcccgctcatcgtggtgccgcagcgggtcatgaccggcctggattcgttcccgctgctggccatcccgctgttcatcctgatgggcaacctcatggagaaagccggactttcgcggcgcctgatcgacctcatcgacatgctggtgggccgggtgcatggcgcgctgggctacgtcaccatcctcgcctgcgcgatgttcggcgcgctgaccggctcggccccggccaccgtggcggccatcggcgccatcatgatgccggccatgatcgcgcagaaatacccgccgcagctggccaccggcgtcaccgcctcggccggcgcgctgggcaacatcatcccacccagcatcgcgctcatcctctacggcgccaccgtcaacgtctccatccccaagctgttcgtggccaacatcgttccgggcctgctgatggcgctggccttcatggccaccaacttcctgctggcgcgccggctgcgcgtcccgcgccagccggcgcgcgcctgcacggccgggcaggcaatccggatcgtgtggcgcgccgtgccgccgctgctcatgcccgtggtcatcctgggcggcatctacggcggcgtgttcacgccgaccgaagccgccgccgtcggcgtggcgctcagtctggcgctcggcctgtgctaccggcagttcacgccgcgcaacctgtggcgcgtcatggtcggatcggtcgagacctcatccatggtcggcttcatcctgggcggcgccggcatcttcggctggatcctcgcctcggcgcgcatcccctccctgctggccaccgagctggcgcccgtcctcgacagccagttcctctacctggcgctgctcaccgtcttcctgctgctggtcggctgcatcatggacgcgggcgcgagcatcatcatcctcgcccccatcctcgtgcccatcggcctcatgctgggcgtggaccccatccacctcggcgtggtgttctgcgtcaacctggtggtgggcttcttcacgccgcccttcggcctgaacctcttcaccaccgtatccgtatcgcggcagccctacgaagtcgtggtgcgcggcgtcctgcccttcgtgctggccgccatcgccgtgcttttcatcctggcctacgtgcccggcctgtcgctcgcgctggtcaggctgatggagaactga

SEQ ID NO: 56186 - protein, 428 aa, Bordetella parapertussis 12822
MQDALLLFSLMFALFLAGIPIAFSLLLCGAIFLLATGLRPLIVVPQRVMTGLDSFPLLAIPLFILMGNLMEKAGLSRRLIDLIDMLVGRVHGALGYVTILACAMFGALTGSAPATVAAIGAIMMPAMIAQKYPPQLATGVTASAGALGNIIPPSIALILYGATVNVSIPKLFVANIVPGLLMALAFMATNFLLARRLRVPRQPARACTAGQAIRIVWRAVPPLLMPVVILGGIYGGVFTPTEAAAVGVALSLALGLCYRQFTPRNLWRVMVGSVETSSMVGFILGGAGIFGWILASARIPSLLATELAPVLDSQFLYLALLTVFLLLVGCIMDAGASIIILAPILVPIGLMLGVDPIHLGVVFCVNLVVGFFTPPFGLNLFTTVSVSRQPYEVVVRGVLPFVLAAIAVLFILAYVPGLSLALVRLMEN

SEQ ID NO: 56187 - DNA, 1299 bp, Bordetella parapertussis 12822
  CDS (1)..(1299)
atgatcgcggcgctgctgttcgccgtattcattaccctgatgctgatcggcgtgccggtcggcgtggcgctgggcctgggcggcacggtcgccatcgtgctgtccaacctcgatgtgtcctggttcggcctgctggccgtgccgcagaatttctacgccggcctggccaagtacccgctgctggcgattcccatgttcgtgctggtgggctcgatcttcgaccgctcgggcgtggccaggcggctggtcgacttcgccgtggcgcttgtgggccgcggcccgggcatgctgccgctggtatcgatcgccgtggcgatgttcctgagcgggatttccggctcgggtccggcatgcgcggcggccgtgggcgcggtgatgatcgccgccatgtcgcgcgccggctatccggcgccctactcggccgccgtggtcgccgccggcgccgccaccgatatcctgatcccgccttcggtggccttcatcatctattcggtgctggtgccgggcgcctcggtgccggcgctgttcgccgcgggcatggtaccgggcatcctggccggcgtcgcgctcatcattcctgcggtctggctggcgcgccgccatggcatgggcgcacgcgaagcgcacctgccgcgcccgccgctgtgggccagcctgcgcgaggcgtcctggggcctggccgcgccggtgctgatcctgggcggcatgcggatgggctggttcacccccaccgaagccgcggtcgtggccgtgttctacgggctgttcgtgggcatgtgcatccatcgcaccatcaaggtacgcgacctgttcgtgatcctgcgcgaggccgccgaactgtcggccgtcatcatgctggtggtgacgctggccggcatcttcgcctgggccctgtccacgctcagcgtgatcgaccccatcacgcacgccatcgtcaattccgggctgggcgaatggggcgtgctggcgctgctcatcgtgctgctgatgaccgtgggcatgttcctcgacggcatctccatcttcctgattttcgtcccgctgctcatgccgatcgccaatgcctatggctgggatccggtctggttcggcgtcatcctgacgctgaaggtggcgctgggccagttcacgccgcccctggcggtcaacctgatggtttcctgccgcatcgcgcgcgtgccgatggagtccaccgtgggctgggtggtctggctgctgggcggcatgttcctggtgctggtggccgtgctgatttttccgcaactggcgctgtggctgccgcaccggctgggatattga

SEQ ID NO: 56188 - protein, 432 aa, Bordetella parapertussis 12822
MIAALLFAVFITLMLIGVPVGVALGLGGTVAIVLSNLDVSWFGLLAVPQNFYAGLAKYPLLAIPMFVLVGSIFDRSGVARRLVDFAVALVGRGPGMLPLVSIAVAMFLSGISGSGPACAAAVGAVMIAAMSRAGYPAPYSAAVVAAGAATDILIPPSVAFIIYSVLVPGASVPALFAAGMVPGILAGVALIIPAVWLARRHGMGAREAHLPRPPLWASLREASWGLAAPVLILGGMRMGWFTPTEAAVVAVFYGLFVGMCIHRTIKVRDLFVILREAAELSAVIMLVVTLAGIFAWALSTLSVIDPITHAIVNSGLGEWGVLALLIVLLMTVGMFLDGISIFLIFVPLLMPIANAYGWDPVWFGVILTLKVALGQFTPPLAVNLMVSCRIARVPMESTVGWVVWLLGGMFLVLVAVLIFPQLALWLPHRLGY

SEQ ID NO: 56189 - DNA, 1281 bp, Bordetella parapertussis 12822
  CDS (1)..(1281)
atgacgctggcaatctttgtcttcgtgctgctggcgggcctggccatcggcttgccggtcgcgtacgcgctgatcctcacgggcgtggcgctgatgtaccagctggacttctacgacgcccagatcgtggcccagaacctgctcaacggcgccgacagctttcccctgatggcggtgccgttcttcatgctcgccggcgcggtcatgaacgccggcggcctgtcggcgcgcatcgtcgacctggccctcaaactggtgggccacatcaagggcgggctgggatacgtcaccatcctggccgcctgcattctggccagcctgtcgggctcggcggccgccgatgcggcggccctgtcggccctgctggtgcccatgatgatgaaagccgggcacagccgcgcgcgctccagcgggctggtggcctcgtccggcatcatcgcgctggtcatccccccttccatcggcctggtgctgatcggcgtcaccggcaacatcagcatcaccggcctgttcatggccggcatcgtgcccgggatacttatgggcatgtcgctgtgcgtggcctggtggctgctgtcgcgcaaggaacggatccagcccctgccgcgggtggatcgtgccgaggtccggcagtcgctggtaagaagtttctgggccctgatgctgccggtcatcatcatcgtcggcctgcgcttcggcatcttcacgcccaccgaagcgggcgtggtggccgcggtgtacgccatcttcgtggccacctgcatttaccgcgaactgcccatgcgccggctctacgaggtcttcctgacctccgccaagatgaccgcgatggtgatgttcctggtggccggcgcgctcgtctcgggatggatgatcaccgttgccgggctgccggcgcaggtctccgacatcatcagccccttcagcgacacgccgaccttgctgatgctggtcatcatcggcctggtgatcgtgatcggcatggccatggacatgattcccatcgtcctgatcctgatccccgtgctgctgccttcggtgacggccgccggcatcgacccggtctacttcggcgtcgtcttcatgctggcctgcgccatcggactcatcacgccgccggtgggcgccgttctcaacgtggtggccggcgtgacgggcacccgcatggtcgaactcgtcaagggcgtctggccgttcctgctggcgcaatgcgcgaccctgctgctgctgatcccgtttccgcagctggtgctggccccgtatcgctggatcatgcattga

SEQ ID NO: 56190 - protein, 426 aa, Bordetella parapertussis 12822
MTLAIFVFVLLAGLAIGLPVAYALILTGVALMYQLDFYDAQIVAQNLLNGADSFPLMAVPFFMLAGAVMNAGGLSARIVDLALKLVGHIKGGLGYVTILAACILASLSGSAAADAAALSALLVPMMMKAGHSRARSSGLVASSGIIALVIPPSIGLVLIGVTGNISITGLFMAGIVPGILMGMSLCVAWWLLSRKERIQPLPRVDRAEVRQSLVRSFWALMLPVIIIVGLRFGIFTPTEAGVVAAVYAIFVATCIYRELPMRRLYEVFLTSAKMTAMVMFLVAGALVSGWMITVAGLPAQVSDIISPFSDTPTLLMLVIIGLVIVIGMAMDMIPIVLILIPVLLPSVTAAGIDPVYFGVVFMLACAIGLITPPVGAVLNVVAGVTGTRMVELVKGVWPFLLAQCATLLLLIPFPQLVLAPYRWIMH

SEQ ID NO: 56191 - DNA, 1293 bp, Bordetella bronchiseptica RB50
  CDS (1)..(1293)
atgacccagttcgtgctggtgatcgcagtgttcctggtcctgctgctggcgggcatgtggattccgttcgcgatctttctgtccgccagcctctatatcgtgctgtacgccggctgggatggcctgagcggcttcgggctgagctcgtggggcagcatgaacagctttacgcttaccgccattccgctgttcatcctgatggccgagatcatgctcgaaagcgggctgagccagcgcgtgtaccgcgggctggcgcgcatcgtgcgccggctgcccggcgggctgctgcagaccaatatcgccgggtgcgcggcgttctcggccatcagcggctcgtcggtcgcgacggcggcggccatcggttcggtggcgctgccgcagctcgaggcgcgcggctattgcctcaagctgtcgaccggcacgctggccgcgggcggcacgctgggcatcctgatcccgcccagcatcgccatgatcatctacggcaccttcaccgagacgtcgatcgccaagctgttcatggcgggcgtcgtgccggggctggcgctggtggtcctgttcatgtgctatgtggcggtgcgctgcctggtcaatccgcggctggcgccgccgcccgagcaggacacgccgccgccgctgcgccagacgctggccgacctgctgccgttcggcgcgctgatcgtcggcgtgatgggcagcctgtacgccggcctggccacgcccaccgaggcggcgggcgtgggcgcatgcctggcggcgctgatcgcgcgcatctggggcgattgctcgatcgccacgctgcgccggtcgctggccaagacggtcaaggcctgcggcgccatcctgttcatcgtgtatgccgcgttcctgttctcgtacgcgatcgccatgacgggcctgaccgacagcctcaccgacctgctcgacgcctggcagctgagccgcctggagctgctgctggccgtcgtgctgctgtacacggtgctgggcttcctgatggacagcatcggcatgatggtgatcaccgtgcccatcctgcaccccatcctggccagctacggcgtcgacccgatatggttcggcgtgctgctggtcgtgctgatcgagctggggcagatcacgccgccggtcggcatgaacctgttcgtcgtcaagagcgtgtcgccgtcggcccgcctcaaggacgtcgtggtgggttcgctgccgttctgcctgctgatgtatgtcctgatcgcctggctgatctactccccccaattggccctgtggttcccgggccggatgaccggataa

SEQ ID NO: 56192 - protein, 430 aa, Bordetella bronchiseptica RB50
MTQFVLVIAVFLVLLLAGMWIPFAIFLSASLYIVLYAGWDGLSGFGLSSWGSMNSFTLTAIPLFILMAEIMLESGLSQRVYRGLARIVRRLPGGLLQTNIAGCAAFSAISGSSVATAAAIGSVALPQLEARGYCLKLSTGTLAAGGTLGILIPPSIAMIIYGTFTETSIAKLFMAGVVPGLALVVLFMCYVAVRCLVNPRLAPPPEQDTPPPLRQTLADLLPFGALIVGVMGSLYAGLATPTEAAGVGACLAALIARIWGDCSIATLRRSLAKTVKACGAILFIVYAAFLFSYAIAMTGLTDSLTDLLDAWQLSRLELLLAVVLLYTVLGFLMDSIGMMVITVPILHPILASYGVDPIWFGVLLVVLIELGQITPPVGMNLFVVKSVSPSARLKDVVVGSLPFCLLMYVLIAWLIYSPQLALWFPGRMTG

SEQ ID NO: 56193 - DNA, 1287 bp, Bordetella bronchiseptica RB50
  CDS (1)..(1287)
atgcaagacgccctgttgctgttctcgctgatgttcgcgctgttcctggccggcatccccatcgccttctcgctgctgctgtgcggcgcgatcttcctcatggccaccggcctgcgcccgctcatcgtggtgccgcagcgggtcatggccggcctggactcgtttccgctgctggccatcccgctgttcatcctgatgggcaacctcatggagaaagccggactgtcgcggcgcctgatcgacctcatcaacatgctggtgggccgggtgcatggcgcgctgggctacgtcaccatcctcgcctgcgccatgttcggcgcgctgaccggctcggccccggccaccgtggcggccatcggcgccatcatgatgccggccatgatcgcgcagaaatacccgccgcagctggccaccggcgtcaccgcctcggccggcgcgctgggcaacatcattccgccgagcatcgcgctcatcctctacggcgccaccgtcaacgtttccatccccaagctgttcgtggccaacatcattccgggcctgttgatggcgctggccttcatggtcaccaacttcctgctggcgcgccggctgcgcgtgccgcgccagccggcgcgcgcctgcacggccggacaggccgcccgggtcgtgtggcgcgccgtgccgccgctgctcatgcccgtggtcatcctgggcggcatctacggcggcatcttcacgccgaccgaagccgccgccgtcggcgtggcgctcagcctcgtgctcggcctgtgctaccggcagttcacggcgcgcaacctgtggcgcgtcatggtggggtcggtcgagacttcgtccatggtcggtttcatcctgggcggcgccggcatcttcggctggatcctcgcctcggcgcgcatccccaccctgctggccaccgagctggcgcccatcctcgacagccagttcctctacctggcgctgctcaccgtgttcctgctgctggtcggctgcatcatggacgcgggcgcgagcatcatcatcctcgcccccattctcgttcccatcggcctcatgctgggcgtggaccccatccacctcggcgtggtgttctgcgtcaacctggtggtgggcttcttcacgccgcccttcggcctgaacctcttcaccaccgtatccgtatcgcggcagccctacgaagtggtcgtgcgcggcgtgctgcccttcgtgctggccgccatcgtcgtgcttttcatcctggcctacgtgcccggcctgtcgctcacgctggtcaggctgatggagaactga

SEQ ID NO: 56194 - protein, 428 aa, Bordetella bronchiseptica RB50
MQDALLLFSLMFALFLAGIPIAFSLLLCGAIFLMATGLRPLIVVPQRVMAGLDSFPLLAIPLFILMGNLMEKAGLSRRLIDLINMLVGRVHGALGYVTILACAMFGALTGSAPATVAAIGAIMMPAMIAQKYPPQLATGVTASAGALGNIIPPSIALILYGATVNVSIPKLFVANIIPGLLMALAFMVTNFLLARRLRVPRQPARACTAGQAARVVWRAVPPLLMPVVILGGIYGGIFTPTEAAAVGVALSLVLGLCYRQFTARNLWRVMVGSVETSSMVGFILGGAGIFGWILASARIPTLLATELAPILDSQFLYLALLTVFLLLVGCIMDAGASIIILAPILVPIGLMLGVDPIHLGVVFCVNLVVGFFTPPFGLNLFTTVSVSRQPYEVVVRGVLPFVLAAIVVLFILAYVPGLSLTLVRLMEN

SEQ ID NO: 56195 - DNA, 1287 bp, Bordetella bronchiseptica RB50
  CDS (1)..(1287)
atgactatcgccattctctcgttctccttcgtactgctggtactggtcggcatgccgatcagtttcgccatgggcatttcgtcgctgctggcgatgctctaccagagcgacctgcccatcaacctgctggtgcaccgcaccgtgatgggtatcgattcgttcgtcctgctggccattccgctgttcatcttcgccggctccatcatggagcagggcggcatctccgagcggctggtccgtttcgcctataccttgctcggccgctttcgcggcggcctgcccatggtggtggtggggtccaccatgctgcagtccggcatttcgggctcgaccgtcgcggacgtttccgcgatgtcggcgatgaccctcaagccgctggagaacgaaggctatccacgcccgtacagcctgtcggtgatcggcgcatcgtgcgcgttctccatcctcatcccgccctgcatcctgatggtggtcgtggcggccgtggccaatacctcggtggtcgccgtgttcgccgcgggcgtggtgccggccgtcgtcatcggcctgatgttcttcgccttcatccacatccaggcacgcctgcagaacatgccgcgcggcgaagcctactcgttcgtggccatcctcaagggcctgaaggacgcgctgttcgcgctgggcgtgcccatcctcatcttcggcggcatacgcatgggcgtggccaccgtcaccgagatggcggccttcgccgtggtgtactcgctgctggtgggcgggctggtctaccgccggctgagctggcgcggcatctaccaggcgctggtcgacacctgcgtggcgaccggcgtgatctgcctgctgatggggttcgccatgatcttcggctacctgctggcgaccgaaggggtgccgggcgcggtggcgcaatggatacgcgacaaccacatcagcccctggggcgtcatgctgatcacggcgctgatcttcgtgttcatcggcgcggtgctcgagggcgcgcccgccgtgctgatcttcgtgcccatcctgctgcccgtggtgcgcgagctgggcatcgacgtggtgcattggctgaccgtcgtggtgctggcctcgggcatcgggctgttcgtgccgcccaccgggctggcggtgctggtggcatgcagcgtggggcgggtcagcatgcaggccatcatccggccgctgattcccttcctgctgctgcttctggccggcctggcggtgatcatggcctttccggtcatctcgatcggcctgccgcgcgccatgggcattccgtggtag

SEQ ID NO: 56196 - protein, 428 aa, Bordetella bronchiseptica RB50
MTIAILSFSFVLLVLVGMPISFAMGISSLLAMLYQSDLPINLLVHRTVMGIDSFVLLAIPLFIFAGSIMEQGGISERLVRFAYTLLGRFRGGLPMVVVGSTMLQSGISGSTVADVSAMSAMTLKPLENEGYPRPYSLSVIGASCAFSILIPPCILMVVVAAVANTSVVAVFAAGVVPAVVIGLMFFAFIHIQARLQNMPRGEAYSFVAILKGLKDALFALGVPILIFGGIRMGVATVTEMAAFAVVYSLLVGGLVYRRLSWRGIYQALVDTCVATGVICLLMGFAMIFGYLLATEGVPGAVAQWIRDNHISPWGVMLITALIFVFIGAVLEGAPAVLIFVPILLPVVRELGIDVVHWLTVVVLASGIGLFVPPTGLAVLVACSVGRVSMQAIIRPLIPFLLLLLAGLAVIMAFPVISIGLPRAMGIPW

SEQ ID NO: 56197 - DNA, 1269 bp, Bordetella bronchiseptica RB50
  CDS (1)..(1269)
atgctttcagccgttgttctgctgttgctgctgttcgccgccagcatccccgtggccctgagcctgggcatcgcgccgctgccggcgctgctggcgcgggacgtgccgttgctggccgtgccccagaccatgttcgagtcgatggactcgttcgcgctgatggccgtgccgttcttcgtgctggccgggcgcctgatgcagaccggcggcatcgccgggcggctgatggacctgggcctggcgctgatcggctgggtcaagggcggcctgggcggcgccgcggtgctgaccaccatgttcttctcgaccatctgcggttcgtcctcggccaccaccgcggccatcggttcggtgatgattcccgagatggagcggcgcggctatccgcgtccgttcgccgcgtcggtggtggcctccagcggcgagctgggggtgatcctgccgccgtcggtgccgatgatcatctacgccatgctgaccggcacgtcggtggcgcagatgttcgtggccggcatcctgcccggcctgctgatcggcctgtcgctgatcatcaccatcctcatcatgtcgcgcctgggcgattacggcggttcgcagcgcgtgagcgtgggcgaatgggcgctcaacgtctggcgcgcgctgcgccgggccagcctgtcgctgctgatgccggtgatcatcctgggcggcatctacggcgggctgttcaccgccaccgaggccgcggtcgtggcggtggcctataccttcgtggtcagcgtgttcatttaccgcgaaatcaagtggaaggacctgcccgagatcttctggtcgtcggcggtgacctccggcatcgtcctgttgatcgtgggcttcgcgtcggtgttcgcctatgtgctgtcgctctaccaggcgccgcagcaggtggccgcgctgttgctgggcgtgtccgacaacccgctggtattcctgctgctggtcaatatcgccctgctggtggtgggcctgttcatggagaccttcgcggcgatcctgatcctggccccggtgctggccccggtggccgtcagcctgggcatcgacccggtgcatttcgggctgatcgtgatcgtcaacctggcggtgggcatggtcacgccgccggtcggggtgaacctgttcctggtatgcggcatcgcccgcgtgtcgatggagtgcctgatgcgcccgctgtcggtattcctgggcgtgctgctgctggacctgatgatcattacctacgggccggtgctgtacgcccgctttttctga

SEQ ID NO: 56198 - protein, 422 aa, Bordetella bronchiseptica RB50
MLSAVVLLLLLFAASIPVALSLGIAPLPALLARDVPLLAVPQTMFESMDSFALMAVPFFVLAGRLMQTGGIAGRLMDLGLALIGWVKGGLGGAAVLTTMFFSTICGSSSATTAAIGSVMIPEMERRGYPRPFAASVVASSGELGVILPPSVPMIIYAMLTGTSVAQMFVAGILPGLLIGLSLIITILIMSRLGDYGGSQRVSVGEWALNVWRALRRASLSLLMPVIILGGIYGGLFTATEAAVVAVAYTFVVSVFIYREIKWKDLPEIFWSSAVTSGIVLLIVGFASVFAYVLSLYQAPQQVAALLLGVSDNPLVFLLLVNIALLVVGLFMETFAAILILAPVLAPVAVSLGIDPVHFGLIVIVNLAVGMVTPPVGVNLFLVCGIARVSMECLMRPLSVFLGVLLLDLMIITYGPVLYARFF

SEQ ID NO: 56199 - DNA, 1299 bp, Bordetella bronchiseptica RB50
  CDS (1)..(1299)
atggacgccgtactcattctgaccgtgatactcgggctgttcggcctgctgctggtattgggcatcccgattttcgccgcgctgggcgtgcccagcattctcggcatctatctggtgggcggcgcctcggcgctgaacgtcgtgccgtcggtgctgcatcgcggcatcgccagctactcgctgatctgcattccgctgttcatcctgatgggcgagacgctggcccgcaccagcatcggcgcgcgcctctataccttgttctacacctggctgagccgcgtgcgttgcagcctggcgattgccagcgtgggggcctcggccatcttcggcgccatgagcggcgtcagcgtggccggcgcggccaccataggccgcgtcgccattccggagatgctcaagcgccgctatgaccctggcctggccggcggatcggtagccgcggcgggttcgctggccttgctgattccgcccagcgtgggcttcgtgctgtatggcgagatcgccagccagtcgatcggcaagctgttcagcgccgccatcgtgcccggcctgctgctcagcgtcctgatgatgctttatctgtacggattgagccgcatcaagccctcggtggcgccggacgaagcgcagaaggtctcgtggcgggagcgctggcaggcgctgcgcgatgtatgggccgccattgtgctgatcgtcgccgtgctgggcacgatctatctgggcatcgccacgccgaccgaggcttcgggcctgggcgcggccggcgcgctgctggtggcgctcggctaccgcgaactggaccgcgcgaagctgcgcgagatcgtccgctccaccatcgtcaccagcagcatgatcctgctgatcgtggcggccgcgctgttgttcggccatgtcctgatgcgcctgcaggcgccgcagatgctgatcgcctgggtcgccgcgctggcccagccggattgggtgatcctgctgctgatcctggtcttcctgctgatcgtcgggatgttcctggacatcgtctcgatcatcctgatcacgaccccgatcgtgcttccggtgatcacgtcgctgggcctggatccgatctggttcggcgtggtcatgatcatcatgtgcgagatggcggtgatcacgccgcccatcggcctgaacctgtatgtcatcaagggcgtggcgccggagatctcgctgcgcgacatcaccatgggcgccctgccgttcgtgctggtggaagcgctggccgtgctgatcctggtgctgtttccgcaactggccttgtggctgcccagccacatgtag

SEQ ID NO: 56200 - protein, 432 aa, Bordetella bronchiseptica RB50
MDAVLILTVILGLFGLLLVLGIPIFAALGVPSILGIYLVGGASALNVVPSVLHRGIASYSLICIPLFILMGETLARTSIGARLYTLFYTWLSRVRCSLAIASVGASAIFGAMSGVSVAGAATIGRVAIPEMLKRRYDPGLAGGSVAAAGSLALLIPPSVGFVLYGEIASQSIGKLFSAAIVPGLLLSVLMMLYLYGLSRIKPSVAPDEAQKVSWRERWQALRDVWAAIVLIVAVLGTIYLGIATPTEASGLGAAGALLVALGYRELDRAKLREIVRSTIVTSSMILLIVAAALLFGHVLMRLQAPQMLIAWVAALAQPDWVILLLILVFLLIVGMFLDIVSIILITTPIVLPVITSLGLDPIWFGVVMIIMCEMAVITPPIGLNLYVIKGVAPEISLRDITMGALPFVLVEALAVLILVLFPQLALWLPSHM

SEQ ID NO: 56201 - DNA, 1284 bp, Bordetella bronchiseptica RB50
  CDS (1)..(1284)
atgtctaccggtgcccttttcctgatgggcgtattcacggtcacggtgctgatcgacatgccgatcgccttcgggctggtgctggcgtgcctggcgtacctggccgtctacgacgccgccccgatgatggtggcggcccagcaatacgtggtcggcctggacagcttcacgctgctggccattcccctgttcatcctggccgcccagctgatgaacggcgcgggcctgacgcagcgcatcgtgcggctgtgcgcggccatcgtcggcgatatcaagggcggcctggccgtggtggccgtgctggcctgcctgatgttcggcgcgctgtcgggttcgggcgtggccgacgtgatcgccatcggcagcctgctgctgcccgccatggcacgcagcggctacgacaaggggttcagctgcgcgctgatcggcagcgccggcgccacctcgaccatcatcccgcccagcatcgtgctgattgtctacggcactatcaccgacacttcggtgggcaagctgttcctggccggcatcatccccggcatcctgctgggcgcttcgctgatcgtcgtggcgatctggcaggcccgcaagcacaactgggccggcggccagccgttctcgtggggcgagctgcgcgccgccgccatcgacgccctgcccgcgctgatggtgcccgtgctgatcatcggcggcatccgcttcggcatcttcaccgccacggaggccgcctccagcgccatcgtctatgcgctgctggtgggctttttctggtaccgcacgctcagcctgaagtccctgtgggagagcctgaagtcgaccggcgaaggcagcgcgtccatcctgctgctgatcggcgcctcgggcctgttcgcctgggtgctggtggccgagcaggtgccgcaggccctgtccggcctgctggtggactggaccgacagcaagatcgccgtactgctggtgctgacggtggtgctgctgctgctgggcaccttcatggaagccatcccggtcatcatcatcgtggcgccggtggtcatgccggtgctggcccactacaacatcgacccggtgcatttcggcatcctgctgtcgatcaacatggcgatcggcgcgaacaccccgccggtgggcgtggacctgatggccgcctgcaagatcggcggcatcaacatgatgcagaccctgcgcccgctgagctggatgatgctggccatgaccgccgtcatgctgctgctgaccttcgtccccgaactggtgctgttcctgccgaggcacgtgcaatga

SEQ ID NO: 56202 - protein, 427 aa, Bordetella bronchiseptica RB50
MSTGALFLMGVFTVTVLIDMPIAFGLVLACLAYLAVYDAAPMMVAAQQYVVGLDSFTLLAIPLFILAAQLMNGAGLTQRIVRLCAAIVGDIKGGLAVVAVLACLMFGALSGSGVADVIAIGSLLLPAMARSGYDKGFSCALIGSAGATSTIIPPSIVLIVYGTITDTSVGKLFLAGIIPGILLGASLIVVAIWQARKHNWAGGQPFSWGELRAAAIDALPALMVPVLIIGGIRFGIFTATEAASSAIVYALLVGFFWYRTLSLKSLWESLKSTGEGSASILLLIGASGLFAWVLVAEQVPQALSGLLVDWTDSKIAVLLVLTVVLLLLGTFMEAIPVIIIVAPVVMPVLAHYNIDPVHFGILLSINMAIGANTPPVGVDLMAACKIGGINMMQTLRPLSWMMLAMTAVMLLLTFVPELVLFLPRHVQ

SEQ ID NO: 56203 - DNA, 1299 bp, Bordetella bronchiseptica RB50
  CDS (1)..(1299)
atgggtgagctcgcgcaaagcctggtgctcatcgccagcctcctgctattgctggccgccggcgtatgggtatcgctggcgctggtggccagcggcctggtggccttgctgctgttcaccgacgcgccggccggcatcatcttcgccaccaagagctgggacgcctcggccaactgggccctgaccgcgctgccgctgttcatctggatgggtgaaatcctctaccgcacccgcctggccgaggacatgttcagcggactgggcccctgggtgcgccgcctgccgggccgcctggtgcatgtcaacgtgctgggctgcgggattttcgccgcggtcagcggctcgtccgccgccaccgccgcgaccatcggccgcatctcgctgccggagctcaaggctcgcggctatgacgacggcctggccatcggatcgctggccggcgccggcacgctgggcctgctgatccccccgtccatcgtcatgatcgtctacggcgtggcggcccaggtctcgctcatcaagctgttcatcgccggcatcctgcccggcctgctgctgatggcgctgttctccggctacatcggcgtatggtcgctgcgcaatcccgcgcgggtaccgccgcgcgagcccgcggtgccctggctcaccatgctggcccgcctgcgcctgctgctgccggtggtggcgttgatcgccggggtcatcggttcgatctacgccggcatcgcgaccgccaccgaggcggccacgatcggcgtcatcggcgccctggcgatcgccgcctggggcaagtcgctcaaccgcagatcgttcatcgacagcctgatgggcgcgacccgcacttcgtgcatgatctcgttcatcctgctgggcgcggcctatctcaccagcgcgatgagcttcaccggcctgccggccaacctggccgagtggatctcgtcgctgggcctgagccagtatggactgatcgcggtgctgaccgtcttcttcatcctgatgggcgccttcctcgatggcatatccatcgtcgtgctgaccaccgccgtgctcatgccggccatccaggcggcggacatcgacccgatctggttcggcatctacctgatcctggtggtcgagatggcgcagatcaccccgccggtgggcttcaacctgttcgtgatccagggcattaccggacgcaacctgttcgagctggtgcgcatggcctttccgttcttcctgctgctggtgctggccacggcgatcatcacgatatttccggcgatcgtgaccgcgctgccgctggcgatgcggtag

SEQ ID NO: 56204 - protein, 432 aa, Bordetella bronchiseptica RB50
MGELAQSLVLIASLLLLLAAGVWVSLALVASGLVALLLFTDAPAGIIFATKSWDASANWALTALPLFIWMGEILYRTRLAEDMFSGLGPWVRRLPGRLVHVNVLGCGIFAAVSGSSAATAATIGRISLPELKARGYDDGLAIGSLAGAGTLGLLIPPSIVMIVYGVAAQVSLIKLFIAGILPGLLLMALFSGYIGVWSLRNPARVPPREPAVPWLTMLARLRLLLPVVALIAGVIGSIYAGIATATEAATIGVIGALAIAAWGKSLNRRSFIDSLMGATRTSCMISFILLGAAYLTSAMSFTGLPANLAEWISSLGLSQYGLIAVLTVFFILMGAFLDGISIVVLTTAVLMPAIQAADIDPIWFGIYLILVVEMAQITPPVGFNLFVIQGITGRNLFELVRMAFPFFLLLVLATAIITIFPAIVTALPLAMR

SEQ ID NO: 56205 - DNA, 1302 bp, Bordetella bronchiseptica RB50
  CDS (1)..(1302)
atgaatgaaatcctgatcgtcaccctgctggtcgtctcgatcttcgcgctgctgggttgcggagtctgggttggcctcaccctggccggcacggcctggatcggcatggaagtcctctccagccggccggccggcgacgccatggccgtcacgatctggggcgcctcgtcgagctggacgctgaccgccctgccgctcttcctgtggatgggcgagatcctgttccgcacccgcctgtccgaggacctgttcaagggcctcgcgccgtggctgaaccggctgcccggccggctgctgcacaccaacgtcatcggctgcgccatcttcgccgcggtttccggctcgtcggccgccacctgcgccacggtgggcaagatgaccatccccgaactgacgcggcgcggctatccggaggacaagatcctcggcacgctgtccggcgccggcaccctgggcctgctgattccaccgtccatcatcatgatcgtctacggcgtggcggccgacgtctccatcgccaagctgttcatcgccggaattttccccggtctcctgctggcgctgctgttcatgggctatatcgcctggtgggccatccggcaccccggcgccgtgcctgccgccgacccgggcatctcgctcatgcagaagctgaagcagtcccgccacctgatcccggtgctgctgctcatcggcgcggtgctcggctccatctacaccggcatcgccaccgccaccgaggcggcggccgtgggcgtggtcggcgcgctgatcctgtcggccctgcagggctcgctcacacgcgccagcttcatgacctcgctgctgggcgccacgcgcctgtactgcatgatcgccctcatcctggccggcgcccagttcctcaccctggccatgggctacatcggcctgccccgcgcgctggccgagtggatcggcgggctgggcctgtcccagttcggcctgatcatggccttgatggtgttcttcgtcgtgctgggctgcttcctggacggcatctccatcgtcgtcctgaccatgggcgtgctgctgcccaccgtgcaggccgccggcatcgacctgatctggttcggcatcttcatcgtgttcgtggtcgagatggcgcagatcaccccgcctgtcggcttcaacctgttcgtgctcgccggcatgagcggacgcgagctgccctacatcgcccgcgcctcgctgccgatgttcttcctgatgatcgtggccgtgctgctgctgtactacctgcccggcatcgccacctggctgccgcagcacatgacgctgtag

SEQ ID NO: 56206 - protein, 433 aa, Bordetella bronchiseptica RB50
MNEILIVTLLVVSIFALLGCGVWVGLTLAGTAWIGMEVLSSRPAGDAMAVTIWGASSSWTLTALPLFLWMGEILFRTRLSEDLFKGLAPWLNRLPGRLLHTNVIGCAIFAAVSGSSAATCATVGKMTIPELTRRGYPEDKILGTLSGAGTLGLLIPPSIIMIVYGVAADVSIAKLFIAGIFPGLLLALLFMGYIAWWAIRHPGAVPAADPGISLMQKLKQSRHLIPVLLLIGAVLGSIYTGIATATEAAAVGVVGALILSALQGSLTRASFMTSLLGATRLYCMIALILAGAQFLTLAMGYIGLPRALAEWIGGLGLSQFGLIMALMVFFVVLGCFLDGISIVVLTMGVLLPTVQAAGIDLIWFGIFIVFVVEMAQITPPVGFNLFVLAGMSGRELPYIARASLPMFFLMIVAVLLLYYLPGIATWLPQHMTL

SEQ ID NO: 56207 - DNA, 1278 bp, Bordetella bronchiseptica RB50
  CDS (1)..(1278)
atgtcgcagttgatgattctctcgatgttgattttcttcgggctgtcggtgccggtcgcggtggcgatcggcatcgcggccctgaccggcgtgtcggtgggcggcctgccctggctggtggtggcgcagcagatctacgcggccctggacaaatacccgctggtggccattcccttcttcatcctggccggcaacctgatggaggccggcgggatctccgagcgcatggtcgaattcgccaagagcctggtgggcggcatacagggcggcctggcgtgcacctgcgtgctgacctgcatgatcttcgcggcggtggccggctccagcgtggcgaccaccttcgcggtgggcgcgatcctgattccggccatggtccgccacggctacccggcgccgttcgccgcgtcgctgcaggccagcgcggccgagctcggcgtgatcattccgccgtccattcccatgatcctgttcgccgtgtccaccgacacctccaccggcgagctgttcatcgcaggcgtcatgcccggcgtgctgatcggcctggcgctgatgctgtatgtatggctgtacgcgcgccgcaatggcctgggcaagcaggacggcgcgggccgcctgccggtgtggcaggcgttcaagcgggcctggctggccctgctgatgccggtcatcatcctgggcggcatctacggcggcgtgttcacgcccaccgaggcgtcggtggtcgcggtcatgtacgcggtgctgataggctggctggtctaccgccgcctgtcgttcggcctcatttcgaccaccctgcatcgctcggtgatctcgaccgcggtcatcatgttcgtgatcgccaacgcgggcgtcttcagcttcctgctcaaccgcgccggcatcccggacgcgctgggcgtatggctgagccagctgttcgacaaccacttcaccttcctgatgggcgtgaacgcggcgctgttcgtgatcggcatgttcatcgagacctcggcctcggtggtggtgctggcgccgctgctgctgcccgtggccatgaagttcggcgtcgagccggtccacttcggcgtcatcatggtggtgaacctggcactgggcatgatcactccgcccttcggcgtcaacctgttcgccgcctgcgcggtcgccaagctgccgctggagcgcctggtccggccgctggtcccgttcgtcggcgtggtggtcgcgtgcctgctggtcattacttactggcccggcctgtcgctgggcctgcgcgacctggtctatggccgctag

SEQ ID NO: 56208 - protein, 425 aa, Bordetella bronchiseptica RB50
MSQLMILSMLIFFGLSVPVAVAIGIAALTGVSVGGLPWLVVAQQIYAALDKYPLVAIPFFILAGNLMEAGGISERMVEFAKSLVGGIQGGLACTCVLTCMIFAAVAGSSVATTFAVGAILIPAMVRHGYPAPFAASLQASAAELGVIIPPSIPMILFAVSTDTSTGELFIAGVMPGVLIGLALMLYVWLYARRNGLGKQDGAGRLPVWQAFKRAWLALLMPVIILGGIYGGVFTPTEASVVAVMYAVLIGWLVYRRLSFGLISTTLHRSVISTAVIMFVIANAGVFSFLLNRAGIPDALGVWLSQLFDNHFTFLMGVNAALFVIGMFIETSASVVVLAPLLLPVAMKFGVEPVHFGVIMVVNLALGMITPPFGVNLFAACAVAKLPLERLVRPLVPFVGVVVACLLVITYWPGLSLGLRDLVYGR

SEQ ID NO: 56209 - DNA, 1275 bp, Bordetella bronchiseptica RB50
  CDS (1)..(1275)
atgagcctcgccttcgcaggattgttcctgctgctgatcatcggcatgccgctgggcatggcgttcgccctggccgtgatgggccgcgccggaagtttcaacctggatctcgacgcgctgggagccatcccctacgaaaccatttcggcggttccgctggtggcgattccgctgttcctgctggtcggcgaaatcatgaaccgcggcggcctggccttgtgcctgagccagatctgcgaccgcgtgctgcacttcctgcccgcccgcatggggcacatcgccgtggcggcctcggggctgatgagcgccatgaccggctcgtccgtggccacggtggccgccatcggcgcgaccgtgggccccgaaatgacggcgcgcggctacaagcgcgcctacagcgcgtcgctggtcgccgccgccggcctgctgggcgtgctgctgccgccatcgataccgttgatcctgtacggttcggtggtcggcacgtccatcgtcgatctattcctcgccaccctggtgcccggcctgatcatggcgggcgcgttcttcgccacgcacgccctgcgctcgcgctcggccttgcgggacggcgtcgaaagcgccggcgcggcgggcctggaccgcgcccccgccccgacctccggcgccaccgtctcggcattgctgctgccggtgttcgtcctgggcggcatctactccggcctgaccacgccgaccgaggcagccgcggtcgcggcagcggccgccctggcgatgacgctgatccagcgcaccctgtgctgggaccaggtaccggtggtgttcaccaatgccgtcaaggcgtcggcggccatcctcaccatcatcgcgctgacgagcctgttcaaccgcgccctggtcctcaaccagattccccaggacatcgccgccttcgcgctgtccgtgacggacgaccccatcgtcttcctgctcggggtcaatctgttgctgctgctggtcggcatgttcatggaaaccaatgccgcggtcatgctcatgggcccgctgctggcgccggcggccatcaagttcggaatcgatccagtgcacttcggtatcatcctggtcaccaacatcgaaattggcttgatcaccccacctttggccgccaatgttttcgttgcagcccgcacactggacgtgaacatggtgaaaatgctgccccatctcgcctggttcttcgccgccgcgctgagcgtcctgctgctcatcagcttcgtgcccgaactgaccctgtggttcaggcatttccaatag

SEQ ID NO: 56210 - protein, 424 aa, Bordetella bronchiseptica RB50
MSLAFAGLFLLLIIGMPLGMAFALAVMGRAGSFNLDLDALGAIPYETISAVPLVAIPLFLLVGEIMNRGGLALCLSQICDRVLHFLPARMGHIAVAASGLMSAMTGSSVATVAAIGATVGPEMTARGYKRAYSASLVAAAGLLGVLLPPSIPLILYGSVVGTSIVDLFLATLVPGLIMAGAFFATHALRSRSALRDGVESAGAAGLDRAPAPTSGATVSALLLPVFVLGGIYSGLTTPTEAAAVAAAAALAMTLIQRTLCWDQVPVVFTNAVKASAAILTIIALTSLFNRALVLNQIPQDIAAFALSVTDDPIVFLLGVNLLLLLVGMFMETNAAVMLMGPLLAPAAIKFGIDPVHFGIILVTNIEIGLITPPLAANVFVAARTLDVNMVKMLPHLAWFFAAALSVLLLISFVPELTLWFRHFQ

SEQ ID NO: 56211 - DNA, 2103 bp, Bordetella bronchiseptica RB50
  CDS (1)..(2103)
atgagcagtatcgagatgccggcacctgtcatgccgatcgagccggcggagcttgcgggcgcttccccctaccccctggcgatcgatcaggacttctgcctgatccgctggatggcggcgatctcgcgcgcctgcggcgcgctggcgacggtggcgctgctgctcatggccttgtcgatgtgctatgagatcttctcgcgctacctcttcaacgcgcccacggcatgggcgaccgagatctccggctacctgctcgtggccaccgtgttcttcggcctggccgcggcgcaggcctccaactcgcatgtccaggtcgaactctggatcgaccgcctgtccgcgcccgtgcgcctgcgggtggaattgctgtgccagtggctggcgttgctgttctgcgtggtgctgggctggcagatggccagtttcaacgtgcgcgagtacctcaacgacacgcgcgactggggcttgctttccacgccgcagtggatgcccgagctggcggtgtcggtgggaatggtggttttctgcatgtccatcctggtggacatctatcgcctgagcccgcctgcccaggcctggcggcgctggctgacgccggcgctgctggccttgctggcggccgcgctggtggccctgggcgccaatgcggtgccgatggcggccggcggccgcttcgactggggcatggccctcatcgtcgcggccctgctggcctgcgcatgggcgtggagcggcgtgcgcaccctggcgcacgtcgtgctggtcgtcggcggctgcgccgtcctgtatggcctggcgcgcggacagtcgctgggctgggtcgccttcctgctggtagccagcatgatgctgctgctgtttctcggcgtgcgcatcggggtcgcgttgggcctggtgggcctgttcggcgtgtatttcctgctgtcgcgtccgcagctgtcgctgctggccgagcgcgcctggagcagcaccaataccttcacgctgacggccgtgcccatgttcatcttcatgggcggactgttgctgcgcagcggcattaccgcgggcatgttcgacgcgctggtgcgctggttcggccgcgcgcccggcggcctggcgcacgcgtcggcgggcgcctcggccgtgttcgcggcggtgtcgggctcgagcctggccacggccgccacgctgggcaaggtggcctgcccggacatgatcgaacgcggctacagtccgcgcctgacctacggggtagcggcggccggcgcgacgctcggcattctcatcccgcccagcatcccgatgatcatctatggcacgaccgtgggcgcgtcggtcacccatctctttctggccggcatgttgccgggcctgctgctgatggcctgcttcatgctgggcgcgctggtctgggcgctggcggtgccgggctcggcgccggtggcgcgcgcctacacgctgcgcgagaagctgagcgcgtcgcgcggcatggtgcctttcgtggcgatcatcggcgcggtgctcggttcgatgtacacgggcgtggccacgccgaccgaggccgccgccatcggcgccgtcagcgccttcgtgctgtgcctggtgcgtcgccagttgagctggcgggcgttgttcgagatcgcgcacgactccgccaaggtgacggcgctgttgctgctgatcgtcgtgggcgcgggcatcttcagctgggtgttcgattatctgcggctgccgcgcgaggtggtcaacctgatccagggcgcggatctgtcgccggcgctgatcgtcgccgccatggtgctggcctatctggtgctgggcatgttcgtcgagtccatcgcgatgatgctgatgaccctgccggtgacataccccatcgccatgtcgctgggcctggaccccatctggttcggcgtcttcctggtgctgatgatcgagctcgggctgatcacgccgcccgtgggcatggttctgttcgtgttgcgcagcatgaacgagaaggcgcgtttcacggatatcatccgcggcgccttgcccttcgtgctgatcatcctgctctttctgtgcctgatctacatttatccgcagatcgtgatgtggcttccccaacaagtgaaatga

SEQ ID NO: 56212 - protein, 700 aa, Bordetella bronchiseptica RB50
MSSIEMPAPVMPIEPAELAGASPYPLAIDQDFCLIRWMAAISRACGALATVALLLMALSMCYEIFSRYLFNAPTAWATEISGYLLVATVFFGLAAAQASNSHVQVELWIDRLSAPVRLRVELLCQWLALLFCVVLGWQMASFNVREYLNDTRDWGLLSTPQWMPELAVSVGMVVFCMSILVDIYRLSPPAQAWRRWLTPALLALLAAALVALGANAVPMAAGGRFDWGMALIVAALLACAWAWSGVRTLAHVVLVVGGCAVLYGLARGQSLGWVAFLLVASMMLLLFLGVRIGVALGLVGLFGVYFLLSRPQLSLLAERAWSSTNTFTLTAVPMFIFMGGLLLRSGITAGMFDALVRWFGRAPGGLAHASAGASAVFAAVSGSSLATAATLGKVACPDMIERGYSPRLTYGVAAAGATLGILIPPSIPMIIYGTTVGASVTHLFLAGMLPGLLLMACFMLGALVWALAVPGSAPVARAYTLREKLSASRGMVPFVAIIGAVLGSMYTGVATPTEAAAIGAVSAFVLCLVRRQLSWRALFEIAHDSAKVTALLLLIVVGAGIFSWVFDYLRLPREVVNLIQGADLSPALIVAAMVLAYLVLGMFVESIAMMLMTLPVTYPIAMSLGLDPIWFGVFLVLMIELGLITPPVGMVLFVLRSMNEKARFTDIIRGALPFVLIILLFLCLIYIYPQIVMWLPQQVK

SEQ ID NO: 56213 - DNA, 1329 bp, Chromobacterium violaceum ATCC 12472
  CDS (1)..(1329)
atgagcgccctgatcattttcggcctgctgctggcgctgatgctgaccggcatgcccatttccatctcgctgggcctgaccgtcctcaccttcctgttcaccatgaccgaggtgccgatcacctcggtcgccctcaagctgttcaccggcatcgagaagttcgagatcatggcgatccccttcttcatcctggccggcaacttcctgatgcacggcggcgtcgcgcggcggatgatacgtttcgccaccaccctggtcggccactggtacggcggcctgggcctggccggcgtggtgtcctgcgcgctgttcgccgccatcaccggctcctcggtcgccaccgtcgtcgccgtgggctccatcatcctgccggcgatgctgaaacaaggctacccgcagcgcttcggcgccggcgtgatcaccacctccggcgcgctgggcatcctgttcccgccgtcgatcaatctggtgatgtacagcatcgccaccgccggcatggacgtcaccggccccagcggcatgagcgtgtccaccgcctcggtcggccagctgttcatggccggcgtgctgcccggcctgtgcctgtccttcctcttgggcatgaccacctggttccgcgccaagaagttcgactaccctaggttgcctcgcgccagctggggcgagcgctggctcgcgttccgcgaatgcgtgtggggcctgctgctgatcgtgctggtgataggcggcatctactccggcgtgttcaccccgaccgaagcggcggcgatggccgcggtgtacgccttcgtgatcgcggtgttcgtctacaaggacatggggctgaaagacgtgcccaaggtgctgatcaacgccgcgtcgatgagcgcgatgctgctctacatcatcaccaacgcggtgctgttctccttcctgatggcgtccgagcagatcccgcaaaccatggcggcctggatggccagccagggcttcggcatcgtcgccttcctgctgttgaccaacatcctgctcttggcggccggcaacttcatggacccgtcggccatcgtgctgatcatggcgcccatcctgtacccggtggcggtgaagctgggcgtcaacccggtgcatttcggcatcctgatcgcggtcaacatggaggtgggcatgtgccacccgccggtgggattgaacctttacgtcgcgtcggggatcaccaagatggggatcaccgagttgacggtggcggtgtggccgtggctgctgaccatgctgggcttcctgctggcagtgaccttcatcccggaaatctcgctttggctgccgcggatgctgggcatgatgaactga

SEQ ID NO: 56214 - protein, 442 aa, Chromobacterium violaceum ATCC 12472
MSALIIFGLLLALMLTGMPISISLGLTVLTFLFTMTEVPITSVALKLFTGIEKFEIMAIPFFILAGNFLMHGGVARRMIRFATTLVGHWYGGLGLAGVVSCALFAAITGSSVATVVAVGSIILPAMLKQGYPQRFGAGVITTSGALGILFPPSINLVMYSIATAGMDVTGPSGMSVSTASVGQLFMAGVLPGLCLSFLLGMTTWFRAKKFDYPRLPRASWGERWLAFRECVWGLLLIVLVIGGIYSGVFTPTEAAAMAAVYAFVIAVFVYKDMGLKDVPKVLINAASMSAMLLYIITNAVLFSFLMASEQIPQTMAAWMASQGFGIVAFLLLTNILLLAAGNFMDPSAIVLIMAPILYPVAVKLGVNPVHFGILIAVNMEVGMCHPPVGLNLYVASGITKMGITELTVAVWPWLLTMLGFLLAVTFIPEISLWLPRMLGMMN

SEQ ID NO: 56215 - DNA, 1287 bp, Wolinella succinogenes DSM 1740
  CDS (1)..(1287)
ttgagtattgcgtttctttttattggcctttttggcttgatgctaattggcgtccccgttgcggtggcgcttggaaccagcaccgttttatcaatgttgctcttcactgagctagacccgatgtccatccctcagcttgtctttgatggcatcaacaaattctctctcatggcgattccgatgttcatccttgcaggaaacctgctgagcaaaggaagctctgcccgccgaatcatcgactttgccaagtccatggttggacaccttcctggcggactccctatgagcgccatttttgcttgtatcatttttgctgccgtgagcggtagctctcctgccaccgttgtagcgattggttcaatcatgtttgcagcgatcaaagatgcaggctatcccgccagctacgccgtaggaggaatcaccaccgcaggaagccttggaatcctcatccctccctccatcgtcatgatcgtctatggggttacagcggaagaatccatcggtaaactcttcatggcgggcgtcatccccggactcatgattggagcgatgatgatgcttcagacctactggggggctaaacgccttggctttaaagccaccgagcctgcgccctttagagagcgactccaaaagcttggcaaagctttttgggctctcatggtcatctttgttgtcattggcggtatctatggcggcatcttcaccccgactgaggctgcggctgtaagcgccgtctatgcttttgtcatctcctattttgtctataaagatatccaactcaaagacctctacaaggttttcctagaatcagccatgaccacctccatgatctttttcatcatcgccaatgccgtggtttttgcacacttcctcaccagcgagcagattcctcaaaccatcgctcagacgattctagatcacaatgtaggcaagattggattcttgattctagtgaacatcatcctctttatcatgggtcagttcatggagccctccagtgtggtgatgatcatggttcctctgctcctccctatcgccacagagctaggaatcgaccccattcactttggtattatcatggtggtcaacatggagcttggcatgatcacgcctcccgtgggactcaacctctttgtcgctagtgggctcacgggaatgagcctcaaagatgtcgtgatcgcctcgctcccttggacgatcactatctttataggactcattctagtcacctatgttcctgcgatctccctttggttgcccaacctgatgtttggcacctattaa

SEQ ID NO: 56216 - protein, 428 aa, Wolinella succinogenes DSM 1740
MSIAFLFIGLFGLMLIGVPVAVALGTSTVLSMLLFTELDPMSIPQLVFDGINKFSLMAIPMFILAGNLLSKGSSARRIIDFAKSMVGHLPGGLPMSAIFACIIFAAVSGSSPATVVAIGSIMFAAIKDAGYPASYAVGGITTAGSLGILIPPSIVMIVYGVTAEESIGKLFMAGVIPGLMIGAMMMLQTYWGAKRLGFKATEPAPFRERLQKLGKAFWALMVIFVVIGGIYGGIFTPTEAAAVSAVYAFVISYFVYKDIQLKDLYKVFLESAMTTSMIFFIIANAVVFAHFLTSEQIPQTIAQTILDHNVGKIGFLILVNIILFIMGQFMEPSSVVMIMVPLLLPIATELGIDPIHFGIIMVVNMELGMITPPVGLNLFVASGLTGMSLKDVVIASLPWTITIFIGLILVTYVPAISLWLPNLMFGTY

SEQ ID NO: 56217 - DNA, 1314 bp, Photorhabdus luminescens subsp. laumondii TTO1
  CDS (1)..(1314)
atggattggcaagtggttttagcgttgttcggtagttttgccgtgttgctggcactgggtgtaccggtatcctttgcgattggtttgtcatcattactggcaattatgatgactttaccaatggaagcggcgattaccgtggttgctcaacgtatggcagtcggtgttgataacttctctttgctcgctatcccgttctttattctggcgggaaatattatgaatcaagggggaatcgctgcccgtctaattaatctggcgaaagtcatgggcggccgtttgcccggttctctggtgcacgtcaatattatagcgaatatgtttttcggtgcgatttcgggctcagcagtggcatcggctgcggcggtcggcggaacgatggcaccaatgcagaaaaaagagggttatgagccggaatactccgctgctgtaaacattgcttcctgtcctgccggtttgttgatcccgccaagtaatactttgattgtttactcactggtttctggtggcacatcaattgccgcactgtttttggcgggttatattcccggtattttgatgggggcatctttgatgattgtggcggcaatcattgccaagcgccgtggttatccggtatcacccaagccgacatggaacgaatttttcaccacattagttcgtgcattgccttctctgatgctggttgtggttattatgggagggatcattgccggtatttttaccgccacagaagcctcggcgattgctgtgttgtacagctttatattggcagtattgatttatcgtgaagtcagtatcactaaattacccaaaatcattctggattctgcggtgaccacttccattgttttgttgctgattggtgcatcaatgggcatgtcttgggcaatggcgaatgcggatctgccctatttgatcgctgatgcactcatggcgttttctgaaaaccctctggttattctgctggtcattaatctggttctgttgttggtcggaacctttatggatatgacaccggcgattctgatttttacgccgattttcctgccagtagcgcagaatatgggcgttgatccggtacatttcggcatcattatgaccttcaacctagctattggtatttgtacaccgccggtagggagtgcgctgtttgtgggttgttctatcggtgaggtcagcattaataaggtattgaaaccgttagttcccatgtattgcgctttggttatcgcgttgatgttggtgaccttcataccgcaactgagcttgtggttgcctcagatgttactgaattactcagtatttaagtaa

SEQ ID NO: 56218 - protein, 437 aa, Photorhabdus luminescens subsp. laumondii TTO1
MDWQVVLALFGSFAVLLALGVPVSFAIGLSSLLAIMMTLPMEAAITVVAQRMAVGVDNFSLLAIPFFILAGNIMNQGGIAARLINLAKVMGGRLPGSLVHVNIIANMFFGAISGSAVASAAAVGGTMAPMQKKEGYEPEYSAAVNIASCPAGLLIPPSNTLIVYSLVSGGTSIAALFLAGYIPGILMGASLMIVAAIIAKRRGYPVSPKPTWNEFFTTLVRALPSLMLVVVIMGGIIAGIFTATEASAIAVLYSFILAVLIYREVSITKLPKIILDSAVTTSIVLLLIGASMGMSWAMANADLPYLIADALMAFSENPLVILLVINLVLLLVGTFMDMTPAILIFTPIFLPVAQNMGVDPVHFGIIMTFNLAIGICTPPVGSALFVGCSIGEVSINKVLKPLVPMYCALVIALMLVTFIPQLSLWLPQMLLNYSVFK

SEQ ID NO: 56219 - DNA, 1362 bp, Vibrio vulnificus YJ016
  CDS (1)..(1362)
atggatattctatttttatttttgttagtcattggctttatgctgattggcgtgcctatcgcggtttctctcggcttatcgagcattctgtttttgatgtggcactccgatgcgtctttggcgtcggtggcgcagactttatttaatgcctttgaaggccattacaccttgttggcgattccgttttttatcttggcatccagttttatgtcgacgggtggggtagccaagcgcatcattcgatttgcgattgccatggtaggttggtttcgcggtggccttgccatggcctcggtggtggcatgtatgatgtttgccgcgctgtccggctcttctccggctaccgtggtggcaattggtagcatcgttatcgctgggatgatcaaaaacggttactcgaaagaattcgcggctggggtgatttgtaatgccgggacactgggtattttgatcccaccgtcgattgtgatggtcgtttactctgcggccaccgatgtctcggtcggtcgtatgttccttggtggcgtgatcccagggctacttgccggtcttatgctgattgtggcgatttatattgcagcacgaataaaaaatctgcctaagcagccttttgtgggttggtcagaagccatcaacgcggcaaaggaagcgagttggggattgctgttggtggtgatcatccttggtggtatctatgggggcatttttaccccaaccgaagcggctgcggtggctgccgtctactcattcttgatcgctaacttcgtttataaagacatggggccttttgccgataagcaaaaccaacgtcctgcgctcgtgaaagtgtttgaagccttctttcataaagacacccaacatacgctttttgaagcgggtaagctgaccatcatgttgttgtttatcattgccaacgcattgattcttaaacacgtactgacggaagagcgcattccgcaaatgatcacagaatcgatgttgtcagcggggcttggtcccatcaccttcttgattgtggttaacgtattgctgctgattggcggtcagtttatggaaccctcaggtctactgatcatcgtggctccgttagtcttccccatcgccattgcgttaggcatcgacccgattcacttgggtatcatcatggtggtgaacatggaaatcggcatgatcacaccgcctgtcgggctcaatttattcgtcaccgcaggggtggcaaaaatgtcgatgatgaacgtggtcaaagccgcattgccttgggtggcggtgatgttcctcttcctcattattgtcacgtacgttccttgggtatcgacttggctaccaaccacactgatggggccggagatcattaccaagtaa

SEQ ID NO: 56220 - protein, 453 aa, Vibrio vulnificus YJ016
MDILFLFLLVIGFMLIGVPIAVSLGLSSILFLMWHSDASLASVAQTLFNAFEGHYTLLAIPFFILASSFMSTGGVAKRIIRFAIAMVGWFRGGLAMASVVACMMFAALSGSSPATVVAIGSIVIAGMIKNGYSKEFAAGVICNAGTLGILIPPSIVMVVYSAATDVSVGRMFLGGVIPGLLAGLMLIVAIYIAARIKNLPKQPFVGWSEAINAAKEASWGLLLVVIILGGIYGGIFTPTEAAAVAAVYSFLIANFVYKDMGPFADKQNQRPALVKVFEAFFHKDTQHTLFEAGKLTIMLLFIIANALILKHVLTEERIPQMITESMLSAGLGPITFLIVVNVLLLIGGQFMEPSGLLIIVAPLVFPIAIALGIDPIHLGIIMVVNMEIGMITPPVGLNLFVTAGVAKMSMMNVVKAALPWVAVMFLFLIIVTYVPWVSTWLPTTLMGPEIITK

SEQ ID NO: 56221 - DNA, 1299 bp, Vibrio vulnificus YJ016
  CDS (1)..(1299)
atgatcgaatctattgttggcttttcagtactgattgcactgatattgctgcgtttacctcttgcgtttgcgatgggcgtgatcggcttcatcggcttttggtatatcaatgattacaattggaccgcggccatgtcgatggcggcgagacgcattatcgacacaggtcaagactacggtttgtccgtgattccactgtttattttgatgggtaacttcgtcaccaaagcgggcatctccaatgagttgtacaaagcgtgtaatgcctttgttggtcatcgtcgaggtggtctgtcgatgtcgacgatcctcgcatgtggcggcttctctgcgatttgtggctctagccttgcgacctcggcaaccatgtcaaaagtcgccatgccaccaatgcgtaaatacggttattctgacgggttggcttctgcttctatcgcggcaggtggcacgttagggattttgattccaccgagcgtgatgttggtgatttacggtctattgaccgaaaccagtatccgtgaactgtttgccgcaggcttcttacctgggttactaggcatcgtactttacctccttgcagtgcaatgggtggtatcacgtaagcccgaaagcgcccctccgggtgaaagagtcagttggaaaggccgcttgattgcactaaaaggcatcttctctaccctactgctgtttgtgatcgtgatgggtggcatttacattggtgcgtttaccccgaccgaggccgcgggtatcggggcgtgtggcgcttttgccttggcaggtgtgcgtggtaagttaaattacactgtactacgtgaaattctcatcgatacggcaaagacctctgcttcgctattcgcggtggtcatttcagcgctgatcctgtcgaacttcgtcaaccgcgcaggcctgccaactgcattggttgagctaattcaaaccgccaatgtcacgcctatgatggcactcggacttattctagttatctacattattttaggttgtgtatttgaaagcatgtcgatgatgttgctgacggtacctatattctatcctgtcattgtcgaacttggttttgacccgatttggtttggcatcatcgtggtggtggtcaccgaaatcagtttgatcaccccgcctgttggactcaacgtattcgtcctgtcagggctgattaaagacataaataccgcaaccatctttagaggcgttttgccattctgggtagcggatatggttcgattagcattaattgtgctggtaccggctatcgccctgtacctaccgaatatgctttattga

SEQ ID NO: 56222 - protein, 432 aa, Vibrio vulnificus YJ016
MIESIVGFSVLIALILLRLPLAFAMGVIGFIGFWYINDYNWTAAMSMAARRIIDTGQDYGLSVIPLFILMGNFVTKAGISNELYKACNAFVGHRRGGLSMSTILACGGFSAICGSSLATSATMSKVAMPPMRKYGYSDGLASASIAAGGTLGILIPPSVMLVIYGLLTETSIRELFAAGFLPGLLGIVLYLLAVQWVVSRKPESAPPGERVSWKGRLIALKGIFSTLLLFVIVMGGIYIGAFTPTEAAGIGACGAFALAGVRGKLNYTVLREILIDTAKTSASLFAVVISALILSNFVNRAGLPTALVELIQTANVTPMMALGLILVIYIILGCVFESMSMMLLTVPIFYPVIVELGFDPIWFGIIVVVVTEISLITPPVGLNVFVLSGLIKDINTATIFRGVLPFWVADMVRLALIVLVPAIALYLPNMLY

SEQ ID NO: 56223 - DNA, 1281 bp, Vibrio vulnificus YJ016
  CDS (1)..(1281)
atggacgcgtttctattaaccatgctggtgtttgtcatcctgctgtttatcgggatgccgattgcgatcagtattggtatgtgtacagcgtttgctttagttatcgctgatatcccaatgtcattcattgcgcagacggcctttacttcactagactcctttacttatctcgcgatcccaatgtttattttggccggtttcgtgatggagaaaggaggcttgtcggctaggatagttaactttgcctctagcttagttggtcgagcctctggtggccttggtatcgtgactgtcgttgcgtgtatgttctttgctgcaatttctggttcatcacctgcaacggtagcggcaatcggttcaatgatggtgccttccatgattgaaaagggctacaaccgtcactttgctggagcactgaccgcatcagcaggttcattgggtatcttaattccgccgtctatacctatgatcatctatgcggtaacggctgagatctcgattggtgacatgttcctcgcaggctttgtacctggtggtatgatcggcttaggtttgatccttgcggtttacatcattgccaaaaaacgtgggtataaaggccaagatgaaggctttaacctagcgcgcgtcaagactaccttctgggaagcgaaatgggcactgttgacgccgattattattcttggcggtatctactcagggatattcacggcaacagaagctgcgtgtattacggttatttatactctggtagtgagtttcgttattcataaggaaatgacctacgctgatttaattccaactatttctcgtgcggcattaactacgggttgtgtcattattattcttggctttgctaccgcatttgcgcgttatcttaccatcagtatgattccacaaatgattggtgaggcaattctgcagattaccgataacccaaccattattttattaatatttgttgcactgattatgtttacggggctgtttattgagactgcagcacagatattaatctatacaccactatttttgccaatattggttcagcttggtattagcccattccatttcggtattattttgattgttggtactgagcttgcgcttattactcctcctgttggcgttaacttatttgttgctaaaggcattactggctcgtcgatggtgcagttgacccgcgccgttattccattccttatcagcatgcttctggttcagatcgcgttggtatttatgcctggtgttattacttttctcccagatttatttaagtaa

SEQ ID NO: 56224 - protein, 426 aa, Vibrio vulnificus YJ016
MDAFLLTMLVFVILLFIGMPIAISIGMCTAFALVIADIPMSFIAQTAFTSLDSFTYLAIPMFILAGFVMEKGGLSARIVNFASSLVGRASGGLGIVTVVACMFFAAISGSSPATVAAIGSMMVPSMIEKGYNRHFAGALTASAGSLGILIPPSIPMIIYAVTAEISIGDMFLAGFVPGGMIGLGLILAVYIIAKKRGYKGQDEGFNLARVKTTFWEAKWALLTPIIILGGIYSGIFTATEAACITVIYTLVVSFVIHKEMTYADLIPTISRAALTTGCVIIILGFATAFARYLTISMIPQMIGEAILQITDNPTIILLIFVALIMFTGLFIETAAQILIYTPLFLPILVQLGISPFHFGIILIVGTELALITPPVGVNLFVAKGITGSSMVQLTRAVIPFLISMLLVQIALVFMPGVITFLPDLFK

SEQ ID NO: 56225 - DNA, 1308 bp, Rhodopseudomonas palustris CGA009
  CDS (1)..(1308)
atgctgaccaacgagaccgtggccgcgatcggcttcgtcagcctgttcgtcctgatgttgctgcgcgtgccggtcggcatggcgatgggcctcgtcggcgtcaccggcttcggctatctcaccggcttcgagccggcgctgaagctggtcggccagaccacgatgcgcaccgtcaccgactattcgttcggtgtgattccgatgttcctgctgatgggcgcgttcgtgtcggcgtcgggcatcagccgcgagctgttccgcgccggcaacaccatcgtcggccattggaagggcgggctcggcatcgccaccatcgcggcctgcggcggctttgcggcgatctccggctcgtcggtcgcgaccgccgcgaccttctcggcggtggcctatccggagatgcggcggttcggctatccacagtcgttctcgaccggcgtgatcgcggtcggcggcacgctcggcgcgatgctgccgccgtcaaccgtgctggcggtgtacggcatcattacgcagcaggacatcggcaagctgttcatcgccggcatcctgccgggcctgctggcgatcgtgatgcatatgatcacgatctggatcatcggcgtggcgcggccgggtttcttgccggcggggccgaagagttcgtggggcgaccgcctcgcggcgtttcgcgacgtgtggtcgccgctgctactgttcttgttcgtgatcggcgggctgtatggcggcttcttcattccgaccgaggcgggcgcggtgggggcggtcggcgcgttcctgatcggcatcttgcgcggcaagctcgaccgcgagggcatcctgcagtcgctgctgcaggcgacccgcaccgcggccgcggtgttcaccgtgctgatcggcgcgctgtgcttcggctacttcctgaccatcacccagacgccgcaatacgtcaccgaattcctcaccgggctcggcatcgggccctacggcgtgctggcgctgatcctgctgatgtatctggtgctcggctgcctgatggacgcgatggcgatggtgatcctcaccgttccgatcgtgtttcctgtcgtcaccgcgctcggcttcgatccgatctggttcggcatcatcattgtgatgacggttgaacttggcctgatccatccgccggtcggcatgaatgtgttcgtgatcaagagcgtgatcaaggacgtcagcatgtccacggtgttcgccggcgtgctgccgttcgtcgtcaccgacctgatccggctggttatcctgatcgcatttccgatcatcgcgctgtggctgccgatgcggatgatcgggtag

SEQ ID NO: 56226 - protein, 435 aa, Rhodopseudomonas palustris CGA009
MLTNETVAAIGFVSLFVLMLLRVPVGMAMGLVGVTGFGYLTGFEPALKLVGQTTMRTVTDYSFGVIPMFLLMGAFVSASGISRELFRAGNTIVGHWKGGLGIATIAACGGFAAISGSSVATAATFSAVAYPEMRRFGYPQSFSTGVIAVGGTLGAMLPPSTVLAVYGIITQQDIGKLFIAGILPGLLAIVMHMITIWIIGVARPGFLPAGPKSSWGDRLAAFRDVWSPLLLFLFVIGGLYGGFFIPTEAGAVGAVGAFLIGILRGKLDREGILQSLLQATRTAAAVFTVLIGALCFGYFLTITQTPQYVTEFLTGLGIGPYGVLALILLMYLVLGCLMDAMAMVILTVPIVFPVVTALGFDPIWFGIIIVMTVELGLIHPPVGMNVFVIKSVIKDVSMSTVFAGVLPFVVTDLIRLVILIAFPIIALWLPMRMIG

SEQ ID NO: 56227 - DNA, 1326 bp, Rhodopseudomonas palustris CGA009
  CDS (1)..(1326)
atgaacaccgcaatcatcttcgggcttctcatcgccctgatgctgaccggaatgccgatctcgatcgcgctcggtctcaccgtgctgtcgttcgtcgtgctgatgaccaacgtgccgatggaagcggtgtcgttgaagctgttcaccggcatcgagaatttcgagatcatggcgatcccgttcttcatcctcgccggcaacttcctgacccacggcggcgtcgcccgccgtatgatcaacttcgccaccacgatggtcggccactggtacggcggcctcggtctcgccggcgtgatggcctgcgcgctgttcgcggccgtctcgggttcctcgcccgcgaccgtgattgcgatcggctcgatcatgctgccggcgatggtgaagcagggcttcccgaagcggttcggcgccggcgtcatcaccacctccggcgcgctcggcatcctgatcccgccgtcgatcgtgatggtggtgtatgcggtggcgaccggcggctcgatcgcgctcgatccggacggaaaccgcgtgtcgtcggcttcggtaggccagctgttcatggccggcgtcattcccggcatcatgctggcgtcgctgctcggcctcaccaccttctaccgcgcctggaagaacgactatccgcgtctgccgaaggcgagctgggcggagcggttcgacgcgttccgcaagtgtatctggggcctattgctgatcgtgatcgtgctcggcggtatctatgccggcatgtttacgccgaccgaagcggcggcgatcagtgcggtgtacgccttcatcatcgcggtgttcgtctatcgcgacatgggcctgcgggacgtgccgcgggtgctgctcggctcggcgaacatgagcgcgatgatcctctacatcatcaccaacgccgtgctgttctcgttcctgatggccaacgaaaacatcccgcaacagatcgcgagctggatgtcgactgcgggcgtgaattgggtctggttcctgctggtggtgaacatcctgctgctgctcgccggcaacgtgatggaagcgacgtcgatcgtgttgatcatggcgccgatcctgttcccggtggcggtgaagctcggcattcacccggtccatctcggtatcctgatggtggtgaacatggaggtcggcatgtgtcacccgccggtcggcctcaacctctacgtcgcctccggcatcgccaaaatgggcattaccgagctgacggtggcggtaatgccgtggctgctcaccatgctggcgttcctggcgttggtgacttacgtgccggagatttcgctgtggctgccgcgcatgctcggcatgttgtag

SEQ ID NO: 56228 - protein, 441 aa, Rhodopseudomonas palustris CGA009
MNTAIIFGLLIALMLTGMPISIALGLTVLSFVVLMTNVPMEAVSLKLFTGIENFEIMAIPFFILAGNFLTHGGVARRMINFATTMVGHWYGGLGLAGVMACALFAAVSGSSPATVIAIGSIMLPAMVKQGFPKRFGAGVITTSGALGILIPPSIVMVVYAVATGGSIALDPDGNRVSSASVGQLFMAGVIPGIMLASLLGLTTFYRAWKNDYPRLPKASWAERFDAFRKCIWGLLLIVIVLGGIYAGMFTPTEAAAISAVYAFIIAVFVYRDMGLRDVPRVLLGSANMSAMILYIITNAVLFSFLMANENIPQQIASWMSTAGVNWVWFLLVVNILLLLAGNVMEATSIVLIMAPILFPVAVKLGIHPVHLGILMVVNMEVGMCHPPVGLNLYVASGIAKMGITELTVAVMPWLLTMLAFLALVTYVPEISLWLPRMLGML

SEQ ID NO: 56229 - DNA, 1884 bp, Rhodopseudomonas palustris CGA009
  CDS (1)..(1884)
atggcgagcgccgacgcttcccagctcaccgccggtgaacggctccacgcgccgcagcgtaaaacgctgatcggcgcgctggaggctgcgctcggcctgatggtcgagattccggcggcgatcctggtcgtcgtcgagatcgtcgtgctgttcgccggcgtggtatctcgctacgtcttccacagcccgctgatctggtccgacgaactggcgtcgatcctgttcctgtggctggcgatgttcggcgcggcggtggcgttccgccgcggtgagcacatgcggatgaccgcgatggtggcgggggcctccccgcgcctgcgtgcctggctcgatctggtcggcatttgtgcggcgctggcgttcctgctgctgatcgcggcgccagcctacgaatacgcctacgaggaaagctacatcaccacgccggcgctgtcgctcgccaacagctggcgcgcagcggcgctgccggtcggcatcgcgctgatggcgctgttcgcggctctgcggctgatccggttcggcgatctcaagctggtcgttggcgccgcgctgacggtcgcgctgctgatcggcgcgttctggctggcgcagccgctgttcaagccgctcggcaacctcaatctggtgatctttttcgtcggcgtggtggcttgttgcgtgttcgccggcgtgccgatcgcgttcggatttggcctcgcgatctacggctatctggcgctgaccacgacgacgccgctactgatcctggtcggccggatggatgagggcatgagccacctcatcctgctgtcggtgccgctgttcgtcttcctcggccttctgatcgagatgaccggcatggcgcgggcgatggtggcgtttctcgccagcctgctcggccacgtccgcggcggcctgcactacgtgctggtcggcgcgatgtatctggtgtccggcatctccggctcgaaggccgccgacatggccgcggtcgcgccggtgctgtttccggagatgaaggagcgcggcgccaagccgggcgatctggtcgccctgctctccgccaccggcgcccagaccgaaaccattccgccgagcctggtgctgatcaccatcggctcggtcaccggcgtgtcgatctcggcgctattcaccggcggcttgctgccgggcgtggtgctggcgatcatgttgagcgccctggtgtggtggcgctatcgcggcgaggatctcagccacgtcaaacgcgcgcgcggcagcgagatcggcaaggcgttcatcgtcgccctgcccgcgctggcgctgccgttcgtgatccgcgccgccgtggtcgaaggcgtcgccaccgccactgaagtctcgaccatcggcatcgtctatgccgtggtggtcggcatcctggtgtaccgcaagttcgacctgcgccggctgcggccgatgctggtcgagaccgcggcgctgtcgggtgcgatcctgttgatcatcggcaccgcgaccggcatggcctggggcctgacgcagtccggcttctcgcgggcgctggcggcggcgatgaccggcctgcccggcggctccgccaccttcctagcggtgtcgatcgtcgccttcgtcatcctcggcagtgtgcttgagggcattccggcgatcgtgctgttcgggccgctgttgtttccgatcgcccgcgctgtcggtatccacgaggtgcactacgccatggtggtgatcctggcgatgggcatcggattgttcgcgccgccgttcggcgtcggctattatgcggcctgcgcgatcggccgggtcgatcccgccgaaggcatgcgcccgatctggggatatatgctggcgttgctgatcggcttgatcgtggtcgcggcgatcccgtggatctcgattggattcttgtag

SEQ ID NO: 56230 - protein, 627 aa, Rhodopseudomonas palustris CGA009
MASADASQLTAGERLHAPQRKTLIGALEAALGLMVEIPAAILVVVEIVVLFAGVVSRYVFHSPLIWSDELASILFLWLAMFGAAVAFRRGEHMRMTAMVAGASPRLRAWLDLVGICAALAFLLLIAAPAYEYAYEESYITTPALSLANSWRAAALPVGIALMALFAALRLIRFGDLKLVVGAALTVALLIGAFWLAQPLFKPLGNLNLVIFFVGVVACCVFAGVPIAFGFGLAIYGYLALTTTTPLLILVGRMDEGMSHLILLSVPLFVFLGLLIEMTGMARAMVAFLASLLGHVRGGLHYVLVGAMYLVSGISGSKAADMAAVAPVLFPEMKERGAKPGDLVALLSATGAQTETIPPSLVLITIGSVTGVSISALFTGGLLPGVVLAIMLSALVWWRYRGEDLSHVKRARGSEIGKAFIVALPALALPFVIRAAVVEGVATATEVSTIGIVYAVVVGILVYRKFDLRRLRPMLVETAALSGAILLIIGTATGMAWGLTQSGFSRALAAAMTGLPGGSATFLAVSIVAFVILGSVLEGIPAIVLFGPLLFPIARAVGIHEVHYAMVVILAMGIGLFAPPFGVGYYAACAIGRVDPAEGMRPIWGYMLALLIGLIVVAAIPWISIGFL

SEQ ID NO: 56231 - DNA, 1290 bp, Rhodopseudomonas palustris CGA009
  CDS (1)..(1290)
atgaccaccctgatcgttctcggcctgctgttcgtcctgctcgccatcggcacgccggtcggctttgcgatggccttctccggctcggtcggcctgctgatggtcggcggcaccggcacgttgttcggcatcctggagacagcgccgctgtcgacggtgtcgtcctacgagctgatcaccatcccgatgttcctgctgatggccgaactggtgctgttgtccggtgtcgccgacgctttgttcaagaccgcatcggcctgggtcggccgtatccccggcggcctcggcatggcgaccgcgctcgccggcgccggcttcggcgcgatctgcggcaccagcacggcatcggcggcgacgctctcctcgaccagcctgccggcgatgatcaagcagggctacgagccgaagatggcggccggcgtggtggcgatctccggcacgttggcgatgctgatcccgcccagcgtggcgttggtgatcttcggccttctcgccgaagtgaatatcggccagctgctgatcggcgggatcattcccgctgcgctggtcaccgcgaccatcatggcgacgatctacatcctggtctggctcgatccgtcacgtgcgcctcgggtcgcgtcggtgccgtggcgcgagcgttttgtgctgctgtggcagatcggcccgatgctggcgctgttctcgctggtcaccggcactatctatctcggagtcgcgaccccgaccgaggcttcggccctcggtgccgcgggcgcgctcgtgctggcgatctccaagggtaaggtgaccccgaggacgctgtacaaggcactgctcagcgccagctacggcacctgcatgatcgtgacgatcctggtcggtgcgtcgatctttgggtacttcttcacgctcacccacgtcacccaggacctcgtcgcctgggtcggatcgctggagacctcgcgctgggtgatcatcacgctgatcctgtgcggctacatcgtgctcggctcgttcatggaccagatcgccatcctggtgctgacggtgccgatcgtgatgccgctgatcaagtcgctcggctttgatccgatctggttcggcgtgatcaagatcgtcaccgccgaggtcggcatgatcacgccgccggtcgggctgaactgcttcatcgtcgcgcgctacgccaagcggccggtcgccgaagtgttccacggcaccttcccgcacttcatcgcgcacctgatcgcgatcgccatcatggtggcgttcccgagcatcatcctgtggctgccgtcgcagatggcgccgtaa

SEQ ID NO: 56232 - protein, 429 aa, Rhodopseudomonas palustris CGA009
MTTLIVLGLLFVLLAIGTPVGFAMAFSGSVGLLMVGGTGTLFGILETAPLSTVSSYELITIPMFLLMAELVLLSGVADALFKTASAWVGRIPGGLGMATALAGAGFGAICGTSTASAATLSSTSLPAMIKQGYEPKMAAGVVAISGTLAMLIPPSVALVIFGLLAEVNIGQLLIGGIIPAALVTATIMATIYILVWLDPSRAPRVASVPWRERFVLLWQIGPMLALFSLVTGTIYLGVATPTEASALGAAGALVLAISKGKVTPRTLYKALLSASYGTCMIVTILVGASIFGYFFTLTHVTQDLVAWVGSLETSRWVIITLILCGYIVLGSFMDQIAILVLTVPIVMPLIKSLGFDPIWFGVIKIVTAEVGMITPPVGLNCFIVARYAKRPVAEVFHGTFPHFIAHLIAIAIMVAFPSIILWLPSQMAP

SEQ ID NO: 56233 - DNA, 1266 bp, Geobacter sulfurreducens PCA
  CDS (1)..(1266)
atgtttttcatgctgttcgtactgcggattcccgcagccttcaccctcatgatggtcggttttctcggcatcgccacggtcaccacctgggacgcggccctggccatgctcggcagcgaactctggggcagcttttccaactacggcctcacggtcattcccctgttcattctggtgggggaaatcgtccattacgccggctacaacaacagtctctaccacgctacctacaagtggttcggccacaagcgcggcggccttgccatgaccacgatcctggcatcggcggccttctcggccatcagcggctccaacaccgccaccgccgccaccatgagcgccgtggcgattccggccatgaaagaatacaagtaccatccgctgctcaacgccggctccgtggctgccggcgcgaccctgggggtcctgatccctcccagcatcgtactggtggtctacgggctctacacgggccagtccatcggcaagctcttcttcggcaatgtcatccccagcgccatcctgacgatcctcatcctcctgaccgtagtctggatctgccgccgccacccggactggggccccgaggggcccagaagcggctggggggagcggtttgccgccctgcccgaggccatcgatatcctgatcctcttcgccatcatcatgtacgccctgttcaccggcgtggtgaccgccaccgaggcggcggcagtgagctgcttcctggctctcgtgatctgcggtctgcgcagaaagctcacctggaagaagctgaccggggcattagtggacaccctgcgcatctcctgcatggtgttcatgatcgtggccggcgcggtcatcttcgccaagttcctgaccatcacgcggctcccctatgaaaccgccgagtggatcagctccctggatcttccccgctggatggtcctctgggtcatcctggcctgctacatcatcggcggctgtatcatggacgccctggcgttcctgctggtgtcgctccccatcttctacccgctggtgacccaactgggctacgacccgatctggttcggccaggtgatcaccatcgtgaccaccatggggtccatcatgccccccatcggcatctgctgctacgtggtatccggcatgtcgggcatccctctcggcacggtctttcgtagcggcctctactacatgccgtcctacatcgcttccatcgcaatcctcatggtgtccccctactggacggtgctcgtgctggccgacctagtgaagtaa

SEQ ID NO: 56234 - protein, 421 aa, Geobacter sulfurreducens PCA
MFFMLFVLRIPAAFTLMMVGFLGIATVTTWDAALAMLGSELWGSFSNYGLTVIPLFILVGEIVHYAGYNNSLYHATYKWFGHKRGGLAMTTILASAAFSAISGSNTATAATMSAVAIPAMKEYKYHPLLNAGSVAAGATLGVLIPPSIVLVVYGLYTGQSIGKLFFGNVIPSAILTILILLTVVWICRRHPDWGPEGPRSGWGERFAALPEAIDILILFAIIMYALFTGVVTATEAAAVSCFLALVICGLRRKLTWKKLTGALVDTLRISCMVFMIVAGAVIFAKFLTITRLPYETAEWISSLDLPRWMVLWVILACYIIGGCIMDALAFLLVSLPIFYPLVTQLGYDPIWFGQVITIVTTMGSIMPPIGICCYVVSGMSGIPLGTVFRSGLYYMPSYIASIAILMVSPYWTVLVLADLVK

SEQ ID NO: 56235 - DNA, 1848 bp, Treponema denticola ATCC 35405
  CDS (1)..(1848)
atgaaaaagttagttaatggttttattttagctcttacggcagtactaattgtactgccttttgtaagccatatacttgcaagtttaggtggaaatagtttagagtatgagcggttgattgttcagctggtctttgtttttgcctgtcttgcaggtcttatcacaacaatagaaaaaaaacaactgaatatagaagtttttacttccaaattgaataaaaagcatcaatcaattgtacatgtgactttatcctgcgtaaatacagcaatccttacagctatatttttatccgtatttccaaactacaatatgctctcttcagaagatcatgttttgtatattccgataaaaattttcttctctgcactccctccgatgtacctgataatgcttgcattggaaataaagagaaacaagtgcataatttcaaacatagcaggtcttctaatagggctgttaataagtacgggctctattttgggactcttaaatttggtattcggttcatggtaccctgaaataaacgattcaggtctcgcagttcttttaagcggtatttccacctccgtgcaaattttttctgaaaatgctatttggctgattgtattaatttttaccgtattcagccttttcggtatgcctctttatattgtactttcaggtctggcatattttgcctttatgaccaccggaggctatgtagagagcatacccatggaaacctataatatcttaacggatacatccatagctgcaattccgctgtttacgattgcaggctatcttttggcaggaggaagtgccggaaaaaggctcttggattttgttaaaagctctgtcggctgtataagaggcggcgttgtgattgcagcagtattggtcgcaactttttttacaaccttcacgggagcctctggagtaaccatattagccttgggagggattttaagcgtaattttaacaggctcgggctattcggaagatgactcggaagcccttataacggcatcaggttccatcggactcttattacctccaagcttggccgttatagtctatggagcaactaactttatgaccgtaaacatatttgacctttttaagggggctgtccttcccggagtgctattggccttgtcaatgatagtcataggagttataaaggataaaaaatcaaaaagaatcaggttttcaagagatgcccttgctcaaagttttaaggcaggttttttagagcttcttcttcccgtattaatagtgattgtatattttggaggctattttaccctttttgaaaccgcagcctttacggttttatattcgtttgtgttggaagttttaataagaaaggacttgagcataaaaaaagccatccacgttattttacaaagtataccggtcgcaggaggagtgctcgtaataataggagccgcaaaggggcttgccctctttttagtctatgcaggaatcccccaaatactctcagatcttgcaatcacctttgtcggttcaaaaattttattcctgctgctgttaaatattgtgctgttgatagtaggctgtatcatggatttatattcggctatcttggtagtatcgccccttataattcccgttgccgaaagcttcggtatacatccggtacataccggagtaatatttttaactaacctggctctcggctttttgacaccgcctatcggaatgaacctttttatagcaagttatacatttaaaaagcctgtaataaaaatagtaaagagcatactgccctatctggcagttcaatttgttatattgcttttaattacgtacattccgtggttcagcactgtctttgtagattaa

SEQ ID NO: 56236 - protein, 615 aa, Treponema denticola ATCC 35405
MKKLVNGFILALTAVLIVLPFVSHILASLGGNSLEYERLIVQLVFVFACLAGLITTIEKKQLNIEVFTSKLNKKHQSIVHVTLSCVNTAILTAIFLSVFPNYNMLSSEDHVLYIPIKIFFSALPPMYLIMLALEIKRNKCIISNIAGLLIGLLISTGSILGLLNLVFGSWYPEINDSGLAVLLSGISTSVQIFSENAIWLIVLIFTVFSLFGMPLYIVLSGLAYFAFMTTGGYVESIPMETYNILTDTSIAAIPLFTIAGYLLAGGSAGKRLLDFVKSSVGCIRGGVVIAAVLVATFFTTFTGASGVTILALGGILSVILTGSGYSEDDSEALITASGSIGLLLPPSLAVIVYGATNFMTVNIFDLFKGAVLPGVLLALSMIVIGVIKDKKSKRIRFSRDALAQSFKAGFLELLLPVLIVIVYFGGYFTLFETAAFTVLYSFVLEVLIRKDLSIKKAIHVILQSIPVAGGVLVIIGAAKGLALFLVYAGIPQILSDLAITFVGSKILFLLLLNIVLLIVGCIMDLYSAILVVSPLIIPVAESFGIHPVHTGVIFLTNLALGFLTPPIGMNLFIASYTFKKPVIKIVKSILPYLAVQFVILLLITYIPWFSTVFVD

SEQ ID NO: 56237 - DNA, 1314 bp, Thermus thermophilus HB27
  CDS (1)..(1314)
atgccgattgagaccctcacctggctgatgttcggggccctttttgtccttctcctcaccggctaccccctggcctttttggtcggggggctttccgtggtcttcatcgcctggctctggagccccgacgccttggccttggtgccccagcgggtctggaacaacatgacccaatacctcctcgccgccatcccccttttcatcttcatggcctccatgctggaaaaatcgggggtcatagaggaggtttttgacgtggcctacaaatggctgggccggatcccgggggggttggccgtggccacggtggtggcctctaccgtcctcgcggccatggtgggggttatcggggcggcggtggtgaccatggccctggtggccctcccttccatgctccgccggggctatagcccggttttggccgtgggaacggtgatggctggggggaccttgggcatcctgattccccccagcgtcttggccatcgtctacggcttggtggctaaccagtccgtgggggagctttacctgggctcggttttccctgggctggtcctttcggggttgtacattctcttctcggtggggtatgccctcctgaaccccaaggcggccccccgcttgagcccggaggaaacgcccacctggtccgagcggtggcgggcgctccggtccatatggtcccctttggtccttatctttttggtgctgggcacgatctttctggggcttgccgcccccacggaggccgcggccatcggggccttcggggccatggtggtggcggccatccaccgccgtctttcctggaccatcttgcgcttggccctggagcagacggcgaaggcgacggccatggtgatgtggatcgtctttggggccaacgcctttgtggggttttacatcgcccaagggggggaccgctacgtttccgagctcctgctggggacgggactttccccctggggcatcctcctcctgatgcagggaatcctcatcgtcttggggatgttcttggactgggtggggatcctgctcttggcggtgcccgtctttgtgccgatcatccgggacctggggtttgatcccttgtggttcggcgtcctctatctggtgaacatgcagatctctttcctaagtccacccttcggctacgcccttttctacgtgcggggtgtggcccctcaggtccctatggggacgatctataaagctgcccttcccttcctcttcctccagctcgtggggctggccttggtgatgcttttcccggggctggccacctggcttccgagcgtggtgtacggccgctag

SEQ ID NO: 56238 - protein, 437 aa, Thermus thermophilus HB27
MPIETLTWLMFGALFVLLLTGYPLAFLVGGLSVVFIAWLWSPDALALVPQRVWNNMTQYLLAAIPLFIFMASMLEKSGVIEEVFDVAYKWLGRIPGGLAVATVVASTVLAAMVGVIGAAVVTMALVALPSMLRRGYSPVLAVGTVMAGGTLGILIPPSVLAIVYGLVANQSVGELYLGSVFPGLVLSGLYILFSVGYALLNPKAAPRLSPEETPTWSERWRALRSIWSPLVLIFLVLGTIFLGLAAPTEAAAIGAFGAMVVAAIHRRLSWTILRLALEQTAKATAMVMWIVFGANAFVGFYIAQGGDRYVSELLLGTGLSPWGILLLMQGILIVLGMFLDWVGILLLAVPVFVPIIRDLGFDPLWFGVLYLVNMQISFLSPPFGYALFYVRGVAPQVPMGTIYKAALPFLFLQLVGLALVMLFPGLATWLPSVVYGR

SEQ ID NO: 56239 - DNA, 1284 bp, Thermus thermophilus HB27
  CDS (1)..(1284)
atgctgctgagctttgcggtgtttttgctcctccttcttctggggatgcccgtggtgttcgccatcgggatcggggggctcgtcttcttcctcacccagcccgggcttcagctcaccatgcccgtgcagctggccctggcggagacccagaacttctccctcctggccatccccaccttcatcctggccagcaacctgatgaacgagctgggcgtgacccggaggctcctccgcttcgcccacgtggcgacggggttcatgcggggcgggctcgcccaggtgagcgtccttctgggcttcctcatggggggggtctcgggctcggccatcgccgacgccagcatgcaagcgaggctcttgggccccgagatggtgcgccgggggtacagccgggggttcatcgccgccctccagggcttctccggcctcctcgccgtggccatccccccgagcatcggcctcatcctctacgggagcatcggccaggtgtccatcggccagctcttcgcgggggggatcggggtaggggtgctcctggcggcggtgtacatgctcaccgtggccctcctggcccggagccgggggtaccttcccgaggccgccccgcccacggccaaggaggttggggcggccctccgggaaagcttcttcgccgtgcttttccccttcctgctccttgccgccctgcgcttcggggtcttcgtcccctcagaggtaggggcggcggcggtggtctacgccctcttggtggggctcatctaccgggagctttcccttgagcgggtgaaccgggccttggcccactcggtgcgggacgtaggcatggtggccctcctcatcgccatgaccgcggttttgagctacgggatgaagtgggagatgttcccccagcaggtctcggcctttctcctcgaggcggtgcagaacccccaggtggccctcctcctcatcctcttggccctcctcgttttgggcaccgtgctggactccacggtgatgatcatcctcctcacccccatcctggtccccgcggccaaggccttggggattgacctggtctacttcggcgtcctcatggtcatgacctgcgccgtggggctcctcacgccccccgtggggctttccatgtactcggtctgctcggtgatggggtgcggcatcggggagtacgtgcgggaagggtggcccttgctggccgccacccttttggtccttctcctcgtgtacctcttccccggggtggtgctcttcctgccccggttgctctttggaggtggggtgtga

SEQ ID NO: 56240 - protein, 427 aa, Thermus thermophilus HB27
MLLSFAVFLLLLLLGMPVVFAIGIGGLVFFLTQPGLQLTMPVQLALAETQNFSLLAIPTFILASNLMNELGVTRRLLRFAHVATGFMRGGLAQVSVLLGFLMGGVSGSAIADASMQARLLGPEMVRRGYSRGFIAALQGFSGLLAVAIPPSIGLILYGSIGQVSIGQLFAGGIGVGVLLAAVYMLTVALLARSRGYLPEAAPPTAKEVGAALRESFFAVLFPFLLLAALRFGVFVPSEVGAAAVVYALLVGLIYRELSLERVNRALAHSVRDVGMVALLIAMTAVLSYGMKWEMFPQQVSAFLLEAVQNPQVALLLILLALLVLGTVLDSTVMIILLTPILVPAAKALGIDLVYFGVLMVMTCAVGLLTPPVGLSMYSVCSVMGCGIGEYVREGWPLLAATLLVLLLVYLFPGVVLFLPRLLFGGGV

SEQ ID NO: 56241 - DNA, 1281 bp, Desulfovibrio vulgaris subsp. vulgaris str. Hildenborough
  CDS (1)..(1281)
atgaccgcgctggtgctcttcgggatgctgggcctgctcttcgcctgcaacgcccccatcatgctggcggtgggtgcctcggccttcgccgcgctgctcatcaagggaggcatggaccccatggtggcggttcaacggctgtacgccggggccgacagctttcccctgctggccgtaccgctcttcatgacagccgggcagcttatgagcgcggggggcatttcgcagcgcatcgtccgacttgccgacacgcttgtggggcaccttccgggcggtctcgccgtggtctcggtggtgtcatccatgttcttcgcaggggtgtcagggtctgcggcagccgataccgccgccgtgggctccatcctcattccctcgatggtggcccgcggctattcccctgccttcgccggagcggttcaggccgctgccgggtccatcggcgtcgtcattccccccagcatacccatgatcgtcttcggggcgctgaccggggcgtccatcggcaaactcttcgctggcggcgtcatgcccgggctgctcatgggcatcacgctctcggcatggtgcgtccatgaagggctgcgttccgggcgagagacacgccgcttcgaacccgcggccgtgtggcccgccctgctgcgtgccggatggtcgctcggagcccccgccatcatcctcggcggcatcatctcaggcgtatgcaccgccacggaagccgcagccgtggctgtggtgtacgcctttctggtgggcctcttcgctcaccgcgaactcgaccttcgccgcctgcccgccctgcttctggatgccgctgtcacttccggcgtcgtcatgagcatcatcgccgcagcctccctcttcggatgggtgatggccatcgaacgcatccccgccgcactggcggacgccatccttgccgtaggcggagagggatggatgctgctgcttgccgtcaacatcctgcttcttctggccggaacgatgctggagaccactgccgccctcatcctgctcgttcccgtgcttgtgcagcttctgccacgcatgggcatcgacctcatccatctgggcgtgatcgtggtgatgaacctctccatcggcatgctcaccccgcccctcggtgtctgcctcatggtctcgtgcggcatcgcacgtgtgcccctcgccaccctcgcccgtgccgtcctgcctttgctcgcggtgctggtggtcgacctcatgctcgtcacctacatcccgtggttcgtggcggcgttcagcaccgacatcatcgccccctga

SEQ ID NO: 56242 - protein, 426 aa, Desulfovibrio vulgaris subsp. vulgaris str. Hildenborough
MTALVLFGMLGLLFACNAPIMLAVGASAFAALLIKGGMDPMVAVQRLYAGADSFPLLAVPLFMTAGQLMSAGGISQRIVRLADTLVGHLPGGLAVVSVVSSMFFAGVSGSAAADTAAVGSILIPSMVARGYSPAFAGAVQAAAGSIGVVIPPSIPMIVFGALTGASIGKLFAGGVMPGLLMGITLSAWCVHEGLRSGRETRRFEPAAVWPALLRAGWSLGAPAIILGGIISGVCTATEAAAVAVVYAFLVGLFAHRELDLRRLPALLLDAAVTSGVVMSIIAAASLFGWVMAIERIPAALADAILAVGGEGWMLLLAVNILLLLAGTMLETTAALILLVPVLVQLLPRMGIDLIHLGVIVVMNLSIGMLTPPLGVCLMVSCGIARVPLATLARAVLPLLAVLVVDLMLVTYIPWFVAAFSTDIIAP

SEQ ID NO: 56243 - DNA, 1284 bp, Desulfovibrio vulgaris subsp. vulgaris str. Hildenborough
  CDS (1)..(1284)
atgaccatcctccttttcggactgttcgcagtcatgatgttcatcggcgtgcctctggccacggccatgggtctatccgccacggtggccatcgccgcagccaagctcggcctgctgtccgtgcccatcagcgtatacacgggcgtggccaagtatcccctgctggccattccgatgttcatcttcgctggcatggtgttcgagcgatccggcgtggccctgcggctcgtcaatttcaccgtcgctctcgtgggtccgctgcgcgggggtctggccatcgcgtccatcatggtctgcatggttctgggcggcatttccggctccggacccgccgacgctgcggccgtggccatggtcatgataccggggatggcggccgcgggataccccaaggcattctccgctggcctcatcgccgccgcggggtcgacggccatcctcatcccgccgtcaatcgccttcatcctctacagcgtgctcgtgccgcaggcgtccgtaccggccctgttcgcggcgggcctcatcccgggctttctggcgggcatagctctcatcatcccggcgtgggccctgtccgtgcggcacggcttcggcctcgttggcgacgacgcgtcctgcggaagcatcctcatcgccttcaaggaagccatctgggggcttctcgcgccagtcatcatcctcggcggcatccggtccggctacttcacgccgaccgaggccgccgtggccgccgtgttctacgggctgttcgtgggcttcttcgtgtaccgcacgctgaccctgcgtggcatctacgaactgcttgtggagtcggcagaagtttcggccgtggtgatgatgatcatcgcgctgtcctcggtcttcgcgtgggcaggcagcacgctgggcgccttcgaggccatgggcaatgcgctcatcggcatctcgaccagcgagacgatgacgcttctggccgtggttctggtgctgatcatcgccggaatgttccttgacggcgtgtccatcctgttcatcttcataccgattctgctgccggtgatgacccatttcggctggaacgccgtgtggttcggcgtgatcatgaccatgtgtctggccattggccagttcacgccgcccctggcgctgaatctcatggtcacgacccgcatcgcggacatcggcatagaggagaccgtgccatgggtgctctggttcgtgcttgccatgaccatcgccatgttgctggtggttttcgtgccgcagttggccaccctggttcccggtcatctaggatatctctga

SEQ ID NO: 56244 - protein, 427 aa, Desulfovibrio vulgaris subsp. vulgaris str. Hildenborough
MTILLFGLFAVMMFIGVPLATAMGLSATVAIAAAKLGLLSVPISVYTGVAKYPLLAIPMFIFAGMVFERSGVALRLVNFTVALVGPLRGGLAIASIMVCMVLGGISGSGPADAAAVAMVMIPGMAAAGYPKAFSAGLIAAAGSTAILIPPSIAFILYSVLVPQASVPALFAAGLIPGFLAGIALIIPAWALSVRHGFGLVGDDASCGSILIAFKEAIWGLLAPVIILGGIRSGYFTPTEAAVAAVFYGLFVGFFVYRTLTLRGIYELLVESAEVSAVVMMIIALSSVFAWAGSTLGAFEAMGNALIGISTSETMTLLAVVLVLIIAGMFLDGVSILFIFIPILLPVMTHFGWNAVWFGVIMTMCLAIGQFTPPLALNLMVTTRIADIGIEETVPWVLWFVLAMTIAMLLVVFVPQLATLVPGHLGYL

SEQ ID NO: 56245 - DNA, 1776 bp, Desulfovibrio vulgaris subsp. vulgaris str. Hildenborough
  CDS (1)..(1776)
atgctcgccatcatcttcatcatcaccttccagaccctgtaccgctacatcggcgtacacatgcacgaaggggcgtctgccgccatctggaccgaagagatggcccgcttcatcttcatctggatatcctacctcgccctgccggttgccatccgcaaccggtcgagcatccgggtggacatcatctacgaccgcctgcccaagcgttttcaggaaatgtcgtgggtcgtggtcgacctgtgcttcctcgtgctggcaggcaccgtgctgtggcagtcgctcgacctcatcaagatgcagatcgagtttccgcagacgacccctgccctccagatttcctactacatcccctatctggtgctgcccgtgagcttcggtctcatggcgctccgcctcgtcgaagaccttttcgcacaggcccgcgtctgcggcctcaaggacaccctgctcgcgctggccgcctgtgcggccctcgccgcccccgtaatgctggccgaagacctcgagcctctgcccgtcctcttcggttacttcgccatcttcctcgccgtgggcgtgcccatcgccatcggcctcggccttgcagcactggcgaccatcatcgccgccgggaccctgcccatcgaatacatcgcgcaggtggccttcacctccatcgacagcttccccatcatggccatccccttcttcatcgctgccggggtgttcatgggcgcgggcggtctctcgcgcaggcttctcactcttgccgacgagatgctgggttcgctgcatggcggcatggccctcgccaccatcggcacctgcatgttcttcgccgccatcagcgggtccggccccgccaccgtcgctgccatcgggtcgctcaccatccccgccatggtcgagcgcggctacgacaagtacttctccgccgcagtggtggcagccgccggtgccatcggcgtcatgattccccccagcaaccccttcgtggtctacggcgtctcggcgcaggtctccatcgggaagctctttctgggcggcatcgtgcccggagtgctcaccggtctggccctcatggtctacagctactggtactccaagaagcgcggctggaagggcgaagtgcgcgtgcgcaacctcaggaccttcaccagggccctgtgggacgccaagtgggccctcatggttccggtcatcgtcctcggcggcatctacggcggcatcatgacccccaccgaagccgcagcgctggccgccttctacggactgttcgtgggctgcttcatccaccgcgaactcaactgcggcagcctctacgactgcatcgtcgaagcagcaggcacctcggccgtcgtcatcgtgctcatggccatggccaccatcttcggcaacatcatgaccatcgaagaggtgcccaccgccatcgccaccgcgatgctcaacctcaccgagaacaagatagccatcctgatgctcatcaacgtgctgctcatcgtcatcggcacgttcatggaagcactggcggccatcgtcatcctcacccccatcctgctgcccatcgtgctgaaggtgggtgtcgaccccgtgcacttcggcgtcatcatggtggtcaacctcgccatcggcttcgtgcccccgcccgtgggcgtgaacctcttcgtcgccagcggcgtggcccacgccaagatagagcacctctccaaggtggtcatgccgctcatcgccatcatgataggcgtgctgctgctcatcacctacgttccggccctcccgatgttcctcgcggagtag

SEQ ID NO: 56246 - protein, 591 aa, Desulfovibrio vulgaris subsp. vulgaris str. Hildenborough
MLAIIFIITFQTLYRYIGVHMHEGASAAIWTEEMARFIFIWISYLALPVAIRNRSSIRVDIIYDRLPKRFQEMSWVVVDLCFLVLAGTVLWQSLDLIKMQIEFPQTTPALQISYYIPYLVLPVSFGLMALRLVEDLFAQARVCGLKDTLLALAACAALAAPVMLAEDLEPLPVLFGYFAIFLAVGVPIAIGLGLAALATIIAAGTLPIEYIAQVAFTSIDSFPIMAIPFFIAAGVFMGAGGLSRRLLTLADEMLGSLHGGMALATIGTCMFFAAISGSGPATVAAIGSLTIPAMVERGYDKYFSAAVVAAAGAIGVMIPPSNPFVVYGVSAQVSIGKLFLGGIVPGVLTGLALMVYSYWYSKKRGWKGEVRVRNLRTFTRALWDAKWALMVPVIVLGGIYGGIMTPTEAAALAAFYGLFVGCFIHRELNCGSLYDCIVEAAGTSAVVIVLMAMATIFGNIMTIEEVPTAIATAMLNLTENKIAILMLINVLLIVIGTFMEALAAIVILTPILLPIVLKVGVDPVHFGVIMVVNLAIGFVPPPVGVNLFVASGVAHAKIEHLSKVVMPLIAIMIGVLLLITYVPALPMFLAE

SEQ ID NO: 56247 - DNA, 1293 bp, Erwinia carotovora subsp. atroseptica SCRI1043
  CDS (1)..(1293)
atggatgcatttattcttgttgccacgctggcagtgctgttggcggtcggcgttcccgtcgcctatgcggtagggttgagcgcgattgttggcgccttctggatcgatttaccgcttgaagcggttatgattcagattactaatggcgtgaacaaattttcgctgctggcgattcccttctttattctggctggggccattatggccgaaggcggcatcgctcgtcgtctggtcagcttcgcgtacatctttgtcggctttattcgcggcggcttatcgctggttaacatcgttgcatcgacatttttcggcgcgatatccggctcttccgtcgcagacacggcctcaatcggttcggtgatgatcccggaaatggagaagaaaggttacccacgcgacttctccgccgccgtcaccgccagcggttccgtgcaggccattctgacaccgccgagccacaactccgtgatctactcgctggcaaccggcggcacggtttccattgcctcactgtttatcgcagggatcctgcccggtttactgctcagcctgaccctgatggtgatgtgtgtcggttttgcacatcggcgcggttacccgaaaggcgaacgtgtaccgttccgtcaggcgctaaaaatctttgtcgatacactgtgggggctgatgaccgtcgtcatcatcatgggggggattctgtccggtatttttaccgcgaccgagtctgcggccatcgcctgcctgtggtccttcttcgtgaccatgtttatctataaagattataaatggtcagaactgcccaagctgatgtaccgcacggtaaaaaccgtcacgatcgtaatgatcctgatcggcttcgccgccgcgttcggtgccatcatgacctacatgcagttgccgagccgcattaccgaattcttcacctccatttcggataacaagtacgtcatcctgatgtggattaacatcatgctgctgctggtcggtacgctgatggacatggcaccgctgatcctgattctgacccccgttctgctgcctgtcgccctctcacttggcatcgatccggtccatttcggcatgataatgctggtgaacctcgggataggtttgattacgccaccagtagggtcggtacttttcgtcgccagtgcggtgagtaagcagaagatagaacaagtggttaaagcaatgctgcccttctactgcgggctgttcttcgtgctgatgctagtcacctatattccggccatctcgctctggctgcctaaattctttggcgtccatacgggttaa

SEQ ID NO: 56248 - protein, 430 aa, Erwinia carotovora subsp. atroseptica SCRI1043
MDAFILVATLAVLLAVGVPVAYAVGLSAIVGAFWIDLPLEAVMIQITNGVNKFSLLAIPFFILAGAIMAEGGIARRLVSFAYIFVGFIRGGLSLVNIVASTFFGAISGSSVADTASIGSVMIPEMEKKGYPRDFSAAVTASGSVQAILTPPSHNSVIYSLATGGTVSIASLFIAGILPGLLLSLTLMVMCVGFAHRRGYPKGERVPFRQALKIFVDTLWGLMTVVIIMGGILSGIFTATESAAIACLWSFFVTMFIYKDYKWSELPKLMYRTVKTVTIVMILIGFAAAFGAIMTYMQLPSRITEFFTSISDNKYVILMWINIMLLLVGTLMDMAPLILILTPVLLPVALSLGIDPVHFGMIMLVNLGIGLITPPVGSVLFVASAVSKQKIEQVVKAMLPFYCGLFFVLMLVTYIPAISLWLPKFFGVHTG

SEQ ID NO: 56249 - DNA, 1263 bp, Desulfotalea psychrophila LSv54
  CDS (1)..(1263)
atgaccattgccaaaataataactcttgggctcgcactgctgggcacccctctctttctggttattgccgcccttgccctcatctctttccagtcggtgggcattgacctctcggtggtcatcattgagatgtcacgccttgctgacaccccaatgctggtctccctgcccctctttatctttgccggcagcctcctctcggagagcggagcccccaagagaatgctcaccttttcccgggtttttctcggctggatgccgggtggcatggcagttatcaccctggtggtctgtgccatcttcaccgcatttaccggggcctcaggagttaccatttttgcccttggcggcctgctcttaccggcactgctagaagacggctacgaagaccgtttctccacgggactgataacctcatcgggaagcctcggcctgctctttccaccgagcctgcccctgatcctctacggcgttatatctggatcccggattgatcatctctttctggcagggattctcccaggcctggtaatgctcctcctcctcattgcttactccattgccaagagccccaaacagaaagaacgcgttcgttataacggcaaggaaaagctggctggcttgaaggaaattggctgggagttgcccctacccatcatcattttgggtggcatttacggcggtttttttgtggcgggtgaagcggctgcgattacagcctgctatgtactggtggtcgaggtatttattctccgggatatttctctcaggaaacttcctgcaattatggcccagtccatggtgcttttcgggggcatcctcgtcatcctggccgcctccatggcttcaacaaactttttggtggatcaggaggtaccggcacggctctttgaaacaatcagcaactatattgattcgaagtacaccttccttctcctcctcaacatcttcctcctgatcgttggggcaatgctcgatattttttctgccctggtactggtggtaccgctgatcctgcccattgccacggcatatcagatagacccaattcacttaggaattatctttcttaccaacctgcagataggctattgcaccccacctgtgggtctcaacctctttctcgcctcataccgtttcaacaaacccattactgagctttatcgagccaccctgccctaccttggacttctgctcatcaccctggcaatcatcacctatataccatggttgagtacggttttaatatcgatctggggctaa

SEQ ID NO: 56250 - protein, 420 aa, Desulfotalea psychrophila LSv54
MTIAKIITLGLALLGTPLFLVIAALALISFQSVGIDLSVVIIEMSRLADTPMLVSLPLFIFAGSLLSESGAPKRMLTFSRVFLGWMPGGMAVITLVVCAIFTAFTGASGVTIFALGGLLLPALLEDGYEDRFSTGLITSSGSLGLLFPPSLPLILYGVISGSRIDHLFLAGILPGLVMLLLLIAYSIAKSPKQKERVRYNGKEKLAGLKEIGWELPLPIIILGGIYGGFFVAGEAAAITACYVLVVEVFILRDISLRKLPAIMAQSMVLFGGILVILAASMASTNFLVDQEVPARLFETISNYIDSKYTFLLLLNIFLLIVGAMLDIFSALVLVVPLILPIATAYQIDPIHLGIIFLTNLQIGYCTPPVGLNLFLASYRFNKPITELYRATLPYLGLLLITLAIITYIPWLSTVLISIWG

SEQ ID NO: 56251 - DNA, 1305 bp, Desulfotalea psychrophila LSv54
  CDS (1)..(1305)
atggaaatcatagcaatttctcttattgccctcgccgcacttgtggtcctgctcagttttggcgttccgctaccatactgttttggtggtgccctgatgtccatggttatcctgggtgatattcccatggaaggcaccatggtctggggcttttcacagctttctaatccagttcttctctgcatacctctctttgtctttgctggtaccatcatgagtgagagtggtattgcggccagcttgctggattttgtaaatatatttgtaggtagaatacggggtggacttggggtggttgcctcggtgagttgtgctattattggggcaatttccggaagtggcctgaccggtgttgcggcaacgggtcctctgttgattccagccatggccgccaagggttacccccgtggatatgccacagcccttgtttcaaactcctctgttcttggtctgctcatcccgcccagtgttaccatgatcatctatggttgggtaacggatacctcaattcttgcctgtttcctggcaaccctgggaccaggcattgccattaccgttcttctctcagcagtgaatctgtatatggccagaagttttcccctggagcttgagcctcccgctaccaaaaaagagattattaaggaaggtatcagctgtacatcccgggcaattcccgccctgatgatgccacttattattcttggtggtatctacggtggcattatgactcccaccgaggccgcggctgttgcggtgatctatgctattcccgttggctttttgatttataagggtttgactgtcgagacattcctcaaggctgccaagagttctgccaccgctgttggtgccattatgatcatgattgtcttcagtcttatgctcagtcagatctttgttatggaagatgtgcctcaggccctggtatcgggaattttttctatcaccgaaaataaggttttactgttaatcctcatcaactttctcctctttttcgttggcatgattgttaatgatattacagcaatcattcttatagccccccttctccttcccctgatggaggcgattggtgtttctcctgttcagtttgccgcgatcatgggcgtgaatacgggaatggggcggggtaaccccaccctatgcatctatcctctaccttgggatcgaataggcaaggggcagttttctgaagttattagaccggcaatggtattgcttctctttgcctatgtgccggtagtctttttgacctccctgtggccagatttgtctctcttttttccaagactcttcggctattaa

SEQ ID NO: 56252 - protein, 434 aa, Desulfotalea psychrophila LSv54
MEIIAISLIALAALVVLLSFGVPLPYCFGGALMSMVILGDIPMEGTMVWGFSQLSNPVLLCIPLFVFAGTIMSESGIAASLLDFVNIFVGRIRGGLGVVASVSCAIIGAISGSGLTGVAATGPLLIPAMAAKGYPRGYATALVSNSSVLGLLIPPSVTMIIYGWVTDTSILACFLATLGPGIAITVLLSAVNLYMARSFPLELEPPATKKEIIKEGISCTSRAIPALMMPLIILGGIYGGIMTPTEAAAVAVIYAIPVGFLIYKGLTVETFLKAAKSSATAVGAIMIMIVFSLMLSQIFVMEDVPQALVSGIFSITENKVLLLILINFLLFFVGMIVNDITAIILIAPLLLPLMEAIGVSPVQFAAIMGVNTGMGRGNPTLCIYPLPWDRIGKGQFSEVIRPAMVLLLFAYVPVVFLTSLWPDLSLFFPRLFGY

SEQ ID NO: 56253 - DNA, 1305 bp, Desulfotalea psychrophila LSv54
  CDS (1)..(1305)
atggaaatcatagcaatttctcttattgccctcgcggcacttgttgtcctgctcagttttggtgtcccgctaccatactgttttggtggcgccctgatgtccatggttatcctgggtgatattcccatggaaggcaccatggtctggggcttttcacagctttctaatcctgtccttctctgcatacctctctttgtctttgccggtaccatcatgagtgagagtggtattgccgctagtctgctggattttgtaaatatatttgtaggtagaatacggggtggacttggggttgttgcctcggtgagttgtgccattattggggcaatttccggaagtggactgaccggtgttgcggcaacggggcctctgttgattccagccatggctgccaagggttatccccgtggatatgccaccgcccttgtctcaaactcctctgttcttggtctactcatcccgcccagtgtaaccatgattatctatggttgggtgacggatacctccatccttgcctgttttttggcaaccctggggcctggtattgccattaccattcttctctcggcggtgaatctgtacatggccagaagttttcctctggagcttgagcctcccgctaccaaaaagcagatcatcaaagagggtattagctgcacctcccgggcaattccagccctgatgatgccgctcattatccttggcggtatctacggcggtatcatgaccccgactgaagctgctgccgttgcggtgatttatgcgattcctgttggcttcctgatatataagggactgactgtcgatacatttttgaaggctgctaagagttctgccaccgctgtcggtgccatcatgatcatgattgtcttcagtcttatgctcagtcagatctttgtgatggaagatgtacctcaggccctggtatcgggaattttttcgatcaccgaaaataaggtcttactcttaattctgatcaacttcctcctcttctttgttgggatgattgttaatgatatcacggcaattattcttatcgctcccctcctcctgcctctgatggaggcgattggtgtttctcccgttcagtttgcagcgatcatgggcgtgaatacggcaatgggcggtgtaaccccaccctatgcatctatcctctatctcggtatccgcataggcaaggtgcagttttctgaggttatcaggccagcaatggtattgcttctctttgcctatgtgccggttgtctttttaacctctctatggccagatctgtctctctttttcccaagactctttggctattaa

SEQ ID NO: 56254 - protein, 434 aa, Desulfotalea psychrophila LSv54
MEIIAISLIALAALVVLLSFGVPLPYCFGGALMSMVILGDIPMEGTMVWGFSQLSNPVLLCIPLFVFAGTIMSESGIAASLLDFVNIFVGRIRGGLGVVASVSCAIIGAISGSGLTGVAATGPLLIPAMAAKGYPRGYATALVSNSSVLGLLIPPSVTMIIYGWVTDTSILACFLATLGPGIAITILLSAVNLYMARSFPLELEPPATKKQIIKEGISCTSRAIPALMMPLIILGGIYGGIMTPTEAAAVAVIYAIPVGFLIYKGLTVDTFLKAAKSSATAVGAIMIMIVFSLMLSQIFVMEDVPQALVSGIFSITENKVLLLILINFLLFFVGMIVNDITAIILIAPLLLPLMEAIGVSPVQFAAIMGVNTAMGGVTPPYASILYLGIRIGKVQFSEVIRPAMVLLLFAYVPVVFLTSLWPDLSLFFPRLFGY

SEQ ID NO: 56255 - DNA, 1287 bp, Desulfotalea psychrophila LSv54
  CDS (1)..(1287)
atgagtatgtctgtaacagctgttttattttgctcttttgcgggattactgcttttgggagcacccattaccgtggcgcttggcgtttctgccatggtgtcatttatggtcgtggggcaggatcttggaaccctcattcaaattgcctttacctcggtaaactcctttcctattatggctctgcccgcctttgttttggccggggccttgatggataaggctggtgtttccaagagacttgtcaccgtggctgaaaagatggtaggtcccattcccggtggtcttgctgtttctactgccctcgcctgtgtcttctttggcgcaatttcaggttccggccctgcgacaactgcagcggttggcatgttgatgattcctgccatggtcaataagggttatgataagggatatgctgcggcagctactgctacagcgggtggtgtaggtattattattcctccaagtattccaatggttatctatggtgtagcctctcaggaatctatcaccagaatgtttcttggtggtgttgttcccggtttgatcatcagtcttggcctctgtgcaatgcatctctggatgtgtcgtaagatgaagcctgctgaaggggatgaggcgtggtcagctcaagagctgattaaatctgttaaggatggcttttgggctatcatggccccggttgttatcctcggtggtatctatactggtatctttacccctacagaggctgctatcgtagcaatcttctatgtgctctttgtcggtatctttatttatcgtgaacttaccttcaagtctgtgcagaaatgtctcgagaccacctcttggattaccggtcgtgttcttgttatcatgtttaccgcctatgcctttggtcgtttgctcattcagtaccgtattcccaatcagatcgtagagtggcttttgaccatgacaaccaatgtaaatctggtttggatatttgttcttatccttctccttttctttggtatgttcatggagaccctggccatcatcctcttggtaactcctgtactgcttcctgtaatgacagcatttggggttgacccaattcactttggtgttgttctggtttgttgttgtggtgttggtttctctacaccgcctctgggggaaaatatatttattgcctcgggtattgccgatgtctcaattgagaaaatttccgtgaaggccctgcccttctgtgcggttaccatcggtgtgattctgttgatcaccttctgcccgcaaatcgtactgtggttgcctaatttgttgatgtag

SEQ ID NO: 56256 - protein, 428 aa, Desulfotalea psychrophila LSv54
MSMSVTAVLFCSFAGLLLLGAPITVALGVSAMVSFMVVGQDLGTLIQIAFTSVNSFPIMALPAFVLAGALMDKAGVSKRLVTVAEKMVGPIPGGLAVSTALACVFFGAISGSGPATTAAVGMLMIPAMVNKGYDKGYAAAATATAGGVGIIIPPSIPMVIYGVASQESITRMFLGGVVPGLIISLGLCAMHLWMCRKMKPAEGDEAWSAQELIKSVKDGFWAIMAPVVILGGIYTGIFTPTEAAIVAIFYVLFVGIFIYRELTFKSVQKCLETTSWITGRVLVIMFTAYAFGRLLIQYRIPNQIVEWLLTMTTNVNLVWIFVLILLLFFGMFMETLAIILLVTPVLLPVMTAFGVDPIHFGVVLVCCCGVGFSTPPLGENIFIASGIADVSIEKISVKALPFCAVTIGVILLITFCPQIVLWLPNLLM

SEQ ID NO: 56257 - DNA, 1287 bp, Desulfotalea psychrophila LSv54
  CDS (1)..(1287)
atgacactttttatctttgtgtgtgccttcttattaatcggtttaaacacgcctatttttatctcccttgcctgtacgacctttgttgtttttgctctttttacgaatatgccattagggattctcccgcaacgaatgtttgcgggtgtcgataatatggcgctcattgccattccatactttatctttgctgcccaaataatgagcaaaggtggcctcaccgtacgtttgatcaaatttgcccaaactcttgtagggcaccttcccggtggacttggcatttgtgccgttctaagttgtctcttttttgcggcaatatcgggttctacggcttctaccgttgtggctgtcggttctataatctatcctgccctactcaaagctggttatggcgagaaattttctcttggactagtgacctgttcagcacttttaggaatggttattccgcccagtaatgccatgattatctatggctctatctccagggtttcgatcggggctctttttctatctggatttggggcagggatggtctttgtttgtgtctattcagcatggtgtgtctaccatgcttacaaaacaaaggttcccttacaacaacgtgccacactaagagaaattactctagctgcaaaagatgcaggttggtcccttggctttcctctagttatccttggcgggatatatagcggtgtcttcacttccacagaatctgcggtggtctctgtagcttatgctattcttgttgcgatggtcatctacagagaacttaaaccccaagaaatctgggtaattgcatgcgaaacaggacttgcctcagcaaaaatcctcatcatggtggcggctgcaactttgttctcctggcttttgaccgtggaaaatattacgactcaactcattgaaccgataaaggcacttgaccttccatggtggtcaatacttttcatcaacaacgtcattatgctatttgccggaatgtttatagacgtcttttcaaacattttaatattttgcccacttatgacgccacttattcaagaagcgggaatcagcactcttcattttggccttattgcttcagttaatgcggatatgggtaacatcacaccaccatttgggttaaacctttttatagcaagtggcgtatttggcgtaagctatttcacaatcgtccgagctgttttaccgtggctgtgccttgccctactttgtctaatgatcatcacctatgtgccacaaatatctctttggctgccaagtattatttaccctggatccttttag

SEQ ID NO: 56258 - protein, 428 aa, Desulfotalea psychrophila LSv54
MTLFIFVCAFLLIGLNTPIFISLACTTFVVFALFTNMPLGILPQRMFAGVDNMALIAIPYFIFAAQIMSKGGLTVRLIKFAQTLVGHLPGGLGICAVLSCLFFAAISGSTASTVVAVGSIIYPALLKAGYGEKFSLGLVTCSALLGMVIPPSNAMIIYGSISRVSIGALFLSGFGAGMVFVCVYSAWCVYHAYKTKVPLQQRATLREITLAAKDAGWSLGFPLVILGGIYSGVFTSTESAVVSVAYAILVAMVIYRELKPQEIWVIACETGLASAKILIMVAAATLFSWLLTVENITTQLIEPIKALDLPWWSILFINNVIMLFAGMFIDVFSNILIFCPLMTPLIQEAGISTLHFGLIASVNADMGNITPPFGLNLFIASGVFGVSYFTIVRAVLPWLCLALLCLMIITYVPQISLWLPSIIYPGSF

SEQ ID NO: 56259 - DNA, 1302 bp, Desulfotalea psychrophila LSv54
  CDS (1)..(1302)
atgtcagaaataacaatcccactttgcctactcggcctgctcttccttctgctaggtagcggtatctgggtggccttctccctattgggggtaggcataattggaatgatggtctttaccgatgcccccgttggcaatgtactggccaccacggtttggggagcgagcaatagctgggcgcttgcggccctccccctctttatctggatgggagaaattctctttcgttcaaagctatcggaaaatatgtttgagggtttagcaccctggctgacacacctgccaggacgcctattacacgtcaacatcttcggttgcggtatttttgccgcagtctccggatcatctgcggcaacggcagccaccatcggcaagatgtccatccctgagcttacccaacgaggttatccggagaagatgatcctcgggactctggccggttctgcaaccctgggactactcattccgccatcgatcatccttatcgtctacggtgttgccaccgaacaatccattgcccgactctttatcgccggccttttgcccggagtcctgttagtcactctctttgttggctatgtcatcatctggtcactactcaataaagagcaaattccgatggaagagaacaatctctcctttatggaaaaggtgcgcggcaccaagagactgatacctgttatcctgctgataggtggcgtcctcggctccatctacaccggcatcgcctctccgacagatgcggcggctgtaggcgttgtccttgccctccttctctccagggccactggttctctctgcaaagagacctttatagagggtttactcggggcaacccgcacctcgtgcatgatcgcctttattctggcaggtgctgcctttttaacagttgccatgggctttaccggcattccaaaatcactggccacctggatcggcaccatggacctctccccctatgcgctactgggagctctgacaatcttctttgttgtcctaggctgttttcttgatggaatttccgtagtggtgctcaccacctccgttatcatgcccatggttcaggcggcaggaatcgacccactatggtttggtatcttcgttgtcatcgtagtcgagatgtcacaaatcaccccgcctgttggttttaatctctttgttattcagggccttacgggaattaatatcctacgagtagcccatgccgccctgcccttcttcttgctcctgctcacagcacttgctattatcactgtcgtaccagaggtggtaaccctgctaccaaatatgatgggtagctaa

SEQ ID NO: 56260 - protein, 433 aa, Desulfotalea psychrophila LSv54
MSEITIPLCLLGLLFLLLGSGIWVAFSLLGVGIIGMMVFTDAPVGNVLATTVWGASNSWALAALPLFIWMGEILFRSKLSENMFEGLAPWLTHLPGRLLHVNIFGCGIFAAVSGSSAATAATIGKMSIPELTQRGYPEKMILGTLAGSATLGLLIPPSIILIVYGVATEQSIARLFIAGLLPGVLLVTLFVGYVIIWSLLNKEQIPMEENNLSFMEKVRGTKRLIPVILLIGGVLGSIYTGIASPTDAAAVGVVLALLLSRATGSLCKETFIEGLLGATRTSCMIAFILAGAAFLTVAMGFTGIPKSLATWIGTMDLSPYALLGALTIFFVVLGCFLDGISVVVLTTSVIMPMVQAAGIDPLWFGIFVVIVVEMSQITPPVGFNLFVIQGLTGINILRVAHAALPFFLLLLTALAIITVVPEVVTLLPNMMGS

SEQ ID NO: 56261 - DNA, 1281 bp, Desulfotalea psychrophila LSv54
  CDS (1)..(1281)
atggacttcactataatatctatctttgtttcattagcaatatttctccttgccagcgtacccatcggcattgctattggtatgagtgtcattgtgggcatgacctttggcgatatgctgccctatgaatttttgattcaaaagatggtgacatcattagatgtgtttcctcttatggcggtaccttttttcataatggcaggcgaagttatgcaaaagggaagcatggcgcaacgattactgaatgtgtctcgcgcattggtaggacatttaacaggtggtatggctcatatctccatactgacaagcatgttttacggttctctttctggatcagcccctgcaacggttgcggccgtcggtggaattatgattccggcgatggaaaaggagaattatagcaaatcttttgccacggccgttaatacggcggctggctgtttgggggttattattcctccaagtgtgccacttattatttacggtacaacagcaggtgtttctgttggtgatctttttattgcaggcgttattccgggcttgtttattggtcttgccctgatgctctgtagctatgttttagcaaaaaaatatggttttacaggttctgcgcagcaggcaactattggtgagattttaacggcggttttagcctctcttcccgccctgatggttcctattattgttttgggcggaatttatggtggttttacgacacctacggaagctggtgttattgcggttgtttacgcacttgttgttgaaggccttttcctgcggaccttaagtgtgagcaaagttgtggaggttttcaaatctacggcgctgacaacagcctctatttttcttgttgttgcaacggcgacagcccttgggcaaattttacttttttataaccttcctaaccaattagtagaaatattgagtaatatttcagacaatagatatgttcttattgcgataatactcttgtttttgattgtgatgggaacctttatggatgccctggcgaatattttaatccttacgccactgttattacctattgttaagatgctgggctttgatccgatacattttggtattatcatgattgttacctcctcgatgggttttcttactccacctgttggagtaaatctctttgttggctgtagtatctctaaattgtcaattgaacgtctcagtgttgccgttatgccatttcttttcaccatggttattgcattgcttattttgacttttgtgccacaaataaccctatggcttcctagtctgtag

SEQ ID NO: 56262 - protein, 426 aa, Desulfotalea psychrophila LSv54
MDFTIISIFVSLAIFLLASVPIGIAIGMSVIVGMTFGDMLPYEFLIQKMVTSLDVFPLMAVPFFIMAGEVMQKGSMAQRLLNVSRALVGHLTGGMAHISILTSMFYGSLSGSAPATVAAVGGIMIPAMEKENYSKSFATAVNTAAGCLGVIIPPSVPLIIYGTTAGVSVGDLFIAGVIPGLFIGLALMLCSYVLAKKYGFTGSAQQATIGEILTAVLASLPALMVPIIVLGGIYGGFTTPTEAGVIAVVYALVVEGLFLRTLSVSKVVEVFKSTALTTASIFLVVATATALGQILLFYNLPNQLVEILSNISDNRYVLIAIILLFLIVMGTFMDALANILILTPLLLPIVKMLGFDPIHFGIIMIVTSSMGFLTPPVGVNLFVGCSISKLSIERLSVAVMPFLFTMVIALLILTFVPQITLWLPSL

SEQ ID NO: 56263 - DNA, 1869 bp, Desulfotalea psychrophila LSv54
  CDS (1)..(1869)
atgtcttcagcgacaccaccacagatgccggcggccaataaaaattggatgcattggcttgatgataattttgaaaagccctttcttatcttgggaatgctctctatcattctcatcagtgtcttccaaacctcctaccgttatatcggcgtacctcttggtgctgacccgagtgctggtgtttggaccgaagaacttgcccgttttatctttatctggatctcttatctggcagttcccatagcgatcaagaatcgaagtaatattcgagttgatattgtttatgatcgccttcctccgcgtttgcaacggataagctgggttgtggttgatgtcttctttttgatcctcacttcagtaattttgtatatgggtatcaagcatatcggtatgcagatcagatatccacagactacagcagccttgcaaataccgtactatataccctatttgattctgcccattgcctttggcctgatgtctctgcgcctgcttcaggatcttttcaagcaggttaaggaaacgggtattcttgattcacttgttggtgtggggctctgtgctgctatctctttgcctataatcttatttagtggctttaacgtattgtcagtgctctttggctactttgccctctttttggtaattggtgtgcccattgccatcagtcttggccttgcagctcttgccaccgttgtggccaacggctctctccccattgagtatgtggcgcaggtgagttttacctccattgatagctttcccatcatggcaattccattttttattgctgccggtgtgttcatgggctgtggtgggctttcccgccgtctactggatcttgccgatgaacttctcggtgccctgcccggtggtctggcccttgcgaccattgcaacctgtatgttctttgccgcaatctctggttctggccctgcaaccgttgctgcaattggctccctgaccattcctgccatgatggcacgtggctatgataagtacttttcctgtgccgttgtggcaaccgccggtgcgatcggggtaatgattcctccatccaacccctttgtcgtctacggtgtttccgcccaggtatcggtaggtgatctctttattgccggtattgttcccggtcttcttaccggacttgccctgatggtttttagtttcttttattcgaagaagcgtggctggaagggtgaggtgaaagaacgtaattttaagacatttgctcgggcattttgggatgcaaagcttgccctgatggtaccggtgattgttctcggtggtatctacggtggtatcatgacccccaccgaagccgctgccgttgcagccttctacggtttggttgttggtatctttgtctaccgcgagctgaacatgaagaatctggctcctgcctttattgaggcctgttcaacctcggcgattgttattgtccttatggccatggccaagatttttggtaacgtcatgaccgtggagcaggtaccggctatgattgccgacttcattcttggcatgacttccaataaaattgttatcctgctcttgatcaacgttctgcttctggtcgttggtacctttatggaggccctggcagccattgttattttggtacccatcctcctgccgattgtcatgaaggtaggtgttgatccactgcattttggtatcatcatggtggtcaacctggccattggttttgttaccccgcctgttggggtcaacctctttgttgccgctggggttgctaatgttaagattgagcaggtctccaaggttgttattccatttttgggcgtcatgatattggtactgcttgctgtaacctttattccgcaactctccctcttcatgatctag

SEQ ID NO: 56264 - protein, 622 aa, Desulfotalea psychrophila LSv54
MSSATPPQMPAANKNWMHWLDDNFEKPFLILGMLSIILISVFQTSYRYIGVPLGADPSAGVWTEELARFIFIWISYLAVPIAIKNRSNIRVDIVYDRLPPRLQRISWVVVDVFFLILTSVILYMGIKHIGMQIRYPQTTAALQIPYYIPYLILPIAFGLMSLRLLQDLFKQVKETGILDSLVGVGLCAAISLPIILFSGFNVLSVLFGYFALFLVIGVPIAISLGLAALATVVANGSLPIEYVAQVSFTSIDSFPIMAIPFFIAAGVFMGCGGLSRRLLDLADELLGALPGGLALATIATCMFFAAISGSGPATVAAIGSLTIPAMMARGYDKYFSCAVVATAGAIGVMIPPSNPFVVYGVSAQVSVGDLFIAGIVPGLLTGLALMVFSFFYSKKRGWKGEVKERNFKTFARAFWDAKLALMVPVIVLGGIYGGIMTPTEAAAVAAFYGLVVGIFVYRELNMKNLAPAFIEACSTSAIVIVLMAMAKIFGNVMTVEQVPAMIADFILGMTSNKIVILLLINVLLLVVGTFMEALAAIVILVPILLPIVMKVGVDPLHFGIIMVVNLAIGFVTPPVGVNLFVAAGVANVKIEQVSKVVIPFLGVMILVLLAVTFIPQLSLFMI

SEQ ID NO: 56265 - DNA, 1278 bp, Mannheimia succiniciproducens MBEL55E
  CDS (1)..(1278)
atgacggtcgtaatttttcttgctgttttattaggtgcgattattttaggtattcctgtcgccttctcattgcttgtgtgcggtgtggcgttaatggttcacctggatttattcgattcgcaaattttagcccaacaaatcgttagcggtgcggacagtttctccctgatggcgattccgttctttattcttgccggcgagctgatgaatgaagggggcttatccaaacgaattattgatttaccgatgaagcttgtcggtcataaacgcggcggattaggcttcgttgccatccttgccgccatgattatggcgagtctttccggttctgcggtggcggatacggcagcggttgccgctatgttgttgccgatgatgaaaaccaccggttatccggaagcccgttccgccggcttaatcggtaccgcagggattattgcgccgattattccgccgtccattccttttatcgttttcggggtggccagcggcgtatctatcaccaaattattcatggccggtattttcccgggcattatgatgggtatttgcttaggcatgctttggtggtggcaggcaaaacgcttaaatttaatgaccttttccaaagccaccagacaagatctttgtatctcctttaaaaacagtatttgggcattgttattaccggttattatcatcggcggattccgtaccggtatctttactccgacggaagccggtgccgtggcgactttctatgctttggtcgtttcaatgtttatttatcgcgaattaaaattcaaagatctttataaagtgctgttggccgctgctaaaacaaccgcagtggtaatgttcttggttgccgccgccaacgttaccggttggttaatcaccgttgccgaattaccggccatgttaaccgagttactcgaacctttacttggtaatccgacagtcttattgcttgttgtgatgttagcggtatttgttatcggtatggtaatggacttaaccccgaccgtgttgatcttaaccccggtattaatgccgttaattgaagaagcgggaatcgacccggtatatttcggcgtactatttatcctaaatacatccatcggcttaattacaccgcctgtgggcaacgtattaaacgtgattacgggtgtgtctaaacttccgtttgaccaagcggcgaaaggcatcttcccgtatttaatcatgatgattttattgcttttattatttgtattcgttccttcacttattctcgttccattaagttggatgttgtaa

SEQ ID NO: 56266 - protein, 425 aa, Mannheimia succiniciproducens MBEL55E
MTVVIFLAVLLGAIILGIPVAFSLLVCGVALMVHLDLFDSQILAQQIVSGADSFSLMAIPFFILAGELMNEGGLSKRIIDLPMKLVGHKRGGLGFVAILAAMIMASLSGSAVADTAAVAAMLLPMMKTTGYPEARSAGLIGTAGIIAPIIPPSIPFIVFGVASGVSITKLFMAGIFPGIMMGICLGMLWWWQAKRLNLMTFSKATRQDLCISFKNSIWALLLPVIIIGGFRTGIFTPTEAGAVATFYALVVSMFIYRELKFKDLYKVLLAAAKTTAVVMFLVAAANVTGWLITVAELPAMLTELLEPLLGNPTVLLLVVMLAVFVIGMVMDLTPTVLILTPVLMPLIEEAGIDPVYFGVLFILNTSIGLITPPVGNVLNVITGVSKLPFDQAAKGIFPYLIMMILLLLLFVFVPSLILVPLSWML

SEQ ID NO: 56267 - DNA, 1293 bp, Mannheimia succiniciproducens MBEL55E
  CDS (1)..(1293)
atggacgtgatcattcctatttcaattttattgattctctttgttattggtacgccggttgcattttgtattttctgttctacgctgacttatttcttaatgagccatcaaccaatggttattttaattcaacgtttagcgggtggattagaaagtgtcacattgcttgcaataccattctttattatggccggtgtctttatgaaccatacagggattagtgagcggttattaaaattctgtgaagtacttaccggtcatatgaacggcggtttagcgcaagtaaacgttgcattaagtacattaatgggtggtttatccggttcaaatattgccgatgcggcaatgaactctaaattgcttgtaccacaaatggttgctcgtggttatagtgcatcattttcagcagcggtaactgcagcaggttcattaatcacacctattattccgcctggcattgcgatgattatttacggttatgtcaataatgtttctattggtcgcttattcttggccggtgtcgttccgggtacaatgctctgtattctaatgatgatcttagtgtcaatcatttctaaaaaacgaggctatttacctatccgtgaaaaacgtgcaagttgcaaagaagtcattgtttcggcaaaagatgccgtattagcacttttacttccgattatcattatcggcggcatccgtatgggggtatttacgcctacggaagctggtgcggtggcggttatttatgcgcttatccttggtatgtttatttaccgcaatatggatgctaagaaattatggttagcaacgcgtgaatcggcattaggtgcggcaaacgtactattaattatttgtgtcgccgttgcattttcaaaattcttaacttgggagcgtgttccacaggctcttgcgagttggatgacaacggtggtagatagtccaatagcatttttgatgctagtgaatgtcgcattattagtcttaggtatgtttttagaaggtaatgcgattatgatcgtattagccccgttgcttgccccgattgcacattcatacggtattgatccaatccattttggtattgtgtttatttttaatggtgcaatcggaacaattaccccgccattaggtacagtaatgtttaccacctgttcaattactgaagttccgattgagaaatttattaaagatgtgcttccattctggggcttacttttattagaacttgttcttttaacttatatcccgacaatcacaacatggttaccaaacttagtttatggcgtagcacaataa

SEQ ID NO: 56268 - protein, 430 aa, Mannheimia succiniciproducens MBEL55E
MDVIIPISILLILFVIGTPVAFCIFCSTLTYFLMSHQPMVILIQRLAGGLESVTLLAIPFFIMAGVFMNHTGISERLLKFCEVLTGHMNGGLAQVNVALSTLMGGLSGSNIADAAMNSKLLVPQMVARGYSASFSAAVTAAGSLITPIIPPGIAMIIYGYVNNVSIGRLFLAGVVPGTMLCILMMILVSIISKKRGYLPIREKRASCKEVIVSAKDAVLALLLPIIIIGGIRMGVFTPTEAGAVAVIYALILGMFIYRNMDAKKLWLATRESALGAANVLLIICVAVAFSKFLTWERVPQALASWMTTVVDSPIAFLMLVNVALLVLGMFLEGNAIMIVLAPLLAPIAHSYGIDPIHFGIVFIFNGAIGTITPPLGTVMFTTCSITEVPIEKFIKDVLPFWGLLLLELVLLTYIPTITTWLPNLVYGVAQ

SEQ ID NO: 56269 - DNA, 1302 bp, Mannheimia succiniciproducens MBEL55E
  CDS (1)..(1302)
atggaatggacaacaattatcactttagccggtagttttttcttgttactggctattggtgtaccaatttcttttgccattggcgtgtcatcattaattaccattatgctggcaattccttttgatgcggccattgcggtaatttcgcaaaaaatggcctccggtttagacagtttctcgttgcttgctattcccttctttattctggcgggtaatattatgaaccgaggcggtatcgcattacgtcttattgaatttgccaaagtattgggcggacgcttacccggttctttagcccatgtaaatgtgttggccaacatgatgttcggctcaatttccggttcggcggtcgcggcggcggctgcagtgggcgggacaatggctccgctgcaaaagaaagaaggttatgatccggcattttccgccgcggtaaatattacctcttcaccgacaggcttattgattcccccgagtaataccttcatcgtttactctctgatttccggcggtacctcaatcggcgcattattcttagcgggttacattccggggattttaatgggtttagggatcatgatcatcgcctactttattgcgaagaaaaataaatatcccgtttcaccgaaaccgacctttaaagaagtgactcatcgcactttagatgcattaccgagtttaggactagtcgtcgtcatcatcggcggtatcattgccggcatttttaccgctacggaagcttccgccattgccgttgtttatactctgattctttccatggttatctataaggaaatttcactgaaagaattaccgcagattatccttgatgccatgaccacaacttcaattgtattgttattaatcggcgcatccatgggtatgtcctgggcgatggcgaatgcggatattccttataccattagtgatgccttattaagcgtttcggaaaatcctattgttattttattaattatcaacttaacgttattaatcgtgggtacctttatggatatgacacccgcattattaattttcaccccgatttttttaccaatcgtaaccgaattaggtatggatccggtacatttcggtattttaatggcatttaacttatcaatcggtatctgcacgccgcctgtgggttcaaccctgttcgtcggctgttccgtagccggcgtaaaaattgataaagtcattaaaccgttgcttcctttctatgcaatactgattttaaccctattccttgtaacattcctgccgcaattaagcttatggttgccacaaacattactcggctattga

SEQ ID NO: 56270 - protein, 433 aa, Mannheimia succiniciproducens MBEL55E
MEWTTIITLAGSFFLLLAIGVPISFAIGVSSLITIMLAIPFDAAIAVISQKMASGLDSFSLLAIPFFILAGNIMNRGGIALRLIEFAKVLGGRLPGSLAHVNVLANMMFGSISGSAVAAAAAVGGTMAPLQKKEGYDPAFSAAVNITSSPTGLLIPPSNTFIVYSLISGGTSIGALFLAGYIPGILMGLGIMIIAYFIAKKNKYPVSPKPTFKEVTHRTLDALPSLGLVVVIIGGIIAGIFTATEASAIAVVYTLILSMVIYKEISLKELPQIILDAMTTTSIVLLLIGASMGMSWAMANADIPYTISDALLSVSENPIVILLIINLTLLIVGTFMDMTPALLIFTPIFLPIVTELGMDPVHFGILMAFNLSIGICTPPVGSTLFVGCSVAGVKIDKVIKPLLPFYAILILTLFLVTFLPQLSLWLPQTLLGY

SEQ ID NO: 56271 - DNA, 1317 bp, Mannheimia succiniciproducens MBEL55E
  CDS (1)..(1317)
atggatgcgttattatcttgggaatggtttgttcccgccgtgatgtttttctctttctttgtattggtgtttgtgggcgtgccgatttctttttctatcgggattgctaccttggccgccgccgcattcatgttaccttttgagaccaccttaattgtctccggacaaaaaatcgccaccggattagacagtttttccttgcttgccattccgttttttattctcgccggctcactgatgaatagcggcgggattgccacccggttaattaacttctctcaaattttagtcggccgtattcccggctccctgggacataccaatgtgatggcgaatatgatgttcggctcgatttccgggtcggccgtagccgctgccgccgccgtaggcggtactatggcgccgttacaggctaaagccggctacgacccggcttattccgccgccattaatgtctcttcctgtatctccggattattgattccgccctccaatgtcatgattgtctatgcattaaccgccggcggcatttccgttgccaccctctttatggccggttatgtgcccggtattttaatgggcttcgggattatggcgatgaattatatcattgcaagaaaacgccgttatccggtatcggataaaccgacctttgccgaagtggttaaatattccttagatgccgttccaagcctattaatggtggtggtcgtcatgggcgggattttaggcggcgtctttaccgctaccgaagcctccgccattgccgtagtctatacctttatactttccgtcattatttatcgtgaaattaagttaactcaattgccgaaaatcattttggacgccattgtcaccacctctatcgtgctgttcctcatcggtgtctccgtcgccatgtcctgggcgatgactaacgccgatattccttatatggttaacgagttattaatcagcgtatccgataatctgattgtgattttattaatcatcaatatgttattattagttatcggtatctttatggatatgactcccgccgtcttaatctttacccctatctttttacctattgtcaaagaattggggatggaccccgtccatttcggcattatgatgattttcaatctctgtatcggtttatgtaccccgcctgtcggtagcgcattatttgtcggctgctccgtttccggtgtaaaactacaagatttaatcaaacctatgttgcctttctttgccgtgttggtcatcaccttattgatggtcacctatatcccgcaattgtcgttatttttaccgggattgtttgagttataa

SEQ ID NO: 56272 - protein, 438 aa, Mannheimia succiniciproducens MBEL55E
MDALLSWEWFVPAVMFFSFFVLVFVGVPISFSIGIATLAAAAFMLPFETTLIVSGQKIATGLDSFSLLAIPFFILAGSLMNSGGIATRLINFSQILVGRIPGSLGHTNVMANMMFGSISGSAVAAAAAVGGTMAPLQAKAGYDPAYSAAINVSSCISGLLIPPSNVMIVYALTAGGISVATLFMAGYVPGILMGFGIMAMNYIIARKRRYPVSDKPTFAEVVKYSLDAVPSLLMVVVVMGGILGGVFTATEASAIAVVYTFILSVIIYREIKLTQLPKIILDAIVTTSIVLFLIGVSVAMSWAMTNADIPYMVNELLISVSDNLIVILLIINMLLLVIGIFMDMTPAVLIFTPIFLPIVKELGMDPVHFGIMMIFNLCIGLCTPPVGSALFVGCSVSGVKLQDLIKPMLPFFAVLVITLLMVTYIPQLSLFLPGLFEL

SEQ ID NO: 56273 - DNA, 1296 bp, Bacillus licheniformis ATCC 14580
  CDS (1)..(1296)
atggccatagcagccggtctcattttatcggcggtattcttcatattgttgtttctcggcgttccgatttctgtaagtattgcggcggcatccattgtaacaatgcttaccatttttccttttgatgttgccattttcacttcggcgcaaaaaatggtcactggaatcgacagctttgctttattagcggtgccgttcttcattttatcaggcattattatgaataatggcggtattgcaatgcggctcattaacttcgcaaaattgatcagcggcaggctgcccggttctctggcccatacaaatgttgtcggaaacatgttattcggttccatttccggttcgtctgtagctgctgctgctgcaatcggcggggtcatgtcgccgcttcaagaaaaggaaggatatgaccggacttactctgccgcagtaaatattgcttcagcaccaactggtttgcttattccgcctagcggtcttttgatcattttctcattagtcagcggcggaacatctgttgccgctttatttatggcgggctatttgccgggaatcttgtgggggctggctacgatggttgtcgcctgtatgattgcaaaaaagaaaaaataccctgttgcgccaaagattacgattagtcaaggttttaaagtgcttctcgatgcgattccaagcctgttgctcattgtaatcgtaatcgggggtattatcgccggtgtatttacagcaactgaaggagcagcaatagcggtggcttattccttattgttgtcgctcttttataggacattgaaatggaaacagctccccaaaatgctgctggaaacggtagaaatcacagccgttattatgtttttggttgggacatcaacgatgctgtcattggtcatggcgtttacaggcataccgacggcaatcagcaatggaattttagggattacagataacccaattttgatcctgctgatgatgaatatcatcttattaataatcggtacatttatggacatcactccggctgtactaattttcactccaatctttctgccaattgttgaaagctttggcatggatcccgtgcattttggaattatgatcgtatttaacctttgtatcggcaatatcactcctcctgtaggaagtgctctgtttgtaggatgcagcataggtaaagttgatattgaacgagtggttaaaccgattctgccattttatgctgcgatcatgatcgtccttttaattgttacctacattccacaaatcagcttagtgttgcctcaattatttggactttaa

SEQ ID NO: 56274 - protein, 431 aa, Bacillus licheniformis ATCC 14580
MAIAAGLILSAVFFILLFLGVPISVSIAAASIVTMLTIFPFDVAIFTSAQKMVTGIDSFALLAVPFFILSGIIMNNGGIAMRLINFAKLISGRLPGSLAHTNVVGNMLFGSISGSSVAAAAAIGGVMSPLQEKEGYDRTYSAAVNIASAPTGLLIPPSGLLIIFSLVSGGTSVAALFMAGYLPGILWGLATMVVACMIAKKKKYPVAPKITISQGFKVLLDAIPSLLLIVIVIGGIIAGVFTATEGAAIAVAYSLLLSLFYRTLKWKQLPKMLLETVEITAVIMFLVGTSTMLSLVMAFTGIPTAISNGILGITDNPILILLMMNIILLIIGTFMDITPAVLIFTPIFLPIVESFGMDPVHFGIMIVFNLCIGNITPPVGSALFVGCSIGKVDIERVVKPILPFYAAIMIVLLIVTYIPQISLVLPQLFGL

SEQ ID NO: 56275 - DNA, 1284 bp, Photobacterium profundum SS9
  CDS (1)..(1284)
atgtttacatccatagtgggctggctagggcttcttttcgcaggtatgccagtagggttctctttaatatttgttggtcttgcttttttagtcttaacagaaagtaccggaataaattttgccgctcagcaaatgattggaggcttggataatttcacattgcttgcggtaccattttttgtattaactgggcacctaatgaatagtgccggtattacagaacgtatttttaattttgctaaagcaatggtaggacatataacgggtagtttaggccacgtaaatattctggcgagtttgttgttttctggtatgtcgggatcggcattggctgatgctggtggtcttggtcagcttgaaatcaaatcgatgagagatgcgaaatatgatgatgactttgctggtggcttaaccgcggcatcctgtattattggccccttagtaccaccatcgattcctcttgttatttatggtgttgtgtctaacacctcaattggtgcgttatttcttgctggtgcaataccgggattattatgttgtattgccttgtgtatcatgacgtattttatcgcgaagaaacgtggttatatgacgttacctcgtgcatcgagaaaagaaagattaatcgcatttagagatgcatttttatctttattaacgccgttcattattataggtggtattttttctggtaaattcacccccactgaagcggctattatctcgtcgttatatgcactttttctaggtactgttgtatacaaatctttaacaatggacaagtttattaaacttgttcaagaaacggtaacaacgacatctgttgtcgctttaatggtgatgggagttactgtatttggctggatagttgctcgtgaacaattaccacagcagttagcagagctctttttatcgatcagtgataatcctttgattttattgctactcattaatctgttgttactttttttgggtacctttattgaatcgctagcgttgttattattacttgtaccgtttctagtacccgttgctacatccgttggtattgaccctgttcattttggtgttatggctatccttaacttaatgatcggtatattaacgccaccaatgggaatggctctatacgttgtatcaaaggttggtaatatcccatttcatgtattaacacgtggtgttttaccactactagtaccgttatttattgtgcttggtttaattatcgtttttccacaaatcacgctgtttttaccgcaacttgtacttggatatgggctttaa

SEQ ID NO: 56276 - protein, 427 aa, Photobacterium profundum SS9
MFTSIVGWLGLLFAGMPVGFSLIFVGLAFLVLTESTGINFAAQQMIGGLDNFTLLAVPFFVLTGHLMNSAGITERIFNFAKAMVGHITGSLGHVNILASLLFSGMSGSALADAGGLGQLEIKSMRDAKYDDDFAGGLTAASCIIGPLVPPSIPLVIYGVVSNTSIGALFLAGAIPGLLCCIALCIMTYFIAKKRGYMTLPRASRKERLIAFRDAFLSLLTPFIIIGGIFSGKFTPTEAAIISSLYALFLGTVVYKSLTMDKFIKLVQETVTTTSVVALMVMGVTVFGWIVAREQLPQQLAELFLSISDNPLILLLLINLLLLFLGTFIESLALLLLLVPFLVPVATSVGIDPVHFGVMAILNLMIGILTPPMGMALYVVSKVGNIPFHVLTRGVLPLLVPLFIVLGLIIVFPQITLFLPQLVLGYGL

SEQ ID NO: 56277 - DNA, 1308 bp, Photobacterium profundum SS9
  CDS (1)..(1308)
atggacatagcattaaccgcagcattaatcatgttttctggtgctgtactgttgctaattattggtgctccaataagtattagtatcggcatttcctctttcgcagcaatgatgtcaattcttccagccaatggtgcaatggtgacttctgctcaacggatgtttgttgggttagattcctttgctttacttgctattccgttttttatcctggcgggtaatattatgaataatgggggtattgcgataaggctgattaattgttccaaaatcattagtggtttttttccaggatcgttagctcaaacgaatgttgtgtcaaacatgatgtttggatctattagtggttctggtgtcgcttctgccgctgccgtcggtggaattatggctccgattcagaaaaaagaggggtatgatcccgcttttagtactgcggttaatattgcatccgcaccaactggcatgctaataccaccaagtaatacgctaattgtatatgcaacggttgcgggtagcgtgtcaatctcagcactatttatggctggttacattccgggtttattatggggaatgagtgtaatgttagttgcaggtatcatggcaaaacgtcgtggctatgtcgctaaacattcaatgtcttttagagagagtatcaacgtatttattgctgcaattccaagtctttctcttattgttgttgtaatcggtggaatactcggtggtatttttacagcaacagaagcctctgcgatagcggtagtatattctttgctattaagtttctgctatcgaacaataaaattaaaaatgctgccagaaatattcctttctacagctaaaatgtcagcgattgtaatttttatgttggctgcatcttcgatcatgtcatgggtaatggcttttactcaaatacccaacatgattgcagatcaattgctctctctaaccgatagcccgattattattttattaattattaatttgatattattattagttggaacatttatggacccaacgccagcagtacttatctttacgccgatatttttacctatttgtatgaacctgggtatggaccctgttcagtttggtattttactcgtatttaatttgtctctcggtactattactccacctgttgggcctattttatttacgggctgtaaagtgagtggaattgcgattgatagcgtaataaaaacattattaccctttttcttagttatcgcaggggtgctgatgttagtcacttatgttccagaaatttccatgacggtgccgcaagctatgggattagttaagtaa

SEQ ID NO: 56278 - protein, 435 aa, Photobacterium profundum SS9
MDIALTAALIMFSGAVLLLIIGAPISISIGISSFAAMMSILPANGAMVTSAQRMFVGLDSFALLAIPFFILAGNIMNNGGIAIRLINCSKIISGFFPGSLAQTNVVSNMMFGSISGSGVASAAAVGGIMAPIQKKEGYDPAFSTAVNIASAPTGMLIPPSNTLIVYATVAGSVSISALFMAGYIPGLLWGMSVMLVAGIMAKRRGYVAKHSMSFRESINVFIAAIPSLSLIVVVIGGILGGIFTATEASAIAVVYSLLLSFCYRTIKLKMLPEIFLSTAKMSAIVIFMLAASSIMSWVMAFTQIPNMIADQLLSLTDSPIIILLIINLILLLVGTFMDPTPAVLIFTPIFLPICMNLGMDPVQFGILLVFNLSLGTITPPVGPILFTGCKVSGIAIDSVIKTLLPFFLVIAGVLMLVTYVPEISMTVPQAMGLVK

SEQ ID NO: 56279 - DNA, 1302 bp, Photobacterium profundum SS9
  CDS (1)..(1302)
atggaatggcaagtcattcttactctatttggtagctttgcggttctcttaacgttaggggtcccggtttcatttgctattggtctgtcttcgttagcaaccattatgctaagcctgccacttgaaccagcaattgccgtggtagcacagcgtatggcggcaggtcttgataactttgcactacttgcgatcccgttttttatcttggcgggcaatattatgaaccaaggtggtattgcgattcgccttattaattttgcaaaagtattaggtggtcgtcttcctggttccctagcgcatgtaaacatcatggcgaatatgatgtttggttcaatttcaggttcagcggtagcttctgcggcagccgttggcggtacgatgtctcctttgcaaaagaaagatggctatgatgagcatttctctgccgcggtcaacattacatcttgccctactggtctattgattccaccgagtaataccttaatcgtattctctttagtttctggtggtacatcgattgcggcactatttctagcaggttacattccaggtctgattatgggcttgagcttaatgtgtgtcgcaggttttattgccaagcgccgtggctaccctgtcgcagcaaaaccaagtctggcagaagtgtgggatacattattaagagcattaccttctttaatgcttatcgtcattattatgggcggtattattggcggtatcttcaccgcaactgaagcctcagccattgcggtggtctatacctttatactcgcggtattgatttaccgtgaagtgaagttccgcgatttacctaaaatcattttagaatcagcagtgacaacctcaattgttctactgttagtgggtgcatcaatgggcatgtcatgggcaatggctaacgccgatatcccttacatgattgccgacgcactactggctgtttctgataaccctctcgttgtcttattgattatcaacctcattttattaattgttggtatcttcatggacatgacaccagcagtactgatcttcacgcctatcttcttgcctatcgtattagatttaggtgtcgaccctgtgcacttcggcatcatgatgacgtttaaccttgcgattggtatttgtactccgccagtaggtagcgcgttattcattggttgttcagttgcaaatgtatcgattgataagatcatcaaaccattattacctttctatgcggcactggttattgcgctaatggcagttacctttattccacagctaagcctattcctaccaggtctagttctaggttactaa

SEQ ID NO: 56280 - protein, 433 aa, Photobacterium profundum SS9
MEWQVILTLFGSFAVLLTLGVPVSFAIGLSSLATIMLSLPLEPAIAVVAQRMAAGLDNFALLAIPFFILAGNIMNQGGIAIRLINFAKVLGGRLPGSLAHVNIMANMMFGSISGSAVASAAAVGGTMSPLQKKDGYDEHFSAAVNITSCPTGLLIPPSNTLIVFSLVSGGTSIAALFLAGYIPGLIMGLSLMCVAGFIAKRRGYPVAAKPSLAEVWDTLLRALPSLMLIVIIMGGIIGGIFTATEASAIAVVYTFILAVLIYREVKFRDLPKIILESAVTTSIVLLLVGASMGMSWAMANADIPYMIADALLAVSDNPLVVLLIINLILLIVGIFMDMTPAVLIFTPIFLPIVLDLGVDPVHFGIMMTFNLAIGICTPPVGSALFIGCSVANVSIDKIIKPLLPFYAALVIALMAVTFIPQLSLFLPGLVLGY

SEQ ID NO: 56281 - DNA, 1404 bp, Photobacterium profundum SS9
  CDS (1)..(1404)
atgactatttttgcattattcggcttactgtttttctgtatgtttattggtatgcccatcgcgattgcgctcgggttatcaagtgttgcaaccatcctgctattctcgaatgattcactggcctctattgccttaaaattatttgaagcaaccagcgaacattacacattattagccattccatttttcattttatcttctgcctttctatcaacggggggagtcgccaaacgattaataaattttgccattgatgctgtcggtcatattcgcggtggtcttgcaatggcatcggtaatggcgtgtatgttgtttgcggcagtgtcagggtcttcccctgcgacggttgcggcaattggctcgattgttatcgttggcatggtgaaggcgggttacccgaaaagctttgcggcaggtgtgattgcgaatgcgggcacattaggtattttgatccctccttctattgttatgttggtttatgcggcagcaaccgaagtgtcggcatcccgtatgttcatggcgggttttattcccggcttgatgatgggtggtattttgatgattgccatttacatcgttgcccgtataaaagggctgccatcacaaccgtttccaggttttgcttcattgtttatttcggggctgaaagcgcttggcggtttaatgctcatcgttattgtactggggtctatttatggtggtgtcgcaagtccaactgaagcggcatctgttgcggcagtatatgcatggtttgtgagtgtttggggttaccgagatatcggtccgttgaaaggcgtaccgtggcgatataaaaatgaacatattataaaagcagttgtacgcaataccgcgagctttccattggcattaatccgttcgtttaccgataaagaagtcaatcacattgtgagagatgcagcaaaagtgagtattatgctgctgttcattattgctaatgcaatgctgtttgcacatgtacttacaacggaacgtattccacatatgatcgccgagacaatcgtgagtatggggttacccgcctggggattcttgattgttgtgaatatcttgctgctaatcgcaggtaacttcatggagccctcggcaatactactgataatggcgccaatcttgtttcctattgcagttcaacttggtattgatcctattcatttaggtatcattatggtggtcaatatggaaataggcatgttaaccccgcctgtagggcttaatttattcgtaacagcaggaataacaggtgaaagcatgggatgggcaattcgtgcggcattaccatggctgggcttattattaatcttcttaatgttgattacttatattcctcagatctcgttattcttgccagaatatattgatagcctacgagtgccaatacagtag

SEQ ID NO: 56282 - protein, 467 aa, Photobacterium profundum SS9
MTIFALFGLLFFCMFIGMPIAIALGLSSVATILLFSNDSLASIALKLFEATSEHYTLLAIPFFILSSAFLSTGGVAKRLINFAIDAVGHIRGGLAMASVMACMLFAAVSGSSPATVAAIGSIVIVGMVKAGYPKSFAAGVIANAGTLGILIPPSIVMLVYAAATEVSASRMFMAGFIPGLMMGGILMIAIYIVARIKGLPSQPFPGFASLFISGLKALGGLMLIVIVLGSIYGGVASPTEAASVAAVYAWFVSVWGYRDIGPLKGVPWRYKNEHIIKAVVRNTASFPLALIRSFTDKEVNHIVRDAAKVSIMLLFIIANAMLFAHVLTTERIPHMIAETIVSMGLPAWGFLIVVNILLLIAGNFMEPSAILLIMAPILFPIAVQLGIDPIHLGIIMVVNMEIGMLTPPVGLNLFVTAGITGESMGWAIRAALPWLGLLLIFLMLITYIPQISLFLPEYIDSLRVPIQ

SEQ ID NO: 56283 - DNA, 1284 bp, Thermus thermophilus HB8
  CDS (1)..(1284)
atgctgctgagctttgcggtgtttttgctcctccttcttctggggatgcccgtggtgttcgccatcgggatcggggggctcgtcttcttcctcacccagcccgggcttcagctcaccatgcccgtgcagctggccctggcggagacccagaacttctccctcctggccatccccaccttcatcctggccagcaacctgatgaacgagctgggcgtgacccggaggctcctccgcttcgcccacgtggcgacggggttcatgcggggcgggctcgcccaggtgagcgtccttctgggcttcctcatggggggggtctcgggctcggccatcgccgacgccaccatgcaagcgaggctcttgggccccgagatggtgcgccgggggtacagccgggggttcatcgccgccctccagggcttctccggcctcctcgccgtggccatccccccgagcatcggcctcatcctctacgggagcatcggccaggtgtccatcggccagctcttcgcgggggggatcggggtaggggtgctcctggcggcggtgtacatgctcaccgtggccctcctggcccggagccgggggtaccttcccgagaccgccccgcccacggccaaggaggttggggcggccctccgggagggcttcttcgccgtgcttttccccttcctgctcctcgccgccctgcgcttcggggtcttcgtcccctcggaggtaggggcggcggcggtggtctacgccctcttggtggggctcatctaccgggagctttcccttgagcgggtgaaccgggccttggcccactcggtgcgggacgtgggcatggtggccctcctcatcgccatggccgcggttttgggctacgggatgaagtgggagatgttcccccagcaggtctcggcctttctcctcgaggcggtgcagaacccccaggtggccctcctcctcatcctcttggccctcctcgttttgggcaccgtgctggactccacggtgatgatcatcctcctcacccccatcctggtccccgcggccaaggccttggggattgacctggtctacttcggcgtcctcatggtcatgacctgcgccgtggggctcctcacgccccccgtggggctttccatgtactcggtctgctcagtgatggggtgcagcattggggagtacgtgcgggaggggtggcccttgctggtcgccacccttttggtccttctcctcgtgtacctcttccccggggtggtgctcttcctgccccggttgctctttggaggtggggtgtga

SEQ ID NO: 56284 - protein, 427 aa, Thermus thermophilus HB8
MLLSFAVFLLLLLLGMPVVFAIGIGGLVFFLTQPGLQLTMPVQLALAETQNFSLLAIPTFILASNLMNELGVTRRLLRFAHVATGFMRGGLAQVSVLLGFLMGGVSGSAIADATMQARLLGPEMVRRGYSRGFIAALQGFSGLLAVAIPPSIGLILYGSIGQVSIGQLFAGGIGVGVLLAAVYMLTVALLARSRGYLPETAPPTAKEVGAALREGFFAVLFPFLLLAALRFGVFVPSEVGAAAVVYALLVGLIYRELSLERVNRALAHSVRDVGMVALLIAMAAVLGYGMKWEMFPQQVSAFLLEAVQNPQVALLLILLALLVLGTVLDSTVMIILLTPILVPAAKALGIDLVYFGVLMVMTCAVGLLTPPVGLSMYSVCSVMGCSIGEYVREGWPLLVATLLVLLLVYLFPGVVLFLPRLLFGGGV

SEQ ID NO: 56285 - DNA, 1284 bp, Geobacillus kaustophilus HTA426
  CDS (1)..(1284)
atggcgttagtcgtctttatcgggtcgcttttaggggtcatggcgctcgggatgccgatcgcgtttgcgctgcttgtcagcggcgttgctctcatgttttacttgaatatttttgatacgcaaatcatcgcgcaaaatttaatcagcggcgcggacagctttcctctgatggcgattccgttctttatgctcgctggggagctgatgaacgccggcggcatttcgaagcggatcatccgctttgccatggcgcttgtcggccatatccgcggcgggctcggatatgtggcgatcatcgcaagcgtgctgtttgccggtttgtcggggtcggcggtggccgatacggcggcgcttggggccattctcatcccgatgatggtgaaagccggatacaaccgcaaccggtcggccggcctcatcgccgccggcggcatcatcgcgccgatcattccgccgagcatcccgatgatcatctttggggtgacgagcggcgtgtcgattacgaaactgtttatggccggcattgttccggggattctgcttgggatttctttggcggtttgttggtggtgggtgacccggagagatcaagtggacgtgcttccgcgccaatcggcgaaagacatttggcgggcgacccgcgaggcgttttgggcgttgctgctgccggtgatcatcgtcggtgggctgcgcggaggagtgtttacgccgaccgaggcggcggtggtggccgcgttttacgcgttgattgtcggcttgtgcatttaccgtgagctgaaagtgaaagacttgtttcacgtgctcgtggccgcggcgaaaacgacaagtgtcgtcatgtttttggtggcagccgccatggtgtcggcctggctcattacggtcgccaacattccggcgatcgtcacggacgtgctcgcgccgctcatcgatcatccgctggcgctgctgctggccattaacgccttggtgctgcttgtggggacggcgatggatttgacgccgacggtgctcattttgacgccggtgttgatgccgattattcaaaaagcgggaatcgacccggtgtacttcggggtgctgtttatcctgaacaactgcatcgggctgctcacgccgccggtcggcacggtgctgaacgtcgcctgcggggtcgggaaaatcagcatggaagacattatgaaaggagtttggccgtttttgcttgtggaaacgctcctgttgcttttgttgattttcttcccgtctcttgtgaccgtgccgctcggatggtttacgggcagttga

SEQ ID NO: 56286 - protein, 427 aa, Geobacillus kaustophilus HTA426
MALVVFIGSLLGVMALGMPIAFALLVSGVALMFYLNIFDTQIIAQNLISGADSFPLMAIPFFMLAGELMNAGGISKRIIRFAMALVGHIRGGLGYVAIIASVLFAGLSGSAVADTAALGAILIPMMVKAGYNRNRSAGLIAAGGIIAPIIPPSIPMIIFGVTSGVSITKLFMAGIVPGILLGISLAVCWWWVTRRDQVDVLPRQSAKDIWRATREAFWALLLPVIIVGGLRGGVFTPTEAAVVAAFYALIVGLCIYRELKVKDLFHVLVAAAKTTSVVMFLVAAAMVSAWLITVANIPAIVTDVLAPLIDHPLALLLAINALVLLVGTAMDLTPTVLILTPVLMPIIQKAGIDPVYFGVLFILNNCIGLLTPPVGTVLNVACGVGKISMEDIMKGVWPFLLVETLLLLLLIFFPSLVTVPLGWFTGS

SEQ ID NO: 56287 - DNA, 1308 bp, Salmonella enterica subsp. enterica serovar Paratypi A str. ATCC
  CDS (1)..(1308)
atgattgaccctatttttgcgtcctgtacgctaattgccgtctttgttgttttactggccatgggcgcgcctatcgggatctgcatcgttatcgcctctttcagcaccatgatgctggtactgcctttcgatatttcgatgttcgccaccgcgcaaaaaatgttctccagcctggacagttttgccttgctggccgtgccgttcttcgttttgtccggggtgatcatgaatagcgggggaattgccgcccggttggtcaattttgccaaactgtttactggcaaactgcccggctcgctctcttataccaacatcgtcggcaatatgatgttcggtgcaatttccggatcggcaattgccgcctcaacctccattggcggcgtgatggtgccgatgagcgcgcgcgaaggttacgatcgcggctttgcggccgcggtgaatatcgcctccgcgccgacgggaatgttaattccgcccaccacggcttttatcctttatgcgctggcaagcgggggaacatcgattgccgctctgttcgccggcggtctggtcgcgggagtgctgtggggcgttggctgtatgctggtcacgctggtagtcgctaagcgtcgaaattatcgggttttcttcaccgtccaaaaaggcatggcgctaaaagttgccgttgaggccattcccagcctgttactgatcgtgattatcgtcggcggcattgtgcaggggattttcaccgccattgaagcctccgcgattgccgtggtgtatacgttattgctgacgatggtgttttaccgcacgctgaaaattaaggatttgccttcgattttgctccagacagtggtaatgaccggggtcatcatgttcctgctggcaacctcttcggcgatgtccttctcgatgtcgatcaccaatattcctgcggcgctgagcgatatgatcctcggtatttccgccaataaactggttatcctgttagtcattaccgtctttttgttgattatcggcgcatttatggatatcggtccggccattctgatttttaccccgattctgctgccgattatgactaaactgggcgtcgatccggtgcatttcggcattatcatgatctataacctggcgataggcaccattacgccgccagttggcagtggtttatatgtcggggcgagcgtcggtaaggtcaaagttgaggacgttatcaaaccgttgatgcctttttacggcgcgattatcggcgttctgttattaattacctacattccggaaatcacactgtttttaccccgtctactgggcatcatgtaa

SEQ ID NO: 56288 - protein, 435 aa, Salmonella enterica subsp. enterica serovar Paratypi A str. ATCC
MIDPIFASCTLIAVFVVLLAMGAPIGICIVIASFSTMMLVLPFDISMFATAQKMFSSLDSFALLAVPFFVLSGVIMNSGGIAARLVNFAKLFTGKLPGSLSYTNIVGNMMFGAISGSAIAASTSIGGVMVPMSAREGYDRGFAAAVNIASAPTGMLIPPTTAFILYALASGGTSIAALFAGGLVAGVLWGVGCMLVTLVVAKRRNYRVFFTVQKGMALKVAVEAIPSLLLIVIIVGGIVQGIFTAIEASAIAVVYTLLLTMVFYRTLKIKDLPSILLQTVVMTGVIMFLLATSSAMSFSMSITNIPAALSDMILGISANKLVILLVITVFLLIIGAFMDIGPAILIFTPILLPIMTKLGVDPVHFGIIMIYNLAIGTITPPVGSGLYVGASVGKVKVEDVIKPLMPFYGAIIGVLLLITYIPEITLFLPRLLGIM

SEQ ID NO: 56289 - DNA, 1284 bp, Azoarcus sp. EbN1
  CDS (1)..(1284)
atgagcgccgccatcatcttcgtattgctcctggtgctgatgctcaccgggatgccgatctcgatctcgctcggcctcacggtcctgaccttcctcttcacgatgaccgaagtgccgatcgagtcggtcgcgctgaaattgttcaccggtatcgagaagttcgagatcatggcgatcccgttcttcatcctcgcgggcaacttcctgacgcacgggggtgtggcgcggcggatgatcaacttcgcgaccgcgatggtcggccactggtacggcggtctgggtcttggcggcgtcgtcgcgtgcgcgttgttcgccgcggtatcgggctcgagcccggcgacggtcgtcgcgatcggcgcgatcctgctgccggcgatggtcaggcagggcttcccgaacaagttcggcgccggcgtgatcacgacttcgggcgcgctcggcatcctgatcccgccgtcgatcgtcatggtcatgtactcggtgtcgacgaacacttcggtcggctcgctgttcatggccggcgtcgtgccgggcctgctgctcgcgatgtttctcggcttcacgacctggtaccgcgcgcgcaagtacgactacccgcgccagccgaaggcgagctgggggcagcggctgcgcgcgttcaaggaatccgcgtggggtctgttcctgatcgtcgtcgtcatgggcgggatctactccggcatcttcacgccgaccgaggcggctgcgatgagtgcggtgtatgcgttcttcgtcgcggtgttcgtctacaaggacctcggcatgaaggacgtgccgaaggtgctgctgaactccgcgaacatgagcgcgatgctgctgtacatcatcaccaacgcggtgctgttctcgttcctgctgacgcatgaaaacattccgcaggagatggcggacttcatgatcggcaccggcgtcggcatgatcggcttcctgatcatggccaacatcctgatgctgatcgccggcaacttcatggagccgtcgtcgatcgtgctgatcctcgcgccgatcctgttcccgatcgcgatcaagctcggcatcgacccggtgcatttcggcatcatcatggtcgtcaacatggaagtcggcatgtgccatccgccggtcggcctgaatctttacgtcgccagcggcatcacgaagatgggcatcaccgagctgacggtggcagtgtggccgtggctgctgtcgatgctggtattcctgatcctcgtcacctacgtcccggccatctcgctggccctgccgcgcgcgctcggcatgatgtag

SEQ ID NO: 56290 - protein, 427 aa, Azoarcus sp. EbN1
MSAAIIFVLLLVLMLTGMPISISLGLTVLTFLFTMTEVPIESVALKLFTGIEKFEIMAIPFFILAGNFLTHGGVARRMINFATAMVGHWYGGLGLGGVVACALFAAVSGSSPATVVAIGAILLPAMVRQGFPNKFGAGVITTSGALGILIPPSIVMVMYSVSTNTSVGSLFMAGVVPGLLLAMFLGFTTWYRARKYDYPRQPKASWGQRLRAFKESAWGLFLIVVVMGGIYSGIFTPTEAAAMSAVYAFFVAVFVYKDLGMKDVPKVLLNSANMSAMLLYIITNAVLFSFLLTHENIPQEMADFMIGTGVGMIGFLIMANILMLIAGNFMEPSSIVLILAPILFPIAIKLGIDPVHFGIIMVVNMEVGMCHPPVGLNLYVASGITKMGITELTVAVWPWLLSMLVFLILVTYVPAISLALPRALGMM

SEQ ID NO: 56291 - DNA, 1281 bp, Silicibacter pomeroyi DSS-3
  CDS (1)..(1281)
atgacccttgctctcttccttggcgttctgttggtttcgatctttctcggactgcctgtcgccttcgcgctcttgctggcgtcgattgccctgatgttccagctggatacgttcagcaccgatattcttgctcaatccttgatcaacggggtcgatagtttccccttgctggcgattcccttctttctggtcgctggcgaggtgatgtccgccggcgggctgtcgcaacggatcgtgcgtctggccaccagccttgtcgggcatcgccgtggcggcctgggatatgtggcgatctttacctcgatcctgcttgccggtctgtcaggatctgcggttgccgatgcggctgcattggtcagtattctttatccgatgatgaagaaggccggctatccagagggccattcgatgggattgctcgcatcgggcggtatcatcgcaccggtcattccgccctcgctgcccctgatccttatcggtgtcgctggtggtatttcgatcaaaagcctgttcctgggcgggatcgtgcccgggctcttgatggggctgactttggtcctggtctggggcgttctgatgcgcaaggaagacctcgaggttgcgccgcgcgccaccgcgggtgaacggctgcgcgctgtcagagagggtttctgggccttgctgcttccggtgatcatcattggcggtattcgcttcggcgttttcaccccgaccgaagcggcggttgtggcggcagtttacgccatttttgtttcaactttggtttatcgtgaactcaacttgaaagccttgttccatgtgctggtcagtgcagggcgggcgacggcgatggtgatgttccttgtggggtgcgccatggttgcggcttggctgatcacgatcgcacagttgccccaacagcttgccgcgatgctcggcccgctggtcgatcatccccggctgttgatggccgtgatcatgctgatcgtgctggccgtgggcatggtgatggatctggccccgacggttctgatcctggtccccttgctgatgccggtggtcaagctggcggggatcgacccggtctacttcggcctcatgttcgtcatcaacacctcgatcggtctgatcacaccgcccgtggggaatgtactgaatgtcgtgtgtggcgtggggcgggtgccgatgtctgctgccgtcaggggcgtcgcgcccttcattctcgcctatctcgcgctgctcgctctctttgtcgtttttccaaacatcatcatcaccccgatgaaattcatcatcggataa

SEQ ID NO: 56292 - protein, 426 aa, Silicibacter pomeroyi DSS-3
MTLALFLGVLLVSIFLGLPVAFALLLASIALMFQLDTFSTDILAQSLINGVDSFPLLAIPFFLVAGEVMSAGGLSQRIVRLATSLVGHRRGGLGYVAIFTSILLAGLSGSAVADAAALVSILYPMMKKAGYPEGHSMGLLASGGIIAPVIPPSLPLILIGVAGGISIKSLFLGGIVPGLLMGLTLVLVWGVLMRKEDLEVAPRATAGERLRAVREGFWALLLPVIIIGGIRFGVFTPTEAAVVAAVYAIFVSTLVYRELNLKALFHVLVSAGRATAMVMFLVGCAMVAAWLITIAQLPQQLAAMLGPLVDHPRLLMAVIMLIVLAVGMVMDLAPTVLILVPLLMPVVKLAGIDPVYFGLMFVINTSIGLITPPVGNVLNVVCGVGRVPMSAAVRGVAPFILAYLALLALFVVFPNIIITPMKFIIG

SEQ ID NO: 56293 - DNA, 1266 bp, Silicibacter pomeroyi DSS-3
  CDS (1)..(1266)
atgttcgtcatgctgctcgggcttttgttgaccgggatgccgcttgcgttcgtgacactgcttgtcgccttgatcttcgccttgggctggttcggcccgatggcggttccactgatcacatcgcggatcttcagtttcgtaaacagcttcgttttcgtctctgtcccgatgttcgtgcttatggcgtcgatattggatcgctcgggcatcgccaaagatcttttcgatgcgatgcgggttgtcggggggcgactgcgcggcggtgtggccatccaaacccttcttgtggccgtcgtcctggccgcgatgtccggaatcatcggcggagaagtcgttctgttgggtctgctggctttgccgcagatgctgcggctgggatatgatcgacggcttgcgatcggcgtatgctgcgcaggcggtgcgctggggaccatgatcccgccgtcgatcgttctgatcatctatggcctcaccgcgagcgtttccatcggcgatctgttcaccgcatcgttcctgccgggcctgatgctggcctcgttctatatcgcctatgtcctgatccgggcatatctgaaccctgatatcgcgccgatcccggaacccgatgaaatcccgacgaaagagaagttgcgtctgctcaagggtcttatcttgccgatcctcgtggtgttcatggtcctggggtcgatctatggcgggattgcgtctgttacagaagcctcggcaatgggcgttctcggggtcgcgttgtccgccgtcattcgaggggaatttaactgggagcttctgaagggggcttcactccagactctttcgaccgtcggcatgatcgtctggatcggtatcggcgcaaccgcactggtcggtgtgttcaacctgatgggcggcatcaactttgtgtccgggctgatcatcggagtttcagataacccgacagtcatcgtccttgtcatgatgctgatcctcttcgtgctgggaatgtttctcgattgggtcgggatcgcgttgctgacgatgccgatctttgtcccgatcattcgcgaacttggcctcgatcccgtctggttcggagttgtgttcgcaatgaacatgcaggtcagtttcctgtcgccgccctttggacccgcagctttctatctgaagtcggtcgcgcccgaggggatctcgcttggtgaaatcttccggtccttgttgccgttcattgcgatgcaggttctggcactggcgatcctgattgctttccctggtgtcacggggaggtggtaa

SEQ ID NO: 56294 - protein, 421 aa, Silicibacter pomeroyi DSS-3
MFVMLLGLLLTGMPLAFVTLLVALIFALGWFGPMAVPLITSRIFSFVNSFVFVSVPMFVLMASILDRSGIAKDLFDAMRVVGGRLRGGVAIQTLLVAVVLAAMSGIIGGEVVLLGLLALPQMLRLGYDRRLAIGVCCAGGALGTMIPPSIVLIIYGLTASVSIGDLFTASFLPGLMLASFYIAYVLIRAYLNPDIAPIPEPDEIPTKEKLRLLKGLILPILVVFMVLGSIYGGIASVTEASAMGVLGVALSAVIRGEFNWELLKGASLQTLSTVGMIVWIGIGATALVGVFNLMGGINFVSGLIIGVSDNPTVIVLVMMLILFVLGMFLDWVGIALLTMPIFVPIIRELGLDPVWFGVVFAMNMQVSFLSPPFGPAAFYLKSVAPEGISLGEIFRSLLPFIAMQVLALAILIAFPGVTGRW

SEQ ID NO: 56295 - DNA, 1353 bp, Silicibacter pomeroyi DSS-3
  CDS (1)..(1353)
atgactgccgcactgatcggttttgcacttgtcctggtgctggtgctgctgcgcctgcccatcgtctttgccatgggtctggtcggcacgctgggctttgcctacgagcggggcggctcgatcctggatgaacgcgggctcaaggccgcgatgtccatggtgggccgtcaggtgatggataccgcgcaggattacggcctcagcgtggtgccgctgtttatcctgatggggcttttcgtcaacaagggcggcatggcgcgcgagctttatgcggtgtcgaacgcattcctgggccatttccggggtggcatcgccatggcaacggttgccgcctgtggtggcttctcggccatctgcggctcgtcgctggccacggcggccaccatgtccaaggtcgcgatgccggaaatgcgccgctacggctataccgacgagctgtcgaccgcgtccatcgcggcgggcggcacgctgggcatcctgatcccgccttcggtcatcctggtgatctacgggttgttgaccgaaacctcgatcggcaagctgttcatggcggggatcattcccggtatcctgggcatcctgttctatctctttgccgtgcgctggaccgtgtggcgcaatcccgaagcgggccccgcgggtgaacgtgcgggctggggcgagcgggtgcgtgcactgggttcggtctgggcggtgctgttgctgttcttcctggtgatcggcgggctgtatggcgctttcgactttcaccctctgaatctgaccttctcgccgaccgaggcggcaggcatgggcgcggcaggcgcctttctgatcgcgcttttccggggtgggttgacggttgggtccaccttcgaggtgctgaaagagaccagctttaccgccgcatccctgttttcggtgctgatcggggcgcaggtgttttccaacttcatcaaccttgccggcctacccgaggcgctgatcgccatggtcaccgcctatgatgtggcgccgtttgtggtgatcctgatgatcctcggcatctacatcatcctgggctgcgtgtttgaatcgctgtcgatgctgctgctcaccgtgccgatcttctttccgctggtcacctcgctgggatatgatccgatctggttcggcatcgtggtcgtggtggtcaccgagatcagcctgatcaccccacccgtgggcctcaatgttttcatcctcaagggcgtggttggcgatgtctcgaccggcacgatctttcgcggggtgacgccgttctggatcgccgacatcttccggctggcgctgatcgtactggtgccggtggtggtgctctacctgccgcagcagatgggcgcgatgggccactga

SEQ ID NO: 56296 - protein, 450 aa, Silicibacter pomeroyi DSS-3
MTAALIGFALVLVLVLLRLPIVFAMGLVGTLGFAYERGGSILDERGLKAAMSMVGRQVMDTAQDYGLSVVPLFILMGLFVNKGGMARELYAVSNAFLGHFRGGIAMATVAACGGFSAICGSSLATAATMSKVAMPEMRRYGYTDELSTASIAAGGTLGILIPPSVILVIYGLLTETSIGKLFMAGIIPGILGILFYLFAVRWTVWRNPEAGPAGERAGWGERVRALGSVWAVLLLFFLVIGGLYGAFDFHPLNLTFSPTEAAGMGAAGAFLIALFRGGLTVGSTFEVLKETSFTAASLFSVLIGAQVFSNFINLAGLPEALIAMVTAYDVAPFVVILMILGIYIILGCVFESLSMLLLTVPIFFPLVTSLGYDPIWFGIVVVVVTEISLITPPVGLNVFILKGVVGDVSTGTIFRGVTPFWIADIFRLALIVLVPVVVLYLPQQMGAMGH

SEQ ID NO: 56297 - DNA, 1287 bp, Silicibacter pomeroyi DSS-3
  CDS (1)..(1287)
atggctgcaaccattttcctgaccatgattgtcctgcttctgctgggctttccgatgatgatcccgctgattgcgggcgcgttcatcggctttctgatgctgttcggcgatctggcaaggaccgagaccatggtacagcagatgctggcggggatccggcccgcctcgttgatcgcggtgccgatgttcatctttgccgcagacatcatgacccgcggccagtcggccgggcggctgatcaatgtggtgatggcctatgtcggccatatccgcggcgggcttgcgatttcgacggcggcggcctgcaccatgttcggggcggtctcgggctcgactcaggccacggtcgtggccatcggctcgcccctgcggccgcgtatgctgaaggcaggctacaaggacagctttgtgctggccctgatcgtcaatgccagcgacatcgcctttctgatcccgccctcgatcggcatgatcatctacggggtggtctcgagcacctcgattgccgagctgttcatcgcggggatcggccccggcctgctgatcctggtgctgttttcggcctatgcctatatctatgcggtgcgcaacgacgtgccgacggaacccagggcaagctgggccgagcgtgcaagaaccatgcggcaggcgctgtggccgatggggtttccggtgatcatcatcggtggcatctatggtggcgtcttcagcccgaccgaggcggcggcggcctgtgtcctgtacgcgctggtgctggaggtccttgtgttccgctcgatgtcgctggccgatgtctatgacacggccaagtccaccgggctgatcaccgcgatcgtcttcatcctggtgggggccggtgcggcgttttcctgggtgatctcgtttgcgcaggtaccccagcagatcctgggggccatcggcattgccgagatgggccccatcggggtgctgttcgtgatctccatcgcgtttttcatcggctgcatgtttgtcgatcccatcgtggtgatcctggtgctggtgccggtctttgcgcccgtggtgaaatcggtggggctggacccggtgctggtcggcaccatcatcaccctgcaggttgccatcggatcggccacaccgccttttggctgcgatatctttaccgcaatcgccgtcttcaaacgcccctatgccgaggtggtgcgcggaacacccccgttcatcctgatgctgctgggggtgtcggtggcactgatcttcttcccgcagattgcgctgttcctgcgcgatctggccttttccaagtaa

SEQ ID NO: 56298 - protein, 428 aa, Silicibacter pomeroyi DSS-3
MAATIFLTMIVLLLLGFPMMIPLIAGAFIGFLMLFGDLARTETMVQQMLAGIRPASLIAVPMFIFAADIMTRGQSAGRLINVVMAYVGHIRGGLAISTAAACTMFGAVSGSTQATVVAIGSPLRPRMLKAGYKDSFVLALIVNASDIAFLIPPSIGMIIYGVVSSTSIAELFIAGIGPGLLILVLFSAYAYIYAVRNDVPTEPRASWAERARTMRQALWPMGFPVIIIGGIYGGVFSPTEAAAACVLYALVLEVLVFRSMSLADVYDTAKSTGLITAIVFILVGAGAAFSWVISFAQVPQQILGAIGIAEMGPIGVLFVISIAFFIGCMFVDPIVVILVLVPVFAPVVKSVGLDPVLVGTIITLQVAIGSATPPFGCDIFTAIAVFKRPYAEVVRGTPPFILMLLGVSVALIFFPQIALFLRDLAFSK

SEQ ID NO: 56299 - DNA, 1278 bp, Silicibacter pomeroyi DSS-3
  CDS (1)..(1278)
atggatgtcgcgatcctcttctcgatctttgtcggcggcctggtgctgggcattccggtggccattacgctgggtctgtcgtcacttgcctatctgatcgctgccggcatgcctccggtggtgatgccccagaaaatgtacgcaggcatggatgtattcgtcctgctatccatcccaggcttcatcctggccgggaacctgatgaaccagggcgggatcacgggcaggatcatccgctttgccaatgctctcgtggggtggatcaagggcgggctcggactgaccaacatcgccgcttcgatgctgttcgggggcatcaccggcacggctgtcgccgatgccgcctcgcttggtggcgttctgatcccgggcatgaagaaggcgggctacccggccgatttctcggccgcagttaccgcggcctcatcaactgtcggcccgatcatcccgccgtcggtgcccatgatcatcgtcggggcgctttccgggatctcggtcggcaagatgttcctcgcgggcgccattccgggcatcctgatgggtatcgcaatgatggtgacggcatatatcatttcggtgcgtcgcggcttcccgcaccaaccctggcaaggcttcggcgaggtcgcgcgctcgttcgcaggtgcgatctgggccatcgcgatgaccttcctgatcatctatgggcttctctcggggcttgccacgccaaccgagacggcggtggtcgccagcgtctatgccttcatcgtcggcgccttcatctaccgcgaactgcccctcgggaaagtgccgggcatcgtcgccaacagcgcggtctcggcggcgggtatcctggcgcttgtcggttttgccaatgtcttcgggtggattctcgtctctgagcggatcccgcaggccatcgccgatggcgtgctgtcgataacggacaacaagttcctcgtcattctgctgatcaacctgctgctgctttttgtcggcatgttcatggagacgatcgcggcgctgatcatcctgttcgtgccgctcctgtccttggcacaggcggtcggaatcgatccgctgcacttcgccaccttcgcggttctgaacctgatgatcggcttgacgacgccgccggtcggcgtctgccttttcgtctgcgccaatatcgcgcgcctgccgctggccccggtggtgcgcgcgataatgcccttccttctgaccaatatcctggtgctgctcgcggtcagctacttcccgccgctcgctacctggcttccatccctgctgatcccctga

SEQ ID NO: 56300 - protein, 425 aa, Silicibacter pomeroyi DSS-3
MDVAILFSIFVGGLVLGIPVAITLGLSSLAYLIAAGMPPVVMPQKMYAGMDVFVLLSIPGFILAGNLMNQGGITGRIIRFANALVGWIKGGLGLTNIAASMLFGGITGTAVADAASLGGVLIPGMKKAGYPADFSAAVTAASSTVGPIIPPSVPMIIVGALSGISVGKMFLAGAIPGILMGIAMMVTAYIISVRRGFPHQPWQGFGEVARSFAGAIWAIAMTFLIIYGLLSGLATPTETAVVASVYAFIVGAFIYRELPLGKVPGIVANSAVSAAGILALVGFANVFGWILVSERIPQAIADGVLSITDNKFLVILLINLLLLFVGMFMETIAALIILFVPLLSLAQAVGIDPLHFATFAVLNLMIGLTTPPVGVCLFVCANIARLPLAPVVRAIMPFLLTNILVLLAVSYFPPLATWLPSLLIP

SEQ ID NO: 56301 - DNA, 1260 bp, Silicibacter pomeroyi DSS-3
  CDS (1)..(1260)
atgaccccgatcctattcctggtcctgctctttgcctcggttcccatcgcgttggtgctggcgctgaccgcgctctggtacatctatgacagcggcaatctggtactgtatgacagtttcgcccagcagatgttcgcaggtgtcgagaattacgggctgcttgccattcccctgttcatcctgaccggagagttgatgaacgaaggcggcatgacccagcgcctggtgcatgccgcgcgcgtctttgtcggcgggtttcgcggcgggctggcctatatcaacctgctggccaacatgttcatggccgcgatcatcggatcggcggccagccagatcgcggttatgagccgggccatggtgcccgccatgaaggacgaaggctatgaccccggtttcgccgccgccaccaccgctgccggcgggctgctggcgccagtgatcccgccctcgatgctgttcgtgatctatggcgtgctggcgcaattgccgatcggcgatctgttcatcgccggcatcatccccggcctgatcatggccgggtcgtttttcgtggtggtggcgctgatcgggctcagccagcagtttccaaagggcgagtggatgacgatgccgcaggcgctgcgtgccctgcgcgacgccctgcccgcctttctgatccctctggccatcgtcggcggcatcctctttggcatcgccaccccgaccgaaagcgccgccgtcgcctcgctcatcgcctttggcgtgggctggctggtctatcgcgagatccatatccgcgatctgggcgccatgttcgcacgcacggccaccaattcctcgctggtgatcttcatgatcgcggcagccaatgtgttcggctgggtggtgatctacgaggaactgccgcagaaactggcggcgtttctgtccaccgtcacctcggacccgttcaccttcctgctgatcgtcaacctgtgcctgctgttcgtgggcatgctgatcgacggcatcgcggcgctgatcctgatcacgccgatcctgctgccgatcgcgatgaacagctatggcatcagcccctatcagtttggggtggtgatcagcctgaacctggtgctgggcctgctgacgccaccggtgggcgtgggcctgtacatcgcctcggccatgtcgggggtgcgccccttcaccatcttcaccgcactctggccgttcctgctggcggtggcggtggtgctggtaatgctgagctatttccccatcctgagcaccgcgctgatctga

SEQ ID NO: 56302 - protein, 419 aa, Silicibacter pomeroyi DSS-3
MTPILFLVLLFASVPIALVLALTALWYIYDSGNLVLYDSFAQQMFAGVENYGLLAIPLFILTGELMNEGGMTQRLVHAARVFVGGFRGGLAYINLLANMFMAAIIGSAASQIAVMSRAMVPAMKDEGYDPGFAAATTAAGGLLAPVIPPSMLFVIYGVLAQLPIGDLFIAGIIPGLIMAGSFFVVVALIGLSQQFPKGEWMTMPQALRALRDALPAFLIPLAIVGGILFGIATPTESAAVASLIAFGVGWLVYREIHIRDLGAMFARTATNSSLVIFMIAAANVFGWVVIYEELPQKLAAFLSTVTSDPFTFLLIVNLCLLFVGMLIDGIAALILITPILLPIAMNSYGISPYQFGVVISLNLVLGLLTPPVGVGLYIASAMSGVRPFTIFTALWPFLLAVAVVLVMLSYFPILSTALI

SEQ ID NO: 56303 - DNA, 1362 bp, Silicibacter pomeroyi DSS-3
  CDS (1)..(1362)
atgactgacggaaactggacgatcctcatctcggtcggggtgaccttcttgttcatgctgggcgtgccggtctttctggtgatcggctactgggtcatcggcatgagccttgttctgggcctgccgctgatcaacaccggctcggcgctggccgatgtgttcaccgacgggttcgccctgctggcgatgccgctcttcatcctcaccggagacctgatcaaccgctccggcatcgcccggcggttgtcggatttcgcctatgcctgccttggctggctgcgcggcgggctggcgatggcctcgctcggggcttgcggcctgtttgccgccatctccggctcgaactcggccaccacggcgacaatcggctcgatgctgcaccccgagatggtcaagggcggctatgacgaacgcttctcggccgccaccgcggcggcgggcggcacggtgggcatcatcatcccgccctcgatcatcttcatcgtctacggcttcctgatgaacctgccgatttccgagcttttcgtggccgggatcattccgggcgcgatgatggtcggcggcatgatgctggtggccttcttcatctgctcgcgcaacaagtggggtcacctgatccggctggagctggcccgggttctgaaaaccggccttggcgcctggcttggcttcttcgcgatcgggctggtcctgtgggggatctacaccggcaagttctctccgaccgaggcggcgggtgtgaccgtcggcttctgcatcatcgtgggcttcgtcagcctgccgatccatgcgctgatggggcgcccgtccgaggaacgcgatttccgggaacgcggtatctcggaatatctggtggtacaggggttcagcccgctggaactgccctcgatcaccatgcgctcggcccagatcaccggcatcctggcgccgctgatcgccgtttcggtggtgatgcagcagatcctgtcggtactgggcgcgcaggagatcatcggggatttcgtgcgcgggatgggtggctactatgccgttctgttcacctcgatggcgattgtcttctttgccggcatggtgcttgaaagcctgcccgtcaccatcatcctcgccccgatcctcgcgccgatcgcggcctctgtcggggtcgatccgatccagttcggcgtgatcttccttgtcggtgcctcgatcggcttcatcaccccgccttacgggctgaacctctatgtcgcctcgggcgtgacaggcgtgccctatttccggctgctgcgctacacggtgccttacctgttcgccctgttgtcggtctggatcatggtggcgctgcttccggctctctcgacaatcctgatcccgagcgggtaa

SEQ ID NO: 56304 - protein, 453 aa, Silicibacter pomeroyi DSS-3
MTDGNWTILISVGVTFLFMLGVPVFLVIGYWVIGMSLVLGLPLINTGSALADVFTDGFALLAMPLFILTGDLINRSGIARRLSDFAYACLGWLRGGLAMASLGACGLFAAISGSNSATTATIGSMLHPEMVKGGYDERFSAATAAAGGTVGIIIPPSIIFIVYGFLMNLPISELFVAGIIPGAMMVGGMMLVAFFICSRNKWGHLIRLELARVLKTGLGAWLGFFAIGLVLWGIYTGKFSPTEAAGVTVGFCIIVGFVSLPIHALMGRPSEERDFRERGISEYLVVQGFSPLELPSITMRSAQITGILAPLIAVSVVMQQILSVLGAQEIIGDFVRGMGGYYAVLFTSMAIVFFAGMVLESLPVTIILAPILAPIAASVGVDPIQFGVIFLVGASIGFITPPYGLNLYVASGVTGVPYFRLLRYTVPYLFALLSVWIMVALLPALSTILIPSG

SEQ ID NO: 56305 - DNA, 1314 bp, Silicibacter pomeroyi DSS-3
  CDS (1)..(1314)
gtgtcgaaacgggagggaaggggccagatggaaattgttctgctcgtggtctgttttgtcgtgcttgtgctgctcggggccccggtggcgctggcgatgatactgatgccgaccacatacatcctgctgaccgacgccgcgccgctgctgaccgttccacatcagatgtacgagggcatagcgcacttcccgctcgtggcggtgccgttcttcatgctgacgggcgagttgatgaatggctcttcggtgacccagcggatcatgcggctgagccgcgtgatcgtggggcggatgcgcggcgggctggcgcaggtcaatatcgtggcgagcatgttctttgcaggcatgaacggatcggcggttgctgacaccgcgaccatcggcacgatcatgatccctgacatgaagcgcaagggctacacgcccgcctatgccgccgcgatcacggccatcggatcgacgattggcgggatcatcccgcccagcatcgcgatgatcgttctggccagttcggtcaacctgtcggtgggcgcgttgttcgcgggcggcatcctgcccggtatcctgatcggtctgctgctgatgctgaccgcctggatcatcgccaaggccaaggatcatgagcgcggtgacgagcccttcacgtttcgcgcgttcctgagcgcggcctggggcgcgtcgctggcgctctgcgtgccgctcattctcgtggtcggcatcttcggtggctggttcagttcggtcgaggccggggcgatcaccgcgctggtggcgctgatcctgggaacggtggtctatcgtgatctcgacttggcctcgttccttggcgccctgaaccgcacggtccggatgtcggcatccgtctttgtcatcatcgcggctgcgggtccgttcacatggttgctggcccgtctgggcgcgctggaaatgcttcagaactggctgctcggcttcgccgaaacgccgttcttcttcgcgctcatgctgctcgggcttatccttctggcggggatgatcatggatgccgcggcgaatatcatcgtgctgggccccctgctggtcgccgcctgcgagaccgcgggctacgaacccgtccaggccgcattggtggtggtggtcggcttcctgctgggcacggtcacgccgcctgtcggtgtgtgctatttcaccgccacggccatcgccgggtgcaggctcgaacaatccgctgcggccctgctaccgttcctcgcggtcgagatcctggtgctgttgctgatgctctttctggcgccgctgacgctctttcttccggccttgttggggttcctgtga

SEQ ID NO: 56306 - protein, 437 aa, Silicibacter pomeroyi DSS-3
MSKREGRGQMEIVLLVVCFVVLVLLGAPVALAMILMPTTYILLTDAAPLLTVPHQMYEGIAHFPLVAVPFFMLTGELMNGSSVTQRIMRLSRVIVGRMRGGLAQVNIVASMFFAGMNGSAVADTATIGTIMIPDMKRKGYTPAYAAAITAIGSTIGGIIPPSIAMIVLASSVNLSVGALFAGGILPGILIGLLLMLTAWIIAKAKDHERGDEPFTFRAFLSAAWGASLALCVPLILVVGIFGGWFSSVEAGAITALVALILGTVVYRDLDLASFLGALNRTVRMSASVFVIIAAAGPFTWLLARLGALEMLQNWLLGFAETPFFFALMLLGLILLAGMIMDAAANIIVLGPLLVAACETAGYEPVQAALVVVVGFLLGTVTPPVGVCYFTATAIAGCRLEQSAAALLPFLAVEILVLLLMLFLAPLTLFLPALLGFL

SEQ ID NO: 56307 - DNA, 1398 bp, Silicibacter pomeroyi DSS-3
  CDS (1)..(1398)
atggacgtggtgcttctctttgtgatggtggtggggttcctgctgatcggggtgcccatcgcggttgcgctcggtttcagctcggtcctgttcctgctgatcttctcggacagctcgctcgcctcggtggcgcagacgctgttccaggcgtttgagggacatttcaccctgctggcgatccccttcttcatcctcgcctcgtccttcatgaccacgggcggggtggcgcagcggatcatccggtttgccatcgcctgtgtaggccatctgcgcggcggtcttgccatctcgggcgtgtttgcttgcatgatgtttgccgccctgtcaggttcgtccccggcgacggtggtggccatcgggtccatcgtcatcgcggcgatgaaacaggcgggatataccaaggaattcgccgctggtgtgatctgtaacgcgggcacgctgggcatcctgatcccgccctcgatcgtgatggtggtctatgccgcctcggtcgaggtctcggtgggccggatgttcctggccggcgtcattccgggcattctggccggtgtcatgctgatggtggcgatctatgtcatggccacgatcaagggcatgcccaagggcgattgggcgggctggggcgagatcggtgacagtttccgtgatgcgctgtggggtctaatgctgatcgtggtgatcatggtgggtatctacggcatccccggcatcaccaaggcgatctttaccccgacagaggcggcggcggtggcctcggtctatgccttcctggtggcctctttcgtctatcgcgacatggggccgctggcggcagagaacaacgggggcgtgcgcaagagcctgctgacccggccgctcgcactggtgggggcgttctttcacaaggacacccgcaacaccctgttcgaggcgggcaagctgaccgtgacgctgatgttcgtgatcgccaacgcgctgatcctgaaacatgtgctgaccgacgagcaggtgccccagcatgtggccaatgcgatgctgtcggcgggtctgggtccgatcaccttcctgatcgtggtcaacgtgatcctgctgatcggcggccagttcatggagccctcgggcctgctggtcatcgtggcgccgctggtgtttccgatcgccatcgaactggggatcgatccgatccatctgggcatcatcatggtggtgaacatggagatcgggatgatcacgccgccggtgggtctgaacctgttcgtgacctcgggcgtggcggggatgccgatgatgagcgtggtgcgcgcggcgctgcccttcctggccgtgctgttcgtcttcctgatcctggtgacctatgttccctggctgtcgacggtgctgcccaacgcgctgatggggccagagatcatcatcaagtaa

SEQ ID NO: 56308 - protein, 465 aa, Silicibacter pomeroyi DSS-3
MDVVLLFVMVVGFLLIGVPIAVALGFSSVLFLLIFSDSSLASVAQTLFQAFEGHFTLLAIPFFILASSFMTTGGVAQRIIRFAIACVGHLRGGLAISGVFACMMFAALSGSSPATVVAIGSIVIAAMKQAGYTKEFAAGVICNAGTLGILIPPSIVMVVYAASVEVSVGRMFLAGVIPGILAGVMLMVAIYVMATIKGMPKGDWAGWGEIGDSFRDALWGLMLIVVIMVGIYGIPGITKAIFTPTEAAAVASVYAFLVASFVYRDMGPLAAENNGGVRKSLLTRPLALVGAFFHKDTRNTLFEAGKLTVTLMFVIANALILKHVLTDEQVPQHVANAMLSAGLGPITFLIVVNVILLIGGQFMEPSGLLVIVAPLVFPIAIELGIDPIHLGIIMVVNMEIGMITPPVGLNLFVTSGVAGMPMMSVVRAALPFLAVLFVFLILVTYVPWLSTVLPNALMGPEIIIK

SEQ ID NO: 56309 - DNA, 1302 bp, Bacillus clausii KSM-K16
  CDS (1)..(1302)
atggctctccttgcaggtattagtttaattgtcgtgtttttaggattgcttttactaggcgtgccaatcgccatcagtgttgcaggtgcatccattgtcacgatgtttctgatcgccccttttgatgtcgcgatctttacatctgcacaaaagatggtgacaggcattgacagctttacactgttagcggttccattctttttgttgacaggcattatcatgaaccaaggaggcatcgctctccggcttgtcaatgtagcaaaactatttacaggcaaattgccaggttcccttgcccatacgaacattgtcggaaacatgctttttggatcgattgccggctcttccgtcgcttcggctgcggcaatcggcaaagtcatgaacccattgcaggaaaaagaagggtatgaccggaaattttcagccgcagtcaacattgcctccgccccaactggattgattattcctccaacagggttgtttattatctattccctcgttagcggtggaacgtcagtggcggcccttttccttgctggttatttacctggtatcctttggggtcttgctacactggttgtcgctttttttattgctaaaaagaaaggctacacaacatcgtcggctacaaaggttgaatctcccttaaaagttatctgggaagcgatccctagcttgtttttagtcattattatcattggtggcattatcggcggtctatttacagcaaccgaagcgtcagcagtcgcgattgtgtacgcgttgcttctgtcttttgcctacaaaagcctaacgttgcggcagttgccaggcatttttaaagaagctgttgaactaaccgtcgtcatcatgttcctaattgggacatcggccatgctttccctagtcatgtcatttactggcattccgagcgccattagctccgcgattttagctttgacggataaccctattcttatcttgctgttgatcaatgtgattttgttactaatcggcattgtcatggacgtcacaccggcgatcttgatctttacgcccatctttttaccagtcgtgatggagtttggcatggacccagtccattttggcgtcattttaatcgtcaacctttgcattggcaacattactccaccaggaggaagcgctttatttgttggcagtaccatcggcaaagtcaaaattgaagaagtcatccgccctttgcttccattttacggcgcggtcattgtcgttttaatgctcgtaaccatgtttccttttttaagcacgtggctgccaactctagcgggattaatggaataa

SEQ ID NO: 56310 - protein, 433 aa, Bacillus clausii KSM-K16
MALLAGISLIVVFLGLLLLGVPIAISVAGASIVTMFLIAPFDVAIFTSAQKMVTGIDSFTLLAVPFFLLTGIIMNQGGIALRLVNVAKLFTGKLPGSLAHTNIVGNMLFGSIAGSSVASAAAIGKVMNPLQEKEGYDRKFSAAVNIASAPTGLIIPPTGLFIIYSLVSGGTSVAALFLAGYLPGILWGLATLVVAFFIAKKKGYTTSSATKVESPLKVIWEAIPSLFLVIIIIGGIIGGLFTATEASAVAIVYALLLSFAYKSLTLRQLPGIFKEAVELTVVIMFLIGTSAMLSLVMSFTGIPSAISSAILALTDNPILILLLINVILLLIGIVMDVTPAILIFTPIFLPVVMEFGMDPVHFGVILIVNLCIGNITPPGGSALFVGSTIGKVKIEEVIRPLLPFYGAVIVVLMLVTMFPFLSTWLPTLAGLME

SEQ ID NO: 56311 - DNA, 1284 bp, Bacillus clausii KSM-K16
  CDS (1)..(1284)
atggatttaacgatcgctttaattatcatgtttgctctgatcatattgaatattcctgtagcctacgccattattgccggctgcgcctactactttatcatgaatgatagcttcacccatgaaatcttaatccaacgaatgatgagtggcgtagaatcctttcctctccttgcgatcgttttctttataacagcagggattctgatgaactataccggaattacggaaagaatgcttaactttgcccaagtcatgactggccatatgacaggtgggctagcgaaagtcaacgtattgctcagtgtgctgatgggaggtttatcggggtctaatatcgcggatgcggccatgcagtccaaagtacttgtgccgcaaatgacgaagcgcaattatccgcctgctttctcgactgtattaacagcggcaacgtctctgattacaccgatcattccaccagggatagccttaattatgtacggttatatcgggaacgtgtctattggcaacctgtttttagctggcattgtaccgggtttaatgcttagtgtgattttcttaatacttgttcattttattgctaaaaagagaggctttgaaacagaaaaaaagccagcggctaaaccaaaagagatgctcattgcttctaaggatgcagcgtttgctattttgttgccgattatcattattggtggaattcgctttggcgtgttcagcccaacggaggccggagcgattgccgttatttatgctcttattttagggttttttatttatcgccagatgaagggcaatcagctcgttaccgctttaaaagaatcggtcaatttaacggccacgatcatgatcattattgcggcgggaacggccttcggctggattttaacgctggagcagattccacagcaactaactggcacggtaaccaattttatcgagagccctgctctgtttttattagtcattatggtctttttactcgtagtaggcatgtttattgaaggcaacgttttacttattatactaacacctatctttatgcctatgattcaaacattcggtatagatcctgtgcattttgggcttttctttattctttgccttagtgttggaacgatcactcctcctatcgggacgattatgtttacgacaacggcaattactaaagtgaaaattgaagattttattaaagaggcatggcctttttatattgttttaatcattgcgattttgcttgttgcctatttcccagcaatttccctatggctgccttctctgttctcctaa

SEQ ID NO: 56312 - protein, 427 aa, Bacillus clausii KSM-K16
MDLTIALIIMFALIILNIPVAYAIIAGCAYYFIMNDSFTHEILIQRMMSGVESFPLLAIVFFITAGILMNYTGITERMLNFAQVMTGHMTGGLAKVNVLLSVLMGGLSGSNIADAAMQSKVLVPQMTKRNYPPAFSTVLTAATSLITPIIPPGIALIMYGYIGNVSIGNLFLAGIVPGLMLSVIFLILVHFIAKKRGFETEKKPAAKPKEMLIASKDAAFAILLPIIIIGGIRFGVFSPTEAGAIAVIYALILGFFIYRQMKGNQLVTALKESVNLTATIMIIIAAGTAFGWILTLEQIPQQLTGTVTNFIESPALFLLVIMVFLLVVGMFIEGNVLLIILTPIFMPMIQTFGIDPVHFGLFFILCLSVGTITPPIGTIMFTTTAITKVKIEDFIKEAWPFYIVLIIAILLVAYFPAISLWLPSLFS

SEQ ID NO: 56313 - DNA, 1305 bp, Bacillus clausii KSM-K16
  CDS (1)..(1305)
atggatatagcaatattatcggtattacttctttttggaatattcttctttcttcttgcgataggtgttccaatatcaataagcattggtctatcctctattgtatctgttatggtagctacgccgttagacgtgatcctttatacgagtgcgcaacgtttattttctggaatgaacagttttgcgttattagctatcgtcttttttattatgtcaggaagcattatgaataatggaggaatcgcattacgattaattaatttagcaaagttgattgcaggaaggttacctggatcattggcacatacaaatgtagttgggaatatgctttttggctctatttcagggtcagcagtggcttctgcggcagcaattggcagtgttatggctcctttgcagaagaaagaaggctatgacaaaggtttttcggcagctgtaaatataacttcttcaccagtgggcattttgatcccccctagtggtgtattaatcctctattcattagtcagtggaggaacttctgtttctgcattattcatggctggatatttgcctggcattttgatgggattaacagttatgatcgttgcttactttattgctaaaaaaaatcattatacgatttctgaaaaaataggtctaaaagaggcaaacagaatcatcatacaatcaattcctagtttactattgattgttattgtgattggtggaattgtagcaggcatttttactgctacagaaggtgccgcagttgcggttctatattctttaattctttcattgatttatcgctccttaacgtgggcccatattcctaaaattttcaaggaaacaattgtgatgacaggaattgttttatttttagttgctgtctcttctatcatgtcatgggcaatggcattaacaggcatgccggcagctattagtaacgggcttttaagtatctcagataatcgctatattgtattgttgattatgatgttgattttattagttgttggcatttttatggacctcacgccagcagtactcatttttacacctattttcttgccgattgttgtgcaaatgggggtagaccctgtccattttggaatcatgcttgtatttaatctggctattggtgctatgacaccaccggtagggagtgttttatttataggttgtagcgtagggaaagtgtccattgaagaagtgataaaacctttgagctatttctttatagcgcttgttgcagcattatttatagtggtttatatcccttccattagtctaattatccctaaactttttaacctgttataa

SEQ ID NO: 56314 - protein, 434 aa, Bacillus clausii KSM-K16
MDIAILSVLLLFGIFFFLLAIGVPISISIGLSSIVSVMVATPLDVILYTSAQRLFSGMNSFALLAIVFFIMSGSIMNNGGIALRLINLAKLIAGRLPGSLAHTNVVGNMLFGSISGSAVASAAAIGSVMAPLQKKEGYDKGFSAAVNITSSPVGILIPPSGVLILYSLVSGGTSVSALFMAGYLPGILMGLTVMIVAYFIAKKNHYTISEKIGLKEANRIIIQSIPSLLLIVIVIGGIVAGIFTATEGAAVAVLYSLILSLIYRSLTWAHIPKIFKETIVMTGIVLFLVAVSSIMSWAMALTGMPAAISNGLLSISDNRYIVLLIMMLILLVVGIFMDLTPAVLIFTPIFLPIVVQMGVDPVHFGIMLVFNLAIGAMTPPVGSVLFIGCSVGKVSIEEVIKPLSYFFIALVAALFIVVYIPSISLIIPKLFNLL

SEQ ID NO: 56315 - DNA, 1284 bp, Bacillus clausii KSM-K16
  CDS (1)..(1284)
atgatcggcctctttttagtgctgttgtttattgtgctcttgtttttaggggtacccattgcgtttacgcttgggattgtcgcttttgtaggcatctggcttctcgatgccatgccgttgcaaattgttgtacagacgatgtttgctggtgtggaatcgtttattctactggcagtgcctctctttattttagcggcaaacattatgaaccaagggcaaatttcagagcgtttaatccaattggcggtttcaatggtcggccacattcgcggcggtctcgctcaagctaatattgtggtgtcgatgttttttggcggcatctctggttctgcacaggcagacacagctggcatcggaaaaattttgattccaagcatgatgaaggaaggctatagcaagtcaaccgccgtcggtacaacagcggcatcttccacaatgggcttgctgattccgccaagcatcccaatggtcgtgtatggcagtgtgacaagtgtttctgtcgggcaaatgtttatcggcggcattattcctggccttttaatgggcgtggcgatgatggctcttgttgccttcgtttctcgtaggcaaaactatccccgccatgagcgtgttaaactcgctgaaattggccggcaatttctaaagtgcgtgccgcctttattgacgcctttgattattttagggggaatcgtcggtgggtttgttacgccgacagaagcggccattattgcctgcttgtatgcgctcattttagcgatgttcgtctacaaaaccattaaatggaaggacatgccggaaattatatttgatacgatccgtctaagttctcttacgctgtttgcgttggcgacagcaagcgctcttgggcggttatttagctactaccgtgtacctgatgcgattgccggattttttgattcgacattttcaagtgctggcctgttcttgcttgctgtcattttattgtttctctttgtcggcatgtttttagatgccattccagcaatgattttgtttgtgccaatcgtccttccagcgtcacaaacacttggtatcgatccgattcattttgggattgtcatcgtgatgtgcttggccgttggcatgattacgccgccttatggcctatgtatgctgttggcaagttcaatagcgaaattgtctgttagccgttcagtagttgctttattgccttatgtagcggtcatccttgtggcgattttaattgttgcgtttgtgccggctgtggcgttatggctgccaagtttattaaatgaatactag

SEQ ID NO: 56316 - protein, 427 aa, Bacillus clausii KSM-K16
MIGLFLVLLFIVLLFLGVPIAFTLGIVAFVGIWLLDAMPLQIVVQTMFAGVESFILLAVPLFILAANIMNQGQISERLIQLAVSMVGHIRGGLAQANIVVSMFFGGISGSAQADTAGIGKILIPSMMKEGYSKSTAVGTTAASSTMGLLIPPSIPMVVYGSVTSVSVGQMFIGGIIPGLLMGVAMMALVAFVSRRQNYPRHERVKLAEIGRQFLKCVPPLLTPLIILGGIVGGFVTPTEAAIIACLYALILAMFVYKTIKWKDMPEIIFDTIRLSSLTLFALATASALGRLFSYYRVPDAIAGFFDSTFSSAGLFLLAVILLFLFVGMFLDAIPAMILFVPIVLPASQTLGIDPIHFGIVIVMCLAVGMITPPYGLCMLLASSIAKLSVSRSVVALLPYVAVILVAILIVAFVPAVALWLPSLLNEY

SEQ ID NO: 56317 - DNA, 1332 bp, Bacillus clausii KSM-K16
  CDS (1)..(1332)
atgttatcggcgttgctctttgtattgttcttctgtttgttgttgatccacgtgcctgttgcctttgcattaggtgtatcagctttggtcattctcgtgttgggctcggggttttcgtcgttggcgcttctccctagcattatgtattcctccatttcttcatttacgttattggcaattccgtttttcgtgttagctggcgtcattatgagctattcgggcatttctaaacggcttgttgactttgcctacctttgttttggccacaagaaaaacggcatcgtcatcgtcgccattgtcgctgcgttgtttttctcggctatttctggctcagggccggcgacggttgccgcaatgggcgcgatcctcatccctgcccttgttaagaatggctttaacaaaaatagtgcttcggcgttgattgccagttcaggcgcattagggattattttgccgccaagcattgcctttatcatttttggcgtcatagccaatgactttgttggcatctcgattagccgcctgtttgtcgcaggcatcataccgggccttttacttgctgccggtcttctcgttgctagcatttttgcaagtaagcgcgtttctcacttgcaaacagctagcaagcgcccagatgaagcggcagccagcgtggaacgcgcctctttggcagcaattttgaaagcgttttaccgagcgcttttcgggttgcttgtccctgtcatcattatgggcggtatctattcaggcatgtttacgccaacggaggctgccgttgtcgcggtgttttatgcactgctcgtcggcggggtgttttaccgagaaataaaactgaaacatctcggccgaattttagtcgattcgtctgtacaatcagcggtcattatgttcattattggcgctgcttcattgttctcttatctcgtgacgacgcaacatgtagcggaagggatgacgcaagctgtgctagggatgacggaaaaccgcgtcctcctattgcttctgacagccgtgattttgttggtgattggcgcgtttatagacgccatttccgcattttatatctttgtaccgattttgatgccgattttgcttgaagtcggcgttgacccgactacgattggcgtgctcatgacggtcgcattggcaattggcctgtttacgccacctgtcggattgaatttgtttgtggccagtggcatttctggtgtgccatctgaacaaattgtaaggggaattggtccttttctagtttcttctattgttgtgttgctcatcgtcatgtatgttccagctgtatccaattggttgccagatttattgaatctttaa

SEQ ID NO: 56318 - protein, 443 aa, Bacillus clausii KSM-K16
MLSALLFVLFFCLLLIHVPVAFALGVSALVILVLGSGFSSLALLPSIMYSSISSFTLLAIPFFVLAGVIMSYSGISKRLVDFAYLCFGHKKNGIVIVAIVAALFFSAISGSGPATVAAMGAILIPALVKNGFNKNSASALIASSGALGIILPPSIAFIIFGVIANDFVGISISRLFVAGIIPGLLLAAGLLVASIFASKRVSHLQTASKRPDEAAASVERASLAAILKAFYRALFGLLVPVIIMGGIYSGMFTPTEAAVVAVFYALLVGGVFYREIKLKHLGRILVDSSVQSAVIMFIIGAASLFSYLVTTQHVAEGMTQAVLGMTENRVLLLLLTAVILLVIGAFIDAISAFYIFVPILMPILLEVGVDPTTIGVLMTVALAIGLFTPPVGLNLFVASGISGVPSEQIVRGIGPFLVSSIVVLLIVMYVPAVSNWLPDLLNL

SEQ ID NO: 56319 - DNA, 1272 bp, Bacillus clausii KSM-K16
  CDS (1)..(1272)
atgtcgttattattagtcgggttgttcttattttttattatggcagggattccaattgcgtttagccttggcctgtcttcgttgatttatttgcttatcgccggcattcctttgacgatcattccccaaacgatgctgtccgggatcaattcatttgtgttgctcgccattccagcctttattcttgctggaaatttaatgaacgcaggaggaatcaccacaaggatcattgattttgccaatgccgttgttggccacatccgcggcgggctggcgttaacgaatgtcgcttcttcacttgggtttgcgggcatttcaggtacggcattgtccgacacagccagcattggctcagtaatgattccggcgatgaaaaagcaagggtatggcgccggtttttccgctgcggttacgtcgatttcctcaactgttggcccgatgcttccgccatctttgccaatgatcattattggtactctcgccagcgtctcgattggcgatttgtttcttgctggtgctattcctggcattctattggcgatcggctttttagtcgttacgtatatcatttctgtgaagcgcggttatccaaagggagaacggcagccgtttaaaacagtcgtcacgtcattttttggcgccttctgggcgttgtttatggtctttatcattttatggggcattcttggcggctattttacgccaacagaagcagcggtcgtttgtgtgctgtacgcattggtcgtcggcggttttgtttatcgcgagcttaactttaaagaagtgccagggctgcttgtcagcacactgcgatcgacgtcttcgattttgttgcttgttggtttcgccaatctatttggctggattttggtatcggaaggtgtgcctgtattaatcgcaaatgggattttgtcgattacagaaaacccgattcttgtcattctccttatcattcttttattgcttgtgatcggcatgtttatggaaacgattgcagctcttgtcatcttattccctgtcttattgcctgtcgctacaagcgtcgggatggaccctgtccattttggcgtagtgatggtattgacattgatgattggtttgtccactccgccagtaggcgtctgtttgtttgtggcttctagctttgcgaaagtgccaatcggcaaaacggttaaagaactggtgccatactttgcaattgccatcgtcgtcttgctggttgtcgcctatattcctcaactatctttattcttgcctagtttgtttgaatga

SEQ ID NO: 56320 - protein, 423 aa, Bacillus clausii KSM-K16
MSLLLVGLFLFFIMAGIPIAFSLGLSSLIYLLIAGIPLTIIPQTMLSGINSFVLLAIPAFILAGNLMNAGGITTRIIDFANAVVGHIRGGLALTNVASSLGFAGISGTALSDTASIGSVMIPAMKKQGYGAGFSAAVTSISSTVGPMLPPSLPMIIIGTLASVSIGDLFLAGAIPGILLAIGFLVVTYIISVKRGYPKGERQPFKTVVTSFFGAFWALFMVFIILWGILGGYFTPTEAAVVCVLYALVVGGFVYRELNFKEVPGLLVSTLRSTSSILLLVGFANLFGWILVSEGVPVLIANGILSITENPILVILLIILLLLVIGMFMETIAALVILFPVLLPVATSVGMDPVHFGVVMVLTLMIGLSTPPVGVCLFVASSFAKVPIGKTVKELVPYFAIAIVVLLVVAYIPQLSLFLPSLFE

SEQ ID NO: 56321 - DNA, 1275 bp, Bacillus clausii KSM-K16
  CDS (1)..(1275)
atgatcatcgttttacttgtatcgttactcgtcctcttctttatcggcgtgccagtagcgattgcgctcggtttatcgacgagtatggccatgattgtagcaggcgatgttcctttattaacgcttgcacaacgagcgtttgtatcactcgattcgtttccgttgctggcgattccattatttattttggctggcgtcatcatggaatacggcggcatttcgcaacgacttattaacctcgccaatgcccttactggccatttaacaggaggactagccgttgttacggttgtgacaacaatgttttttgccgccatatcaggctcaagtgtcgctgccactgccgctttaggggcaattttagtgcctgcgatgattagcagagggtacgaaaaagaattttcaggaggcgtgcaagctgtatcagggacacttggcattattatgccgccgagcatcccattgattttgtatggcacagcagtcggggcatcgattggcgacttgtttattgctggaatggtccctggcatccttattggcattggtctaattgtaactgtttatataattgccaaaaaacggaactatgcaaaagaagacaagaaaagtggaaaagaaatcggtacagcgtttgtaaaagcgattccggcactgattatgcctgtaatcattttaggcggtatttatacaggtgtgtttacggcaacggaggctgccggtgtagctgttgcctacgcctttattgtaggggtgtttgtctatagggcgatcacgtttacgaaaatcaaaatgattttgtcacaagcatcgataacgacggcaaccattatgcttattttggcgacagcgggcttgtttagttggattttaacgattgagaatgtaccgcagcaagtggcaagcgtcattacgtcaatttccgaaaatccatgggtatttctcggtatcgttgttctattgctcctcctcgtaggcatgtttatggaaacaaatgcatcgattattattttggcgccgattcttgtgccagtggcatcggaattagggattgaccctgttcacttcggcatcgtcatgattgtcacacttgccatcggcatggtcacgccgccacttgggctcaatctctttgttgtatcaaaaatcgccaacttaaggatggatcggttaacgattagcctcatccccttttatatcactatattgatctgtttattgattgttacgtttattccgtctctcaccatgaccgttgtagagtggatgaaataa

SEQ ID NO: 56322 - protein, 424 aa, Bacillus clausii KSM-K16
MIIVLLVSLLVLFFIGVPVAIALGLSTSMAMIVAGDVPLLTLAQRAFVSLDSFPLLAIPLFILAGVIMEYGGISQRLINLANALTGHLTGGLAVVTVVTTMFFAAISGSSVAATAALGAILVPAMISRGYEKEFSGGVQAVSGTLGIIMPPSIPLILYGTAVGASIGDLFIAGMVPGILIGIGLIVTVYIIAKKRNYAKEDKKSGKEIGTAFVKAIPALIMPVIILGGIYTGVFTATEAAGVAVAYAFIVGVFVYRAITFTKIKMILSQASITTATIMLILATAGLFSWILTIENVPQQVASVITSISENPWVFLGIVVLLLLLVGMFMETNASIIILAPILVPVASELGIDPVHFGIVMIVTLAIGMVTPPLGLNLFVVSKIANLRMDRLTISLIPFYITILICLLIVTFIPSLTMTVVEWMK

SEQ ID NO: 56323 - DNA, 1161 bp, Rhodobacter sphaeroides 2.4.1
  CDS (1)..(1161)
atgccgctgcccatcgcggtgcagcgcatcatctcgcccacgcagaacacctctctgctggccattcccttcttcgtgctgctgggcacgctgctcggcaccacggggatcgccgggcgcctgctgaagctcgccgacctgatggtcgggcggctcaccggcgggctcgggcataccaatgtcatgctgtccacgctgatgggcgggatctcggcctcgaacctcgccgatgcggcgatgatgtgccggatcctcgtgcccgagatgcgccgtcagggctacagcgccggggccgccgccgccatcaccgcctgcggctcgctcatcacgccgatcatcccgccggggatcgcgctcatcatctatgcgctggtggccgacgtctccatcggcgcgatgttcaccgcgggcatcctgcccggcctcatgtgcgcggccctgctgctcttcgccgtctggctcaatgcccgcagccggggcctcaagccctcgcgcgacagctggcccaccgcgcaggagacgcgccagacgatcgtcggcgcctggcctgcgctctttctcgtgctggtgatcgtgggcggtatccgcctgtcgatcttcacccccacggaagcgggcgccgtggccaccctcgtgaccctcgccatcggcctgttcctctaccgcgagatgaagctcgccgatgtgggcgcggccttcgccgagacggcgcggcagacgtcggcggtgctcctcgtcatcatgacctcctcggccctcgcctggatcttctcgatggagcgcgcgggcatcacgatggccgagctcatcaccaatctcaccaccaacccctggctcttcctgctggccgtgaacctgatgctcctcgtgctcggcatgttcatcgagggcacggcgctgatgatcatcctcgtgccgctcctgaagcccgtggtccagcagctcggcatcgacccggtgcatttcgggatcgtgctgatcctgaacctttcgatcggcacgctgacaccgccggtgggaacggttctccttctggtcacgaacctcacgggcgcgaagctcgcggagtttctgcgcgacggctggccgttcctgctcgcgcttgtggtggcgctcctccttgtgaccttcgtgccggccatctcgctggcgctggtctga

SEQ ID NO: 56324 - protein, 386 aa, Rhodobacter sphaeroides 2.4.1
MPLPIAVQRIISPTQNTSLLAIPFFVLLGTLLGTTGIAGRLLKLADLMVGRLTGGLGHTNVMLSTLMGGISASNLADAAMMCRILVPEMRRQGYSAGAAAAITACGSLITPIIPPGIALIIYALVADVSIGAMFTAGILPGLMCAALLLFAVWLNARSRGLKPSRDSWPTAQETRQTIVGAWPALFLVLVIVGGIRLSIFTPTEAGAVATLVTLAIGLFLYREMKLADVGAAFAETARQTSAVLLVIMTSSALAWIFSMERAGITMAELITNLTTNPWLFLLAVNLMLLVLGMFIEGTALMIILVPLLKPVVQQLGIDPVHFGIVLILNLSIGTLTPPVGTVLLLVTNLTGAKLAEFLRDGWPFLLALVVALLLVTFVPAISLALV

SEQ ID NO: 56325 - DNA, 1326 bp, Rhodobacter sphaeroides 2.4.1
  CDS (1)..(1326)
atgaacgcagccctcatcttcggcggtctcatcgccctcatgctgaccggcatgccgatctcgatcgcgctcggcctgacggttctgaccttcctcttcaccatgacggccgtgccgatcgacacggtggcgctgaagctcttcaccggcatcgagaagttcgagatcatggcgatcccgttcttcatcctcgcggggaacttcctgacccacggcggggtggcgcggcggatgatcgccttcgccacctcgatggtgggccactggcacgggggcctcggcctcggcggcgtcttcgcctgcgccctcttcgccgccgtctcgggctcttcgcccgcgaccgtggtggccatcggctcggtcatcctgcccgccatggtggcgcagggcttccccacccgcttcggcgcgggcgtcatcaccacgagcggcgcgctcggcatcctgatcccgccgtccatcgtgatggtgatgtattgcgtggccacctcggggatgatggtcgaggggccggacggcaccatcgtcgatgcggcctcggtgggcgagatgttcatcgcgggcgtgatcccggggatcatgctggcgggcgcgctcgccctcaccacctggtatcgggcctggaagaacgactatccccgcctgccgaaggccagctggggcgaacgctggcaggccttccgccgggcgatctggggcctcctgctcatcgtgatcgtgatgggcggcatctataccggcaccttcacccccaccgaagccgccgccatgagcgccgtctatgccttcgtgatcgcggtcttcgtctacaaggacatggggctcagggacgtgccgcgggtgctgctcgcctcggccaacatgtcggcgatgctgctctacatcatcaccaatgcggtgctgttcagcttcctgctcacgcacgagaacatcccgcaggcgctcggccagtggatggtggattcgggcctgacctggtggatgttcctcatcgcggtgaacatcatcctgctcgcggccggcaacttcatggagccctcctccatcgtgctcatcatggcgccgatcctgttcccggtggccgtgcggctcgggatcgacccggtgcatttcgggatcatgatcatcgtgaacatggaggtcggcatgtgccacccgcccgtggggctgaacctctatgtggcctcgggcatcaccaagatgggcatcaccgagctcaccatcgcggtctggccgtggctgctgacgatgctggccttcctcctgctcgtgacctacgtcccgcagatctcgctcttcctgccgcatctgctgggcatgcgctga

SEQ ID NO: 56326 - protein, 441 aa, Rhodobacter sphaeroides 2.4.1
MNAALIFGGLIALMLTGMPISIALGLTVLTFLFTMTAVPIDTVALKLFTGIEKFEIMAIPFFILAGNFLTHGGVARRMIAFATSMVGHWHGGLGLGGVFACALFAAVSGSSPATVVAIGSVILPAMVAQGFPTRFGAGVITTSGALGILIPPSIVMVMYCVATSGMMVEGPDGTIVDAASVGEMFIAGVIPGIMLAGALALTTWYRAWKNDYPRLPKASWGERWQAFRRAIWGLLLIVIVMGGIYTGTFTPTEAAAMSAVYAFVIAVFVYKDMGLRDVPRVLLASANMSAMLLYIITNAVLFSFLLTHENIPQALGQWMVDSGLTWWMFLIAVNIILLAAGNFMEPSSIVLIMAPILFPVAVRLGIDPVHFGIMIIVNMEVGMCHPPVGLNLYVASGITKMGITELTIAVWPWLLTMLAFLLLVTYVPQISLFLPHLLGMR

SEQ ID NO: 56327 - DNA, 1341 bp, Rhodobacter sphaeroides 2.4.1
  CDS (1)..(1341)
atggacggccttttgatcgaaatcctgttcggggccttcttcgccctcatgcttctcggcgcgccgatcaccgtggcgctcggcgtctcggcgctggccgccatggtctatctgggcgacaacccgatcaagatggtgcagatggcctggtcctcggtggggtccttcccgctgatggcgctgccctccttcatcctcgccggcgcgctgatggaggccgcgggcctgtcgcggcggctcattgcggtggccgaaagcctcgccggtcccttcacggggggcctgtcggccgcgacgatcatggcctgcctcttcttcggcgcgatctcgggctcgggtccggccaccacggcggcggtggggatgctgatgatcccggccatgtcgcggcagggctacgggccgggctatgcggcctcggtcacggcggcggcgggcgggctcgggatcatcatcccgccctcgatcccgatggtgatcttcggcatctcggccatggggctcgccccgccgcccgaggccatcgcggcgcacggtcccttccagtcggtctcgatctcgaagctcttcatcgcgggcttcgtgccgggggtcatcatggcgggcgggctccttgtgatgaactacatccgctgccggatgcggggtttccgcggctcggccgcgccgctctcggcccgcaacgtggcccgcgcctgctatcagggcttctgggcgctgctcgccccggtcgtgatcctcggcggcatctattcgggcttcttcacccccaccgaggccgccatcgtcgcgatcttctacacgctcttcgtcgggatcttcatctaccgcgagctggatctggccgaggtcatcaaggcgctcgacacgaccacctggctggcggggcgggtgctgctcgtgctcttcgcggccacgatcttcggccgggtgctggtcgagaacaacattccgggcatcatcgcgggcggcgttctggggcttaccaccaacatccatgcgatctgggccatggtgatcgggatgctgctcatcgtcggcatgttcatggagacgctggccgccatcatgatcctcgtgccggtgatgctgcccgtggcctacatggtgggcatcgacccgatccacttcgggatcgtgatgatctgcacgctctctgtcggcttccagaccccgccgctcggcgagaacctcttcatcgcctcgggcatctcgggcgtctcgatcgagcggatcagcctgcgcgcgctgcccttcgcggccgcgtcggtcaccgcaatcttcatcatcgccagcttccccgagcttgccctctggctgccccgggcgatgggctactag

SEQ ID NO: 56328 - protein, 446 aa, Rhodobacter sphaeroides 2.4.1
MDGLLIEILFGAFFALMLLGAPITVALGVSALAAMVYLGDNPIKMVQMAWSSVGSFPLMALPSFILAGALMEAAGLSRRLIAVAESLAGPFTGGLSAATIMACLFFGAISGSGPATTAAVGMLMIPAMSRQGYGPGYAASVTAAAGGLGIIIPPSIPMVIFGISAMGLAPPPEAIAAHGPFQSVSISKLFIAGFVPGVIMAGGLLVMNYIRCRMRGFRGSAAPLSARNVARACYQGFWALLAPVVILGGIYSGFFTPTEAAIVAIFYTLFVGIFIYRELDLAEVIKALDTTTWLAGRVLLVLFAATIFGRVLVENNIPGIIAGGVLGLTTNIHAIWAMVIGMLLIVGMFMETLAAIMILVPVMLPVAYMVGIDPIHFGIVMICTLSVGFQTPPLGENLFIASGISGVSIERISLRALPFAAASVTAIFIIASFPELALWLPRAMGY

SEQ ID NO: 56329 - DNA, 1329 bp, Magnetospirillum magnetotacticum MS-1
  CDS (1)..(1329)
atgagcggcaccacgctgggcctcgtcgccttcggcattctgctcttgatgctggtggtgcgcatccatatcggcgtcgccatgttcctggccgccaccggcatctacatggtgctgaaccacggcgagttgaacgcgctgctgttcacgctcaacaatctggtctacgcccggctgtccaattacgacctggcagtgattccgctgttcatcctgatgggccagttcgccacccatggcgggctgtccaaggcgctgttccatgccgcgggcaccctgatcggccatttccggggcggactggcctatgccgccaccgcagcctgtgccgccttcggggccatctgcggctcgtcgctcgccaccgccgccaccatgggtcaggtggccctgcccgaactgacgcgccggaactattccggacgcctcgccaccggcaccctggcggcgggcggcacgctgggcatcctgatcccgccctcggttcccctggtgatctatgccgtgctgacccaggaaagcatcggcaagctgttcgtggccgccgtcattcccggcatcgtcgcggcgctgggctatatggcggtgatccgcatcatcgtcaccttcgatcccaaggcgggtcccgccagcgagcgggtctcgatcaaggagatgctgaaggcacaggtgggcatcctgcccgtgctgctggtcttcctggtggtgatcgtcggcatctatggcggctgggccaatcccaccgaagccgcctccatcggcgcggcggcctgcggcatcattgccgtggtctcgggcggcatgcgcttcaaggacctgaagcagagcatcttcggcaccgccatcgccaccgccatgatcttcatggtgctgatcggcgccgatcttctgaactcggccctggcgctcacccagatgcccaccgaactggctaattgggtgaagaacagcggcatgccgcccgtgggcgtgctgttcaccatcatcgccatctatgtgctgctgggttgtgtcatggactctctcgccatgatcctgctcaccatcccgatcttctatccggtggtgctgggcctggatttctacggcatgagcatcgaggacaagtccatctggttcggcatcgtcgccctgatggtggtcgagatcggcctggtccatccgccggtgggcatgaatctctacgtcatcaacaagatcgccaaggacgtgcccttgaaggagaccgcgatgggtgtgctgcccttcctggcttcggacttcatccgcatcctggtcctggtgttcttcccgccgctggccctgtggctggtccacgtcacaggctga

SEQ ID NO: 56330 - protein, 442 aa, Magnetospirillum magnetotacticum MS-1
MSGTTLGLVAFGILLLMLVVRIHIGVAMFLAATGIYMVLNHGELNALLFTLNNLVYARLSNYDLAVIPLFILMGQFATHGGLSKALFHAAGTLIGHFRGGLAYAATAACAAFGAICGSSLATAATMGQVALPELTRRNYSGRLATGTLAAGGTLGILIPPSVPLVIYAVLTQESIGKLFVAAVIPGIVAALGYMAVIRIIVTFDPKAGPASERVSIKEMLKAQVGILPVLLVFLVVIVGIYGGWANPTEAASIGAAACGIIAVVSGGMRFKDLKQSIFGTAIATAMIFMVLIGADLLNSALALTQMPTELANWVKNSGMPPVGVLFTIIAIYVLLGCVMDSLAMILLTIPIFYPVVLGLDFYGMSIEDKSIWFGIVALMVVEIGLVHPPVGMNLYVINKIAKDVPLKETAMGVLPFLASDFIRILVLVFFPPLALWLVHVTG

SEQ ID NO: 56331 - DNA, 1284 bp, Azotobacter vinelandii
  CDS (1)..(1284)
atgaccatcctgttcctcttcctcgccctgttcctgctgatgttcatcggcgtgccgatcgccatcgccctgggcctgtccggctcgctgaccatcatgctgttcagccccgactcggtgcgctcgctggcgatcaagctgttcgagacctccgagcactacaccctgctggcgatccccttcttcctgctggccggcgccttcatgaccaccggcggcgtggcgcgccggctgatcgacttcgccaacgcctgcgtcgggcacatccgcggcggcctggcgatcggcgcggtgctcgcctgcatgctgttcgccgcgctgtccggctccagtccggccacggtggcggcggtcggctccatcgccatcgccggcatggtgcgctcgggctacccgcaggccttcggcgccggcatcgtctgcaacgccgggaccctcggcatcctgatcccgccgtcggtggtgatggtggtctacgccgccgccacggaaagctcggtcggcaagctgttcatggccggagtgctgccgggcatcctgctcggcgtggtgctgatggtggcgatctatatcgtcgcggcgaagaaacacctgccggccctgccgcgggcgaccccgagcgaatggctttccgccgcgcgcaaggcgatctggggcctgctcctgatggcgatcatcctcggcggcatctactcgggcatgttcacccccaccgaggcggcggcggtggcggcggtctacgcggccttcgtcgcgctgttcgtctacaaggacatgcgcttgcgcgaggtgcccagggtgctattggagtcgggcaagctgtcgatcatgctgatgttcatcatcgccaacgcgatgctcttcgcccatgtgctgaccaccgagcagatcccgcagaccatcaccgcctgggtgatcgggatgggcctgtcgccgtggatgttcctgctggtggtgaacctggtgttgctggtcgccggtgccttcatggagccctcggcgatcatcctgatcctcgcgccgatcctcttccccatcgccatgcgcctgggcatcgacccgatccacctgggtatcgtcatggtggtgaacatggagatcggcctgatcaccccgccggtggggctgaacctgttcgtcgcctcggcggtgaccggcatgagcgtcggccaggtgatccatgccgcgctgccctggctgctgatactgctgggctttctgctggtcatcacctacgtgccggccatttccctggccctgccgaactggctggggatgggctga

SEQ ID NO: 56332 - protein, 427 aa, Azotobacter vinelandii
MTILFLFLALFLLMFIGVPIAIALGLSGSLTIMLFSPDSVRSLAIKLFETSEHYTLLAIPFFLLAGAFMTTGGVARRLIDFANACVGHIRGGLAIGAVLACMLFAALSGSSPATVAAVGSIAIAGMVRSGYPQAFGAGIVCNAGTLGILIPPSVVMVVYAAATESSVGKLFMAGVLPGILLGVVLMVAIYIVAAKKHLPALPRATPSEWLSAARKAIWGLLLMAIILGGIYSGMFTPTEAAAVAAVYAAFVALFVYKDMRLREVPRVLLESGKLSIMLMFIIANAMLFAHVLTTEQIPQTITAWVIGMGLSPWMFLLVVNLVLLVAGAFMEPSAIILILAPILFPIAMRLGIDPIHLGIVMVVNMEIGLITPPVGLNLFVASAVTGMSVGQVIHAALPWLLILLGFLLVITYVPAISLALPNWLGMG

SEQ ID NO: 56333 - DNA, 1782 bp, Desulfitobacterium hafniense DCB-2
  CDS (1)..(1782)
atgctggcgattattatgctgattacctatcaaactctttatcgttatatcgtttccaatatcaccggcggtacggccattgtgggcttagaagaattagcgcgctttattttcatatggatcacctatttggcgatcccgctggccattaaagggcgcaataatatcagggtcgatattctctatgaccggatttccgaccggtggcagaaaatcagctggatcatggtcgacagctgcatcctcgtcttaacgggtgtgatattctttatggggatcgatcatctgcagatgatgctaaactatcctcagacttccccggcgctcaatatccccttcttttttccctacttaatcctacccattggttttggcttaatgtccatccggtgtatccaggacttggtcaagcaggcgttggaaattggccttaaggataccttgatcggggttttggttacggcggcaattttttctcccctcttcttaaagcccgatgttccggccatggcttggctttttggctattttgtgctttttatctttattggggtgcccattgccatggccttaggcctttccgctttagggacgattctctgtgccaatacgatgcccatcgagtatatatcacaaatttcctttacctccattgatagttttccgattatggccattcccttttttgtggcggcaggtgtcttcatgggggaagggggattatccaagcggctcttaggcctggctgatgaactcctggggtcctttaccgggggcctggccttggctacggttgtcacctgtatgttttttgcggcgatcagcggctcggggccggctacggtagctgccatcggctccctgaccattccggccatggtggaaagagggtattcccgggcctttgcggcggcacttgtggcagcggccggctccatcggggtgatgattcctcccagcaacccctttgtcgtttatggtgtttccgctcaggtctccattggcaaactctttatgggcgggattgttcccggcttgatcattggtttggttttaatgggcatcagttactactattccaaaaagaacggctggaaaggcgaagcccgcaaacgtacctttcgtacagtgggcaaggctttttgggaggccaagtgggccttgatggttccggtgataattttaggcgggatttattccgggtacatgacccctaccgaatcggcggctgtggcagccttttatggactgatcgtcggtgttttcatccacaaagggattaaccgcaagaatattgtctattgcttcacggaatcctgcagtacctccgccgtcattattgccttgatggccatggccacgatcttcggtaatattttgacgattgaacagattcccaccaaaatcgccacctggatgctggcgataaccgacagcaaatacgttattctcctgatcattaccctattgctgctcttcgtgggaaccttcatggaagctttggcggcgattgttattcttaccccgattttactgccgattgtccttcaggtgggtatcgatccgattcacttcggaatcattatggtggtcaacctggcgatcggcttcattacaccaccggttggtgtgaacctgtttgtggcaagcggtttggcgaagctgaagatcgaagagatatccaaagcggtggtccccttcctcttaggcatgatcgccgtactgttgctgatttcttatgtgccttccatttccatgttcctgactcaatttgtgaagtaa

SEQ ID NO: 56334 - protein, 593 aa, Desulfitobacterium hafniense DCB-2
MLAIIMLITYQTLYRYIVSNITGGTAIVGLEELARFIFIWITYLAIPLAIKGRNNIRVDILYDRISDRWQKISWIMVDSCILVLTGVIFFMGIDHLQMMLNYPQTSPALNIPFFFPYLILPIGFGLMSIRCIQDLVKQALEIGLKDTLIGVLVTAAIFSPLFLKPDVPAMAWLFGYFVLFIFIGVPIAMALGLSALGTILCANTMPIEYISQISFTSIDSFPIMAIPFFVAAGVFMGEGGLSKRLLGLADELLGSFTGGLALATVVTCMFFAAISGSGPATVAAIGSLTIPAMVERGYSRAFAAALVAAAGSIGVMIPPSNPFVVYGVSAQVSIGKLFMGGIVPGLIIGLVLMGISYYYSKKNGWKGEARKRTFRTVGKAFWEAKWALMVPVIILGGIYSGYMTPTESAAVAAFYGLIVGVFIHKGINRKNIVYCFTESCSTSAVIIALMAMATIFGNILTIEQIPTKIATWMLAITDSKYVILLIITLLLLFVGTFMEALAAIVILTPILLPIVLQVGIDPIHFGIIMVVNLAIGFITPPVGVNLFVASGLAKLKIEEISKAVVPFLLGMIAVLLLISYVPSISMFLTQFVK

SEQ ID NO: 56335 - DNA, 1143 bp, Desulfitobacterium hafniense DCB-2
  CDS (1)..(1143)
atgtttgccggaatcaatacagcaccgctcatggcgatacccggatatgtactggcgggagtactcatgtcccggggaggggtatccaaatatctcatcgaatgtttaaaggcttggatcggtcatttgcctggtggactttccgtggtcacgattcttgcctgtacccttttcgccgcgatttccggttccagcccagccacagcggcggcgattggagctatcatgctgccggctatgttgaagggtggttatcctaaacgttatacaatgggcttgattgctgcctccggaaccttaggtatcctcattcctcccagtatccctttgatcgtgtacggggtgacttctgatacttccatcggcaagctatttatggccggcatcattccgggtctcatcctcgcttctactctggtgattatagccattgtttatgccaaaatacacggctatggacagacagagaaagcgacttggagcgagcgctggaaatccacgataagggctatacctgccagttttctgcctgttttaattctcggcagtatttatgcggggatttgtacacccacagaggcagctgttgtggcagttttctatactctaatcatctctctttttgtctataaggaattgcgtccgcaagattttcgcaaggttttggtggaaaccatcaatacaacctccatgattttcctgatcattgcggcagccatggtctttgctctattcctcaccaataatcaggtacccaataaggtggctgcttggatcggtgaatccagcgttaatatcttcgtcttcttcttacttacccagttaatgttctttgttatgggaaccttcttggaggcagtgtccattatcttgatcaccctgcctattttgcttccgattatgagaagtatcggcatcgatccaattcactttgctattgttatgacggtgaatatggagttggcaatgattacgccaccggtcggcctcaatctctttgtggtgagctctatggccaaagaaaaacttggggaagtggtcatgggggttcttcccttcatcttagtgatgattgtgatgctgattgtcctcgtggtattccccgagctttcacttatgttgccaacggctgtcatgaaataa

SEQ ID NO: 56336 - protein, 380 aa, Desulfitobacterium hafniense DCB-2
MFAGINTAPLMAIPGYVLAGVLMSRGGVSKYLIECLKAWIGHLPGGLSVVTILACTLFAAISGSSPATAAAIGAIMLPAMLKGGYPKRYTMGLIAASGTLGILIPPSIPLIVYGVTSDTSIGKLFMAGIIPGLILASTLVIIAIVYAKIHGYGQTEKATWSERWKSTIRAIPASFLPVLILGSIYAGICTPTEAAVVAVFYTLIISLFVYKELRPQDFRKVLVETINTTSMIFLIIAAAMVFALFLTNNQVPNKVAAWIGESSVNIFVFFLLTQLMFFVMGTFLEAVSIILITLPILLPIMRSIGIDPIHFAIVMTVNMELAMITPPVGLNLFVVSSMAKEKLGEVVMGVLPFILVMIVMLIVLVVFPELSLMLPTAVMK

SEQ ID NO: 56337 - DNA, 1281 bp, Haemophilus somnus 129PT
  CDS (1)..(1281)
atgacggttattatctttctttccactttattaggaggtattttattaggtattcctgtcgccttttctctgttattgtgcggtatagcattaatgttgtatttagacttatttgatgcacaaattttggcacaacaaatcgtgagtggtgcagatagtttctctttaatggcaattccattctttatcttagctggtgaaattatgaatgaagggggattatcaaaacggattattgatttgccgatgaaattagtaggacataaacgtggaggattaggttttgttgcaattcttgctgcgatgattatggcgagtttgtcaggttcggctgttgcggataccgctgcggtggcagcgatgctattacctatgatgaaaacaacaggttatccgttggatcgttcggctggtttgattggtacggctggtattattgcacctattatcccgccttctattccgtttattatctttggagtctctagtggtgtgtctattactaagctgtttctagcaggaatcgtaccgggaatcctaatgggaatttgtttagctgtcctatggtggtggcaagcaaagcaccttcgcttaatgactttttccaaggcaagaaaagaagaactttgtgtttcctttaaaaatagtatttgggcattaatgttacctgtaatcattattggtggtttccgttctggtatttttaccccaacagaagcaggtgctgttgcagcattttatgcattatttgtcgcactctttgtatataaggaattgaaaatcaagcaactttatcaagtttttctcgcggcggcaaaaacaactgcggtagttatgtttctcgttgccgctgctcaagttacaggttggttaatcacgattgctgaattaccacatatgatgacagcattgttagagccactaattgatacaccaactttattacttattgtcgtaatgctatttgtttttttgattggtatggtgatggatcttacgcctactgtattaattctcacaccggtattaatgccattggttgaggaagcaggaattaaccctatctattttggtgtgctctttattttgaatacttcaattggtttaattacgccaccggtaggtaatgtccttaatgtcattacaggtgtatctaaattgccatttgatcaagtgacaaagggcatacttccttatttattgatgatgattgtgttgctctttatctttattttcttccctgctttaattttaatgccacttaattggttacaactttaa

SEQ ID NO: 56338 - protein, 426 aa, Haemophilus somnus 129PT
MTVIIFLSTLLGGILLGIPVAFSLLLCGIALMLYLDLFDAQILAQQIVSGADSFSLMAIPFFILAGEIMNEGGLSKRIIDLPMKLVGHKRGGLGFVAILAAMIMASLSGSAVADTAAVAAMLLPMMKTTGYPLDRSAGLIGTAGIIAPIIPPSIPFIIFGVSSGVSITKLFLAGIVPGILMGICLAVLWWWQAKHLRLMTFSKARKEELCVSFKNSIWALMLPVIIIGGFRSGIFTPTEAGAVAAFYALFVALFVYKELKIKQLYQVFLAAAKTTAVVMFLVAAAQVTGWLITIAELPHMMTALLEPLIDTPTLLLIVVMLFVFLIGMVMDLTPTVLILTPVLMPLVEEAGINPIYFGVLFILNTSIGLITPPVGNVLNVITGVSKLPFDQVTKGILPYLLMMIVLLFIFIFFPALILMPLNWLQL

SEQ ID NO: 56339 - DNA, 1221 bp, Haemophilus somnus 129PT
  CDS (1)..(1221)
atgcctattgcattttcaatgggattaggtgccataatttcaattctgtctaatgatttaccgttagcattgatttctcagcgtttattctcaggtataaattccttttcattattagcaattccgttttttatgttagctggagaattaatggagaatggaggaatatccagaagacttattcatttatcgaaatgtttagtcggacattttagaggcggtctaggtatgatagatatatccacctctgtaatttttgccggagtatcaggatctgcagcagcagatacagccgccgtcggttcaattatgatacctaccatgaaaaaaaatggctatccagcaggcttaactgcagtccttcaatcggtagcaggatctcttggtccaattattccacctagcttaactgcgattatttttgcctcattaactggattatcaattaaagatttatttttagcagggattttacctggaattgctatagctatcggattggttctagtcacctatttctatgctaaaaaatataatcttggtagagatcaaaaggcatctagagccattttatgcaaagcatttaaagaggcgtcttctgcattatttatgccggttatcatagtaggtggaattttggttgggttctttacgccaactgaagctggggctgtagcagtactttatgctattgcagtcggtatttattataaagaattaacttttgaaaaattcaaacattcaatactaaatgcagccgcaatgaccgcaatgtgtaccctaattatatcaggagcaactattttatcatggattatcgcatttactcgtttgcctgatttaattatagggttcttaacaagtattacggataatccttacatgatccttctgctcttagtagcatttttattatttatcggcatgtttattgaaactattgccgcaactattattgttgcaccaattttaatgccagtagcttatcaatatggaatagatccgatacaatttgccataattatgatcgttgtcttagtttacgcaggagtaacccctcctgtcggtggagtattgttcattactatggggattgctaatgtcaaactacaggaaacgctaaaatacctcgtgccttatttaggtgtcatattcatcgttgtgttactgatgatattattcccttcgatctctttgatgatacctaatatgttccgttaa

SEQ ID NO: 56340 - protein, 406 aa, Haemophilus somnus 129PT
MPIAFSMGLGAIISILSNDLPLALISQRLFSGINSFSLLAIPFFMLAGELMENGGISRRLIHLSKCLVGHFRGGLGMIDISTSVIFAGVSGSAAADTAAVGSIMIPTMKKNGYPAGLTAVLQSVAGSLGPIIPPSLTAIIFASLTGLSIKDLFLAGILPGIAIAIGLVLVTYFYAKKYNLGRDQKASRAILCKAFKEASSALFMPVIIVGGILVGFFTPTEAGAVAVLYAIAVGIYYKELTFEKFKHSILNAAAMTAMCTLIISGATILSWIIAFTRLPDLIIGFLTSITDNPYMILLLLVAFLLFIGMFIETIAATIIVAPILMPVAYQYGIDPIQFAIIMIVVLVYAGVTPPVGGVLFITMGIANVKLQETLKYLVPYLGVIFIVVLLMILFPSISLMIPNMFR

SEQ ID NO: 56341 - DNA, 1281 bp, Pseudomonas syringae pv. syringae B728a
  CDS (1)..(1281)
atggacgcttttatactgttgggcagctttatcgcgttgatcctgatcggcatgccggtggcctacgcgctgggcctttcagccctgatcggcgcctggtggatcgacatcccggccgatgcgctgatgatccagattgcgggcggggttaacaaattctcgctgttggcgattccgttcttcgtgctggccggcgcgatcatggccgaaggcggcatgtcgcgacgtctggtcgcgtttgctgcggtgctggtgggcttcgtgcgtggcgggctgtcgctggtcaatatcgtggcttcgactttcttcggcgcgatctcgggttcctcggtggccgacacggcctcggtaggctcggtgctgatcccggaaatggaacgcaacggctacccgcgggacttctcgacggcagtgaccgtcagcggctcggtgcaggcgctgctgactccgcccagccacaactcggtgctctattcgctggcggcaggcggcacggtgtcgatcgcgtcgctgttcatggccgggatcctcccgggcctgctgctcagcgcggtgatgatgggcctgtgcatgatcttcgcgcgcaagcgcaattaccccaagggtgaagtggtgccgctgcgtcaggcgctgaaaatcgccggtgaagcgctctgggggatgatggccatggtcattattctcggcggcattctgtcggggattttcacggccaccgagtcggcggcgattgccgtgctctgggcgttctttgtcaccatgttcatctaccgcgactacaaatggcgcgatctgcccaaactgatgcaccgggcggcacgcaccatttccatcgtgatgattctgatcggttttgccgccagcttcggttacatcctgacactgatggaaataccgatgaagatcaccaccgcgttcctgaccctgtcggacaaccgctacgtgatcctgatgtgcatcaacgtgatgttgctgctgctcggtacggtcatggacatggcgccgctgattctgatcctgaccccgattctgttgccggtcatcgtcggtgtcggtatcgatccggtgcacttcggcatgatcatgctggtcaatctggggatcgggctgattaccccgccggtgggcgcggtgctgttcgtcggtgctgccgtgggcaaggtcaccatcgaagccacggtaaaagcactggtgccgttctatgtcgcgctgttcctggtgctgatgctggtgacctacattcctgccatctcgttgtggctgccgagcgtcgtgctctga

SEQ ID NO: 56342 - protein, 426 aa, Pseudomonas syringae pv. syringae B728a
MDAFILLGSFIALILIGMPVAYALGLSALIGAWWIDIPADALMIQIAGGVNKFSLLAIPFFVLAGAIMAEGGMSRRLVAFAAVLVGFVRGGLSLVNIVASTFFGAISGSSVADTASVGSVLIPEMERNGYPRDFSTAVTVSGSVQALLTPPSHNSVLYSLAAGGTVSIASLFMAGILPGLLLSAVMMGLCMIFARKRNYPKGEVVPLRQALKIAGEALWGMMAMVIILGGILSGIFTATESAAIAVLWAFFVTMFIYRDYKWRDLPKLMHRAARTISIVMILIGFAASFGYILTLMEIPMKITTAFLTLSDNRYVILMCINVMLLLLGTVMDMAPLILILTPILLPVIVGVGIDPVHFGMIMLVNLGIGLITPPVGAVLFVGAAVGKVTIEATVKALVPFYVALFLVLMLVTYIPAISLWLPSVVL

SEQ ID NO: 56343 - DNA, 1302 bp, Desulfovibrio desulfuricans G20
  CDS (1)..(1302)
atggagccggtgactctgggggttctttccgtaggtgttcttctggcggccattctggcatcacgcattccggtggggtttgccatggcggtcacggggcttggcgggtatgccgcagccatggggcctgctgccgcatggtccatgctggggggcgaagtgtgggaggtgttttcctcttacgggcttacggttatcccgtttttcattttcatggggcagatctgtttttattccggcgtcaacgaacgcctgtacagggcggtatatgcatggatgggacatatccgcgggggcatagcctacgcaacggtgcttgcctgtgcggggttttcggccatctgcgggtcaaataccgccacggccgccaccatgtctgccgtggccctgccggaaatgaaaaaatacggctatgcaccggtgctttccaccggctgcgtggcggcaggagccactctgggggtgctgattccgcccagcgtggtgctcattgtcatcgggctgcagaccggtctttccatttccacgctgtttatggcgggcattatgcccggcctgctgcttacggggctttttctggctgtggtctggctgttgtgccggcggcaccctcagtggggtccggccggagaaaaaagcagctggcgcagcagaatgcgcgcactacccggcgcgggcgagattctgattctttttgttcttgtcataggcgggctgttcatgggggtgttcacccccacggaggcaggtgctgcggggtcggccattgctctgctgctcagccttgcggggcgcaggctgtcgttgcgggggctggtggatgctgtaaacgacacgctgcgtatttccagcatgattatggtcatcattctgggggccgtgctgtacgggcgctttctggccgtaacccgtctgccatttgccgtggcggagtggacggcttcgctgccgctgccgccgctgggcattctgctgctgatctgcggggtgtacattgtgggcggcatgatgatggatgcgctggcgttgctgctggtcaccattcccattttctttccggtggtgcaggccatggggtacgaccccgtgtggttcagtgtgttcattaccgtgataaccaccatgggggccatcacgccgcctgtgggggtgaccgcgtttgtggtggcctccgctgccggagacgtgggagtgcaggatgtcttcagaggggtgaccttttttctggcggcgtatgcggtatgtgctctgctgttgctgctggtgccccagatagttctttttataccatcccttatgtaa

SEQ ID NO: 56344 - protein, 433 aa, Desulfovibrio desulfuricans G20
MEPVTLGVLSVGVLLAAILASRIPVGFAMAVTGLGGYAAAMGPAAAWSMLGGEVWEVFSSYGLTVIPFFIFMGQICFYSGVNERLYRAVYAWMGHIRGGIAYATVLACAGFSAICGSNTATAATMSAVALPEMKKYGYAPVLSTGCVAAGATLGVLIPPSVVLIVIGLQTGLSISTLFMAGIMPGLLLTGLFLAVVWLLCRRHPQWGPAGEKSSWRSRMRALPGAGEILILFVLVIGGLFMGVFTPTEAGAAGSAIALLLSLAGRRLSLRGLVDAVNDTLRISSMIMVIILGAVLYGRFLAVTRLPFAVAEWTASLPLPPLGILLLICGVYIVGGMMMDALALLLVTIPIFFPVVQAMGYDPVWFSVFITVITTMGAITPPVGVTAFVVASAAGDVGVQDVFRGVTFFLAAYAVCALLLLLVPQIVLFIPSLM

SEQ ID NO: 56345 - DNA, 1284 bp, Desulfovibrio desulfuricans G20
  CDS (1)..(1284)
atgagcattcttttgctgcttgtcttttttgccatgctggcatcggggctgccgctgtttgtggccatgctgtgtacagcactggccgggtttgcctacatcggcgagtccggtcaactgcggctgatggtgcagcagttttatggcggcatggaacctttttccctgctggccataccgtactttattctggtgggcgaactgatgggctgcgccggactgaccagcagactgttgcgttttgccgaggctcttgtgggacacctcaagggcggactgggctatgtgacagtggtggccagcatcatttttgccggtgtcaacggctctgccgcggcggatgcgtccgcagtaggctccatcatgattcccgccatgaaaaaaggcggataccccgactcgtatgccgcgggccttactgccggcagttcgcttatcggtcccatcattccgccgagcatttttatgattttgttcggcgccatgacaaagacgaatgtgggcgggctgtttatggcgggtgtggtgccggggttgctgcttggtgtcgcttttatggtcatgcaccgcatcagtgccgcgcggctcaacctgcctacggtcaatacggccttttccatgcctgatctctggagggccaccggcggagccatggctgcgctcattgctccgggtatcattatcggcggtatcctgttcgggttcatgacccccaccgagtccggtgccatagccagtctgtatgtggtcatcgtgggctttgtctggacacggcagctgacggtgaagggcgtgctgctggcgttgtcgaacacggtccggcttaccagtgtcatttttgtggttatcggggcggcgactattgtcggctggattctgtctgccgaaaaagtaccgcagtccatggctccggtgatcatgagttatgcctcgagtcctgaacaggttctgctgctgataagcctgattgtgtttgtggtgggcatgttcatggaagaaattgcggctctggtgctgcttactccggtgttcgcgccgctggctgtggcggcgggaattgatccgtatcatttcggcatcgtgatgacactgaacatcaccattgcgcttatcactccgcccatgggagcctgcgtgtacatcgtatcctccgtgggcaatgtgtcgctggaaaaaatgttcaggcacatctggccgtttgttctggtggcgctggcctgtcagctgctgctgatttttgttcccgggatatctgtctggctgccgcatatgctgggctattaa

SEQ ID NO: 56346 - protein, 427 aa, Desulfovibrio desulfuricans G20
MSILLLLVFFAMLASGLPLFVAMLCTALAGFAYIGESGQLRLMVQQFYGGMEPFSLLAIPYFILVGELMGCAGLTSRLLRFAEALVGHLKGGLGYVTVVASIIFAGVNGSAAADASAVGSIMIPAMKKGGYPDSYAAGLTAGSSLIGPIIPPSIFMILFGAMTKTNVGGLFMAGVVPGLLLGVAFMVMHRISAARLNLPTVNTAFSMPDLWRATGGAMAALIAPGIIIGGILFGFMTPTESGAIASLYVVIVGFVWTRQLTVKGVLLALSNTVRLTSVIFVVIGAATIVGWILSAEKVPQSMAPVIMSYASSPEQVLLLISLIVFVVGMFMEEIAALVLLTPVFAPLAVAAGIDPYHFGIVMTLNITIALITPPMGACVYIVSSVGNVSLEKMFRHIWPFVLVALACQLLLIFVPGISVWLPHMLGY

SEQ ID NO: 56347 - DNA, 1269 bp, Haemophilus somnus 2336
  CDS (1)..(1269)
atgctacttcttgcattcttatgcttctttattttggttctgctcggtgtgcctattgcattttcaatgggattaggtgccataatttcaattctgtctaatgatttaccgttagcattgatttctcagcgtttattctcaggtataaattccttttcattattagcaattccgttttttatgttagctggagaattaatggagaatggaggaatatccagaagacttattcatttatcgaaatgtttagtcggacattttagaggcggtctaggtatgatagatatatccacctctgtaatttttgccggagtatcaggatctgcagcagcagatacagccgccgtcggttcaattatgatacctaccatgaaaaaaaatggctatccagcaggcttaactgcagtccttcaatctgtagcaggatctcttggtccaattattccacctagcttaactgcgattatttttgcctcattaactggattatcaattaaagatttatttttagcagggattttacctggaattgctatagctatcggattggttctagtcacctatttctatgctaaaaaatataatcttggtagagatcaaaaggcatctagagccattttatgcaaagcatttaaagaggcgtcttctgcattatttatgccggttatcatagtaggtggaattttggttggcttctttacgccaactgaagctggggctgtagcagtactttatgctattgcagtcggtatttattataaagaattaacttttaaaaaattcaaacattcaatactaaatgcagccgcaatgaccgcaatgtgtaccctaattatatcgggagcaactattttatcatggattatcgccttcactcgtttgcctgatttaattatagggttcttaacaagtattacggataatccttacatgatccttctgctcttagtagcatttttattatttatcggcatgtttattgaaactattgccgcaactattattgttgcaccaattttaatgccagtagcttatcaatatggaatagatccgatacaatttgccataattatgatcgtggtcttagtttatgcaggtgtaacacctcctgtcggtggagtattgttcattaccatggggattgctaatgtcaaactacaggaaacgctaaaatacctcgttccttatttaggtgtcatattcatcgttgtgttactgatgatattattcccttcgatctctttgatgatacctaatatgttccgttaa

SEQ ID NO: 56348 - protein, 422 aa, Haemophilus somnus 2336
MLLLAFLCFFILVLLGVPIAFSMGLGAIISILSNDLPLALISQRLFSGINSFSLLAIPFFMLAGELMENGGISRRLIHLSKCLVGHFRGGLGMIDISTSVIFAGVSGSAAADTAAVGSIMIPTMKKNGYPAGLTAVLQSVAGSLGPIIPPSLTAIIFASLTGLSIKDLFLAGILPGIAIAIGLVLVTYFYAKKYNLGRDQKASRAILCKAFKEASSALFMPVIIVGGILVGFFTPTEAGAVAVLYAIAVGIYYKELTFKKFKHSILNAAAMTAMCTLIISGATILSWIIAFTRLPDLIIGFLTSITDNPYMILLLLVAFLLFIGMFIETIAATIIVAPILMPVAYQYGIDPIQFAIIMIVVLVYAGVTPPVGGVLFITMGIANVKLQETLKYLVPYLGVIFIVVLLMILFPSISLMIPNMFR

SEQ ID NO: 56349 - DNA, 1857 bp, Haemophilus somnus 2336
  CDS (1)..(1857)
atgaacaagttagaagaatggattggcggggcattattccttgcaattttcctgattttgattgcacaaattgttgcacgtcaagttattcatatgccacttatatggtcggaagaattagcacgtttgctgtttgtttatacggcattattggggatcagtatggcggtacgtgcacaacaacacgtctatattgactttattaccaatttaatgccgctgacaatcaaacgtatggcgatgacctttgttcaattattaatttttgtctcaattattctgtttatctacttaggttatggcgtttgggcagacgcaacttttcctatggaagcattaaaagctacctttggaacggaaattacgcaaaaatggctctacgcagggttgccgattattgcatctttgatgttattccgttttttagaagctcaagcagaaaactttagaaacaaagtcacttacttgcctgtttcttttttccttgtaagtgcggtcattatttttgcgattttatattttcagccggagtggtttaaatctctgcgtatttccaactatataaaattcggtaaaaatgccgtttatatcgctttagcggtttggttagtgattatgttcttaggcacgcctgtaggatggtcattatttattgccgctttactttatttttcaatgacacgttggaatatcacttattccgcatcgggtaaattagttgatagcttagacagcttcccgttattgtccgtaccgttttttatcttaaccggtattttgatgaacactggcggtatcactgagcgtatcttccacttcgcaaaaacgttattaggacactataccggtggtatgggacatgtaaatatcggtgccagcttaattttttcgggtatgtcaggatctgctttagcagatgctggcggtttaggtcaattggaaatcaaagcgatgcgtgatgcaggctatgatgacgatatttgcggtggtattactgctgcttcctgtatcatcggtccgttagttccgccaagtattgcaatgataatctatggtgttattgctaatgaatccatcgcaaagctatttgtagcaggttttgtacctggcgtgttggttaccatcgcattgatggtcatgaactactatgtttctaaaaaacgtggttaccctaaaacaccaaaggcgagcaaagcagaagtttgtgccgcatttaaagacacattttgggcaattttgacaccgtttttgattattggtggtattttctcaggtttatttacaccgacagaagcggcggtcgttgctgctgcatattccgtaattgtaggaaagtttgtttataatgatttgaatctaaagaatttcctcaaaagctgtgtagaagcagtatctattaccggtgtaaccgcattaatggtaatgacagtcactttcttcggtgacatgattgcccgtgaacaggttgcgatgaaaattgcggaaatttttgttgctgttgcagattcgcctatcacagtgttaattatgatcaatttgcttctcttattcttaggaatgttcattgacgccttggcactacaatttttagtgttgccaatgttgattccaattgcgatgcaatttggtattgatcttgtcttttttggggtcatgactacattaaatatgatgattggtattttaacccctccaatgggaatggcattatttgtcgttgctcgggtgggtaatatgcctgtaagtgtggtagcaaaaggtgttttacctttcttgataccaatttttatgaccttagtattgattacgattttcccacaaatcattacatttatacctaacttgctaatgctttag

SEQ ID NO: 56350 - protein, 618 aa, Haemophilus somnus 2336
MNKLEEWIGGALFLAIFLILIAQIVARQVIHMPLIWSEELARLLFVYTALLGISMAVRAQQHVYIDFITNLMPLTIKRMAMTFVQLLIFVSIILFIYLGYGVWADATFPMEALKATFGTEITQKWLYAGLPIIASLMLFRFLEAQAENFRNKVTYLPVSFFLVSAVIIFAILYFQPEWFKSLRISNYIKFGKNAVYIALAVWLVIMFLGTPVGWSLFIAALLYFSMTRWNITYSASGKLVDSLDSFPLLSVPFFILTGILMNTGGITERIFHFAKTLLGHYTGGMGHVNIGASLIFSGMSGSALADAGGLGQLEIKAMRDAGYDDDICGGITAASCIIGPLVPPSIAMIIYGVIANESIAKLFVAGFVPGVLVTIALMVMNYYVSKKRGYPKTPKASKAEVCAAFKDTFWAILTPFLIIGGIFSGLFTPTEAAVVAAAYSVIVGKFVYNDLNLKNFLKSCVEAVSITGVTALMVMTVTFFGDMIAREQVAMKIAEIFVAVADSPITVLIMINLLLLFLGMFIDALALQFLVLPMLIPIAMQFGIDLVFFGVMTTLNMMIGILTPPMGMALFVVARVGNMPVSVVAKGVLPFLIPIFMTLVLITIFPQIITFIPNLLML

SEQ ID NO: 56351 - DNA, 1665 bp, Fusobacterium nucleatum subsp. vincentii ATCC 49256
  CDS (1)..(1665)
atgaaagtatttaataaattagaagagtggctaggaggaagtctatttattgcaatgtttgttgtacttgttatgcaaatattttctagacaaatttttaatagccctcttatttggagtgaagagctatcaagattaatatttgtttatgttggcttacttggagtcagtatgggaataagaagtcaacaacatataatgatagattttttgtatggaaaatttccaaaatctatgcaaaagattgttttcacaattatacaaattttaattttagcttgtttaatattctttttatattttggctatgatttatttataaaaaaagaagaattagagatagtttcattgggaatttcaatgaaatggatgtatttagctttaccacttatcactttattgatgttagttagattttaccaagcatattcagaaaattatgctcaaaataaagtatatattaaacctatttttatattagctttaattataatcttagtacttatagcatttataaagccagaattatttaaagttttaaaattatctaattattttgattttggtgaaatgactatatattatgtactaatagcttggttagtgatgatattttttggagttcctgttggttggtccttacttgtagcttgtattttatattttgctcttactagatggaaagttgtatattttgcagctgataaattagtttatagtttggatagtttcagtcttttaagtgtaccattcttcatacttactggaatcttgatgaatggagcaggaataacagaaagaatttttaactttgctaaggctatgttaggacattatacaggtggaatgggacatgttaatgttgcagcaagtttaattttttctggaatgtctggttcagctattgctgatgcaggtggtttaggtcaacttgaaataaaggctatgagagatgaaggctatgatgatgatatttgtggaggacttacagctgcctcttgtattataggaccattagttcctcctagcataagtatgattatatatggagttattgcaaaccaatcaatagcaaaattatttttagctggttttgttcctgggttcttaactactattgcacttatgataatgaactattttgtatgtaaaaaaagaggctataaaaaggctgctaaggcaagtcctaaggaaagatggatagcatttaaaaaatcattttgggcattattaactcccattttaataattggtggtatattttctggaatatttactcctactgaagctgctgttatagcaacattttattctataattttaggaggatttatttataaagaattaactataaaatcattctttaaacattgtgttgaagccgttgcaataagcggagtcactgtacttatgataatgacagtaactttctttggtgatattattgcaagagaacaagttgctatgagagttgcagaagtatttattaagtatgcaacatctcctataatggttcttgttatgataaacttattgcttttattcttaggaatgtttatagatgccttagctttacaatttttagtattaccaatgttgattcctattgcagagcaagttggaattgatttagtattctttggtgttatgacaacattaatatga

SEQ ID NO: 56352 - protein, 554 aa, Fusobacterium nucleatum subsp. vincentii ATCC 49256
MKVFNKLEEWLGGSLFIAMFVVLVMQIFSRQIFNSPLIWSEELSRLIFVYVGLLGVSMGIRSQQHIMIDFLYGKFPKSMQKIVFTIIQILILACLIFFLYFGYDLFIKKEELEIVSLGISMKWMYLALPLITLLMLVRFYQAYSENYAQNKVYIKPIFILALIIILVLIAFIKPELFKVLKLSNYFDFGEMTIYYVLIAWLVMIFFGVPVGWSLLVACILYFALTRWKVVYFAADKLVYSLDSFSLLSVPFFILTGILMNGAGITERIFNFAKAMLGHYTGGMGHVNVAASLIFSGMSGSAIADAGGLGQLEIKAMRDEGYDDDICGGLTAASCIIGPLVPPSISMIIYGVIANQSIAKLFLAGFVPGFLTTIALMIMNYFVCKKRGYKKAAKASPKERWIAFKKSFWALLTPILIIGGIFSGIFTPTEAAVIATFYSIILGGFIYKELTIKSFFKHCVEAVAISGVTVLMIMTVTFFGDIIAREQVAMRVAEVFIKYATSPIMVLVMINLLLLFLGMFIDALALQFLVLPMLIPIAEQVGIDLVFFGVMTTLI

SEQ ID NO: 56353 - DNA, 1275 bp, Fusobacterium nucleatum subsp. vincentii ATCC 49256
  CDS (1)..(1275)
atggaagctttatatccagtaattgtattatttgtattattctttttaaatatcccaatagcttttgcattaatgggatcagcattattttattttatatttttaaatacaactatgtctatggacatggttatacaacaatttgtaacatcagttgaatctttcccttatttagcagtaccattctttataatggttgggtctgtaatgaactattcaggaataagtgaagaacttatgaatatggcagaagttttagcaggtcatatgaaaggtggacttgcacaagtaaactgtttattaagtgctatgatgggaggaatttctggttctgcaaatgcagatgctgcaatggaatctaaaatattagtacccgaaatgattaaaaaaggtttttcaaaagaattctcagcagcagttacagctgcctcatctgctgttagccctgttataccaccaggaacaaatttaattctttatgctttaatagcaaatgtacctgttggtgatatgttcttggcaggatacacacctggaattttaatgacagctgcaatgatggtaactgtttatataatttctaaaaaaagaggctatgaaccttcaagagaaagaatggcaagacctgttgaaattttaaaacaagctataaagtcaatttgggctcttgcaattccatttggtatcataatgggaatgagaattggaatattcactccaacagaagcaggaggagttgcagtatttttttgtttcttagttggtttctttatatataaaaaattaaaacttcatcatattcctataatattaatggagactgtaaaaaatacaggagcagttatgataataattgcctctgcaaaagtttttggttattatatgacccttgaaagaatacctcaatttataactaattctttaatgaattttacagataataaacttgtattgttaatggttataaatgtacttttattatttataggtatgtttattgaaggaggagctgcacttgttattcttgctccacttttagtaccagcagtaagagaattaggggttgatccattacactttggagtaatatttatagttaatataatgataggagggttaactccaccatttggttctatgatgttcactgtatgctctattgttggagtgcggattagaggcatttataaaagaagtatggccatttatagttgctcttttaatagttttacttttagtgacttactcagaatcaatagcattgtttatacctaa

SEQ ID NO: 56354 - protein, 424 aa, Fusobacterium nucleatum subsp. vincentii ATCC 49256
MEALYPVIVLFVLFFLNIPIAFALMGSALFYFIFLNTTMSMDMVIQQFVTSVESFPYLAVPFFIMVGSVMNYSGISEELMNMAEVLAGHMKGGLAQVNCLLSAMMGGISGSANADAAMESKILVPEMIKKGFSKEFSAAVTAASSAVSPVIPPGTNLILYALIANVPVGDMFLAGYTPGILMTAAMMVTVYIISKKRGYEPSRERMARPVEILKQAIKSIWALAIPFGIIMGMRIGIFTPTEAGGVAVFFCFLVGFFIYKKLKLHHIPIILMETVKNTGAVMIIIASAKVFGYYMTLERIPQFITNSLMNFTDNKLVLLMVINVLLLFIGMFIEGGAALVILAPLLVPAVRELGVDPLHFGVIFIVNIMIGGLTPPFGSMMFTVCSIVGVRIRGIYKRSMAIYSCSFNSFTFSDLLRINSIVYT

SEQ ID NO: 56355 - DNA, 1281 bp, Dechloromonas aromatica RCB
  CDS (1)..(1281)
atggattggctgctcttcgggatttttattgcgctgatgctctccggcgtgccgcttgcggttgccatggggctggctggcattgcggtggttgcggtcgccgatcttggcatgatgtccttgccgaccaacgtttataccggtattgccaaatatccgttgatggcgattccggttttcgtgatcgctggtctgatcttcgaaaaggccggtgttgctgccaccatcgtgcgttttgcctcggcgctggtcgggcagcggcgtggcagcttggccatagtcgctattctggtggcgatgatcctgggcgggatttccggttccgggccagccgactcggcggccgttggtgccgtgatgttgccgtcgatgctgaaggctggttatccgcgctctttcacggctggtgtcattgcagcagccggttcgaccgatatcctgattccgccgtccatagccttcgtgatctacagcctgctggtgccacaggcatccgtgccggcgctgttcgcggccggcatgattcccggtattttgtcaggattgaccttgattctggttgcctggtggctgtcggtaaaaaacaatttcgaagccgagccggccgagccacggccgccattctggcaaagcctgaaggcagctggctggggattgctagcgccggtcatcatcctgggcggcatgcgcagcggcttcttcacgccgactgaagctgctgtggtggcggtgttctatggcctgattgtcggcatggtgatctaccggacgctgacctggaaggatgtgtacatcgtgctggtcgagtcggccgagatttcctcggtgatcctgaccgtcgtggcgctggccagcgtttttgcttggggcagcaatacgcttggtaccctcgatcacctcgctgcggccttgctcggcactggtctctcggaaattccgatgctgctcagcatccagctcttgctgctgatcgctggcatgttcctcgatgccatatcgatctacttcattttcctgccgctactggtgccgattgccatgcatttcaactgggatctggtctggttcggcgtgatcatcacgatgaatatggcgcttggccagttccatccgccgctcggcgtcaatctgatggtgacttgccgcatggccggggtctcgatggaatcgaccgtgccctgggtattgtggatggtggcggcgatggcggggacgatgttcctggtgacatttgtgccggaattggcgctttggttgccgcgtcacctcgggtatctgtaa

SEQ ID NO: 56356 - protein, 426 aa, Dechloromonas aromatica RCB
MDWLLFGIFIALMLSGVPLAVAMGLAGIAVVAVADLGMMSLPTNVYTGIAKYPLMAIPVFVIAGLIFEKAGVAATIVRFASALVGQRRGSLAIVAILVAMILGGISGSGPADSAAVGAVMLPSMLKAGYPRSFTAGVIAAAGSTDILIPPSIAFVIYSLLVPQASVPALFAAGMIPGILSGLTLILVAWWLSVKNNFEAEPAEPRPPFWQSLKAAGWGLLAPVIILGGMRSGFFTPTEAAVVAVFYGLIVGMVIYRTLTWKDVYIVLVESAEISSVILTVVALASVFAWGSNTLGTLDHLAAALLGTGLSEIPMLLSIQLLLLIAGMFLDAISIYFIFLPLLVPIAMHFNWDLVWFGVIITMNMALGQFHPPLGVNLMVTCRMAGVSMESTVPWVLWMVAAMAGTMFLVTFVPELALWLPRHLGYL

SEQ ID NO: 56357 - DNA, 1851 bp, Haemophilus influenzae R2846
  CDS (1)..(1851)
atgaaatatattaataagcttgaagaatggctgggtggcacattatttatcgccattttcggtattcttatcgctcagattctttcacgccaagtttttcattctccgttaatttggagtgaagaactcgccaagctcttatttgtttacgtgggtatgttaggtatcagcgttgctgtgagaaaacaagaacacgtatttattgattttttaactaatctaatgcccgaaaaaatcagaaaatttacaaatacttttgtacaattattagtctttgtatgtattttcttatttattcatttcggtattcgtacttttaacggcgcatcattccctattgatgccttaggaggcatttctgaaaaatggattttcgcagcactgcctgttatcgcaatattaatgatgtttcgctttatccaagcgcaaaccgtaaactttaagacagggaaaagctatttacctgcgactttctttatcataagtgcggtcattttatttgcgattttatttttcgcaccagattggttcaaagtattgcgcattagcaattatataaaactcggttcaagttcagtctatgtcgccttactcgtttggctcatcattatgtttatcggtgtccctgtaggttggtccttatttattgctaccctactttatttttctatgacacgttggaatgtcgtaaatgccgcaactgaaaaattagtctatagcctagacagcttcccattacttgccgtgccgttttatattttaacgggcattctaatgaatacaggtgggattaccgaacgtatttttaatttcgctaaagccttactcggtcattacacaggaggaatgggacacgttaatatcggtgcaagtttattgttctctggtatgtcaggttcagcacttgctgatgctgggggcttaggtcaattagaaatcaaatcaatgcgtgatgctggttatgacgatgatatttgcggaggaattactgctgcttcttgtattattgggccattagttccgccaagtattgcaatgattatttacggtgtaattgccaatgaatctatcgcaaaactctttattgcaggttttattccaggtgtattaattactttagctttaatggcaatgaattatcgcattgccaaaaaacgaggttatccacgaacaccaaaagctacgagagaacaactttgcagcagctttaaacaatctttttgggcaatcttaacgccgttattaattatcggtggtattttttcaggattattcagtccaacagaatctgccattgttgcagccgcatactctgtaattattggtaaatttgtgtataaagaattaaccttaaaaagcttatttaatagttgcatagaagcaatggcaattacgggcgtagtcgccttaatgattatgaccgtgactttctttggcgatatgattgcccgtgaacaagtcgcaatgcgtgttgctaatgtgtttgttgccgttgccgattcgcctttaaccgtattagtaatgattaacgcactgttactttttcttggaatgttcattgatgccctagcattacaatttttagtattaccaatgcttattcctatcgcaatgcaattcaatattgacttaatcttctttggtgtaatgaccacattaaatatgatgattggtattcttaccccaccaatgggaatggctctctttgttgttgctcgtgtaggtaatatgtcagtttccacggtaaccaaaggcgtattaccgttcttgattcccgttttcgtcacattagtattaatcacgattttcccacaaatcatcacatttgtgccaaatctattgataccataa

SEQ ID NO: 56358 - protein, 616 aa, Haemophilus influenzae R2846
MKYINKLEEWLGGTLFIAIFGILIAQILSRQVFHSPLIWSEELAKLLFVYVGMLGISVAVRKQEHVFIDFLTNLMPEKIRKFTNTFVQLLVFVCIFLFIHFGIRTFNGASFPIDALGGISEKWIFAALPVIAILMMFRFIQAQTVNFKTGKSYLPATFFIISAVILFAILFFAPDWFKVLRISNYIKLGSSSVYVALLVWLIIMFIGVPVGWSLFIATLLYFSMTRWNVVNAATEKLVYSLDSFPLLAVPFYILTGILMNTGGITERIFNFAKALLGHYTGGMGHVNIGASLLFSGMSGSALADAGGLGQLEIKSMRDAGYDDDICGGITAASCIIGPLVPPSIAMIIYGVIANESIAKLFIAGFIPGVLITLALMAMNYRIAKKRGYPRTPKATREQLCSSFKQSFWAILTPLLIIGGIFSGLFSPTESAIVAAAYSVIIGKFVYKELTLKSLFNSCIEAMAITGVVALMIMTVTFFGDMIAREQVAMRVANVFVAVADSPLTVLVMINALLLFLGMFIDALALQFLVLPMLIPIAMQFNIDLIFFGVMTTLNMMIGILTPPMGMALFVVARVGNMSVSTVTKGVLPFLIPVFVTLVLITIFPQIITFVPNLLIP

SEQ ID NO: 56359 - DNA, 1272 bp, Haemophilus influenzae R2846
  CDS (1)..(1272)
atgttactattatttttgtgtagtttattcttattgttatttcttggtgtacctgtagcactatcaatgctgttgagtgcgagtattatgctatatcatcttgatatgtttgatacgcaattaattacagaaaactttgtgatgggaacgaataattttcctttgatggctattcctttctttatgcttactggagaaataatgaagcatggtggaatttctgagcgaatcattaattttgcaacaagtatggttggtcatattaaaggtggtttaggttatgttgcgatcatttctgggttgatatttgcagggttatctggttctgcggtagcggatacggccgcgttaggtgcaatactaattcctatgatgatttctaaaaaatatgatggtgctcgttccacaggattaatttgtgctgcaggtattatttcagttgttattcctccaagcattcctatgatcatttacggtattactgctggagcatccatcactaaattatttatggggggaactgtaccaggcttattaatggtcgttggattatgggttacttggaaaattttgtatagaaataatgatacaagtctagaaagaaaacaaactggcaaagaaagatgggttgcttttaaaaaagcattttggcctttattattacctatcattattattgtgggattaagaggagggatttttactccaacagaagcgggagttgttgctgcaatttatgctggcatagtaagtattgcttataaaggcttaacattttctaaattaaaagacgtcttcattggcaccatcaaaacaacatcaatggtaatgtttgttgctgcatcagcaatgatatctgcttttgcgattacagttgctcaaattccaacagaattagtccaaacgattaaaggattaactgatagtccgacaattttaatgtttattataatgctatttttattacttgttggatgtgtaatggatttaattcctgcggtattaatttttgttccagtcttattaccagtgttaagagcatataatattgatattgcgtattttggaatcatgatggtgattaatttatctataggattaataacaccgcctgtgggaacagttttgtatgtaggctcagggatatcaaaattagggataggagcattatccaaaggaattgctccattcttatttgtgtacgcaattattatgatgttgatcgtattttttcctgaaattgtaattgttccaatgaattggttatcttga

SEQ ID NO: 56360 - protein, 423 aa, Haemophilus influenzae R2846
MLLLFLCSLFLLLFLGVPVALSMLLSASIMLYHLDMFDTQLITENFVMGTNNFPLMAIPFFMLTGEIMKHGGISERIINFATSMVGHIKGGLGYVAIISGLIFAGLSGSAVADTAALGAILIPMMISKKYDGARSTGLICAAGIISVVIPPSIPMIIYGITAGASITKLFMGGTVPGLLMVVGLWVTWKILYRNNDTSLERKQTGKERWVAFKKAFWPLLLPIIIIVGLRGGIFTPTEAGVVAAIYAGIVSIAYKGLTFSKLKDVFIGTIKTTSMVMFVAASAMISAFAITVAQIPTELVQTIKGLTDSPTILMFIIMLFLLLVGCVMDLIPAVLIFVPVLLPVLRAYNIDIAYFGIMMVINLSIGLITPPVGTVLYVGSGISKLGIGALSKGIAPFLFVYAIIMMLIVFFPEIVIVPMNWLS

SEQ ID NO: 56361 - DNA, 1305 bp, Ralstonia eutropha JMP134
  CDS (1)..(1305)
atgacactggtcgccatcatcctgttcgtggtctttatcggcctgatgctgctgggcgtgcccatcggcgtgtcgctgggccttggcgggcttgtcgccatcggcctgtcgaacctcgatacccagatgttcggcctgctggccgtgccgcagaacttctatgccggtctggccaagtatccgctgctggccattcccatgttcgtgctggtcggatcgatctttgatcgctctggcgtggcgcagcgcctggtgacgtttgccatcgctatcgtcgggcgtggccccggcatgctgccgctggtcgccattctggtggccatgtttctcggcggcatttcgggctctggccccgccaacgcggccgccgtcggcggcgtgatgatcgcggcgatgtcgcgggccggctatccgggttcgtacagcgcggcagtggtcggcgccgcggcggcgaccgacatcctgattccgccttcggtggccttcatcatctacagcgtgctggtgccgggtgcttcggtgcctgcgctgttcgcggccggcatgatcccgggcgtgctggccggcgtggcgctgatcgtgccggcggtgtggctggcccgcaagcacaacatgggcgccatcgaagccgcgctgccgcgcccgccgttctggaagagcctgcgcgaggcagcctggggcctggtcgcgccattcctaattctcggtggcatgcgtgccggctggttcacgccaaccgaagccgcggtggttgcggtggtctatggcctgttcgtgggcatggtgatctaccgcagcattggcatgaaggacctgttcgtgatcttccaggaggcggcggagacctcggccgtgatcctcctggtggtcgcgctggctggcatcttcgcgtatgcgctgtcgacgctcggcgtcattgacccgctcgcaaacgcgatcgccaactccggtctcggcgaatacggcgtgctggcgctgatcgtgctgctgctgatgacggttggcatgttcctggacggcatttctatcttcctgatcttcgtgccgctgctgctgccgatcgccaccgcgttccactggaacccggtgtggttcggggtggtgctcacgctcaaggtggcgctggggcagttcacgccgccgctggccgtgaacctgatggtgtcgtgccggattgcccgcgtgcgcatggaggagaccgtgccctgggtggtctggatgctgctggcgatgttcatcgccatgctgatggtgctggcctatccgccgctggcgacgtggttgccggactatctgggctattga

SEQ ID NO: 56362 - protein, 434 aa, Ralstonia eutropha JMP134
MTLVAIILFVVFIGLMLLGVPIGVSLGLGGLVAIGLSNLDTQMFGLLAVPQNFYAGLAKYPLLAIPMFVLVGSIFDRSGVAQRLVTFAIAIVGRGPGMLPLVAILVAMFLGGISGSGPANAAAVGGVMIAAMSRAGYPGSYSAAVVGAAAATDILIPPSVAFIIYSVLVPGASVPALFAAGMIPGVLAGVALIVPAVWLARKHNMGAIEAALPRPPFWKSLREAAWGLVAPFLILGGMRAGWFTPTEAAVVAVVYGLFVGMVIYRSIGMKDLFVIFQEAAETSAVILLVVALAGIFAYALSTLGVIDPLANAIANSGLGEYGVLALIVLLLMTVGMFLDGISIFLIFVPLLLPIATAFHWNPVWFGVVLTLKVALGQFTPPLAVNLMVSCRIARVRMEETVPWVVWMLLAMFIAMLMVLAYPPLATWLPDYLGY

SEQ ID NO: 56363 - DNA, 1263 bp, Mesorhizobium sp. BNC1
  CDS (1)..(1263)
ttggtctacgctggcttgcatgtgcctgtagcctttattctggtttcctttttcggcgtttttctcgttcgcggcagtttcgacgttgccgctaactcgctggtgatcgccgcgacggattcaatatcgagctacacctttgcaacggtcccggtcttcgtgttcatgggattgctggttgttctcgccggaatgggacgctctacatttgatgtcgccgcccatgccactaggcgtcttccgggcggcctcgccatcggttcagtcggtgcgaacgcgatttttgcggctaccatcggtgtgggtatcgcggcggctgcaatcttttccaaactcgcgattccggagatgcagcgatacggctattcgctccggcgatctgcaggcgtggtcgcagcggcatcccttctgggcccgctcattccgcccagtctgttactgatccttttcggcgtgatgacgttcacctcgatagggtcactctttctcgccgcagtaattccagggttgttgcttgctgccgcctatgtgctgttcattgtgctagaggcgcgcttccggccggccatctatgggggcacggatgcggatcgtccctgcgggcctgccatgacctggcgcgagatcatcctcaagatcggacccatcactgtcctcgtatttctaatcttcggtggcctttatggtggcattttcacagcgaacgaggccggcgcgatgggtgcattcggcgcacttctgttcgcgcttttcaaggttagaaacccgaaaacctactggcgtctgctgaccgaaaccggccaggtcaccgcatctattctgctgctggtgattggtgccagtatttatacccgtatgctggctctcacgggcgttcctgcagctcttgtaggtctcttctccgacctcggcctgggtgtcgtcggaacgctggtcatctacgtgaccataatccttctgctcggtactcttattgactccgcgtccatcattcttctcgtggttccgctgatgtatcctatctttcagtccatgaacgtggacccgatctggctgggaataataaccgtcatgagcgtcgaagtcggtcttctgacaccacctttcggcatggccgccttcgtcgttaaagccacttcggagcagaaagaactgaaggtcgaggacgtatattggggagccgcaccatttgcgatcatcacgattggcgtggtcggtcttttgatcctgtttcctcagctaacgactgttctgttaaggtag

SEQ ID NO: 56364 - protein, 420 aa, Mesorhizobium sp. BNC1
MVYAGLHVPVAFILVSFFGVFLVRGSFDVAANSLVIAATDSISSYTFATVPVFVFMGLLVVLAGMGRSTFDVAAHATRRLPGGLAIGSVGANAIFAATIGVGIAAAAIFSKLAIPEMQRYGYSLRRSAGVVAAASLLGPLIPPSLLLILFGVMTFTSIGSLFLAAVIPGLLLAAAYVLFIVLEARFRPAIYGGTDADRPCGPAMTWREIILKIGPITVLVFLIFGGLYGGIFTANEAGAMGAFGALLFALFKVRNPKTYWRLLTETGQVTASILLLVIGASIYTRMLALTGVPAALVGLFSDLGLGVVGTLVIYVTIILLLGTLIDSASIILLVVPLMYPIFQSMNVDPIWLGIITVMSVEVGLLTPPFGMAAFVVKATSEQKELKVEDVYWGAAPFAIITIGVVGLLILFPQLTTVLLR

SEQ ID NO: 56365 - DNA, 1278 bp, Mesorhizobium sp. BNC1
  CDS (1)..(1278)
atgatcctgaccttattcctggtcttcttcgcctgcctgctgatcggtgttccgatcggcttcggcatgggtttcgcttctatggtcgcgatcgcccttcatggcagtttccccatggaggtcattccccataagatggcgaatgccgtcaattcctttccgctggtggcgttgccgctgttcattctcgcaggcgcgctggcaggggaaacgagcatcgcgggtcggctcgtccgcttcgccgatgccctgttcgggcatatccgcggcggcctcggccacgtgaacgtcgcctcgtcgatgttcttcggtggcatttcgggttcggcggtcgccgacacggccgcaatcggcagcctcatgatcccggccatggaaaagcagggctacaaacgcgccgatgcgggcgcgattaccatctgctcttccgtcatcggcgtgctgatcccgccgagcattcccatggttctctacggcgtgacagtcggcacctctatcgggtcgctgttccttgccggaatcgtgcccggcgtactggtcggcgttttcctgatggcggccgtgttcttcatgtcgaaaaagaagggctggccgcggcgggaacaccgcgcgcccgcaggtgagctctggtcagcgttcaagcaggcgatcctgccgctgctgctgccggtcttcctgctcggagcgatcgtttccggcctcaccaccgccaccgaggcaggcgttatcggcgtggtttatgcgctgatcctcggcggcttcgtctaccgcgatcatacgctgccggacctcttccgcatcgcggtcgacgcggcaatcagcactgcgattccggtcttcgtcctggccaccacctcggttgcggcctggatcatcgccatcgagcaattcccggcggcgctggctggcttcttctcggagatggctttcggcaagataatcgtcctcctcgtcatcaacttgttcctgatgctggttggcatggtgatggatctggttcccgccctgatcctgttcgcaccgatcctgctgccggtggcgcaggaggctggcatggatgcgatccagttcggcgtgttgatggtggtgaacctcggcgtcggactggtgacaccgccggtgggcaactgcctctatctcggggcggtggtcgcccgtgtcgatctctcctccctgatccgcgcgagcctgcccttcctgatggtcaacttattcgtgctgctgctggtcacctatgtgccgcagctcagcaccttcctcccatccctcttctactga

SEQ ID NO: 56366 - protein, 425 aa, Mesorhizobium sp. BNC1
MILTLFLVFFACLLIGVPIGFGMGFASMVAIALHGSFPMEVIPHKMANAVNSFPLVALPLFILAGALAGETSIAGRLVRFADALFGHIRGGLGHVNVASSMFFGGISGSAVADTAAIGSLMIPAMEKQGYKRADAGAITICSSVIGVLIPPSIPMVLYGVTVGTSIGSLFLAGIVPGVLVGVFLMAAVFFMSKKKGWPRREHRAPAGELWSAFKQAILPLLLPVFLLGAIVSGLTTATEAGVIGVVYALILGGFVYRDHTLPDLFRIAVDAAISTAIPVFVLATTSVAAWIIAIEQFPAALAGFFSEMAFGKIIVLLVINLFLMLVGMVMDLVPALILFAPILLPVAQEAGMDAIQFGVLMVVNLGVGLVTPPVGNCLYLGAVVARVDLSSLIRASLPFLMVNLFVLLLVTYVPQLSTFLPSLFY

SEQ ID NO: 56367 - DNA, 1257 bp, Mesorhizobium sp. BNC1
  CDS (1)..(1257)
atgtggatatttcttgctctgacctttctgggcgcgttggggctttggtgggtggcagggttcccgattgaccgcattggcctcctcctccagactacgttctggaacagttccaagatgtgggagctttcggcggtacccctctttgtttggatgggagaaatatactatcgaacaaatttggcggcagaattgtttcgcgggatcgctccccttatcaagtggctgcctggcaagctgcttcattccaatgtcatcggatgtaccgccttcgcggcagtcagcggttcgtccgcggccaccactgccacgatcgcaaggataacgttgccagtactggcagcgagcggctattcgcgcaatcttgcgctcggctcgctggcgggcgcgggtactctcgggatactgattccaccatcgacagctcttataatatacggtgtgctggccgaagtatccatagcggatctatttgtcgctggtatcgtgccgggtcttatggttgcagggctgtcgtcgctctttattatgatcgttgccttgataaatccgtcggtagccggctcagtgcagtcggagcggggcgacagcgatcgggtttcgttcttgtccttgctttctgatgtcgtgcctacggccagcgtatttgtcgtgatcatggggtcgatctatctcggcttggcgacgccatctgagtcagcagccattggtctggcaatgacggtcgtgatagcagcactcaagcgacgtttcagtttcgcagtattggcgcaagctttggcaagtgcgatccgcacgtcctgcatggtgtgcatattattggtgtcggccgcctttcttacgtcggcgatgagtttcatgcatttgcctaaccagatcgccgacgcaatcggtcagatgcatttgccacctctacaattgatcctaatcttggctgtattctatctggtgcttgggatcgtggtcgacggcctgcccataatggtaatgaccttgcctttcgtctatccgctcgtgacggcgctcggatacgatccgctttggctgggcatttttatcattctcaatatcgagatggggatgatatcacctcccgtcggtctgaacctatttgtcttgaaagggcttaccggcgaatcgatcggcaggatcggatttgctgcattaccattcttcgctgtaatgtgcgtggtgacggcgctaatttctatttttccggaactcgtactatggttaccctcgctggcgatcaattaa

SEQ ID NO: 56368 - protein, 418 aa, Mesorhizobium sp. BNC1
MWIFLALTFLGALGLWWVAGFPIDRIGLLLQTTFWNSSKMWELSAVPLFVWMGEIYYRTNLAAELFRGIAPLIKWLPGKLLHSNVIGCTAFAAVSGSSAATTATIARITLPVLAASGYSRNLALGSLAGAGTLGILIPPSTALIIYGVLAEVSIADLFVAGIVPGLMVAGLSSLFIMIVALINPSVAGSVQSERGDSDRVSFLSLLSDVVPTASVFVVIMGSIYLGLATPSESAAIGLAMTVVIAALKRRFSFAVLAQALASAIRTSCMVCILLVSAAFLTSAMSFMHLPNQIADAIGQMHLPPLQLILILAVFYLVLGIVVDGLPIMVMTLPFVYPLVTALGYDPLWLGIFIILNIEMGMISPPVGLNLFVLKGLTGESIGRIGFAALPFFAVMCVVTALISIFPELVLWLPSLAIN

SEQ ID NO: 56369 - DNA, 1275 bp, Mesorhizobium sp. BNC1
  CDS (1)..(1275)
atgtcactagaagcgttctacgcggtgagcgcgctcatcgtgttgctcctcaccggaatcccgattgctcttgcgctgacgctggcaggtgccttcggcctgtggcttctcgacttccctatgcttgtggtgatccagcgtttcgcggcgggatctgaaagcttcgttctgctcgccattccctttttcatcctggcaggcgcggtcatggaagccggcggtatatcgaggcgcctcataggtttttgcgatgcttgtctggggtatcttcccggcgggcttgcgaacgcgaatatcggtgcctccatggtctttggcggcatatcagggtctgcggttgcggatacctcggcggtcgggtcggtcatgatcccggcgatggaacgagagggatactcacgccgctacagcgcggcggtgacggcggccgcttccccggtcggcatgatcatcccgccatcgatcccgatgatcgtctggagctatatttcaggccagtccctcaatgagcttttcatggcgggtatcgtgcccggcatcttgatcactctggcgcttgcattggtcagcacctggatttgccaacgccgcgggttccaacgaggatttcgtccgttccgtgcgggctttttcctgtcgtccttgaaggatggcctgctggccctcggtgccccggtcatcatcatcggaggcattctgatcggtgccttcacaccgaccgaagcctccgtcgtcgcgctcgcctatgcgcttatccttagtttcggagtttatcgcgagctgtcaccccgaaagcttgcagcggtgttcgtccaggccggcaagaccagcgcctcgatcatgttcatcatctgcggcgccaccgtattctccttttttctgacggtttccggaatgccggcgcaaatcggcagcttgatcctcagcgtatccgaaacgccgcttggcttcatcattgctgcggggctgctgatgttcgtgttgggaatgtttctggataccaccacgaccattctgatggccgggccgatcatcattcccctgttcagccaagtcggagttgatccgttggtcgctaccatggtcatcatggtgatcctggccatcggtctcatcacgccgcctgtggggttgtgccttttcgtcgtctcgtcgatcaccccggtcaaagtttgggacgtggcgcgggaatgcgtgccgttcattctcgcaatgaccgccgtcgctgccttgatctggatctttcctcctctggttacgtgggtcgtgccatga

SEQ ID NO: 56370 - protein, 424 aa, Mesorhizobium sp. BNC1
MSLEAFYAVSALIVLLLTGIPIALALTLAGAFGLWLLDFPMLVVIQRFAAGSESFVLLAIPFFILAGAVMEAGGISRRLIGFCDACLGYLPGGLANANIGASMVFGGISGSAVADTSAVGSVMIPAMEREGYSRRYSAAVTAAASPVGMIIPPSIPMIVWSYISGQSLNELFMAGIVPGILITLALALVSTWICQRRGFQRGFRPFRAGFFLSSLKDGLLALGAPVIIIGGILIGAFTPTEASVVALAYALILSFGVYRELSPRKLAAVFVQAGKTSASIMFIICGATVFSFFLTVSGMPAQIGSLILSVSETPLGFIIAAGLLMFVLGMFLDTTTTILMAGPIIIPLFSQVGVDPLVATMVIMVILAIGLITPPVGLCLFVVSSITPVKVWDVARECVPFILAMTAVAALIWIFPPLVTWVVP

SEQ ID NO: 56371 - DNA, 1278 bp, Pseudomonas aeruginosa UCBPP-PA14
  CDS (1)..(1278)
atggccatcgccatgatcgcggccttcgtggtcaacctcctgctcggcctgccgctgttcctctgcctgctgctcaccgcgctggtggggttcctcttcgtcgacccggcgctgttcgccaacaccctgccgcagcgcttcttcggcggcatggacatcttctcgctgatggcgatcccgctgttcgtgctggccggcaacctgatgaaccattccggcatgaccccgcgcctgatgcgcctggccaacgccctggtcggccacttccgcggcggcctcggccacgtcaacgtggtcgccggggtgttcttcgccggggtcaacgggtccgccgcggccgacgcttcggcactcagcaccctgctggtgccggccatggaaaaggaaggctactcgcggcgcttcgccgccgggctgaccgcgggcagctcgctgatcggtccgatcatcccgccgagcatcttcatgatcctctactcctcgctgaccaacacctcggtgggcgagctgttcctcgccggggtgattcccggcctgctgctggccgccgccttcatgctgctgaacgcggtgtacgcctaccgcaacgggctgcaggcgcgccatgcggcaccggcctggggcgagatcctggcggcactgtccggcgccctgaccgcgctgatcgcgccggtgatcatcgtcgccggaatcgtcctgggcctggtcacgcccaccgagtcgggcgccctgatcgccctctacgtggcgctggtcggcctgctccagcgccaactgagcctggtcgggctgtggaactcgctgcgcgagacggtacgcctgaccgccagcatctacgtgatcatcgccgccgcctcggtggtcaactggttgctcaactacgcccaggtcgccagcgagttcgcccagttgctggagccgttcggccactcgccgaccctgatgctgttcatcatcagtgcggtgatcttcgtctgcggcatgctcatggaggaggtctcggtactgatgctgctgacaccgatagtcgctccggtggcgctggccgccggcgtggatccggtgcacctggggctgatcttcaccctgaacatcaccatcgccctgatcaccccaccaatgggcgcctgcctgttcatcgtggcgaccatcagccgcctcgatatcctggaaatgttcaagggtatctggccgttcatcctgctggccctgggggtactctcgctgctgatcctgttcccctccctgaccctgtggctgccacgcctgctcaattga

SEQ ID NO: 56372 - protein, 425 aa, Pseudomonas aeruginosa UCBPP-PA14
MAIAMIAAFVVNLLLGLPLFLCLLLTALVGFLFVDPALFANTLPQRFFGGMDIFSLMAIPLFVLAGNLMNHSGMTPRLMRLANALVGHFRGGLGHVNVVAGVFFAGVNGSAAADASALSTLLVPAMEKEGYSRRFAAGLTAGSSLIGPIIPPSIFMILYSSLTNTSVGELFLAGVIPGLLLAAAFMLLNAVYAYRNGLQARHAAPAWGEILAALSGALTALIAPVIIVAGIVLGLVTPTESGALIALYVALVGLLQRQLSLVGLWNSLRETVRLTASIYVIIAAASVVNWLLNYAQVASEFAQLLEPFGHSPTLMLFIISAVIFVCGMLMEEVSVLMLLTPIVAPVALAAGVDPVHLGLIFTLNITIALITPPMGACLFIVATISRLDILEMFKGIWPFILLALGVLSLLILFPSLTLWLPRLLN

SEQ ID NO: 56373 - DNA, 1281 bp, Rhodobacter sphaeroides 2.4.1
  CDS (1)..(1281)
ttggagctcttcatcctgttcggaagcttcgtcttccttctcctgatcggcacgcctgtcgccttctgcctcggcgtgtcgagtttcctcaccgtgctctatctgggcctgccgccggtcgtggtgttccagcgcctcaactcgggcgtctcggtctatgcgctgatggccatccccttcttcatctattcgggcgatctgatggtgcggggcgacatcgcccgacggctcgtggcgctggcaggcgcgctggtcggccacctccggggcgggctcggacaggtgaacgtcgtggcctcggtcatgttcggcggcgtctcgggctcggccgcggcggatgcctcggcggtgggcggcctcatggtgccgcagatgaaggcccgcggctacggcgtcgactatgccgtgaacctgaccgtcgtgggctcgatcatcgcgctgatgatcccgccctcgcacaacatgatcatctattccatcgccgcgggcggccggatctcgatcgcggacctcttcacggcaggcatcatcccgggcctcctgctcgcgctggggctgatggtggcggcctatttcgtggcccgccgccgcggctatccgaccgagcgctttccggggctgcgcgcgctcggtgccatcttcgtgagcgccgtgccggggctcatcctcgtcgcgctgatcttcggcggcgtgcgctcgggcatcttcaccgcctcggaaagcgccaacatcgccgtggtctatgcgctgctcgtcaccatcctgatctaccgcactctcacgtggtccgagttcgtccatgccaccatcggcgcggtgcgcacgacggccatggtgctgctcgtgatcggctgcgcggcctcgttcggctggcttctggcctatctcaaggtgccgacggcgctggtggccttcatgcaggggctgtcggacaatccgctggtgatcctgctgctcatcaacgtggcgctcctggtgctcggcaccttcatggacatgtcgccgctgatcgtcatcacgacgccgatcttcctgccggtggcgcaggccttcggggtggatccggtgcatttcggcgtcatcctgatcctgaacctcgggatcggcctctgcacgccgcccgtcggggccgtgctcttcgtgggctgcgccgtggggcggatctcgatctggacggcgatgcgcaccatctggcccttctacggggcggccctcgccgtcctgctgctcgtgacctacatcccggcgctgtcgctctggctgccggcccaattccgctga

SEQ ID NO: 56374 - protein, 426 aa, Rhodobacter sphaeroides 2.4.1
MELFILFGSFVFLLLIGTPVAFCLGVSSFLTVLYLGLPPVVVFQRLNSGVSVYALMAIPFFIYSGDLMVRGDIARRLVALAGALVGHLRGGLGQVNVVASVMFGGVSGSAAADASAVGGLMVPQMKARGYGVDYAVNLTVVGSIIALMIPPSHNMIIYSIAAGGRISIADLFTAGIIPGLLLALGLMVAAYFVARRRGYPTERFPGLRALGAIFVSAVPGLILVALIFGGVRSGIFTASESANIAVVYALLVTILIYRTLTWSEFVHATIGAVRTTAMVLLVIGCAASFGWLLAYLKVPTALVAFMQGLSDNPLVILLLINVALLVLGTFMDMSPLIVITTPIFLPVAQAFGVDPVHFGVILILNLGIGLCTPPVGAVLFVGCAVGRISIWTAMRTIWPFYGAALAVLLLVTYIPALSLWLPAQFR

SEQ ID NO: 56375 - DNA, 1281 bp, Rhodobacter sphaeroides 2.4.1
  CDS (1)..(1281)
atgaccatcggcctctttctcggaaccctgatcgcgatgatcggcatcggcgcccccatcgcctatgcgctgatcgtgaccggcgcggcgctgatgtggcagatggggctcttcgacgggcagatcatcgcgcagaacctgctgaacgcggtcgacagtttcccgatggtggcgatcccgctcttcatcctcgccggagaggtgatgaacgcaggcggcctgtcgcgccgcatcgtcgatctggcgcgggcgctcgtcggccaccaccgcggcggcctcggctatgtgaccatcttcgcgggcgtcctgctttcgagcctctcgggctcggcccttgcggatgcggcctcgctctcggcgctgctgctgccgatgatggtggccgcgggccatgcgcgcgaacgctcgggcggtctcatcgcggcctcggcgatcatcggcccgatcatcccgccgagcatcggcttcatcgtcttcggcgtggccacgaacctctcgatcagcaagctcttcatggcgggcatcgcgccgggcctgatgatcgggctcgcgctctgcatcgcgtggttcttcgtctcgcgccgcgacgatgtggcgaccgcacccaaggtcggtgcgcgcgagcggctgcgggccttcggccgcagcctctgggcgctgatgctgccggtgatcatcatcgtcgggctgcgcttcggcatcgtgaccccgaccgaggccgccgccgtcgccgccgtctatgcgctcttcgtggcgctggtcgtctaccgcgagctgagctggcgcgacctgccggacctcgtgctcgacgcaggcaagaccgcggcgggcgtgatgttcctcgtggccgcggccgcgattccggcctggatgatctcggtggccgacattccgggccagctcgtcgacctgatcgagccgctgatgggcaaccagacgctgctgatcgtggtgctgatgctgctgatcctgatggtggggacggcgatggatctcaccccgacgatcctcctgctcggccccattctggtgccggtggtgatcgaggcaggcatcgatccgatctatttcggggtgctcttcatgatcaactgctcgatcggcctcatcacgccgccggtcggcacggtgctgaacgtggtctgcgccgtgggccgtctcgattacgaggcactggtgcgcgggacgctgcccttcctcctcgcgcaggtggccgtgctgttcctcctgatcctcttccccgccctcgtgacccagccgctgcagtggttgctgcactga

SEQ ID NO: 56376 - protein, 426 aa, Rhodobacter sphaeroides 2.4.1
MTIGLFLGTLIAMIGIGAPIAYALIVTGAALMWQMGLFDGQIIAQNLLNAVDSFPMVAIPLFILAGEVMNAGGLSRRIVDLARALVGHHRGGLGYVTIFAGVLLSSLSGSALADAASLSALLLPMMVAAGHARERSGGLIAASAIIGPIIPPSIGFIVFGVATNLSISKLFMAGIAPGLMIGLALCIAWFFVSRRDDVATAPKVGARERLRAFGRSLWALMLPVIIIVGLRFGIVTPTEAAAVAAVYALFVALVVYRELSWRDLPDLVLDAGKTAAGVMFLVAAAAIPAWMISVADIPGQLVDLIEPLMGNQTLLIVVLMLLILMVGTAMDLTPTILLLGPILVPVVIEAGIDPIYFGVLFMINCSIGLITPPVGTVLNVVCAVGRLDYEALVRGTLPFLLAQVAVLFLLILFPALVTQPLQWLLH

SEQ ID NO: 56377 - DNA, 1281 bp, Pseudomonas fluorescens PfO-1
  CDS (1)..(1281)
atggacgcattgattctgctgggcagttttatcgcactgatcctgatcggcatgccggttgcctacgccctcgggctgtcagccctgattggcgcgtggtggatcgacatcccgttccaggccttgatgattcaggtggcgggcggggtgaacaaattctcgctgctggcgattccgttcttcgtgctggccggcgcgatcatggccgagggcggcatgtcgcgacggctggtggcgttcgccggggtcctggtgggctttgtgcgtggcgggctgtcgctggtcaacatcatggcctcgacctttttcggcgcgatttccggctcgtcggtggccgacaccgcatcggtgggttcggtgctgatcccggaaatggagcgcaagggctaccctcgggaattctccacagcggtcaccgtcagcggttcggtacaagccctgctgaccccgccgagtcacaactcggtgctctactcgctggcggccggcggcaccgtttccattgcgtcgctgttcatggccggcgtggtgccgggcctgctgatgagcgcgtgcctgatggtgttgtgtctgatttttgcgcgcaaacgcgactaccccaagggcgaagtgatcccgctgcgcgaagccctgaagatctgcggcgaagccttgtggggcctgatggcgatggtgatcattctcggcgggattctttcggggatcttcacggccaccgagtcggcggccatcgccgtgctgtggtcgtttttcgtcaccatgttcatctaccgcgactacaaatggagtgagctgccgaaactgatgcatcgcacagtgcgcaccatttccatcgtgatgatcctgatcggcttcgccgccagcttcggctacatcatgaccctgatgcagatcccggcgaagatcaccacgctgttcctgaccctgtccgacaaccgctacgtgatcctgatgtgcatcaacgtcatgctgctgttgctcggcaccgtaatggacatggcaccgctgatcctgatcctcacaccgatcctgatgccggtgattctcggtatcggcgtcgacccggtgcagttcggcatgatcatgctggtcaacctcggtatcggcctgataacgccgcccgtgggcgccgtgctgttcgtgggttcggcggtgggcaaggtcagtatcgaaagcacggtgaaggcgctgctgccgttctacgccgtgctgttcctggtgctgatgctggtgacctacgttccggcgctgtcgctttggttgccgcatctggtgttgtaa

SEQ ID NO: 56378 - protein, 426 aa, Pseudomonas fluorescens PfO-1
MDALILLGSFIALILIGMPVAYALGLSALIGAWWIDIPFQALMIQVAGGVNKFSLLAIPFFVLAGAIMAEGGMSRRLVAFAGVLVGFVRGGLSLVNIMASTFFGAISGSSVADTASVGSVLIPEMERKGYPREFSTAVTVSGSVQALLTPPSHNSVLYSLAAGGTVSIASLFMAGVVPGLLMSACLMVLCLIFARKRDYPKGEVIPLREALKICGEALWGLMAMVIILGGILSGIFTATESAAIAVLWSFFVTMFIYRDYKWSELPKLMHRTVRTISIVMILIGFAASFGYIMTLMQIPAKITTLFLTLSDNRYVILMCINVMLLLLGTVMDMAPLILILTPILMPVILGIGVDPVQFGMIMLVNLGIGLITPPVGAVLFVGSAVGKVSIESTVKALLPFYAVLFLVLMLVTYVPALSLWLPHLVL

SEQ ID NO: 56379 - DNA, 1284 bp, Rhodospirillum rubrum
  CDS (1)..(1284)
atgagcgccctcatcatcttcaccctgctgctctgcctgatgctgacgggcatgccgatctcgatctcgctcggcctgacggttctgaccttcctgttcaccatgaccacggtgccgatcgaatcggtggccttgaagctgttcaccggcatcgagaagttcgagatcatggcgatcccgttcttcattctggcgggcaacttcctgacccacggcggggtcgccaagcgcatgatcaatttcgccacggcgatggtcggccattggtatggcggcctggggctgggcggcgtggtcgcctgcgcgctgttcgccgccatttcgggctcgtcgccggccaccgtcgtcgccatcggctcgatcttgctgccggcgatggtcaagcagggctttccccggcgcttcggcgccggcgtcatcaccacctcgggcgcgcttggcatcctgatcccgccgtcgctggtcatggtgatgtacgcggtggcgaccaacacctcggtcggcgccctgttcatggccggcgtcgtccccgggctggtgctggccaccttgctgggcgtcaccacctcggtcatcgcccgcaagaacaactatccgcgcctgcccaaggcgagttgggcgacccgggccaaggccttccgcgaggcgatctggggcctgatgctggtcgtcatcgtcatcggcggcatctattccgggatcttcaccccgaccgaagccgcggcgatgagcgccgtctacgcctttctgatcgccgtcttcgtctataaggacatgccgctgcgcggcgtggtgaagatcttgctgtcctcggcctcgatgtcggcgatgctgctctacatcatcaccaacgcggtgctgttcagcttcgttctggccaatgagaacattccccaggccatcgccgactggatcgtcggcaaggaactgggcatcgtcgccttcttgctggtggtcaacgtcctgctgctggcggcgggcaatttcatggagccgtcatcgatcgttctgatcatggcgcctattcttttcccggtggcgatgaagctgggcatcgatccggtgcatttcggcatcctgatcatcgtcaacatggaggtcggcatgtgccatccgccggtcgggctgaacctctatgtcgcctcgggcattaccaagatgggaatatccgagctgacggtggcggtgatgccctggctgctgaccatgctgggcttcctgatcgtcgtcacctattggccgggcctgtcgctgtggctgccccgggccctgggcatgatgtag

SEQ ID NO: 56380 - protein, 427 aa, Rhodospirillum rubrum
MSALIIFTLLLCLMLTGMPISISLGLTVLTFLFTMTTVPIESVALKLFTGIEKFEIMAIPFFILAGNFLTHGGVAKRMINFATAMVGHWYGGLGLGGVVACALFAAISGSSPATVVAIGSILLPAMVKQGFPRRFGAGVITTSGALGILIPPSLVMVMYAVATNTSVGALFMAGVVPGLVLATLLGVTTSVIARKNNYPRLPKASWATRAKAFREAIWGLMLVVIVIGGIYSGIFTPTEAAAMSAVYAFLIAVFVYKDMPLRGVVKILLSSASMSAMLLYIITNAVLFSFVLANENIPQAIADWIVGKELGIVAFLLVVNVLLLAAGNFMEPSSIVLIMAPILFPVAMKLGIDPVHFGILIIVNMEVGMCHPPVGLNLYVASGITKMGISELTVAVMPWLLTMLGFLIVVTYWPGLSLWLPRALGMM

SEQ ID NO: 56381 - DNA, 1353 bp, Burkholderia fungorum LB400
  CDS (1)..(1353)
atggaacttgccattctctccgtcagtttcctcgtctttcttcttctcggcgttcctgtttccttcgggctcgggctctcgtgtgtcctgacttacctgtacgaaggcttgccggcggccaccgccatgcagtcgatgatttcgggcatcaacggtttttcgtttctcgcggtgccgttcttcattctgtccggtgaactgatgctgcacggcggtatcgcggaccgtatcctgcgtttcgcgcaagccaccgtcgggcattttcgcggcggcctgggcatggccaacgtggtcgcgtgtacgttgttcggcggcgtctccggttcgccttcggcggatacctctgcaatgggcggcgtggtgatcccgctgatgaagcgtgaaggctacagcgcggcctacgcggtcaacgtgacgacacactcttcgctggcgggcgcgttgatgccgacgtcgaccaacatgatcatctatgcgttcgcggcccaaggcatcaccggcaccttgaatggacacccgatgagcggagtgtcgattggcgatctgctgttttccggtctgctgccggtattgtgggtgatgggtttcgtgctgctcgccgcgtactggcaagccgtcaaatatggctatccgcgtcgtccggatggttcgaccgaattgcagcgattccccggctggtacgccgtggcccgcacgttcctcggcgcattgcctggcctgatggtgatcgcgatcattctggtttgcgtcgcaaagggtattgccaccgcgacggaagccgccgcaatcgccgtgttttattcgctcgtgctgacgatcgtcgtgtatcgctcgatgacgatgaagaagctgtttcatgcgctctcgaaggcggccaaaaccaccggcgtggtgctgctgctgatcggcgtgtcgaacatgttgcgctaccagatggcttatctggagattccggatgcgatcgaacacatgctcgacggcgcgaccagcttgccctggctgatgctgctgtacatcaacctgatccagattttcctcggtacgttcgtcgatatggcggcgcacatcctgatcaccacgccgctgttcctgccgatggcgatgcacgcgggcgtaggtccggtgcagttcgggatcatgatcctgctgaactgcgcactgggtctggtgcacccgccgatcggttcggtgcagttcatcggctgcgcgatcggcaatgtgtcgattggtgaaactaccaaggtggcgtggccgtattacctggcgatcttcagcgcgatcaacatcgtgacttacgtgccgatgttttccacctggctgccgagcctgatcaatggccatccggtattttga

SEQ ID NO: 56382 - protein, 450 aa, Burkholderia fungorum LB400
MELAILSVSFLVFLLLGVPVSFGLGLSCVLTYLYEGLPAATAMQSMISGINGFSFLAVPFFILSGELMLHGGIADRILRFAQATVGHFRGGLGMANVVACTLFGGVSGSPSADTSAMGGVVIPLMKREGYSAAYAVNVTTHSSLAGALMPTSTNMIIYAFAAQGITGTLNGHPMSGVSIGDLLFSGLLPVLWVMGFVLLAAYWQAVKYGYPRRPDGSTELQRFPGWYAVARTFLGALPGLMVIAIILVCVAKGIATATEAAAIAVFYSLVLTIVVYRSMTMKKLFHALSKAAKTTGVVLLLIGVSNMLRYQMAYLEIPDAIEHMLDGATSLPWLMLLYINLIQIFLGTFVDMAAHILITTPLFLPMAMHAGVGPVQFGIMILLNCALGLVHPPIGSVQFIGCAIGNVSIGETTKVAWPYYLAIFSAINIVTYVPMFSTWLPSLINGHPVF

SEQ ID NO: 56383 - DNA, 1287 bp, Burkholderia fungorum LB400
  CDS (1)..(1287)
atgcccgccttcctgttcgtgcttttcatcggcctgatggccctcggcgtgccggtgacgatggcgatcggcgcgtcggcgctctccgtattcgcgatgagcggcttcaccgatgcgctttatgtgttgccgcaacagatgctcgaaggcatcgacagcccgtcgatgatgtcgattccgtttttcattctcgcgggcaacctgatgaacgcggtgggcgtgaccgaccggatcttctcgctggctctcgtgctcgtggggcgttttcggggcggccttgcgcaggtcagcgtgattgcggccgccatcttctccggcatttcgggctcggcgctcgccgacatcgcgggactcggggcgatcgaagtgaaagccatgcgcgagcgcggctaccctgctgaattcgccgctgccgtatccgtcgcgtcgtcggtcatggcgccgatcatgccgccgtcgattgcgttcattgtgtacgcgtcaatggccaatgcgtcggtggcccgcatgttcatggcgggcatcgtgcccgccacgttgctggcgatttcactgatggtgtgcaatcgcatcattgccggcaggcggggttatccgcgagaggaagccatgccgttcgacctcgcggtgcgtaccgtcatcgccggcctgcccgcgctcggcgcaccggcgatcattctgatcggcacgatgggcggctatacgacggttggcgaagcgggcattctcgcttcggtctattcgatgctgctcggtttcgcgtaccgctccatcaacctgaagaaagtctggcaagcgatcaacgacacggtttctgtcacggccctgatcatggtgatcatcgggttctcgcatttcatgagctgggtgctggccatccagcaggcgccgcagcatctggcagcgctcgtgctgacgctcacgcaatcgccgacggtcctgatgctgctgctcgtcgcattcctgctcttcatcggctgctttatcgaaagcgcgccggccaagctgattctcgtgccggtgctgctgccggtaatcgaccagttcggcatcgaccgcgtgcagttcggcgtggtgatgacgctcgctctcgcactcggcatcgcgcatccgccaatgggtgtaggcctctttgtcgtgacgcgcgtgtccaatgtgtcgctggaacgcgtcacgatggcagtgctgcctctgctgattccgctgctcgtcgtcctgatcgtcgtggcgctgattccttcgctatcgacgtggctgcctgatctggtgatgggcgcgccttcctga

SEQ ID NO: 56384 - protein, 428 aa, Burkholderia fungorum LB400
MPAFLFVLFIGLMALGVPVTMAIGASALSVFAMSGFTDALYVLPQQMLEGIDSPSMMSIPFFILAGNLMNAVGVTDRIFSLALVLVGRFRGGLAQVSVIAAAIFSGISGSALADIAGLGAIEVKAMRERGYPAEFAAAVSVASSVMAPIMPPSIAFIVYASMANASVARMFMAGIVPATLLAISLMVCNRIIAGRRGYPREEAMPFDLAVRTVIAGLPALGAPAIILIGTMGGYTTVGEAGILASVYSMLLGFAYRSINLKKVWQAINDTVSVTALIMVIIGFSHFMSWVLAIQQAPQHLAALVLTLTQSPTVLMLLLVAFLLFIGCFIESAPAKLILVPVLLPVIDQFGIDRVQFGVVMTLALALGIAHPPMGVGLFVVTRVSNVSLERVTMAVLPLLIPLLVVLIVVALIPSLSTWLPDLVMGAPS

SEQ ID NO: 56385 - DNA, 1887 bp, Burkholderia fungorum LB400
  CDS (1)..(1887)
atgtcgaatcacgcattgaatccggcggacgcgggcgtgccgctgcacgcggcgagcacgccgcgccgctggttgaggagtttcgatcgcggtctgattgcgctcgtcgaagtgtgcgcggcggcgctgctcgcggtggagatcgtcgtgatgctcgcgggcgtgatgtgccgctacgtgctgcatcaaccgctcgtgtggtccgatgaactggcgggcattctgttcctgtggctcgccatgctcggcgccgtgctcgcgttgcggcgcggcgaacatatgcggatgacggcactggtcagccgcctgtcgccgcagcggcgcgcgttcgtcgatacgctggcgatcgccgcgtcgatcgcattgcttgcgctgttgatcgctcccgcctacgactatgcgtccggcgaggcggcgatcgtgacgcccgccctgcagatcagcaatgcgtggcgcgcgctcgctttgccgatcggcgcagcgctcatgctgctggtcggtctgattcgcctcgcccaggtgagccgtgtgcgcgacgtcgtaatcgtgctcgcgatcacggccgtactggccgcgatagccatgttcgccgggccgtggtttcagacgctcggcaaaaccaatctcgtgatctttttcgtgggcgtggtggcgatcgggatcttttcgggcgtgcctatcggcttttcgtttgcgctcgccacgttcggttatctgggcctctcgaccttcacgccgctcgaagtcgtggtcggccgcatggacgagggcatgtcgcatctcgtgctgctcgctgtgccgctgttcgtctttctcggcttgctgatcgagatgaccggcatggcgcgcgcgatgatcgagtttctcgcgagcctcgtcggccatgtgcatggcggactgtcattcgtgctgatcggcgcgatgtatctggtgtcgggcatttccggttcgaaagtggcggacatggcggcgatcgcgcccgtgctgttcccggagatgaaaaaacgcggcgcttccgaaggcgatctggtcgcgctgctcgccacgaccggcgcgcaaagcgaaaccattccgccgagcattgtgctgatcacgatcggttcggtcacgggtctgtcgatctccgcgctcttcaccgcgggcatgctgccaggcgcggtgctcgcgctgattctgtgcgcggtggtgtggtggcgctatcgcaaggaagacctgagcggcgcgcagcgtttcagcaagcggcagatcgggcgtctgttcatcgtgtcgctgcccgcgctggcgttgccgtttgtgattcgcatggcagtggtcgaaggcgtggcgacggcaaccgaggtgtcgaccatcggcattgcctattcgatgctgatcggcctgctggtgtaccgccgcttcgaatggcggcggctgggccgcatgctggtggatgcggccacgttgtcgggcgcgatcctcttcatcatcggctgtgcgactgcaatggcgtgggcgctgacgcaatccggcttttcgcaggatcttgcgcaagtcatgggctcgatgcccggcggcgcgtacggttttctggcggtttcgattgtcgtgttcgtgatgctcggcagcgtgctcgaaggcattcccgcgatcgtgctgttcgggccgctgctgtttcctatcgcgcggctcgcgggcgtgcacgaagtgcattacgcgatcgtcgtgattctctcgatgggcgtggggctcttttcgccgccgttcggcgtgggctactactcggcgtgcgcgatcagcaaggtcaatcccgacgcgggcattcgtccgattgtcggctatatgggcgcattgctcgtcggcctgattctggtcgcggcgatcccctggatttcgatcgggtttctctaa

SEQ ID NO: 56386 - protein, 628 aa, Burkholderia fungorum LB400
MSNHALNPADAGVPLHAASTPRRWLRSFDRGLIALVEVCAAALLAVEIVVMLAGVMCRYVLHQPLVWSDELAGILFLWLAMLGAVLALRRGEHMRMTALVSRLSPQRRAFVDTLAIAASIALLALLIAPAYDYASGEAAIVTPALQISNAWRALALPIGAALMLLVGLIRLAQVSRVRDVVIVLAITAVLAAIAMFAGPWFQTLGKTNLVIFFVGVVAIGIFSGVPIGFSFALATFGYLGLSTFTPLEVVVGRMDEGMSHLVLLAVPLFVFLGLLIEMTGMARAMIEFLASLVGHVHGGLSFVLIGAMYLVSGISGSKVADMAAIAPVLFPEMKKRGASEGDLVALLATTGAQSETIPPSIVLITIGSVTGLSISALFTAGMLPGAVLALILCAVVWWRYRKEDLSGAQRFSKRQIGRLFIVSLPALALPFVIRMAVVEGVATATEVSTIGIAYSMLIGLLVYRRFEWRRLGRMLVDAATLSGAILFIIGCATAMAWALTQSGFSQDLAQVMGSMPGGAYGFLAVSIVVFVMLGSVLEGIPAIVLFGPLLFPIARLAGVHEVHYAIVVILSMGVGLFSPPFGVGYYSACAISKVNPDAGIRPIVGYMGALLVGLILVAAIPWISIGFL

SEQ ID NO: 56387 - DNA, 1296 bp, Enterococcus faecium
  CDS (1)..(1296)
atggcaatagaagccggattagtgttattttttgtatttgttgtgttgcttgtattagggatgccgattgctataagtattgcattctcatcgatgatgactttattgttagttataccgtttgatgtttctgcttttagttcagctcaaaaaatggtgggaagtatcaatagtttttcgctgatcgctattccgtttttcgttctctcgggcattatcatgaataatggagggatagctaagaaactagtggattttgcgatgttgttcgtcgggcgcgtgccgggggctttggctcatacgaatgtgttagggaatgctttatttggttccatctctagctcggccattgccgcttctaccgcgattggcggagtgttgatccctcagcaagtggaagaaggatatgaccggaagtttgcgacagcggtcaatatcgcgtcagctccgacaggtatggtcattcctccaagtactgcttttatcatgtattcacttgttgctggtggtgcttcgatctctgctttgtttatgggaggttatctcgtaggcgctttgtgggcgctaggaatcatgctagtagcattcatcgttgctaaaaagaataaataccctgttgtcgaaaaaggacagatggctcatgctggaaaaataataaaagaggcgattcctagccttctattgattgtcatcattatcggtggtatcttgacggggatatttacagcagtagaagcttcagcgatagctgtcatttactccctgttgattgctatgttttactataaaacggtaaaactaaaagatatacctaatatgttgtttcaatcagtagcaatgtcagggacgatcatgttcttattggctacttcttccatgatgtctttcgccatggcgtttaccggtattcctcaggcaattagttcgttgattatgggcgtaacggataataaatttattattctgttattagtcaatcttgtgttattactggtgggtatgtttatggatgtggcgcctgctatcttgatttttacaccaatatttttaccaatcgtcacaagtgtaggggttgatcctgtacattacgggttgttttcaatcatgaatctgtgtgtaggctccatcacgccgccagtaggtacaggactatatgtcggtgcaagtgtaggaggcgtaaaagcagaggcaatgctgaaaccgcttcttcctttttatggggttatcttagtcgtcttgtttttgattacttacttcccgcaaatcgtcatgtggctacccaatatgctgagttag

SEQ ID NO: 56388 - protein, 431 aa, Enterococcus faecium
MAIEAGLVLFFVFVVLLVLGMPIAISIAFSSMMTLLLVIPFDVSAFSSAQKMVGSINSFSLIAIPFFVLSGIIMNNGGIAKKLVDFAMLFVGRVPGALAHTNVLGNALFGSISSSAIAASTAIGGVLIPQQVEEGYDRKFATAVNIASAPTGMVIPPSTAFIMYSLVAGGASISALFMGGYLVGALWALGIMLVAFIVAKKNKYPVVEKGQMAHAGKIIKEAIPSLLLIVIIIGGILTGIFTAVEASAIAVIYSLLIAMFYYKTVKLKDIPNMLFQSVAMSGTIMFLLATSSMMSFAMAFTGIPQAISSLIMGVTDNKFIILLLVNLVLLLVGMFMDVAPAILIFTPIFLPIVTSVGVDPVHYGLFSIMNLCVGSITPPVGTGLYVGASVGGVKAEAMLKPLLPFYGVILVVLFLITYFPQIVMWLPNMLS

SEQ ID NO: 56389 - DNA, 1287 bp, Magnetococcus sp. MC-1
  CDS (1)..(1287)
atgaccgttatactcctctttcttggtttgatctttttgttgctaatcggggtgcccattgccatcagcctggggttatccagcctgctgtttgttttgtttgccggcgaagatccctccatggcgattaccgttgcgcaaaagctctttagtaccatggagcacaccaccttattggcgattccgttttttattctctcgtcacactttctcaccacgggcggggtttcgcgccgtttgattgagtttgccaaagcgctggtgggttggatgaccggtggtctggccatggcgggggtggtctcttgcatgttgtttgcggcgatttcgggctcttctccggccacggtggttgccattggctcaatcatgataccgggcatgatctcggctgggtatgacaaacgctttgcggtgggggtgatcgccacctcgggctcgttaggcattttgatcccgccctcgatccctatgattgtctatgccgatgcggtggaagagtcggtggggaaaatgtttatcgcgggtattttgccgggtctattgatgggctctatgttgctgctggccacgtgggttgcggccaaacgtatgaacatgcccaaagagccttggcagggattttcccacctgatcaagacgtttttaaaagcgttttggggcttgttgctgatcggtattgtggttggtggcatttatggagggatctttacccccaccgaagcggccgctgtggcggcggtctattccgcctttatcgcgctgtttgtgcaccatgatatggggttcaaggagatccccaaggtgatgttggattctgccaagatgaccgccatgttgatgttcatcatcgcctgtgccatgatctttgcccatgtgttgaccgaggagcgcattccccaagaactggcggcccaggtgatggcgaataatccatcgccttacatgtttttgctgttggtgaatgtgatcctatggtttgccggtgattttatggaaccctcggcgattttgcttattctatcgccgctgttccatcccatcgctgtgagtttgggtattgatccgatccatctaggtattatcatgaccaccaatatggaggtgggtatgatcaccccaccggtggggcttaatctctatgtggcggcaggtttgtcgggtatgagtttgggggctgtcacacgcgcggcgatgccgtggatgtttgtgctgattgccgccttggtggtcattacctatgtgccatggttgagtttggtgttggtcaatctgctttacggttga

SEQ ID NO: 56390 - protein, 428 aa, Magnetococcus sp. MC-1
MTVILLFLGLIFLLLIGVPIAISLGLSSLLFVLFAGEDPSMAITVAQKLFSTMEHTTLLAIPFFILSSHFLTTGGVSRRLIEFAKALVGWMTGGLAMAGVVSCMLFAAISGSSPATVVAIGSIMIPGMISAGYDKRFAVGVIATSGSLGILIPPSIPMIVYADAVEESVGKMFIAGILPGLLMGSMLLLATWVAAKRMNMPKEPWQGFSHLIKTFLKAFWGLLLIGIVVGGIYGGIFTPTEAAAVAAVYSAFIALFVHHDMGFKEIPKVMLDSAKMTAMLMFIIACAMIFAHVLTEERIPQELAAQVMANNPSPYMFLLLVNVILWFAGDFMEPSAILLILSPLFHPIAVSLGIDPIHLGIIMTTNMEVGMITPPVGLNLYVAAGLSGMSLGAVTRAAMPWMFVLIAALVVITYVPWLSLVLVNLLYG

SEQ ID NO: 56391 - DNA, 1386 bp, Magnetococcus sp. MC-1
  CDS (1)..(1386)
atggaagcgtatgccgcgctctacatgtttgctggggtctgtgtggtgctgctgtcgggttatcccgtggcttttgcgctagggggaaccgcgctgctatttgcgtgggggggatctctacttgacctttacgatctaagcgatctggcctttatgcccaaccgcctgttcggcattatgaccaacgatacgctgattgccgtaccgctgtttatctttatgggtatggtgctggaacgctcccgggtggccgaacagctgctggataccatggccatgctgtttggcccattgcgggggggcttgggtatctctgtcaccctggtgggcatgctgatggccgctagtaccggcattgtgggggcgaccgtcgtgaccatgggtctgctctcgctgccaaccatgctgcgacgcaactatgatcccgctgtggcggcgggtaccatctgcgcctcgggtaccttggggcaaattatccccccctccattgtcttggtgctgctgggggatgtgatctcggcctcctatcaacaggcgcaactgcaaatgggcagctactccccccgcaccatctcggtgggggatctgtttgtgggggcgttgattcccggtttaatgctggtggggttctatatcctttatctgctgtggctggcttggcggcggcccgaggcggtacccgcaatccccgcgcaagagcgcaccttaaaagggcgggcgctggttttgcaggtattcaaggtgctggtaccaccactgtttttaatcctggcggtgctgggctctatccttggcgggctggcgacgccgaccgaagcggcctcggtgggggccatgggggccttgctgttggcggccctgcaaaaacagctcaccctgcaaaccctgcaaagggttatgcaaggcaccacccgtgtcaccagtatggtctttttaatctttgtgggggcaaccctcttttccctggtttttcggggttttggtggcgatcagctggtcgcagagctgctacaggatctacccggtggtaagtttggggcgatgctggctgtgatgctgcttatgtttgtgttgggcttttttattgattttatcgagatcacctttgtggtggtgcccatcgttggccccattttgctcatgatggggtttgaccccatctggttgggggtgatgatcgccatcaatttacaaacctcgtttttaaccccgccctttggcttttcgctcttttatctacggggggtggcccctgcgcagctctctacgctacagatctatcgaggggtgttgccctttattgcccttcagatgctggctttagccgcgctggcacagtggcccaatctggcgacatggttgccgaggctggtttatggcgagtaa

SEQ ID NO: 56392 - protein, 461 aa, Magnetococcus sp. MC-1
MEAYAALYMFAGVCVVLLSGYPVAFALGGTALLFAWGGSLLDLYDLSDLAFMPNRLFGIMTNDTLIAVPLFIFMGMVLERSRVAEQLLDTMAMLFGPLRGGLGISVTLVGMLMAASTGIVGATVVTMGLLSLPTMLRRNYDPAVAAGTICASGTLGQIIPPSIVLVLLGDVISASYQQAQLQMGSYSPRTISVGDLFVGALIPGLMLVGFYILYLLWLAWRRPEAVPAIPAQERTLKGRALVLQVFKVLVPPLFLILAVLGSILGGLATPTEAASVGAMGALLLAALQKQLTLQTLQRVMQGTTRVTSMVFLIFVGATLFSLVFRGFGGDQLVAELLQDLPGGKFGAMLAVMLLMFVLGFFIDFIEITFVVVPIVGPILLMMGFDPIWLGVMIAINLQTSFLTPPFGFSLFYLRGVAPAQLSTLQIYRGVLPFIALQMLALAALAQWPNLATWLPRLVYGE

SEQ ID NO: 56393 - DNA, 1209 bp, Microbulbifer degradans 2-40
  CDS (1)..(1209)
atgcttgctaccatcgattttattcctgcagctatgacgatggcccagcgcatggggggcggcataaatagcttctctttgttggccataccgttttttattctttccggcctgcttatggggcgcggcggtattgcgcatcgtttaattgagttcgccaaagtggttattggtatgttgcctggcggcttagcgtttgtgaatattattagctgtacgctgtttggtgctatttcgggttctgctgttgcagcaacgtcagcgataggtgggtttatgattcccaccatgaataaggaaggctacgacaaaaactttaatgctgcggttactgtggcgtcgtcaacaactggcctacttattccgccaagtaatattttaattgtttattctcttgctagtggcggtgtttctattgctgcattattcgtggcgggttatttgccaggtttattggtggcgttatctttaatggttgtgtgtgccatatacgcaaaaattcacaattaccctgttggaaaaattccaaccgcgcgtgaattcgcaagaaagtctattgatgctgtaccaagcttgatgcttattgtgttggttattggcggtattattggtggctttttcactgctaccgaggccagtgtggtcgctgtgctgtatgcgctttcgttgtcggtatttgtgtataaagaagtgcgagtgtctgatctgcccgacattttagtgaagtcggtggagacaacggcaatcgttatgctgctaattggtacttctacggcaatgtcgtggatgttgagctatgagaacataccgcaaagcatcagtgctgcgttaatggggttaagcgataacccgtttattattctacttaccattaaccttattctgttgtgtgtaggtgtgtttatggatatgacgcctgcggtacttatatttacccctatctttttgccggttgctgtagagttgggcatgtcgcctctgcacttcggtattatgatggtgttaaacctctgtatcgggctgtgtacaccaccggtgggagcggtgctgtttgtgggttgcggtattgccaaaaccactataggtcagcttattaaaccgcttatgcctatgtacgcggccatggtggtggccctgttactggtagcgtatgtgcccgcaattagtgagtttttacccatattcttcgatctatacgataagccctaa

SEQ ID NO: 56394 - protein, 402 aa, Microbulbifer degradans 2-40
MLATIDFIPAAMTMAQRMGGGINSFSLLAIPFFILSGLLMGRGGIAHRLIEFAKVVIGMLPGGLAFVNIISCTLFGAISGSAVAATSAIGGFMIPTMNKEGYDKNFNAAVTVASSTTGLLIPPSNILIVYSLASGGVSIAALFVAGYLPGLLVALSLMVVCAIYAKIHNYPVGKIPTAREFARKSIDAVPSLMLIVLVIGGIIGGFFTATEASVVAVLYALSLSVFVYKEVRVSDLPDILVKSVETTAIVMLLIGTSTAMSWMLSYENIPQSISAALMGLSDNPFIILLTINLILLCVGVFMDMTPAVLIFTPIFLPVAVELGMSPLHFGIMMVLNLCIGLCTPPVGAVLFVGCGIAKTTIGQLIKPLMPMYAAMVVALLLVAYVPAISEFLPIFFDLYDKP

SEQ ID NO: 56395 - DNA, 1299 bp, Microbulbifer degradans 2-40
  CDS (1)..(1299)
atggatattacagcattaattttactttttgtttttggtgttctactcgccataaacgtacccatcgccattgctattgccatttctacgctggctacaatgttagttacgattgattccttgcccgcagttacaacgcttgcacagcgcatgagcgcaggtatggatagctttgccctattggccattcccttttttatattctctggctttttaatggggcaaggcggcattgcacgtaggctaattgattttgccaaagtgttggttggtcaattaccgggcgggttagcatttgtaaatgttatagcctgtgcgttatttggttctatttctgggtcggcagtggctgccacatcggcaattggcgggtttatgattccagccatgaacaaagaaggttacgacaaaaactttaataccgcggttacggttacagcctctacaacaggtatgcttattccccccagcaatattctcattatttattcactggcgagtggtggcgtttctattgctgcgttatttattgcagggtacctacccggtattctagttgctatatcacttatgtgtgtgtgtggtatttatgcaaaacgtcgtggctaccctgttggccagcgtgaatcattcgccacagccattaagaaaacagtgggtgctattcctagcttgtttttagtggtgttggtaataggcggtattattggtggttactttacaccaacagaggccggtgccatcgcagtggtgtattcgcttgtactatcaatggtgatttacaaagaaatcaagcccaaccaaataccagccatactaaccaaatcggttaccactacggctattgtaatgctactaatcggcgcttctgccgctatgtcttggttgctttcttacgagaatatccctcaagagataagtgctggcttattaggcattacagaaaacaaaattatcttgctgctacttattaacgtgttgttactggtagtgggtacatttatggatatgactcctgcagtgcttatttttactccaatctttttacctattgtagaaacgctgggtatatcgccactgcattttggcattattatgattctcaacttatctatcggcttgtgtaccccccctgttggcagcgtattgtttgtaggttgtagtgtgggtaaaacttccattgcgcaggttattaagccgctaatacctctatatatagccatgtttatagcccttgctctggtaaccgcatttccacaaataagcgagtatctaccaaaagcgtttggtttatattag

SEQ ID NO: 56396 - protein, 432 aa, Microbulbifer degradans 2-40
MDITALILLFVFGVLLAINVPIAIAIAISTLATMLVTIDSLPAVTTLAQRMSAGMDSFALLAIPFFIFSGFLMGQGGIARRLIDFAKVLVGQLPGGLAFVNVIACALFGSISGSAVAATSAIGGFMIPAMNKEGYDKNFNTAVTVTASTTGMLIPPSNILIIYSLASGGVSIAALFIAGYLPGILVAISLMCVCGIYAKRRGYPVGQRESFATAIKKTVGAIPSLFLVVLVIGGIIGGYFTPTEAGAIAVVYSLVLSMVIYKEIKPNQIPAILTKSVTTTAIVMLLIGASAAMSWLLSYENIPQEISAGLLGITENKIILLLLINVLLLVVGTFMDMTPAVLIFTPIFLPIVETLGISPLHFGIIMILNLSIGLCTPPVGSVLFVGCSVGKTSIAQVIKPLIPLYIAMFIALALVTAFPQISEYLPKAFGLY

SEQ ID NO: 56397 - DNA, 1278 bp, Thiobacillus denitrificans ATCC 25259
  CDS (1)..(1278)
atgacgctgttgccgttcgtggcgctggccttgctcggcgtgccgctcttcgtcgtgctgggcgcggcggcgctcgtcgcgacccgcgatgcgcaactcgattccgcgctcctgatggtcgagttcgcgcggctcgccgcatcacccaatctggtcgcgattccgctcttcgtgctcgccggcgcgaccatggggcacggcggcgccgggcgccgcctggtccgcttcttcaacgccttgctcggatggatgccggcgggcatcgcctgggttgccgccgcgtcgtgcatgctcttcaccgctttttccggcgcgtccggcgtcacgatcctcgcgctcggcggtctgctgtatccgatgctcaaggacgagggttacccggaacgcttcgcgctcgggctcatcagttcgggcggctccatggggctgctgctgccgcccagcctcgcggtgctgctctacggcgtcgttgcccaggtcgatatcggcgatttgttcgtcgccggcctgctgccgacgctgctgctgttcgtgatggtcgggagttatgccgtccggcggggcgcgcgcggggcgccgcgtcaccgcttccgatggcgcgaactcgcggccgcggcgcgcgcgggctgggccgatctgctgctgccgatcggcgtcgttgcgggcctggctgccgggctgttgaccgtcgccgaactcgccgcatgcagtgcgctctacgcgctcgtgctcgaaacagtggttcaccgcacgatccgcgcgaaagaactcgcgtgggtgggctacgaagcggcgacgctggtcggcagcatcttcgtcatactcggcttgagcctcggactgaccaatctgctggtcgatgcccaggtgccgatgcgcttgctcgattgggtcgtcgagcaggtgcacagcccgctcgctttcctgctctggatgaacgccgtcctgctcgtggtgggctgcatgatggatatcttttccgcgatcgtgatcgtcacgccgctgctcctgccgctcgcgacccatttcgggatccacccgctgcacctcggcatcgtggttctggcgaacctcgagatcggctatctgacaccgcccgtgggcatcaacctctaccttgccagccagcgcttcaaacaacccgtgctcacggtgttccgtgcgacgctgccgttcctgctgctgctgctcgtctggctgctactcctcacctacgtgcccgcgctgagcctctggaatcaaggcatgcacggtgcggcggctcagcttccgctgtag

SEQ ID NO: 56398 - protein, 425 aa, Thiobacillus denitrificans ATCC 25259
MTLLPFVALALLGVPLFVVLGAAALVATRDAQLDSALLMVEFARLAASPNLVAIPLFVLAGATMGHGGAGRRLVRFFNALLGWMPAGIAWVAAASCMLFTAFSGASGVTILALGGLLYPMLKDEGYPERFALGLISSGGSMGLLLPPSLAVLLYGVVAQVDIGDLFVAGLLPTLLLFVMVGSYAVRRGARGAPRHRFRWRELAAAARAGWADLLLPIGVVAGLAAGLLTVAELAACSALYALVLETVVHRTIRAKELAWVGYEAATLVGSIFVILGLSLGLTNLLVDAQVPMRLLDWVVEQVHSPLAFLLWMNAVLLVVGCMMDIFSAIVIVTPLLLPLATHFGIHPLHLGIVVLANLEIGYLTPPVGINLYLASQRFKQPVLTVFRATLPFLLLLLVWLLLLTYVPALSLWNQGMHGAAAQLPL

SEQ ID NO: 56399 - DNA, 1377 bp, Silicibacter sp. TM1040
  CDS (1)..(1377)
atggaagtggttcttctttttacactggtcattggccttttgctgatcggggtgccgattgcggtttctctgggtctgtcgtccaccattttcctgctgatctattccgacagctcgctcggctcggttgcagggacgttgtttcaggcctttgaagggcatttcaccctcttggcgatcccgttcttcatccttgcgtcgagctttatgaccacgggtggtgttgcacgccggatcatccgtttctcgattgcctgtgtgggccacctgccgggtggtctggcgattgcgggggtctttgcctgtatgctctttgctgcgctgtccggctcgtcgccagcaaccgtggttgcgatcgggacaatcgtgatcgcgggcatgcgccaggtgggctattccaaggagttcgccgcaggtgtgatctgtaacgcgggcacgctcggtatcctgatcccgccgtccatcgtgatggtggtctacgccgcagcggttgaggtctcggtcgggcggatgttccttgctggtgtcattccgggcctgatggcgggcatcatgctgatggtcacgatttatgtgatggccaaggtcaagaacctgcccaaaggcgagtggaacggctggggagaggtctttgcctctgcgcgtgaagctggctggggtctgttcctgatcgtgatcatcctgggcggcatttatggcgggatcttcaccccgaccgaagcggcagcggttgcggctgtctatgccttcttcatcgcgtgttttgtctataaggacatggggccgctttccaatggagaggggcagcccaaggactcgcttctgaagaaaccctatgcgctgatcaccgcgtttttccacagcgacaccaaacacacgctgtttgaggctggcaaactcaccgtgacgctgttgtttgtgatcgccaacgcgctgatcctgaagcatgttctgaccgacgagcaggtgccgcagcatattgcaaacgcgatgctctcggcaggttttggcccagtgatgttcctgatcgtggtgaacgtgatcctgctgattggcggtcagttcatggagccctcgggcctcctggtgatcgtggcgcccctggtgttcccgattgcaatcgagctggggatcgaccccattcacctcgggatcatcatggttgtgaacatggagatcgggatgatcacaccgccggtggggctcaacctctttgtgacctccggggttgcggggatgccgatgatggcggtcgtgaaggctgcgctgcctttccttgcggtgctctttgtgttcctcatcatggtcacctacatcccggcgatctcgaccttcctgcccaatatgatcatggggcctgagatcataaccaactga

SEQ ID NO: 56400 - protein, 458 aa, Silicibacter sp. TM1040
MEVVLLFTLVIGLLLIGVPIAVSLGLSSTIFLLIYSDSSLGSVAGTLFQAFEGHFTLLAIPFFILASSFMTTGGVARRIIRFSIACVGHLPGGLAIAGVFACMLFAALSGSSPATVVAIGTIVIAGMRQVGYSKEFAAGVICNAGTLGILIPPSIVMVVYAAAVEVSVGRMFLAGVIPGLMAGIMLMVTIYVMAKVKNLPKGEWNGWGEVFASAREAGWGLFLIVIILGGIYGGIFTPTEAAAVAAVYAFFIACFVYKDMGPLSNGEGQPKDSLLKKPYALITAFFHSDTKHTLFEAGKLTVTLLFVIANALILKHVLTDEQVPQHIANAMLSAGFGPVMFLIVVNVILLIGGQFMEPSGLLVIVAPLVFPIAIELGIDPIHLGIIMVVNMEIGMITPPVGLNLFVTSGVAGMPMMAVVKAALPFLAVLFVFLIMVTYIPAISTFLPNMIMGPEIITN

SEQ ID NO: 56401 - DNA, 1302 bp, Silicibacter sp. TM1040
  CDS (1)..(1302)
atgacgacagctatttttcttctctttggcagttttgtcgtgctgatggcgctgggtgtgccgattgcgtttgctattggtcttgcgaccaccgcgacgttcttgttgtttatgggagtggaccaatccctgtttatcgttgcgcagcaaatggcgtcagggttggacagctttacgcttctcgccattccattttttatcttggcggggaacatcatgaaccgcggtgggatcgccatgcggttgatcaacttcgccaaagtgctgggcggtcggcttcctggcgcgctggcccattgcaacgtgattgccaacatgatgttcggatctatttccggatctgctgtggcctctgctgcggcagtgggcggcgtgatggctcctttgcaaaagaaagagggttacgatcctgctttttctgctgcggtcaatattgcctcctgtccgacaggcctgttgataccgccgtcagcaacgttgatcgtttactccttgatcactggcggaacatctatagccgcgttgttcgtagctggatatttgcccggcatcctgatggggctgggattgatgatcgtggctggtgtgatcgctaagcggcgcggctatcctgttgcgccccgtcccgcactcagcgaggtcatggtggccgcgcgcgatgcagccttgcctctgggcctgatcgtgatcgtgatgggcggcatcatctcgggtgtcttcacggcaaccgaggcctcggccgcagcagtgctctacacgctggttttggcattggtctggtaccgcgaaatcacgattaaggatttgcccgcaatattgatagaaagcgcggtcactacttcagtggttctattgatgatcggcgcgtccatcgcgatgagccgtgtcatggcctttggcggcatcccttttgcgatctcagatttcttgttgggtctatctgataacccgattgctatcctcctggcgatcaacgtggcgctgctggtcgtcgggacctttatggatatgacacctgcgctcttaatcttcacgccaattttcatgccagttgtcaaaggccttggtatggaccctgtgcattttggcatcgtgatgacgctaaacctctgcattggtatctgtacgccgcctgtgggttcagccctgtttgtgggctgctctgtcgggggcacttctattgccaaagtcatccgcccacttctgcccttttatgcggtgttgttcggtctcctgatgctggtcacttatgtgcctgacatcagcctcttcctgccgcgccttctattgggatatcagtaa

SEQ ID NO: 56402 - protein, 433 aa, Silicibacter sp. TM1040
MTTAIFLLFGSFVVLMALGVPIAFAIGLATTATFLLFMGVDQSLFIVAQQMASGLDSFTLLAIPFFILAGNIMNRGGIAMRLINFAKVLGGRLPGALAHCNVIANMMFGSISGSAVASAAAVGGVMAPLQKKEGYDPAFSAAVNIASCPTGLLIPPSATLIVYSLITGGTSIAALFVAGYLPGILMGLGLMIVAGVIAKRRGYPVAPRPALSEVMVAARDAALPLGLIVIVMGGIISGVFTATEASAAAVLYTLVLALVWYREITIKDLPAILIESAVTTSVVLLMIGASIAMSRVMAFGGIPFAISDFLLGLSDNPIAILLAINVALLVVGTFMDMTPALLIFTPIFMPVVKGLGMDPVHFGIVMTLNLCIGICTPPVGSALFVGCSVGGTSIAKVIRPLLPFYAVLFGLLMLVTYVPDISLFLPRLLLGYQ

SEQ ID NO: 56403 - DNA, 1287 bp, Silicibacter sp. TM1040
  CDS (1)..(1287)
atgattattctcggcagtctttttatcctgtgtgtgctgctcctcattggggtgagcgtgcctctggcctttggtggcgtgctggtctttatcggcgtctttggcggccatgatgtgaccgggttcctgcccacggggcactggaagatgaattccatcgtgctgcttgcgattccgctgttcattctggcaggtgctatcatggagcgggggcggatcgcggcgccgctggtgtcggtggcggagcttctggtggggcgcatccacggggggctcagcgcggcggcggtgttcgccagcggtatcttcggctcgatctcgggctctgcggcggcgacgctgacctgtatcgggtcgattatgatgccgcacctgaaggccgcgaattacccgcgcggcccggcggcggcgctgattgtggcggcctgtcccttggggctcctgatcccgccgtcgtcgtcgcagatcctttatgcgtgggtggcgcagcaatcggtgctgaagtgtttcctttcgaccgtggtgccggggcttatcctgattacgcttttgtgcatggtgaactacgtactgatgcgcaaggcggacctgaaactgctcgaacgcccggcaagctacccgcaggaattcgtgcgccgcggtgggcgggcctttccggcgctgttgatgccgatcatcattcttggcggtatctacggcggcatcatgaccccgaccgaggccgcaggcgtggcggtgatctatgccattcccgttggcctgttcatctatcgcggccttacgcctcagaatatctggccgaccctgcgctatgcgggcaccaccatcggtgtggtgatgctgatggtctttgtggtagtgatcgtcagccgctttctggtctttgaagacatccccgggatggccaaggatctgatcttctcgatctcggacaacccgatcgtgatcttgctgatggtcaatctggtgatgatcctcatcggtatgctgatggatgatatttcagggctgttgctgtcagcaccgctcctgttgcccatcgtacaaagcgtcggaatggacccggtgcattttgccgccgtccttggcgtcaacctcggcatggccaacatcacgccgcccacggcaccgctgttgtatctaggtgcaaaggtcaccgacacacccgtgagcgagatgctgaagcccaccttcatcatgatcctgtttgcatggctgccgacgctgctgatcaccacatttgtgcccgaggtggcgctgtggctgcccaattttgtctttggctaa

SEQ ID NO: 56404 - protein, 428 aa, Silicibacter sp. TM1040
MIILGSLFILCVLLLIGVSVPLAFGGVLVFIGVFGGHDVTGFLPTGHWKMNSIVLLAIPLFILAGAIMERGRIAAPLVSVAELLVGRIHGGLSAAAVFASGIFGSISGSAAATLTCIGSIMMPHLKAANYPRGPAAALIVAACPLGLLIPPSSSQILYAWVAQQSVLKCFLSTVVPGLILITLLCMVNYVLMRKADLKLLERPASYPQEFVRRGGRAFPALLMPIIILGGIYGGIMTPTEAAGVAVIYAIPVGLFIYRGLTPQNIWPTLRYAGTTIGVVMLMVFVVVIVSRFLVFEDIPGMAKDLIFSISDNPIVILLMVNLVMILIGMLMDDISGLLLSAPLLLPIVQSVGMDPVHFAAVLGVNLGMANITPPTAPLLYLGAKVTDTPVSEMLKPTFIMILFAWLPTLLITTFVPEVALWLPNFVFG

SEQ ID NO: 56405 - DNA, 1284 bp, Silicibacter sp. TM1040
  CDS (1)..(1284)
atggctgagatccttttccctgcactttttgtcttgctggcgcttggactgccggtggcctttgcaatgatgatcgctgtttttctggcactgagccttgggtcgtcttacccgcacctcgttgtggtcaaagagatgttctctggccttgacagttttccgctcttggcggtgcctttctttatcctcgcggcagagatcatgacgggcggggccgtcaccatggcgctgttgcgattggcgcagtccttcgtcgggcatctgagaggtgggttagggcacgccaatgtggtcagctccgccatgtttgcaggcatttccgggagcgccttggccgatgcggctggacccggctcgatgatgatccggatgatggaaaaaggcgggtatgatcgctcgtatgccggggcgctcacgattgccagcgcggtagtcgggcccatcatcccgccttcgatcaccatgatcatctacgccatgcaggatcagaatgtctctgttgggtccttgttcatggcgggggtgttgccgggcgtcttgatcacctgcatggtgcttgtcgccaacgcttatgtgagccgcaagcgtggctacatgagcggtgatgtcatgccgaccctcctcgagatcgggcggatttttgtctatgcgcttcctgcgctttcgctgatcgtcctgatcgtcggaggcatcaggtttggggccttcacgcccacagaagcctcggtcatcgcggtattttatgcgctgattgtggggatgtttgtctatcgttcgctgcggattcgtgacctgccgaacatctcgctcaaggccgcaatgacctccggggcggttctgttgatcctgggggcggcgcgggcctttgcctgggtcctgatcatcgagggcatcccgcagcaactcgccgaaacgatcatcagctgggagctgtcgccagtggcgtttctgttggctgtgaacctgctgctgctggccttcgggctcttcatggatccgttgccgggcgtcatgatccttgtcccgatcttggccccgatcagctttgcgcttgggatcgacccaaaccattttgccatcatcgtgatcgtgaacctgacgatggggctgaccacgcccccggtcgggagcctgatctttgtagtgtcctcaacggtgcatctgaagccgtccgctctgatccgcgaattgccgcctttctttctggccttggccgcggcgcttttgctgatcacatttgtaccaaacctgtctacctggcttcctgaggtcagcggattctga

SEQ ID NO: 56406 - protein, 427 aa, Silicibacter sp. TM1040
MAEILFPALFVLLALGLPVAFAMMIAVFLALSLGSSYPHLVVVKEMFSGLDSFPLLAVPFFILAAEIMTGGAVTMALLRLAQSFVGHLRGGLGHANVVSSAMFAGISGSALADAAGPGSMMIRMMEKGGYDRSYAGALTIASAVVGPIIPPSITMIIYAMQDQNVSVGSLFMAGVLPGVLITCMVLVANAYVSRKRGYMSGDVMPTLLEIGRIFVYALPALSLIVLIVGGIRFGAFTPTEASVIAVFYALIVGMFVYRSLRIRDLPNISLKAAMTSGAVLLILGAARAFAWVLIIEGIPQQLAETIISWELSPVAFLLAVNLLLLAFGLFMDPLPGVMILVPILAPISFALGIDPNHFAIIVIVNLTMGLTTPPVGSLIFVVSSTVHLKPSALIRELPPFFLALAAALLLITFVPNLSTWLPEVSGF

SEQ ID NO: 56407 - DNA, 1476 bp, Silicibacter sp. TM1040
  CDS (1)..(1476)
atgctgatttggttcctcccggtatttctggtccttttgatgatcggcctaccggtgttcttcagcctactggcggcccccggcgcgttgctgattttgaacggtcaagaacgcgacctgacacttctttatcgtaacctttacaatggtatggacagcttcccgctgatggcgatccccttcttcatgttggcaggggagttgatgaaccgtggcggcatcacgcagcgactggtggagttctctcaggcattgatggggcatctgcgcggaggcttggcacaggtgaacatcctgtcttcgattctctttgctggcctgtctggctctgcggtcgcagacacttcggcccttgggtccatgctgatccccgcgatggaaaaagaaggctattcgcgccggtttgccgctgccatcactgccgcaagttcggtcatcggcccgattatccccccttcgggcatcatgatcatctacgcctatgttatgggggaaagcgtcgccgcgctcttccttgccgggatcgtgccgggtgttctggtgggggttgggctgatggtcgcggtgcgtctgatggccaatcggtaccagttgccagaagcaaaacgcgttgtttttgaaaaggtcgaaattggccggatggaatccgtggtgtcctttcttctggtgcgcctcaacctcggcctgatcctgtcgcagttcgtacccagcggggcagacgccactgcaacaactcattggttgatcttcctcgcgagtctccttgcggcgcatgggctgatgcttggcctgagacgccaggtcagccatgagtttcgcttgatctgcaaacgggctgttgtcccattgcagacccctgtgctgatccttggcggtatcctagcgggtgtgttcaccccgacagaggccgcagccgtagcggttgcttatgcgattttcatcgggtttggcgtgctgcggaccatgacgctggcagatctgccggatgtgctgactcgtgcgggcatcacctcttcggttgtgctcttgctggtgggggcggcgatgtcgttcaaaaccgttgtcagcctcagccatgcgccggagcagcttgcctctttcattctgaccctgtccgagaacccgctgatcctgttgttcctgatcaacctcttgctcttcatcgtagggatgttcctcgatgcggggccggcgatcatcattcttggccccattctcggccccgtttttgcggatctcggggtcgagtcggtgcattttgcaatcatcatgtgcgtcaatctgacggttggcctggcgacgccaccgatggggctcgtgttgtttgtggcggcagcggtgtcacacgagagggtgaccacgatcgcgcgggcgatcctgcctttcctggcgatcgagatcgcagtgatctttctgatcactttcgtgcccgcgatttcccttacagttccaaggcttactgggttcttgaactag

SEQ ID NO: 56408 - protein, 491 aa, Silicibacter sp. TM1040
MLIWFLPVFLVLLMIGLPVFFSLLAAPGALLILNGQERDLTLLYRNLYNGMDSFPLMAIPFFMLAGELMNRGGITQRLVEFSQALMGHLRGGLAQVNILSSILFAGLSGSAVADTSALGSMLIPAMEKEGYSRRFAAAITAASSVIGPIIPPSGIMIIYAYVMGESVAALFLAGIVPGVLVGVGLMVAVRLMANRYQLPEAKRVVFEKVEIGRMESVVSFLLVRLNLGLILSQFVPSGADATATTHWLIFLASLLAAHGLMLGLRRQVSHEFRLICKRAVVPLQTPVLILGGILAGVFTPTEAAAVAVAYAIFIGFGVLRTMTLADLPDVLTRAGITSSVVLLLVGAAMSFKTVVSLSHAPEQLASFILTLSENPLILLFLINLLLFIVGMFLDAGPAIIILGPILGPVFADLGVESVHFAIIMCVNLTVGLATPPMGLVLFVAAAVSHERVTTIARAILPFLAIEIAVIFLITFVPAISLTVPRLTGFLN

SEQ ID NO: 56409 - DNA, 1287 bp, Silicibacter sp. TM1040
  CDS (1)..(1287)
atgatcgtcggcatctgttttgtcgtgcttctcgcagttggcatgcccatcggctttgccattggtcttgcgggtgtcatcgggattttcaccatggggggcggcagcacgttccttgcaattggaccaagcaagatcttcaacgggctcaatattttcccgttccttgcgatgccgttctttatcctggcgggcgagatcatgaacagcaccgggatcaccggacgattggtgaagctggccgaggtgcttgtgggccgctttcgcggtggccttgcgcataccaacatgctggcgtcggtcttttttgcgggtcttaccgggtctgcgactgcggatgcggccgcctttggccgtacgttggtgcccgcgatggtgaaacagggctacaaacgcgattacgcctgcgcggtcacggctgccgggtcaatcatcgggccgaccattcctccctccgggctgatggtggtctatggctccttgatgggggtctcgattggcgggttgttcgcagcgggattgctgccgggcctggtgatctgtgcggtctgcatgggcgttattgccattggcggcaaacgcgaaaacctgcccaaagcagcgcgtggcgcaagcttgggtgaagtatggcgcaccttcctgtcgtcgatcaccgcgcttttgatgccgatcattattctcggcggtattctgggcgggatcgtcacccctaccgaagcagcctccatcgccgtggcctacgccctctttatcggctttttcgtctatcgcacgctgaccttcccggatctctacgggatgctgatccgcaccgcgcgcattaccggggtgatcttcgtgatcatcgcctttgcgagcatcctcggctggtggatgagttttgagcgcatcccgcaggccatcgcgggcagcgtgctgggcctgtcggaaaacccctatgcggtgatcgcgatcatcatctgcatcctcctggtgatcggcatggtgatggacatcaccgcgatcctgatcatcctcggcccggtgcttgtgccgctcacagagcaaatcggactggagccaatccacgccgggatcatctttgtgctagcgctcaacatctccttgatgacgccccccgttggggcctgcctcttcgtattgtcgtcggtgacaggcgaaaagctcgagcggatttcggtgaagcttgcccccttcttaatcgcggaagtgatcattctcttcctcttcgcattctgggaggacgcggctctgttgctgccgcgtgcgctcggatttgccccctaa

SEQ ID NO: 56410 - protein, 428 aa, Silicibacter sp. TM1040
MIVGICFVVLLAVGMPIGFAIGLAGVIGIFTMGGGSTFLAIGPSKIFNGLNIFPFLAMPFFILAGEIMNSTGITGRLVKLAEVLVGRFRGGLAHTNMLASVFFAGLTGSATADAAAFGRTLVPAMVKQGYKRDYACAVTAAGSIIGPTIPPSGLMVVYGSLMGVSIGGLFAAGLLPGLVICAVCMGVIAIGGKRENLPKAARGASLGEVWRTFLSSITALLMPIIILGGILGGIVTPTEAASIAVAYALFIGFFVYRTLTFPDLYGMLIRTARITGVIFVIIAFASILGWWMSFERIPQAIAGSVLGLSENPYAVIAIIICILLVIGMVMDITAILIILGPVLVPLTEQIGLEPIHAGIIFVLALNISLMTPPVGACLFVLSSVTGEKLERISVKLAPFLIAEVIILFLFAFWEDAALLLPRALGFAP

SEQ ID NO: 56411 - DNA, 1299 bp, Silicibacter sp. TM1040
  CDS (1)..(1299)
atgagcgagatctacaccacagtcattttcctctttgtgctgtttgcgcttctgggcgggtcggtctggatcggtctcgcgctgatgggcgtggcctgggtcgggatggagcttttcaccacccgtccggcaggggatgcgatgatcacaaccatctggagcggcgcgtcgagctggacgcttacggccctgccgctctttatctggatgggcgaaatcctgtatcggacccgattatcggaggacatgttccggggacttgcaccatggatgcggttcctgccgggggggcttttgcacaccaatattgccggttgcacaatctttgctgcggtctcggggtcatctgcggcgacgctcaacatggttggcaagatgtcgatcccggaactgcgcgcgcgcggctatcccgagtatatgatcattggcacacttgcgggcgcggcaactctcggcctgatgatcccgccgtcgctgactctgatcgtctatggcgtgaccataaatgagagcatcaccaagctgttcatggcgggggtatttccgggtctcgtgcttgccgggctctttatgctctatatcgtgggctggcacttctttggcccgggcgaacgcccaaagccggaaccccgtctgacattcggtgagcggattgccgaaagccggttcctgcttccgctcttcgggctcgtctttgtggtgattggctccatgtatatgggttttgccaccgcaaccgaggcggcggccgtgggggttctgggtgctcttgggctgtccttgatgcaagggagtctcagctggggaacctttgtcgagagcctgatgggcgcgacgcgtacctcggcgatgatcgcctttatcctgatgggggctgcattcctgtcgctgtcgatgggctttacgggtctgccgcgggcgctggcaggcatgatcgagagctacaacctgtcgcccattgcgctcattgcggtgctgacggtgttctacctgatcctcggcatgttcatggatgggctgtcctcggtggttctgaccatggccattgtggagccgatgatccggcaggccgggattgatgtgatctggtttggtatcttcctcgtggtggtcatcgagaccgcacaagtaacgccaccgatcggcttcaatctctttgtgctgcagggcatgacccggcacgagatctcctacatcgccaaaaccgctgtgccgatggtcgcgctgatgctgttgatggtggtgatcctggtggtctggccggagctcgcaacctggttgccaaacaacatccgttga

SEQ ID NO: 56412 - protein, 432 aa, Silicibacter sp. TM1040
MSEIYTTVIFLFVLFALLGGSVWIGLALMGVAWVGMELFTTRPAGDAMITTIWSGASSWTLTALPLFIWMGEILYRTRLSEDMFRGLAPWMRFLPGGLLHTNIAGCTIFAAVSGSSAATLNMVGKMSIPELRARGYPEYMIIGTLAGAATLGLMIPPSLTLIVYGVTINESITKLFMAGVFPGLVLAGLFMLYIVGWHFFGPGERPKPEPRLTFGERIAESRFLLPLFGLVFVVIGSMYMGFATATEAAAVGVLGALGLSLMQGSLSWGTFVESLMGATRTSAMIAFILMGAAFLSLSMGFTGLPRALAGMIESYNLSPIALIAVLTVFYLILGMFMDGLSSVVLTMAIVEPMIRQAGIDVIWFGIFLVVVIETAQVTPPIGFNLFVLQGMTRHEISYIAKTAVPMVALMLLMVVILVVWPELATWLPNNIR

SEQ ID NO: 56413 - DNA, 1290 bp, Psychrobacter sp. 273-4
  CDS (1)..(1290)
atgagtccagaaattattggtgccattggtttgttatgtatgattgcgatggtcatgctgcgtgttcctgttgcacttgccatgttaggtgtgggtctggttggctttggtgccgtgacagcgcctattggtgctttacatatgctaaaagacttaccggtcgatgtcttagcgaaatatgattttagtgccattccgttgttcatacttatgggcgtcttcgcctctcattctggtatggcaggaaagttatttgaggccacccgaactatctttggcggcgtaagaggcagtctaggtattgccggtatcggctcatctggtatctttgcatccatttcagggtcgtcattggcgactgcttctaccatgactaaagtagcgctgccacaaatggagaagtatggatatcaaccaggctttgcctgcggtattttagccgctggtggtactttggggatcatgattccgcccagtattgcgctactggtctatgccatcttaacccagcagtcagtcggtgatatgtttatcgctggtttcttaccgggcatgcttggcatggtgatgtattcaatcactgtgatgatcatggtgcgttggaagccgcatttagcacaacgcggggagcctacttcttggaaacaaaagttaatctctttgacaggtcttattccctttagctttatctttatcgtgattattgcgggtattttcttggggttatttacgccaacagaaggcgctgcagttggtgcatttgtatcatgggcttatgcctttgccaaaggtatgcgcatgaaagggctgaagcaatcgcttatagaaacactggcattatcagcagtggtcttctttatgttgctgggtgcagaagccttgggctattttatctcagtctctagaatgtcttatacgttagcgagttggattggtacactggcggtcagcccaatgatagtattgatctgcattttgattatgtactttctgttaggcctgttcatggatgccttagcgatgctggtgattaccattccggtggtgtttcctattatcctagcgttagggtttgatccaatctggttcggtatcattgctgtattgacggtagagcttggactcattacgccgcctatggggatgaatatctttgtgattaaggcgatggcgccgcatattaagctgtccgatatgttcaagggggtgatgccctttattgtctcagatttggttcgtctggtcattttggtagcgttcccggcgatatcactggtgttgttaagttag

SEQ ID NO: 56414 - protein, 429 aa, Psychrobacter sp. 273-4
MSPEIIGAIGLLCMIAMVMLRVPVALAMLGVGLVGFGAVTAPIGALHMLKDLPVDVLAKYDFSAIPLFILMGVFASHSGMAGKLFEATRTIFGGVRGSLGIAGIGSSGIFASISGSSLATASTMTKVALPQMEKYGYQPGFACGILAAGGTLGIMIPPSIALLVYAILTQQSVGDMFIAGFLPGMLGMVMYSITVMIMVRWKPHLAQRGEPTSWKQKLISLTGLIPFSFIFIVIIAGIFLGLFTPTEGAAVGAFVSWAYAFAKGMRMKGLKQSLIETLALSAVVFFMLLGAEALGYFISVSRMSYTLASWIGTLAVSPMIVLICILIMYFLLGLFMDALAMLVITIPVVFPIILALGFDPIWFGIIAVLTVELGLITPPMGMNIFVIKAMAPHIKLSDMFKGVMPFIVSDLVRLVILVAFPAISLVLLS

SEQ ID NO: 56415 - DNA, 1317 bp, Desulfovibrio desulfuricans G20
  CDS (1)..(1317)
atggatcccacgattgcgggtatttgcggcattgctgccatgatggtgcttttcatgctgcgcatgccggtggcttatgccatgctgctggtgggggttgccgggttcagtatgcttaccagcgtcaccggcgggctgaacatgctggggcggtcggtatattccacgtttgcctcgcacgagctgagcaccatccctttgttcattctcatggggcagattgctttcaatgcgggtataagccggcggctttatgacaccgcgtattgttttttgggccatgtgcgcggcgggctggccatggccacggtttccgcctgtacggcattcggcgctgtctgcggatccagtccggccacggcggccaccatggccacagtgggcctgcccgagatgaagcgcttcggatattcggacgaactggccgccggcgccgtggcttccggcggcgggctgggcatgatcatgccgcccagtgttgttctgctggtttacggagtgctcacagagcagtccataggcgctctgttcgtcgccggtattctgcccgccttgctgcttaccttgctttttatcgcggcggttgcggtgcagtgcctgctgtacccgcagcacggaccggcaggccggcgttcgtcatggcgttgccgtctgtgttcacttatgggactggtggacactctgcttgtttttgcgcttgtcatcggcggcatgttctacggctggttcacccccacggaggctgcttccatcggcgtgctcggggtgtttgtgcttgccgtatccagagggcatctgggatggcggggttttgtcaaagccgtggatgagaccctgcgcacatcatgcatggtcatgctgctgatagccggtgccaccgtgttcggcaaatttcttgccgtgacccgtattccttttgacattgccggctgggtgggtggttttgatctgccggcctttgccgttatgggacttgtggtggccgtgtactttgtgggcggctgctttatggattcactggcgctggtcatgctgaccataccggtgttctatcctctggtgctcaatctggggtacgaccctgtctggttcggcatcatcattgtgctggtaactgaaatgggggtcatcactccgccggtgggtataaatgtctatgttgtgtacggcattgcccagcaggttgttccgggcggtatcgctctcgagagtgtgttcaagggggttctgccttttcttgtggcggtgattgcgggcattgccctgctgctttgctttccgcagattgtcaccctgttgccatcgctgatgtattga

SEQ ID NO: 56416 - protein, 438 aa, Desulfovibrio desulfuricans G20
MDPTIAGICGIAAMMVLFMLRMPVAYAMLLVGVAGFSMLTSVTGGLNMLGRSVYSTFASHELSTIPLFILMGQIAFNAGISRRLYDTAYCFLGHVRGGLAMATVSACTAFGAVCGSSPATAATMATVGLPEMKRFGYSDELAAGAVASGGGLGMIMPPSVVLLVYGVLTEQSIGALFVAGILPALLLTLLFIAAVAVQCLLYPQHGPAGRRSSWRCRLCSLMGLVDTLLVFALVIGGMFYGWFTPTEAASIGVLGVFVLAVSRGHLGWRGFVKAVDETLRTSCMVMLLIAGATVFGKFLAVTRIPFDIAGWVGGFDLPAFAVMGLVVAVYFVGGCFMDSLALVMLTIPVFYPLVLNLGYDPVWFGIIIVLVTEMGVITPPVGINVYVVYGIAQQVVPGGIALESVFKGVLPFLVAVIAGIALLLCFPQIVTLLPSLMY

SEQ ID NO: 56417 - DNA, 1284 bp, Dechloromonas aromatica RCB
  CDS (1)..(1284)
atgaacgcgctagtgattttcagtctgctggctgtcttgatgctgaccggtatgccgatctcgatttcgctcggcctgacggtgctgaccttcctttttacaatgacccaggtgccactcgaatcggtagcgctgaagctgttcacggggatagagaagttcgagatcatggccatcccgttcttcatcctggccggcaatttcctgactcatggcggggtggcgaagcggatgatcaacttcgcgacctcaatggttggtcactggtacggtggtcttggtctggctggtgtgctggcgtgcgccttgttcgcggcggtctcggggtccagtccggccaccgtcgtggccatcggctccattttgctgccggctatggtcaaggctggcttcccgaacaagttcggagctggcgtgattgccacctcgggagcgctcggtatcctgattccaccgtcgatcgtcatggtgatgtattcggtggcgaccaatacctcggtgggggcgttgttcatggccggggtagtgcccggtctggcattggccgcgacgcttggtggcgtgacctggtaccgggctcgcaaattcgattacccgcggcagccgaaagccagctgggccgagcgctggaaatcctttcgcgcttctgtctggggcttgctgctgattgtcgtcgtaatgggggggatctacaccgggatctttacaccgactgaggcggctgcaatgtcggcggtctatgcctttttcgtcgcggttttcgtctatcgcgatatgggcttgaaggatgtgccgaaggtgttgctcaattcagccaacatgtcggcgatgttgctctacatcattaccaacgcggtgttgttctccttcatcatgaccaacgagaacatcccacaggcgttggctgactggatgatgggccatggtctcggggtcatttccttcctgttgatgtgcaatgtcctgttgctgttggctggtaatttcatggaaccctcgtccattgtgctgatctttgcgccgattctgttcccggtggccatgaagctgggaattgatccggtccatttcggcatcatcatggtggtgaatatggaagttggcatgtgtcatccgcccgtcggactcaatctttacgtggcctcgggaattaccaagatgggtattaccgagctgacggttgcggtttggccatggctgctctccatgttgtgtttcctggcggtcgttacttactggcccaccttgtcattatggttcccaaggcagcttggaatgatctag

SEQ ID NO: 56418 - protein, 427 aa, Dechloromonas aromatica RCB
MNALVIFSLLAVLMLTGMPISISLGLTVLTFLFTMTQVPLESVALKLFTGIEKFEIMAIPFFILAGNFLTHGGVAKRMINFATSMVGHWYGGLGLAGVLACALFAAVSGSSPATVVAIGSILLPAMVKAGFPNKFGAGVIATSGALGILIPPSIVMVMYSVATNTSVGALFMAGVVPGLALAATLGGVTWYRARKFDYPRQPKASWAERWKSFRASVWGLLLIVVVMGGIYTGIFTPTEAAAMSAVYAFFVAVFVYRDMGLKDVPKVLLNSANMSAMLLYIITNAVLFSFIMTNENIPQALADWMMGHGLGVISFLLMCNVLLLLAGNFMEPSSIVLIFAPILFPVAMKLGIDPVHFGIIMVVNMEVGMCHPPVGLNLYVASGITKMGITELTVAVWPWLLSMLCFLAVVTYWPTLSLWFPRQLGMI

SEQ ID NO: 56419 - DNA, 1335 bp, Chloroflexus aurantiacus
  CDS (1)..(1335)
atgtacgactggctcggacccacgatgttccttggagcgctggtcattctcgggatcggctatccggttgcattttcgctgggggcaacagcgattgtcttcggtatcatcggcgtttcacttggcatctttgaccccatcatcattcgggcgatgccatcacgtatcttcaacgtgatgtcaaattacaccctgctggcaatcccttactttatcttcctcggctcaatgctggaaaaatctggcctggcagaggacttactcgatacgatggggattctcttcggccccgtgcggggtggcctggcgattgcggttgtcgctgtaggtgctttgctggcagccactaccggcgttgttgccgcaacagtggtggcaatgggattgatttcgctgcctattatgttgcgctacaactacaacaaagagctggcttgtggcgtgatttgtgctgccggtacactagggcagattattccaccttcggtcgttctggtggttctcggtgaccagatcggtgtttcggttggcaaactctttctcggctcgttgataccaggacttttgctggcagcggcgctggcattttactgttggattgttgctttactgaagccagaaatggcaccagcacttccattatcggcacgttcgatcagtggtgcagccctggcgaaacgagtagtgcaggtgatgattcccccgcttctgctcattgtcgccgtactcggttctattttcttcggtatctcgacggcaacggaggcgggggctgttggcgcacttggggcaacgttgctggcggctgctaatcgacgattgacctggaagaatttcgtggcggtttgcgatgccacgatgcgcgccacaacgatggttctcttcattttaattggctcgaccgcattcgccctggtgttccgcgccttgagcggcgataagtttgtgttcgatctgatggcgaacctgcccggcggtgcctggggcttcctggttgtcagcatgcttatcgtcttctttctcggttttttcatcgatttcttcgagatttgctttattgtgatcccgctcttcgttccagtagcgcaggctctcggatttgacctgatatggtttggtgtgttgctcggcgctaatttgcagacctcgttcctgacaccaccatttggtttcgctctcttctacctgcgcggtgttgcccctccaggcattacaactgccgatatttaccggggtgttgtaccgttcattgcgatccagcttacgattgtcgttgttttgatcttcttcccgcagttggccctctatctgccggcgatctccttcggccagtag

SEQ ID NO: 56420 - protein, 444 aa, Chloroflexus aurantiacus
MYDWLGPTMFLGALVILGIGYPVAFSLGATAIVFGIIGVSLGIFDPIIIRAMPSRIFNVMSNYTLLAIPYFIFLGSMLEKSGLAEDLLDTMGILFGPVRGGLAIAVVAVGALLAATTGVVAATVVAMGLISLPIMLRYNYNKELACGVICAAGTLGQIIPPSVVLVVLGDQIGVSVGKLFLGSLIPGLLLAAALAFYCWIVALLKPEMAPALPLSARSISGAALAKRVVQVMIPPLLLIVAVLGSIFFGISTATEAGAVGALGATLLAAANRRLTWKNFVAVCDATMRATTMVLFILIGSTAFALVFRALSGDKFVFDLMANLPGGAWGFLVVSMLIVFFLGFFIDFFEICFIVIPLFVPVAQALGFDLIWFGVLLGANLQTSFLTPPFGFALFYLRGVAPPGITTADIYRGVVPFIAIQLTIVVVLIFFPQLALYLPAISFGQ

SEQ ID NO: 56421 - DNA, 1290 bp, Polaromonas sp. JS666
  CDS (1)..(1290)
atgagcgccatcctgggtattagttttgttgggctgatggtgatcggccttccaatcgccttcgcgatgctgatcgccggactcgttgccatctggatgaaaccggggctgagcgggctgatcgtcatccagaacctgttcagcggtctggacagctttccgctgctggcgattccgttcttcatcctggccgccgaactcatgtctggcggtgcgctgaccgacgtgctgctgcacttcgcggcacgtcttgttggccgccggcgaggtggcttgggccatgccaacatcctgacgctgaccttcttctccgggatcagcggctcggcactcgccgatgccgcaggacccggcgcgatgctgatcaagatgatgcgcaaggcgggttacagcgcgccttacgcggcagcgctcacggcttccaccgccattgttggtcccatcatccctccttcgatcatcatgatcatctatgcgctgacagacaacagcgtgacgattaccggcctcttcctggcgggtgtggtgcccggactgctgatcgcgggttccctggccatcgttaaccatatcgtgagcgtgcgtcgcaactatcgctccgcgccggagctgctggacccgtcgccgatcctgagacttttcatacgggcgctgccagcattgatgctgcctgcgatcatcctgggcgggatccactttggggtcttcacgccaacggaggcgtccgcagcagcggtgctgtatgccctgctggtgggccgctttgtatatggcacgctgaccatggacaagctgcctgccatcttgttccgcacggcgctgatgacatcatccatcctgtttatcgtcgctacgtcggcggtgttcgcctgggtgctgaccgtgggccagatcccgcagaccgttgcggcctggatcgcaggcatgcagctgtcgccgggcatgctgctgctggccatcaatgtgctgctgctgctggtggggatattcatcgaaccgcttcccggcgtcatgatcatggtgcccatcctcgcgccgctggcggacgctgccggcctgaatccgctgcacttcgcaatcgtggtgatcgtgaacctcacgctcggaatgatcacgcccccggtgggcggtctgctcttcgttacttcgattgtctctggcgtccagatggggcccatggtgcgcgaaggccggcccatgctcgtcgcactgctgatcgtgctggcgcttctcactttcttcccggctttgtccacctggctgccgggcctgctgggctacaggaactag

SEQ ID NO: 56422 - protein, 429 aa, Polaromonas sp. JS666
MSAILGISFVGLMVIGLPIAFAMLIAGLVAIWMKPGLSGLIVIQNLFSGLDSFPLLAIPFFILAAELMSGGALTDVLLHFAARLVGRRRGGLGHANILTLTFFSGISGSALADAAGPGAMLIKMMRKAGYSAPYAAALTASTAIVGPIIPPSIIMIIYALTDNSVTITGLFLAGVVPGLLIAGSLAIVNHIVSVRRNYRSAPELLDPSPILRLFIRALPALMLPAIILGGIHFGVFTPTEASAAAVLYALLVGRFVYGTLTMDKLPAILFRTALMTSSILFIVATSAVFAWVLTVGQIPQTVAAWIAGMQLSPGMLLLAINVLLLLVGIFIEPLPGVMIMVPILAPLADAAGLNPLHFAIVVIVNLTLGMITPPVGGLLFVTSIVSGVQMGPMVREGRPMLVALLIVLALLTFFPALSTWLPGLLGYRN

SEQ ID NO: 56423 - DNA, 1395 bp, Polaromonas sp. JS666
  CDS (1)..(1395)
atgctgaaagttgctttcctgttcctgatgagcggcggcctgccggtggccatggccatggccggcgcttcgctcctctacatcctgttcacccaaagctcgccgccctttgtggtgattcaccgcatggtcagcggcattgacagctttccgctgctggccgtgcctttcttcattctggccggcaacctgatgaacaacgccggcatcaccaaccgcatctacaactacgcgctggcgctggtgggctggatgaagggcgggctgggccatgtcaacgtcgtgggctcggtggtgtttgccggcatgagcggcaccgccattgccgacgcggccggtctgggcacgatcgagatcaaggccatgaaggaccacggctacagcaccgaatttgccgtgggcgtgacggcggcttccgccacgctgggccccatcattccgcccagcctgccctttgtgatctacggcatgatggccaacgtcagtgttggcgccctgtttctggccggcatactgccgggcgtcatgatggccatcctgatgatgctcaccgtggcttacttcgcgcacaagaacggctggggcgccgacgtcaagttcgattggcgccgcctgagcaaggcgctgatcgaaaccgcggtggtcatcggctggccgctgctgctgtggctgctgattggcaagcttaactttccgccgcaagtcaccgtggccgccgcgctggtggcgctgtttgcggccgacaaggcgttcaagttccaggccgttctgcccatcatgacgccggtgctgctgatcggcggcatgacgaccggcatcttcacgcccaccgaaggcgcaattgccgcctgcgtctggtcgctgatcctcggctttgcctggtatggcacgttgaccttcaagagtttcgtgaaggtctgcctggatacggtagagacgacagccaccgtgctgttcatcgtggccgcggcgtccatcttcggctggatgctcaccgccaccggcgtgaccaccgacattgccaactgggtgctgggtttcaccaaggaggcctgggtcttcctgctgctggccaatgtgctgatgctgtttgtgggctgcttcctggagccgacggcggccatcacgattctggtgcccatcctggtgcccatcgccgtgcagctgggcgttgaccccgtccatttcgggctggtgatggtgctcaacctgatgataggcctgctgcacccacccatgggcatggtgctgtttgtgctggcgcgcgtggccaagctctcggtcgagcgcaccaccatcgccattctgccctggctgtttccgctgctgggcagcctgattgtcattacctacttccccaagctggtgctgtggctgcccaagatgttttattga

SEQ ID NO: 56424 - protein, 464 aa, Polaromonas sp. JS666
MLKVAFLFLMSGGLPVAMAMAGASLLYILFTQSSPPFVVIHRMVSGIDSFPLLAVPFFILAGNLMNNAGITNRIYNYALALVGWMKGGLGHVNVVGSVVFAGMSGTAIADAAGLGTIEIKAMKDHGYSTEFAVGVTAASATLGPIIPPSLPFVIYGMMANVSVGALFLAGILPGVMMAILMMLTVAYFAHKNGWGADVKFDWRRLSKALIETAVVIGWPLLLWLLIGKLNFPPQVTVAAALVALFAADKAFKFQAVLPIMTPVLLIGGMTTGIFTPTEGAIAACVWSLILGFAWYGTLTFKSFVKVCLDTVETTATVLFIVAAASIFGWMLTATGVTTDIANWVLGFTKEAWVFLLLANVLMLFVGCFLEPTAAITILVPILVPIAVQLGVDPVHFGLVMVLNLMIGLLHPPMGMVLFVLARVAKLSVERTTIAILPWLFPLLGSLIVITYFPKLVLWLPKMFY

SEQ ID NO: 56425 - DNA, 1260 bp, Polaromonas sp. JS666
  CDS (1)..(1260)
atgagcgcgctcatcctcctggtgttcctgggcgctgccacggcagcggtaccgattgcacatgcgctgctgatggcctcggtggcagccgccacggtctcggagcgcatcccgctggatctggtcgtgcagcagatggtggcgcaggtccagagcttcccgctgattgccattcccttcttcatgctcaccggaaccctgatgatgggcggcaagctcggtgaatccctgatcggcgtgctgtccacgctgattggccgctttcacggcgggccgggccaggtgggcgtgctgtcgtccaccatttttggcggtgtctccggctcggcggtcgccgacgcgtccgccatcggttcgctgctgcttccctggcagaagcggctgggctatccgcccgcattctccgccgccacgctggccgcggccgcaacgattgacatcctgattccgccatcgattccgatgatcctgttcgcgctgacgtccaatgcgtcgatcgcggcgctattcgtcgccggcattttgccggggctgatgatgtgtgccggtttcatgggagtctgctggtgtgttggcaagcgccgcaattttccgcgagagacgcgcccgatcgactggccggtatttcgcaagcagctggcctacgcttcgcccgcgctggtgctgccggtgctgatcgtgatcttcctgcgcttcggtattgccacgcccaccgaggtcagtgtcctgtccaccgcctactcgggcctgatttccgcgctgatttaccgcgatctgagcatcaggcgcctgcactcggccatcgtggaggcgggtctggccacgggcgtggtgctgctggtgatcatggcttcggcgtcggtcgggtggttgctgaccttcgaccacatgcccgacggcgtggtgcactgggcccaggctcacctgcacgccgactgggccgtgatcctgctgatgaacggcctcatgctggttgccggcatgttcatcgacctgccggctgcggtgctgctgctcacgccggtgttcgtgcctctggccaacagcatcggcatggacctggtgcagctcggcatcatgatgacggtgaaccttgccatcgggctgtacacgcccccggtggggacgacgctgttcatcaccagttcggtcgccagggtcaaggtgggggaaaccgtgcgcgagctgatccccttctattgtgtggcgttcatcatcctgctgattgtttcgtacgttccggcgtcgatcctgcgttga

SEQ ID NO: 56426 - protein, 419 aa, Polaromonas sp. JS666
MSALILLVFLGAATAAVPIAHALLMASVAAATVSERIPLDLVVQQMVAQVQSFPLIAIPFFMLTGTLMMGGKLGESLIGVLSTLIGRFHGGPGQVGVLSSTIFGGVSGSAVADASAIGSLLLPWQKRLGYPPAFSAATLAAAATIDILIPPSIPMILFALTSNASIAALFVAGILPGLMMCAGFMGVCWCVGKRRNFPRETRPIDWPVFRKQLAYASPALVLPVLIVIFLRFGIATPTEVSVLSTAYSGLISALIYRDLSIRRLHSAIVEAGLATGVVLLVIMASASVGWLLTFDHMPDGVVHWAQAHLHADWAVILLMNGLMLVAGMFIDLPAAVLLLTPVFVPLANSIGMDLVQLGIMMTVNLAIGLYTPPVGTTLFITSSVARVKVGETVRELIPFYCVAFIILLIVSYVPASILR

SEQ ID NO: 56427 - DNA, 1281 bp, Polaromonas sp. JS666
  CDS (1)..(1281)
atgaccatcgcagttttcctgggctccctgctcgccgccatggcgctgggcattcccatttcattttccctgttgctgtgcggtgccgcattgatgtggcacctggatatgttcgatgcgcaaattctggcgcagaacgtgatcaacggtgctgacagcttcccgctgctggcggtaccgtttttcatgctggctggggaaatcatgaacgccggcggcctgtcgcgccgtatcgtcaactttgccatgacgctggtggggcacatcaagggcgggctgggctatgtggccattgtggcggccgtgctgatggccgccctgtccggctccgccgtggcagatgccgccgccctgtcggccctgttgctgcccatgatggtggccgccggccacgacaaggcgcgctccgccggcctgctggcatcggccagcatcatcgctcccgttattccgcccagcatcggcttcgtgatcttcggcgtggcggccaatgtctcgatttccaagctattcatggccggcattgcgcccggcgtcatgctcggggtcgccttgtggttcacgtggtggtatgtcgcacgcaaggaaaccgtcgcggtgcccccccgcaagtcacgtgcggacgtgatcgccgccttcaaggacaccacctttgcgatggtcttgccggtgatcgtggtggtgggtctgaagtttggcgtgttcacgcccaccgaggcggcggtggtggctgcggtttacgcgctgttgatctcgacgctggtctacagggagctcaagctcaaccagttgtacggcctgtttctggcggcggccaagacgacggcggtgatcatgttcctcgttgccgcggcgatggtctcggcctggctaatcacggtggcgcaattgccggcgcaggtggtcacgctgctgcaaccgctgctggacagcccgaagctgctgatgctggccatcatggtgctggtgatggtggtgggtgcggcgatggacatgacccccactatcctgattctcaccccggtgctgatgccgatcgtgaaagcggcagggattgacccggtgtactttggcgtgctgttcatcatcaacaacgcgatcggcctgatcacgccaccggtcggaaccgtgctcaacaccgtcgcaggcgtgggcaaggttagcatggacgaggtgaccaagggcgtctggccgttcatgatcgcgcagttcgccatcatgttcctgatggtgctgttcccgcagctggtcatggtgcccgcacgctggttctatggctag

SEQ ID NO: 56428 - protein, 426 aa, Polaromonas sp. JS666
MTIAVFLGSLLAAMALGIPISFSLLLCGAALMWHLDMFDAQILAQNVINGADSFPLLAVPFFMLAGEIMNAGGLSRRIVNFAMTLVGHIKGGLGYVAIVAAVLMAALSGSAVADAAALSALLLPMMVAAGHDKARSAGLLASASIIAPVIPPSIGFVIFGVAANVSISKLFMAGIAPGVMLGVALWFTWWYVARKETVAVPPRKSRADVIAAFKDTTFAMVLPVIVVVGLKFGVFTPTEAAVVAAVYALLISTLVYRELKLNQLYGLFLAAAKTTAVIMFLVAAAMVSAWLITVAQLPAQVVTLLQPLLDSPKLLMLAIMVLVMVVGAAMDMTPTILILTPVLMPIVKAAGIDPVYFGVLFIINNAIGLITPPVGTVLNTVAGVGKVSMDEVTKGVWPFMIAQFAIMFLMVLFPQLVMVPARWFYG

SEQ ID NO: 56429 - DNA, 1296 bp, Polaromonas sp. JS666
  CDS (1)..(1296)
atgtctgaacttgccatcacctctttactgattctttcgctgttcctcatattgggctcgggcgtctggatcggcctcaccctgtcgggcgtcgcctggatcggcatgcagcttttttcctcacgcgccgccggcgatgccatggccgtgaccatctggggctcttcatcgagctggacactgacggccctgccgcttttcgtgtggatgggagaaatcctgtttcgcaccaagctcagtgaaagcatgtttaaaggcctggcgccgtgggtcagccgcctgccgggcggcctgctgcacaccaacgtgatcggttgcaccatttttgccgcggtgtcgggctcctcagccgccacctgcgccaccataggcaagatgacattgccggaactcgccaaacgcggctaccccgaagacatcaccatcggctcgctggccggggccggtacgctgggcctgttgatcccgccctccatcatcatgatcgtttacggcgtcagcgccgatgtatcgattgccaaactctttatcgcaggcgttttccccggcctgttgctcgcatcgctgttctctggctacctaatcgtctgggcgctgatgaacaagggcaaaatcccgccgcccgacgcggccatgagcttcagccagaaggtctacgaatcgcgccacctgattcccgtggtgctgctcatcagcgctgtgctcggctccatctacacaggtatcgccacggcgacagaggcggcggccattggtgtggtcgggtcactgctggtatcgctggcgcaacgcgcaatgacgtggaccaccttcaaagagtcgctgctgggcgccacacgcctgtattgcatgattgcgctgattctggcgggtgccgcgttcctgacgctgagcatgggctacatcggcctgccgcgccacctggccgagtttgtatccggcctgggcctgagccctttcctgctgattctcgccctgagcttgttttacatcattctgggctgttttctggacggcatttcgatggtggtgctcaccatgggcgtcatcctgcccacggtgcagacggcgggcctggacctcatctggttcggcattttcatcgtcatcgtggtggagatggcgcaaattaccccgcccgtcggattcaacctgtttgtattgcaaggcatgaccaaaaaggaaatcacctacattgcgcgggtcacgctgccattcttcttcctgatgtgcggcatggtactgctgctgtggtttttcccgcagatagcgacctggctgcccggcaagatgtaa

SEQ ID NO: 56430 - protein, 431 aa, Polaromonas sp. JS666
MSELAITSLLILSLFLILGSGVWIGLTLSGVAWIGMQLFSSRAAGDAMAVTIWGSSSSWTLTALPLFVWMGEILFRTKLSESMFKGLAPWVSRLPGGLLHTNVIGCTIFAAVSGSSAATCATIGKMTLPELAKRGYPEDITIGSLAGAGTLGLLIPPSIIMIVYGVSADVSIAKLFIAGVFPGLLLASLFSGYLIVWALMNKGKIPPPDAAMSFSQKVYESRHLIPVVLLISAVLGSIYTGIATATEAAAIGVVGSLLVSLAQRAMTWTTFKESLLGATRLYCMIALILAGAAFLTLSMGYIGLPRHLAEFVSGLGLSPFLLILALSLFYIILGCFLDGISMVVLTMGVILPTVQTAGLDLIWFGIFIVIVVEMAQITPPVGFNLFVLQGMTKKEITYIARVTLPFFFLMCGMVLLLWFFPQIATWLPGKM

SEQ ID NO: 56431 - DNA, 1323 bp, Polaromonas sp. JS666
  CDS (1)..(1323)
atgagcggttggggcatagccgcctggctgatgctgggcggctccaccgtgctgctgttcatcggcatgccggtggcgctgaccttcatcaccatcaacatcattggcgcctggctctacatgggcggcgagcccggcctggtgcagctggcgcgcagcagcgtgagctcggtcacggcgttttcattgacgccaattccgctgttcgtgctgatgggcgagatcctgtttcataccggcctggccatcaaggtcatcgaaggcgtcgagcggctgatcaagcatgtgcccggccgcctggcggtggtcgccgtggtggccggcacggtgttttcggccatctcgggctccaccattgccaccaccgcgatgctcggctcgctgatgctgcccatcatgctgtcacgcggctaccacccgaccctggccaccgggcccatcatggccattggcgcggtcgacatgctgataccgccctcggcgctgaccgtgctgctgggctcgctgtcgggcatctcgatttccaagctgctgattggcggcgtggtgcccggcgtgatcctgtccgtcgcctttgtgctgtggatcgtcattcgcgtcaccatcagcccgcagctggcccccgtcgacaaggacgatgcggtgcagtaccgcggctgggcgcgctggagcctgttctttggctatgtgctgcccacgctgtcgatctttggcgtggtggtgggcgcgctggccgccggctgggccacgcccaccgagtgcgccgcgctgggcgcctttgccaccatgctgctggcgctgtgctaccgcgtcctgacgcgggacgccgtgctcaaggcgctcaagggcacggccggcatctcgggcatgattttgttcatcatcctgggcgccaccacgtttgcgcaaatcctgtcgttctcgggcgccagcaacggcctggtgcagttcatcaccggccagggcctgtctaccggcatgatcgtggtcggcatgatgctgatgctgatcttcctgggcatctttgtcgaccaggtcagcatgatgatgatcacgctgcccatcttcatgccggtggtgcaggcgctgggcatagacccggtctggtttggcgtgatgtttctcatctgcatgcagctgggcctgctgctgccgccgcacggcctgctgctgatgaccatgcgcggcgtggccccgccggccgtcaccatgggccatatcttcatggcggtggtgccctatgtggtgatgagcctgatactgctggccgccgtgttctggattcccgcgattgcgacctggctgccccggatgattgggtag

SEQ ID NO: 56432 - protein, 440 aa, Polaromonas sp. JS666
MSGWGIAAWLMLGGSTVLLFIGMPVALTFITINIIGAWLYMGGEPGLVQLARSSVSSVTAFSLTPIPLFVLMGEILFHTGLAIKVIEGVERLIKHVPGRLAVVAVVAGTVFSAISGSTIATTAMLGSLMLPIMLSRGYHPTLATGPIMAIGAVDMLIPPSALTVLLGSLSGISISKLLIGGVVPGVILSVAFVLWIVIRVTISPQLAPVDKDDAVQYRGWARWSLFFGYVLPTLSIFGVVVGALAAGWATPTECAALGAFATMLLALCYRVLTRDAVLKALKGTAGISGMILFIILGATTFAQILSFSGASNGLVQFITGQGLSTGMIVVGMMLMLIFLGIFVDQVSMMMITLPIFMPVVQALGIDPVWFGVMFLICMQLGLLLPPHGLLLMTMRGVAPPAVTMGHIFMAVVPYVVMSLILLAAVFWIPAIATWLPRMIG

SEQ ID NO: 56433 - DNA, 1269 bp, Polaromonas sp. JS666
  CDS (1)..(1269)
atgctggtggccggcatgctgctgcgcatgcccatcggtttttcgatgctggcctcgggcattgcctacctgatggtcaaggggcaggacatcggcctggtggccgagcaggtgggcaacggcctctacaacagctatgtgctgctggccgtgccgctcttcgtgtttgcggccaacatcatgaacgccggcacggtgagcgagcgcatttttgacttctgccgcatcctggtcgggcgcgtgcgcggcggcctggcgcaagtggatattctggtgagcgtggtgttctcgggcatgagcggcagcgccattgccgacgccgccgggcccggcctggtcaccattcgccagatgctcaagaagccggaatacacacgcggctttgcgggtgccgtggtggtggccagcgccacactcggacccatcattccgccttccattcccatggtgatttacgccctggtgtcgggcgcttcggtgggggcgctgtttctgggtggtgtggtgccgggctttttgatggcatttttgatgatggcagtggtgcatttcattgccgtgaaacgcaacatgccgcgtgaagacaaaattccgctgagtgaatggccgagcatcatctttcgcggcgccctgccgctgtccatgcccatcgtgctgctcggtggcatttactccggcgccttcacgcccacagaagccgccgcggtggctgcttttcatgcgctggtgctggcgggggtggtttaccgcgcgctgacctggcgcaccttctggggcgtgatcatggagtccacccgcggcagcgccgtcatcaccatgatcctggccggctccttcatgctcaattacgcattcaccgccgaaggcgtgccgcaagccatggccacgtgggtcgacagcatgcagctctcgcagatcaagtttttgctgctggtcaacgtgatgttcctggtgctgggctgctttctggatgtgtcggtgctgctgctggtgtttgtgcccatgctgctgcccgcggccaagctgctgggcgtggacctggtgcactttggcgtgctggtggtgctcaacatgatgatcggcctgatccacccgccctttggcatgctgctgttcgtaaccaaggcgctgaccggcatcccgattggcgaaatgatgaaagaaggctggcatttcctggtcatgctgctgctcttgctgctcgccatgacctgctttccacaaattgtgctgtggctgccgcaaaccatgggctacggaggcaaatag

SEQ ID NO: 56434 - protein, 422 aa, Polaromonas sp. JS666
MLVAGMLLRMPIGFSMLASGIAYLMVKGQDIGLVAEQVGNGLYNSYVLLAVPLFVFAANIMNAGTVSERIFDFCRILVGRVRGGLAQVDILVSVVFSGMSGSAIADAAGPGLVTIRQMLKKPEYTRGFAGAVVVASATLGPIIPPSIPMVIYALVSGASVGALFLGGVVPGFLMAFLMMAVVHFIAVKRNMPREDKIPLSEWPSIIFRGALPLSMPIVLLGGIYSGAFTPTEAAAVAAFHALVLAGVVYRALTWRTFWGVIMESTRGSAVITMILAGSFMLNYAFTAEGVPQAMATWVDSMQLSQIKFLLLVNVMFLVLGCFLDVSVLLLVFVPMLLPAAKLLGVDLVHFGVLVVLNMMIGLIHPPFGMLLFVTKALTGIPIGEMMKEGWHFLVMLLLLLLAMTCFPQIVLWLPQTMGYGGK

SEQ ID NO: 56435 - DNA, 1293 bp, Polaromonas sp. JS666
  CDS (1)..(1293)
atgaccgccagtgccatccttctcgcttccgtttgcatctacctcgccatcggtgtgcccgtggcttttgcgctggggctgtccaccgtgaccgcgctggtgctgtcggaccagtttccgatgatcgtgatgctcaaggagactttcaccggcattgacagcttcccgctgatggcggtgccctttttcatcctcgcggcagaactgatgagcggcggctcgctgaccgaggtgctgctgcgctttgccgggcaattcgtcggccacaagcgcgggggcctgggctataccaacgtggtgtcgctgactttcttctcgggcatctccggttcggcgctggctgatgccgccgggcccgggtccatgatgatccgcatgatggacaaggccggctacgaccgcgcctacgccgcggcgctgacggcctcaaccgcgatcgtggggcctatcatcccgccctctatcatcatgatcatttacgcgctggccgacgacaacgtgtcggtgggtgccctgttcattgcgggcctggtgcccggcatcctgattgcggcggcgatgtgcgtcgtgaactggcatgtgtccaaacggcgcaactaccgcggtgacaacgaacatcccacgatggcggaaatcctgcgcacgacctggaaggcgctgccggccatcctgctgccggtgctgatcctgggcggcatgcgcgccggctggttcacgccgaccgaagcgtccgtcgtagccgttttctacgcgctggtctgcggcaaatacgtgtacggcacgctggaatggaaggcggtaccggacattctgtcgcgctcggcgctgctgaccgcctcggtgctggtcatcatcgccatgtcggcatcgtttgcatgggtgctgacgatcgaaggcgtgccgcaactggccgcaaactggatcgctgacatgcagctgagctcctggatgttcctgctggtggtgaacgtcttcctgctgctgttcggcatcttcatcgagccgctgcccggcgtgatggtgctggtgccgattctcgcgccggtcgcggccaaggtcggcatcgacccgatccacttcgccatgatcgtcatctacaacctgacgctgggcatgatcacgccgcccgtgggcgggctgctgtttgtcacctcgaacgtgtcgcgcgttccgctgagcgccctcacgcgtgaactgaaacccttcctgtgggcgcacggcgtggtgctggttcttttgacctttgtgccggcgctgagcaactggctgccgcatgccatggggtttaaatag

SEQ ID NO: 56436 - protein, 430 aa, Polaromonas sp. JS666
MTASAILLASVCIYLAIGVPVAFALGLSTVTALVLSDQFPMIVMLKETFTGIDSFPLMAVPFFILAAELMSGGSLTEVLLRFAGQFVGHKRGGLGYTNVVSLTFFSGISGSALADAAGPGSMMIRMMDKAGYDRAYAAALTASTAIVGPIIPPSIIMIIYALADDNVSVGALFIAGLVPGILIAAAMCVVNWHVSKRRNYRGDNEHPTMAEILRTTWKALPAILLPVLILGGMRAGWFTPTEASVVAVFYALVCGKYVYGTLEWKAVPDILSRSALLTASVLVIIAMSASFAWVLTIEGVPQLAANWIADMQLSSWMFLLVVNVFLLLFGIFIEPLPGVMVLVPILAPVAAKVGIDPIHFAMIVIYNLTLGMITPPVGGLLFVTSNVSRVPLSALTRELKPFLWAHGVVLVLLTFVPALSNWLPHAMGFK

SEQ ID NO: 56437 - DNA, 1188 bp, Polaromonas sp. JS666
  CDS (1)..(1188)
atggccgatccgtcgctgccgatgctggtgtactcgcagcaggtcatggcgggcatggaccacttcgtgctgctggccattcccttctttgtgctggccggtctgctgatggagtccaacggcatgtcgtcgcgcctgattgaactgctgctgcgcatgttcggccgcgtgcgcggcgggctgggcctgatcaccatcacggccacggccttcttttcgggtgtctccggctccaagctggccgatatcgcggccgtcggcggcatcatcatgcccgccgtgcgcaagaccagacaggacccgaacgaaacggccggcctgctggcctgcacggccgtcatggccgaaaccattccgccctgcatcaacatgatcatcatgggctttgtcgccaacatctcgattgccggcctgttcatggccgggctggtgccggccgcggtgctggcgctgtcgctggcggcggtgacggtgtatgtgggcacccgcatcaaccccgatgaagccttcgatgtgaagaagcccatgctccgcctgctgggtggcgcactggtggcattggtgatggtggcgatgatcggcaagggcgtgacctcgggtgtggccacctccaccgaggtgtcggccttcgccgtgatgtatgccctggtggtgggcgcgctggcgtttcgtgagctgacaatgcgttcggtggcgcagctcttcgtgcgttcagcctccatggcgggcggtattttgttcatcgtcgcggccgcttccagcgtgtcgtttgcgctgaccatccagcagattccgcagtacctgtccgacttcatgatcacctttgcgcatcactacggcagcaccatgttcgtgctgctgtcggtgctgatcatgatcgtgtttggcgcggtgctcgaaggcgcaccggcgctgatcatctttggcccgctgctcaccccgattgcggcccagttgggcgtgcacccgctgcacttcggcacggtgatggtgatcgccatgggctttggcctgttcgcgccaccgatcggcctggggctgtttgccacctgcgccatcaccggcaccgaagtcaaaaacgtggcccggcccatgatgaagtatcttgtggtcttgtttgtgacgctgatggtgctggttctggtgccggcgttttccctgtggctgcccacccgcatgggcttatag

SEQ ID NO: 56438 - protein, 395 aa, Polaromonas sp. JS666
MADPSLPMLVYSQQVMAGMDHFVLLAIPFFVLAGLLMESNGMSSRLIELLLRMFGRVRGGLGLITITATAFFSGVSGSKLADIAAVGGIIMPAVRKTRQDPNETAGLLACTAVMAETIPPCINMIIMGFVANISIAGLFMAGLVPAAVLALSLAAVTVYVGTRINPDEAFDVKKPMLRLLGGALVALVMVAMIGKGVTSGVATSTEVSAFAVMYALVVGALAFRELTMRSVAQLFVRSASMAGGILFIVAAASSVSFALTIQQIPQYLSDFMITFAHHYGSTMFVLLSVLIMIVFGAVLEGAPALIIFGPLLTPIAAQLGVHPLHFGTVMVIAMGFGLFAPPIGLGLFATCAITGTEVKNVARPMMKYLVVLFVTLMVLVLVPAFSLWLPTRMGL

SEQ ID NO: 56439 - DNA, 1323 bp, Rhodobacter capsulatus
  CDS (1)..(1323)
atgagcgccctcatcatctttggtctgctcatcgcgctgatgctgaccggcatgccgatctcgatctcgcttggcctgacggtgctgaccttcctgttcaccatgacccaggtgccgatcgacacggtggcgctcaagctcttcaccggcatcgagaaattcgagatcatggcgatcccgttcttcatcctggcggggaacttcctgacccatggcggggtggcgaagcggatgatcaacttcgccacggcgatggtcggtcactggcacggcgggcttggccttgcgggcgtgatcgcctgcgcgcttttcgccgcggtgtccggctcctcgcccgccaccgtcgtagccatcggctcggtgatcctgcccgcgatggtcaatcagggctttccgaagcaattcggcgcgggcgtcatcaccacctcgggcgccttgggcattctcattccgccgtccatcgtgatggtgatgtatgccgtcgccacctcggggatggtggtgacggggccggatggccagccggtttcctcggcctcggtgggcgaactcttcatggcgggggtcgtgcccggtctgatgctggcgggcttccttgccttcaccacctggaaccgggcgcgcaaattcggctatccgcgtctggaaaaggccagcctgcgccagcgctggaccgccttccgcgaggccgcctgggggctgatgctgatcgtcgtcgtcatcggcgggatctatgcgggcatcttcacgccgaccgaagccgccgcgatgagcgccgtctacgcctttttcatctcggtcttcgtctacaaggacctgaccctgcgcgacgtgccccgggtgctgctgtcgtccgccaacatgtcggcgatgctgctttacatcatcaccaatgcggtgctgttcagcttcctgatggcgcatgagggcatcccgcaggccttgggcgaatggatggtgaacgcgggtctgtcctggtggatgttcctgatcatcgtcaacatcctgctgctggccgcgggcaacttcatggagccctcctcgatcgtcttgatcatggcgccgatcctgtttccggtcgcggtgcggctgggcatcgacccggtgcatttcggcatcatgatcgtcgtcaacatggaagtcggcatgtgccacccgccggtggggctgaacctttacgtcgcctcggggatcaccaagatgggcatcaccgaactgacggtggcggtctggccctggcttctgaccatgctcgccttcctcgtgctggtgacctatgtcccggcgatcagtctggccttgcccaatctgcttggcatgtaa

SEQ ID NO: 56440 - protein, 440 aa, Rhodobacter capsulatus
MSALIIFGLLIALMLTGMPISISLGLTVLTFLFTMTQVPIDTVALKLFTGIEKFEIMAIPFFILAGNFLTHGGVAKRMINFATAMVGHWHGGLGLAGVIACALFAAVSGSSPATVVAIGSVILPAMVNQGFPKQFGAGVITTSGALGILIPPSIVMVMYAVATSGMVVTGPDGQPVSSASVGELFMAGVVPGLMLAGFLAFTTWNRARKFGYPRLEKASLRQRWTAFREAAWGLMLIVVVIGGIYAGIFTPTEAAAMSAVYAFFISVFVYKDLTLRDVPRVLLSSANMSAMLLYIITNAVLFSFLMAHEGIPQALGEWMVNAGLSWWMFLIIVNILLLAAGNFMEPSSIVLIMAPILFPVAVRLGIDPVHFGIMIVVNMEVGMCHPPVGLNLYVASGITKMGITELTVAVWPWLLTMLAFLVLVTYVPAISLALPNLLGM

SEQ ID NO: 56441 - DNA, 1281 bp, Comamonas sp
  CDS (1)..(1281)
atgacttttgctttgggcgtgctgccagtgctgctgctggctctcggctttccggtgttcctggtcctgctgacagcggccgccgtggccctgacgatgttcatggacgtgccgctggccgcgctgcaccagaccctgtacggatccctagacgcctattcgctgctcgcgattcccttcttcatctacgcaggggagttgatggggcgcggctcggttgccaggaggctcgtcgccgtggtgcaggcgggtgcgggcaacatgcggggcagcctcggggtgacgacggtcggtgccacggccgtcttcggcgccatttccggctccagtgcagccaccgtggcaacgatcggcagggtggtgctgccggagatgcggcgcgcgggctacccggtacccttctccgccggcctggtgacttccgtcggggccatcggcgtcatcatcccgccgtcgattcccatgatcgtgtatggcgcggcggcacaggaatcggtgccgcgcctctatgccgccggcgtgttcccggggctcctcatcgcggccatgctggcgctgtacgtgtatgtccaggcgcgcctgcagggcttcgcgcccggggaaccgtcgacactgcgcaatttcatggtcgccatgaaaaagggcgtctgggcgatgggcgcgcccttcatcatcctgggcggcatctatggcggcgtattctccccgaccgaggccggtggcgtcgcgtgcgtctactcggcactggtgacgcgcatcgtttaccgcgacctttcctggcgccaggttctcaaggtggcggaggcctcagccgccctgacggcacagatcctgatcatcatcgcttgtgccagcgtgttctcctggctgctgacggtgaaccaggtgccggtgatggtggtgggatggctgcagggtctcgagctctcgtcctggatgatcctgctggcgatgaacgtgctgctgctggtggtcggctgctttttcgatccgctgtccgccatcctgctgttgtcgccgctgcttgtgccgatcgcccaggcggccggcgtcgacggcgtgcacttcgggatcatcctgacggtgaacctcgccatcggcctgttcaccccaccgttcggattgaacatcttcgtcgcccagtcggtgctgaagcaatctctgggtgacatctaccgcgggacgatgccgttcttcctgatctatcttgtcgcgctgggcttgatcacgtacatcccgcagatctccatgctgggcgttcaattgctgctgcgccagtaa

SEQ ID NO: 56442 - protein, 426 aa, Comamonas sp
MTFALGVLPVLLLALGFPVFLVLLTAAAVALTMFMDVPLAALHQTLYGSLDAYSLLAIPFFIYAGELMGRGSVARRLVAVVQAGAGNMRGSLGVTTVGATAVFGAISGSSAATVATIGRVVLPEMRRAGYPVPFSAGLVTSVGAIGVIIPPSIPMIVYGAAAQESVPRLYAAGVFPGLLIAAMLALYVYVQARLQGFAPGEPSTLRNFMVAMKKGVWAMGAPFIILGGIYGGVFSPTEAGGVACVYSALVTRIVYRDLSWRQVLKVAEASAALTAQILIIIACASVFSWLLTVNQVPVMVVGWLQGLELSSWMILLAMNVLLLVVGCFFDPLSAILLLSPLLVPIAQAAGVDGVHFGIILTVNLAIGLFTPPFGLNIFVAQSVLKQSLGDIYRGTMPFFLIYLVALGLITYIPQISMLGVQLLLRQ

SEQ ID NO: 56443 - DNA, 1341 bp, Paracoccus denitrificans
  CDS (1)..(1341)
atgaacgattacgtcgtagaggtcctgttcggcaccttcgctttgctgatggtgctgggcgccccgatcaccgtcgcgcttggcgtggccgcgctggccgccatgctttatctgggcgacaacccgatcaagatggtgcagatggcctggtcctcggtcgggtccttcccgctgatggcgctgccttcgttcatcctggccggggcgctgatggaggccgcgggcctgtcgcgccggctgatctcggtcgccgaaagccttgccggtccgttcaccggcggcctttccgccgcgaccgtcgtcgcctgcctgttcttcggcgcgatctcgggctcgggtccggccaccaccgccgccgtcggcatgctgatgatccccgggatgatccgcaacggctacagccgcgattacgcggcctcgaccaccgcggccgcgggcggcctgggcatcgtcatcccgccctcgatcccgatgatcatcttcggcatctcggccatgggcatcgcgcccgatccggccgccgtcgaggcgcatggccagttccagtcggtctcgatctcgaagatgttcatcgccggcttcctgcccggcgcggtcatggcgggcggcctgctgctgatgaactatgtccgctgcaagcggcggggctatcacggttcgtccgagccgctgtcgctgcgcaagttcatgtgcgcctgctatcagggcttctgggcgctgctggccccggtggtgatcctgggcggcatctataccggcatgttcacgcccaccgaagccgccatcatcgccatcttctacaccctgttcgtcgggatcttcatctaccgcgaactggatctgggcgaggtcttcaaggcgctcgaggcgacgacctggctggccgggcgggtgcttctggtgctgttcgccgccaccatcttcggccgcatcctggtcgagaacaacgtccccggcatcatcgccggcggcatcctcggcctgaccaccaacatctatgcgatctgggcgctgatcatcggcatgctgctgatcgtgggcatgttcatggagacgctggccgcgatcatgatcctcgtcccggtcatgctgccggtggcctatatggtgggcatcgatccgatccacttcggcatcgtgatgatctgcacgctctccgtcggcttccagaccccgccgctgggcgagaacctgttcatcgcctccggcatctccggcgagaccatcgagaagatcagcgcgaccgcgctgcccttcgccatcgcctcgaccgccgcgatcttcgtcatcgccatgttcccgcaaatcgccctctggcttcccgccctgctgggctactga

SEQ ID NO: 56444 - protein, 446 aa, Paracoccus denitrificans
MNDYVVEVLFGTFALLMVLGAPITVALGVAALAAMLYLGDNPIKMVQMAWSSVGSFPLMALPSFILAGALMEAAGLSRRLISVAESLAGPFTGGLSAATVVACLFFGAISGSGPATTAAVGMLMIPGMIRNGYSRDYAASTTAAAGGLGIVIPPSIPMIIFGISAMGIAPDPAAVEAHGQFQSVSISKMFIAGFLPGAVMAGGLLLMNYVRCKRRGYHGSSEPLSLRKFMCACYQGFWALLAPVVILGGIYTGMFTPTEAAIIAIFYTLFVGIFIYRELDLGEVFKALEATTWLAGRVLLVLFAATIFGRILVENNVPGIIAGGILGLTTNIYAIWALIIGMLLIVGMFMETLAAIMILVPVMLPVAYMVGIDPIHFGIVMICTLSVGFQTPPLGENLFIASGISGETIEKISATALPFAIASTAAIFVIAMFPQIALWLPALLGY

SEQ ID NO: 56445 - DNA, 1284 bp, Halomonas elongata
  CDS (1)..(1284)
atgacgacaataatggttgcgaccatgataggcctgctgctgctgggctttcccatgatgatcccgctggccaccgcctcgatcatcgggttcttcatgatgttcggcgggctgggccagatggagaccctgatccagcagctgatggccggcatacggccggcatcgctgatcgcggtgcccatgttcatccttgccgcggacatcatgacccgcggccagtcggccaaccgactgatcaatatggtgatggccttcatcggccacataaagggcggcctggcggtcagcacggcggcttcctgcacgctgttcggcgccgtttccggctccacccaggccaccgtggtggcagtcggctctccgctgcgcccgcgcatgctcaaggccggctattcggactccttcagcctggcgctgatcatcaattccagcgatatcgcctttctgattccacccagcatcggcatgatcatctacgggatcatttccggtacttccatcggcgagctgttcatcgccggtatcggcccgggcctgatgattctggtcatgttcgccatctactgcgtgatctacgccatcgtccgcggtgtgcccaccgagcccaaggccagttggggagaacgcttctcggccgtgcgcctggccctgtggccgctgggctttccggtgatcatcatcggcggcatctacggcggcatcttcagcccgaccgaagcggcggcagcctgtgtgctctatgcggtactactggaattcgtggtcttccgctcgctgaagatcagcgatatctacgccattgccaagtccaccggccttatcaccgccgtggtgttcatcctggtggcggtgggcaacagcttctcgtggatcatctccttcgcccagattccccaggctatcctcgaggccgtgggtatcaacgaggcggggccgaccggggtgctgatcgccatctgtgtcgccttcttcgtcgcctgcatgttcgtcgatcccatcgtggtgatcctggtactgacaccggtcttcgcgcccgccatcgaggccaccggcctcgacccggtgcttgtcggtatcctgatcacgctgcaggtggccatcggctcggcgacaccgcccttcggttgcgacatcttcactgccatcgccatcttcaagcgcccttacctggacgtgatcaagggcacgccacccttcatcttcatgctggtactggcggccgcgttgctgatcctgttcccgcagatcgccctgttcctgcgcgatctcgctttcaggtaa

SEQ ID NO: 56446 - protein, 427 aa, Halomonas elongata
MTTIMVATMIGLLLLGFPMMIPLATASIIGFFMMFGGLGQMETLIQQLMAGIRPASLIAVPMFILAADIMTRGQSANRLINMVMAFIGHIKGGLAVSTAASCTLFGAVSGSTQATVVAVGSPLRPRMLKAGYSDSFSLALIINSSDIAFLIPPSIGMIIYGIISGTSIGELFIAGIGPGLMILVMFAIYCVIYAIVRGVPTEPKASWGERFSAVRLALWPLGFPVIIIGGIYGGIFSPTEAAAACVLYAVLLEFVVFRSLKISDIYAIAKSTGLITAVVFILVAVGNSFSWIISFAQIPQAILEAVGINEAGPTGVLIAICVAFFVACMFVDPIVVILVLTPVFAPAIEATGLDPVLVGILITLQVAIGSATPPFGCDIFTAIAIFKRPYLDVIKGTPPFIFMLVLAAALLILFPQIALFLRDLAFR

SEQ ID NO: 56447 - DNA, 1296 bp, Mycobacterium smegmatis
  CDS (1)..(1296)
gtgtccatcgaccccatcgctgtgggaatcctcatcggaggattcgccgtgctcatcctgctgcgcatcccgatcgccctggcgctcgcgctggcggcggtgttcgaggcgttctatctcgacctgccgctgcccatcgtcgggcaacggatggtcgcgggcctcgacatcttcgcgctgctcgccatcccgttcttcatcctcgggggcgagatcatggccgccggcgggatctcccggcgactgatcgcgttcgcgagtctgttcgtcggctggctgcgcggcggcctcgcgatgatcaacatcggttccagtaccttcttcggtgcactgtcgggttcgtcggtcgccgacgtctcggccatcgggtcggcgaccatcccgatgatgaaacagaaagggtacgacgccgattacgccgtctgcgtgaccatcaccggagccgctcaggccgtgatgattccgcccagccacaacctggtgatcttctcgatggccgcgggcggggtgtcgatcggtgccctgttcgtcgcaggcatcgtccccggtctgctgatcggcttgtcgcttctggtgctggcctacctgctcgccgtccgccgtgggtaccccaaggagaccctcgtcccggtcagtgaggtcccacgcatcgtgtgggaagggctgctgagcctgctgatgccggtgatcatcctcggcggaatcctcagtggcatcttcacggcgaccgagtccgcggccatcggctgtgtctacgccttcttcctgaccttcttcgtttaccgcgacatcccgctgtcgggcttcatcccgatcctccagcgcaccgcacgaacgctcgggatcgtgctgttcatcatcgcggcggccggggcgttcgggtatttcctgaccttcctccaggtccccgaggcggtcacccaagcactattgggcctctcggacaacaagatcgtcatcctgctggtgatcaacctgctgctgctcgcgctcggcgccgtgatggacatggcaccactgatcttgatcatgacgccgatcctgctgccggtcgccacgagtatcgggatggacccggtccagttcggcatcatgctgctgctcaacctcgccatcggtctcatcacgccgccggtcggcaacgtcctgttcgtcggggctgcgatcggccagatctcgatcgagaaagtctcacgggcactcccggtgttcctggtccccatgctcttggtgctcctgctcatcacgttcctgccgcagttgtccctggccctaccgggcctgctcggcctctag

SEQ ID NO: 56448 - protein, 431 aa, Mycobacterium smegmatis
MSIDPIAVGILIGGFAVLILLRIPIALALALAAVFEAFYLDLPLPIVGQRMVAGLDIFALLAIPFFILGGEIMAAGGISRRLIAFASLFVGWLRGGLAMINIGSSTFFGALSGSSVADVSAIGSATIPMMKQKGYDADYAVCVTITGAAQAVMIPPSHNLVIFSMAAGGVSIGALFVAGIVPGLLIGLSLLVLAYLLAVRRGYPKETLVPVSEVPRIVWEGLLSLLMPVIILGGILSGIFTATESAAIGCVYAFFLTFFVYRDIPLSGFIPILQRTARTLGIVLFIIAAAGAFGYFLTFLQVPEAVTQALLGLSDNKIVILLVINLLLLALGAVMDMAPLILIMTPILLPVATSIGMDPVQFGIMLLLNLAIGLITPPVGNVLFVGAAIGQISIEKVSRALPVFLVPMLLVLLLITFLPQLSLALPGLLGL

SEQ ID NO: 56449 - DNA, 1281 bp, Pseudomonas stutzeri
  CDS (1)..(1281)
atgaccatcctgttcctgttcgtcgccctcttcgcactgatgttcatcggtgtgccggtggccgtttccctgggcctggccggctcgctgaccatcatgatcttcagccaggactcggtgcgctcgctggcgatcaagctgttcgagacctccgagcactacaccctgctggccattccgttcttcctgctggccggcgccttcatgaccaccggtggcgtggcccgtcgcctgatcgacttcgccaatgcctgcgtcggccacatccgtggcggcctggccatcggtgcggtgctggcgtgcatgctgttagccgcactgtccggttcgtcgccggccaccgtggctgcggtcggctccattgccatcgccggcatggtgcgctccggttacccgcaggccttcggcgccggcatcgtctgtaacgccggtaccctgggcatcctgatcccgccgtcggtggtcatggtggtctacgccgccgcgaccgagacctccgtgggcaagctgttcatggccggtgtcgtcccgggcatcatgctcggcctggcgctgatggtggcgatctacatcatcgcggtgaagaagaacctgccggccctgccgcgggcgagcttccgcgagtggctgatcgccgcgcgcaaggcgatctggggcctgctgctaatggtgatcatcctcggcggtatctactccggcatgttcaccccgaccgaagcggcggcggtggcggcggtgtattcggccttcgtcgcgctgttcgtctacaaggacatcacgctgcgcgattgcccgaaagtgctgctggagtccggcaagctgtcgatcatgctgatgttcatcatcgccaacgccatgctgttcgcccacgtgctgaccaccgagcagatcccgcaggcgattactgcctgggtgatcgaagcaggcctgcagccgtggatgttcctgctggtggtgaatatcgtgctgctggtcgccggagccttcatggagccgtcggcgatcatcctgatcctggcaccgatcctgttccccatcccggtccagctgggcatcgacccgattcacctgggcatcatcatggttggtgggatgcgaatcggattgatcacaccaccggtggggctgaacctgttcgtcgcctcggcggtgacgggcatgccggtgacccaggtgatccgcgcggtgctgccatggctggcactgatgctgagcttcctggtgatcatcacctacgtgccgtcgatctccctggccctgccgaactggctgggcatgtag

SEQ ID NO: 56450 - protein, 426 aa, Pseudomonas stutzeri
MTILFLFVALFALMFIGVPVAVSLGLAGSLTIMIFSQDSVRSLAIKLFETSEHYTLLAIPFFLLAGAFMTTGGVARRLIDFANACVGHIRGGLAIGAVLACMLLAALSGSSPATVAAVGSIAIAGMVRSGYPQAFGAGIVCNAGTLGILIPPSVVMVVYAAATETSVGKLFMAGVVPGIMLGLALMVAIYIIAVKKNLPALPRASFREWLIAARKAIWGLLLMVIILGGIYSGMFTPTEAAAVAAVYSAFVALFVYKDITLRDCPKVLLESGKLSIMLMFIIANAMLFAHVLTTEQIPQAITAWVIEAGLQPWMFLLVVNIVLLVAGAFMEPSAIILILAPILFPIPVQLGIDPIHLGIIMVGGMRIGLITPPVGLNLFVASAVTGMPVTQVIRAVLPWLALMLSFLVIITYVPSISLALPNWLGM

SEQ ID NO: 56451 - DNA, 1251 bp, Agrobacterium tumefaciens
  CDS (1)..(1251)
atggtcttgcgcatgccagttgggatggcgatgctgaccgtgggcttcttcggcacgtggatgctgaatggcttccgttcggcgaacgccttaatggttacggagacattctctcaggtatccaactactcgttgaccgtcatccctctatttatattgatgggcaatatagcttcggtagccggcttcagccgtgggctctacgaagcggcttttgcatgggtggggcgactccctggaggtcttgcttcggcttcagtccttgggtgtgcggcgttctccgccgtcagtggctcatcggtggcgactgcggttaccattggacgtgtcgcactgccagagatggcgcgtttcaactattccagcgggctcgcaacgggtgcgattgctgccggtggcacccttggtttccttatcccaccatcaaccggctttgttatctacgccattctcaccgaacaaagcattggccaattgttcatgtcgggtattctccccggtctcttgcttgcaggcttgttcattctcacggtcaccctcatctcgcttcgaaatccagaagcgggaccgcgcggagctcatgttccgctaaaggaacgtatggctgccacactccgtgcggcgcccctgctaacggtaatcatagtatcaattgggggtatttatcttggtgtattcacgccagtcgaagccgccggcatcggcgcgggactggtccttatcttggctctatttacgcggaagctgactccgtcaaccgcttggcgagcggttagcgacacggtcagcactacagccatgctgtacctgatcattataggcgcagcagtcctcaatccgtttctatcgatgacacaattgccgtcgatgttgggcgaagcaatgacgtcttctggtctcggcccctatggcgtgctgtttcttgtcgttgttgcctatctgattttggggatgttcatggacgggttagcaatgctggtcgtgactgttcccatcttctaccccatcatgatgtcgatgggctttgatccgatctggtttggtgttgtagccgttatcatgattgagatgggtatgatcacgcctcctgtcggcatgaatgtatttgtcgtgaaaagtattgccggtgatgtgcccatggccacgatttttcgcggcgtcctgccattctggtttgcaatggggttctgtctgcttttgctcgtacttttcccccaaattgcattgtttataccccaggcgatgttctga

SEQ ID NO: 56452 - protein, 416 aa, Agrobacterium tumefaciens
MVLRMPVGMAMLTVGFFGTWMLNGFRSANALMVTETFSQVSNYSLTVIPLFILMGNIASVAGFSRGLYEAAFAWVGRLPGGLASASVLGCAAFSAVSGSSVATAVTIGRVALPEMARFNYSSGLATGAIAAGGTLGFLIPPSTGFVIYAILTEQSIGQLFMSGILPGLLLAGLFILTVTLISLRNPEAGPRGAHVPLKERMAATLRAAPLLTVIIVSIGGIYLGVFTPVEAAGIGAGLVLILALFTRKLTPSTAWRAVSDTVSTTAMLYLIIIGAAVLNPFLSMTQLPSMLGEAMTSSGLGPYGVLFLVVVAYLILGMFMDGLAMLVVTVPIFYPIMMSMGFDPIWFGVVAVIMIEMGMITPPVGMNVFVVKSIAGDVPMATIFRGVLPFWFAMGFCLLLLVLFPQIALFIPQAMF

SEQ ID NO: 56453 - DNA, 1248 bp, Wolinella succinogenes
  CDS (1)..(1248)
atgctaattggcgtccccgttgcggtggcgcttggaaccagcaccgttttatcaatgttgctcttcactgagctagacccgatgtccatccctcagcttgtctttgatggcatcaacaaattctctctcatggcgattccgatgttcatccttgcaggaaacctgctgagcaaaggaagctctgcccgccgaatcatcgactttgccaagtccatggttggacaccttcctggcggactccctatgagcgccatttttgcttgtatcatttttgctgccgtgagcggtagctctcctgccaccgttgtagcgattggttcaatcatgtttgcagcgatcaaagatgcaggctatcccgccagctacgccgtaggaggaatcaccaccgcaggaagccttggaatcctcatccctccctccatcgtcatgatcgtctatggggttacagcggaagaatccatcggtaaactcttcatggcgggcgtcatccccggactcatgattggagcgatgatgatgcttcagacctactggggggctaaacgccttggctttaaagccaccgagcctgcgccctttagagagcgactccaaaagcttggcaaagctttttgggctctcatggtcatctttgttgtcattggcggtatctatggcggcatcttcaccccgactgaggctgcggctgtaagcgccgtctatgcttttgtcatctcctattttgtctataaagatatccaactcaaagacctctacaaggttttcctagaatcagccatgaccacctccatgatctttttcatcatcgccaatgccgtggtttttgcacacttcctcaccagcgagcagattcctcaaaccatcgctcagacgattctagatcacaatgtaggcaagattggattcttgattctagtgaacatcatcctctttatcatgggtcagttcatggagccctccagtgtggtgatgatcatggttcctctgctcctccctatcgccacagagctaggaatcgaccccattcactttggtattatcatggtggtcaacatggagcttggcatgatcacgcctcccgtgggactcaacctctttgtcgctagtgggctcacgggaatgagcctcaaagatgtcgtgatcgcctcgctcccttggacgatcactatctttataggactcattctagtcacctatgttcctgcgatctccctttggttgcccaacctgatgtttggcacctattaa

SEQ ID NO: 56454 - protein, 415 aa, Wolinella succinogenes
MLIGVPVAVALGTSTVLSMLLFTELDPMSIPQLVFDGINKFSLMAIPMFILAGNLLSKGSSARRIIDFAKSMVGHLPGGLPMSAIFACIIFAAVSGSSPATVVAIGSIMFAAIKDAGYPASYAVGGITTAGSLGILIPPSIVMIVYGVTAEESIGKLFMAGVIPGLMIGAMMMLQTYWGAKRLGFKATEPAPFRERLQKLGKAFWALMVIFVVIGGIYGGIFTPTEAAAVSAVYAFVISYFVYKDIQLKDLYKVFLESAMTTSMIFFIIANAVVFAHFLTSEQIPQTIAQTILDHNVGKIGFLILVNIILFIMGQFMEPSSVVMIMVPLLLPIATELGIDPIHFGIIMVVNMELGMITPPVGLNLFVASGLTGMSLKDVVIASLPWTITIFIGLILVTYVPAISLWLPNLMFGTY

SEQ ID NO: 56455 - DNA, 1206 bp, Haemophilus influenzae
  CDS (1)..(1206)
atgctgttgagtgcgagtattatgctatatcatcttgatatgtttgatacgcaattaattacagaaaactttgtgatgggaacgaataattttcctttgatggctattcctttctttatgcttactggagaaataatgaagcatggtggaatttctgagcgaatcattaattttgcaacaagtatggttggtcatattaaaggtggtttaggttatgttgcgatcatttctgggttgatatttgcagggttatctggttctgcggtagcggatacggccgcgttaggtgcaatactaattcctatgatgatttctaaaaaatatgatggtgctcgttccacaggattaatttgtgctgcaggtattatttcagttgttattcctccaagcattcctatgatcatttacggtattactgctggagcatccatcactaaattatttatggggggaactgtaccaggcttattaatggtcgttggattatgggttacttggaaaattttgtatagaaataatgatacaagtctagaaagaaaacaaactggcaaagaaagatgggttgcttttaaaaaagcattttggcctttattattacctatcattattattgtgggattaagaggagggatttttactccaacagaagcgggagttgttgctgcaatttatgctggcatagtaagtattgcttataaaggcttaacattttctaaattaaaagacgtcttcattggtaccatcaaaacaacatcaatggtaatgtttgttgctgcatcagcaatgatatctgcttttgcgattacagttgctcaaattccaacagaattagtccaaacgattaaaggattaactgatagtccgacaattttaatgtttattataatgctatttttattacttgttggatgtgtaatggatttaattcctgcggtattaatctttgttccagtcttattaccagtgttaagagcatataatattgatattgcgtattttggaatcatgatggtgattaatttatctataggattaataacaccgcctgtgggaacagttttgtatgtaggctcagggatatcaaaattagggataggagcattatccaaaggaattgctccattcttatttgtgtacgcaattattatgatgttgatcgtattttttcctgaaattgtaattgttccaatgaattggttatcttga

SEQ ID NO: 56456 - protein, 401 aa, Haemophilus influenzae
MLLSASIMLYHLDMFDTQLITENFVMGTNNFPLMAIPFFMLTGEIMKHGGISERIINFATSMVGHIKGGLGYVAIISGLIFAGLSGSAVADTAALGAILIPMMISKKYDGARSTGLICAAGIISVVIPPSIPMIIYGITAGASITKLFMGGTVPGLLMVVGLWVTWKILYRNNDTSLERKQTGKERWVAFKKAFWPLLLPIIIIVGLRGGIFTPTEAGVVAAIYAGIVSIAYKGLTFSKLKDVFIGTIKTTSMVMFVAASAMISAFAITVAQIPTELVQTIKGLTDSPTILMFIIMLFLLLVGCVMDLIPAVLIFVPVLLPVLRAYNIDIAYFGIMMVINLSIGLITPPVGTVLYVGSGISKLGIGALSKGIAPFLFVYAIIMMLIVFFPEIVIVPMNWLS

SEQ ID NO: 56457 - DNA, 1278 bp, Haemophilus influenzae
  CDS (1)..(1278)
atgacagtgattatttttctttccgtcttgcttggtaccattattcttggtgtacctgttgcctttgccttgctaatttgtggaatagcactaatgctccatctagacttttttaatgcacaaatacttgcacaacaacttgtcagtggcgcagatagtttttctctaatggctattcccttttttatccttgctggtgaaataatgaatgagggaggactttctaaacgtattattgatttacctatgaaacttgtaggtcataaacgaggagggctgggatttgttgctattttaagtgcaatgattatggcaagcttatctggttcggctgttgctgatactgctgctgtagctgctatgttactaccaatgatgaaaaccacaggatatccaatacatcgttctgctggtttaatcggcactgctggtatcattgctcctataattcctccatcaattccttttattgtctttggtgttgccagtggtgtatctatcactaaattatttttagcaggtattttccctggtgtgattatgggatgttgcctagctattttatggcggtggcaagctaaacgccttaatttaatgacattttcaaaagcaacgaaacaagatctttgtttttcttttaaaaatagtgtttgggcattaatgctaccagtaatcattataggaggatttcgttcaggtatatttacacctactgaagctggtgtagttgcaacattttatgcattaattgtttctctctttatatatcatgaattacccttaaaacatttgccaaaagtattgttagctgcagcaaaaaccaccgcagttgttatgtttttggttgcctcagctaatgtaactggctacttaattactgttgctgaacttcccacaatgctgacaatattgcttgaacctttaattgaaaatccaacaattttacttttggtcattatgcttgctgtatttgtgataggaatggtaatggatttaacaccaacagtcttaattttaacccccgttttaatgccacttgtggaagaagctggaattgatccagtttatttcggcgtattgtttatcttaaatacctcaattggcttaattacaccgcccgtgggcaatgtgttgaacgttatcactggagtatcaaagcttccttttgatcaggctgcgaaaggtattatgccctatttagggatgatgattatgttattacttacctttatttttattccagaactaattttaatgccactacaatggatccagtaa

SEQ ID NO: 56458 - protein, 425 aa, Haemophilus influenzae
MTVIIFLSVLLGTIILGVPVAFALLICGIALMLHLDFFNAQILAQQLVSGADSFSLMAIPFFILAGEIMNEGGLSKRIIDLPMKLVGHKRGGLGFVAILSAMIMASLSGSAVADTAAVAAMLLPMMKTTGYPIHRSAGLIGTAGIIAPIIPPSIPFIVFGVASGVSITKLFLAGIFPGVIMGCCLAILWRWQAKRLNLMTFSKATKQDLCFSFKNSVWALMLPVIIIGGFRSGIFTPTEAGVVATFYALIVSLFIYHELPLKHLPKVLLAAAKTTAVVMFLVASANVTGYLITVAELPTMLTILLEPLIENPTILLLVIMLAVFVIGMVMDLTPTVLILTPVLMPLVEEAGIDPVYFGVLFILNTSIGLITPPVGNVLNVITGVSKLPFDQAAKGIMPYLGMMIMLLLTFIFIPELILMPLQWIQ

SEQ ID NO: 56459 - DNA, 1902 bp, Haemophilus influenzae
  CDS (1)..(1902)
gtgtgccgtaatggccctacattcccttattcttcatcaaacggagtgagtatgaaatatattaataagcttgaggaatggctgggtggcgcattatttatcgccattttcggtattcttatcgctcaaattctttcacgccaagtttttcattctccgttaatttggagtgaagaactcgccaagctcttatttgtttacgtgggtatgttgggtatcagcgttgctgtgagaaaacaagaacacgtatttattgattttttaactaatctaatgcccgaaaaaatcagaaaattcacaaatacgtttgtacaattattagtctttatatgtattttcttatttattcatttcggtattcgtacttttaacggtgcatcattccctattgatgccttaggaggcatttctgaaaaatggattttcgcagcactgcctgttgtcgcaatattaatgatgtttcgctttatccaagcgcaaaccctaaactttaagactgggaaaagctatttacctgcaactttctttatcataagtgcggtcattttatttgcgattttatttttcgcgccagattggttcaaagtattgcgtattagcaattatataaaactcggttcaagttcagtctatgtcgccttactcgtttggctaatcattatgtttatcggtgtccctgtaggttggtccttatttattgctactctactttatttttctatgacacgttggaacgtcgtaaatgccgcaactgaaaaattagtctatagcctagacagcttcccattacttgccgtgccattttatattttaacgggcattctaatgaatacaggtgggattaccgaacgtatttttaattttgctaaagccttactcggtcattacacaggaggaatgggacacgttaatatcggcgcaagtttattgttctctggtatgtcaggttcagcacttgctgatgcggggggcttaggtcaattggaaatcaaagcaatgcgtgatgctggttatgacgatgatatttgcggaggaattactgctgcttcttgtattattgggccattagttccgccaagtattgcaatgattatttacggtgtaattgccaatgaatctatcgcaaaactctttattgcaggttttattccaggtgtattaattactttagctttaatggcaatgaattatcgcattgcaaaaaaacgaggttatccacgtacaccaaaagctacgagagaacaactttgcagcagctttaaacaatctttttgggcaatcttaacgccgttattaattatcggtggtattttttcaggcttattcagtccaacagaatctgccattgttgcagcagcatactctgtaattattggtaaattcgtgtataaagaattaaccttaaaaagcttatttaatagttgcatagaagcaatggcaattacgggcgtagtcgccttaatgattatgaccgtgactttctttggcgatatgattgcgcgtgaacaagtcgcaatgcgtgttgctgatgtgtttgttgccgttgccgattcgcctttaaccgtattgataatgattaacgcactgttactttttcttggaatgttcattgatgccctagcattacaatttttagtattaccaatgcttattcctatcgcaatgcagttcaatattgacttaatcttctttggtgtaatgaccacattaaatatgatggttggtattcttaccccaccaatgggaatggctctctttgttgttgctcgtgtaggaaatatgtcagtttccacggtaaccaaaggcgtattaccgttcttgattcccgttttcgtcacattagtattaatcacgattttcccacaaatcatcacatttgtgccaaatctattgataccataa

SEQ ID NO: 56460 - protein, 633 aa, Haemophilus influenzae
MCRNGPTFPYSSSNGVSMKYINKLEEWLGGALFIAIFGILIAQILSRQVFHSPLIWSEELAKLLFVYVGMLGISVAVRKQEHVFIDFLTNLMPEKIRKFTNTFVQLLVFICIFLFIHFGIRTFNGASFPIDALGGISEKWIFAALPVVAILMMFRFIQAQTLNFKTGKSYLPATFFIISAVILFAILFFAPDWFKVLRISNYIKLGSSSVYVALLVWLIIMFIGVPVGWSLFIATLLYFSMTRWNVVNAATEKLVYSLDSFPLLAVPFYILTGILMNTGGITERIFNFAKALLGHYTGGMGHVNIGASLLFSGMSGSALADAGGLGQLEIKAMRDAGYDDDICGGITAASCIIGPLVPPSIAMIIYGVIANESIAKLFIAGFIPGVLITLALMAMNYRIAKKRGYPRTPKATREQLCSSFKQSFWAILTPLLIIGGIFSGLFSPTESAIVAAAYSVIIGKFVYKELTLKSLFNSCIEAMAITGVVALMIMTVTFFGDMIAREQVAMRVADVFVAVADSPLTVLIMINALLLFLGMFIDALALQFLVLPMLIPIAMQFNIDLIFFGVMTTLNMMVGILTPPMGMALFVVARVGNMSVSTVTKGVLPFLIPVFVTLVLITIFPQIITFVPNLLIP

SEQ ID NO: 56461 - DNA, 1260 bp, Rhizobium sp
  CDS (1)..(1260)
atgacgatcgtgatgatcattgtcttctgcgcactgatgatgctggcagtgccggtcggttacgccctgattatcgccgccggcgtcgcggtcctgttcaacggctatctgccgctttcgattgtggcgcagcagatttatgaccagacccaatcctttccgatgctcgcgctgccgttcttcatgctggccggcacgctgatgcttggcggtgagctcggccggcagctgctggagctggcatcgcatgcgatgcagcgctggcggggcggacccctgtcgaccaccgtcgtttcttccgtcgtgtttggcggcgtctccggttccgccgtggcgaatgccagcgccctcggatccgttcttatcccgtggcagaaaaagcacggctttccgcccgcgctctgcgcggccaacaacgcgacctcggcggtcatcgacgttctgataccgccgtcgattcccatgatcctcttctccctggtaagcggcgtcagtgtcgccaacctcttcgtcgcgggcatcttgccgggcatcctgatggccgcgagctttgtcttcgtctgctggttcgtttcggtgaggcgcggctacgcctcgcagccctcgcagaccagcaggcggcagctcgccacgctggcactgaagagcctgcccgcggtgctgctgccggtgctgatcatcctattcctgcggtttggcctggccacgcccacggaagtcgcggtgctctcggtcgtctattcgctcgcactcagccttctttactaccgcgacctgacatggaagcgattctgcgacaacgtggtcgaggccggcatggccaccggcgtggtcatgctggtcatcatgggcagtgccgccgtgggttgggtcttgaccttcgaccaggcgccgcagcagatggcggattgggtcgccgccaacatctcgagcccgatcgtcatcatcctaatgatgaacatcctgatgctgatcgtcggcatgccgctcgatatgccgcccgccatcctgctgctcggacccatcttcgttccccttgccgacacgatcggtctggaccgggtccagcttgggctgatgatggtgatcaatcttggaatcgggctctacacccccccgatcggcacgacgctcttcatctcctcgtcgatcgccaaatcaccactcggcgagaccacccgtgaactctggcccttctttgccatggcgatgacgctccttcttgcggtgagcttcatcccggcgctcacgctctactga

SEQ ID NO: 56462 - protein, 419 aa, Rhizobium sp
MTIVMIIVFCALMMLAVPVGYALIIAAGVAVLFNGYLPLSIVAQQIYDQTQSFPMLALPFFMLAGTLMLGGELGRQLLELASHAMQRWRGGPLSTTVVSSVVFGGVSGSAVANASALGSVLIPWQKKHGFPPALCAANNATSAVIDVLIPPSIPMILFSLVSGVSVANLFVAGILPGILMAASFVFVCWFVSVRRGYASQPSQTSRRQLATLALKSLPAVLLPVLIILFLRFGLATPTEVAVLSVVYSLALSLLYYRDLTWKRFCDNVVEAGMATGVVMLVIMGSAAVGWVLTFDQAPQQMADWVAANISSPIVIILMMNILMLIVGMPLDMPPAILLLGPIFVPLADTIGLDRVQLGLMMVINLGIGLYTPPIGTTLFISSSIAKSPLGETTRELWPFFAMAMTLLLAVSFIPALTLY

SEQ ID NO: 56463 - DNA, 1308 bp, Salmonella typhimurium
  CDS (1)..(1308)
atggactttgaatatatttacccaataattgttttatttggcagctttgccattatactggcggtcggcgttcctattacattcgctatcgggctgtcgtccttattctcaatcctgatagcccttcccccggatgcggcaatctcggttatttcgcaaaaaatgaccgtcggtctcgatggctttacgctgctggcgatccccttttttgtgttagccggcaatatcatgaataccgggggaatcgcccggcgcctggtgaatctggctcaggcgttagttggccgccttcccggttcgctggcgcactgcaatattctggcgaacaccctgtttggcgcgatatccggctcggcggtcgcttctgcggccgcggtgggcggcatcatgtcgccattacaggaaaaagagggctactctccggcgttctctacggcgatcaacgtcgcttcggcgccgattggcctgatgatcccgcccagcaatgtgctaattgtctattcgctggctagcggcggcacctctgtcgccgccctgtttttggcgggctacctgcccggcatcttaaccgcgctggctttaatgacggtagcggcgctgtatgcccatcgccaccattacccggttgccgaacgcatcaacctgcggcagtttctgtcggtattccgcgattcgttgcccagcctgttgctgatatttattattatcggcggcattatcggcggcgtatttacgccaacagaggcctctgcgatcgcggtaatctatagcctggcgctggcggccatttatcgagaaattaatgtgagtaagttgcgcgatattctgctggattcggtagtaaccagctctattgttctcttactggtcggctgctcaatgggaatgtcatgggcgatgaccaatgctgatgttcctgaactgattaatgaaatgattaccagcgtgtccgaaaataaatgggtcatcttgctgattatcaatctcattttgttattcgtcgggacgtttatggatattaccccggctattctaatctttacgcctattttccttcccattgctcaacatctgggaatcgaccctgtccattttggcattattatggttttcaatttaaccatcggactgtgtacgcccccggtaggcactattttgttcgtcggttgcagtatcggcaaaatcagtattgataaagtcgtcaaaccgctattaccgatgtttctggcactctttgtggtcatggcgatgatttgctacttcccgcagttgagtctgctgcttcccacgctgtttgctccttcctga

SEQ ID NO: 56464 - protein, 435 aa, Salmonella typhimurium
MDFEYIYPIIVLFGSFAIILAVGVPITFAIGLSSLFSILIALPPDAAISVISQKMTVGLDGFTLLAIPFFVLAGNIMNTGGIARRLVNLAQALVGRLPGSLAHCNILANTLFGAISGSAVASAAAVGGIMSPLQEKEGYSPAFSTAINVASAPIGLMIPPSNVLIVYSLASGGTSVAALFLAGYLPGILTALALMTVAALYAHRHHYPVAERINLRQFLSVFRDSLPSLLLIFIIIGGIIGGVFTPTEASAIAVIYSLALAAIYREINVSKLRDILLDSVVTSSIVLLLVGCSMGMSWAMTNADVPELINEMITSVSENKWVILLIINLILLFVGTFMDITPAILIFTPIFLPIAQHLGIDPVHFGIIMVFNLTIGLCTPPVGTILFVGCSIGKISIDKVVKPLLPMFLALFVVMAMICYFPQLSLLLPTLFAPS

SEQ ID NO: 56465 - DNA, 22 bp, Primer
atggctgtgctgatttttctgg

SEQ ID NO: 56466 - DNA, 25 bp, Primer
ttaatccatttcaaagggaggatga

SEQ ID NO: 56467 - protein, 544 aa, consensus
  MISC_FEATURE (1)..(544): consensus for the disclosure of xaa see table XV
PXXXXXXXXXXXXXXXXXXXXXXXXXXXXXXXXXXXXXXXXXXXXXXLXAXPXFXXXGXXXXXXGXXXXXXXXXXXXXGXXXGGLXXXXXXXXXXXXXXSGSXXAXXXXXXXXXXPXXXXXXGYXXXXXXXXXXXXXXXXXXIPPSXXXXXXXXXXXXXXXXXXXXXXXXXXXXXSXXXLFXXGXXPGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXGXXTXTEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPXXXXXXXXXXXXXXXXXXXXXXXXXXXXXXGXXXXXXXXXXXXXPXXXPXXXXXXXXXXXXGXDPXXXGXXXXXXXXXGXXTPPXGXXXXXXXXXXXXXXXXXXXXXXXXXXXXPXXXXXXXXXXXXXXXP

SEQ ID NO: 56468 - protein, 143 aa, consensus
  MISC_FEATURE (1)..(143): consensus for the disclosure of xaa see table XV
XXXXXXXXXXXXXXXXXXXXXXXXXXXXXXXXXXXXXXXXXXXXXXXXXXXXXGXXXXXXXXXXXXXXXXXXXXXXXXXXXXXXXXXXXXXXXXXXPXXXXXXXXXXXXXXXXXXXXXXXXXXXXXXXXXXXXXXXXXXXXXX

SEQ ID NO: 56469 - protein, 70 aa, consensus
  MISC_FEATURE (1)..(70): consensus for the disclosure of xaa see table XV
XXXXXXXXXXXXXXXXXXXXXXXXXXXXXPXXXXXXXXXXXXXXXXXXXXXXXXXXXPPXXXXXXXXXXX

SEQ ID NO: 56470 - DNA, 864 bp, Escherichia coli; identical to SEQ ID NO: 46787
  CDS (1)..(864)

SEQ ID NO: 56471 - protein, 287 aa, Escherichia coli; identical to SEQ ID NO: 46788

SEQ ID NO: 56472 - DNA, 891 bp, Mesorhizobium loti MAFF303099; identical to SEQ ID NO: 46789
  CDS (1)..(891)

SEQ ID NO: 56473 - protein, 296 aa, Mesorhizobium loti MAFF303099; identical to SEQ ID NO: 46790

SEQ ID NO: 56474 - DNA, 867 bp, Borrelia burgdorferi B31; identical to SEQ ID NO: 46791
  CDS (1)..(867)

SEQ ID NO: 56475 - protein, 288 aa, Borrelia burgdorferi B31; identical to SEQ ID NO: 46792

SEQ ID NO: 56476 - DNA, 879 bp, Thermotoga maritima MSB8; identical to SEQ ID NO: 46793
  CDS (1)..(879)

SEQ ID NO: 56477 - protein, 292 aa, Thermotoga maritima MSB8; identical to SEQ ID NO: 46794

SEQ ID NO: 56478 - DNA, 885 bp, Bacillus halodurans C-125; identical to SEQ ID NO: 46795
  CDS (1)..(885)

SEQ ID NO: 56479 - protein, 294 aa, Bacillus halodurans C-125; identical to SEQ ID NO: 46796

SEQ ID NO: 56480 - DNA, 864 bp, Pasteurella multocida subsp. multocida str. Pm70; identical to SEQ ID NO: 46797
  CDS (1)..(864)

SEQ ID NO: 56481 - protein, 287 aa, Pasteurella multocida subsp. multocida str. Pm70; identical to SEQ ID NO: 46798

SEQ ID NO: 56482 - DNA, 864 bp, Pseudomonas aeruginosa PAO1; identical to SEQ ID NO: 46799
  CDS (1)..(864)

SEQ ID NO: 56483 - protein, 287 aa, Pseudomonas aeruginosa PAO1; identical to SEQ ID NO: 46800

SEQ ID NO: 56484 - DNA, 885 bp, Neisseria meningitidis Z2491; identical to SEQ ID NO: 46801
  CDS (1)..(885)

SEQ ID NO: 56485 - protein, 294 aa, Neisseria meningitidis Z2491; identical to SEQ ID NO: 46802

SEQ ID NO: 56486 - DNA, 879 bp, Clostridium acetobutylicum ATCC 824; identical to SEQ ID NO: 46803
  CDS (1)..(879)

SEQ ID NO: 56487 - protein, 292 aa, Clostridium acetobutylicum ATCC 824; identical to SEQ ID NO: 46804

SEQ ID NO: 56488 - DNA, 888 bp, Sinorhizobium meliloti 1021; identical to SEQ ID NO: 46805
  CDS (1)..(888)

SEQ ID NO: 56489 - protein, 295 aa, Sinorhizobium meliloti 1021; identical to SEQ ID NO: 46806

SEQ ID NO: 56490 - DNA, 876 bp, Bacillus subtilis subsp. subtilis str. 168; identical to SEQ ID NO: 46807
  CDS (1)..(876)

SEQ ID NO: 56491 - protein, 291 aa, Bacillus subtilis subsp. subtilis str. 168; identical to SEQ ID NO: 46808

SEQ ID NO: 56492 - DNA, 882 bp, Caulobacter crescentus CB15; identical to SEQ ID NO: 46809
  CDS (1)..(882)

SEQ ID NO: 56493 - protein, 293 aa, Caulobacter crescentus CB15; identical to SEQ ID NO: 46810

SEQ ID NO: 56494 - DNA, 864 bp, Salmonella typhimurium LT2; identical to SEQ ID NO: 46811
  CDS (1)..(864)

SEQ ID NO: 56495 - protein, 287 aa, Salmonella typhimurium LT2; identical to SEQ ID NO: 46812

SEQ ID NO: 56496 - DNA, 876 bp, Listeria innocua Clip11262; identical to SEQ ID NO: 46813
  CDS (1)..(876)

SEQ ID NO: 56497 - protein, 291 aa, Listeria innocua Clip11262; identical to SEQ ID NO: 46814

SEQ ID NO: 56498 - DNA, 888 bp, Agrobacterium tumefaciens str. C58; identical to SEQ ID NO: 46815
  CDS (1)..(888)

SEQ ID NO: 56499 - protein, 295 aa, Agrobacterium tumefaciens str. C58; identical to SEQ ID NO: 46816

SEQ ID NO: 56500 - DNA, 945 bp, Brucella melitensis 16M; identical to SEQ ID NO: 46817
  CDS (1)..(945)

SEQ ID NO: 56501 - protein, 314 aa, Brucella melitensis 16M; identical to SEQ ID NO: 46818

SEQ ID NO: 56502 - DNA, 885 bp, Clostridium perfringens str. 13; identical to SEQ ID NO: 46819
  CDS (1)..(885)

SEQ ID NO: 56503 - protein, 294 aa, Clostridium perfringens str. 13; identical to SEQ ID NO: 46820

SEQ ID NO: 56504 - DNA, 879 bp, Fusobacterium nucleatum subsp. nucleatum ATCC 25586; identical to SEQ ID NO: 46821
  CDS (1)..(879)

SEQ ID NO: 56505 - protein, 292 aa, Fusobacterium nucleatum subsp. nucleatum ATCC 25586; identical to SEQ ID NO: 46822

SEQ ID NO: 56506 - DNA, 873 bp, Thermoanaerobacter tengcongensis MB4; identical to SEQ ID NO: 46823
  CDS (1)..(873)

SEQ ID NO: 56507 - protein, 290 aa, Thermoanaerobacter tengcongensis MB4; identical to SEQ ID NO: 46824

SEQ ID NO: 56508 - DNA, 888 bp, Chlorobium tepidum TLS; identical to SEQ ID NO: 46825
  CDS (1)..(888)

SEQ ID NO: 56509 - protein, 295 aa, Chlorobium tepidum TLS; identical to SEQ ID NO: 46826

SEQ ID NO: 56510 - DNA, 864 bp, Yersinia pestis KIM; identical to SEQ ID NO: 46827
  CDS (1)..(864)

SEQ ID NO: 56511 - protein, 287 aa, Yersinia pestis KIM; identical to SEQ ID NO: 46828

SEQ ID NO: 56512 - DNA, 900 bp, Brucella suis 1330; identical to SEQ ID NO: 46829
  CDS (1)..(900)

SEQ ID NO: 56513 - protein, 299 aa, Brucella suis 1330; identical to SEQ ID NO: 46830

SEQ ID NO: 56514 - DNA, 864 bp, Shewanella oneidensis MR-1; identical to SEQ ID NO: 46831
  CDS (1)..(864)

SEQ ID NO: 56515 - protein, 287 aa, Shewanella oneidensis MR-1; identical to SEQ ID NO: 46832

SEQ ID NO: 56516 - DNA, 951 bp, Pseudomonas putida KT2440; identical to SEQ ID NO: 46833
  CDS (1)..(951)

SEQ ID NO: 56517 - protein, 316 aa, Pseudomonas putida KT2440; identical to SEQ ID NO: 46834

SEQ ID NO: 56518 - DNA, 888 bp, Bradyrhizobium japonicum USDA 110; identical to SEQ ID NO: 46835
  CDS (1)..(888)

SEQ ID NO: 56519 - protein, 295 aa, Bradyrhizobium japonicum USDA 110; identical to SEQ ID NO: 46836

SEQ ID NO: 56520 - DNA, 864 bp, Xylella fastidiosa Temecula1; identical to SEQ ID NO: 46837
  CDS (1)..(864)

SEQ ID NO: 56521 - protein, 287 aa, Xylella fastidiosa Temecula1; identical to SEQ ID NO: 46838

SEQ ID NO: 56522 - DNA, 888 bp, Clostridium tetani E88; identical to SEQ ID NO: 46839
  CDS (1)..(888)

SEQ ID NO: 56523 - protein, 295 aa, Clostridium tetani E88; identical to SEQ ID NO: 46840

SEQ ID NO: 56524 - DNA, 867 bp, Vibrio parahaemolyticus RIMD 2210633; identical to SEQ ID NO: 46841
  CDS (1)..(867)

SEQ ID NO: 56525 - protein, 288 aa, Vibrio parahaemolyticus RIMD 2210633; identical to SEQ ID NO: 46842

SEQ ID NO: 56526 - DNA, 867 bp, Bacteroides thetaiotaomicron VPI-5482; identical to SEQ ID NO: 46843
  CDS (1)..(867)

SEQ ID NO: 56527 - protein, 288 aa, Bacteroides thetaiotaomicron VPI-5482; identical to SEQ ID NO: 46844

SEQ ID NO: 56528 - DNA, 885 bp, Enterococcus faecalis V583; identical to SEQ ID NO: 46845
  CDS (1)..(885)

SEQ ID NO: 56529 - protein, 294 aa, Enterococcus faecalis V583; identical to SEQ ID NO: 46846

SEQ ID NO: 56530 - DNA, 864 bp, Coxiella burnetii RSA 493; identical to SEQ ID NO: 46847
  CDS (1)..(864)

SEQ ID NO: 56531 - protein, 287 aa, Coxiella burnetii RSA 493; identical to SEQ ID NO: 46848

SEQ ID NO: 56532 - DNA, 876 bp, Bacillus cereus ATCC 14579; identical to SEQ ID NO: 46849
  CDS (1)..(876)

SEQ ID NO: 56533 - protein, 291 aa, Bacillus cereus ATCC 14579; identical to SEQ ID NO: 46850

SEQ ID NO: 56534 - DNA, 867 bp, Nitrosomonas europaea ATCC 19718; identical to SEQ ID NO: 46851
  CDS (1)..(867)

SEQ ID NO: 56535 - protein, 288 aa, Nitrosomonas europaea ATCC 19718; identical to SEQ ID NO: 46852

SEQ ID NO: 56536 - DNA, 1029 bp, Rhodopirellula baltica SH 1; identical to SEQ ID NO: 46853
  CDS (1)..(1029)

SEQ ID NO: 56537 - protein, 342 aa, Rhodopirellula baltica SH 1; identical to SEQ ID NO: 46854

SEQ ID NO: 56538 - DNA, 864 bp, Wigglesworthia glossinidia endosymbiont of Glossina brevipalpis; identical to SEQ ID NO: 46855
  CDS (1)..(864)

SEQ ID NO: 56539 - protein, 287 aa, Wigglesworthia glossinidia endosymbiont of Glossina brevipalpis; identical to SEQ ID NO: 46856

SEQ ID NO: 56540 - DNA, 873 bp, Candidatus Blochmannia floridanus; identical to SEQ ID NO: 46857
  CDS (1)..(873)

SEQ ID NO: 56541 - protein, 290 aa, Candidatus Blochmannia floridanus; identical to SEQ ID NO: 46858

SEQ ID NO: 56542 - DNA, 927 bp, Bordetella bronchiseptica RB50; identical to SEQ ID NO: 46859
  CDS (1)..(927)

SEQ ID NO: 56543 - protein, 308 aa, Bordetella bronchiseptica RB50; identical to SEQ ID NO: 46860

SEQ ID NO: 56544 - DNA, 867 bp, Chromobacterium violaceum ATCC 12472; identical to SEQ ID NO: 46861
  CDS (1)..(867)

SEQ ID NO: 56545 - protein, 288 aa, Chromobacterium violaceum ATCC 12472; identical to SEQ ID NO: 46862

SEQ ID NO: 56546 - DNA, 891 bp, Porphyromonas gingivalis W83; identical to SEQ ID NO: 46863
  CDS (1)..(891)

SEQ ID NO: 56547 - protein, 296 aa, Porphyromonas gingivalis W83; identical to SEQ ID NO: 46864

SEQ ID NO: 56548 - DNA, 864 bp, Photorhabdus luminescens subsp. laumondii TTO1; identical to SEQ ID NO: 46865
  CDS (1)..(864)

SEQ ID NO: 56549 - protein, 287 aa, Photorhabdus luminescens subsp. laumondii TTO1; identical to SEQ ID NO: 46866

SEQ ID NO: 56550 - DNA, 888 bp, Rhodopseudomonas palustris CGA009; identical to SEQ ID NO: 46867
  CDS (1)..(888)

SEQ ID NO: 56551 - protein, 295 aa, Rhodopseudomonas palustris CGA009; identical to SEQ ID NO: 46868

SEQ ID NO: 56552 - DNA, 879 bp, Bdellovibrio bacteriovorus HD100; identical to SEQ ID NO: 46869
  CDS (1)..(879)

SEQ ID NO: 56553 - protein, 292 aa, Bdellovibrio bacteriovorus HD100; identical to SEQ ID NO: 46870

SEQ ID NO: 56554 - DNA, 867 bp, Treponema denticola ATCC 35405; identical to SEQ ID NO: 46871
  CDS (1)..(867)

SEQ ID NO: 56555 - protein, 288 aa, Treponema denticola ATCC 35405; identical to SEQ ID NO: 46872

SEQ ID NO: 56556 - DNA, 885 bp, Parachlamydia sp. UWE25; identical to SEQ ID NO: 46873
  CDS (1)..(885)

SEQ ID NO: 56557 - protein, 294 aa, Parachlamydia sp. UWE25; identical to SEQ ID NO: 46874

SEQ ID NO: 56558 - DNA, 882 bp, Desulfovibrio vulgaris subsp. vulgaris str. Hildenborough; identical to SEQ ID NO: 46875
  CDS (1)..(882)

SEQ ID NO: 56559 - protein, 293 aa, Desulfovibrio vulgaris subsp. vulgaris str. Hildenborough; identical to SEQ ID NO: 46876

SEQ ID NO: 56560 - DNA, 864 bp, Erwinia carotovora subsp. atroseptica SCRI1043; identical to SEQ ID NO: 46877
  CDS (1)..(864)

SEQ ID NO: 56561 - protein, 287 aa, Erwinia carotovora subsp. atroseptica SCRI1043; identical to SEQ ID NO: 46878

SEQ ID NO: 56562 - DNA, 894 bp, Desulfotalea psychrophila LSv54; identical to SEQ ID NO: 46879
  CDS (1)..(894)

SEQ ID NO: 56563 - protein, 297 aa, Desulfotalea psychrophila LSv54; identical to SEQ ID NO: 46880

SEQ ID NO: 56564 - DNA, 870 bp, Borrelia garinii PBi; identical to SEQ ID NO: 46881
  CDS (1)..(870)

SEQ ID NO: 56565 - protein, 289 aa, Borrelia garinii PBi; identical to SEQ ID NO: 46882

SEQ ID NO: 56566 - DNA, 879 bp, Symbiobacterium thermophilum IAM 14863; identical to SEQ ID NO: 46883
  CDS (1)..(879)

SEQ ID NO: 56567 - protein, 292 aa, Symbiobacterium thermophilum IAM 14863; identical to SEQ ID NO: 46884

SEQ ID NO: 56568 - DNA, 864 bp, Mannheimia succiniciproducens MBEL55E; identical to SEQ ID NO: 46885
  CDS (1)..(864)

SEQ ID NO: 56569 - protein, 287 aa, Mannheimia succiniciproducens MBEL55E; identical to SEQ ID NO: 46886

SEQ ID NO: 56570 - DNA, 876 bp, Bacillus licheniformis ATCC 14580; identical to SEQ ID NO: 46887
  CDS (1)..(876)

SEQ ID NO: 56571 - protein, 291 aa, Bacillus licheniformis ATCC 14580; identical to SEQ ID NO: 46888

SEQ ID NO: 56572 - DNA, 870 bp, Methylococcus capsulatus str. Bath; identical to SEQ ID NO: 46889
  CDS (1)..(870)

SEQ ID NO: 56573 - protein, 289 aa, Methylococcus capsulatus str. Bath; identical to SEQ ID NO: 46890

SEQ ID NO: 56574 - DNA, 867 bp, Legionella pneumophila str. Paris; identical to SEQ ID NO: 46891
  CDS (1)..(867)

SEQ ID NO: 56575 - protein, 288 aa, Legionella pneumophila str. Paris; identical to SEQ ID NO: 46892

SEQ ID NO: 56576 - DNA, 864 bp, Photobacterium profundum SS9; identical to SEQ ID NO: 46893
  CDS (1)..(864)

SEQ ID NO: 56577 - protein, 287 aa, Photobacterium profundum SS9; identical to SEQ ID NO: 46894

SEQ ID NO: 56578 - DNA, 876 bp, Geobacillus kaustophilus HTA426; identical to SEQ ID NO: 46895
  CDS (1)..(876)

SEQ ID NO: 56579 - protein, 291 aa, Geobacillus kaustophilus HTA426; identical to SEQ ID NO: 46896

SEQ ID NO: 56580 - DNA, 864 bp, Idiomarina loihiensis L2TR; identical to SEQ ID NO: 46897
  CDS (1)..(864)

SEQ ID NO: 56581 - protein, 287 aa, Idiomarina loihiensis L2TR; identical to SEQ ID NO: 46898

SEQ ID NO: 56582 - DNA, 867 bp, Azoarcus sp. EbN1; identical to SEQ ID NO: 46899
  CDS (1)..(867)

SEQ ID NO: 56583 - protein, 288 aa, Azoarcus sp. EbN1; identical to SEQ ID NO: 46900

SEQ ID NO: 56584 - DNA, 891 bp, Silicibacter pomeroyi DSS-3; identical to SEQ ID NO: 46901
  CDS (1)..(891)

SEQ ID NO: 56585 - protein, 296 aa, Silicibacter pomeroyi DSS-3; identical to SEQ ID NO: 46902

SEQ ID NO: 56586 - DNA, 891 bp, Rhodobacter sphaeroides 2.4.1; identical to SEQ ID NO: 46903
  CDS (1)..(891)

SEQ ID NO: 56587 - protein, 296 aa, Rhodobacter sphaeroides 2.4.1; identical to SEQ ID NO: 46904

SEQ ID NO: 56588 - DNA, 870 bp, Desulfitobacterium hafniense DCB-2; identical to SEQ ID NO: 46905
  CDS (1)..(870)

SEQ ID NO: 56589 - protein, 289 aa, Desulfitobacterium hafniense DCB-2; identical to SEQ ID NO: 46906

SEQ ID NO: 56590 - DNA, 864 bp, Actinobacillus pleuropneumoniae serovar 1 str. 4074; identical to SEQ ID NO: 46907
  CDS (1)..(864)

SEQ ID NO: 56591 - protein, 287 aa, Actinobacillus pleuropneumoniae serovar 1 str. 4074; identical to SEQ ID NO: 46908

SEQ ID NO: 56592 - DNA, 855 bp, Dechloromonas aromatica RCB; identical to SEQ ID NO: 46909
  CDS (1)..(855)

SEQ ID NO: 56593 - protein, 284 aa, Dechloromonas aromatica RCB; identical to SEQ ID NO: 46910

SEQ ID NO: 56594 - DNA, 867 bp, Methylobacillus flagellatus KT; identical to SEQ ID NO: 46911
  CDS (1)..(867)

SEQ ID NO: 56595 - protein, 288 aa, Methylobacillus flagellatus KT; identical to SEQ ID NO: 46912

SEQ ID NO: 56596 - DNA, 900 bp, Magnetospirillum magnetotacticum MS-1; identical to SEQ ID NO: 46913
  CDS (1)..(900)

SEQ ID NO: 56597 - protein, 299 aa, Magnetospirillum magnetotacticum MS-1; identical to SEQ ID NO: 46914

SEQ ID NO: 56598 - DNA, 822 bp, Rubrivivax gelatinosus PM1; identical to SEQ ID NO: 46915
  CDS (1)..(822)

SEQ ID NO: 56599 - protein, 273 aa, Rubrivivax gelatinosus PM1; identical to SEQ ID NO: 46916

SEQ ID NO: 56600 - DNA, 888 bp, Rhodospirillum rubrum; identical to SEQ ID NO: 46917
  CDS (1)..(888)

SEQ ID NO: 56601 - protein, 295 aa, Rhodospirillum rubrum; identical to SEQ ID NO: 46918

SEQ ID NO: 56602 - DNA, 936 bp, Ralstonia metallidurans CH34; identical to SEQ ID NO: 46919
  CDS (1)..(936)

SEQ ID NO: 56603 - protein, 311 aa, Ralstonia metallidurans CH34; identical to SEQ ID NO: 46920

SEQ ID NO: 56604 - DNA, 924 bp, Burkholderia fungorum LB400; identical to SEQ ID NO: 46921
  CDS (1)..(924)

SEQ ID NO: 56605 - protein, 307 aa, Burkholderia fungorum LB400; identical to SEQ ID NO: 46922

SEQ ID NO: 56606 - DNA, 882 bp, Enterococcus faecium; identical to SEQ ID NO: 46923
  CDS (1)..(882)

SEQ ID NO: 56607 - protein, 293 aa, Enterococcus faecium; identical to SEQ ID NO: 46924

SEQ ID NO: 56608 - DNA, 888 bp, Magnetococcus sp. MC-1; identical to SEQ ID NO: 46925
  CDS (1)..(888)

SEQ ID NO: 56609 - protein, 295 aa, Magnetococcus sp. MC-1; identical to SEQ ID NO: 46926

SEQ ID NO: 56610 - DNA, 879 bp, Geobacter metallireducens GS-15; identical to SEQ ID NO: 46927
  CDS (1)..(879)

SEQ ID NO: 56611 - protein, 292 aa, Geobacter metallireducens GS-15; identical to SEQ ID NO: 46928

SEQ ID NO: 56612 - DNA, 870 bp, Cytophaga hutchinsonii; identical to SEQ ID NO: 46929
  CDS (1)..(870)

SEQ ID NO: 56613 - protein, 289 aa, Cytophaga hutchinsonii; identical to SEQ ID NO: 46930

SEQ ID NO: 56614 - DNA, 885 bp, Clostridium thermocellum ATCC 27405; identical to SEQ ID NO: 46931
  CDS (1)..(885)

SEQ ID NO: 56615 - protein, 294 aa, Clostridium thermocellum ATCC 27405; identical to SEQ ID NO: 46932

SEQ ID NO: 56616 - DNA, 855 bp, Microbulbifer degradans 2-40; identical to SEQ ID NO: 46933
  CDS (1)..(855)

SEQ ID NO: 56617 - protein, 284 aa, Microbulbifer degradans 2-40; identical to SEQ ID NO: 46934

SEQ ID NO: 56618 - DNA, 879 bp, Moorella thermoacetica ATCC 39073; identical to SEQ ID NO: 46935
  CDS (1)..(879)

SEQ ID NO: 56619 - protein, 292 aa, Moorella thermoacetica ATCC 39073; identical to SEQ ID NO: 46936

SEQ ID NO: 56620 - DNA, 867 bp, Thiobacillus denitrificans ATCC 25259; identical to SEQ ID NO: 46937
  CDS (1)..(867)

SEQ ID NO: 56621 - protein, 288 aa, Thiobacillus denitrificans ATCC 25259; identical to SEQ ID NO: 46938

SEQ ID NO: 56622 - DNA, 882 bp, Silicibacter sp. TM1040; identical to SEQ ID NO: 46939
  CDS (1)..(882)

SEQ ID NO: 56623 - protein, 293 aa, Silicibacter sp. TM1040; identical to SEQ ID NO: 46940

SEQ ID NO: 56624 - DNA, 873 bp, Azotobacter vinelandii; identical to SEQ ID NO: 46941
  CDS (1)..(873)

SEQ ID NO: 56625 - protein, 290 aa, Azotobacter vinelandii; identical to SEQ ID NO: 46942

SEQ ID NO: 56626 - DNA, 903 bp, Polaromonas sp. JS666; identical to SEQ ID NO: 46943
  CDS (1)..(903)

SEQ ID NO: 56627 - protein, 300 aa, Polaromonas sp. JS666; identical to SEQ ID NO: 46944

SEQ ID NO: 56628 - DNA, 864 bp, Haemophilus influenzae; identical to SEQ ID NO: 46945
  CDS (1)..(864)

SEQ ID NO: 56629 - protein, 287 aa, Haemophilus influenzae; identical to SEQ ID NO: 46946

SEQ ID NO: 56630 - DNA, 22 bp, Primer
atgatccgcagtatgaccgcct

SEQ ID NO: 56631 - DNA, 24 bp, Primer
ttattcgatgttctgaatctgctc

SEQ ID NO: 56632 - protein, 338 aa, consensus; identical to SEQ ID NO: 46949
  MISC_FEATURE (1)..(338): consensus for the disclosure of xaa see table XV

SEQ ID NO: 56633 - protein, 73 aa, consensus; identical to SEQ ID NO: 46950
  MISC_FEATURE (1)..(73): consensus for the disclosure of xaa see table XV

SEQ ID NO: 56634 - protein, 101 aa, consensus; identical to SEQ ID NO: 46951
  MISC_FEATURE (1)..(101): consensus for the disclosure of xaa see table XV

SEQ ID NO: 56635 - DNA, 1518 bp, Escherichia coli; identical to SEQ ID NO: 32416
  CDS (1)..(1518)

SEQ ID NO: 56636 - protein, 505 aa, Escherichia coli; identical to SEQ ID NO: 32417

SEQ ID NO: 56637 - DNA, 1536 bp, Streptococcus thermophilus CNRZ1066; identical to SEQ ID NO: 32418
  CDS (1)..(1536)

SEQ ID NO: 56638 - protein, 511 aa, Streptococcus thermophilus CNRZ1066; identical to SEQ ID NO: 32419

SEQ ID NO: 56639 - DNA, 1512 bp, Idiomarina loihiensis L2TR; identical to SEQ ID NO: 32420
  CDS (1)..(1512)

SEQ ID NO: 56640 - protein, 503 aa, Idiomarina loihiensis L2TR; identical to SEQ ID NO: 32421

SEQ ID NO: 56641 - DNA, 1731 bp, Francisella tularensis subsp. tularensis; identical to SEQ ID NO: 32422
  CDS (1)..(1731)

SEQ ID NO: 56642 - protein, 576 aa, Francisella tularensis subsp. tularensis; identical to SEQ ID NO: 32423

SEQ ID NO: 56643 - DNA, 1737 bp, Xenopus tropicalis; identical to SEQ ID NO: 32424
  CDS (1)..(1737)

SEQ ID NO: 56644 - protein, 578 aa, Xenopus tropicalis; identical to SEQ ID NO: 32425

SEQ ID NO: 56645 - DNA, 1809 bp, Danio rerio; identical to SEQ ID NO: 32426
  CDS (1)..(1809)

SEQ ID NO: 56646 - protein, 602 aa, Danio rerio; identical to SEQ ID NO: 32427

SEQ ID NO: 56647 - DNA, 1809 bp, Arabidopsis thaliana; identical to SEQ ID NO: 32428
  CDS (1)..(1809)

SEQ ID NO: 56648 - protein, 602 aa, Arabidopsis thaliana; identical to SEQ ID NO: 32429

SEQ ID NO: 56649 - DNA, 1539 bp, Vibrio cholerae O1 biovar eltor str. N16961; identical to SEQ ID NO: 32430
  CDS (1)..(1539)

SEQ ID NO: 56650 - protein, 512 aa, Vibrio cholerae O1 biovar eltor str. N16961; identical to SEQ ID NO: 32431

SEQ ID NO: 56651 - DNA, 1584 bp, Chlamydophila pneumoniae J138; identical to SEQ ID NO: 32432
  CDS (1)..(1584)

SEQ ID NO: 56652 - protein, 527 aa, Chlamydophila pneumoniae J138; identical to SEQ ID NO: 32433

SEQ ID NO: 56653 - DNA, 1335 bp, Sulfolobus tokodaii str. 7; identical to SEQ ID NO: 32434
  CDS (1)..(1335)

SEQ ID NO: 56654 - protein, 444 aa, Sulfolobus tokodaii str. 7; identical to SEQ ID NO: 32435

SEQ ID NO: 56655 - DNA, 1518 bp, Escherichia coli K12; identical to SEQ ID NO: 32436
  CDS (1)..(1518)

SEQ ID NO: 56656 - protein, 505 aa, Escherichia coli K12; identical to SEQ ID NO: 32437

SEQ ID NO: 56657 - DNA, 1518 bp, Salmonella typhimurium LT2; identical to SEQ ID NO: 32438
  CDS (1)..(1518)

SEQ ID NO: 56658 - protein, 505 aa, Salmonella typhimurium LT2; identical to SEQ ID NO: 32439

SEQ ID NO: 56659 - DNA, 1449 bp, Pyrobaculum aerophilum str. IM2; identical to SEQ ID NO: 32440
  CDS (1)..(1449)

SEQ ID NO: 56660 - protein, 482 aa, Pyrobaculum aerophilum str. IM2; identical to SEQ ID NO: 32441

SEQ ID NO: 56661 - DNA, 1725 bp, Drosophila melanogaster; identical to SEQ ID NO: 32442
  CDS (1)..(1725)

SEQ ID NO: 56662 - protein, 574 aa, Drosophila melanogaster; identical to SEQ ID NO: 32443

SEQ ID NO: 56663 - DNA, 1323 bp, Encephalitozoon cuniculi; identical to SEQ ID NO: 32444
  CDS (1)..(1323)

SEQ ID NO: 56664 - protein, 440 aa, Encephalitozoon cuniculi; identical to SEQ ID NO: 32445

SEQ ID NO: 56665 - DNA, 1596 bp, Schizosaccharomyces pombe; identical to SEQ ID NO: 32446
  CDS (1)..(1596)

SEQ ID NO: 56666 - protein, 531 aa, Schizosaccharomyces pombe; identical to SEQ ID NO: 32447

SEQ ID NO: 56667 - DNA, 1776 bp, Schizosaccharomyces pombe; identical to SEQ ID NO: 32448
  CDS (1)..(1776)

SEQ ID NO: 56668 - protein, 591 aa, Schizosaccharomyces pombe; identical to SEQ ID NO: 32449

SEQ ID NO: 56669 - DNA, 1581 bp, Corynebacterium glutamicum ATCC 13032; identical to SEQ ID NO: 32450
  CDS (1)..(1581)

SEQ ID NO: 56670 - protein, 526 aa, Corynebacterium glutamicum ATCC 13032; identical to SEQ ID NO: 32451

SEQ ID NO: 56671 - DNA, 1683 bp, Bifidobacterium longum NCC2705; identical to SEQ ID NO: 32452
  CDS (1)..(1683)

SEQ ID NO: 56672 - protein, 560 aa, Bifidobacterium longum NCC2705; identical to SEQ ID NO: 32453

SEQ ID NO: 56673 - DNA, 1752 bp, Plasmodium falciparum 3D7; identical to SEQ ID NO: 32454
  CDS (1)..(1752)

SEQ ID NO: 56674 - protein, 583 aa, Plasmodium falciparum 3D7; identical to SEQ ID NO: 32455

SEQ ID NO: 56675 - DNA, 1641 bp, Rhodopirellula baltica SH 1; identical to SEQ ID NO: 32456
  CDS (1)..(1641)

SEQ ID NO: 56676 - protein, 546 aa, Rhodopirellula baltica SH 1; identical to SEQ ID NO: 32457

SEQ ID NO: 56677 - DNA, 1563 bp, Corynebacterium diphtheriae NCTC 13129; identical to SEQ ID NO: 32458
  CDS (1)..(1563)

SEQ ID NO: 56678 - protein, 520 aa, Corynebacterium diphtheriae NCTC 13129; identical to SEQ ID NO: 32459

SEQ ID NO: 56679 - DNA, 1536 bp, Onion yellows phytoplasma OY-M; identical to SEQ ID NO: 32460
  CDS (1)..(1536)

SEQ ID NO: 56680 - protein, 511 aa, Onion yellows phytoplasma OY-M; identical to SEQ ID NO: 32461

SEQ ID NO: 56681 - DNA, 1542 bp, Lactobacillus johnsonii NCC 533; identical to SEQ ID NO: 32462
  CDS (1)..(1542)

SEQ ID NO: 56682 - protein, 513 aa, Lactobacillus johnsonii NCC 533; identical to SEQ ID NO: 32463

SEQ ID NO: 56683 - DNA, 1515 bp, Bdellovibrio bacteriovorus HD100; identical to SEQ ID NO: 32464
  CDS (1)..(1515)

SEQ ID NO: 56684 - protein, 504 aa, Bdellovibrio bacteriovorus HD100; identical to SEQ ID NO: 32465

SEQ ID NO: 56685 - DNA, 1503 bp, Mycoplasma mycoides subsp. mycoides SC str. PG1; identical to SEQ ID NO: 32466
  CDS (1)..(1503)

SEQ ID NO: 56686 - protein, 500 aa, Mycoplasma mycoides subsp. mycoides SC str. PG1; identical to SEQ ID NO: 32467

SEQ ID NO: 56687 - DNA, 1500 bp, Bacillus cereus ATCC 10987; identical to SEQ ID NO: 32468
  CDS (1)..(1500)

SEQ ID NO: 56688 - protein, 499 aa, Bacillus cereus ATCC 10987; identical to SEQ ID NO: 32469

SEQ ID NO: 56689 - DNA, 1578 bp, Eremothecium gossypii; identical to SEQ ID NO: 32470
  CDS (1)..(1578)

SEQ ID NO: 56690 - protein, 525 aa, Eremothecium gossypii; identical to SEQ ID NO: 32471

SEQ ID NO: 56691 - DNA, 1770 bp, Eremothecium gossypii; identical to SEQ ID NO: 32472
  CDS (1)..(1770)

SEQ ID NO: 56692 - protein, 589 aa, Eremothecium gossypii; identical to SEQ ID NO: 32473

SEQ ID NO: 56693 - DNA, 1917 bp, Magnaporthe grisea 70-15; identical to SEQ ID NO: 32474
  CDS (1)..(1917)

SEQ ID NO: 56694 - protein, 638 aa, Magnaporthe grisea 70-15; identical to SEQ ID NO: 32475

SEQ ID NO: 56695 - DNA, 1833 bp, Gibberella zeae PH-1; identical to SEQ ID NO: 32476
  CDS (1)..(1833)

SEQ ID NO: 56696 - protein, 610 aa, Gibberella zeae PH-1; identical to SEQ ID NO: 32477

SEQ ID NO: 56697 - DNA, 1821 bp, Aspergillus nidulans FGSC A4; identical to SEQ ID NO: 32478
  CDS (1)..(1821)

SEQ ID NO: 56698 - protein, 606 aa, Aspergillus nidulans FGSC A4; identical to SEQ ID NO: 32479

SEQ ID NO: 56699 - DNA, 1776 bp, Candida glabrata CBS138; identical to SEQ ID NO: 32480
  CDS (1)..(1776)

SEQ ID NO: 56700 - protein, 591 aa, Candida glabrata CBS138; identical to SEQ ID NO: 32481

SEQ ID NO: 56701 - DNA, 1782 bp, Debaryomyces hansenii CBS767; identical to SEQ ID NO: 32482
  CDS (1)..(1782)

SEQ ID NO: 56702 - protein, 593 aa, Debaryomyces hansenii CBS767; identical to SEQ ID NO: 32483

SEQ ID NO: 56703 - DNA, 1761 bp, Oryza sativa (japonica cultivar-group); identical to SEQ ID NO: 32484
  CDS (1)..(1761)

SEQ ID NO: 56704 - protein, 586 aa, Oryza sativa (japonica cultivar-group); identical to SEQ ID NO: 32485

SEQ ID NO: 56705 - DNA, 1749 bp, Yarrowia lipolytica CLIB99; identical to SEQ ID NO: 32486
  CDS (1)..(1749)

SEQ ID NO: 56706 - protein, 582 aa, Yarrowia lipolytica CLIB99; identical to SEQ ID NO: 32487

SEQ ID NO: 56707 - DNA, 1488 bp, Leptospira interrogans serovar Copenhageni str. Fiocruz L1-130; identical to SEQ ID NO: 32488
  CDS (1)..(1488)

SEQ ID NO: 56708 - protein, 495 aa, Leptospira interrogans serovar Copenhageni str. Fiocruz L1-130; identical to SEQ ID NO: 32489

SEQ ID NO: 56709 - DNA, 1590 bp, Parachlamydia sp. UWE25; identical to SEQ ID NO: 32490
  CDS (1)..(1590)

SEQ ID NO: 56710 - protein, 529 aa, Parachlamydia sp. UWE25; identical to SEQ ID NO: 32491

SEQ ID NO: 56711 - DNA, 1506 bp, Desulfovibrio vulgaris subsp. vulgaris str. Hildenborough; identical to SEQ ID NO: 32492
  CDS (1)..(1506)

SEQ ID NO: 56712 - protein, 501 aa, Desulfovibrio vulgaris subsp. vulgaris str. Hildenborough; identical to SEQ ID NO: 32493

SEQ ID NO: 56713 - DNA, 1518 bp, Erwinia carotovora subsp. atroseptica SCRI1043; identical to SEQ ID NO: 32494
  CDS (1)..(1518)

SEQ ID NO: 56714 - protein, 505 aa, Erwinia carotovora subsp. atroseptica SCRI1043; identical to SEQ ID NO: 32495

SEQ ID NO: 56715 - DNA, 1500 bp, Mesoplasma florum L1; identical to SEQ ID NO: 32496
  CDS (1)..(1500)

SEQ ID NO: 56716 - protein, 499 aa, Mesoplasma florum L1; identical to SEQ ID NO: 32497

SEQ ID NO: 56717 - DNA, 1533 bp, Propionibacterium acnes KPA171202; identical to SEQ ID NO: 32498
  CDS (1)..(1533)

SEQ ID NO: 56718 - protein, 510 aa, Propionibacterium acnes KPA171202; identical to SEQ ID NO: 32499

SEQ ID NO: 56719 - DNA, 1515 bp, Leifsonia xyli subsp. xyli str. CTCB07; identical to SEQ ID NO: 32500
  CDS (1)..(1515)

SEQ ID NO: 56720 - protein, 504 aa, Leifsonia xyli subsp. xyli str. CTCB07; identical to SEQ ID NO: 32501

SEQ ID NO: 56721 - DNA, 1512 bp, Desulfotalea psychrophila LSv54; identical to SEQ ID NO: 32502
  CDS (1)..(1512)

SEQ ID NO: 56722 - protein, 503 aa, Desulfotalea psychrophila LSv54; identical to SEQ ID NO: 32503

SEQ ID NO: 56723 - DNA, 1488 bp, Symbiobacterium thermophilum IAM 14863; identical to SEQ ID NO: 32504
  CDS (1)..(1488)

SEQ ID NO: 56724 - protein, 495 aa, Symbiobacterium thermophilum IAM 14863; identical to SEQ ID NO: 32505

SEQ ID NO: 56725 - DNA, 1512 bp, Mannheimia succiniciproducens MBEL55E; identical to SEQ ID NO: 32506
  CDS (1)..(1512)

SEQ ID NO: 56726 - protein, 503 aa, Mannheimia succiniciproducens MBEL55E; identical to SEQ ID NO: 32507

SEQ ID NO: 56727 - DNA, 1728 bp, Bacteroides fragilis YCH46; identical to SEQ ID NO: 32508
  CDS (1)..(1728)

SEQ ID NO: 56728 - protein, 575 aa, Bacteroides fragilis YCH46; identical to SEQ ID NO: 32509

SEQ ID NO: 56729 - DNA, 1491 bp, Methylococcus capsulatus str. Bath; identical to SEQ ID NO: 32510
  CDS (1)..(1491)

SEQ ID NO: 56730 - protein, 496 aa, Methylococcus capsulatus str. Bath; identical to SEQ ID NO: 32511

SEQ ID NO: 56731 - DNA, 1467 bp, Nocardia farcinica IFM 10152; identical to SEQ ID NO: 32512
  CDS (1)..(1467)

SEQ ID NO: 56732 - protein, 488 aa, Nocardia farcinica IFM 10152; identical to SEQ ID NO: 32513

SEQ ID NO: 56733 - DNA, 1491 bp, Legionella pneumophila str. Paris; identical to SEQ ID NO: 32514
  CDS (1)..(1491)

SEQ ID NO: 56734 - protein, 496 aa, Legionella pneumophila str. Paris; identical to SEQ ID NO: 32515

SEQ ID NO: 56735 - DNA, 1509 bp, Photobacterium profundum SS9; identical to SEQ ID NO: 32516
  CDS (1)..(1509)

SEQ ID NO: 56736 - protein, 502 aa, Photobacterium profundum SS9; identical to SEQ ID NO: 32517

SEQ ID NO: 56737 - DNA, 1488 bp, Leuconostoc mesenteroides subsp. mesenteroides ATCC 8293; identical to SEQ ID NO: 32518
  CDS (1)..(1488)

SEQ ID NO: 56738 - protein, 495 aa, Leuconostoc mesenteroides subsp. mesenteroides ATCC 8293; identical to SEQ ID NO: 32519

SEQ ID NO: 56739 - DNA, 1503 bp, Azotobacter vinelandii; identical to SEQ ID NO: 32520
  CDS (1)..(1503)

SEQ ID NO: 56740 - protein, 500 aa, Azotobacter vinelandii; identical to SEQ ID NO: 32521

SEQ ID NO: 56741 - DNA, 1686 bp, Nostoc punctiforme PCC 73102; identical to SEQ ID NO: 32522
  CDS (1)..(1686)

SEQ ID NO: 56742 - protein, 561 aa, Nostoc punctiforme PCC 73102; identical to SEQ ID NO: 32523

SEQ ID NO: 56743 - DNA, 1503 bp, Actinobacillus pleuropneumoniae serovar 1 str. 4074; identical to SEQ ID NO: 32524
  CDS (1)..(1503)

SEQ ID NO: 56744 - protein, 500 aa, Actinobacillus pleuropneumoniae serovar 1 str. 4074; identical to SEQ ID NO: 32525

SEQ ID NO: 56745 - DNA, 1482 bp, Fusobacterium nucleatum subsp. vincentii ATCC 49256; identical to SEQ ID NO: 32526
  CDS (1)..(1482)

SEQ ID NO: 56746 - protein, 493 aa, Fusobacterium nucleatum subsp. vincentii ATCC 49256; identical to SEQ ID NO: 32527

SEQ ID NO: 56747 - DNA, 1545 bp, Psychrobacter sp. 273-4; identical to SEQ ID NO: 32528
  CDS (1)..(1545)

SEQ ID NO: 56748 - protein, 514 aa, Psychrobacter sp. 273-4; identical to SEQ ID NO: 32529

SEQ ID NO: 56749 - DNA, 1506 bp, Dechloromonas aromatica RCB; identical to SEQ ID NO: 32530
  CDS (1)..(1506)

SEQ ID NO: 56750 - protein, 501 aa, Dechloromonas aromatica RCB; identical to SEQ ID NO: 32531

SEQ ID NO: 56751 - DNA, 1509 bp, Haemophilus influenzae R2866; identical to SEQ ID NO: 32532
  CDS (1)..(1509)

SEQ ID NO: 56752 - protein, 502 aa, Haemophilus influenzae R2866; identical to SEQ ID NO: 32533

SEQ ID NO: 56753 - DNA, 1686 bp, Anabaena variabilis ATCC 29413; identical to SEQ ID NO: 32534
  CDS (1)..(1686)

SEQ ID NO: 56754 - protein, 561 aa, Anabaena variabilis ATCC 29413; identical to SEQ ID NO: 32535

SEQ ID NO: 56755 - DNA, 1515 bp, Synechococcus elongatus PCC 7942; identical to SEQ ID NO: 32536
  CDS (1)..(1515)

SEQ ID NO: 56756 - protein, 504 aa, Synechococcus elongatus PCC 7942; identical to SEQ ID NO: 32537

SEQ ID NO: 56757 - DNA, 1551 bp, Ralstonia eutropha JMP134; identical to SEQ ID NO: 32538
  CDS (1)..(1551)

SEQ ID NO: 56758 - protein, 516 aa, Ralstonia eutropha JMP134; identical to SEQ ID NO: 32539

SEQ ID NO: 56759 - DNA, 1530 bp, Methylobacillus flagellatus KT; identical to SEQ ID NO: 32540
  CDS (1)..(1530)

SEQ ID NO: 56760 - protein, 509 aa, Methylobacillus flagellatus KT; identical to SEQ ID NO: 32541

SEQ ID NO: 56761 - DNA, 1722 bp, Crocosphaera watsonii WH 8501; identical to SEQ ID NO: 32542
  CDS (1)..(1722)

SEQ ID NO: 56762 - protein, 573 aa, Crocosphaera watsonii WH 8501; identical to SEQ ID NO: 32543

SEQ ID NO: 56763 - DNA, 1482 bp, Exiguobacterium sp. 255-15; identical to SEQ ID NO: 32544
  CDS (1)..(1482)

SEQ ID NO: 56764 - protein, 493 aa, Exiguobacterium sp. 255-15; identical to SEQ ID NO: 32545

SEQ ID NO: 56765 - DNA, 1527 bp, Burkholderia cepacia R1808; identical to SEQ ID NO: 32546
  CDS (1)..(1527)

SEQ ID NO: 56766 - protein, 508 aa, Burkholderia cepacia R1808; identical to SEQ ID NO: 32547

SEQ ID NO: 56767 - DNA, 1527 bp, Rubrivivax gelatinosus PM1; identical to SEQ ID NO: 32548
  CDS (1)..(1527)

SEQ ID NO: 56768 - protein, 508 aa, Rubrivivax gelatinosus PM1; identical to SEQ ID NO: 32549

SEQ ID NO: 56769 - DNA, 1506 bp, Magnetococcus sp. MC-1; identical to SEQ ID NO: 32550
  CDS (1)..(1506)

SEQ ID NO: 56770 - protein, 501 aa, Magnetococcus sp. MC-1; identical to SEQ ID NO: 32551

SEQ ID NO: 56771 - DNA, 1491 bp, Thermobifida fusca; identical to SEQ ID NO: 32552
  CDS (1)..(1491)

SEQ ID NO: 56772 - protein, 496 aa, Thermobifida fusca; identical to SEQ ID NO: 32553

SEQ ID NO: 56773 - DNA, 1548 bp, Methanosarcina barkeri str. fusaro; identical to SEQ ID NO: 32554
  CDS (1)..(1548)

SEQ ID NO: 56774 - protein, 515 aa, Methanosarcina barkeri str. fusaro; identical to SEQ ID NO: 32555

SEQ ID NO: 56775 - DNA, 1476 bp, Geobacter metallireducens GS-15; identical to SEQ ID NO: 32556
  CDS (1)..(1476)

SEQ ID NO: 56776 - protein, 491 aa, Geobacter metallireducens GS-15; identical to SEQ ID NO: 32557

SEQ ID NO: 56777 - DNA, 1755 bp, Cytophaga hutchinsonii; identical to SEQ ID NO: 32558
  CDS (1)..(1755)

SEQ ID NO: 56778 - protein, 584 aa, Cytophaga hutchinsonii; identical to SEQ ID NO: 32559

SEQ ID NO: 56779 - DNA, 1509 bp, Microbulbifer degradans 2-40; identical to SEQ ID NO: 32560
  CDS (1)..(1509)

SEQ ID NO: 56780 - protein, 502 aa, Microbulbifer degradans 2-40; identical to SEQ ID NO: 32561

SEQ ID NO: 56781 - DNA, 1497 bp, Pediococcus pentosaceus ATCC 25745; identical to SEQ ID NO: 32562
  CDS (1)..(1497)

SEQ ID NO: 56782 - protein, 498 aa, Pediococcus pentosaceus ATCC 25745; identical to SEQ ID NO: 32563

SEQ ID NO: 56783 - DNA, 1569 bp, Trichodesmium erythraeum IMS101; identical to SEQ ID NO: 32564
  CDS (1)..(1569)

SEQ ID NO: 56784 - protein, 522 aa, Trichodesmium erythraeum IMS101; identical to SEQ ID NO: 32565

SEQ ID NO: 56785 - DNA, 1491 bp, Streptococcus suis 89/1591; identical to SEQ ID NO: 32566
  CDS (1)..(1491)

SEQ ID NO: 56786 - protein, 496 aa, Streptococcus suis 89/1591; identical to SEQ ID NO: 32567

SEQ ID NO: 56787 - DNA, 1506 bp, Thiobacillus denitrificans ATCC 25259; identical to SEQ ID NO: 32568
  CDS (1)..(1506)

SEQ ID NO: 56788 - protein, 501 aa, Thiobacillus denitrificans ATCC 25259; identical to SEQ ID NO: 32569

SEQ ID NO: 56789 - DNA, 1551 bp, Polaromonas sp. JS666; identical to SEQ ID NO: 32570
  CDS (1)..(1551)

SEQ ID NO: 56790 - protein, 516 aa, Polaromonas sp. JS666; identical to SEQ ID NO: 32571

SEQ ID NO: 56791 - DNA, 1734 bp, Brachydanio rerio; identical to SEQ ID NO: 32572
  CDS (1)..(1734)

SEQ ID NO: 56792 - protein, 577 aa, Brachydanio rerio; identical to SEQ ID NO: 32573

SEQ ID NO: 56793 - DNA, 1506 bp, uncultured bacterium 577; identical to SEQ ID NO: 32574
  CDS (1)..(1506)

SEQ ID NO: 56794 - protein, 501 aa, uncultured bacterium 577; identical to SEQ ID NO: 32575

SEQ ID NO: 56795 - DNA, 1491 bp, Candidatus Portiera aleyrodidarum; identical to SEQ ID NO: 32576
  CDS (1)..(1491)

SEQ ID NO: 56796 - protein, 496 aa, Candidatus Portiera aleyrodidarum; identical to SEQ ID NO: 32577

SEQ ID NO: 56797 - DNA, 1518 bp, Citrobacter freundii; identical to SEQ ID NO: 32578
  CDS (1)..(1518)

SEQ ID NO: 56798 - protein, 505 aa, Citrobacter freundii; identical to SEQ ID NO: 32579

SEQ ID NO: 56799 - DNA, 1497 bp, Escherichia coli; identical to SEQ ID NO: 32580
  CDS (1)..(1497)

SEQ ID NO: 56800 - protein, 498 aa, Escherichia coli; identical to SEQ ID NO: 32581

SEQ ID NO: 56801 - DNA, 1788 bp, Mus musculus; identical to SEQ ID NO: 32582
  CDS (1)..(1788)

SEQ ID NO: 56802 - protein, 595 aa, Mus musculus; identical to SEQ ID NO: 32583

SEQ ID NO: 56803 - DNA, 1551 bp, Methanosarcina barkeri; identical to SEQ ID NO: 32584
  CDS (1)..(1551)

SEQ ID NO: 56804 - protein, 516 aa, Methanosarcina barkeri; identical to SEQ ID NO: 32585

SEQ ID NO: 56805 - DNA, 1878 bp, Homo sapiens; identical to SEQ ID NO: 32586
  CDS (1)..(1878)

SEQ ID NO: 56806 - protein, 625 aa, Homo sapiens [sequence omitted]

SEQ ID NO: 56807 - DNA, 1536 bp, Methanosarcina acetivorans; identical to SEQ ID NO: 32588
  CDS (1)..(1536)

SEQ ID NO: 56808 - protein, 511 aa, Methanosarcina acetivorans; identical to SEQ ID NO: 32589

SEQ ID NO: 56809 - DNA, 1536 bp, Methanosarcina mazei; identical to SEQ ID NO: 32590
  CDS (1)..(1536)

SEQ ID NO: 56810 - protein, 511 aa, Methanosarcina mazei; identical to SEQ ID NO: 32591

SEQ ID NO: 56811 - DNA, 1779 bp, Saccharomyces cerevisiae; identical to SEQ ID NO: 32592
  CDS (1)..(1779)

SEQ ID NO: 56812 - protein, 592 aa, Saccharomyces cerevisiae; identical to SEQ ID NO: 32593

SEQ ID NO: 56813 - DNA, 1731 bp, Saccharomyces cerevisiae; identical to SEQ ID NO: 32594
  CDS (1)..(1731)

SEQ ID NO: 56814 - protein, 576 aa, Saccharomyces cerevisiae; identical to SEQ ID NO: 32595

SEQ ID NO: 56815 - DNA, 1530 bp, Acinetobacter sp; identical to SEQ ID NO: 32596
  CDS (1)..(1530)

SEQ ID NO: 56816 - protein, 509 aa, Acinetobacter sp; identical to SEQ ID NO: 32597

SEQ ID NO: 56817 - DNA, 1500 bp, Agrobacterium tumefaciens; identical to SEQ ID NO: 32598
  CDS (1)..(1500)

SEQ ID NO: 56818 - protein, 499 aa, Agrobacterium tumefaciens; identical to SEQ ID NO: 32599

SEQ ID NO: 56819 - DNA, 1686 bp, Anabaena sp; identical to SEQ ID NO: 32600
  CDS (1)..(1686)

SEQ ID NO: 56820 - protein, 561 aa, Anabaena sp; identical to SEQ ID NO: 32601

SEQ ID NO: 56821 - DNA, 1794 bp, Aquifex aeolicus; identical to SEQ ID NO: 32602
  CDS (1)..(1794)

SEQ ID NO: 56822 - protein, 597 aa, Aquifex aeolicus; identical to SEQ ID NO: 32603

SEQ ID NO: 56823 - DNA, 1881 bp, Arabidopsis thaliana; identical to SEQ ID NO: 32604
  CDS (1)..(1881)

SEQ ID NO: 56824 - protein, 626 aa, Arabidopsis thaliana; identical to SEQ ID NO: 32605

SEQ ID NO: 56825 - DNA, 1485 bp, Bacillus stearothermophilus; identical to SEQ ID NO: 32606
  CDS (1)..(1485)

SEQ ID NO: 56826 - protein, 494 aa, Bacillus stearothermophilus; identical to SEQ ID NO: 32607

SEQ ID NO: 56827 - DNA, 1500 bp, Bacillus subtilis; identical to SEQ ID NO: 32608
  CDS (1)..(1500)

SEQ ID NO: 56828 - protein, 499 aa, Bacillus subtilis; identical to SEQ ID NO: 32609

SEQ ID NO: 56829 - DNA, 1731 bp, Bacteroides thetaiotaomicron; identical to SEQ ID NO: 32610
  CDS (1)..(1731)

SEQ ID NO: 56830 - protein, 576 aa, Bacteroides thetaiotaomicron; identical to SEQ ID NO: 32611

SEQ ID NO: 56831 - DNA, 1521 bp, Buchnera aphidicola; identical to SEQ ID NO: 32612
  CDS (1)..(1521)

SEQ ID NO: 56832 - protein, 506 aa, Buchnera aphidicola; identical to SEQ ID NO: 32613

SEQ ID NO: 56833 - DNA, 1512 bp, Buchnera aphidicola; identical to SEQ ID NO: 32614
  CDS (1)..(1512)

SEQ ID NO: 56834 - protein, 503 aa, Buchnera aphidicola; identical to SEQ ID NO: 32615

SEQ ID NO: 56835 - DNA, 1719 bp, Caenorhabditis elegans; identical to SEQ ID NO: 32616
  CDS (1)..(1719)

SEQ ID NO: 56836 - protein, 572 aa, Caenorhabditis elegans; identical to SEQ ID NO: 32617

SEQ ID NO: 56837 - DNA, 1506 bp, Campylobacter jejuni; identical to SEQ ID NO: 32618
  CDS (1)..(1506)

SEQ ID NO: 56838 - protein, 501 aa, Campylobacter jejuni; identical to SEQ ID NO: 32619

SEQ ID NO: 56839 - DNA, 1458 bp, Candidatus Blochmannia floridanus; identical to SEQ ID NO: 32620
  CDS (1)..(1458)

SEQ ID NO: 56840 - protein, 485 aa, Candidatus Blochmannia floridanus; identical to SEQ ID NO: 32621

SEQ ID NO: 56841 - DNA, 1578 bp, Chlamydophila caviae; identical to SEQ ID NO: 32622
  CDS (1)..(1578)

SEQ ID NO: 56842 - protein, 525 aa, Chlamydophila caviae; identical to SEQ ID NO: 32623

SEQ ID NO: 56843 - DNA, 1536 bp, Chlorobium tepidum; identical to SEQ ID NO: 32624
  CDS (1)..(1536)

SEQ ID NO: 56844 - protein, 511 aa, Chlorobium tepidum; identical to SEQ ID NO: 32625

SEQ ID NO: 56845 - DNA, 1581 bp, Chlamydia trachomatis; identical to SEQ ID NO: 32626
  CDS (1)..(1581)

SEQ ID NO: 56846 - protein, 526 aa, Chlamydia trachomatis; identical to SEQ ID NO: 32627

SEQ ID NO: 56847 - DNA, 1509 bp, Chromobacterium violaceum; identical to SEQ ID NO: 32628
  CDS (1)..(1509)

SEQ ID NO: 56848 - protein, 502 aa, Chromobacterium violaceum; identical to SEQ ID NO: 32629

SEQ ID NO: 56849 - DNA, 1506 bp, Clostridium perfringens; identical to SEQ ID NO: 32630
  CDS (1)..(1506)

SEQ ID NO: 56850 - protein, 501 aa, Clostridium perfringens; identical to SEQ ID NO: 32631

SEQ ID NO: 56851 - DNA, 1509 bp, Clostridium tetani; identical to SEQ ID NO: 32632
  CDS (1)..(1509)

SEQ ID NO: 56852 - protein, 502 aa, Clostridium tetani; identical to SEQ ID NO: 32633

SEQ ID NO: 56853 - DNA, 1497 bp, Coxiella burnetii; identical to SEQ ID NO: 32634
  CDS (1)..(1497)

SEQ ID NO: 56854 - protein, 498 aa, Coxiella burnetii; identical to SEQ ID NO: 32635

SEQ ID NO: 56855 - DNA, 1794 bp, Cricetulus longicaudatus; identical to SEQ ID NO: 32636
  CDS (1)..(1794)

SEQ ID NO: 56856 - protein, 597 aa, Cricetulus longicaudatus; identical to SEQ ID NO: 32637

SEQ ID NO: 56857 - DNA, 1578 bp, Deinococcus radiodurans; identical to SEQ ID NO: 32638
  CDS (1)..(1578)

SEQ ID NO: 56858 - protein, 525 aa, Deinococcus radiodurans; identical to SEQ ID NO: 32639

SEQ ID NO: 56859 - DNA, 1497 bp, Enterococcus faecalis; identical to SEQ ID NO: 32640
  CDS (1)..(1497)

SEQ ID NO: 56860 - protein, 498 aa, Enterococcus faecalis; identical to SEQ ID NO: 32641

SEQ ID NO: 56861 - DNA, 1482 bp, Fusobacterium nucleatum; identical to SEQ ID NO: 32642
  CDS (1)..(1482)

SEQ ID NO: 56862 - protein, 493 aa, Fusobacterium nucleatum; identical to SEQ ID NO: 32643

SEQ ID NO: 56863 - DNA, 1494 bp, Gloeobacter violaceus; identical to SEQ ID NO: 32644
  CDS (1)..(1494)

SEQ ID NO: 56864 - protein, 497 aa, Gloeobacter violaceus; identical to SEQ ID NO: 32645

SEQ ID NO: 56865 - DNA, 1497 bp, Haemophilus ducreyi; identical to SEQ ID NO: 32646
  CDS (1)..(1497)

SEQ ID NO: 56866 - protein, 498 aa, Haemophilus ducreyi; identical to SEQ ID NO: 32647

SEQ ID NO: 56867 - DNA, 1557 bp, Helicobacter hepaticus; identical to SEQ ID NO: 32648
  CDS (1)..(1557)

SEQ ID NO: 56868 - protein, 518 aa, Helicobacter hepaticus; identical to SEQ ID NO: 32649

SEQ ID NO: 56869 - DNA, 1485 bp, Lactococcus lactis; identical to SEQ ID NO: 32650
  CDS (1)..(1485)

SEQ ID NO: 56870 - protein, 494 aa, Lactococcus lactis; identical to SEQ ID NO: 32651

SEQ ID NO: 56871 - DNA, 1500 bp, Lactobacillus plantarum; identical to SEQ ID NO: 32652
  CDS (1)..(1500)

SEQ ID NO: 56872 - protein, 499 aa, Lactobacillus plantarum; identical to SEQ ID NO: 32653

SEQ ID NO: 56873 - DNA, 1497 bp, Listeria monocytogenes; identical to SEQ ID NO: 32654
  CDS (1)..(1497)

SEQ ID NO: 56874 - protein, 498 aa, Listeria monocytogenes; identical to SEQ ID NO: 32655

SEQ ID NO: 56875 - DNA, 1767 bp, Lycopersicon esculentum; identical to SEQ ID NO: 32656
  CDS (1)..(1767)

SEQ ID NO: 56876 - protein, 588 aa, Lycopersicon esculentum; identical to SEQ ID NO: 32657

SEQ ID NO: 56877 - DNA, 1512 bp, Neisseria meningitidis; identical to SEQ ID NO: 32658
  CDS (1)..(1512)

SEQ ID NO: 56878 - protein, 503 aa, Neisseria meningitidis; identical to SEQ ID NO: 32659

SEQ ID NO: 56879 - DNA, 1509 bp, Nitrosomonas europaea; identical to SEQ ID NO: 32660
  CDS (1)..(1509)

SEQ ID NO: 56880 - protein, 502 aa, Nitrosomonas europaea; identical to SEQ ID NO: 32661

SEQ ID NO: 56881 - DNA, 1482 bp, Oceanobacillus iheyensis; identical to SEQ ID NO: 32662
  CDS (1)..(1482)

SEQ ID NO: 56882 - protein, 493 aa, Oceanobacillus iheyensis; identical to SEQ ID NO: 32663

SEQ ID NO: 56883 - DNA, 1809 bp, Oryza sativa; identical to SEQ ID NO: 32664
  CDS (1)..(1809)

SEQ ID NO: 56884 - protein, 602 aa, Oryza sativa; identical to SEQ ID NO: 32665

SEQ ID NO: 56885 - DNA, 1506 bp, Pasteurella multocida; identical to SEQ ID NO: 32666
  CDS (1)..(1506)

SEQ ID NO: 56886 - protein, 501 aa, Pasteurella multocida; identical to SEQ ID NO: 32667

SEQ ID NO: 56887 - DNA, 1737 bp, Porphyromonas gingivalis; identical to SEQ ID NO: 32668
  CDS (1)..(1737)

SEQ ID NO: 56888 - protein, 578 aa, Porphyromonas gingivalis; identical to SEQ ID NO: 32669

SEQ ID NO: 56889 - DNA, 1506 bp, Pseudomonas aeruginosa; identical to SEQ ID NO: 32670
  CDS (1)..(1506)

SEQ ID NO: 56890 - protein, 501 aa, Pseudomonas aeruginosa; identical to SEQ ID NO: 32671

SEQ ID NO: 56891 - DNA, 1503 bp, Pseudomonas syringae; identical to SEQ ID NO: 32672
  CDS (1)..(1503)

SEQ ID NO: 56892 - protein, 500 aa, Pseudomonas syringae; identical to SEQ ID NO: 32673

SEQ ID NO: 56893 - DNA, 1533 bp, Ralstonia solanacearum; identical to SEQ ID NO: 32674
  CDS (1)..(1533)

SEQ ID NO: 56894 - protein, 510 aa, Ralstonia solanacearum; identical to SEQ ID NO: 32675

SEQ ID NO: 56895 - DNA, 1497 bp, Rhizobium meliloti; identical to SEQ ID NO: 32676
  CDS (1)..(1497)

SEQ ID NO: 56896 - protein, 498 aa, Rhizobium meliloti; identical to SEQ ID NO: 32677

SEQ ID NO: 56897 - DNA, 1503 bp, Shewanella oneidensis; identical to SEQ ID NO: 32678
  CDS (1)..(1503)

SEQ ID NO: 56898 - protein, 500 aa, Shewanella oneidensis; identical to SEQ ID NO: 32679

SEQ ID NO: 56899 - DNA, 1488 bp, Staphylococcus aureus; identical to SEQ ID NO: 32680
  CDS (1)..(1488)

SEQ ID NO: 56900 - protein, 495 aa, Staphylococcus aureus; identical to SEQ ID NO: 32681

SEQ ID NO: 56901 - DNA, 1485 bp, Sulfolobus solfataricus; identical to SEQ ID NO: 32682
  CDS (1)..(1485)

SEQ ID NO: 56902 - protein, 494 aa, Sulfolobus solfataricus; identical to SEQ ID NO: 32683

SEQ ID NO: 56903 - DNA, 1521 bp, Synechococcus elongatus; identical to SEQ ID NO: 32684
  CDS (1)..(1521)

SEQ ID NO: 56904 - protein, 506 aa, Synechococcus elongatus; identical to SEQ ID NO: 32685

SEQ ID NO: 56905 - DNA, 1509 bp, Synechococcus sp; identical to SEQ ID NO: 32686
  CDS (1)..(1509)

SEQ ID NO: 56906 - protein, 502 aa, Synechococcus sp; identical to SEQ ID NO: 32687

SEQ ID NO: 56907 - DNA, 1509 bp, Thermotoga maritima; identical to SEQ ID NO: 32688
  CDS (1)..(1509)

SEQ ID NO: 56908 - protein, 502 aa, Thermotoga maritima; identical to SEQ ID NO: 32689

SEQ ID NO: 56909 - DNA, 1479 bp, Thermus thermophilus; identical to SEQ ID NO: 32690
  CDS (1)..(1479)

SEQ ID NO: 56910 - protein, 492 aa, Thermus thermophilus; identical to SEQ ID NO: 32691

SEQ ID NO: 56911 - DNA, 1500 bp, Thermoanaerobacter tengcongensis; identical to SEQ ID NO: 32692
  CDS (1)..(1500)

SEQ ID NO: 56912 - protein, 499 aa, Thermoanaerobacter tengcongensis; identical to SEQ ID NO: 32693

SEQ ID NO: 56913 - DNA, 1482 bp, Ureaplasma parvum; identical to SEQ ID NO: 32694
  CDS (1)..(1482)

SEQ ID NO: 56914 - protein, 493 aa, Ureaplasma parvum; identical to SEQ ID NO: 32695

SEQ ID NO: 56915 - DNA, 1518 bp, Vibrio parahaemolyticus; identical to SEQ ID NO: 32696
  CDS (1)..(1518)

SEQ ID NO: 56916 - protein, 505 aa, Vibrio parahaemolyticus; identical to SEQ ID NO: 32697

SEQ ID NO: 56917 - DNA, 1533 bp, Vibrio vulnificus; identical to SEQ ID NO: 32698
  CDS (1)..(1533)

SEQ ID NO: 56918 - protein, 510 aa, Vibrio vulnificus; identical to SEQ ID NO: 32699

SEQ ID NO: 56919 - DNA, 1482 bp, Wigglesworthia glossinidia brevipalpis; identical to SEQ ID NO: 32700
  CDS (1)..(1482)

SEQ ID NO: 56920 - protein, 493 aa, Wigglesworthia glossinidia brevipalpis; identical to SEQ ID NO: 32701

SEQ ID NO: 56921 - DNA, 1524 bp, Wolinella succinogenes; identical to SEQ ID NO: 32702
  CDS (1)..(1524)

SEQ ID NO: 56922 - protein, 507 aa, Wolinella succinogenes; identical to SEQ ID NO: 32703

SEQ ID NO: 56923 - DNA, 1518 bp, Xanthomonas campestris; identical to SEQ ID NO: 32704
  CDS (1)..(1518)

SEQ ID NO: 56924 - protein, 505 aa, Xanthomonas campestris; identical to SEQ ID NO: 32705

SEQ ID NO: 56925 - DNA, 1521 bp, Xylella fastidiosa; identical to SEQ ID NO: 32706
  CDS (1)..(1521)

SEQ ID NO: 56926 - protein, 506 aa, Xylella fastidiosa; identical to SEQ ID NO: 32707

SEQ ID NO: 56927 - DNA, 1518 bp, Yersinia pestis; identical to SEQ ID NO: 32708
  CDS (1)..(1518)

SEQ ID NO: 56928 - protein, 505 aa, Yersinia pestis; identical to SEQ ID NO: 32709

SEQ ID NO: 56929 - DNA, 23 bp, Primer
atgtctgaacaagaaacacgggg

SEQ ID NO: 56930 - DNA, 22 bp, Primer
ttatttctgtgggcgcatcgcc

SEQ ID NO: 56931 - protein, 561 aa, consensus; identical to SEQ ID NO: 32712
  MISC_FEATURE (1)..(561): consensus for the disclosure of xaa see table XV

SEQ ID NO: 56932 - protein, 34 aa, consensus; identical to SEQ ID NO: 32713
  MISC_FEATURE (1)..(34): consensus for the disclosure of xaa see table XV

SEQ ID NO: 56933 - protein, 46 aa, consensus; identical to SEQ ID NO: 32714
  MISC_FEATURE (1)..(46): consensus for the disclosure of xaa see table XV

SEQ ID NO: 56934 - protein, 135 aa, consensus; identical to SEQ ID NO: 32715
  MISC_FEATURE (1)..(135): consensus for the disclosure of xaa see table XV

SEQ ID NO: 56935 - protein, 62 aa, consensus; identical to SEQ ID NO: 32716
  MISC_FEATURE (1)..(62): consensus for the disclosure of xaa see table XV

SEQ ID NO: 56936 - protein, 45 aa, consensus; identical to SEQ ID NO: 32717
  MISC_FEATURE (1)..(45): consensus for the disclosure of xaa see table XV

SEQ ID NO: 56937 - DNA, 378 bp, Escherichia coli; identical to SEQ ID NO: 44321
  CDS (1)..(378)

SEQ ID NO: 56938 - protein, 125 aa, Escherichia coli; identical to SEQ ID NO: 44322

SEQ ID NO: 56939 - DNA, 474 bp, Gluconobacter oxydans 621H; identical to SEQ ID NO: 44323
  CDS (1)..(474)

SEQ ID NO: 56940 - protein, 157 aa, Gluconobacter oxydans 621H; identical to SEQ ID NO: 44324

SEQ ID NO: 56941 - DNA, 405 bp, Wolbachia endosymbiont strain TRS of Brugia malayi; identical to SEQ ID NO: 44325
  CDS (1)..(405)

SEQ ID NO: 56942 - protein, 134 aa, Wolbachia endosymbiont strain TRS of Brugia malayi; identical to SEQ ID NO: 44326

SEQ ID NO: 56943 - DNA, 384 bp, Xanthomonas oryzae pv. oryzae KACC10331; identical to SEQ ID NO: 44327
  CDS (1)..(384)

SEQ ID NO: 56944 - protein, 127 aa, Xanthomonas oryzae pv. oryzae KACC10331; identical to SEQ ID NO: 44328

SEQ ID NO: 56945 - DNA, 465 bp, Caulobacter crescentus CB15; identical to SEQ ID NO: 44329
  CDS (1)..(465)

SEQ ID NO: 56946 - protein, 154 aa, Caulobacter crescentus CB15; identical to SEQ ID NO: 44330

SEQ ID NO: 56947 - DNA, 402 bp, Agrobacterium tumefaciens str. C58; identical to SEQ ID NO: 44331
  CDS (1)..(402)

SEQ ID NO: 56948 - protein, 133 aa, Agrobacterium tumefaciens str. C58; identical to SEQ ID NO: 44332

SEQ ID NO: 56949 - DNA, 426 bp, Brucella melitensis 16M; identical to SEQ ID NO: 44333
  CDS (1)..(426)

SEQ ID NO: 56950 - protein, 141 aa, Brucella melitensis 16M; identical to SEQ ID NO: 44334

SEQ ID NO: 56951 - DNA, 405 bp, Bradyrhizobium japonicum USDA 110; identical to SEQ ID NO: 44335
  CDS (1)..(405)

SEQ ID NO: 56952 - protein, 134 aa, Bradyrhizobium japonicum USDA 110; identical to SEQ ID NO: 44336

SEQ ID NO: 56953 - DNA, 375 bp, Bordetella bronchiseptica RB50; identical to SEQ ID NO: 44337
  CDS (1)..(375)

SEQ ID NO: 56954 - protein, 124 aa, Bordetella bronchiseptica RB50; identical to SEQ ID NO: 44338

SEQ ID NO: 56955 - DNA, 378 bp, Erwinia carotovora subsp. atroseptica SCRI1043; identical to SEQ ID NO: 44339
  CDS (1)..(378)

SEQ ID NO: 56956 - protein, 125 aa, Erwinia carotovora subsp. atroseptica SCRI1043; identical to SEQ ID NO: 44340

SEQ ID NO: 56957 - DNA, 378 bp, Yersinia pseudotuberculosis IP 32953; identical to SEQ ID NO: 44341
  CDS (1)..(378)

SEQ ID NO: 56958 - protein, 125 aa, Yersinia pseudotuberculosis IP 32953; identical to SEQ ID NO: 44342

SEQ ID NO: 56959 - DNA, 381 bp, Methylococcus capsulatus str. Bath; identical to SEQ ID NO: 44343
  CDS (1)..(381)

SEQ ID NO: 56960 - protein, 126 aa, Methylococcus capsulatus str. Bath; identical to SEQ ID NO: 44344

SEQ ID NO: 56961 - DNA, 453 bp, Anaplasma marginale str. St. Maries; identical to SEQ ID NO: 44345
  CDS (1)..(453)

SEQ ID NO: 56962 - protein, 150 aa, Anaplasma marginale str. St. Maries; identical to SEQ ID NO: 44346

SEQ ID NO: 56963 - DNA, 375 bp, Idiomarina loihiensis L2TR; identical to SEQ ID NO: 44347
  CDS (1)..(375)

SEQ ID NO: 56964 - protein, 124 aa, Idiomarina loihiensis L2TR; identical to SEQ ID NO: 44348

SEQ ID NO: 56965 - DNA, 384 bp, Azoarcus sp. EbN1; identical to SEQ ID NO: 44349
  CDS (1)..(384)

SEQ ID NO: 56966 - protein, 127 aa, Azoarcus sp. EbN1; identical to SEQ ID NO: 44350

SEQ ID NO: 56967 - DNA, 405 bp, Ehrlichia ruminantium str. Welgevonden; identical to SEQ ID NO: 44351
  CDS (1)..(405)

SEQ ID NO: 56968 - protein, 134 aa, Ehrlichia ruminantium str. Welgevonden; identical to SEQ ID NO: 44352

SEQ ID NO: 56969 - DNA, 384 bp, Xylella fastidiosa Ann-1; identical to SEQ ID NO: 44353
  CDS (1)..(384)

SEQ ID NO: 56970 - protein, 127 aa, Xylella fastidiosa Ann-1; identical to SEQ ID NO: 44354

SEQ ID NO: 56971 - DNA, 393 bp, Magnetospirillum magnetotacticum MS-1; identical to SEQ ID NO: 44355
  CDS (1)..(393)

SEQ ID NO: 56972 - protein, 130 aa, Magnetospirillum magnetotacticum MS-1; identical to SEQ ID NO: 44356

SEQ ID NO: 56973 - DNA, 393 bp, Magnetospirillum magnetotacticum MS-1; identical to SEQ ID NO: 44357
  CDS (1)..(393)

SEQ ID NO: 56974 - protein, 130 aa, Magnetospirillum magnetotacticum MS-1; identical to SEQ ID NO: 44358

SEQ ID NO: 56975 - DNA, 381 bp, Azotobacter vinelandii; identical to SEQ ID NO: 44359
  CDS (1)..(381)

SEQ ID NO: 56976 - protein, 126 aa, Azotobacter vinelandii; identical to SEQ ID NO: 44360

SEQ ID NO: 56977 - DNA, 384 bp, Desulfitobacterium hafniense DCB-2; identical to SEQ ID NO: 44361
  CDS (1)..(384)

SEQ ID NO: 56978 - protein, 127 aa, Desulfitobacterium hafniense DCB-2; identical to SEQ ID NO: 44362

SEQ ID NO: 56979 - DNA, 384 bp, Methylobacillus flagellatus KT; identical to SEQ ID NO: 44363
  CDS (1)..(384)

SEQ ID NO: 56980 - protein, 127 aa, Methylobacillus flagellatus KT; identical to SEQ ID NO: 44364

SEQ ID NO: 56981 - DNA, 393 bp, Mesorhizobium sp. BNC1; identical to SEQ ID NO: 44365
  CDS (1)..(393)

SEQ ID NO: 56982 - protein, 130 aa, Mesorhizobium sp. BNC1; identical to SEQ ID NO: 44366

SEQ ID NO: 56983 - DNA, 384 bp, Ehrlichia canis str. Jake; identical to SEQ ID NO: 44367
  CDS (1)..(384)

SEQ ID NO: 56984 - protein, 127 aa, Ehrlichia canis str. Jake; identical to SEQ ID NO: 44368

SEQ ID NO: 56985 - DNA, 375 bp, Rubrivivax gelatinosus PM1; identical to SEQ ID NO: 44369
  CDS (1)..(375)

SEQ ID NO: 56986 - protein, 124 aa, Rubrivivax gelatinosus PM1; identical to SEQ ID NO: 44370

SEQ ID NO: 56987 - DNA, 381 bp, Pseudomonas fluorescens PfO-1; identical to SEQ ID NO: 44371
  CDS (1)..(381)

SEQ ID NO: 56988 - protein, 126 aa, Pseudomonas fluorescens PfO-1; identical to SEQ ID NO: 44372

SEQ ID NO: 56989 - DNA, 408 bp, Rhodospirillum rubrum; identical to SEQ ID NO: 44373
  CDS (1)..(408)

SEQ ID NO: 56990 - protein, 135 aa, Rhodospirillum rubrum; identical to SEQ ID NO: 44374

SEQ ID NO: 56991 - DNA, 375 bp, Ralstonia metallidurans CH34; identical to SEQ ID NO: 44375
  CDS (1)..(375)

SEQ ID NO: 56992 - protein, 124 aa, Ralstonia metallidurans CH34; identical to SEQ ID NO: 44376

SEQ ID NO: 56993 - DNA, 375 bp, Burkholderia fungorum LB400; identical to SEQ ID NO: 44377
  CDS (1)..(375)

SEQ ID NO: 56994 - protein, 124 aa, Burkholderia fungorum LB400; identical to SEQ ID NO: 44378

SEQ ID NO: 56995 - DNA, 381 bp, Magnetococcus sp. MC-1; identical to SEQ ID NO: 44379
  CDS (1)..(381)

SEQ ID NO: 56996 - protein, 126 aa, Magnetococcus sp. MC-1; identical to SEQ ID NO: 44380

SEQ ID NO: 56997 - DNA, 399 bp, Novosphingobium aromaticivorans DSM 12444; identical to SEQ ID NO: 44381
  CDS (1)..(399)

SEQ ID NO: 56998 - protein, 132 aa, Novosphingobium aromaticivorans DSM 12444; identical to SEQ ID NO: 44382

SEQ ID NO: 56999 - DNA, 387 bp, Cytophaga hutchinsonii; identical to SEQ ID NO: 44383
  CDS (1)..(387)

SEQ ID NO: 57000 - protein, 128 aa, Cytophaga hutchinsonii; identical to SEQ ID NO: 44384

SEQ ID NO: 57001 - DNA, 372 bp, Microbulbifer degradans 2-40; identical to SEQ ID NO: 44385
  CDS (1)..(372)

SEQ ID NO: 57002 - protein, 123 aa, Microbulbifer degradans 2-40; identical to SEQ ID NO: 44386

SEQ ID NO: 57003 - DNA, 384 bp, Thiobacillus denitrificans ATCC 25259; identical to SEQ ID NO: 44387
  CDS (1)..(384)

SEQ ID NO: 57004 - protein, 127 aa, Thiobacillus denitrificans ATCC 25259; identical to SEQ ID NO: 44388

SEQ ID NO: 57005 - DNA, 384 bp, Dechloromonas aromatica RCB; identical to SEQ ID NO: 44389
  CDS (1)..(384)

SEQ ID NO: 57006 - protein, 127 aa, Dechloromonas aromatica RCB; identical to SEQ ID NO: 44390

SEQ ID NO: 57007 - DNA, 414 bp, Chloroflexus aurantiacus; identical to SEQ ID NO: 44391
  CDS (1)..(414)

SEQ ID NO: 57008 - protein, 137 aa, Chloroflexus aurantiacus; identical to SEQ ID NO: 44392

SEQ ID NO: 57009 - DNA, 396 bp, Polaromonas sp. JS666; identical to SEQ ID NO: 44393
  CDS (1)..(396)

SEQ ID NO: 57010 - protein, 131 aa, Polaromonas sp. JS666; identical to SEQ ID NO: 44394

SEQ ID NO: 57011 - DNA, 903 bp, Oryza sativa; identical to SEQ ID NO: 44395
  CDS (1)..(903)

SEQ ID NO: 57012 - protein, 300 aa, Oryza sativa; identical to SEQ ID NO: 44396

SEQ ID NO: 57013 - DNA, 384 bp, Bdellovibrio bacteriovorus; identical to SEQ ID NO: 44397
  CDS (1)..(384)

SEQ ID NO: 57014 - protein, 127 aa, Bdellovibrio bacteriovorus; identical to SEQ ID NO: 44398

SEQ ID NO: 57015 - DNA, 393 bp, Brucella suis; identical to SEQ ID NO: 44399
  CDS (1)..(393)

SEQ ID NO: 57016 - protein, 130 aa, Brucella suis; identical to SEQ ID NO: 44400

SEQ ID NO: 57017 - DNA, 381 bp, Chromobacterium violaceum; identical to SEQ ID NO: 44401
  CDS (1)..(381)

SEQ ID NO: 57018 - protein, 126 aa, Chromobacterium violaceum; identical to SEQ ID NO: 44402

SEQ ID NO: 57019 - DNA, 387 bp, Deinococcus radiodurans; identical to SEQ ID NO: 44403
  CDS (1)..(387)

SEQ ID NO: 57020 - protein, 128 aa, Deinococcus radiodurans; identical to SEQ ID NO: 44404

SEQ ID NO: 57021 - DNA, 384 bp, Nitrosomonas europaea; identical to SEQ ID NO: 44405
  CDS (1)..(384)

SEQ ID NO: 57022 - protein, 127 aa, Nitrosomonas europaea; identical to SEQ ID NO: 44406

SEQ ID NO: 57023 - DNA, 378 bp, Photorhabdus luminescens; identical to SEQ ID NO: 44407
  CDS (1)..(378)

SEQ ID NO: 57024 - protein, 125 aa, Photorhabdus luminescens; identical to SEQ ID NO: 44408

SEQ ID NO: 57025 - DNA, 384 bp, Photobacterium profundum; identical to SEQ ID NO: 44409
  CDS (1)..(384)

SEQ ID NO: 57026 - protein, 127 aa, Photobacterium profundum; identical to SEQ ID NO: 44410

SEQ ID NO: 57027 - DNA, 381 bp, Pseudomonas aeruginosa; identical to SEQ ID NO: 44411
  CDS (1)..(381)

SEQ ID NO: 57028 - protein, 126 aa, Pseudomonas aeruginosa; identical to SEQ ID NO: 44412

SEQ ID NO: 57029 - DNA, 375 bp, Ralstonia solanacearum; identical to SEQ ID NO: 44413
  CDS (1)..(375)

SEQ ID NO: 57030 - protein, 124 aa, Ralstonia solanacearum; identical to SEQ ID NO: 44414

SEQ ID NO: 57031 - DNA, 393 bp, Rhizobium etli; identical to SEQ ID NO: 44415
  CDS (1)..(393)

SEQ ID NO: 57032 - protein, 130 aa, Rhizobium etli; identical to SEQ ID NO: 44416

SEQ ID NO: 57033 - DNA, 393 bp, Rhizobium loti; identical to SEQ ID NO: 44417
  CDS (1)..(393)

SEQ ID NO: 57034 - protein, 130 aa, Rhizobium loti; identical to SEQ ID NO: 44418

SEQ ID NO: 57035 - DNA, 393 bp, Rhodopseudomonas palustris; identical to SEQ ID NO: 44419
  CDS (1)..(393)

SEQ ID NO: 57036 - protein, 130 aa, Rhodopseudomonas palustris; identical to SEQ ID NO: 44420

SEQ ID NO: 57037 - DNA, 378 bp, Salmonella typhi; identical to SEQ ID NO: 44421
  CDS (1)..(378)

SEQ ID NO: 57038 - protein, 125 aa, Salmonella typhi; identical to SEQ ID NO: 44422

SEQ ID NO: 57039 - DNA, 378 bp, Salmonella typhimurium; identical to SEQ ID NO: 44423
  CDS (1)..(378)

SEQ ID NO: 57040 - protein, 125 aa, Salmonella typhimurium; identical to SEQ ID NO: 44424

SEQ ID NO: 57041 - DNA, 381 bp, Shewanella oneidensis; identical to SEQ ID NO: 44425
  CDS (1)..(381)

SEQ ID NO: 57042 - protein, 126 aa, Shewanella oneidensis; identical to SEQ ID NO: 44426

SEQ ID NO: 57043 - DNA, 381 bp, Vibrio cholerae; identical to SEQ ID NO: 44427
  CDS (1)..(381)

SEQ ID NO: 57044 - protein, 126 aa, Vibrio cholerae; identical to SEQ ID NO: 44428

SEQ ID NO: 57045 - DNA, 381 bp, Vibrio parahaemolyticus; identical to SEQ ID NO: 44429
  CDS (1)..(381)

SEQ ID NO: 57046 - protein, 126 aa, Vibrio parahaemolyticus; identical to SEQ ID NO: 44430

SEQ ID NO: 57047 - DNA, 402 bp, Wolbachia pipientis wMel; identical to SEQ ID NO: 44431
  CDS (1)..(402)

SEQ ID NO: 57048 - protein, 133 aa, Wolbachia pipientis wMel; identical to SEQ ID NO: 44432

SEQ ID NO: 57049 - DNA, 384 bp, Xanthomonas campestris; identical to SEQ ID NO: 44433
  CDS (1)..(384)

SEQ ID NO: 57050 - protein, 127 aa, Xanthomonas campestris; identical to SEQ ID NO: 44434

SEQ ID NO: 57051 - DNA, 384 bp, Xylella fastidiosa; identical to SEQ ID NO: 44435
  CDS (1)..(384)

SEQ ID NO: 57052 - protein, 127 aa, Xylella fastidiosa; identical to SEQ ID NO: 44436

SEQ ID NO: 57053 - DNA, 23 bp, Primer
atgatcaattcgccccgagtgtg

SEQ ID NO: 57054 - DNA, 24 bp, Primer
ttaatgaatgagtgtgggaacggc

SEQ ID NO: 57055 - protein, 78 aa, consensus; identical to SEQ ID NO: 44439
  MISC_FEATURE (1)..(78): consensus for the disclosure of xaa see table XV

SEQ ID NO: 57056 - protein, 112 aa, consensus; identical to SEQ ID NO: 44440
  MISC_FEATURE (1)..(112): consensus for the disclosure of xaa see table XV

SEQ ID NO: 57057 - protein, 114 aa, consensus; identical to SEQ ID NO: 44441
  MISC_FEATURE (1)..(114): consensus for the disclosure of xaa see table XV

SEQ ID NO: 57058 - DNA, 159 bp, Escherichia coli
  CDS (1)..(159)
atgaacggtgctacctccttatatgatgaggtaattattattaataaaatcccccccaaaaaaattgatactaaaggagttgctactgaagaagttgctactaaaaaagtactgctgaacaaattactgacaacgcaattattgaatgagccagaataa

SEQ ID NO: 57059 - protein, 52 aa, Escherichia coli
MNGATSLYDEVIIINKIPPKKIDTKGVATEEVATKKVLLNKLLTTQLLNEPE

SEQ ID NO: 57060 - DNA, 25 bp, Primer
atgaacggtgctacctccttatatg

SEQ ID NO: 57061 - DNA, 26 bp, Primer
ttattctggctcattcaataattgcg

SEQ ID NO: 57062 - DNA, 612 bp, Escherichia coli (strain K-12); identical to SEQ ID NO: 28700
  CDS (1)..(612)

SEQ ID NO: 57063 - protein, 203 aa, Escherichia coli (strain K-12); identical to SEQ ID NO: 28701

SEQ ID NO: 57064 - DNA, 573 bp, Salmonella enterica subsp. enterica serovar Paratypi A str. ATCC; identical to SEQ ID NO: 28702
  CDS (1)..(573)

SEQ ID NO: 57065 - protein, 190 aa, Salmonella enterica subsp. enterica serovar Paratypi A str. ATCC; identical to SEQ ID NO: 28703

SEQ ID NO: 57066 - DNA, 561 bp, Escherichia coli O157:H7; identical to SEQ ID NO: 28704
  CDS (1)..(561)

SEQ ID NO: 57067 - protein, 186 aa, Escherichia coli O157:H7; identical to SEQ ID NO: 28705

SEQ ID NO: 57068 - DNA, 567 bp, Escherichia coli CFT073; identical to SEQ ID NO: 28706
  CDS (1)..(567)

SEQ ID NO: 57069 - protein, 188 aa, Escherichia coli CFT073; identical to SEQ ID NO: 28707

SEQ ID NO: 57070 - DNA, 567 bp, Salmonella enterica subsp. enterica serovar Typhi Ty2; identical to SEQ ID NO: 28708
  CDS (1)..(567)

SEQ ID NO: 57071 - protein, 188 aa, Salmonella enterica subsp. enterica serovar Typhi Ty2; identical to SEQ ID NO: 28709

SEQ ID NO: 57072 - DNA, 585 bp, Salmonella dublin; identical to SEQ ID NO: 28710
  CDS (1)..(585)

SEQ ID NO: 57073 - protein, 194 aa, Salmonella dublin; identical to SEQ ID NO: 28711

SEQ ID NO: 57074 - DNA, 24 bp, Primer
atggaattcggtgtcagattcagt

SEQ ID NO: 57075 - DNA, 27 bp, Primer
ttattgatagatgaaattaaacgtcgc

SEQ ID NO: 57076 - protein, 198 aa, consensus; identical to SEQ ID NO: 28714
  MISC_FEATURE (1)..(198): consensus for the disclosure of xaa see table XV

SEQ ID NO: 57077 - protein, 18 aa, consensus
  MISC_FEATURE (1)..(18): consensus for the disclosure of xaa see table XV
XXVXFTATXXXTTCXXXX

SEQ ID NO: 57078 - protein, 13 aa, consensus
  MISC_FEATURE (1)..(13): consensus for the disclosure of xaa see table XV
GXFXXXATFXFXY

SEQ ID NO: 57079 - DNA, 2535 bp, Escherichia coli; identical to SEQ ID NO: 49910
  CDS (1)..(2535)

SEQ ID NO: 57080 - protein, 844 aa, Escherichia coli; identical to SEQ ID NO: 49911

SEQ ID NO: 57081 - DNA, 2331 bp, Lactobacillus acidophilus NCFM; identical to SEQ ID NO: 49912
  CDS (1)..(2331)

SEQ ID NO: 57082 - protein, 776 aa, Lactobacillus acidophilus NCFM; identical to SEQ ID NO: 49913

SEQ ID NO: 57083 - DNA, 2058 bp, Lactobacillus acidophilus NCFM; identical to SEQ ID NO: 49914
  CDS (1)..(2058)

SEQ ID NO: 57084 - protein, 685 aa, Lactobacillus acidophilus NCFM; identical to SEQ ID NO: 49915

SEQ ID NO: 57085 - DNA, 2445 bp, Xanthomonas oryzae pv. oryzae KACC10331; identical to SEQ ID NO: 49916
  CDS (1)..(2445)

SEQ ID NO: 57086 - protein, 814 aa, Xanthomonas oryzae pv. oryzae KACC10331; identical to SEQ ID NO: 49917

SEQ ID NO: 57087 - DNA, 2373 bp, Vibrio fischeri ES114; identical to SEQ ID NO: 49918
  CDS (1)..(2373)

SEQ ID NO: 57088 - protein, 790 aa, Vibrio fischeri ES114; identical to SEQ ID NO: 49919

SEQ ID NO: 57089 - DNA, 2397 bp, Neisseria gonorrhoeae FA 1090; identical to SEQ ID NO: 49920
  CDS (1)..(2397)

SEQ ID NO: 57090 - protein, 798 aa, Neisseria gonorrhoeae FA 1090; identical to SEQ ID NO: 49921

SEQ ID NO: 57091 - DNA, 2457 bp, Mesorhizobium loti MAFF303099; identical to SEQ ID NO: 49922
  CDS (1)..(2457)

SEQ ID NO: 57092 - protein, 818 aa, Mesorhizobium loti MAFF303099; identical to SEQ ID NO: 49923

SEQ ID NO: 57093 - DNA, 2268 bp, Mesorhizobium loti MAFF303099; identical to SEQ ID NO: 49924
  CDS (1)..(2268)

SEQ ID NO: 57094 - protein, 755 aa, Mesorhizobium loti MAFF303099; identical to SEQ ID NO: 49925

SEQ ID NO: 57095 - DNA, 2154 bp, Mesorhizobium loti MAFF303099; identical to SEQ ID NO: 49926
  CDS (1)..(2154)

SEQ ID NO: 57096 - protein, 717 aa, Mesorhizobium loti MAFF303099; identical to SEQ ID NO: 49927

SEQ ID NO: 57097 - DNA, 1983 bp, Helicobacter pylori J99; identical to SEQ ID NO: 49928
  CDS (1)..(1983)

SEQ ID NO: 57098 - protein, 660 aa, Helicobacter pylori J99; identical to SEQ ID NO: 49929

SEQ ID NO: 57099 - DNA, 1932 bp, Thermotoga maritima MSB8; identical to SEQ ID NO: 49930
  CDS (1)..(1932)

SEQ ID NO: 57100 - protein, 643 aa, Thermotoga maritima MSB8; identical to SEQ ID NO: 49931

SEQ ID NO: 57101 - DNA, 2508 bp, Vibrio cholerae O1 biovar eltor str. N16961; identical to SEQ ID NO: 49932
  CDS (1)..(2508)

SEQ ID NO: 57102 - protein, 835 aa, Vibrio cholerae O1 biovar eltor str. N16961; identical to SEQ ID NO: 49933

SEQ ID NO: 57103 - DNA, 2160 bp, Bacillus halodurans C-125; identical to SEQ ID NO: 49934
  CDS (1)..(2160)

SEQ ID NO: 57104 - protein, 719 aa, Bacillus halodurans C-125; identical to SEQ ID NO: 49935

SEQ ID NO: 57105 - DNA, 2661 bp, Bacillus halodurans C-125; identical to SEQ ID NO: 49936
  CDS (1)..(2661)

SEQ ID NO: 57106 - protein, 886 aa, Bacillus halodurans C-125; identical to SEQ ID NO: 49937

SEQ ID NO: 57107 - DNA, 2064 bp, Bacillus halodurans C-125; identical to SEQ ID NO: 49938
  CDS (1)..(2064)

SEQ ID NO: 57108 - protein, 687 aa, Bacillus halodurans C-125; identical to SEQ ID NO: 49939

SEQ ID NO: 57109 - DNA, 2328 bp, Pasteurella multocida subsp. multocida str. Pm70; identical to SEQ ID NO: 49940
  CDS (1)..(2328)

SEQ ID NO: 57110 - protein, 775 aa, Pasteurella multocida subsp. multocida str. Pm70; identical to SEQ ID NO: 49941

SEQ ID NO: 57111 - DNA, 2562 bp, Pasteurella multocida subsp. multocida str. Pm70; identical to SEQ ID NO: 49942
  CDS (1)..(2562)

SEQ ID NO: 57112 - protein, 853 aa, Pasteurella multocida subsp. multocida str. Pm70; identical to SEQ ID NO: 49943

SEQ ID NO: 57113 - DNA, 1995 bp, Lactococcus lactis subsp. lactis Il1403; identical to SEQ ID NO: 49944
  CDS (1)..(1995)

SEQ ID NO: 57114 - protein, 664 aa, Lactococcus lactis subsp. lactis Il1403; identical to SEQ ID NO: 49945

SEQ ID NO: 57115 - DNA, 2232 bp, Lactococcus lactis subsp. lactis Il1403; identical to SEQ ID NO: 49946
  CDS (1)..(2232)

SEQ ID NO: 57116 - protein, 743 aa, Lactococcus lactis subsp. lactis Il1403; identical to SEQ ID NO: 49947

SEQ ID NO: 57117 - DNA, 3030 bp, Deinococcus radiodurans R1; identical to SEQ ID NO: 49948
  CDS (1)..(3030)

SEQ ID NO: 57118 - protein, 1009 aa, Deinococcus radiodurans R1; identical to SEQ ID NO: 49949

SEQ ID NO: 57119 - DNA, 2430 bp, Clostridium acetobutylicum ATCC 824; identical to SEQ ID NO: 49950
  CDS (1)..(2430)

SEQ ID NO: 57120 - protein, 809 aa, Clostridium acetobutylicum ATCC 824; identical to SEQ ID NO: 49951

SEQ ID NO: 57121 - DNA, 2304 bp, Sinorhizobium meliloti 1021; identical to SEQ ID NO: 49952
  CDS (1)..(2304)

SEQ ID NO: 57122 - protein, 767 aa, Sinorhizobium meliloti 1021; identical to SEQ ID NO: 49953

SEQ ID NO: 57123 - DNA, 2235 bp, Sinorhizobium meliloti 1021; identical to SEQ ID NO: 49954
  CDS (1)..(2235)

SEQ ID NO: 57124 - protein, 744 aa, Sinorhizobium meliloti 1021; identical to SEQ ID NO: 49955

SEQ ID NO: 57125 - DNA, 1944 bp, Bacillus subtilis subsp. subtilis str. 168; identical to SEQ ID NO: 49956
  CDS (1)..(1944)

SEQ ID NO: 57126 - protein, 647 aa, Bacillus subtilis subsp. subtilis str. 168; identical to SEQ ID NO: 49957

SEQ ID NO: 57127 - DNA, 1962 bp, Caulobacter crescentus CB15; identical to SEQ ID NO: 49958
  CDS (1)..(1962)

SEQ ID NO: 57128 - protein, 653 aa, Caulobacter crescentus CB15; identical to SEQ ID NO: 49959

SEQ ID NO: 57129 - DNA, 2385 bp, Caulobacter crescentus CB15; identical to SEQ ID NO: 49960
  CDS (1)..(2385)

SEQ ID NO: 57130 - protein, 794 aa, Caulobacter crescentus CB15; identical to SEQ ID NO: 49961

SEQ ID NO: 57131 - DNA, 2202 bp, Caulobacter crescentus CB15; identical to SEQ ID NO: 49962
  CDS (1)..(2202)

SEQ ID NO: 57132 - protein, 733 aa, Caulobacter crescentus CB15; identical to SEQ ID NO: 49963

SEQ ID NO: 57133 - DNA, 2187 bp, Sinorhizobium meliloti 1021; identical to SEQ ID NO: 49964
  CDS (1)..(2187)

SEQ ID NO: 57134 - protein, 728 aa, Sinorhizobium meliloti 1021; identical to SEQ ID NO: 49965

SEQ ID NO: 57135 - DNA, 2595 bp, Haemophilus influenzae Rd KW20; identical to SEQ ID NO: 49966
  CDS (1)..(2595)

SEQ ID NO: 57136 - protein, 864 aa, Haemophilus influenzae Rd KW20; identical to SEQ ID NO: 49967

SEQ ID NO: 57137 - DNA, 2250 bp, Synechocystis sp. PCC 6803; identical to SEQ ID NO: 49968
  CDS (1)..(2250)

SEQ ID NO: 57138 - protein, 749 aa, Synechocystis sp. PCC 6803; identical to SEQ ID NO: 49969

SEQ ID NO: 57139 - DNA, 1953 bp, Synechocystis sp. PCC 6803; identical to SEQ ID NO: 49970
  CDS (1)..(1953)

SEQ ID NO: 57140 - protein, 650 aa, Synechocystis sp. PCC 6803; identical to SEQ ID NO: 49971

SEQ ID NO: 57141 - DNA, 2658 bp, Synechocystis sp. PCC 6803; identical to SEQ ID NO: 49972
  CDS (1)..(2658)

SEQ ID NO: 57142 - protein, 885 aa, Synechocystis sp. PCC 6803; identical to SEQ ID NO: 49973

SEQ ID NO: 57143 - DNA, 2484 bp, Listeria monocytogenes EGD-e; identical to SEQ ID NO: 49974
  CDS (1)..(2484)

SEQ ID NO: 57144 - protein, 827 aa, Listeria monocytogenes EGD-e; identical to SEQ ID NO: 49975

SEQ ID NO: 57145 - DNA, 2481 bp, Listeria innocua Clip11262; identical to SEQ ID NO: 49976
  CDS (1)..(2481)

SEQ ID NO: 57146 - protein, 826 aa, Listeria innocua Clip11262; identical to SEQ ID NO: 49977

SEQ ID NO: 57147 - DNA, 2271 bp, Nostoc sp. PCC 7120; identical to SEQ ID NO: 49978
  CDS (1)..(2271)

SEQ ID NO: 57148 - protein, 756 aa, Nostoc sp. PCC 7120; identical to SEQ ID NO: 49979

SEQ ID NO: 57149 - DNA, 1932 bp, Nostoc sp. PCC 7120; identical to SEQ ID NO: 49980
  CDS (1)..(1932)

SEQ ID NO: 57150 - protein, 643 aa, Nostoc sp. PCC 7120; identical to SEQ ID NO: 49981

SEQ ID NO: 57151 - DNA, 2295 bp, Agrobacterium tumefaciens str. C58; identical to SEQ ID NO: 49982
  CDS (1)..(2295)

SEQ ID NO: 57152 - protein, 764 aa, Agrobacterium tumefaciens str. C58; identical to SEQ ID NO: 49983

SEQ ID NO: 57153 - DNA, 2274 bp, Agrobacterium tumefaciens str. C58; identical to SEQ ID NO: 49984
  CDS (1)..(2274)

SEQ ID NO: 57154 - protein, 757 aa, Agrobacterium tumefaciens str. C58; identical to SEQ ID NO: 49985

SEQ ID NO: 57155 - DNA, 2448 bp, Agrobacterium tumefaciens str. C58; identical to SEQ ID NO: 49986
  CDS (1)..(2448)

SEQ ID NO: 57156 - protein, 815 aa, Agrobacterium tumefaciens str. C58; identical to SEQ ID NO: 49987

SEQ ID NO: 57157 - DNA, 2460 bp, Brucella melitensis 16M; identical to SEQ ID NO: 49988
  CDS (1)..(2460)

SEQ ID NO: 57158 - protein, 819 aa, Brucella melitensis 16M; identical to SEQ ID NO: 49989

SEQ ID NO: 57159 - DNA, 2193 bp, Brucella melitensis 16M; identical to SEQ ID NO: 49990
  CDS (1)..(2193)

SEQ ID NO: 57160 - protein, 730 aa, Brucella melitensis 16M; identical to SEQ ID NO: 49991

SEQ ID NO: 57161 - DNA, 2040 bp, Clostridium perfringens str. 13; identical to SEQ ID NO: 49992
  CDS (1)..(2040)

SEQ ID NO: 57162 - protein, 679 aa, Clostridium perfringens str. 13; identical to SEQ ID NO: 49993

SEQ ID NO: 57163 - DNA, 2163 bp, Corynebacterium glutamicum ATCC 13032; identical to SEQ ID NO: 49994
  CDS (1)..(2163)

SEQ ID NO: 57164 - protein, 720 aa, Corynebacterium glutamicum ATCC 13032; identical to SEQ ID NO: 49995

SEQ ID NO: 57165 - DNA, 2196 bp, Fusobacterium nucleatum subsp. nucleatum ATCC 25586; identical to SEQ ID NO: 49996
  CDS (1)..(2196)

SEQ ID NO: 57166 - protein, 731 aa, Fusobacterium nucleatum subsp. nucleatum ATCC 25586; identical to SEQ ID NO: 49997

SEQ ID NO: 57167 - DNA, 2532 bp, Thermoanaerobacter tengcongensis MB4; identical to SEQ ID NO: 49998
  CDS (1)..(2532)

SEQ ID NO: 57168 - protein, 843 aa, Thermoanaerobacter tengcongensis MB4; identical to SEQ ID NO: 49999

SEQ ID NO: 57169 - DNA, 2388 bp, Streptomyces coelicolor A3(2); identical to SEQ ID NO: 50000
  CDS (1)..(2388)

SEQ ID NO: 57170 - protein, 795 aa, Streptomyces coelicolor A3(2); identical to SEQ ID NO: 50001

SEQ ID NO: 57171 - DNA, 2151 bp, Streptomyces coelicolor A3(2); identical to SEQ ID NO: 50002
  CDS (1)..(2151)

SEQ ID NO: 57172 - protein, 716 aa, Streptomyces coelicolor A3(2); identical to SEQ ID NO: 50003

SEQ ID NO: 57173 - DNA, 2463 bp, Bacillus anthracis str. A2012; identical to SEQ ID NO: 50004
  CDS (1)..(2463)

SEQ ID NO: 57174 - protein, 820 aa, Bacillus anthracis str. A2012; identical to SEQ ID NO: 50005

SEQ ID NO: 57175 - DNA, 1932 bp, Thermosynechococcus elongatus BP-1; identical to SEQ ID NO: 50006
  CDS (1)..(1932)

SEQ ID NO: 57176 - protein, 643 aa, Thermosynechococcus elongatus BP-1; identical to SEQ ID NO: 50007

SEQ ID NO: 57177 - DNA, 2235 bp, Thermosynechococcus elongatus BP-1; identical to SEQ ID NO: 50008
  CDS (1)..(2235)

SEQ ID NO: 57178 - protein, 744 aa, Thermosynechococcus elongatus BP-1; identical to SEQ ID NO: 50009

SEQ ID NO: 57179 - DNA, 2322 bp, Streptococcus agalactiae 2603V/R; identical to SEQ ID NO: 50010
  CDS (1)..(2322)

SEQ ID NO: 57180 - protein, 773 aa, Streptococcus agalactiae 2603V/R; identical to SEQ ID NO: 50011

SEQ ID NO: 57181 - DNA, 2172 bp, Oceanobacillus iheyensis HTE831; identical to SEQ ID NO: 50012
  CDS (1)..(2172)

SEQ ID NO: 57182 - protein, 723 aa, Oceanobacillus iheyensis HTE831; identical to SEQ ID NO: 50013

SEQ ID NO: 57183 - DNA, 2778 bp, Oceanobacillus iheyensis HTE831; identical to SEQ ID NO: 50014
  CDS (1)..(2778)

SEQ ID NO: 57184 - protein, 925 aa, Oceanobacillus iheyensis HTE831; identical to SEQ ID NO: 50015

SEQ ID NO: 57185 - DNA, 2028 bp, Oceanobacillus iheyensis HTE831; identical to SEQ ID NO: 50016
  CDS (1)..(2028)

SEQ ID NO: 57186 - protein, 675 aa, Oceanobacillus iheyensis HTE831; identical to SEQ ID NO: 50017

SEQ ID NO: 57187 - DNA, 2157 bp, Brucella suis 1330; identical to SEQ ID NO: 50018
  CDS (1)..(2157)

SEQ ID NO: 57188 - protein, 718 aa, Brucella suis 1330; identical to SEQ ID NO: 50019

SEQ ID NO: 57189 - DNA, 2307 bp, Shewanella oneidensis MR-1; identical to SEQ ID NO: 50020
  CDS (1)..(2307)

SEQ ID NO: 57190 - protein, 768 aa, Shewanella oneidensis MR-1; identical to SEQ ID NO: 50021

SEQ ID NO: 57191 - DNA, 2199 bp, Corynebacterium efficiens YS-314; identical to SEQ ID NO: 50022
  CDS (1)..(2199)

SEQ ID NO: 57192 - protein, 732 aa, Corynebacterium efficiens YS-314; identical to SEQ ID NO: 50023

SEQ ID NO: 57193 - DNA, 2409 bp, Vibrio vulnificus CMCP6; identical to SEQ ID NO: 50024
  CDS (1)..(2409)

SEQ ID NO: 57194 - protein, 802 aa, Vibrio vulnificus CMCP6; identical to SEQ ID NO: 50025

SEQ ID NO: 57195 - DNA, 2232 bp, Staphylococcus epidermidis ATCC 12228; identical to SEQ ID NO: 50026
  CDS (1)..(2232)

SEQ ID NO: 57196 - protein, 743 aa, Staphylococcus epidermidis ATCC 12228; identical to SEQ ID NO: 50027

SEQ ID NO: 57197 - DNA, 2214 bp, Bradyrhizobium japonicum USDA 110; identical to SEQ ID NO: 50028
  CDS (1)..(2214)

SEQ ID NO: 57198 - protein, 737 aa, Bradyrhizobium japonicum USDA 110; identical to SEQ ID NO: 50029

SEQ ID NO: 57199 - DNA, 2286 bp, Bradyrhizobium japonicum USDA 110; identical to SEQ ID NO: 50030
  CDS (1)..(2286)

SEQ ID NO: 57200 - protein, 761 aa, Bradyrhizobium japonicum USDA 110; identical to SEQ ID NO: 50031

SEQ ID NO: 57201 - DNA, 2379 bp, Xylella fastidiosa Temecula1; identical to SEQ ID NO: 50032
  CDS (1)..(2379)

SEQ ID NO: 57202 - protein, 792 aa, Xylella fastidiosa Temecula1; identical to SEQ ID NO: 50033

SEQ ID NO: 57203 - DNA, 2322 bp, Pseudomonas syringae pv. tomato str. DC3000; identical to SEQ ID NO: 50034
  CDS (1)..(2322)

SEQ ID NO: 57204 - protein, 773 aa, Pseudomonas syringae pv. tomato str. DC3000; identical to SEQ ID NO: 50035

SEQ ID NO: 57205 - DNA, 2571 bp, Vibrio parahaemolyticus RIMD 2210633; identical to SEQ ID NO: 50036
  CDS (1)..(2571)

SEQ ID NO: 57206 - protein, 856 aa, Vibrio parahaemolyticus RIMD 2210633; identical to SEQ ID NO: 50037

SEQ ID NO: 57207 - DNA, 2523 bp, Salmonella enterica subsp. enterica serovar Typhi Ty2; identical to SEQ ID NO: 50038
  CDS (1)..(2523)

SEQ ID NO: 57208 - protein, 840 aa, Salmonella enterica subsp. enterica serovar Typhi Ty2; identical to SEQ ID NO: 50039

SEQ ID NO: 57209 - DNA, 2187 bp, Enterococcus faecalis V583; identical to SEQ ID NO: 50040
  CDS (1)..(2187)

SEQ ID NO: 57210 - protein, 728 aa, Enterococcus faecalis V583; identical to SEQ ID NO: 50041

SEQ ID NO: 57211 - DNA, 2337 bp, Enterococcus faecalis V583; identical to SEQ ID NO: 50042
  CDS (1)..(2337)

SEQ ID NO: 57212 - protein, 778 aa, Enterococcus faecalis V583; identical to SEQ ID NO: 50043

SEQ ID NO: 57213 - DNA, 2382 bp, Coxiella burnetii RSA 493; identical to SEQ ID NO: 50044
  CDS (1)..(2382)

SEQ ID NO: 57214 - protein, 793 aa, Coxiella burnetii RSA 493; identical to SEQ ID NO: 50045

SEQ ID NO: 57215 - DNA, 2334 bp, Streptomyces avermitilis MA-4680; identical to SEQ ID NO: 50046
  CDS (1)..(2334)

SEQ ID NO: 57216 - protein, 777 aa, Streptomyces avermitilis MA-4680; identical to SEQ ID NO: 50047

SEQ ID NO: 57217 - DNA, 2226 bp, Streptomyces avermitilis MA-4680; identical to SEQ ID NO: 50048
  CDS (1)..(2226)

SEQ ID NO: 57218 - protein, 741 aa, Streptomyces avermitilis MA-4680; identical to SEQ ID NO: 50049

SEQ ID NO: 57219 - DNA, 2043 bp, Bacillus cereus ATCC 14579; identical to SEQ ID NO: 50050
  CDS (1)..(2043)

SEQ ID NO: 57220 - protein, 680 aa, Bacillus cereus ATCC 14579; identical to SEQ ID NO: 50051

SEQ ID NO: 57221 - DNA, 2493 bp, Bacillus cereus ATCC 14579; identical to SEQ ID NO: 50052
  CDS (1)..(2493)

SEQ ID NO: 57222 - protein, 830 aa, Bacillus cereus ATCC 14579; identical to SEQ ID NO: 50053

SEQ ID NO: 57223 - DNA, 2052 bp, Bacillus cereus ATCC 14579; identical to SEQ ID NO: 50054
  CDS (1)..(2052)

SEQ ID NO: 57224 - protein, 683 aa, Bacillus cereus ATCC 14579; identical to SEQ ID NO: 50055

SEQ ID NO: 57225 - DNA, 2010 bp, Helicobacter hepaticus ATCC 51449; identical to SEQ ID NO: 50056
  CDS (1)..(2010)

SEQ ID NO: 57226 - protein, 669 aa, Helicobacter hepaticus ATCC 51449; identical to SEQ ID NO: 50057

SEQ ID NO: 57227 - DNA, 1818 bp, Prochlorococcus marinus subsp. marinus str. CCMP1375; identical to SEQ ID NO: 50058
  CDS (1)..(1818)

SEQ ID NO: 57228 - protein, 605 aa, Prochlorococcus marinus subsp. marinus str. CCMP1375; identical to SEQ ID NO: 50059

SEQ ID NO: 57229 - DNA, 2343 bp, Candidatus Blochmannia floridanus; identical to SEQ ID NO: 50060
  CDS (1)..(2343)

SEQ ID NO: 57230 - protein, 780 aa, Candidatus Blochmannia floridanus; identical to SEQ ID NO: 50061

SEQ ID NO: 57231 - DNA, 1764 bp, Prochlorococcus marinus subsp. pastoris str. CCMP1986; identical to SEQ ID NO: 50062
  CDS (1)..(1764)

SEQ ID NO: 57232 - protein, 587 aa, Prochlorococcus marinus subsp. pastoris str. CCMP1986; identical to SEQ ID NO: 50063

SEQ ID NO: 57233 - DNA, 1977 bp, Prochlorococcus marinus str. MIT 9313; identical to SEQ ID NO: 50064
  CDS (1)..(1977)

SEQ ID NO: 57234 - protein, 658 aa, Prochlorococcus marinus str. MIT 9313; identical to SEQ ID NO: 50065

SEQ ID NO: 57235 - DNA, 2100 bp, Synechococcus sp. WH 8102; identical to SEQ ID NO: 50066
  CDS (1)..(2100)

SEQ ID NO: 57236 - protein, 699 aa, Synechococcus sp. WH 8102; identical to SEQ ID NO: 50067

SEQ ID NO: 57237 - DNA, 2364 bp, Chromobacterium violaceum ATCC 12472; identical to SEQ ID NO: 50068
  CDS (1)..(2364)

SEQ ID NO: 57238 - protein, 787 aa, Chromobacterium violaceum ATCC 12472; identical to SEQ ID NO: 50069

SEQ ID NO: 57239 - DNA, 1920 bp, Wolinella succinogenes DSM 1740; identical to SEQ ID NO: 50070
  CDS (1)..(1920)

SEQ ID NO: 57240 - protein, 639 aa, Wolinella succinogenes DSM 1740; identical to SEQ ID NO: 50071

SEQ ID NO: 57241 - DNA, 2121 bp, Gloeobacter violaceus PCC 7421; identical to SEQ ID NO: 50072
  CDS (1)..(2121)

SEQ ID NO: 57242 - protein, 706 aa, Gloeobacter violaceus PCC 7421; identical to SEQ ID NO: 50073

SEQ ID NO: 57243 - DNA, 2193 bp, Gloeobacter violaceus PCC 7421; identical to SEQ ID NO: 50074
  CDS (1)..(2193)

SEQ ID NO: 57244 - protein, 730 aa, Gloeobacter violaceus PCC 7421; identical to SEQ ID NO: 50075

SEQ ID NO: 57245 - DNA, 2457 bp, Photorhabdus luminescens subsp. laumondii TTO1; identical to SEQ ID NO: 50076
  CDS (1)..(2457)

SEQ ID NO: 57246 - protein, 818 aa, Photorhabdus luminescens subsp. laumondii TTO1; identical to SEQ ID NO: 50077

SEQ ID NO: 57247 - DNA, 2181 bp, Corynebacterium diphtheriae NCTC 13129; identical to SEQ ID NO: 50078
  CDS (1)..(2181)

SEQ ID NO: 57248 - protein, 726 aa, Corynebacterium diphtheriae NCTC 13129; identical to SEQ ID NO: 50079

SEQ ID NO: 57249 - DNA, 1947 bp, Rhodopseudomonas palustris CGA009; identical to SEQ ID NO: 50080
  CDS (1)..(1947)

SEQ ID NO: 57250 - protein, 648 aa, Rhodopseudomonas palustris CGA009; identical to SEQ ID NO: 50081

SEQ ID NO: 57251 - DNA, 2274 bp, Rhodopseudomonas palustris CGA009; identical to SEQ ID NO: 50082
  CDS (1)..(2274)

SEQ ID NO: 57252 - protein, 757 aa, Rhodopseudomonas palustris CGA009; identical to SEQ ID NO: 50083

SEQ ID NO: 57253 - DNA, 2499 bp, Rhodopseudomonas palustris CGA009; identical to SEQ ID NO: 50084
  CDS (1)..(2499)

SEQ ID NO: 57254 - protein, 832 aa, Rhodopseudomonas palustris CGA009; identical to SEQ ID NO: 50085

SEQ ID NO: 57255 - DNA, 1989 bp, Geobacter sulfurreducens PCA; identical to SEQ ID NO: 50086
  CDS (1)..(1989)

SEQ ID NO: 57256 - protein, 662 aa, Geobacter sulfurreducens PCA; identical to SEQ ID NO: 50087

SEQ ID NO: 57257 - DNA, 2391 bp, Geobacter sulfurreducens PCA; identical to SEQ ID NO: 50088
  CDS (1)..(2391)

SEQ ID NO: 57258 - protein, 796 aa, Geobacter sulfurreducens PCA; identical to SEQ ID NO: 50089

SEQ ID NO: 57259 - DNA, 2388 bp, Lactobacillus johnsonii NCC 533; identical to SEQ ID NO: 50090
  CDS (1)..(2388)

SEQ ID NO: 57260 - protein, 795 aa, Lactobacillus johnsonii NCC 533; identical to SEQ ID NO: 50091

SEQ ID NO: 57261 - DNA, 2058 bp, Lactobacillus johnsonii NCC 533; identical to SEQ ID NO: 50092
  CDS (1)..(2058)

SEQ ID NO: 57262 - protein, 685 aa, Lactobacillus johnsonii NCC 533; identical to SEQ ID NO: 50093

SEQ ID NO: 57263 - DNA, 2697 bp, Bdellovibrio bacteriovorus HD100; identical to SEQ ID NO: 50094
  CDS (1)..(2697)

SEQ ID NO: 57264 - protein, 898 aa, Bdellovibrio bacteriovorus HD100; identical to SEQ ID NO: 50095

SEQ ID NO: 57265 - DNA, 2373 bp, Bdellovibrio bacteriovorus HD100; identical to SEQ ID NO: 50096
  CDS (1)..(2373)

SEQ ID NO: 57266 - protein, 790 aa, Bdellovibrio bacteriovorus HD100; identical to SEQ ID NO: 50097

SEQ ID NO: 57267 - DNA, 2514 bp, Bacillus cereus ATCC 10987; identical to SEQ ID NO: 50098
  CDS (1)..(2514)

SEQ ID NO: 57268 - protein, 837 aa, Bacillus cereus ATCC 10987; identical to SEQ ID NO: 50099

SEQ ID NO: 57269 - DNA, 2496 bp, Yersinia pestis biovar Medievalis str. 91001; identical to SEQ ID NO: 50100
  CDS (1)..(2496)

SEQ ID NO: 57270 - protein, 831 aa, Yersinia pestis biovar Medievalis str. 91001; identical to SEQ ID NO: 50101

SEQ ID NO: 57271 - DNA, 2757 bp, Leptospira interrogans serovar Copenhageni str. Fiocruz L1-130; identical to SEQ ID NO: 50102
  CDS (1)..(2757)

SEQ ID NO: 57272 - protein, 918 aa, Leptospira interrogans serovar Copenhageni str. Fiocruz L1-130; identical to SEQ ID NO: 50103

SEQ ID NO: 57273 - DNA, 2088 bp, Thermus thermophilus HB27; identical to SEQ ID NO: 50104
  CDS (1)..(2088)

SEQ ID NO: 57274 - protein, 695 aa, Thermus thermophilus HB27; identical to SEQ ID NO: 50105

SEQ ID NO: 57275 - DNA, 2151 bp, Bartonella quintana str. Toulouse; identical to SEQ ID NO: 50106
  CDS (1)..(2151)

SEQ ID NO: 57276 - protein, 716 aa, Bartonella quintana str. Toulouse; identical to SEQ ID NO: 50107

SEQ ID NO: 57277 - DNA, 2463 bp, Bartonella quintana str. Toulouse; identical to SEQ ID NO: 50108
  CDS (1)..(2463)

SEQ ID NO: 57278 - protein, 820 aa, Bartonella quintana str. Toulouse; identical to SEQ ID NO: 50109

SEQ ID NO: 57279 - DNA, 2151 bp, Bartonella henselae str. Houston-1; identical to SEQ ID NO: 50110
  CDS (1)..(2151)

SEQ ID NO: 57280 - protein, 716 aa, Bartonella henselae str. Houston-1; identical to SEQ ID NO: 50111

SEQ ID NO: 57281 - DNA, 2463 bp, Bartonella henselae str. Houston-1; identical to SEQ ID NO: 50112
  CDS (1)..(2463)

SEQ ID NO: 57282 - protein, 820 aa, Bartonella henselae str. Houston-1; identical to SEQ ID NO: 50113

SEQ ID NO: 57283 - DNA, 2043 bp, Bacillus thuringiensis serovar konkukian str. 97-27; identical to SEQ ID NO: 50114
  CDS (1)..(2043)

SEQ ID NO: 57284 - protein, 680 aa, Bacillus thuringiensis serovar konkukian str. 97-27; identical to SEQ ID NO: 50115

SEQ ID NO: 57285 - DNA, 2505 bp, Bacillus thuringiensis serovar konkukian str. 97-27; identical to SEQ ID NO: 50116
  CDS (1)..(2505)

SEQ ID NO: 57286 - protein, 834 aa, Bacillus thuringiensis serovar konkukian str. 97-27; identical to SEQ ID NO: 50117

SEQ ID NO: 57287 - DNA, 2052 bp, Bacillus thuringiensis serovar konkukian str. 97-27; identical to SEQ ID NO: 50118
  CDS (1)..(2052)

SEQ ID NO: 57288 - protein, 683 aa, Bacillus thuringiensis serovar konkukian str. 97-27; identical to SEQ ID NO: 50119

SEQ ID NO: 57289 - DNA, 2559 bp, Acinetobacter sp. ADP1; identical to SEQ ID NO: 50120
  CDS (1)..(2559)

SEQ ID NO: 57290 - protein, 852 aa, Acinetobacter sp. ADP1; identical to SEQ ID NO: 50121

SEQ ID NO: 57291 - DNA, 2478 bp, Erwinia carotovora subsp. atroseptica SCRI1043; identical to SEQ ID NO: 50122
  CDS (1)..(2478)

SEQ ID NO: 57292 - protein, 825 aa, Erwinia carotovora subsp. atroseptica SCRI1043; identical to SEQ ID NO: 50123

SEQ ID NO: 57293 - DNA, 2346 bp, Propionibacterium acnes KPA171202; identical to SEQ ID NO: 50124
  CDS (1)..(2346)

SEQ ID NO: 57294 - protein, 781 aa, Propionibacterium acnes KPA171202; identical to SEQ ID NO: 50125

SEQ ID NO: 57295 - DNA, 2166 bp, Streptococcus pyogenes MGAS10394; identical to SEQ ID NO: 50126
  CDS (1)..(2166)

SEQ ID NO: 57296 - protein, 721 aa, Streptococcus pyogenes MGAS10394; identical to SEQ ID NO: 50127

SEQ ID NO: 57297 - DNA, 2487 bp, Desulfotalea psychrophila LSv54; identical to SEQ ID NO: 50128
  CDS (1)..(2487)

SEQ ID NO: 57298 - protein, 828 aa, Desulfotalea psychrophila LSv54; identical to SEQ ID NO: 50129

SEQ ID NO: 57299 - DNA, 2400 bp, Symbiobacterium thermophilum IAM 14863; identical to SEQ ID NO: 50130
  CDS (1)..(2400)

SEQ ID NO: 57300 - protein, 799 aa, Symbiobacterium thermophilum IAM 14863; identical to SEQ ID NO: 50131

SEQ ID NO: 57301 - DNA, 2574 bp, Symbiobacterium thermophilum IAM 14863; identical to SEQ ID NO: 50132
  CDS (1)..(2574)

SEQ ID NO: 57302 - protein, 857 aa, Symbiobacterium thermophilum IAM 14863; identical to SEQ ID NO: 50133

SEQ ID NO: 57303 - DNA, 2043 bp, Bacillus cereus ZK; identical to SEQ ID NO: 50134
  CDS (1)..(2043)

SEQ ID NO: 57304 - protein, 680 aa, Bacillus cereus ZK; identical to SEQ ID NO: 50135

SEQ ID NO: 57305 - DNA, 2508 bp, Bacillus cereus ZK; identical to SEQ ID NO: 50136
  CDS (1)..(2508)

SEQ ID NO: 57306 - protein, 835 aa, Bacillus cereus ZK; identical to SEQ ID NO: 50137

SEQ ID NO: 57307 - DNA, 2340 bp, Mannheimia succiniciproducens MBEL55E; identical to SEQ ID NO: 50138
  CDS (1)..(2340)

SEQ ID NO: 57308 - protein, 779 aa, Mannheimia succiniciproducens MBEL55E; identical to SEQ ID NO: 50139

SEQ ID NO: 57309 - DNA, 2622 bp, Mannheimia succiniciproducens MBEL55E; identical to SEQ ID NO: 50140
  CDS (1)..(2622)

SEQ ID NO: 57310 - protein, 873 aa, Mannheimia succiniciproducens MBEL55E; identical to SEQ ID NO: 50141

SEQ ID NO: 57311 - DNA, 2076 bp, Bacillus licheniformis ATCC 14580; identical to SEQ ID NO: 50142
  CDS (1)..(2076)

SEQ ID NO: 57312 - protein, 691 aa, Bacillus licheniformis ATCC 14580; identical to SEQ ID NO: 50143

SEQ ID NO: 57313 - DNA, 2385 bp, Legionella pneumophila subsp. pneumophila str. Philadelphia 1; identical to SEQ ID NO: 50144
  CDS (1)..(2385)

SEQ ID NO: 57314 - protein, 794 aa, Legionella pneumophila subsp. pneumophila str. Philadelphia 1; identical to SEQ ID NO: 50145

SEQ ID NO: 57315 - DNA, 2319 bp, Legionella pneumophila subsp. pneumophila str. Philadelphia 1; identical to SEQ ID NO: 50146
  CDS (1)..(2319)

SEQ ID NO: 57316 - protein, 772 aa, Legionella pneumophila subsp. pneumophila str. Philadelphia 1; identical to SEQ ID NO: 50147

SEQ ID NO: 57317 - DNA, 2559 bp, Burkholderia pseudomallei K96243; identical to SEQ ID NO: 50148
  CDS (1)..(2559)

SEQ ID NO: 57318 - protein, 852 aa, Burkholderia pseudomallei K96243; identical to SEQ ID NO: 50149

SEQ ID NO: 57319 - DNA, 2163 bp, Burkholderia pseudomallei K96243; identical to SEQ ID NO: 50150
  CDS (1)..(2163)

SEQ ID NO: 57320 - protein, 720 aa, Burkholderia pseudomallei K96243; identical to SEQ ID NO: 50151

SEQ ID NO: 57321 - DNA, 2493 bp, Methylococcus capsulatus str. Bath; identical to SEQ ID NO: 50152
  CDS (1)..(2493)

SEQ ID NO: 57322 - protein, 830 aa, Methylococcus capsulatus str. Bath; identical to SEQ ID NO: 50153

SEQ ID NO: 57323 - DNA, 2280 bp, Methylococcus capsulatus str. Bath; identical to SEQ ID NO: 50154
  CDS (1)..(2280)

SEQ ID NO: 57324 - protein, 759 aa, Methylococcus capsulatus str. Bath; identical to SEQ ID NO: 50155

SEQ ID NO: 57325 - DNA, 2370 bp, Nocardia farcinica IFM 10152; identical to SEQ ID NO: 50156
  CDS (1)..(2370)

SEQ ID NO: 57326 - protein, 789 aa, Nocardia farcinica IFM 10152; identical to SEQ ID NO: 50157

SEQ ID NO: 57327 - DNA, 2439 bp, Nocardia farcinica IFM 10152; identical to SEQ ID NO: 50158
  CDS (1)..(2439)

SEQ ID NO: 57328 - protein, 812 aa, Nocardia farcinica IFM 10152; identical to SEQ ID NO: 50159

SEQ ID NO: 57329 - DNA, 2385 bp, Legionella pneumophila str. Paris; identical to SEQ ID NO: 50160
  CDS (1)..(2385)

SEQ ID NO: 57330 - protein, 794 aa, Legionella pneumophila str. Paris; identical to SEQ ID NO: 50161

SEQ ID NO: 57331 - DNA, 2424 bp, Photobacterium profundum SS9; identical to SEQ ID NO: 50162
  CDS (1)..(2424)

SEQ ID NO: 57332 - protein, 807 aa, Photobacterium profundum SS9; identical to SEQ ID NO: 50163

SEQ ID NO: 57333 - DNA, 2391 bp, Photobacterium profundum SS9; identical to SEQ ID NO: 50164
  CDS (1)..(2391)

SEQ ID NO: 57334 - protein, 796 aa, Photobacterium profundum SS9; identical to SEQ ID NO: 50165

SEQ ID NO: 57335 - DNA, 2331 bp, Streptococcus thermophilus LMG 18311; identical to SEQ ID NO: 50166
  CDS (1)..(2331)

SEQ ID NO: 57336 - protein, 776 aa, Streptococcus thermophilus LMG 18311; identical to SEQ ID NO: 50167

SEQ ID NO: 57337 - DNA, 2328 bp, Streptococcus thermophilus CNRZ1066; identical to SEQ ID NO: 50168
  CDS (1)..(2328)

SEQ ID NO: 57338 - protein, 775 aa, Streptococcus thermophilus CNRZ1066; identical to SEQ ID NO: 50169

SEQ ID NO: 57339 - DNA, 2088 bp, Thermus thermophilus HB8; identical to SEQ ID NO: 50170
  CDS (1)..(2088)

SEQ ID NO: 57340 - protein, 695 aa, Thermus thermophilus HB8; identical to SEQ ID NO: 50171

SEQ ID NO: 57341 - DNA, 2046 bp, Geobacillus kaustophilus HTA426; identical to SEQ ID NO: 50172
  CDS (1)..(2046)

SEQ ID NO: 57342 - protein, 681 aa, Geobacillus kaustophilus HTA426; identical to SEQ ID NO: 50173

SEQ ID NO: 57343 - DNA, 2691 bp, Geobacillus kaustophilus HTA426; identical to SEQ ID NO: 50174
  CDS (1)..(2691)

SEQ ID NO: 57344 - protein, 896 aa, Geobacillus kaustophilus HTA426; identical to SEQ ID NO: 50175

SEQ ID NO: 57345 - DNA, 2577 bp, Salmonella enterica subsp. enterica serovar Paratypi A str. ATCC; identical to SEQ ID NO: 50176
  CDS (1)..(2577)

SEQ ID NO: 57346 - protein, 858 aa, Salmonella enterica subsp. enterica serovar Paratypi A str. ATCC; identical to SEQ ID NO: 50177

SEQ ID NO: 57347 - DNA, 2268 bp, Idiomarina loihiensis L2TR; identical to SEQ ID NO: 50178
  CDS (1)..(2268)

SEQ ID NO: 57348 - protein, 755 aa, Idiomarina loihiensis L2TR; identical to SEQ ID NO: 50179

SEQ ID NO: 57349 - DNA, 2373 bp, Azoarcus sp. EbN1; identical to SEQ ID NO: 50180
  CDS (1)..(2373)

SEQ ID NO: 57350 - protein, 790 aa, Azoarcus sp. EbN1; identical to SEQ ID NO: 50181

SEQ ID NO: 57351 - DNA, 2109 bp, Zymomonas mobilis subsp. mobilis ZM4; identical to SEQ ID NO: 50182
  CDS (1)..(2109)

SEQ ID NO: 57352 - protein, 702 aa, Zymomonas mobilis subsp. mobilis ZM4; identical to SEQ ID NO: 50183

SEQ ID NO: 57353 - DNA, 2367 bp, Silicibacter pomeroyi DSS-3; identical to SEQ ID NO: 50184
  CDS (1)..(2367)

SEQ ID NO: 57354 - protein, 788 aa, Silicibacter pomeroyi DSS-3; identical to SEQ ID NO: 50185

SEQ ID NO: 57355 - DNA, 2034 bp, Synechococcus elongatus PCC 6301; identical to SEQ ID NO: 50186
  CDS (1)..(2034)

SEQ ID NO: 57356 - protein, 677 aa, Synechococcus elongatus PCC 6301; identical to SEQ ID NO: 50187

SEQ ID NO: 57357 - DNA, 1878 bp, Synechococcus elongatus PCC 6301; identical to SEQ ID NO: 50188
  CDS (1)..(1878)

SEQ ID NO: 57358 - protein, 625 aa, Synechococcus elongatus PCC 6301; identical to SEQ ID NO: 50189

SEQ ID NO: 57359 - DNA, 1845 bp, Bacillus clausii KSM-K16; identical to SEQ ID NO: 50190
  CDS (1)..(1845)

SEQ ID NO: 57360 - protein, 614 aa, Bacillus clausii KSM-K16; identical to SEQ ID NO: 50191

SEQ ID NO: 57361 - DNA, 2148 bp, Bacillus clausii KSM-K16; identical to SEQ ID NO: 50192
  CDS (1)..(2148)

SEQ ID NO: 57362 - protein, 715 aa, Bacillus clausii KSM-K16; identical to SEQ ID NO: 50193

SEQ ID NO: 57363 - DNA, 2808 bp, Bacillus clausii KSM-K16; identical to SEQ ID NO: 50194
  CDS (1)..(2808)

SEQ ID NO: 57364 - protein, 935 aa, Bacillus clausii KSM-K16; identical to SEQ ID NO: 50195

SEQ ID NO: 57365 - DNA, 2322 bp, Bacillus clausii KSM-K16; identical to SEQ ID NO: 50196
  CDS (1)..(2322)

SEQ ID NO: 57366 - protein, 773 aa, Bacillus clausii KSM-K16; identical to SEQ ID NO: 50197

SEQ ID NO: 57367 - DNA, 1932 bp, Campylobacter jejuni RM1221; identical to SEQ ID NO: 50198
  CDS (1)..(1932)

SEQ ID NO: 57368 - protein, 643 aa, Campylobacter jejuni RM1221; identical to SEQ ID NO: 50199

SEQ ID NO: 57369 - DNA, 2025 bp, Rhodobacter sphaeroides 2.4.1; identical to SEQ ID NO: 50200
  CDS (1)..(2025)

SEQ ID NO: 57370 - protein, 674 aa, Rhodobacter sphaeroides 2.4.1; identical to SEQ ID NO: 50201

SEQ ID NO: 57371 - DNA, 1902 bp, Rhodobacter sphaeroides 2.4.1; identical to SEQ ID NO: 50202
  CDS (1)..(1902)

SEQ ID NO: 57372 - protein, 633 aa, Rhodobacter sphaeroides 2.4.1; identical to SEQ ID NO: 50203

SEQ ID NO: 57373 - DNA, 2427 bp, Xylella fastidiosa Dixon; identical to SEQ ID NO: 50204
  CDS (1)..(2427)

SEQ ID NO: 57374 - protein, 808 aa, Xylella fastidiosa Dixon; identical to SEQ ID NO: 50205

SEQ ID NO: 57375 - DNA, 1947 bp, Lactobacillus gasseri; identical to SEQ ID NO: 50206
  CDS (1)..(1947)

SEQ ID NO: 57376 - protein, 648 aa, Lactobacillus gasseri; identical to SEQ ID NO: 50207

SEQ ID NO: 57377 - DNA, 2193 bp, Leuconostoc mesenteroides subsp. mesenteroides ATCC 8293; identical to SEQ ID NO: 50208
  CDS (1)..(2193)

SEQ ID NO: 57378 - protein, 730 aa, Leuconostoc mesenteroides subsp. mesenteroides ATCC 8293; identical to SEQ ID NO: 50209

SEQ ID NO: 57379 - DNA, 2244 bp, Azotobacter vinelandii; identical to SEQ ID NO: 50210
  CDS (1)..(2244)

SEQ ID NO: 57380 - protein, 747 aa, Azotobacter vinelandii; identical to SEQ ID NO: 50211

SEQ ID NO: 57381 - DNA, 1974 bp, Nostoc punctiforme PCC 73102; identical to SEQ ID NO: 50212
  CDS (1)..(1974)

SEQ ID NO: 57382 - protein, 657 aa, Nostoc punctiforme PCC 73102; identical to SEQ ID NO: 50213

SEQ ID NO: 57383 - DNA, 1926 bp, Nostoc punctiforme PCC 73102; identical to SEQ ID NO: 50214
  CDS (1)..(1926)

SEQ ID NO: 57384 - protein, 641 aa, Nostoc punctiforme PCC 73102; identical to SEQ ID NO: 50215

SEQ ID NO: 57385 - DNA, 2268 bp, Nostoc punctiforme PCC 73102; identical to SEQ ID NO: 50216
  CDS (1)..(2268)

SEQ ID NO: 57386 - protein, 755 aa, Nostoc punctiforme PCC 73102; identical to SEQ ID NO: 50217

SEQ ID NO: 57387 - DNA, 1926 bp, Nostoc punctiforme PCC 73102; identical to SEQ ID NO: 50218
  CDS (1)..(1926)

SEQ ID NO: 57388 - protein, 641 aa, Nostoc punctiforme PCC 73102; identical to SEQ ID NO: 50219

SEQ ID NO: 57389 - DNA, 1932 bp, Nostoc punctiforme PCC 73102; identical to SEQ ID NO: 50220
  CDS (1)..(1932)

SEQ ID NO: 57390 - protein, 643 aa, Nostoc punctiforme PCC 73102; identical to SEQ ID NO: 50221

SEQ ID NO: 57391 - DNA, 2424 bp, Nostoc punctiforme PCC 73102; identical to SEQ ID NO: 50222
  CDS (1)..(2424)

SEQ ID NO: 57392 - protein, 807 aa, Nostoc punctiforme PCC 73102; identical to SEQ ID NO: 50223

SEQ ID NO: 57393 - DNA, 2361 bp, Nostoc punctiforme PCC 73102; identical to SEQ ID NO: 50224
  CDS (1)..(2361)

SEQ ID NO: 57394 - protein, 786 aa, Nostoc punctiforme PCC 73102; identical to SEQ ID NO: 50225

SEQ ID NO: 57395 - DNA, 2325 bp, Haemophilus somnus 2336; identical to SEQ ID NO: 50226
  CDS (1)..(2325)

SEQ ID NO: 57396 - protein, 774 aa, Haemophilus somnus 2336; identical to SEQ ID NO: 50227

SEQ ID NO: 57397 - DNA, 2541 bp, Haemophilus somnus 2336; identical to SEQ ID NO: 50228
  CDS (1)..(2541)

SEQ ID NO: 57398 - protein, 846 aa, Haemophilus somnus 2336; identical to SEQ ID NO: 50229

SEQ ID NO: 57399 - DNA, 2403 bp, Actinobacillus pleuropneumoniae serovar 1 str. 4074; identical to SEQ ID NO: 50230
  CDS (1)..(2403)

SEQ ID NO: 57400 - protein, 800 aa, Actinobacillus pleuropneumoniae serovar 1 str. 4074; identical to SEQ ID NO: 50231

SEQ ID NO: 57401 - DNA, 2325 bp, Pseudomonas aeruginosa UCBPP-PA14; identical to SEQ ID NO: 50232
  CDS (1)..(2325)

SEQ ID NO: 57402 - protein, 774 aa, Pseudomonas aeruginosa UCBPP-PA14; identical to SEQ ID NO: 50233

SEQ ID NO: 57403 - DNA, 2259 bp, Fusobacterium nucleatum subsp. vincentii ATCC 49256; identical to SEQ ID NO: 50234
  CDS (1)..(2259)

SEQ ID NO: 57404 - protein, 752 aa, Fusobacterium nucleatum subsp. vincentii ATCC 49256; identical to SEQ ID NO: 50235

SEQ ID NO: 57405 - DNA, 2484 bp, Psychrobacter sp. 273-4; identical to SEQ ID NO: 50236
  CDS (1)..(2484)

SEQ ID NO: 57406 - protein, 827 aa, Psychrobacter sp. 273-4; identical to SEQ ID NO: 50237

SEQ ID NO: 57407 - DNA, 2595 bp, Haemophilus influenzae R2846; identical to SEQ ID NO: 50238
  CDS (1)..(2595)

SEQ ID NO: 57408 - protein, 864 aa, Haemophilus influenzae R2846; identical to SEQ ID NO: 50239

SEQ ID NO: 57409 - DNA, 2259 bp, Anabaena variabilis ATCC 29413; identical to SEQ ID NO: 50240
  CDS (1)..(2259)

SEQ ID NO: 57410 - protein, 752 aa, Anabaena variabilis ATCC 29413; identical to SEQ ID NO: 50241

SEQ ID NO: 57411 - DNA, 2271 bp, Anabaena variabilis ATCC 29413; identical to SEQ ID NO: 50242
  CDS (1)..(2271)

SEQ ID NO: 57412 - protein, 756 aa, Anabaena variabilis ATCC 29413; identical to SEQ ID NO: 50243

SEQ ID NO: 57413 - DNA, 2139 bp, Synechococcus elongatus PCC 7942; identical to SEQ ID NO: 50244
  CDS (1)..(2139)

SEQ ID NO: 57414 - protein, 712 aa, Synechococcus elongatus PCC 7942; identical to SEQ ID NO: 50245

SEQ ID NO: 57415 - DNA, 2223 bp, Synechococcus elongatus PCC 7942; identical to SEQ ID NO: 50246
  CDS (1)..(2223)

SEQ ID NO: 57416 - protein, 740 aa, Synechococcus elongatus PCC 7942; identical to SEQ ID NO: 50247

SEQ ID NO: 57417 - DNA, 2376 bp, Ralstonia eutropha JMP134; identical to SEQ ID NO: 50248
  CDS (1)..(2376)

SEQ ID NO: 57418 - protein, 791 aa, Ralstonia eutropha JMP134; identical to SEQ ID NO: 50249

SEQ ID NO: 57419 - DNA, 2376 bp, Methylobacillus flagellatus KT; identical to SEQ ID NO: 50250
  CDS (1)..(2376)

SEQ ID NO: 57420 - protein, 791 aa, Methylobacillus flagellatus KT; identical to SEQ ID NO: 50251

SEQ ID NO: 57421 - DNA, 2223 bp, Crocosphaera watsonii WH 8501; identical to SEQ ID NO: 50252
  CDS (1)..(2223)

SEQ ID NO: 57422 - protein, 740 aa, Crocosphaera watsonii WH 8501; identical to SEQ ID NO: 50253

SEQ ID NO: 57423 - DNA, 1842 bp, Crocosphaera watsonii WH 8501; identical to SEQ ID NO: 50254
  CDS (1)..(1842)

SEQ ID NO: 57424 - protein, 613 aa, Crocosphaera watsonii WH 8501; identical to SEQ ID NO: 50255

SEQ ID NO: 57425 - DNA, 2694 bp, Exiguobacterium sp. 255-15; identical to SEQ ID NO: 50256
  CDS (1)..(2694)

SEQ ID NO: 57426 - protein, 897 aa, Exiguobacterium sp. 255-15; identical to SEQ ID NO: 50257

SEQ ID NO: 57427 - DNA, 1707 bp, Exiguobacterium sp. 255-15; identical to SEQ ID NO: 50258
  CDS (1)..(1707)

SEQ ID NO: 57428 - protein, 568 aa, Exiguobacterium sp. 255-15; identical to SEQ ID NO: 50259

SEQ ID NO: 57429 - DNA, 2037 bp, Rubrobacter xylanophilus DSM 9941; identical to SEQ ID NO: 50260
  CDS (1)..(2037)

SEQ ID NO: 57430 - protein, 678 aa, Rubrobacter xylanophilus DSM 9941; identical to SEQ ID NO: 50261

SEQ ID NO: 57431 - DNA, 1959 bp, Rubrobacter xylanophilus DSM 9941; identical to SEQ ID NO: 50262
  CDS (1)..(1959)

SEQ ID NO: 57432 - protein, 652 aa, Rubrobacter xylanophilus DSM 9941; identical to SEQ ID NO: 50263

SEQ ID NO: 57433 - DNA, 2145 bp, Mesorhizobium sp. BNC1; identical to SEQ ID NO: 50264
  CDS (1)..(2145)

SEQ ID NO: 57434 - protein, 714 aa, Mesorhizobium sp. BNC1; identical to SEQ ID NO: 50265

SEQ ID NO: 57435 - DNA, 2457 bp, Mesorhizobium sp. BNC1; identical to SEQ ID NO: 50266
  CDS (1)..(2457)

SEQ ID NO: 57436 - protein, 818 aa, Mesorhizobium sp. BNC1; identical to SEQ ID NO: 50267

SEQ ID NO: 57437 - DNA, 2040 bp, Mesorhizobium sp. BNC1; identical to SEQ ID NO: 50268
  CDS (1)..(2040)

SEQ ID NO: 57438 - protein, 679 aa, Mesorhizobium sp. BNC1; identical to SEQ ID NO: 50269

SEQ ID NO: 57439 - DNA, 2172 bp, Mesorhizobium sp. BNC1; identical to SEQ ID NO: 50270
  CDS (1)..(2172)

SEQ ID NO: 57440 - protein, 723 aa, Mesorhizobium sp. BNC1; identical to SEQ ID NO: 50271

SEQ ID NO: 57441 - DNA, 2064 bp, Burkholderia cepacia R18194; identical to SEQ ID NO: 50272
  CDS (1)..(2064)

SEQ ID NO: 57442 - protein, 687 aa, Burkholderia cepacia R18194; identical to SEQ ID NO: 50273

SEQ ID NO: 57443 - DNA, 2388 bp, Burkholderia cepacia R1808; identical to SEQ ID NO: 50274
  CDS (1)..(2388)

SEQ ID NO: 57444 - protein, 795 aa, Burkholderia cepacia R1808; identical to SEQ ID NO: 50275

SEQ ID NO: 57445 - DNA, 2145 bp, Listeria monocytogenes str. 4b H7858; identical to SEQ ID NO: 50276
  CDS (1)..(2145)

SEQ ID NO: 57446 - protein, 714 aa, Listeria monocytogenes str. 4b H7858; identical to SEQ ID NO: 50277

SEQ ID NO: 57447 - DNA, 2511 bp, Bacillus cereus G9241; identical to SEQ ID NO: 50278
  CDS (1)..(2511)

SEQ ID NO: 57448 - protein, 836 aa, Bacillus cereus G9241; identical to SEQ ID NO: 50279

SEQ ID NO: 57449 - DNA, 2706 bp, Bacillus cereus G9241; identical to SEQ ID NO: 50280
  CDS (1)..(2706)

SEQ ID NO: 57450 - protein, 901 aa, Bacillus cereus G9241; identical to SEQ ID NO: 50281

SEQ ID NO: 57451 - DNA, 2496 bp, Rhodospirillum rubrum; identical to SEQ ID NO: 50282
  CDS (1)..(2496)

SEQ ID NO: 57452 - protein, 831 aa, Rhodospirillum rubrum; identical to SEQ ID NO: 50283

SEQ ID NO: 57453 - DNA, 1929 bp, Rhodospirillum rubrum; identical to SEQ ID NO: 50284
  CDS (1)..(1929)

SEQ ID NO: 57454 - protein, 642 aa, Rhodospirillum rubrum; identical to SEQ ID NO: 50285

SEQ ID NO: 57455 - DNA, 2160 bp, Rhodospirillum rubrum; identical to SEQ ID NO: 50286
  CDS (1)..(2160)

SEQ ID NO: 57456 - protein, 719 aa, Rhodospirillum rubrum; identical to SEQ ID NO: 50287

SEQ ID NO: 57457 - DNA, 2319 bp, Ralstonia metallidurans CH34; identical to SEQ ID NO: 50288
  CDS (1)..(2319)

SEQ ID NO: 57458 - protein, 772 aa, Ralstonia metallidurans CH34; identical to SEQ ID NO: 50289

SEQ ID NO: 57459 - DNA, 2223 bp, Ralstonia metallidurans CH34; identical to SEQ ID NO: 50290
  CDS (1)..(2223)

SEQ ID NO: 57460 - protein, 740 aa, Ralstonia metallidurans CH34; identical to SEQ ID NO: 50291

SEQ ID NO: 57461 - DNA, 2064 bp, Ralstonia metallidurans CH34; identical to SEQ ID NO: 50292
  CDS (1)..(2064)

SEQ ID NO: 57462 - protein, 687 aa, Ralstonia metallidurans CH34; identical to SEQ ID NO: 50293

SEQ ID NO: 57463 - DNA, 2400 bp, Burkholderia fungorum LB400; identical to SEQ ID NO: 50294
  CDS (1)..(2400)

SEQ ID NO: 57464 - protein, 799 aa, Burkholderia fungorum LB400; identical to SEQ ID NO: 50295

SEQ ID NO: 57465 - DNA, 2376 bp, Burkholderia fungorum LB400; identical to SEQ ID NO: 50296
  CDS (1)..(2376)

SEQ ID NO: 57466 - protein, 791 aa, Burkholderia fungorum LB400; identical to SEQ ID NO: 50297

SEQ ID NO: 57467 - DNA, 2172 bp, Enterococcus faecium; identical to SEQ ID NO: 50298
  CDS (1)..(2172)

SEQ ID NO: 57468 - protein, 723 aa, Enterococcus faecium; identical to SEQ ID NO: 50299

SEQ ID NO: 57469 - DNA, 3390 bp, Thermobifida fusca; identical to SEQ ID NO: 50300
  CDS (1)..(3390)

SEQ ID NO: 57470 - protein, 1129 aa, Thermobifida fusca; identical to SEQ ID NO: 50301

SEQ ID NO: 57471 - DNA, 2193 bp, Thermobifida fusca; identical to SEQ ID NO: 50302
  CDS (1)..(2193)

SEQ ID NO: 57472 - protein, 730 aa, Thermobifida fusca; identical to SEQ ID NO: 50303

SEQ ID NO: 57473 - DNA, 2406 bp, Thermobifida fusca; identical to SEQ ID NO: 50304
  CDS (1)..(2406)

SEQ ID NO: 57474 - protein, 801 aa, Thermobifida fusca; identical to SEQ ID NO: 50305

SEQ ID NO: 57475 - DNA, 2055 bp, Novosphingobium aromaticivorans DSM 12444; identical to SEQ ID NO: 50306
  CDS (1)..(2055)

SEQ ID NO: 57476 - protein, 684 aa, Novosphingobium aromaticivorans DSM 12444; identical to SEQ ID NO: 50307

SEQ ID NO: 57477 - DNA, 2475 bp, Clostridium thermocellum ATCC 27405; identical to SEQ ID NO: 50308
  CDS (1)..(2475)

SEQ ID NO: 57478 - protein, 824 aa, Clostridium thermocellum ATCC 27405; identical to SEQ ID NO: 50309

SEQ ID NO: 57479 - DNA, 2238 bp, Microbulbifer degradans 2-40; identical to SEQ ID NO: 50310
  CDS (1)..(2238)

SEQ ID NO: 57480 - protein, 745 aa, Microbulbifer degradans 2-40; identical to SEQ ID NO: 50311

SEQ ID NO: 57481 - DNA, 1986 bp, Oenococcus oeni PSU-1; identical to SEQ ID NO: 50312
  CDS (1)..(1986)

SEQ ID NO: 57482 - protein, 661 aa, Oenococcus oeni PSU-1; identical to SEQ ID NO: 50313

SEQ ID NO: 57483 - DNA, 2640 bp, Oenococcus oeni PSU-1; identical to SEQ ID NO: 50314
  CDS (1)..(2640)

SEQ ID NO: 57484 - protein, 879 aa, Oenococcus oeni PSU-1; identical to SEQ ID NO: 50315

SEQ ID NO: 57485 - DNA, 2154 bp, Pediococcus pentosaceus ATCC 25745; identical to SEQ ID NO: 50316
  CDS (1)..(2154)

SEQ ID NO: 57486 - protein, 717 aa, Pediococcus pentosaceus ATCC 25745; identical to SEQ ID NO: 50317

SEQ ID NO: 57487 - DNA, 2310 bp, Pediococcus pentosaceus ATCC 25745; identical to SEQ ID NO: 50318
  CDS (1)..(2310)

SEQ ID NO: 57488 - protein, 769 aa, Pediococcus pentosaceus ATCC 25745; identical to SEQ ID NO: 50319

SEQ ID NO: 57489 - DNA, 2067 bp, Trichodesmium erythraeum IMS101; identical to SEQ ID NO: 50320
  CDS (1)..(2067)

SEQ ID NO: 57490 - protein, 688 aa, Trichodesmium erythraeum IMS101; identical to SEQ ID NO: 50321

SEQ ID NO: 57491 - DNA, 2289 bp, Trichodesmium erythraeum IMS101; identical to SEQ ID NO: 50322
  CDS (1)..(2289)

SEQ ID NO: 57492 - protein, 762 aa, Trichodesmium erythraeum IMS101; identical to SEQ ID NO: 50323

SEQ ID NO: 57493 - DNA, 1965 bp, Trichodesmium erythraeum IMS101; identical to SEQ ID NO: 50324
  CDS (1)..(1965)

SEQ ID NO: 57494 - protein, 654 aa, Trichodesmium erythraeum IMS101; identical to SEQ ID NO: 50325

SEQ ID NO: 57495 - DNA, 2664 bp, Moorella thermoacetica ATCC 39073; identical to SEQ ID NO: 50326
  CDS (1)..(2664)

SEQ ID NO: 57496 - protein, 887 aa, Moorella thermoacetica ATCC 39073; identical to SEQ ID NO: 50327

SEQ ID NO: 57497 - DNA, 2175 bp, Streptococcus suis 89/1591; identical to SEQ ID NO: 50328
  CDS (1)..(2175)

SEQ ID NO: 57498 - protein, 724 aa, Streptococcus suis 89/1591; identical to SEQ ID NO: 50329

SEQ ID NO: 57499 - DNA, 2208 bp, Silicibacter sp. TM1040; identical to SEQ ID NO: 50330
  CDS (1)..(2208)

SEQ ID NO: 57500 - protein, 735 aa, Silicibacter sp. TM1040; identical to SEQ ID NO: 50331

SEQ ID NO: 57501 - DNA, 2286 bp, Rubrobacter xylanophilus DSM 9941; identical to SEQ ID NO: 50332
  CDS (1)..(2286)

SEQ ID NO: 57502 - protein, 761 aa, Rubrobacter xylanophilus DSM 9941; identical to SEQ ID NO: 50333

SEQ ID NO: 57503 - DNA, 2946 bp, Chloroflexus aurantiacus; identical to SEQ ID NO: 50334
  CDS (1)..(2946)

SEQ ID NO: 57504 - protein, 981 aa, Chloroflexus aurantiacus; identical to SEQ ID NO: 50335

SEQ ID NO: 57505 - DNA, 2028 bp, Polaromonas sp. JS666; identical to SEQ ID NO: 50336
  CDS (1)..(2028)

SEQ ID NO: 57506 - protein, 675 aa, Polaromonas sp. JS666; identical to SEQ ID NO: 50337

SEQ ID NO: 57507 - DNA, 2271 bp, Streptococcus pyogenes M49 591; identical to SEQ ID NO: 50338
  CDS (1)..(2271)

SEQ ID NO: 57508 - protein, 756 aa, Streptococcus pyogenes M49 591; identical to SEQ ID NO: 50339

SEQ ID NO: 57509 - DNA, 1935 bp, Campylobacter lari RM2100; identical to SEQ ID NO: 50340
  CDS (1)..(1935)

SEQ ID NO: 57510 - protein, 644 aa, Campylobacter lari RM2100; identical to SEQ ID NO: 50341

SEQ ID NO: 57511 - DNA, 2541 bp, Citrobacter freundii; identical to SEQ ID NO: 50342
  CDS (1)..(2541)

SEQ ID NO: 57512 - protein, 846 aa, Citrobacter freundii; identical to SEQ ID NO: 50343

SEQ ID NO: 57513 - DNA, 2184 bp, Staphylococcus aureus; identical to SEQ ID NO: 50344
  CDS (1)..(2184)

SEQ ID NO: 57514 - protein, 727 aa, Staphylococcus aureus; identical to SEQ ID NO: 50345

SEQ ID NO: 57515 - DNA, 2292 bp, uncultured bacterium 311; identical to SEQ ID NO: 50346
  CDS (1)..(2292)

SEQ ID NO: 57516 - protein, 763 aa, uncultured bacterium 311; identical to SEQ ID NO: 50347

SEQ ID NO: 57517 - DNA, 2196 bp, Streptococcus pneumoniae; identical to SEQ ID NO: 50348
  CDS (1)..(2196)

SEQ ID NO: 57518 - protein, 731 aa, Streptococcus pneumoniae; identical to SEQ ID NO: 50349

SEQ ID NO: 57519 - DNA, 2196 bp, Streptococcus pneumoniae; identical to SEQ ID NO: 50350
  CDS (1)..(2196)

SEQ ID NO: 57520 - protein, 731 aa, Streptococcus pneumoniae; identical to SEQ ID NO: 50351

SEQ ID NO: 57521 - DNA, 2160 bp, Streptococcus pneumoniae; identical to SEQ ID NO: 50352
  CDS (1)..(2160)

SEQ ID NO: 57522 - protein, 719 aa, Streptococcus pneumoniae; identical to SEQ ID NO: 50353

SEQ ID NO: 57523 - DNA, 2160 bp, Streptococcus pneumoniae; identical to SEQ ID NO: 50354
  CDS (1)..(2160)

SEQ ID NO: 57524 - protein, 719 aa, Streptococcus pneumoniae; identical to SEQ ID NO: 50355

SEQ ID NO: 57525 - DNA, 2112 bp, Streptococcus pneumoniae; identical to SEQ ID NO: 50356
  CDS (1)..(2112)

SEQ ID NO: 57526 - protein, 703 aa, Streptococcus pneumoniae; identical to SEQ ID NO: 50357

SEQ ID NO: 57527 - DNA, 2223 bp, Streptococcus gordonii; identical to SEQ ID NO: 50358
  CDS (1)..(2223)

SEQ ID NO: 57528 - protein, 740 aa, Streptococcus gordonii; identical to SEQ ID NO: 50359

SEQ ID NO: 57529 - DNA, 1980 bp, Helicobacter pylori; identical to SEQ ID NO: 50360
  CDS (1)..(1980)

SEQ ID NO: 57530 - protein, 659 aa, Helicobacter pylori; identical to SEQ ID NO: 50361

SEQ ID NO: 57531 - DNA, 2184 bp, Staphylococcus aureus; identical to SEQ ID NO: 50362
  CDS (1)..(2184)

SEQ ID NO: 57532 - protein, 727 aa, Staphylococcus aureus; identical to SEQ ID NO: 50363

SEQ ID NO: 57533 - DNA, 1983 bp, Helicobacter pylori; identical to SEQ ID NO: 50364
  CDS (1)..(1983)

SEQ ID NO: 57534 - protein, 660 aa, Helicobacter pylori; identical to SEQ ID NO: 50365

SEQ ID NO: 57535 - DNA, 1980 bp, Helicobacter pylori; identical to SEQ ID NO: 50366
  CDS (1)..(1980)

SEQ ID NO: 57536 - protein, 659 aa, Helicobacter pylori; identical to SEQ ID NO: 50367

SEQ ID NO: 57537 - DNA, 2382 bp, Enterococcus hirae; identical to SEQ ID NO: 50368
  CDS (1)..(2382)

SEQ ID NO: 57538 - protein, 793 aa, Enterococcus hirae; identical to SEQ ID NO: 50369

SEQ ID NO: 57539 - DNA, 2148 bp, Mycobacterium smegmatis; identical to SEQ ID NO: 50370
  CDS (1)..(2148)

SEQ ID NO: 57540 - protein, 715 aa, Mycobacterium smegmatis; identical to SEQ ID NO: 50371

SEQ ID NO: 57541 - DNA, 2160 bp, Streptococcus pneumoniae; identical to SEQ ID NO: 50372
  CDS (1)..(2160)

SEQ ID NO: 57542 - protein, 719 aa, Streptococcus pneumoniae; identical to SEQ ID NO: 50373

SEQ ID NO: 57543 - DNA, 2160 bp, Streptococcus pneumoniae; identical to SEQ ID NO: 50374
  CDS (1)..(2160)

SEQ ID NO: 57544 - protein, 719 aa, Streptococcus pneumoniae; identical to SEQ ID NO: 50375

SEQ ID NO: 57545 - DNA, 2160 bp, Streptococcus pneumoniae; identical to SEQ ID NO: 50376
  CDS (1)..(2160)

SEQ ID NO: 57546 - protein, 719 aa, Streptococcus pneumoniae; identical to SEQ ID NO: 50377

SEQ ID NO: 57547 - DNA, 2160 bp, Streptococcus pneumoniae; identical to SEQ ID NO: 50378
  CDS (1)..(2160)

SEQ ID NO: 57548 - protein, 719 aa, Streptococcus pneumoniae; identical to SEQ ID NO: 50379

SEQ ID NO: 57549 - DNA, 2181 bp, Aquifex aeolicus; identical to SEQ ID NO: 50380
  CDS (1)..(2181)

SEQ ID NO: 57550 - protein, 726 aa, Aquifex aeolicus; identical to SEQ ID NO: 50381

SEQ ID NO: 57551 - DNA, 2745 bp, Bacillus subtilis; identical to SEQ ID NO: 50382
  CDS (1)..(2745)

SEQ ID NO: 57552 - protein, 914 aa, Bacillus subtilis; identical to SEQ ID NO: 50383

SEQ ID NO: 57553 - DNA, 2553 bp, Escherichia coli; identical to SEQ ID NO: 50384
  CDS (1)..(2553)

SEQ ID NO: 57554 - protein, 850 aa, Escherichia coli; identical to SEQ ID NO: 50385

SEQ ID NO: 57555 - DNA, 2397 bp, Neisseria flavescens; identical to SEQ ID NO: 50386
  CDS (1)..(2397)

SEQ ID NO: 57556 - protein, 798 aa, Neisseria flavescens; identical to SEQ ID NO: 50387

SEQ ID NO: 57557 - DNA, 2397 bp, Neisseria lactamica; identical to SEQ ID NO: 50388
  CDS (1)..(2397)

SEQ ID NO: 57558 - protein, 798 aa, Neisseria lactamica; identical to SEQ ID NO: 50389

SEQ ID NO: 57559 - DNA, 2283 bp, Buchnera aphidicola; identical to SEQ ID NO: 50390
  CDS (1)..(2283)

SEQ ID NO: 57560 - protein, 760 aa, Buchnera aphidicola; identical to SEQ ID NO: 50391

SEQ ID NO: 57561 - DNA, 2346 bp, Haemophilus influenzae; identical to SEQ ID NO: 50392
  CDS (1)..(2346)

SEQ ID NO: 57562 - protein, 781 aa, Haemophilus influenzae; identical to SEQ ID NO: 50393

SEQ ID NO: 57563 - DNA, 2334 bp, Vibrio cholerae; identical to SEQ ID NO: 50394
  CDS (1)..(2334)

SEQ ID NO: 57564 - protein, 777 aa, Vibrio cholerae; identical to SEQ ID NO: 50395

SEQ ID NO: 57565 - DNA, 19 bp, Primer
atggccgggaatgaccgcg

SEQ ID NO: 57566 - DNA, 28 bp, Primer
ttaattactaccaaacatatccttgatc

SEQ ID NO: 57567 - protein, 968 aa, consensus; identical to SEQ ID NO: 50398
  MISC_FEATURE (1)..(968): consensus for the disclosure of xaa see table XV

SEQ ID NO: 57568 - protein, 164 aa, consensus; identical to SEQ ID NO: 50399
  MISC_FEATURE (1)..(164): consensus for the disclosure of xaa see table XV

SEQ ID NO: 57569 - protein, 44 aa, consensus; identical to SEQ ID NO: 50400
  MISC_FEATURE (1)..(44): consensus for the disclosure of xaa see table XV

SEQ ID NO: 57570 - protein, 104 aa, consensus; identical to SEQ ID NO: 50401
  MISC_FEATURE (1)..(104): consensus for the disclosure of xaa see table XV

SEQ ID NO: 57571 - protein, 71 aa, consensus; identical to SEQ ID NO: 50402
  MISC_FEATURE (1)..(71): consensus for the disclosure of xaa see table XV

SEQ ID NO: 57572 - DNA, 1425 bp, Escherichia coli K12; identical to SEQ ID NO: 28717
  CDS (1)..(1425)

SEQ ID NO: 57573 - protein, 474 aa, Escherichia coli K12; identical to SEQ ID NO: 28718

SEQ ID NO: 57574 - DNA, 1401 bp, Haemophilus influenzae; identical to SEQ ID NO: 28719
  CDS (1)..(1401)

SEQ ID NO: 57575 - protein, 466 aa, Haemophilus influenzae; identical to SEQ ID NO: 28720

SEQ ID NO: 57576 - DNA, 1350 bp, Bacillus subtilis; identical to SEQ ID NO: 28721
  CDS (1)..(1350)

SEQ ID NO: 57577 - protein, 449 aa, Bacillus subtilis; identical to SEQ ID NO: 28722

SEQ ID NO: 57578 - DNA, 1545 bp, Xylella fastidiosa; identical to SEQ ID NO: 28723
  CDS (1)..(1545)

SEQ ID NO: 57579 - protein, 514 aa, Xylella fastidiosa; identical to SEQ ID NO: 28724

SEQ ID NO: 57580 - DNA, 1251 bp, Nostoc sp. PCC 7120; identical to SEQ ID NO: 28725
  CDS (1)..(1251)

SEQ ID NO: 57581 - protein, 416 aa, Nostoc sp. PCC 7120; identical to SEQ ID NO: 28726

SEQ ID NO: 57582 - DNA, 1428 bp, Salmonella enterica subsp. enterica serovar Typhi; identical to SEQ ID NO: 28727
  CDS (1)..(1428)

SEQ ID NO: 57583 - protein, 475 aa, Salmonella enterica subsp. enterica serovar Typhi; identical to SEQ ID NO: 28728

SEQ ID NO: 57584 - DNA, 1290 bp, Nostoc sp. PCC 7120; identical to SEQ ID NO: 28729
  CDS (1)..(1290)

SEQ ID NO: 57585 - protein, 429 aa, Nostoc sp. PCC 7120; identical to SEQ ID NO: 28730

SEQ ID NO: 57586 - DNA, 1206 bp, Nostoc sp. PCC 7120; identical to SEQ ID NO: 28731
  CDS (1)..(1206)

SEQ ID NO: 57587 - protein, 401 aa, Nostoc sp. PCC 7120; identical to SEQ ID NO: 28732

SEQ ID NO: 57588 - DNA, 1545 bp, Agrobacterium tumefaciens; identical to SEQ ID NO: 28733
  CDS (1)..(1545)

SEQ ID NO: 57589 - protein, 514 aa, Agrobacterium tumefaciens; identical to SEQ ID NO: 28734

SEQ ID NO: 57590 - DNA, 1446 bp, Yersinia pestis; identical to SEQ ID NO: 28735
  CDS (1)..(1446)

SEQ ID NO: 57591 - protein, 481 aa, Yersinia pestis; identical to SEQ ID NO: 28736

SEQ ID NO: 57592 - DNA, 1572 bp, Agrobacterium tumefaciens; identical to SEQ ID NO: 28737
  CDS (1)..(1572)

SEQ ID NO: 57593 - protein, 523 aa, Agrobacterium tumefaciens; identical to SEQ ID NO: 28738

SEQ ID NO: 57594 - DNA, 1407 bp, Agrobacterium tumefaciens; identical to SEQ ID NO: 28739
  CDS (1)..(1407)

SEQ ID NO: 57595 - protein, 468 aa, Agrobacterium tumefaciens; identical to SEQ ID NO: 28740

SEQ ID NO: 57596 - DNA, 1425 bp, Brucella melitensis; identical to SEQ ID NO: 28741
  CDS (1)..(1425)

SEQ ID NO: 57597 - protein, 474 aa, Brucella melitensis; identical to SEQ ID NO: 28742

SEQ ID NO: 57598 - DNA, 1362 bp, Aquifex aeolicus; identical to SEQ ID NO: 28743
  CDS (1)..(1362)

SEQ ID NO: 57599 - protein, 453 aa, Aquifex aeolicus; identical to SEQ ID NO: 28744

SEQ ID NO: 57600 - DNA, 1500 bp, Neisseria meningitidis; identical to SEQ ID NO: 28745
  CDS (1)..(1500)

SEQ ID NO: 57601 - protein, 499 aa, Neisseria meningitidis; identical to SEQ ID NO: 28746

SEQ ID NO: 57602 - DNA, 1170 bp, Pseudomonas aeruginosa; identical to SEQ ID NO: 28747
  CDS (1)..(1170)

SEQ ID NO: 57603 - protein, 389 aa, Pseudomonas aeruginosa; identical to SEQ ID NO: 28748

SEQ ID NO: 57604 - DNA, 1407 bp, Sinorhizobium meliloti; identical to SEQ ID NO: 28749
  CDS (1)..(1407)

SEQ ID NO: 57605 - protein, 468 aa, Sinorhizobium meliloti; identical to SEQ ID NO: 28750

SEQ ID NO: 57606 - DNA, 1332 bp, Helicobacter pylori; identical to SEQ ID NO: 28751
  CDS (1)..(1332)

SEQ ID NO: 57607 - protein, 443 aa, Helicobacter pylori; identical to SEQ ID NO: 28752

SEQ ID NO: 57608 - DNA, 1419 bp, Caulobacter crescentus; identical to SEQ ID NO: 28753
  CDS (1)..(1419)

SEQ ID NO: 57609 - protein, 472 aa, Caulobacter crescentus; identical to SEQ ID NO: 28754

SEQ ID NO: 57610 - DNA, 1446 bp, Xylella fastidiosa; identical to SEQ ID NO: 28755
  CDS (1)..(1446)

SEQ ID NO: 57611 - protein, 481 aa, Xylella fastidiosa; identical to SEQ ID NO: 28756

SEQ ID NO: 57612 - DNA, 1458 bp, Treponema pallidum subsp. pallidum (syphilis spirochete); identical to SEQ ID NO: 28757
  CDS (1)..(1458)

SEQ ID NO: 57613 - protein, 485 aa, Treponema pallidum subsp. pallidum (syphilis spirochete); identical to SEQ ID NO: 28758

SEQ ID NO: 57614 - DNA, 1380 bp, Thermotoga maritima; identical to SEQ ID NO: 28759
  CDS (1)..(1380)

SEQ ID NO: 57615 - protein, 459 aa, Thermotoga maritima; identical to SEQ ID NO: 28760

SEQ ID NO: 57616 - DNA, 1371 bp, Vibrio cholerae; identical to SEQ ID NO: 28761
  CDS (1)..(1371)

SEQ ID NO: 57617 - protein, 456 aa, Vibrio cholerae; identical to SEQ ID NO: 28762

SEQ ID NO: 57618 - DNA, 1961 bp, Pseudomonas aeruginosa; identical to SEQ ID NO: 28763
  CDS (496)..(1920)

SEQ ID NO: 57619 - protein, 474 aa, Pseudomonas aeruginosa; identical to SEQ ID NO: 28764

SEQ ID NO: 57620 - DNA, 1593 bp, Caulobacter crescentus; identical to SEQ ID NO: 28765
  CDS (1)..(1593)

SEQ ID NO: 57621 - protein, 530 aa, Caulobacter crescentus; identical to SEQ ID NO: 28766

SEQ ID NO: 57622 - DNA, 1536 bp, Rickettsia conorii; identical to SEQ ID NO: 28767
  CDS (1)..(1536)

SEQ ID NO: 57623 - protein, 511 aa, Rickettsia conorii; identical to SEQ ID NO: 28768

SEQ ID NO: 57624 - DNA, 1452 bp, Borrelia burgdorferi (Lyme disease spirochete); identical to SEQ ID NO: 28769
  CDS (1)..(1452)

SEQ ID NO: 57625 - protein, 483 aa, Borrelia burgdorferi (Lyme disease spirochete); identical to SEQ ID NO: 28770

SEQ ID NO: 57626 - DNA, 1494 bp, Chlamydia trachomatis; identical to SEQ ID NO: 28771
  CDS (1)..(1494)

SEQ ID NO: 57627 - protein, 497 aa, Chlamydia trachomatis; identical to SEQ ID NO: 28772

SEQ ID NO: 57628 - DNA, 1431 bp, Helicobacter pylori; identical to SEQ ID NO: 28773
  CDS (1)..(1431)

SEQ ID NO: 57629 - protein, 476 aa, Helicobacter pylori; identical to SEQ ID NO: 28774

SEQ ID NO: 57630 - DNA, 1302 bp, Clostridium acetobutylicum; identical to SEQ ID NO: 28775
  CDS (1)..(1302)

SEQ ID NO: 57631 - protein, 433 aa, Clostridium acetobutylicum; identical to SEQ ID NO: 28776

SEQ ID NO: 57632 - DNA, 2009 bp, Brucella abortus; identical to SEQ ID NO: 28777
  CDS (275)..(1816)

SEQ ID NO: 57633 - protein, 513 aa, Brucella abortus; identical to SEQ ID NO: 28778

SEQ ID NO: 57634 - DNA, 1185 bp, Synechocystis sp; identical to SEQ ID NO: 28779
  CDS (1)..(1185)

SEQ ID NO: 57635 - protein, 394 aa, Synechocystis sp; identical to SEQ ID NO: 28780

SEQ ID NO: 57636 - DNA, 1251 bp, Synechocystis sp; identical to SEQ ID NO: 28781
  CDS (1)..(1251)

SEQ ID NO: 57637 - protein, 416 aa, Synechocystis sp; identical to SEQ ID NO: 28782

SEQ ID NO: 57638 - DNA, 1359 bp, Synechocystis sp; identical to SEQ ID NO: 28783
  CDS (1)..(1359)

SEQ ID NO: 57639 - protein, 452 aa, Synechocystis sp; identical to SEQ ID NO: 28784

SEQ ID NO: 57640 - DNA, 1740 bp, Lactococcus lactis; identical to SEQ ID NO: 28785
  CDS (230)..(1456)

SEQ ID NO: 57641 - protein, 408 aa, Lactococcus lactis; identical to SEQ ID NO: 28786

SEQ ID NO: 57642 - DNA, 1383 bp, Rhodobacter capsulatus; identical to SEQ ID NO: 28787
  CDS (1)..(1383)

SEQ ID NO: 57643 - protein, 460 aa, Rhodobacter capsulatus; identical to SEQ ID NO: 28788

SEQ ID NO: 57644 - DNA, 1392 bp, Haemophilus influenzae; identical to SEQ ID NO: 28789
  CDS (1)..(1392)

SEQ ID NO: 57645 - protein, 463 aa, Haemophilus influenzae; identical to SEQ ID NO: 28790

SEQ ID NO: 57646 - DNA, 1800 bp, Yersinia enterocolitica; identical to SEQ ID NO: 28791
  CDS (244)..(1680)

SEQ ID NO: 57647 - protein, 478 aa, Yersinia enterocolitica; identical to SEQ ID NO: 28792

SEQ ID NO: 57648 - DNA, 2027 bp, Azotobacter vinelandii; identical to SEQ ID NO: 28793
  CDS (483)..(1904)

SEQ ID NO: 57649 - protein, 473 aa, Azotobacter vinelandii; identical to SEQ ID NO: 28794

SEQ ID NO: 57650 - DNA, 1905 bp, Brucella abortus; identical to SEQ ID NO: 28795
  CDS (333)..(1835)

SEQ ID NO: 57651 - protein, 500 aa, Brucella abortus; identical to SEQ ID NO: 28796

SEQ ID NO: 57652 - DNA, 1466 bp, Campylobacter jejuni; identical to SEQ ID NO: 28797
  CDS (48)..(1466)

SEQ ID NO: 57653 - protein, 472 aa, Campylobacter jejuni; identical to SEQ ID NO: 28798

SEQ ID NO: 57654 - DNA, 1191 bp, Pseudomonas aeruginosa; identical to SEQ ID NO: 28799
  CDS (14)..(1183)

SEQ ID NO: 57655 - protein, 389 aa, Pseudomonas aeruginosa; identical to SEQ ID NO: 28800

SEQ ID NO: 57656 - DNA, 1488 bp, Burkholderia mallei ATCC 23344; identical to SEQ ID NO: 28801
  CDS (1)..(1488)

SEQ ID NO: 57657 - protein, 495 aa, Burkholderia mallei ATCC 23344; identical to SEQ ID NO: 28802

SEQ ID NO: 57658 - DNA, 1209 bp, Burkholderia pseudomallei K96243; identical to SEQ ID NO: 28803
  CDS (1)..(1209)

SEQ ID NO: 57659 - protein, 402 aa, Burkholderia pseudomallei K96243; identical to SEQ ID NO: 28804

SEQ ID NO: 57660 - DNA, 1458 bp, Burkholderia pseudomallei K96243; identical to SEQ ID NO: 28805
  CDS (1)..(1458)

SEQ ID NO: 57661 - protein, 485 aa, Burkholderia pseudomallei K96243; identical to SEQ ID NO: 28806

SEQ ID NO: 57662 - DNA, 1557 bp, Burkholderia pseudomallei K96243; identical to SEQ ID NO: 28807
  CDS (1)..(1557)

SEQ ID NO: 57663 - protein, 518 aa, Burkholderia pseudomallei K96243; identical to SEQ ID NO: 28808

SEQ ID NO: 57664 - DNA, 1419 bp, Burkholderia pseudomallei K96243; identical to SEQ ID NO: 28809
  CDS (1)..(1419)

SEQ ID NO: 57665 - protein, 472 aa, Burkholderia pseudomallei K96243; identical to SEQ ID NO: 28810

SEQ ID NO: 57666 - DNA, 1566 bp, Bacteroides fragilis; identical to SEQ ID NO: 28811
  CDS (19)..(1566)

SEQ ID NO: 57667 - protein, 515 aa, Bacteroides fragilis; identical to SEQ ID NO: 28812

SEQ ID NO: 57668 - DNA, 2358 bp, Bacillus licheniformis DSM 13; identical to SEQ ID NO: 28813
  CDS (501)..(1871)

SEQ ID NO: 57669 - protein, 456 aa, Bacillus licheniformis DSM 13; identical to SEQ ID NO: 28814

SEQ ID NO: 57670 - DNA, 1470 bp, Mannheimia succiniciproducens MBEL55E; identical to SEQ ID NO: 28815
  CDS (1)..(1470)

SEQ ID NO: 57671 - protein, 489 aa, Mannheimia succiniciproducens MBEL55E; identical to SEQ ID NO: 28816

SEQ ID NO: 57672 - DNA, 1425 bp, Borrelia garinii PBi; identical to SEQ ID NO: 28817
  CDS (1)..(1425)

SEQ ID NO: 57673 - protein, 474 aa, Borrelia garinii PBi; identical to SEQ ID NO: 28818

SEQ ID NO: 57674 - DNA, 1224 bp, Lactococcus lactis; identical to SEQ ID NO: 28819
  CDS (1)..(1224)

SEQ ID NO: 57675 - protein, 407 aa, Lactococcus lactis; identical to SEQ ID NO: 28820

SEQ ID NO: 57676 - DNA, 1557 bp, Rickettsia typhi; identical to SEQ ID NO: 28821
  CDS (1)..(1557)

SEQ ID NO: 57677 - protein, 518 aa, Rickettsia typhi; identical to SEQ ID NO: 28822

SEQ ID NO: 57678 - DNA, 1485 bp, Onchocerca volvulus endobacterium; identical to SEQ ID NO: 28823
  CDS (1)..(1485)

SEQ ID NO: 57679 - protein, 494 aa, Onchocerca volvulus endobacterium; identical to SEQ ID NO: 28824

SEQ ID NO: 57680 - DNA, 1455 bp, Desulfotalea psychrophila; identical to SEQ ID NO: 28825
  CDS (1)..(1455)

SEQ ID NO: 57681 - protein, 484 aa, Desulfotalea psychrophila; identical to SEQ ID NO: 28826

SEQ ID NO: 57682 - DNA, 1467 bp, Erwinia carotovora; identical to SEQ ID NO: 28827
  CDS (1)..(1467)

SEQ ID NO: 57683 - protein, 488 aa, Erwinia carotovora; identical to SEQ ID NO: 28828

SEQ ID NO: 57684 - DNA, 1371 bp, Erwinia carotovora; identical to SEQ ID NO: 28829
  CDS (1)..(1371)

SEQ ID NO: 57685 - protein, 456 aa, Erwinia carotovora; identical to SEQ ID NO: 28830

SEQ ID NO: 57686 - DNA, 1404 bp, Acinetobacter sp; identical to SEQ ID NO: 28831
  CDS (1)..(1404)

SEQ ID NO: 57687 - protein, 467 aa, Acinetobacter sp; identical to SEQ ID NO: 28832

SEQ ID NO: 57688 - DNA, 1518 bp, Bartonella quintana; identical to SEQ ID NO: 28833
  CDS (1)..(1518)

SEQ ID NO: 57689 - protein, 505 aa, Bartonella quintana; identical to SEQ ID NO: 28834

SEQ ID NO: 57690 - DNA, 1395 bp, Bartonella quintana; identical to SEQ ID NO: 28835
  CDS (1)..(1395)

SEQ ID NO: 57691 - protein, 464 aa, Bartonella quintana; identical to SEQ ID NO: 28836

SEQ ID NO: 57692 - DNA, 1512 bp, Bartonella quintana; identical to SEQ ID NO: 28837
  CDS (1)..(1512)

SEQ ID NO: 57693 - protein, 503 aa, Bartonella quintana; identical to SEQ ID NO: 28838

SEQ ID NO: 57694 - DNA, 1518 bp, Bartonella henselae; identical to SEQ ID NO: 28839
  CDS (1)..(1518)

SEQ ID NO: 57695 - protein, 505 aa, Bartonella henselae; identical to SEQ ID NO: 28840

SEQ ID NO: 57696 - DNA, 1392 bp, Bartonella henselae; identical to SEQ ID NO: 28841
  CDS (1)..(1392)

SEQ ID NO: 57697 - protein, 463 aa, Bartonella henselae; identical to SEQ ID NO: 28842

SEQ ID NO: 57698 - DNA, 1368 bp, Photobacterium profundum; identical to SEQ ID NO: 28843
  CDS (1)..(1368)

SEQ ID NO: 57699 - protein, 455 aa, Photobacterium profundum; identical to SEQ ID NO: 28844

SEQ ID NO: 57700 - DNA, 1455 bp, Parachlamydia sp; identical to SEQ ID NO: 28845
  CDS (1)..(1455)

SEQ ID NO: 57701 - protein, 484 aa, Parachlamydia sp; identical to SEQ ID NO: 28846

SEQ ID NO: 57702 - DNA, 1563 bp, Rhodopseudomonas palustris; identical to SEQ ID NO: 28847
  CDS (1)..(1563)

SEQ ID NO: 57703 - protein, 520 aa, Rhodopseudomonas palustris; identical to SEQ ID NO: 28848

SEQ ID NO: 57704 - DNA, 1506 bp, Rhodopseudomonas palustris; identical to SEQ ID NO: 28849
  CDS (1)..(1506)

SEQ ID NO: 57705 - protein, 501 aa, Rhodopseudomonas palustris; identical to SEQ ID NO: 28850

SEQ ID NO: 57706 - DNA, 1200 bp, Rhodopseudomonas palustris; identical to SEQ ID NO: 28851
  CDS (1)..(1200)

SEQ ID NO: 57707 - protein, 399 aa, Rhodopseudomonas palustris; identical to SEQ ID NO: 28852

SEQ ID NO: 57708 - DNA, 1392 bp, Rhodopseudomonas palustris; identical to SEQ ID NO: 28853
  CDS (1)..(1392)

SEQ ID NO: 57709 - protein, 463 aa, Rhodopseudomonas palustris; identical to SEQ ID NO: 28854

SEQ ID NO: 57710 - DNA, 1572 bp, Rhodopseudomonas palustris; identical to SEQ ID NO: 28855
  CDS (1)..(1572)

SEQ ID NO: 57711 - protein, 523 aa, Rhodopseudomonas palustris; identical to SEQ ID NO: 28856

SEQ ID NO: 57712 - DNA, 1401 bp, uncultured bacterium 580; identical to SEQ ID NO: 28857
  CDS (1)..(1401)

SEQ ID NO: 57713 - protein, 466 aa, uncultured bacterium 580; identical to SEQ ID NO: 28858

SEQ ID NO: 57714 - DNA, 1476 bp, uncultured bacterium 106; identical to SEQ ID NO: 28859
  CDS (1)..(1476)

SEQ ID NO: 57715 - protein, 491 aa, uncultured bacterium 106; identical to SEQ ID NO: 28860

SEQ ID NO: 57716 - DNA, 1143 bp, uncultured bacterium 105; identical to SEQ ID NO: 28861
  CDS (1)..(1143)

SEQ ID NO: 57717 - protein, 380 aa, uncultured bacterium 105; identical to SEQ ID NO: 28862

SEQ ID NO: 57718 - DNA, 1395 bp, Rhizobium sp; identical to SEQ ID NO: 28863
  CDS (1)..(1395)

SEQ ID NO: 57719 - protein, 464 aa, Rhizobium sp; identical to SEQ ID NO: 28864

SEQ ID NO: 57720 - DNA, 1449 bp, Desulfovibrio vulgaris; identical to SEQ ID NO: 28865
  CDS (1)..(1449)

SEQ ID NO: 57721 - protein, 482 aa, Desulfovibrio vulgaris; identical to SEQ ID NO: 28866

SEQ ID NO: 57722 - DNA, 1167 bp, Leptospira interrogans; identical to SEQ ID NO: 28867
  CDS (1)..(1167)

SEQ ID NO: 57723 - protein, 388 aa, Leptospira interrogans; identical to SEQ ID NO: 28868

SEQ ID NO: 57724 - DNA, 1494 bp, Wolbachia pipientis wMel; identical to SEQ ID NO: 28869
  CDS (1)..(1494)

SEQ ID NO: 57725 - protein, 497 aa, Wolbachia pipientis wMel; identical to SEQ ID NO: 28870

SEQ ID NO: 57726 - DNA, 1482 bp, Treponema denticola; identical to SEQ ID NO: 28871
  CDS (1)..(1482)

SEQ ID NO: 57727 - protein, 493 aa, Treponema denticola; identical to SEQ ID NO: 28872

SEQ ID NO: 57728 - DNA, 1395 bp, Geobacter sulfurreducens; identical to SEQ ID NO: 28873
  CDS (1)..(1395)

SEQ ID NO: 57729 - protein, 464 aa, Geobacter sulfurreducens; identical to SEQ ID NO: 28874

SEQ ID NO: 57730 - DNA, 1416 bp, Geobacter sulfurreducens; identical to SEQ ID NO: 28875
  CDS (1)..(1416)

SEQ ID NO: 57731 - protein, 471 aa, Geobacter sulfurreducens; identical to SEQ ID NO: 28876

SEQ ID NO: 57732 - DNA, 1221 bp, Lactobacillus johnsonii; identical to SEQ ID NO: 28877
  CDS (1)..(1221)

SEQ ID NO: 57733 - protein, 406 aa, Lactobacillus johnsonii; identical to SEQ ID NO: 28878

SEQ ID NO: 57734 - DNA, 1425 bp, Wolinella succinogenes; identical to SEQ ID NO: 28879
  CDS (1)..(1425)

SEQ ID NO: 57735 - protein, 474 aa, Wolinella succinogenes; identical to SEQ ID NO: 28880

SEQ ID NO: 57736 - DNA, 1368 bp, Vibrio vulnificus; identical to SEQ ID NO: 28881
  CDS (1)..(1368)

SEQ ID NO: 57737 - protein, 455 aa, Vibrio vulnificus; identical to SEQ ID NO: 28882

SEQ ID NO: 57738 - DNA, 1497 bp, Porphyromonas gingivalis; identical to SEQ ID NO: 28883
  CDS (1)..(1497)

SEQ ID NO: 57739 - protein, 498 aa, Porphyromonas gingivalis; identical to SEQ ID NO: 28884

SEQ ID NO: 57740 - DNA, 1320 bp, Gloeobacter violaceus; identical to SEQ ID NO: 28885
  CDS (1)..(1320)

SEQ ID NO: 57741 - protein, 439 aa, Gloeobacter violaceus; identical to SEQ ID NO: 28886

SEQ ID NO: 57742 - DNA, 1467 bp, Chromobacterium violaceum; identical to SEQ ID NO: 28887
  CDS (1)..(1467)

SEQ ID NO: 57743 - protein, 488 aa, Chromobacterium violaceum; identical to SEQ ID NO: 28888

SEQ ID NO: 57744 - DNA, 1413 bp, Chromobacterium violaceum; identical to SEQ ID NO: 28889
  CDS (1)..(1413)

SEQ ID NO: 57745 - protein, 470 aa, Chromobacterium violaceum; identical to SEQ ID NO: 28890

SEQ ID NO: 57746 - DNA, 1158 bp, Prochlorococcus marinus; identical to SEQ ID NO: 28891
  CDS (1)..(1158)

SEQ ID NO: 57747 - protein, 385 aa, Prochlorococcus marinus; identical to SEQ ID NO: 28892

SEQ ID NO: 57748 - DNA, 1125 bp, Synechococcus sp; identical to SEQ ID NO: 28893
  CDS (1)..(1125)

SEQ ID NO: 57749 - protein, 374 aa, Synechococcus sp; identical to SEQ ID NO: 28894

SEQ ID NO: 57750 - DNA, 1299 bp, Synechococcus sp; identical to SEQ ID NO: 28895
  CDS (1)..(1299)

SEQ ID NO: 57751 - protein, 432 aa, Synechococcus sp; identical to SEQ ID NO: 28896

SEQ ID NO: 57752 - DNA, 1527 bp, Rhodopirellula baltica; identical to SEQ ID NO: 28897
  CDS (1)..(1527)

SEQ ID NO: 57753 - protein, 508 aa, Rhodopirellula baltica; identical to SEQ ID NO: 28898

SEQ ID NO: 57754 - DNA, 1530 bp, Rhodopirellula baltica; identical to SEQ ID NO: 28899
  CDS (1)..(1530)

SEQ ID NO: 57755 - protein, 509 aa, Rhodopirellula baltica; identical to SEQ ID NO: 28900

SEQ ID NO: 57756 - DNA, 1890 bp, Rhodopirellula baltica; identical to SEQ ID NO: 28901
  CDS (1)..(1890)

SEQ ID NO: 57757 - protein, 629 aa, Rhodopirellula baltica; identical to SEQ ID NO: 28902

SEQ ID NO: 57758 - DNA, 1188 bp, Prochlorococcus marinus; identical to SEQ ID NO: 28903
  CDS (1)..(1188)

SEQ ID NO: 57759 - protein, 395 aa, Prochlorococcus marinus; identical to SEQ ID NO: 28904

SEQ ID NO: 57760 - DNA, 1176 bp, Prochlorococcus marinus; identical to SEQ ID NO: 28905
  CDS (1)..(1176)

SEQ ID NO: 57761 - protein, 391 aa, Prochlorococcus marinus; identical to SEQ ID NO: 28906

SEQ ID NO: 57762 - DNA, 1434 bp, Helicobacter hepaticus; identical to SEQ ID NO: 28907
  CDS (1)..(1434)

SEQ ID NO: 57763 - protein, 477 aa, Helicobacter hepaticus; identical to SEQ ID NO: 28908

SEQ ID NO: 57764 - DNA, 1419 bp, Haemophilus ducreyi; identical to SEQ ID NO: 28909
  CDS (1)..(1419)

SEQ ID NO: 57765 - protein, 472 aa, Haemophilus ducreyi; identical to SEQ ID NO: 28910

SEQ ID NO: 57766 - DNA, 1386 bp, Candidatus Blochmannia floridanus; identical to SEQ ID NO: 28911
  CDS (1)..(1386)

SEQ ID NO: 57767 - protein, 461 aa, Candidatus Blochmannia floridanus; identical to SEQ ID NO: 28912

SEQ ID NO: 57768 - DNA, 1137 bp, Bordetella pertussis; identical to SEQ ID NO: 28913
  CDS (1)..(1137)

SEQ ID NO: 57769 - protein, 378 aa, Bordetella pertussis; identical to SEQ ID NO: 28914

SEQ ID NO: 57770 - DNA, 1116 bp, Bordetella parapertussis; identical to SEQ ID NO: 28915
  CDS (1)..(1116)

SEQ ID NO: 57771 - protein, 371 aa, Bordetella parapertussis; identical to SEQ ID NO: 28916

SEQ ID NO: 57772 - DNA, 1488 bp, Bordetella parapertussis; identical to SEQ ID NO: 28917
  CDS (1)..(1488)

SEQ ID NO: 57773 - protein, 495 aa, Bordetella parapertussis; identical to SEQ ID NO: 28918

SEQ ID NO: 57774 - DNA, 1467 bp, Chlamydophila caviae; identical to SEQ ID NO: 28919
  CDS (1)..(1467)

SEQ ID NO: 57775 - protein, 488 aa, Chlamydophila caviae; identical to SEQ ID NO: 28920

SEQ ID NO: 57776 - DNA, 1419 bp, Streptomyces avermitilis; identical to SEQ ID NO: 28921
  CDS (1)..(1419)

SEQ ID NO: 57777 - protein, 472 aa, Streptomyces avermitilis; identical to SEQ ID NO: 28922

SEQ ID NO: 57778 - DNA, 1491 bp, Nitrosomonas europaea; identical to SEQ ID NO: 28923
  CDS (1)..(1491)

SEQ ID NO: 57779 - protein, 496 aa, Nitrosomonas europaea; identical to SEQ ID NO: 28924

SEQ ID NO: 57780 - DNA, 1323 bp, Enterococcus faecalis; identical to SEQ ID NO: 28925
  CDS (25)..(1323)

SEQ ID NO: 57781 - protein, 432 aa, Enterococcus faecalis; identical to SEQ ID NO: 28926

SEQ ID NO: 57782 - DNA, 1356 bp, Coxiella burnetii; identical to SEQ ID NO: 28927
  CDS (1)..(1356)

SEQ ID NO: 57783 - protein, 451 aa, Coxiella burnetii; identical to SEQ ID NO: 28928

SEQ ID NO: 57784 - DNA, 1368 bp, Enterobacter cloacae; identical to SEQ ID NO: 28929
  CDS (1)..(1368)

SEQ ID NO: 57785 - protein, 455 aa, Enterobacter cloacae; identical to SEQ ID NO: 28930

SEQ ID NO: 57786 - DNA, 1545 bp, Xylella fastidiosa; identical to SEQ ID NO: 28931
  CDS (1)..(1545)

SEQ ID NO: 57787 - protein, 514 aa, Xylella fastidiosa; identical to SEQ ID NO: 28932

SEQ ID NO: 57788 - DNA, 1377 bp, Xylella fastidiosa; identical to SEQ ID NO: 28933
  CDS (1)..(1377)

SEQ ID NO: 57789 - protein, 458 aa, Xylella fastidiosa; identical to SEQ ID NO: 28934

SEQ ID NO: 57790 - DNA, 1368 bp, Vibrio parahaemolyticus; identical to SEQ ID NO: 28935
  CDS (1)..(1368)

SEQ ID NO: 57791 - protein, 455 aa, Vibrio parahaemolyticus; identical to SEQ ID NO: 28936

SEQ ID NO: 57792 - DNA, 1161 bp, Pseudomonas syringae; identical to SEQ ID NO: 28937
  CDS (1)..(1161)

SEQ ID NO: 57793 - protein, 386 aa, Pseudomonas syringae; identical to SEQ ID NO: 28938

SEQ ID NO: 57794 - DNA, 1440 bp, Pseudomonas syringae; identical to SEQ ID NO: 28939
  CDS (1)..(1440)

SEQ ID NO: 57795 - protein, 479 aa, Pseudomonas syringae; identical to SEQ ID NO: 28940

SEQ ID NO: 57796 - DNA, 1479 bp, Pseudomonas putida; identical to SEQ ID NO: 28941
  CDS (1)..(1479)

SEQ ID NO: 57797 - protein, 492 aa, Pseudomonas putida; identical to SEQ ID NO: 28942

SEQ ID NO: 57798 - DNA, 1524 bp, Bradyrhizobium japonicum; identical to SEQ ID NO: 28943
  CDS (1)..(1524)

SEQ ID NO: 57799 - protein, 507 aa, Bradyrhizobium japonicum; identical to SEQ ID NO: 28944

SEQ ID NO: 57800 - DNA, 1272 bp, Bradyrhizobium japonicum; identical to SEQ ID NO: 28945
  CDS (1)..(1272)

SEQ ID NO: 57801 - protein, 423 aa, Bradyrhizobium japonicum; identical to SEQ ID NO: 28946

SEQ ID NO: 57802 - DNA, 1578 bp, Bradyrhizobium japonicum; identical to SEQ ID NO: 28947
  CDS (1)..(1578)

SEQ ID NO: 57803 - protein, 525 aa, Bradyrhizobium japonicum; identical to SEQ ID NO: 28948

SEQ ID NO: 57804 - DNA, 1587 bp, Bradyrhizobium japonicum; identical to SEQ ID NO: 28949
  CDS (1)..(1587)

SEQ ID NO: 57805 - protein, 528 aa, Bradyrhizobium japonicum; identical to SEQ ID NO: 28950

SEQ ID NO: 57806 - DNA, 1536 bp, Bacteroides thetaiotaomicron; identical to SEQ ID NO: 28951
  CDS (1)..(1536)

SEQ ID NO: 57807 - protein, 511 aa, Bacteroides thetaiotaomicron; identical to SEQ ID NO: 28952

SEQ ID NO: 57808 - DNA, 1410 bp, Escherichia coli O6; identical to SEQ ID NO: 28953
  CDS (1)..(1410)

SEQ ID NO: 57809 - protein, 469 aa, Escherichia coli O6; identical to SEQ ID NO: 28954

SEQ ID NO: 57810 - DNA, 1392 bp, Yersinia pestis; identical to SEQ ID NO: 28955
  CDS (1)..(1392)

SEQ ID NO: 57811 - protein, 463 aa, Yersinia pestis; identical to SEQ ID NO: 28956

SEQ ID NO: 57812 - DNA, 1374 bp, Wigglesworthia glossinidia brevipalpis; identical to SEQ ID NO: 28957
  CDS (1)..(1374)

SEQ ID NO: 57813 - protein, 457 aa, Wigglesworthia glossinidia brevipalpis; identical to SEQ ID NO: 28958

SEQ ID NO: 57814 - DNA, 1128 bp, Synechococcus elongatus; identical to SEQ ID NO: 28959
  CDS (1)..(1128)

SEQ ID NO: 57815 - protein, 375 aa, Synechococcus elongatus; identical to SEQ ID NO: 28960

SEQ ID NO: 57816 - DNA, 1170 bp, Synechococcus elongatus; identical to SEQ ID NO: 28961
  CDS (1)..(1170)

SEQ ID NO: 57817 - protein, 389 aa, Synechococcus elongatus; identical to SEQ ID NO: 28962

SEQ ID NO: 57818 - DNA, 1353 bp, Shewanella oneidensis; identical to SEQ ID NO: 28963
  CDS (1)..(1353)

SEQ ID NO: 57819 - protein, 450 aa, Shewanella oneidensis; identical to SEQ ID NO: 28964

SEQ ID NO: 57820 - DNA, 1518 bp, Chlorobium tepidum; identical to SEQ ID NO: 28965
  CDS (1)..(1518)

SEQ ID NO: 57821 - protein, 505 aa, Chlorobium tepidum; identical to SEQ ID NO: 28966

SEQ ID NO: 57822 - DNA, 1461 bp, Rhizobium etli; identical to SEQ ID NO: 28967
  CDS (1)..(1461)

SEQ ID NO: 57823 - protein, 486 aa, Rhizobium etli; identical to SEQ ID NO: 28968

SEQ ID NO: 57824 - DNA, 1368 bp, Pasteurella piscicida; identical to SEQ ID NO: 28969
  CDS (1)..(1368)

SEQ ID NO: 57825 - protein, 455 aa, Pasteurella piscicida; identical to SEQ ID NO: 28970

SEQ ID NO: 57826 - DNA, 1437 bp, Xanthomonas campestris; identical to SEQ ID NO: 28971
  CDS (1)..(1437)

SEQ ID NO: 57827 - protein, 478 aa, Xanthomonas campestris; identical to SEQ ID NO: 28972

SEQ ID NO: 57828 - DNA, 1437 bp, Xanthomonas axonopodis; identical to SEQ ID NO: 28973
  CDS (1)..(1437)

SEQ ID NO: 57829 - protein, 478 aa, Xanthomonas axonopodis; identical to SEQ ID NO: 28974

SEQ ID NO: 57830 - DNA, 1578 bp, Xanthomonas axonopodis; identical to SEQ ID NO: 28975
  CDS (1)..(1578)

SEQ ID NO: 57831 - protein, 525 aa, Xanthomonas axonopodis; identical to SEQ ID NO: 28976

SEQ ID NO: 57832 - DNA, 2077 bp, Klebsiella pneumoniae; identical to SEQ ID NO: 28977
  CDS (374)..(1807)

SEQ ID NO: 57833 - protein, 477 aa, Klebsiella pneumoniae; identical to SEQ ID NO: 28978

SEQ ID NO: 57834 - DNA, 1536 bp, Xanthomonas campestris; identical to SEQ ID NO: 28979
  CDS (1)..(1536)

SEQ ID NO: 57835 - protein, 511 aa, Xanthomonas campestris; identical to SEQ ID NO: 28980

SEQ ID NO: 57836 - DNA, 1473 bp, Ralstonia solanacearum; identical to SEQ ID NO: 28981
  CDS (1)..(1473)

SEQ ID NO: 57837 - protein, 490 aa, Ralstonia solanacearum; identical to SEQ ID NO: 28982

SEQ ID NO: 57838 - DNA, 1518 bp, Ralstonia solanacearum; identical to SEQ ID NO: 28983
  CDS (1)..(1518)

SEQ ID NO: 57839 - protein, 505 aa, Ralstonia solanacearum; identical to SEQ ID NO: 28984

SEQ ID NO: 57840 - DNA, 1368 bp, Salmonella typhimurium; identical to SEQ ID NO: 28985
  CDS (1)..(1368)

SEQ ID NO: 57841 - protein, 455 aa, Salmonella typhimurium; identical to SEQ ID NO: 28986

SEQ ID NO: 57842 - DNA, 1512 bp, Rhizobium meliloti; identical to SEQ ID NO: 28987
  CDS (1)..(1512)

SEQ ID NO: 57843 - protein, 503 aa, Rhizobium meliloti; identical to SEQ ID NO: 28988

SEQ ID NO: 57844 - DNA, 1398 bp, Rhizobium meliloti; identical to SEQ ID NO: 28989
  CDS (1)..(1398)

SEQ ID NO: 57845 - protein, 465 aa, Rhizobium meliloti; identical to SEQ ID NO: 28990

SEQ ID NO: 57846 - DNA, 1551 bp, Rhizobium loti; identical to SEQ ID NO: 28991
  CDS (1)..(1551)

SEQ ID NO: 57847 - protein, 516 aa, Rhizobium loti; identical to SEQ ID NO: 28992

SEQ ID NO: 57848 - DNA, 1542 bp, Rhizobium loti; identical to SEQ ID NO: 28993
  CDS (1)..(1542)

SEQ ID NO: 57849 - protein, 513 aa, Rhizobium loti; identical to SEQ ID NO: 28994

SEQ ID NO: 57850 - DNA, 1515 bp, Rhizobium loti; identical to SEQ ID NO: 28995
  CDS (1)..(1515)

SEQ ID NO: 57851 - protein, 504 aa, Rhizobium loti; identical to SEQ ID NO: 28996

SEQ ID NO: 57852 - DNA, 1287 bp, Rhizobium loti; identical to SEQ ID NO: 28997
  CDS (1)..(1287)

SEQ ID NO: 57853 - protein, 428 aa, Rhizobium loti; identical to SEQ ID NO: 28998

SEQ ID NO: 57854 - DNA, 1446 bp, Pseudomonas syringae; identical to SEQ ID NO: 28999
  CDS (1)..(1446)

SEQ ID NO: 57855 - protein, 481 aa, Pseudomonas syringae; identical to SEQ ID NO: 29000

SEQ ID NO: 57856 - DNA, 1380 bp, Pasteurella multocida; identical to SEQ ID NO: 29001
  CDS (1)..(1380)

SEQ ID NO: 57857 - protein, 459 aa, Pasteurella multocida; identical to SEQ ID NO: 29002

SEQ ID NO: 57858 - DNA, 1362 bp, Aeromonas hydrophila; identical to SEQ ID NO: 29003
  CDS (1)..(1362)

SEQ ID NO: 57859 - protein, 453 aa, Aeromonas hydrophila; identical to SEQ ID NO: 29004

SEQ ID NO: 57860 - DNA, 1503 bp, Myxococcus xanthus; identical to SEQ ID NO: 29005
  CDS (1)..(1503)

SEQ ID NO: 57861 - protein, 500 aa, Myxococcus xanthus; identical to SEQ ID NO: 29006

SEQ ID NO: 57862 - DNA, 1476 bp, Shigella sonnei; identical to SEQ ID NO: 29007
  CDS (1)..(1476)

SEQ ID NO: 57863 - protein, 491 aa, Shigella sonnei; identical to SEQ ID NO: 29008

SEQ ID NO: 57864 - DNA, 1512 bp, Bartonella henselae; identical to SEQ ID NO: 29009
  CDS (1)..(1512)

SEQ ID NO: 57865 - protein, 503 aa, Bartonella henselae; identical to SEQ ID NO: 29010

SEQ ID NO: 57866 - DNA, 1437 bp, Buchnera aphidicola; identical to SEQ ID NO: 29011
  CDS (1)..(1437)

SEQ ID NO: 57867 - protein, 478 aa, Buchnera aphidicola; identical to SEQ ID NO: 29012

SEQ ID NO: 57868 - DNA, 1515 bp, Rhizobium meliloti; identical to SEQ ID NO: 29013
  CDS (1)..(1515)

SEQ ID NO: 57869 - protein, 504 aa, Rhizobium meliloti; identical to SEQ ID NO: 29014

SEQ ID NO: 57870 - DNA, 1377 bp, Bacillus subtilis; identical to SEQ ID NO: 29015
  CDS (1)..(1377)

SEQ ID NO: 57871 - protein, 458 aa, Bacillus subtilis; identical to SEQ ID NO: 29016

SEQ ID NO: 57872 - DNA, 24 bp, Primer
atgaaaaaaaccacattagcactg

SEQ ID NO: 57873 - DNA, 25 bp, Primer
ttactgcattaacaggtagatggtg

SEQ ID NO: 57874 - protein, 406 aa, consensus; identical to SEQ ID NO: 29019
  MISC_FEATURE (1)..(406): consensus for the disclosure of xaa see table XV

SEQ ID NO: 57875 - protein, 66 aa, consensus; identical to SEQ ID NO: 29020
  MISC_FEATURE (1)..(66): consensus for the disclosure of xaa see table XV

SEQ ID NO: 57876 - protein, 37 aa, consensus; identical to SEQ ID NO: 29021
  MISC_FEATURE (1)..(37): consensus for the disclosure of xaa see table XV

SEQ ID NO: 57877 - protein, 30 aa, consensus; identical to SEQ ID NO: 29022
  MISC_FEATURE (1)..(30): consensus for the disclosure of xaa see table XV

SEQ ID NO: 57878 - protein, 34 aa, consensus; identical to SEQ ID NO: 29023
  MISC_FEATURE (1)..(34): consensus for the disclosure of xaa see table XV

SEQ ID NO: 57879 - protein, 68 aa, consensus; identical to SEQ ID NO: 29024
  MISC_FEATURE (1)..(68): consensus for the disclosure of xaa see table XV

SEQ ID NO: 57880 - DNA, 1293 bp, Escherichia coli; identical to SEQ ID NO: 36320
  CDS (1)..(1293)

SEQ ID NO: 57881 - protein, 430 aa, Escherichia coli; identical to SEQ ID NO: 36321

SEQ ID NO: 57882 - DNA, 1524 bp, Anopheles gambiae str. PEST; identical to SEQ ID NO: 36322
  CDS (1)..(1524)

SEQ ID NO: 57883 - protein, 507 aa, Anopheles gambiae str. PEST; identical to SEQ ID NO: 36323

SEQ ID NO: 57884 - DNA, 2106 bp, Anopheles gambiae str. PEST; identical to SEQ ID NO: 36324
  CDS (1)..(1392)

SEQ ID NO: 57885 - protein, 463 aa, Anopheles gambiae str. PEST; identical to SEQ ID NO: 36325

SEQ ID NO: 57886 - DNA, 2001 bp, Anopheles gambiae str. PEST; identical to SEQ ID NO: 36326
  CDS (1)..(2001)

SEQ ID NO: 57887 - protein, 666 aa, Anopheles gambiae str. PEST; identical to SEQ ID NO: 36327

SEQ ID NO: 57888 - DNA, 2034 bp, Danio rerio; identical to SEQ ID NO: 36328
  CDS (1)..(2034)

SEQ ID NO: 57889 - protein, 677 aa, Danio rerio; identical to SEQ ID NO: 36329

SEQ ID NO: 57890 - DNA, 1428 bp, Danio rerio; identical to SEQ ID NO: 36330
  CDS (1)..(1428)

SEQ ID NO: 57891 - protein, 475 aa, Danio rerio; identical to SEQ ID NO: 36331

SEQ ID NO: 57892 - DNA, 1923 bp, Danio rerio; identical to SEQ ID NO: 36332
  CDS (1)..(1923)

SEQ ID NO: 57893 - protein, 640 aa, Danio rerio; identical to SEQ ID NO: 36333

SEQ ID NO: 57894 - DNA, 2211 bp, Archaeoglobus fulgidus DSM 4304; identical to SEQ ID NO: 36334
  CDS (1)..(2211)

SEQ ID NO: 57895 - protein, 736 aa, Archaeoglobus fulgidus DSM 4304; identical to SEQ ID NO: 36335

SEQ ID NO: 57896 - DNA, 1596 bp, Archaeoglobus fulgidus DSM 4304; identical to SEQ ID NO: 36336
  CDS (1)..(1596)

SEQ ID NO: 57897 - protein, 531 aa, Archaeoglobus fulgidus DSM 4304; identical to SEQ ID NO: 36337

SEQ ID NO: 57898 - DNA, 1692 bp, Thermoplasma volcanium GSS1; identical to SEQ ID NO: 36338
  CDS (1)..(1692)

SEQ ID NO: 57899 - protein, 563 aa, Thermoplasma volcanium GSS1; identical to SEQ ID NO: 36339

SEQ ID NO: 57900 - DNA, 1617 bp, Aeropyrum pernix K1; identical to SEQ ID NO: 36340
  CDS (1)..(1617)

SEQ ID NO: 57901 - protein, 538 aa, Aeropyrum pernix K1; identical to SEQ ID NO: 36341

SEQ ID NO: 57902 - DNA, 1773 bp, Arabidopsis thaliana; identical to SEQ ID NO: 36342
  CDS (1)..(1773)

SEQ ID NO: 57903 - protein, 590 aa, Arabidopsis thaliana; identical to SEQ ID NO: 36343

SEQ ID NO: 57904 - DNA, 1710 bp, Arabidopsis thaliana; identical to SEQ ID NO: 36344
  CDS (1)..(1710)

SEQ ID NO: 57905 - protein, 569 aa, Arabidopsis thaliana; identical to SEQ ID NO: 36345

SEQ ID NO: 57906 - DNA, 1803 bp, Arabidopsis thaliana; identical to SEQ ID NO: 36346
  CDS (1)..(1803)

SEQ ID NO: 57907 - protein, 600 aa, Arabidopsis thaliana; identical to SEQ ID NO: 36347

SEQ ID NO: 57908 - DNA, 1755 bp, Arabidopsis thaliana; identical to SEQ ID NO: 36348
  CDS (1)..(1755)

SEQ ID NO: 57909 - protein, 584 aa, Arabidopsis thaliana; identical to SEQ ID NO: 36349

SEQ ID NO: 57910 - DNA, 1752 bp, Arabidopsis thaliana; identical to SEQ ID NO: 36350
  CDS (1)..(1752)

SEQ ID NO: 57911 - protein, 583 aa, Arabidopsis thaliana; identical to SEQ ID NO: 36351

SEQ ID NO: 57912 - DNA, 1830 bp, Arabidopsis thaliana; identical to SEQ ID NO: 36352
  CDS (1)..(1830)

SEQ ID NO: 57913 - protein, 609 aa, Arabidopsis thaliana; identical to SEQ ID NO: 36353

SEQ ID NO: 57914 - DNA, 1434 bp, Pseudomonas aeruginosa PAO1; identical to SEQ ID NO: 36354
  CDS (1)..(1434)

SEQ ID NO: 57915 - protein, 477 aa, Pseudomonas aeruginosa PAO1; identical to SEQ ID NO: 36355

SEQ ID NO: 57916 - DNA, 1356 bp, Pseudomonas aeruginosa PAO1; identical to SEQ ID NO: 36356
  CDS (1)..(1356)

SEQ ID NO: 57917 - protein, 451 aa, Pseudomonas aeruginosa PAO1; identical to SEQ ID NO: 36357

SEQ ID NO: 57918 - DNA, 1410 bp, Lactococcus lactis subsp. lactis Il1403; identical to SEQ ID NO: 36358
  CDS (1)..(1410)

SEQ ID NO: 57919 - protein, 469 aa, Lactococcus lactis subsp. lactis Il1403; identical to SEQ ID NO: 36359

SEQ ID NO: 57920 - DNA, 1344 bp, Streptococcus pyogenes M1 GAS; identical to SEQ ID NO: 36360
  CDS (1)..(1344)

SEQ ID NO: 57921 - protein, 447 aa, Streptococcus pyogenes M1 GAS; identical to SEQ ID NO: 36361

SEQ ID NO: 57922 - DNA, 1275 bp, Methanothermobacter thermautotrophicus str. Delta H; identical to SEQ ID NO: 36362
  CDS (1)..(1275)

SEQ ID NO: 57923 - protein, 424 aa, Methanothermobacter thermautotrophicus str. Delta H; identical to SEQ ID NO: 36363

SEQ ID NO: 57924 - DNA, 2331 bp, Halobacterium salinarum NRC-1; identical to SEQ ID NO: 36364
  CDS (1)..(2331)

SEQ ID NO: 57925 - protein, 776 aa, Halobacterium salinarum NRC-1; identical to SEQ ID NO: 36365

SEQ ID NO: 57926 - DNA, 1530 bp, Xylella fastidiosa 9a5c; identical to SEQ ID NO: 36366
  CDS (1)..(1530)

SEQ ID NO: 57927 - protein, 509 aa, Xylella fastidiosa 9a5c; identical to SEQ ID NO: 36367

SEQ ID NO: 57928 - DNA, 1434 bp, Xylella fastidiosa 9a5c; identical to SEQ ID NO: 36368
  CDS (1)..(1434)

SEQ ID NO: 57929 - protein, 477 aa, Xylella fastidiosa 9a5c; identical to SEQ ID NO: 36369

SEQ ID NO: 57930 - DNA, 1518 bp, Mycobacterium leprae TN; identical to SEQ ID NO: 36370
  CDS (1)..(1518)

SEQ ID NO: 57931 - protein, 505 aa, Mycobacterium leprae TN; identical to SEQ ID NO: 36371

SEQ ID NO: 57932 - DNA, 1719 bp, Mycobacterium leprae TN; identical to SEQ ID NO: 36372
  CDS (1)..(1719)

SEQ ID NO: 57933 - protein, 572 aa, Mycobacterium leprae TN; identical to SEQ ID NO: 36373

SEQ ID NO: 57934 - DNA, 1305 bp, Mycobacterium tuberculosis CDC1551; identical to SEQ ID NO: 9113
  CDS (1)..(1305)

SEQ ID NO: 57935 - protein, 434 aa, Mycobacterium tuberculosis CDC1551; identical to SEQ ID NO: 9114

SEQ ID NO: 57936 - DNA, 1416 bp, Mycobacterium tuberculosis CDC1551; identical to SEQ ID NO: 36376
  CDS (1)..(1416)

SEQ ID NO: 57937 - protein, 471 aa, Mycobacterium tuberculosis CDC1551; identical to SEQ ID NO: 36377

SEQ ID NO: 57938 - DNA, 1488 bp, Mycobacterium tuberculosis CDC1551; identical to SEQ ID NO: 36378
  CDS (1)..(1488)

SEQ ID NO: 57939 - protein, 495 aa, Mycobacterium tuberculosis CDC1551; identical to SEQ ID NO: 36379

SEQ ID NO: 57940 - DNA, 1254 bp, Sulfolobus solfataricus P2; identical to SEQ ID NO: 36380
  CDS (1)..(1254)

SEQ ID NO: 57941 - protein, 417 aa, Sulfolobus solfataricus P2; identical to SEQ ID NO: 36381

SEQ ID NO: 57942 - DNA, 1401 bp, Clostridium acetobutylicum ATCC 824; identical to SEQ ID NO: 36382
  CDS (1)..(1401)

SEQ ID NO: 57943 - protein, 466 aa, Clostridium acetobutylicum ATCC 824; identical to SEQ ID NO: 36383

SEQ ID NO: 57944 - DNA, 1404 bp, Streptococcus pneumoniae R6; identical to SEQ ID NO: 36384
  CDS (1)..(1404)

SEQ ID NO: 57945 - protein, 467 aa, Streptococcus pneumoniae R6; identical to SEQ ID NO: 36385

SEQ ID NO: 57946 - DNA, 1398 bp, Rickettsia conorii str. Malish 7; identical to SEQ ID NO: 36386
  CDS (1)..(1398)

SEQ ID NO: 57947 - protein, 465 aa, Rickettsia conorii str. Malish 7; identical to SEQ ID NO: 36387

SEQ ID NO: 57948 - DNA, 1638 bp, Staphylococcus aureus subsp. aureus Mu50; identical to SEQ ID NO: 36388
  CDS (1)..(1638)

SEQ ID NO: 57949 - protein, 545 aa, Staphylococcus aureus subsp. aureus Mu50; identical to SEQ ID NO: 36389

SEQ ID NO: 57950 - DNA, 1449 bp, Staphylococcus aureus subsp. aureus Mu50; identical to SEQ ID NO: 36390
  CDS (1)..(1449)

SEQ ID NO: 57951 - protein, 482 aa, Staphylococcus aureus subsp. aureus Mu50; identical to SEQ ID NO: 36391

SEQ ID NO: 57952 - DNA, 1278 bp, Sulfolobus tokodaii str. 7; identical to SEQ ID NO: 36392
  CDS (1)..(1278)

SEQ ID NO: 57953 - protein, 425 aa, Sulfolobus tokodaii str. 7; identical to SEQ ID NO: 36393

SEQ ID NO: 57954 - DNA, 1386 bp, Bacillus subtilis subsp. subtilis str. 168; identical to SEQ ID NO: 36394
  CDS (1)..(1386)

SEQ ID NO: 57955 - protein, 461 aa, Bacillus subtilis subsp. subtilis str. 168; identical to SEQ ID NO: 36395

SEQ ID NO: 57956 - DNA, 1464 bp, Halobacterium salinarum NRC-1; identical to SEQ ID NO: 36396
  CDS (1)..(1464)

SEQ ID NO: 57957 - protein, 487 aa, Halobacterium salinarum NRC-1; identical to SEQ ID NO: 36397

SEQ ID NO: 57958 - DNA, 1527 bp, Yersinia pestis CO92; identical to SEQ ID NO: 36398
  CDS (1)..(1527)

SEQ ID NO: 57959 - protein, 508 aa, Yersinia pestis CO92; identical to SEQ ID NO: 36399

SEQ ID NO: 57960 - DNA, 1392 bp, Yersinia pestis CO92; identical to SEQ ID NO: 9051
  CDS (1)..(1392)

SEQ ID NO: 57961 - protein, 463 aa, Yersinia pestis CO92; identical to SEQ ID NO: 9052

SEQ ID NO: 57962 - DNA, 1551 bp, Escherichia coli K12; identical to SEQ ID NO: 36402
  CDS (1)..(1551)

SEQ ID NO: 57963 - protein, 516 aa, Escherichia coli K12; identical to SEQ ID NO: 36403

SEQ ID NO: 57964 - DNA, 1389 bp, Escherichia coli K12; identical to SEQ ID NO: 36404
  CDS (1)..(1389)

SEQ ID NO: 57965 - protein, 462 aa, Escherichia coli K12; identical to SEQ ID NO: 36405

SEQ ID NO: 57966 - DNA, 1503 bp, Caulobacter crescentus CB15; identical to SEQ ID NO: 36406
  CDS (1)..(1503)

SEQ ID NO: 57967 - protein, 500 aa, Caulobacter crescentus CB15; identical to SEQ ID NO: 36407

SEQ ID NO: 57968 - DNA, 1641 bp, Caulobacter crescentus CB15; identical to SEQ ID NO: 36408
  CDS (1)..(1641)

SEQ ID NO: 57969 - protein, 546 aa, Caulobacter crescentus CB15; identical to SEQ ID NO: 36409

SEQ ID NO: 57970 - DNA, 1302 bp, Caulobacter crescentus CB15; identical to SEQ ID NO: 36410
  CDS (1)..(1302)

SEQ ID NO: 57971 - protein, 433 aa, Caulobacter crescentus CB15; identical to SEQ ID NO: 36411

SEQ ID NO: 57972 - DNA, 1326 bp, Sinorhizobium meliloti 1021; identical to SEQ ID NO: 36412
  CDS (1)..(1326)

SEQ ID NO: 57973 - protein, 441 aa, Sinorhizobium meliloti 1021; identical to SEQ ID NO: 36413

SEQ ID NO: 57974 - DNA, 1392 bp, Listeria monocytogenes EGD-e; identical to SEQ ID NO: 36414
  CDS (1)..(1392)

SEQ ID NO: 57975 - protein, 463 aa, Listeria monocytogenes EGD-e; identical to SEQ ID NO: 36415

SEQ ID NO: 57976 - DNA, 1368 bp, Nostoc sp. PCC 7120; identical to SEQ ID NO: 36416
  CDS (1)..(1368)

SEQ ID NO: 57977 - protein, 455 aa, Nostoc sp. PCC 7120; identical to SEQ ID NO: 36417

SEQ ID NO: 57978 - DNA, 1626 bp, Caenorhabditis elegans; identical to SEQ ID NO: 36418
  CDS (1)..(1626)

SEQ ID NO: 57979 - protein, 541 aa, Caenorhabditis elegans; identical to SEQ ID NO: 36419

SEQ ID NO: 57980 - DNA, 1752 bp, Caenorhabditis elegans; identical to SEQ ID NO: 36420
  CDS (1)..(1752)

SEQ ID NO: 57981 - protein, 583 aa, Caenorhabditis elegans; identical to SEQ ID NO: 36421

SEQ ID NO: 57982 - DNA, 1770 bp, Caenorhabditis elegans; identical to SEQ ID NO: 36422
  CDS (1)..(1770)

SEQ ID NO: 57983 - protein, 589 aa, Caenorhabditis elegans; identical to SEQ ID NO: 36423

SEQ ID NO: 57984 - DNA, 1482 bp, Caenorhabditis elegans; identical to SEQ ID NO: 36424
  CDS (1)..(1482)

SEQ ID NO: 57985 - protein, 493 aa, Caenorhabditis elegans; identical to SEQ ID NO: 36425

SEQ ID NO: 57986 - DNA, 1431 bp, Ralstonia solanacearum GMI1000; identical to SEQ ID NO: 36426
  CDS (1)..(1431)

SEQ ID NO: 57987 - protein, 476 aa, Ralstonia solanacearum GMI1000; identical to SEQ ID NO: 36427

SEQ ID NO: 57988 - DNA, 1458 bp, Agrobacterium tumefaciens str. C58; identical to SEQ ID NO: 9087
  CDS (1)..(1458)

SEQ ID NO: 57989 - protein, 485 aa, Agrobacterium tumefaciens str. C58; identical to SEQ ID NO: 9088

SEQ ID NO: 57990 - DNA, 1323 bp, Clostridium perfringens str. 13; identical to SEQ ID NO: 36430
  CDS (1)..(1323)

SEQ ID NO: 57991 - protein, 440 aa, Clostridium perfringens str. 13; identical to SEQ ID NO: 36431

SEQ ID NO: 57992 - DNA, 1383 bp, Clostridium perfringens str. 13; identical to SEQ ID NO: 36432
  CDS (1)..(1383)

SEQ ID NO: 57993 - protein, 460 aa, Clostridium perfringens str. 13; identical to SEQ ID NO: 36433

SEQ ID NO: 57994 - DNA, 1710 bp, Arabidopsis thaliana; identical to SEQ ID NO: 36434
  CDS (1)..(1710)

SEQ ID NO: 57995 - protein, 569 aa, Arabidopsis thaliana; identical to SEQ ID NO: 36435

SEQ ID NO: 57996 - DNA, 1503 bp, Drosophila melanogaster; identical to SEQ ID NO: 36436
  CDS (1)..(1503)

SEQ ID NO: 57997 - protein, 500 aa, Drosophila melanogaster; identical to SEQ ID NO: 36437

SEQ ID NO: 57998 - DNA, 1320 bp, Methanosarcina acetivorans C2A; identical to SEQ ID NO: 36438
  CDS (1)..(1320)

SEQ ID NO: 57999 - protein, 439 aa, Methanosarcina acetivorans C2A; identical to SEQ ID NO: 36439

SEQ ID NO: 58000 - DNA, 1293 bp, Methanosarcina acetivorans C2A; identical to SEQ ID NO: 36440
  CDS (1)..(1293)

SEQ ID NO: 58001 - protein, 430 aa, Methanosarcina acetivorans C2A; identical to SEQ ID NO: 36441

SEQ ID NO: 58002 - DNA, 1320 bp, Methanosarcina acetivorans C2A; identical to SEQ ID NO: 36442
  CDS (1)..(1320)

SEQ ID NO: 58003 - protein, 439 aa, Methanosarcina acetivorans C2A; identical to SEQ ID NO: 36443

SEQ ID NO: 58004 - DNA, 1380 bp, Thermoanaerobacter tengcongensis MB4; identical to SEQ ID NO: 36444
  CDS (1)..(1380)

SEQ ID NO: 58005 - protein, 459 aa, Thermoanaerobacter tengcongensis MB4; identical to SEQ ID NO: 36445

SEQ ID NO: 58006 - DNA, 1440 bp, Thermoanaerobacter tengcongensis MB4; identical to SEQ ID NO: 36446
  CDS (1)..(1440)

SEQ ID NO: 58007 - protein, 479 aa, Thermoanaerobacter tengcongensis MB4; identical to SEQ ID NO: 36447

SEQ ID NO: 58008 - DNA, 1428 bp, Thermoanaerobacter tengcongensis MB4; identical to SEQ ID NO: 36448
  CDS (1)..(1428)

SEQ ID NO: 58009 - protein, 475 aa, Thermoanaerobacter tengcongensis MB4; identical to SEQ ID NO: 36449

SEQ ID NO: 58010 - DNA, 1491 bp, Streptomyces coelicolor A3(2); identical to SEQ ID NO: 36450
  CDS (1)..(1491)

SEQ ID NO: 58011 - protein, 496 aa, Streptomyces coelicolor A3(2); identical to SEQ ID NO: 36451

SEQ ID NO: 58012 - DNA, 1440 bp, Streptomyces coelicolor A3(2); identical to SEQ ID NO: 36452
  CDS (1)..(1440)

SEQ ID NO: 58013 - protein, 479 aa, Streptomyces coelicolor A3(2); identical to SEQ ID NO: 36453

SEQ ID NO: 58014 - DNA, 2238 bp, Methanosarcina mazei Go1; identical to SEQ ID NO: 36454
  CDS (1)..(2238)

SEQ ID NO: 58015 - protein, 745 aa, Methanosarcina mazei Go1; identical to SEQ ID NO: 36455

SEQ ID NO: 58016 - DNA, 1281 bp, Methanosarcina mazei Go1; identical to SEQ ID NO: 36456
  CDS (1)..(1281)

SEQ ID NO: 58017 - protein, 426 aa, Methanosarcina mazei Go1; identical to SEQ ID NO: 36457

SEQ ID NO: 58018 - DNA, 1431 bp, Xanthomonas campestris pv. campestris str. ATCC 33913; identical to SEQ ID NO: 36458
  CDS (1)..(1431)

SEQ ID NO: 58019 - protein, 476 aa, Xanthomonas campestris pv. campestris str. ATCC 33913; identical to SEQ ID NO: 36459

SEQ ID NO: 58020 - DNA, 1482 bp, Xanthomonas campestris pv. campestris str. ATCC 33913; identical to SEQ ID NO: 36460
  CDS (1)..(1482)

SEQ ID NO: 58021 - protein, 493 aa, Xanthomonas campestris pv. campestris str. ATCC 33913; identical to SEQ ID NO: 36461

SEQ ID NO: 58022 - DNA, 1587 bp, Xanthomonas campestris pv. campestris str. ATCC 33913; identical to SEQ ID NO: 36462
  CDS (1)..(1587)

SEQ ID NO: 58023 - protein, 528 aa, Xanthomonas campestris pv. campestris str. ATCC 33913; identical to SEQ ID NO: 36463

SEQ ID NO: 58024 - DNA, 1302 bp, Xanthomonas campestris pv. campestris str. ATCC 33913; identical to SEQ ID NO: 36464
  CDS (1)..(1302)

SEQ ID NO: 58025 - protein, 433 aa, Xanthomonas campestris pv. campestris str. ATCC 33913; identical to SEQ ID NO: 36465

SEQ ID NO: 58026 - DNA, 1413 bp, Xanthomonas campestris pv. campestris str. ATCC 33913; identical to SEQ ID NO: 36466
  CDS (1)..(1413)

SEQ ID NO: 58027 - protein, 470 aa, Xanthomonas campestris pv. campestris str. ATCC 33913; identical to SEQ ID NO: 36467

SEQ ID NO: 58028 - DNA, 1431 bp, Xanthomonas axonopodis pv. citri str. 306; identical to SEQ ID NO: 36468
  CDS (1)..(1431)

SEQ ID NO: 58029 - protein, 476 aa, Xanthomonas axonopodis pv. citri str. 306; identical to SEQ ID NO: 36469

SEQ ID NO: 58030 - DNA, 1482 bp, Xanthomonas axonopodis pv. citri str. 306; identical to SEQ ID NO: 36470
  CDS (1)..(1482)

SEQ ID NO: 58031 - protein, 493 aa, Xanthomonas axonopodis pv. citri str. 306; identical to SEQ ID NO: 36471

SEQ ID NO: 58032 - DNA, 1587 bp, Xanthomonas axonopodis pv. citri str. 306; identical to SEQ ID NO: 36472
  CDS (1)..(1587)

SEQ ID NO: 58033 - protein, 528 aa, Xanthomonas axonopodis pv. citri str. 306; identical to SEQ ID NO: 36473

SEQ ID NO: 58034 - DNA, 1317 bp, Xanthomonas axonopodis pv. citri str. 306; identical to SEQ ID NO: 36474
  CDS (1)..(1317)

SEQ ID NO: 58035 - protein, 438 aa, Xanthomonas axonopodis pv. citri str. 306; identical to SEQ ID NO: 36475

SEQ ID NO: 58036 - DNA, 1416 bp, Xanthomonas axonopodis pv. citri str. 306; identical to SEQ ID NO: 36476
  CDS (1)..(1416)

SEQ ID NO: 58037 - protein, 471 aa, Xanthomonas axonopodis pv. citri str. 306; identical to SEQ ID NO: 36477

SEQ ID NO: 58038 - DNA, 2010 bp, Drosophila melanogaster; identical to SEQ ID NO: 36478
  CDS (1)..(2010)

SEQ ID NO: 58039 - protein, 669 aa, Drosophila melanogaster; identical to SEQ ID NO: 36479

SEQ ID NO: 58040 - DNA, 1815 bp, Drosophila melanogaster; identical to SEQ ID NO: 36480
  CDS (1)..(1815)

SEQ ID NO: 58041 - protein, 604 aa, Drosophila melanogaster; identical to SEQ ID NO: 36481

SEQ ID NO: 58042 - DNA, 1518 bp, Drosophila melanogaster; identical to SEQ ID NO: 36482
  CDS (1)..(1518)

SEQ ID NO: 58043 - protein, 505 aa, Drosophila melanogaster; identical to SEQ ID NO: 36483

SEQ ID NO: 58044 - DNA, 1416 bp, Bacillus anthracis str. A2012; identical to SEQ ID NO: 36484
  CDS (1)..(1416)

SEQ ID NO: 58045 - protein, 471 aa, Bacillus anthracis str. A2012; identical to SEQ ID NO: 36485

SEQ ID NO: 58046 - DNA, 1404 bp, Bacillus anthracis str. A2012; identical to SEQ ID NO: 36486
  CDS (1)..(1404)

SEQ ID NO: 58047 - protein, 467 aa, Bacillus anthracis str. A2012; identical to SEQ ID NO: 36487

SEQ ID NO: 58048 - DNA, 1287 bp, Bacillus anthracis str. A2012; identical to SEQ ID NO: 36488
  CDS (1)..(1287)

SEQ ID NO: 58049 - protein, 428 aa, Bacillus anthracis str. A2012; identical to SEQ ID NO: 36489

SEQ ID NO: 58050 - DNA, 1359 bp, Mus musculus; identical to SEQ ID NO: 36490
  CDS (1)..(1359)

SEQ ID NO: 58051 - protein, 452 aa, Mus musculus; identical to SEQ ID NO: 36491

SEQ ID NO: 58052 - DNA, 1488 bp, Chlorobium tepidum TLS; identical to SEQ ID NO: 36492
  CDS (1)..(1488)

SEQ ID NO: 58053 - protein, 495 aa, Chlorobium tepidum TLS; identical to SEQ ID NO: 36493

SEQ ID NO: 58054 - DNA, 1392 bp, Streptococcus pyogenes MGAS315; identical to SEQ ID NO: 36494
  CDS (1)..(1392)

SEQ ID NO: 58055 - protein, 463 aa, Streptococcus pyogenes MGAS315; identical to SEQ ID NO: 36495

SEQ ID NO: 58056 - DNA, 1137 bp, Thermosynechococcus elongatus BP-1; identical to SEQ ID NO: 36496
  CDS (1)..(1137)

SEQ ID NO: 58057 - protein, 378 aa, Thermosynechococcus elongatus BP-1; identical to SEQ ID NO: 36497

SEQ ID NO: 58058 - DNA, 1374 bp, Shigella flexneri 2a str. 301; identical to SEQ ID NO: 9205
  CDS (1)..(1374)

SEQ ID NO: 58059 - protein, 457 aa, Shigella flexneri 2a str. 301; identical to SEQ ID NO: 9206

SEQ ID NO: 58060 - DNA, 1293 bp, Shigella flexneri 2a str. 301; identical to SEQ ID NO: 36500
  CDS (1)..(1293)

SEQ ID NO: 58061 - protein, 430 aa, Shigella flexneri 2a str. 301; identical to SEQ ID NO: 36501

SEQ ID NO: 58062 - DNA, 1257 bp, Shigella flexneri 2a str. 301; identical to SEQ ID NO: 36502
  CDS (1)..(1257)

SEQ ID NO: 58063 - protein, 418 aa, Shigella flexneri 2a str. 301; identical to SEQ ID NO: 36503

SEQ ID NO: 58064 - DNA, 1626 bp, Drosophila melanogaster; identical to SEQ ID NO: 36504
  CDS (1)..(1626)

SEQ ID NO: 58065 - protein, 541 aa, Drosophila melanogaster; identical to SEQ ID NO: 36505

SEQ ID NO: 58066 - DNA, 1866 bp, Drosophila melanogaster; identical to SEQ ID NO: 36506
  CDS (1)..(1866)

SEQ ID NO: 58067 - protein, 621 aa, Drosophila melanogaster; identical to SEQ ID NO: 36507

SEQ ID NO: 58068 - DNA, 1353 bp, Streptococcus agalactiae NEM316; identical to SEQ ID NO: 36508
  CDS (1)..(1353)

SEQ ID NO: 58069 - protein, 450 aa, Streptococcus agalactiae NEM316; identical to SEQ ID NO: 36509

SEQ ID NO: 58070 - DNA, 1452 bp, Staphylococcus epidermidis ATCC 12228; identical to SEQ ID NO: 36510
  CDS (1)..(1452)

SEQ ID NO: 58071 - protein, 483 aa, Staphylococcus epidermidis ATCC 12228; identical to SEQ ID NO: 36511

SEQ ID NO: 58072 - DNA, 1368 bp, Bradyrhizobium japonicum USDA 110; identical to SEQ ID NO: 36512
  CDS (1)..(1368)

SEQ ID NO: 58073 - protein, 455 aa, Bradyrhizobium japonicum USDA 110; identical to SEQ ID NO: 36513

SEQ ID NO: 58074 - DNA, 1434 bp, Xylella fastidiosa Temecula1; identical to SEQ ID NO: 36514
  CDS (1)..(1434)

SEQ ID NO: 58075 - protein, 477 aa, Xylella fastidiosa Temecula1; identical to SEQ ID NO: 36515

SEQ ID NO: 58076 - DNA, 1443 bp, Xylella fastidiosa Temecula1; identical to SEQ ID NO: 36516
  CDS (1)..(1443)

SEQ ID NO: 58077 - protein, 480 aa, Xylella fastidiosa Temecula1; identical to SEQ ID NO: 36517

SEQ ID NO: 58078 - DNA, 1398 bp, Lactobacillus plantarum WCFS1; identical to SEQ ID NO: 36518
  CDS (1)..(1398)

SEQ ID NO: 58079 - protein, 465 aa, Lactobacillus plantarum WCFS1; identical to SEQ ID NO: 36519

SEQ ID NO: 58080 - DNA, 1332 bp, Lactobacillus plantarum WCFS1; identical to SEQ ID NO: 36520
  CDS (1)..(1332)

SEQ ID NO: 58081 - protein, 443 aa, Lactobacillus plantarum WCFS1; identical to SEQ ID NO: 36521

SEQ ID NO: 58082 - DNA, 1428 bp, Lactobacillus plantarum WCFS1; identical to SEQ ID NO: 36522
  CDS (1)..(1428)

SEQ ID NO: 58083 - protein, 475 aa, Lactobacillus plantarum WCFS1; identical to SEQ ID NO: 36523

SEQ ID NO: 58084 - DNA, 1500 bp, Lactobacillus plantarum WCFS1; identical to SEQ ID NO: 36524
  CDS (1)..(1500)

SEQ ID NO: 58085 - protein, 499 aa, Lactobacillus plantarum WCFS1; identical to SEQ ID NO: 36525

SEQ ID NO: 58086 - DNA, 1341 bp, Lactobacillus plantarum WCFS1; identical to SEQ ID NO: 9305
  CDS (1)..(1341)

SEQ ID NO: 58087 - protein, 446 aa, Lactobacillus plantarum WCFS1; identical to SEQ ID NO: 9306

SEQ ID NO: 58088 - DNA, 1425 bp, Lactobacillus plantarum WCFS1; identical to SEQ ID NO: 36528
  CDS (1)..(1425)

SEQ ID NO: 58089 - protein, 474 aa, Lactobacillus plantarum WCFS1; identical to SEQ ID NO: 36529

SEQ ID NO: 58090 - DNA, 1290 bp, Salmonella enterica subsp. enterica serovar Typhi Ty2; identical to SEQ ID NO: 36530
  CDS (1)..(1290)

SEQ ID NO: 58091 - protein, 429 aa, Salmonella enterica subsp. enterica serovar Typhi Ty2; identical to SEQ ID NO: 36531

SEQ ID NO: 58092 - DNA, 1392 bp, Enterococcus faecalis V583; identical to SEQ ID NO: 36532
  CDS (1)..(1392)

SEQ ID NO: 58093 - protein, 463 aa, Enterococcus faecalis V583; identical to SEQ ID NO: 36533

SEQ ID NO: 58094 - DNA, 1500 bp, Enterococcus faecalis V583; identical to SEQ ID NO: 36534
  CDS (1)..(1500)

SEQ ID NO: 58095 - protein, 499 aa, Enterococcus faecalis V583; identical to SEQ ID NO: 36535

SEQ ID NO: 58096 - DNA, 1314 bp, Coxiella burnetii RSA 493; identical to SEQ ID NO: 36536
  CDS (1)..(1314)

SEQ ID NO: 58097 - protein, 437 aa, Coxiella burnetii RSA 493; identical to SEQ ID NO: 36537

SEQ ID NO: 58098 - DNA, 1464 bp, Streptomyces avermitilis MA-4680; identical to SEQ ID NO: 9239
  CDS (1)..(1464)

SEQ ID NO: 58099 - protein, 487 aa, Streptomyces avermitilis MA-4680; identical to SEQ ID NO: 9240

SEQ ID NO: 58100 - DNA, 1479 bp, Streptomyces avermitilis MA-4680; identical to SEQ ID NO: 36540
  CDS (1)..(1479)

SEQ ID NO: 58101 - protein, 492 aa, Streptomyces avermitilis MA-4680; identical to SEQ ID NO: 36541

SEQ ID NO: 58102 - DNA, 1416 bp, Bacillus cereus ATCC 14579; identical to SEQ ID NO: 36542
  CDS (1)..(1416)

SEQ ID NO: 58103 - protein, 471 aa, Bacillus cereus ATCC 14579; identical to SEQ ID NO: 36543

SEQ ID NO: 58104 - DNA, 1311 bp, Bacillus cereus ATCC 14579; identical to SEQ ID NO: 36544
  CDS (1)..(1311)

SEQ ID NO: 58105 - protein, 436 aa, Bacillus cereus ATCC 14579; identical to SEQ ID NO: 36545

SEQ ID NO: 58106 - DNA, 1257 bp, Shigella flexneri 2a str. 2457T; identical to SEQ ID NO: 36546
  CDS (1)..(1257)

SEQ ID NO: 58107 - protein, 418 aa, Shigella flexneri 2a str. 2457T; identical to SEQ ID NO: 36547

SEQ ID NO: 58108 - DNA, 1563 bp, Nitrosomonas europaea ATCC 19718; identical to SEQ ID NO: 36548
  CDS (1)..(1563)

SEQ ID NO: 58109 - protein, 520 aa, Nitrosomonas europaea ATCC 19718; identical to SEQ ID NO: 36549

SEQ ID NO: 58110 - DNA, 1446 bp, Mycobacterium bovis AF2122/97; identical to SEQ ID NO: 36550
  CDS (1)..(1446)

SEQ ID NO: 58111 - protein, 481 aa, Mycobacterium bovis AF2122/97; identical to SEQ ID NO: 36551

SEQ ID NO: 58112 - DNA, 1470 bp, Mycobacterium bovis AF2122/97; identical to SEQ ID NO: 36552
  CDS (1)..(1470)

SEQ ID NO: 58113 - protein, 489 aa, Mycobacterium bovis AF2122/97; identical to SEQ ID NO: 9208

SEQ ID NO: 58114 - DNA, 1329 bp, Rhodopirellula baltica SH 1; identical to SEQ ID NO: 36554
  CDS (1)..(1329)

SEQ ID NO: 58115 - protein, 442 aa, Rhodopirellula baltica SH 1; identical to SEQ ID NO: 36555

SEQ ID NO: 58116 - DNA, 2190 bp, Rhodopirellula baltica SH 1; identical to SEQ ID NO: 36556
  CDS (1)..(2190)

SEQ ID NO: 58117 - protein, 729 aa, Rhodopirellula baltica SH 1; identical to SEQ ID NO: 36557

SEQ ID NO: 58118 - DNA, 1455 bp, Rhodopirellula baltica SH 1; identical to SEQ ID NO: 36558
  CDS (1)..(1455)

SEQ ID NO: 58119 - protein, 484 aa, Rhodopirellula baltica SH 1; identical to SEQ ID NO: 36559

SEQ ID NO: 58120 - DNA, 1338 bp, Bordetella parapertussis 12822; identical to SEQ ID NO: 36560
  CDS (1)..(1338)

SEQ ID NO: 58121 - protein, 445 aa, Bordetella parapertussis 12822; identical to SEQ ID NO: 36561

SEQ ID NO: 58122 - DNA, 1338 bp, Bordetella bronchiseptica RB50; identical to SEQ ID NO: 36562
  CDS (1)..(1338)

SEQ ID NO: 58123 - protein, 445 aa, Bordetella bronchiseptica RB50; identical to SEQ ID NO: 36563

SEQ ID NO: 58124 - DNA, 1398 bp, Chromobacterium violaceum ATCC 12472; identical to SEQ ID NO: 36564
  CDS (1)..(1398)

SEQ ID NO: 58125 - protein, 465 aa, Chromobacterium violaceum ATCC 12472; identical to SEQ ID NO: 36565

SEQ ID NO: 58126 - DNA, 1332 bp, Chromobacterium violaceum ATCC 12472; identical to SEQ ID NO: 36566
  CDS (1)..(1332)

SEQ ID NO: 58127 - protein, 443 aa, Chromobacterium violaceum ATCC 12472; identical to SEQ ID NO: 36567

SEQ ID NO: 58128 - DNA, 1851 bp, Oryza sativa (japonica cultivar-group); identical to SEQ ID NO: 36568
  CDS (1)..(1851)

SEQ ID NO: 58129 - protein, 616 aa, Oryza sativa (japonica cultivar-group); identical to SEQ ID NO: 36569

SEQ ID NO: 58130 - DNA, 1332 bp, Gloeobacter violaceus PCC 7421; identical to SEQ ID NO: 36570
  CDS (1)..(1332)

SEQ ID NO: 58131 - protein, 443 aa, Gloeobacter violaceus PCC 7421; identical to SEQ ID NO: 36571

SEQ ID NO: 58132 - DNA, 1416 bp, Gloeobacter violaceus PCC 7421; identical to SEQ ID NO: 36572
  CDS (1)..(1416)

SEQ ID NO: 58133 - protein, 471 aa, Gloeobacter violaceus PCC 7421; identical to SEQ ID NO: 36573

SEQ ID NO: 58134 - DNA, 1371 bp, Gloeobacter violaceus PCC 7421; identical to SEQ ID NO: 36574
  CDS (1)..(1371)

SEQ ID NO: 58135 - protein, 456 aa, Gloeobacter violaceus PCC 7421; identical to SEQ ID NO: 36575

SEQ ID NO: 58136 - DNA, 1602 bp, Photorhabdus luminescens subsp. laumondii TTO1; identical to SEQ ID NO: 36576
  CDS (1)..(1602)

SEQ ID NO: 58137 - protein, 533 aa, Photorhabdus luminescens subsp. laumondii TTO1; identical to SEQ ID NO: 36577

SEQ ID NO: 58138 - DNA, 1413 bp, Corynebacterium diphtheriae NCTC 13129; identical to SEQ ID NO: 9471
  CDS (1)..(1413)

SEQ ID NO: 58139 - protein, 470 aa, Corynebacterium diphtheriae NCTC 13129; identical to SEQ ID NO: 9472

SEQ ID NO: 58140 - DNA, 1482 bp, Rhodopseudomonas palustris CGA009; identical to SEQ ID NO: 36580
  CDS (1)..(1482)

SEQ ID NO: 58141 - protein, 493 aa, Rhodopseudomonas palustris CGA009; identical to SEQ ID NO: 36581

SEQ ID NO: 58142 - DNA, 1518 bp, Mycobacterium avium subsp. paratuberculosis str. k10; identical to SEQ ID NO: 36582
  CDS (1)..(1518)

SEQ ID NO: 58143 - protein, 505 aa, Mycobacterium avium subsp. paratuberculosis str. k10; identical to SEQ ID NO: 36583

SEQ ID NO: 58144 - DNA, 1353 bp, Lactobacillus johnsonii NCC 533; identical to SEQ ID NO: 36584
  CDS (1)..(1353)

SEQ ID NO: 58145 - protein, 450 aa, Lactobacillus johnsonii NCC 533; identical to SEQ ID NO: 36585

SEQ ID NO: 58146 - DNA, 1377 bp, Lactobacillus johnsonii NCC 533; identical to SEQ ID NO: 36586
  CDS (1)..(1377)

SEQ ID NO: 58147 - protein, 458 aa, Lactobacillus johnsonii NCC 533; identical to SEQ ID NO: 36587

SEQ ID NO: 58148 - DNA, 1311 bp, Lactobacillus johnsonii NCC 533; identical to SEQ ID NO: 36588
  CDS (1)..(1311)

SEQ ID NO: 58149 - protein, 436 aa, Lactobacillus johnsonii NCC 533; identical to SEQ ID NO: 36589

SEQ ID NO: 58150 - DNA, 1353 bp, Lactobacillus johnsonii NCC 533; identical to SEQ ID NO: 36590
  CDS (1)..(1353)

SEQ ID NO: 58151 - protein, 450 aa, Lactobacillus johnsonii NCC 533; identical to SEQ ID NO: 36591

SEQ ID NO: 58152 - DNA, 1389 bp, Lactobacillus johnsonii NCC 533; identical to SEQ ID NO: 36592
  CDS (1)..(1389)

SEQ ID NO: 58153 - protein, 462 aa, Lactobacillus johnsonii NCC 533; identical to SEQ ID NO: 36593

SEQ ID NO: 58154 - DNA, 1401 bp, Lactobacillus johnsonii NCC 533; identical to SEQ ID NO: 36594
  CDS (1)..(1401)

SEQ ID NO: 58155 - protein, 466 aa, Lactobacillus johnsonii NCC 533; identical to SEQ ID NO: 36595

SEQ ID NO: 58156 - DNA, 1398 bp, Lactobacillus johnsonii NCC 533; identical to SEQ ID NO: 36596
  CDS (1)..(1398)

SEQ ID NO: 58157 - protein, 465 aa, Lactobacillus johnsonii NCC 533; identical to SEQ ID NO: 36597

SEQ ID NO: 58158 - DNA, 1239 bp, Bdellovibrio bacteriovorus HD100; identical to SEQ ID NO: 36598
  CDS (1)..(1239)

SEQ ID NO: 58159 - protein, 412 aa, Bdellovibrio bacteriovorus HD100; identical to SEQ ID NO: 36599

SEQ ID NO: 58160 - DNA, 1281 bp, Treponema denticola ATCC 35405; identical to SEQ ID NO: 36600
  CDS (1)..(1281)

SEQ ID NO: 58161 - protein, 426 aa, Treponema denticola ATCC 35405; identical to SEQ ID NO: 36601

SEQ ID NO: 58162 - DNA, 1404 bp, Bacillus cereus ATCC 10987; identical to SEQ ID NO: 36602
  CDS (1)..(1404)

SEQ ID NO: 58163 - protein, 467 aa, Bacillus cereus ATCC 10987; identical to SEQ ID NO: 36603

SEQ ID NO: 58164 - DNA, 1416 bp, Bacillus cereus ATCC 10987; identical to SEQ ID NO: 36604
  CDS (1)..(1416)

SEQ ID NO: 58165 - protein, 471 aa, Bacillus cereus ATCC 10987; identical to SEQ ID NO: 36605

SEQ ID NO: 58166 - DNA, 1590 bp, Xenopus tropicalis; identical to SEQ ID NO: 36606
  CDS (1)..(1590)

SEQ ID NO: 58167 - protein, 529 aa, Xenopus tropicalis; identical to SEQ ID NO: 36607

SEQ ID NO: 58168 - DNA, 1527 bp, Xenopus tropicalis; identical to SEQ ID NO: 36608
  CDS (1)..(1527)

SEQ ID NO: 58169 - protein, 508 aa, Xenopus tropicalis; identical to SEQ ID NO: 36609

SEQ ID NO: 58170 - DNA, 1827 bp, Rattus norvegicus; identical to SEQ ID NO: 36610
  CDS (1)..(1827)

SEQ ID NO: 58171 - protein, 608 aa, Rattus norvegicus; identical to SEQ ID NO: 36611

SEQ ID NO: 58172 - DNA, 1908 bp, Rattus norvegicus; identical to SEQ ID NO: 36612
  CDS (1)..(1908)

SEQ ID NO: 58173 - protein, 635 aa, Rattus norvegicus; identical to SEQ ID NO: 36613

SEQ ID NO: 58174 - DNA, 1467 bp, Rattus norvegicus; identical to SEQ ID NO: 36614
  CDS (1)..(1467)

SEQ ID NO: 58175 - protein, 488 aa, Rattus norvegicus; identical to SEQ ID NO: 36615

SEQ ID NO: 58176 - DNA, 1575 bp, Anopheles gambiae str. PEST; identical to SEQ ID NO: 36616
  CDS (1)..(1575)

SEQ ID NO: 58177 - protein, 524 aa, Anopheles gambiae str. PEST; identical to SEQ ID NO: 36617

SEQ ID NO: 58178 - DNA, 1707 bp, Apis mellifera; identical to SEQ ID NO: 36618
  CDS (1)..(1707)

SEQ ID NO: 58179 - protein, 568 aa, Apis mellifera; identical to SEQ ID NO: 36619

SEQ ID NO: 58180 - DNA, 1656 bp, Apis mellifera; identical to SEQ ID NO: 36620
  CDS (1)..(1656)

SEQ ID NO: 58181 - protein, 551 aa, Apis mellifera; identical to SEQ ID NO: 36621

SEQ ID NO: 58182 - DNA, 2163 bp, Apis mellifera; identical to SEQ ID NO: 36622
  CDS (1)..(2163)

SEQ ID NO: 58183 - protein, 720 aa, Apis mellifera; identical to SEQ ID NO: 36623

SEQ ID NO: 58184 - DNA, 1446 bp, Apis mellifera; identical to SEQ ID NO: 36624
  CDS (1)..(1446)

SEQ ID NO: 58185 - protein, 481 aa, Apis mellifera; identical to SEQ ID NO: 36625

SEQ ID NO: 58186 - DNA, 2076 bp, Ustilago maydis 521; identical to SEQ ID NO: 36626
  CDS (1)..(2076)

SEQ ID NO: 58187 - protein, 691 aa, Ustilago maydis 521; identical to SEQ ID NO: 36627

SEQ ID NO: 58188 - DNA, 2328 bp, Gallus gallus; identical to SEQ ID NO: 36628
  CDS (1)..(2328)

SEQ ID NO: 58189 - protein, 775 aa, Gallus gallus; identical to SEQ ID NO: 36629

SEQ ID NO: 58190 - DNA, 1818 bp, Oryza sativa (japonica cultivar-group); identical to SEQ ID NO: 36630
  CDS (1)..(1818)

SEQ ID NO: 58191 - protein, 605 aa, Oryza sativa (japonica cultivar-group); identical to SEQ ID NO: 36631

SEQ ID NO: 58192 - DNA, 1920 bp, Oryza sativa (japonica cultivar-group); identical to SEQ ID NO: 36632
  CDS (1)..(1920)

SEQ ID NO: 58193 - protein, 639 aa, Oryza sativa (japonica cultivar-group); identical to SEQ ID NO: 36633

SEQ ID NO: 58194 - DNA, 1686 bp, Oryza sativa (japonica cultivar-group); identical to SEQ ID NO: 36634
  CDS (1)..(1686)

SEQ ID NO: 58195 - protein, 561 aa, Oryza sativa (japonica cultivar-group); identical to SEQ ID NO: 36635

SEQ ID NO: 58196 - DNA, 1599 bp, Yarrowia lipolytica CLIB99; identical to SEQ ID NO: 36636
  CDS (1)..(1599)

SEQ ID NO: 58197 - protein, 532 aa, Yarrowia lipolytica CLIB99; identical to SEQ ID NO: 36637

SEQ ID NO: 58198 - DNA, 1656 bp, Canis familiaris; identical to SEQ ID NO: 36638
  CDS (1)..(1656)

SEQ ID NO: 58199 - protein, 551 aa, Canis familiaris; identical to SEQ ID NO: 36639

SEQ ID NO: 58200 - DNA, 1599 bp, Canis familiaris; identical to SEQ ID NO: 36640
  CDS (1)..(1599)

SEQ ID NO: 58201 - protein, 532 aa, Canis familiaris; identical to SEQ ID NO: 36641

SEQ ID NO: 58202 - DNA, 1308 bp, Parachlamydia sp. UWE25; identical to SEQ ID NO: 36642
  CDS (1)..(1308)

SEQ ID NO: 58203 - protein, 435 aa, Parachlamydia sp. UWE25; identical to SEQ ID NO: 36643

SEQ ID NO: 58204 - DNA, 1332 bp, Picrophilus torridus DSM 9790; identical to SEQ ID NO: 36644
  CDS (1)..(1332)

SEQ ID NO: 58205 - protein, 443 aa, Picrophilus torridus DSM 9790; identical to SEQ ID NO: 36645

SEQ ID NO: 58206 - DNA, 1338 bp, Picrophilus torridus DSM 9790; identical to SEQ ID NO: 36646
  CDS (1)..(1338)

SEQ ID NO: 58207 - protein, 445 aa, Picrophilus torridus DSM 9790; identical to SEQ ID NO: 36647

SEQ ID NO: 58208 - DNA, 1404 bp, Bacillus thuringiensis serovar konkukian str. 97-27; identical to SEQ ID NO: 36648
  CDS (1)..(1404)

SEQ ID NO: 58209 - protein, 467 aa, Bacillus thuringiensis serovar konkukian str. 97-27; identical to SEQ ID NO: 36649

SEQ ID NO: 58210 - DNA, 1317 bp, Bacillus thuringiensis serovar konkukian str. 97-27; identical to SEQ ID NO: 36650
  CDS (1)..(1317)

SEQ ID NO: 58211 - protein, 438 aa, Bacillus thuringiensis serovar konkukian str. 97-27; identical to SEQ ID NO: 36651

SEQ ID NO: 58212 - DNA, 1485 bp, Acinetobacter sp. ADP1; identical to SEQ ID NO: 36652
  CDS (1)..(1485)

SEQ ID NO: 58213 - protein, 494 aa, Acinetobacter sp. ADP1; identical to SEQ ID NO: 36653

SEQ ID NO: 58214 - DNA, 1377 bp, Erwinia carotovora subsp. atroseptica SCRI1043; identical to SEQ ID NO: 36654
  CDS (1)..(1377)

SEQ ID NO: 58215 - protein, 458 aa, Erwinia carotovora subsp. atroseptica SCRI1043; identical to SEQ ID NO: 36655

SEQ ID NO: 58216 - DNA, 1449 bp, Propionibacterium acnes KPA171202; identical to SEQ ID NO: 36656
  CDS (1)..(1449)

SEQ ID NO: 58217 - protein, 482 aa, Propionibacterium acnes KPA171202; identical to SEQ ID NO: 36657

SEQ ID NO: 58218 - DNA, 1407 bp, Propionibacterium acnes KPA171202; identical to SEQ ID NO: 36658
  CDS (1)..(1407)

SEQ ID NO: 58219 - protein, 468 aa, Propionibacterium acnes KPA171202; identical to SEQ ID NO: 36659

SEQ ID NO: 58220 - DNA, 1461 bp, Streptococcus pyogenes MGAS10394; identical to SEQ ID NO: 36660
  CDS (1)..(1461)

SEQ ID NO: 58221 - protein, 486 aa, Streptococcus pyogenes MGAS10394; identical to SEQ ID NO: 36661

SEQ ID NO: 58222 - DNA, 1518 bp, Desulfotalea psychrophila LSv54; identical to SEQ ID NO: 36662
  CDS (1)..(1518)

SEQ ID NO: 58223 - protein, 505 aa, Desulfotalea psychrophila LSv54; identical to SEQ ID NO: 36663

SEQ ID NO: 58224 - DNA, 1407 bp, Rickettsia typhi str. Wilmington; identical to SEQ ID NO: 36664
  CDS (1)..(1407)

SEQ ID NO: 58225 - protein, 468 aa, Rickettsia typhi str. Wilmington; identical to SEQ ID NO: 36665

SEQ ID NO: 58226 - DNA, 1416 bp, Bacillus cereus ZK; identical to SEQ ID NO: 36666
  CDS (1)..(1416)

SEQ ID NO: 58227 - protein, 471 aa, Bacillus cereus ZK; identical to SEQ ID NO: 36667

SEQ ID NO: 58228 - DNA, 1404 bp, Bacillus cereus ZK; identical to SEQ ID NO: 36668
  CDS (1)..(1404)

SEQ ID NO: 58229 - protein, 467 aa, Bacillus cereus ZK; identical to SEQ ID NO: 36669

SEQ ID NO: 58230 - DNA, 1416 bp, Bacillus cereus ZK; identical to SEQ ID NO: 36670
  CDS (1)..(1416)

SEQ ID NO: 58231 - protein, 471 aa, Bacillus cereus ZK; identical to SEQ ID NO: 36671

SEQ ID NO: 58232 - DNA, 1287 bp, Bacillus cereus ZK; identical to SEQ ID NO: 36672
  CDS (1)..(1287)

SEQ ID NO: 58233 - protein, 428 aa, Bacillus cereus ZK; identical to SEQ ID NO: 36673

SEQ ID NO: 58234 - DNA, 1317 bp, Bacillus cereus ZK; identical to SEQ ID NO: 36674
  CDS (1)..(1317)

SEQ ID NO: 58235 - protein, 438 aa, Bacillus cereus ZK; identical to SEQ ID NO: 36675

SEQ ID NO: 58236 - DNA, 1329 bp, Bacillus licheniformis ATCC 14580; identical to SEQ ID NO: 36676
  CDS (1)..(1329)

SEQ ID NO: 58237 - protein, 442 aa, Bacillus licheniformis ATCC 14580; identical to SEQ ID NO: 36677

SEQ ID NO: 58238 - DNA, 1578 bp, Bacillus licheniformis ATCC 14580; identical to SEQ ID NO: 36678
  CDS (1)..(1578)

SEQ ID NO: 58239 - protein, 525 aa, Bacillus licheniformis ATCC 14580; identical to SEQ ID NO: 36679

SEQ ID NO: 58240 - DNA, 1668 bp, Bacteroides fragilis YCH46; identical to SEQ ID NO: 36680
  CDS (1)..(1668)

SEQ ID NO: 58241 - protein, 555 aa, Bacteroides fragilis YCH46; identical to SEQ ID NO: 36681

SEQ ID NO: 58242 - DNA, 1404 bp, Burkholderia mallei ATCC 23344; identical to SEQ ID NO: 36682
  CDS (1)..(1404)

SEQ ID NO: 58243 - protein, 467 aa, Burkholderia mallei ATCC 23344; identical to SEQ ID NO: 36683

SEQ ID NO: 58244 - DNA, 1404 bp, Burkholderia pseudomallei K96243; identical to SEQ ID NO: 36684
  CDS (1)..(1404)

SEQ ID NO: 58245 - protein, 467 aa, Burkholderia pseudomallei K96243; identical to SEQ ID NO: 36685

SEQ ID NO: 58246 - DNA, 1296 bp, Burkholderia pseudomallei K96243; identical to SEQ ID NO: 36686
  CDS (1)..(1296)

SEQ ID NO: 58247 - protein, 431 aa, Burkholderia pseudomallei K96243; identical to SEQ ID NO: 36687

SEQ ID NO: 58248 - DNA, 1398 bp, Methylococcus capsulatus str. Bath; identical to SEQ ID NO: 36688
  CDS (1)..(1398)

SEQ ID NO: 58249 - protein, 465 aa, Methylococcus capsulatus str. Bath; identical to SEQ ID NO: 36689

SEQ ID NO: 58250 - DNA, 1422 bp, Methylococcus capsulatus str. Bath; identical to SEQ ID NO: 36690
  CDS (1)..(1422)

SEQ ID NO: 58251 - protein, 473 aa, Methylococcus capsulatus str. Bath; identical to SEQ ID NO: 36691

SEQ ID NO: 58252 - DNA, 1293 bp, Methylococcus capsulatus str. Bath; identical to SEQ ID NO: 36692
  CDS (1)..(1293)

SEQ ID NO: 58253 - protein, 430 aa, Methylococcus capsulatus str. Bath; identical to SEQ ID NO: 36693

SEQ ID NO: 58254 - DNA, 1338 bp, Nocardia farcinica IFM 10152; identical to SEQ ID NO: 36694
  CDS (1)..(1338)

SEQ ID NO: 58255 - protein, 445 aa, Nocardia farcinica IFM 10152; identical to SEQ ID NO: 36695

SEQ ID NO: 58256 - DNA, 1488 bp, Nocardia farcinica IFM 10152; identical to SEQ ID NO: 36696
  CDS (1)..(1488)

SEQ ID NO: 58257 - protein, 495 aa, Nocardia farcinica IFM 10152; identical to SEQ ID NO: 36697

SEQ ID NO: 58258 - DNA, 1296 bp, Legionella pneumophila str. Paris; identical to SEQ ID NO: 36698
  CDS (1)..(1296)

SEQ ID NO: 58259 - protein, 431 aa, Legionella pneumophila str. Paris; identical to SEQ ID NO: 36699

SEQ ID NO: 58260 - DNA, 1185 bp, Legionella pneumophila str. Paris; identical to SEQ ID NO: 36700
  CDS (1)..(1185)

SEQ ID NO: 58261 - protein, 394 aa, Legionella pneumophila str. Paris; identical to SEQ ID NO: 36701

SEQ ID NO: 58262 - DNA, 1185 bp, Legionella pneumophila str. Lens; identical to SEQ ID NO: 36702
  CDS (1)..(1185)

SEQ ID NO: 58263 - protein, 394 aa, Legionella pneumophila str. Lens; identical to SEQ ID NO: 36703

SEQ ID NO: 58264 - DNA, 1455 bp, Haloarcula marismortui ATCC 43049; identical to SEQ ID NO: 36704
  CDS (1)..(1455)

SEQ ID NO: 58265 - protein, 484 aa, Haloarcula marismortui ATCC 43049; identical to SEQ ID NO: 36705

SEQ ID NO: 58266 - DNA, 2265 bp, Haloarcula marismortui ATCC 43049; identical to SEQ ID NO: 36706
  CDS (1)..(2265)

SEQ ID NO: 58267 - protein, 754 aa, Haloarcula marismortui ATCC 43049; identical to SEQ ID NO: 36707

SEQ ID NO: 58268 - DNA, 2205 bp, Haloarcula marismortui ATCC 43049; identical to SEQ ID NO: 36708
  CDS (1)..(2205)

SEQ ID NO: 58269 - protein, 734 aa, Haloarcula marismortui ATCC 43049; identical to SEQ ID NO: 36709

SEQ ID NO: 58270 - DNA, 1386 bp, Streptococcus thermophilus LMG 18311; identical to SEQ ID NO: 36710
  CDS (1)..(1386)

SEQ ID NO: 58271 - protein, 461 aa, Streptococcus thermophilus LMG 18311; identical to SEQ ID NO: 36711

SEQ ID NO: 58272 - DNA, 1386 bp, Streptococcus thermophilus CNRZ1066; identical to SEQ ID NO: 36712
  CDS (1)..(1386)

SEQ ID NO: 58273 - protein, 461 aa, Streptococcus thermophilus CNRZ1066; identical to SEQ ID NO: 36713

SEQ ID NO: 58274 - DNA, 1416 bp, Geobacillus kaustophilus HTA426; identical to SEQ ID NO: 36714
  CDS (1)..(1416)

SEQ ID NO: 58275 - protein, 471 aa, Geobacillus kaustophilus HTA426; identical to SEQ ID NO: 36715

SEQ ID NO: 58276 - DNA, 1365 bp, Geobacillus kaustophilus HTA426; identical to SEQ ID NO: 36716
  CDS (1)..(1365)

SEQ ID NO: 58277 - protein, 454 aa, Geobacillus kaustophilus HTA426; identical to SEQ ID NO: 36717

SEQ ID NO: 58278 - DNA, 1407 bp, Salmonella enterica subsp. enterica serovar Paratypi A str. ATCC; identical to SEQ ID NO: 36718
  CDS (1)..(1407)

SEQ ID NO: 58279 - protein, 468 aa, Salmonella enterica subsp. enterica serovar Paratypi A str. ATCC; identical to SEQ ID NO: 36719

SEQ ID NO: 58280 - DNA, 1371 bp, Salmonella enterica subsp. enterica serovar Paratypi A str. ATCC; identical to SEQ ID NO: 36720
  CDS (1)..(1371)

SEQ ID NO: 58281 - protein, 456 aa, Salmonella enterica subsp. enterica serovar Paratypi A str. ATCC; identical to SEQ ID NO: 36721

SEQ ID NO: 58282 - DNA, 1311 bp, Idiomarina loihiensis L2TR; identical to SEQ ID NO: 36722
  CDS (1)..(1311)

SEQ ID NO: 58283 - protein, 436 aa, Idiomarina loihiensis L2TR; identical to SEQ ID NO: 36723

SEQ ID NO: 58284 - DNA, 1221 bp, Idiomarina loihiensis L2TR; identical to SEQ ID NO: 36724
  CDS (1)..(1221)

SEQ ID NO: 58285 - protein, 406 aa, Idiomarina loihiensis L2TR; identical to SEQ ID NO: 36725

SEQ ID NO: 58286 - DNA, 1497 bp, Zymomonas mobilis subsp. mobilis ZM4; identical to SEQ ID NO: 36726
  CDS (1)..(1497)

SEQ ID NO: 58287 - protein, 498 aa, Zymomonas mobilis subsp. mobilis ZM4; identical to SEQ ID NO: 36727

SEQ ID NO: 58288 - DNA, 1434 bp, Zymomonas mobilis subsp. mobilis ZM4; identical to SEQ ID NO: 36728
  CDS (1)..(1434)

SEQ ID NO: 58289 - protein, 477 aa, Zymomonas mobilis subsp. mobilis ZM4; identical to SEQ ID NO: 36729

SEQ ID NO: 58290 - DNA, 1347 bp, Silicibacter pomeroyi DSS-3; identical to SEQ ID NO: 36730
  CDS (1)..(1347)

SEQ ID NO: 58291 - protein, 448 aa, Silicibacter pomeroyi DSS-3; identical to SEQ ID NO: 36731

SEQ ID NO: 58292 - DNA, 1209 bp, Silicibacter pomeroyi DSS-3; identical to SEQ ID NO: 36732
  CDS (1)..(1209)

SEQ ID NO: 58293 - protein, 402 aa, Silicibacter pomeroyi DSS-3; identical to SEQ ID NO: 36733

SEQ ID NO: 58294 - DNA, 1443 bp, Xylella fastidiosa Dixon; identical to SEQ ID NO: 36734
  CDS (1)..(1443)

SEQ ID NO: 58295 - protein, 480 aa, Xylella fastidiosa Dixon; identical to SEQ ID NO: 36735

SEQ ID NO: 58296 - DNA, 1443 bp, Xylella fastidiosa Ann-1; identical to SEQ ID NO: 36736
  CDS (1)..(1443)

SEQ ID NO: 58297 - protein, 480 aa, Xylella fastidiosa Ann-1; identical to SEQ ID NO: 36737

SEQ ID NO: 58298 - DNA, 1437 bp, Xylella fastidiosa Ann-1; identical to SEQ ID NO: 36738
  CDS (1)..(1437)

SEQ ID NO: 58299 - protein, 478 aa, Xylella fastidiosa Ann-1; identical to SEQ ID NO: 36739

SEQ ID NO: 58300 - DNA, 1491 bp, Xylella fastidiosa Ann-1; identical to SEQ ID NO: 36740
  CDS (1)..(1491)

SEQ ID NO: 58301 - protein, 496 aa, Xylella fastidiosa Ann-1; identical to SEQ ID NO: 36741

SEQ ID NO: 58302 - DNA, 1329 bp, Lactobacillus gasseri; identical to SEQ ID NO: 36742
  CDS (1)..(1329)

SEQ ID NO: 58303 - protein, 442 aa, Lactobacillus gasseri; identical to SEQ ID NO: 36743

SEQ ID NO: 58304 - DNA, 1401 bp, Lactobacillus gasseri; identical to SEQ ID NO: 36744
  CDS (1)..(1401)

SEQ ID NO: 58305 - protein, 466 aa, Lactobacillus gasseri; identical to SEQ ID NO: 36745

SEQ ID NO: 58306 - DNA, 1332 bp, Leuconostoc mesenteroides subsp. mesenteroides ATCC 8293; identical to SEQ ID NO: 36746
  CDS (1)..(1332)

SEQ ID NO: 58307 - protein, 443 aa, Leuconostoc mesenteroides subsp. mesenteroides ATCC 8293; identical to SEQ ID NO: 36747

SEQ ID NO: 58308 - DNA, 1401 bp, Leuconostoc mesenteroides subsp. mesenteroides ATCC 8293; identical to SEQ ID NO: 36748
  CDS (1)..(1401)

SEQ ID NO: 58309 - protein, 466 aa, Leuconostoc mesenteroides subsp. mesenteroides ATCC 8293; identical to SEQ ID NO: 36749

SEQ ID NO: 58310 - DNA, 1332 bp, Leuconostoc mesenteroides subsp. mesenteroides ATCC 8293; identical to SEQ ID NO: 36750
  CDS (1)..(1332)

SEQ ID NO: 58311 - protein, 443 aa, Leuconostoc mesenteroides subsp. mesenteroides ATCC 8293; identical to SEQ ID NO: 36751

SEQ ID NO: 58312 - DNA, 1314 bp, Pseudomonas syringae pv. syringae B728a; identical to SEQ ID NO: 36752
  CDS (1)..(1314)

SEQ ID NO: 58313 - protein, 437 aa, Pseudomonas syringae pv. syringae B728a; identical to SEQ ID NO: 36753

SEQ ID NO: 58314 - DNA, 1284 bp, Rickettsia sibirica 246; identical to SEQ ID NO: 36754
  CDS (1)..(1284)

SEQ ID NO: 58315 - protein, 427 aa, Rickettsia sibirica 246; identical to SEQ ID NO: 36755

SEQ ID NO: 58316 - DNA, 1443 bp, Psychrobacter sp. 273-4; identical to SEQ ID NO: 36756
  CDS (1)..(1443)

SEQ ID NO: 58317 - protein, 480 aa, Psychrobacter sp. 273-4; identical to SEQ ID NO: 36757

SEQ ID NO: 58318 - DNA, 1446 bp, Rickettsia rickettsii; identical to SEQ ID NO: 36758
  CDS (1)..(1446)

SEQ ID NO: 58319 - protein, 481 aa, Rickettsia rickettsii; identical to SEQ ID NO: 36759

SEQ ID NO: 58320 - DNA, 1284 bp, Rickettsia rickettsii; identical to SEQ ID NO: 36760
  CDS (1)..(1284)

SEQ ID NO: 58321 - protein, 427 aa, Rickettsia rickettsii; identical to SEQ ID NO: 36761

SEQ ID NO: 58322 - DNA, 1359 bp, Anabaena variabilis ATCC 29413; identical to SEQ ID NO: 36762
  CDS (1)..(1359)

SEQ ID NO: 58323 - protein, 452 aa, Anabaena variabilis ATCC 29413; identical to SEQ ID NO: 36763

SEQ ID NO: 58324 - DNA, 1365 bp, Ralstonia eutropha JMP134; identical to SEQ ID NO: 36764
  CDS (1)..(1365)

SEQ ID NO: 58325 - protein, 454 aa, Ralstonia eutropha JMP134; identical to SEQ ID NO: 36765

SEQ ID NO: 58326 - DNA, 1383 bp, Ralstonia eutropha JMP134; identical to SEQ ID NO: 36766
  CDS (1)..(1383)

SEQ ID NO: 58327 - protein, 460 aa, Ralstonia eutropha JMP134; identical to SEQ ID NO: 36767

SEQ ID NO: 58328 - DNA, 1398 bp, Ralstonia eutropha JMP134; identical to SEQ ID NO: 36768
  CDS (1)..(1398)

SEQ ID NO: 58329 - protein, 465 aa, Ralstonia eutropha JMP134; identical to SEQ ID NO: 36769

SEQ ID NO: 58330 - DNA, 1407 bp, Methylobacillus flagellatus KT; identical to SEQ ID NO: 36770
  CDS (1)..(1407)

SEQ ID NO: 58331 - protein, 468 aa, Methylobacillus flagellatus KT; identical to SEQ ID NO: 36771

SEQ ID NO: 58332 - DNA, 1389 bp, Exiguobacterium sp. 255-15; identical to SEQ ID NO: 36772
  CDS (1)..(1389)

SEQ ID NO: 58333 - protein, 462 aa, Exiguobacterium sp. 255-15; identical to SEQ ID NO: 36773

SEQ ID NO: 58334 - DNA, 1401 bp, Exiguobacterium sp. 255-15; identical to SEQ ID NO: 36774
  CDS (1)..(1401)

SEQ ID NO: 58335 - protein, 466 aa, Exiguobacterium sp. 255-15; identical to SEQ ID NO: 36775

SEQ ID NO: 58336 - DNA, 1506 bp, Rubrobacter xylanophilus DSM 9941; identical to SEQ ID NO: 36776
  CDS (1)..(1506)

SEQ ID NO: 58337 - protein, 501 aa, Rubrobacter xylanophilus DSM 9941; identical to SEQ ID NO: 36777

SEQ ID NO: 58338 - DNA, 1341 bp, Rubrobacter xylanophilus DSM 9941; identical to SEQ ID NO: 36778
  CDS (1)..(1341)

SEQ ID NO: 58339 - protein, 446 aa, Rubrobacter xylanophilus DSM 9941; identical to SEQ ID NO: 36779

SEQ ID NO: 58340 - DNA, 1422 bp, Rubrobacter xylanophilus DSM 9941; identical to SEQ ID NO: 36780
  CDS (1)..(1422)

SEQ ID NO: 58341 - protein, 473 aa, Rubrobacter xylanophilus DSM 9941; identical to SEQ ID NO: 36781

SEQ ID NO: 58342 - DNA, 1302 bp, Methanococcoides burtonii DSM 6242; identical to SEQ ID NO: 36782
  CDS (1)..(1302)

SEQ ID NO: 58343 - protein, 433 aa, Methanococcoides burtonii DSM 6242; identical to SEQ ID NO: 36783

SEQ ID NO: 58344 - DNA, 1374 bp, Burkholderia cepacia R18194; identical to SEQ ID NO: 36784
  CDS (1)..(1374)

SEQ ID NO: 58345 - protein, 457 aa, Burkholderia cepacia R18194; identical to SEQ ID NO: 36785

SEQ ID NO: 58346 - DNA, 1275 bp, Burkholderia cepacia R18194; identical to SEQ ID NO: 36786
  CDS (1)..(1275)

SEQ ID NO: 58347 - protein, 424 aa, Burkholderia cepacia R18194; identical to SEQ ID NO: 36787

SEQ ID NO: 58348 - DNA, 1359 bp, Burkholderia cepacia R18194; identical to SEQ ID NO: 36788
  CDS (1)..(1359)

SEQ ID NO: 58349 - protein, 452 aa, Burkholderia cepacia R18194; identical to SEQ ID NO: 36789

SEQ ID NO: 58350 - DNA, 1407 bp, Burkholderia cepacia R1808; identical to SEQ ID NO: 36790
  CDS (1)..(1407)

SEQ ID NO: 58351 - protein, 468 aa, Burkholderia cepacia R1808; identical to SEQ ID NO: 36791

SEQ ID NO: 58352 - DNA, 1392 bp, Listeria monocytogenes str. 1/2a F6854; identical to SEQ ID NO: 36792
  CDS (1)..(1392)

SEQ ID NO: 58353 - protein, 463 aa, Listeria monocytogenes str. 1/2a F6854; identical to SEQ ID NO: 36793

SEQ ID NO: 58354 - DNA, 1461 bp, Bacillus cereus G9241; identical to SEQ ID NO: 36794
  CDS (1)..(1461)

SEQ ID NO: 58355 - protein, 486 aa, Bacillus cereus G9241; identical to SEQ ID NO: 36795

SEQ ID NO: 58356 - DNA, 1317 bp, Bacillus cereus G9241; identical to SEQ ID NO: 36796
  CDS (1)..(1317)

SEQ ID NO: 58357 - protein, 438 aa, Bacillus cereus G9241; identical to SEQ ID NO: 36797

SEQ ID NO: 58358 - DNA, 1320 bp, Bacillus cereus G9241; identical to SEQ ID NO: 36798
  CDS (1)..(1320)

SEQ ID NO: 58359 - protein, 439 aa, Bacillus cereus G9241; identical to SEQ ID NO: 36799

SEQ ID NO: 58360 - DNA, 1416 bp, Bacillus cereus G9241; identical to SEQ ID NO: 36800
  CDS (1)..(1416)

SEQ ID NO: 58361 - protein, 471 aa, Bacillus cereus G9241; identical to SEQ ID NO: 36801

SEQ ID NO: 58362 - DNA, 1377 bp, Bacillus cereus G9241; identical to SEQ ID NO: 36802
  CDS (1)..(1377)

SEQ ID NO: 58363 - protein, 458 aa, Bacillus cereus G9241; identical to SEQ ID NO: 36803

SEQ ID NO: 58364 - DNA, 1410 bp, Ralstonia metallidurans CH34; identical to SEQ ID NO: 36804
  CDS (1)..(1410)

SEQ ID NO: 58365 - protein, 469 aa, Ralstonia metallidurans CH34; identical to SEQ ID NO: 36805

SEQ ID NO: 58366 - DNA, 1392 bp, Burkholderia fungorum LB400; identical to SEQ ID NO: 36806
  CDS (1)..(1392)

SEQ ID NO: 58367 - protein, 463 aa, Burkholderia fungorum LB400; identical to SEQ ID NO: 36807

SEQ ID NO: 58368 - DNA, 1350 bp, Enterococcus faecium; identical to SEQ ID NO: 36808
  CDS (1)..(1350)

SEQ ID NO: 58369 - protein, 449 aa, Enterococcus faecium; identical to SEQ ID NO: 36809

SEQ ID NO: 58370 - DNA, 1356 bp, Enterococcus faecium; identical to SEQ ID NO: 36810
  CDS (1)..(1356)

SEQ ID NO: 58371 - protein, 451 aa, Enterococcus faecium; identical to SEQ ID NO: 36811

SEQ ID NO: 58372 - DNA, 1377 bp, Enterococcus faecium; identical to SEQ ID NO: 36812
  CDS (1)..(1377)

SEQ ID NO: 58373 - protein, 458 aa, Enterococcus faecium; identical to SEQ ID NO: 36813

SEQ ID NO: 58374 - DNA, 1503 bp, Thermobifida fusca; identical to SEQ ID NO: 36814
  CDS (1)..(1503)

SEQ ID NO: 58375 - protein, 500 aa, Thermobifida fusca; identical to SEQ ID NO: 36815

SEQ ID NO: 58376 - DNA, 1269 bp, Methanosarcina barkeri str. fusaro; identical to SEQ ID NO: 36816
  CDS (1)..(1269)

SEQ ID NO: 58377 - protein, 422 aa, Methanosarcina barkeri str. fusaro; identical to SEQ ID NO: 36817

SEQ ID NO: 58378 - DNA, 1578 bp, Novosphingobium aromaticivorans DSM 12444; identical to SEQ ID NO: 36818
  CDS (1)..(1578)

SEQ ID NO: 58379 - protein, 525 aa, Novosphingobium aromaticivorans DSM 12444; identical to SEQ ID NO: 36819

SEQ ID NO: 58380 - DNA, 1317 bp, Novosphingobium aromaticivorans DSM 12444; identical to SEQ ID NO: 36820
  CDS (1)..(1317)

SEQ ID NO: 58381 - protein, 438 aa, Novosphingobium aromaticivorans DSM 12444; identical to SEQ ID NO: 36821

SEQ ID NO: 58382 - DNA, 1596 bp, Ferroplasma acidarmanus; identical to SEQ ID NO: 36822
  CDS (1)..(1596)

SEQ ID NO: 58383 - protein, 531 aa, Ferroplasma acidarmanus; identical to SEQ ID NO: 36823

SEQ ID NO: 58384 - DNA, 1323 bp, Ferroplasma acidarmanus; identical to SEQ ID NO: 36824
  CDS (1)..(1323)

SEQ ID NO: 58385 - protein, 440 aa, Ferroplasma acidarmanus; identical to SEQ ID NO: 36825

SEQ ID NO: 58386 - DNA, 1365 bp, Ferroplasma acidarmanus; identical to SEQ ID NO: 36826
  CDS (1)..(1365)

SEQ ID NO: 58387 - protein, 454 aa, Ferroplasma acidarmanus; identical to SEQ ID NO: 36827

SEQ ID NO: 58388 - DNA, 1560 bp, Ferroplasma acidarmanus; identical to SEQ ID NO: 36828
  CDS (1)..(1560)

SEQ ID NO: 58389 - protein, 519 aa, Ferroplasma acidarmanus; identical to SEQ ID NO: 36829

SEQ ID NO: 58390 - DNA, 1443 bp, Cytophaga hutchinsonii; identical to SEQ ID NO: 36830
  CDS (1)..(1443)

SEQ ID NO: 58391 - protein, 480 aa, Cytophaga hutchinsonii; identical to SEQ ID NO: 36831

SEQ ID NO: 58392 - DNA, 1314 bp, Microbulbifer degradans 2-40; identical to SEQ ID NO: 36832
  CDS (1)..(1314)

SEQ ID NO: 58393 - protein, 437 aa, Microbulbifer degradans 2-40; identical to SEQ ID NO: 36833

SEQ ID NO: 58394 - DNA, 1359 bp, Oenococcus oeni PSU-1; identical to SEQ ID NO: 36834
  CDS (1)..(1359)

SEQ ID NO: 58395 - protein, 452 aa, Oenococcus oeni PSU-1; identical to SEQ ID NO: 36835

SEQ ID NO: 58396 - DNA, 1437 bp, Oenococcus oeni PSU-1; identical to SEQ ID NO: 36836
  CDS (1)..(1437)

SEQ ID NO: 58397 - protein, 478 aa, Oenococcus oeni PSU-1; identical to SEQ ID NO: 36837

SEQ ID NO: 58398 - DNA, 1422 bp, Pediococcus pentosaceus ATCC 25745; identical to SEQ ID NO: 36838
  CDS (1)..(1422)

SEQ ID NO: 58399 - protein, 473 aa, Pediococcus pentosaceus ATCC 25745; identical to SEQ ID NO: 36839

SEQ ID NO: 58400 - DNA, 1302 bp, Trichodesmium erythraeum IMS101; identical to SEQ ID NO: 36840
  CDS (1)..(1302)

SEQ ID NO: 58401 - protein, 433 aa, Trichodesmium erythraeum IMS101; identical to SEQ ID NO: 36841

SEQ ID NO: 58402 - DNA, 1566 bp, Moorella thermoacetica ATCC 39073; identical to SEQ ID NO: 36842
  CDS (1)..(1566)

SEQ ID NO: 58403 - protein, 521 aa, Moorella thermoacetica ATCC 39073; identical to SEQ ID NO: 36843

SEQ ID NO: 58404 - DNA, 1521 bp, Moorella thermoacetica ATCC 39073; identical to SEQ ID NO: 36844
  CDS (1)..(1521)

SEQ ID NO: 58405 - protein, 506 aa, Moorella thermoacetica ATCC 39073; identical to SEQ ID NO: 36845

SEQ ID NO: 58406 - DNA, 1401 bp, Moorella thermoacetica ATCC 39073; identical to SEQ ID NO: 36846
  CDS (1)..(1401)

SEQ ID NO: 58407 - protein, 466 aa, Moorella thermoacetica ATCC 39073; identical to SEQ ID NO: 36847

SEQ ID NO: 58408 - DNA, 1392 bp, Rickettsia akari str. Hartford; identical to SEQ ID NO: 36848
  CDS (1)..(1392)

SEQ ID NO: 58409 - protein, 463 aa, Rickettsia akari str. Hartford; identical to SEQ ID NO: 36849

SEQ ID NO: 58410 - DNA, 1290 bp, Rickettsia akari str. Hartford; identical to SEQ ID NO: 36850
  CDS (1)..(1290)

SEQ ID NO: 58411 - protein, 429 aa, Rickettsia akari str. Hartford; identical to SEQ ID NO: 36851

SEQ ID NO: 58412 - DNA, 1356 bp, Pseudomonas aeruginosa UCBPP-PA14; identical to SEQ ID NO: 36852
  CDS (1)..(1356)

SEQ ID NO: 58413 - protein, 451 aa, Pseudomonas aeruginosa UCBPP-PA14; identical to SEQ ID NO: 36853

SEQ ID NO: 58414 - DNA, 1389 bp, Bacillus subtilis; identical to SEQ ID NO: 36854
  CDS (1)..(1389)

SEQ ID NO: 58415 - protein, 462 aa, Bacillus subtilis; identical to SEQ ID NO: 36855

SEQ ID NO: 58416 - DNA, 1512 bp, Schistosoma mansoni; identical to SEQ ID NO: 36856
  CDS (1)..(1512)

SEQ ID NO: 58417 - protein, 503 aa, Schistosoma mansoni; identical to SEQ ID NO: 36857

SEQ ID NO: 58418 - DNA, 1281 bp, Aeromonas salmonicida; identical to SEQ ID NO: 36858
  CDS (1)..(1281)

SEQ ID NO: 58419 - protein, 426 aa, Aeromonas salmonicida; identical to SEQ ID NO: 36859

SEQ ID NO: 58420 - DNA, 1608 bp, Pongo pygmaeus; identical to SEQ ID NO: 36860
  CDS (1)..(1608)

SEQ ID NO: 58421 - protein, 535 aa, Pongo pygmaeus; identical to SEQ ID NO: 36861

SEQ ID NO: 58422 - DNA, 1608 bp, Pongo pygmaeus; identical to SEQ ID NO: 36862
  CDS (1)..(1608)

SEQ ID NO: 58423 - protein, 535 aa, Pongo pygmaeus; identical to SEQ ID NO: 36863

SEQ ID NO: 58424 - DNA, 1455 bp, Xenopus tropicalis; identical to SEQ ID NO: 36864
  CDS (1)..(1455)

SEQ ID NO: 58425 - protein, 484 aa, Xenopus tropicalis; identical to SEQ ID NO: 36865

SEQ ID NO: 58426 - DNA, 1791 bp, Oryza sativa; identical to SEQ ID NO: 36866
  CDS (1)..(1791)

SEQ ID NO: 58427 - protein, 596 aa, Oryza sativa; identical to SEQ ID NO: 36867

SEQ ID NO: 58428 - DNA, 1581 bp, Gallus gallus; identical to SEQ ID NO: 36868
  CDS (1)..(1581)

SEQ ID NO: 58429 - protein, 526 aa, Gallus gallus; identical to SEQ ID NO: 36869

SEQ ID NO: 58430 - DNA, 1869 bp, Xenopus laevis; identical to SEQ ID NO: 36870
  CDS (1)..(1869)

SEQ ID NO: 58431 - protein, 622 aa, Xenopus laevis [sequence omitted]

SEQ ID NO: 58432 - DNA, 1908 bp, Homo sapiens; identical to SEQ ID NO: 36872
  CDS (1)..(1908)

SEQ ID NO: 58433 - protein, 635 aa, Homo sapiens [sequence omitted]

SEQ ID NO: 58434 - DNA, 1986 bp, Xenopus laevis; identical to SEQ ID NO: 36874
  CDS (1)..(1986)

SEQ ID NO: 58435 - protein, 661 aa, Xenopus laevis; identical to SEQ ID NO: 36875

SEQ ID NO: 58436 - DNA, 1245 bp, Xenopus laevis; identical to SEQ ID NO: 36876
  CDS (1)..(1245)

SEQ ID NO: 58437 - protein, 414 aa, Xenopus laevis; identical to SEQ ID NO: 36877

SEQ ID NO: 58438 - DNA, 1713 bp, Rhodococcus erythropolis; identical to SEQ ID NO: 36878
  CDS (1)..(1713)

SEQ ID NO: 58439 - protein, 570 aa, Rhodococcus erythropolis; identical to SEQ ID NO: 36879

SEQ ID NO: 58440 - DNA, 1611 bp, Didelphis marsupialis virginiana; identical to SEQ ID NO: 36880
  CDS (1)..(1611)

SEQ ID NO: 58441 - protein, 536 aa, Didelphis marsupialis virginiana; identical to SEQ ID NO: 36881

SEQ ID NO: 58442 - DNA, 1584 bp, Xenopus laevis; identical to SEQ ID NO: 36882
  CDS (1)..(1584)

SEQ ID NO: 58443 - protein, 527 aa, Xenopus laevis; identical to SEQ ID NO: 36883

SEQ ID NO: 58444 - DNA, 1590 bp, Xenopus laevis; identical to SEQ ID NO: 36884
  CDS (1)..(1590)

SEQ ID NO: 58445 - protein, 529 aa, Xenopus laevis; identical to SEQ ID NO: 36885

SEQ ID NO: 58446 - DNA, 1317 bp, Shigella flexneri; identical to SEQ ID NO: 36886
  CDS (1)..(1317)

SEQ ID NO: 58447 - protein, 438 aa, Shigella flexneri; identical to SEQ ID NO: 36887

SEQ ID NO: 58448 - DNA, 1377 bp, Shigella flexneri; identical to SEQ ID NO: 36888
  CDS (1)..(1377)

SEQ ID NO: 58449 - protein, 458 aa, Shigella flexneri; identical to SEQ ID NO: 36889

SEQ ID NO: 58450 - DNA, 1908 bp, Arabidopsis thaliana; identical to SEQ ID NO: 36890
  CDS (1)..(1908)

SEQ ID NO: 58451 - protein, 635 aa, Arabidopsis thaliana; identical to SEQ ID NO: 36891

SEQ ID NO: 58452 - DNA, 1497 bp, Rhodococcus sp; identical to SEQ ID NO: 36892
  CDS (1)..(1497)

SEQ ID NO: 58453 - protein, 498 aa, Rhodococcus sp; identical to SEQ ID NO: 36893

SEQ ID NO: 58454 - DNA, 1857 bp, Oryza sativa; identical to SEQ ID NO: 36894
  CDS (1)..(1857)

SEQ ID NO: 58455 - protein, 618 aa, Oryza sativa; identical to SEQ ID NO: 36895

SEQ ID NO: 58456 - DNA, 1602 bp, Arabidopsis thaliana; identical to SEQ ID NO: 36896
  CDS (1)..(1602)

SEQ ID NO: 58457 - protein, 533 aa, Arabidopsis thaliana; identical to SEQ ID NO: 36897

SEQ ID NO: 58458 - DNA, 1524 bp, Homo sapiens; identical to SEQ ID NO: 36898
  CDS (1)..(1524)

SEQ ID NO: 58459 - protein, 507 aa, Homo sapiens; identical to SEQ ID NO: 36899

SEQ ID NO: 58460 - DNA, 1485 bp, Homo sapiens; identical to SEQ ID NO: 36900
  CDS (1)..(1485)

SEQ ID NO: 58461 - protein, 494 aa, Homo sapiens; identical to SEQ ID NO: 36901

SEQ ID NO: 58462 - DNA, 1851 bp, Arabidopsis thaliana; identical to SEQ ID NO: 36902
  CDS (1)..(1851)

SEQ ID NO: 58463 - protein, 616 aa, Arabidopsis thaliana; identical to SEQ ID NO: 36903

SEQ ID NO: 58464 - DNA, 1845 bp, Arabidopsis thaliana; identical to SEQ ID NO: 36904
  CDS (1)..(1845)

SEQ ID NO: 58465 - protein, 614 aa, Arabidopsis thaliana; identical to SEQ ID NO: 36905

SEQ ID NO: 58466 - DNA, 1608 bp, Oryctolagus cuniculus; identical to SEQ ID NO: 36906
  CDS (1)..(1608)

SEQ ID NO: 58467 - protein, 535 aa, Oryctolagus cuniculus; identical to SEQ ID NO: 36907

SEQ ID NO: 58468 - DNA, 1845 bp, Arabidopsis thaliana; identical to SEQ ID NO: 36908
  CDS (1)..(1845)

SEQ ID NO: 58469 - protein, 614 aa, Arabidopsis thaliana; identical to SEQ ID NO: 36909

SEQ ID NO: 58470 - DNA, 1593 bp, Mus musculus; identical to SEQ ID NO: 36910
  CDS (1)..(1593)

SEQ ID NO: 58471 - protein, 530 aa, Mus musculus; identical to SEQ ID NO: 36911

SEQ ID NO: 58472 - DNA, 1500 bp, Escherichia coli; identical to SEQ ID NO: 36912
  CDS (1)..(1500)

SEQ ID NO: 58473 - protein, 499 aa, Escherichia coli; identical to SEQ ID NO: 9412

SEQ ID NO: 58474 - DNA, 1494 bp, Salmonella typhimurium; identical to SEQ ID NO: 36914
  CDS (1)..(1494)

SEQ ID NO: 58475 - protein, 497 aa, Salmonella typhimurium; identical to SEQ ID NO: 36915

SEQ ID NO: 58476 - DNA, 1470 bp, Streptomyces coelicolor; identical to SEQ ID NO: 36916
  CDS (1)..(1470)

SEQ ID NO: 58477 - protein, 489 aa, Streptomyces coelicolor; identical to SEQ ID NO: 9150

SEQ ID NO: 58478 - DNA, 1563 bp, Bacillus subtilis; identical to SEQ ID NO: 36918
  CDS (1)..(1563)

SEQ ID NO: 58479 - protein, 520 aa, Bacillus subtilis; identical to SEQ ID NO: 36919

SEQ ID NO: 58480 - DNA, 1602 bp, Rattus norvegicus; identical to SEQ ID NO: 36920
  CDS (1)..(1602)

SEQ ID NO: 58481 - protein, 533 aa, Rattus norvegicus; identical to SEQ ID NO: 36921

SEQ ID NO: 58482 - DNA, 1374 bp, Escherichia coli; identical to SEQ ID NO: 36922
  CDS (1)..(1374)

SEQ ID NO: 58483 - protein, 457 aa, Escherichia coli; identical to SEQ ID NO: 9056

SEQ ID NO: 58484 - DNA, 1371 bp, Salmonella typhimurium; identical to SEQ ID NO: 36924
  CDS (1)..(1371)

SEQ ID NO: 58485 - protein, 456 aa, Salmonella typhimurium; identical to SEQ ID NO: 9418

SEQ ID NO: 58486 - DNA, 1509 bp, Mus musculus; identical to SEQ ID NO: 36926
  CDS (1)..(1509)

SEQ ID NO: 58487 - protein, 502 aa, Mus musculus; identical to SEQ ID NO: 36927

SEQ ID NO: 58488 - DNA, 1308 bp, Methanococcus jannaschii; identical to SEQ ID NO: 36928
  CDS (1)..(1308)

SEQ ID NO: 58489 - protein, 435 aa, Methanococcus jannaschii; identical to SEQ ID NO: 36929

SEQ ID NO: 58490 - DNA, 1323 bp, Mycobacterium tuberculosis; identical to SEQ ID NO: 36930
  CDS (1)..(1323)

SEQ ID NO: 58491 - protein, 440 aa, Mycobacterium tuberculosis; identical to SEQ ID NO: 36931

SEQ ID NO: 58492 - DNA, 1257 bp, Escherichia coli; identical to SEQ ID NO: 36932
  CDS (1)..(1257)

SEQ ID NO: 58493 - protein, 418 aa, Escherichia coli; identical to SEQ ID NO: 36933

SEQ ID NO: 58494 - DNA, 24 bp, Primer
atgatgaacacggaaggtaataac

SEQ ID NO: 58495 - DNA, 24 bp, Primer
ttatacggttttattgcgcttcat

SEQ ID NO: 58496 - protein, 78 aa, consensus; identical to SEQ ID NO: 36936
  MISC_FEATURE (1)..(78): consensus for the disclosure of xaa see table XV

SEQ ID NO: 58497 - protein, 38 aa, consensus; identical to SEQ ID NO: 36937
  MISC_FEATURE (1)..(38): consensus for the disclosure of xaa see table XV

SEQ ID NO: 58498 - DNA, 258 bp, Escherichia coli; identical to SEQ ID NO: 44740
  CDS (1)..(258)

SEQ ID NO: 58499 - protein, 85 aa, Escherichia coli; identical to SEQ ID NO: 44741

SEQ ID NO: 58500 - DNA, 264 bp, Vibrio fischeri ES114; identical to SEQ ID NO: 44742
  CDS (1)..(264)

SEQ ID NO: 58501 - protein, 87 aa, Vibrio fischeri ES114; identical to SEQ ID NO: 44743

SEQ ID NO: 58502 - DNA, 288 bp, Vibrio fischeri ES114; identical to SEQ ID NO: 44744
  CDS (1)..(288)

SEQ ID NO: 58503 - protein, 95 aa, Vibrio fischeri ES114; identical to SEQ ID NO: 44745

SEQ ID NO: 58504 - DNA, 318 bp, Danio rerio; identical to SEQ ID NO: 44746
  CDS (1)..(318)

SEQ ID NO: 58505 - protein, 105 aa, Danio rerio; identical to SEQ ID NO: 44747

SEQ ID NO: 58506 - DNA, 393 bp, Arabidopsis thaliana; identical to SEQ ID NO: 6900
  CDS (1)..(393)

SEQ ID NO: 58507 - protein, 130 aa, Arabidopsis thaliana; identical to SEQ ID NO: 6901

SEQ ID NO: 58508 - DNA, 264 bp, Pasteurella multocida subsp. multocida str. Pm70; identical to SEQ ID NO: 44750
  CDS (1)..(264)

SEQ ID NO: 58509 - protein, 87 aa, Pasteurella multocida subsp. multocida str. Pm70; identical to SEQ ID NO: 44751

SEQ ID NO: 58510 - DNA, 309 bp, Rickettsia conorii str. Malish 7; identical to SEQ ID NO: 44752
  CDS (1)..(309)

SEQ ID NO: 58511 - protein, 102 aa, Rickettsia conorii str. Malish 7; identical to SEQ ID NO: 44753

SEQ ID NO: 58512 - DNA, 252 bp, Escherichia coli K12; identical to SEQ ID NO: 44754
  CDS (1)..(252)

SEQ ID NO: 58513 - protein, 83 aa, Escherichia coli K12; identical to SEQ ID NO: 44755

SEQ ID NO: 58514 - DNA, 255 bp, Caulobacter crescentus CB15; identical to SEQ ID NO: 44756
  CDS (1)..(255)

SEQ ID NO: 58515 - protein, 84 aa, Caulobacter crescentus CB15; identical to SEQ ID NO: 44757

SEQ ID NO: 58516 - DNA, 252 bp, Salmonella typhimurium LT2; identical to SEQ ID NO: 44758
  CDS (1)..(252)

SEQ ID NO: 58517 - protein, 83 aa, Salmonella typhimurium LT2; identical to SEQ ID NO: 44759

SEQ ID NO: 58518 - DNA, 258 bp, Ralstonia solanacearum GMI1000; identical to SEQ ID NO: 44760
  CDS (1)..(258)

SEQ ID NO: 58519 - protein, 85 aa, Ralstonia solanacearum GMI1000; identical to SEQ ID NO: 44761

SEQ ID NO: 58520 - DNA, 246 bp, Salmonella enterica subsp. enterica serovar Typhi str. CT18; identical to SEQ ID NO: 44762
  CDS (1)..(246)

SEQ ID NO: 58521 - protein, 81 aa, Salmonella enterica subsp. enterica serovar Typhi str. CT18; identical to SEQ ID NO: 44763

SEQ ID NO: 58522 - DNA, 264 bp, Yersinia pestis KIM; identical to SEQ ID NO: 44764
  CDS (1)..(264)

SEQ ID NO: 58523 - protein, 87 aa, Yersinia pestis KIM; identical to SEQ ID NO: 44765

SEQ ID NO: 58524 - DNA, 267 bp, Brucella suis 1330; identical to SEQ ID NO: 44766
  CDS (1)..(267)

SEQ ID NO: 58525 - protein, 88 aa, Brucella suis 1330; identical to SEQ ID NO: 44767

SEQ ID NO: 58526 - DNA, 252 bp, Shigella flexneri 2a str. 301; identical to SEQ ID NO: 44768
  CDS (1)..(252)

SEQ ID NO: 58527 - protein, 83 aa, Shigella flexneri 2a str. 301; identical to SEQ ID NO: 44769

SEQ ID NO: 58528 - DNA, 261 bp, Shewanella oneidensis MR-1; identical to SEQ ID NO: 44770
  CDS (1)..(261)

SEQ ID NO: 58529 - protein, 86 aa, Shewanella oneidensis MR-1; identical to SEQ ID NO: 44771

SEQ ID NO: 58530 - DNA, 255 bp, Pseudomonas putida KT2440; identical to SEQ ID NO: 44772
  CDS (1)..(255)

SEQ ID NO: 58531 - protein, 84 aa, Pseudomonas putida KT2440; identical to SEQ ID NO: 44773

SEQ ID NO: 58532 - DNA, 252 bp, Pseudomonas syringae pv. tomato str. DC3000; identical to SEQ ID NO: 44774
  CDS (1)..(252)

SEQ ID NO: 58533 - protein, 83 aa, Pseudomonas syringae pv. tomato str. DC3000; identical to SEQ ID NO: 44775

SEQ ID NO: 58534 - DNA, 258 bp, Nitrosomonas europaea ATCC 19718; identical to SEQ ID NO: 44776
  CDS (1)..(258)

SEQ ID NO: 58535 - protein, 85 aa, Nitrosomonas europaea ATCC 19718; identical to SEQ ID NO: 44777

SEQ ID NO: 58536 - DNA, 234 bp, Wigglesworthia glossinidia endosymbiont of Glossina brevipalpis; identical to SEQ ID NO: 44778
  CDS (1)..(234)

SEQ ID NO: 58537 - protein, 77 aa, Wigglesworthia glossinidia endosymbiont of Glossina brevipalpis; identical to SEQ ID NO: 44779

SEQ ID NO: 58538 - DNA, 264 bp, Haemophilus ducreyi 35000HP; identical to SEQ ID NO: 44780
  CDS (1)..(264)

SEQ ID NO: 58539 - protein, 87 aa, Haemophilus ducreyi 35000HP; identical to SEQ ID NO: 44781

SEQ ID NO: 58540 - DNA, 1803 bp, Danio rerio; identical to SEQ ID NO: 44782
  CDS (1)..(1803)

SEQ ID NO: 58541 - protein, 600 aa, Danio rerio; identical to SEQ ID NO: 44783

SEQ ID NO: 58542 - DNA, 261 bp, Photorhabdus luminescens subsp. laumondii TTO1; identical to SEQ ID NO: 44784
  CDS (1)..(261)

SEQ ID NO: 58543 - protein, 86 aa, Photorhabdus luminescens subsp. laumondii TTO1; identical to SEQ ID NO: 44785

SEQ ID NO: 58544 - DNA, 264 bp, Vibrio vulnificus YJ016; identical to SEQ ID NO: 44786
  CDS (1)..(264)

SEQ ID NO: 58545 - protein, 87 aa, Vibrio vulnificus YJ016; identical to SEQ ID NO: 44787

SEQ ID NO: 58546 - DNA, 339 bp, Wolbachia endosymbiont of Drosophila melanogaster; identical to SEQ ID NO: 44788
  CDS (1)..(339)

SEQ ID NO: 58547 - protein, 112 aa, Wolbachia endosymbiont of Drosophila melanogaster; identical to SEQ ID NO: 44789

SEQ ID NO: 58548 - DNA, 330 bp, Neurospora crassa; identical to SEQ ID NO: 6934
  CDS (1)..(330)

SEQ ID NO: 58549 - protein, 109 aa, Neurospora crassa; identical to SEQ ID NO: 6935

SEQ ID NO: 58550 - DNA, 309 bp, Magnaporthe grisea 70-15; identical to SEQ ID NO: 44792
  CDS (1)..(309)

SEQ ID NO: 58551 - protein, 102 aa, Magnaporthe grisea 70-15; identical to SEQ ID NO: 44793

SEQ ID NO: 58552 - DNA, 321 bp, Gibberella zeae PH-1; identical to SEQ ID NO: 44794
  CDS (1)..(321)

SEQ ID NO: 58553 - protein, 106 aa, Gibberella zeae PH-1; identical to SEQ ID NO: 44795

SEQ ID NO: 58554 - DNA, 309 bp, Ustilago maydis 521; identical to SEQ ID NO: 44796
  CDS (1)..(309)

SEQ ID NO: 58555 - protein, 102 aa, Ustilago maydis 521; identical to SEQ ID NO: 44797

SEQ ID NO: 58556 - DNA, 309 bp, Aspergillus nidulans FGSC A4; identical to SEQ ID NO: 44798
  CDS (1)..(309)

SEQ ID NO: 58557 - protein, 102 aa, Aspergillus nidulans FGSC A4; identical to SEQ ID NO: 44799

SEQ ID NO: 58558 - DNA, 342 bp, Debaryomyces hansenii CBS767; identical to SEQ ID NO: 44800
  CDS (1)..(342)

SEQ ID NO: 58559 - protein, 113 aa, Debaryomyces hansenii CBS767; identical to SEQ ID NO: 44801

SEQ ID NO: 58560 - DNA, 258 bp, Bartonella quintana str. Toulouse; identical to SEQ ID NO: 44802
  CDS (1)..(258)

SEQ ID NO: 58561 - protein, 85 aa, Bartonella quintana str. Toulouse; identical to SEQ ID NO: 44803

SEQ ID NO: 58562 - DNA, 258 bp, Acinetobacter sp. ADP1; identical to SEQ ID NO: 44804
  CDS (1)..(258)

SEQ ID NO: 58563 - protein, 85 aa, Acinetobacter sp. ADP1; identical to SEQ ID NO: 44805

SEQ ID NO: 58564 - DNA, 267 bp, Erwinia carotovora subsp. atroseptica SCRI1043; identical to SEQ ID NO: 44806
  CDS (1)..(267)

SEQ ID NO: 58565 - protein, 88 aa, Erwinia carotovora subsp. atroseptica SCRI1043; identical to SEQ ID NO: 44807

SEQ ID NO: 58566 - DNA, 315 bp, Rickettsia typhi str. Wilmington; identical to SEQ ID NO: 44808
  CDS (1)..(315)

SEQ ID NO: 58567 - protein, 104 aa, Rickettsia typhi str. Wilmington; identical to SEQ ID NO: 44809

SEQ ID NO: 58568 - DNA, 264 bp, Mannheimia succiniciproducens MBEL55E; identical to SEQ ID NO: 44810
  CDS (1)..(264)

SEQ ID NO: 58569 - protein, 87 aa, Mannheimia succiniciproducens MBEL55E; identical to SEQ ID NO: 44811

SEQ ID NO: 58570 - DNA, 255 bp, Legionella pneumophila subsp. pneumophila str. Philadelphia 1; identical to SEQ ID NO: 44812
  CDS (1)..(255)

SEQ ID NO: 58571 - protein, 84 aa, Legionella pneumophila subsp. pneumophila str. Philadelphia 1; identical to SEQ ID NO: 44813

SEQ ID NO: 58572 - DNA, 255 bp, Legionella pneumophila str. Lens; identical to SEQ ID NO: 44814
  CDS (1)..(255)

SEQ ID NO: 58573 - protein, 84 aa, Legionella pneumophila str. Lens; identical to SEQ ID NO: 44815

SEQ ID NO: 58574 - DNA, 279 bp, Photobacterium profundum SS9; identical to SEQ ID NO: 44816
  CDS (1)..(279)

SEQ ID NO: 58575 - protein, 92 aa, Photobacterium profundum SS9; identical to SEQ ID NO: 44817

SEQ ID NO: 58576 - DNA, 243 bp, Anaplasma marginale str. St. Maries; identical to SEQ ID NO: 44818
  CDS (1)..(243)

SEQ ID NO: 58577 - protein, 80 aa, Anaplasma marginale str. St. Maries; identical to SEQ ID NO: 44819

SEQ ID NO: 58578 - DNA, 267 bp, Idiomarina loihiensis L2TR; identical to SEQ ID NO: 44820
  CDS (1)..(267)

SEQ ID NO: 58579 - protein, 88 aa, Idiomarina loihiensis L2TR; identical to SEQ ID NO: 44821

SEQ ID NO: 58580 - DNA, 261 bp, Francisella tularensis subsp. tularensis Schu 4; identical to SEQ ID NO: 44822
  CDS (1)..(261)

SEQ ID NO: 58581 - protein, 86 aa, Francisella tularensis subsp. tularensis Schu 4; identical to SEQ ID NO: 44823

SEQ ID NO: 58582 - DNA, 264 bp, Synechococcus elongatus PCC 6301; identical to SEQ ID NO: 44824
  CDS (1)..(264)

SEQ ID NO: 58583 - protein, 87 aa, Synechococcus elongatus PCC 6301; identical to SEQ ID NO: 44825

SEQ ID NO: 58584 - DNA, 288 bp, Ehrlichia ruminantium str. Welgevonden; identical to SEQ ID NO: 44826
  CDS (1)..(288)

SEQ ID NO: 58585 - protein, 95 aa, Ehrlichia ruminantium str. Welgevonden; identical to SEQ ID NO: 44827

SEQ ID NO: 58586 - DNA, 255 bp, Azotobacter vinelandii; identical to SEQ ID NO: 44828
  CDS (1)..(255)

SEQ ID NO: 58587 - protein, 84 aa, Azotobacter vinelandii; identical to SEQ ID NO: 44829

SEQ ID NO: 58588 - DNA, 252 bp, Pseudomonas syringae pv. syringae B728a; identical to SEQ ID NO: 44830
  CDS (1)..(252)

SEQ ID NO: 58589 - protein, 83 aa, Pseudomonas syringae pv. syringae B728a; identical to SEQ ID NO: 44831

SEQ ID NO: 58590 - DNA, 264 bp, Actinobacillus pleuropneumoniae serovar 1 str. 4074; identical to SEQ ID NO: 44832
  CDS (1)..(264)

SEQ ID NO: 58591 - protein, 87 aa, Actinobacillus pleuropneumoniae serovar 1 str. 4074; identical to SEQ ID NO: 44833

SEQ ID NO: 58592 - DNA, 258 bp, Ralstonia eutropha JMP134; identical to SEQ ID NO: 44834
  CDS (1)..(258)

SEQ ID NO: 58593 - protein, 85 aa, Ralstonia eutropha JMP134; identical to SEQ ID NO: 44835

SEQ ID NO: 58594 - DNA, 246 bp, Ehrlichia canis str. Jake; identical to SEQ ID NO: 44836
  CDS (1)..(246)

SEQ ID NO: 58595 - protein, 81 aa, Ehrlichia canis str. Jake; identical to SEQ ID NO: 44837

SEQ ID NO: 58596 - DNA, 261 bp, Burkholderia cepacia R1808; identical to SEQ ID NO: 44838
  CDS (1)..(261)

SEQ ID NO: 58597 - protein, 86 aa, Burkholderia cepacia R1808; identical to SEQ ID NO: 44839

SEQ ID NO: 58598 - DNA, 267 bp, Rhodospirillum rubrum; identical to SEQ ID NO: 44840
  CDS (1)..(267)

SEQ ID NO: 58599 - protein, 88 aa, Rhodospirillum rubrum; identical to SEQ ID NO: 44841

SEQ ID NO: 58600 - DNA, 258 bp, Ralstonia metallidurans CH34; identical to SEQ ID NO: 44842
  CDS (1)..(258)

SEQ ID NO: 58601 - protein, 85 aa, Ralstonia metallidurans CH34; identical to SEQ ID NO: 44843

SEQ ID NO: 58602 - DNA, 243 bp, Novosphingobium aromaticivorans DSM 12444; identical to SEQ ID NO: 44844
  CDS (1)..(243)

SEQ ID NO: 58603 - protein, 80 aa, Novosphingobium aromaticivorans DSM 12444; identical to SEQ ID NO: 44845

SEQ ID NO: 58604 - DNA, 261 bp, Trichodesmium erythraeum IMS101; identical to SEQ ID NO: 44846
  CDS (1)..(261)

SEQ ID NO: 58605 - protein, 86 aa, Trichodesmium erythraeum IMS101; identical to SEQ ID NO: 44847

SEQ ID NO: 58606 - DNA, 294 bp, Rickettsia akari str. Hartford; identical to SEQ ID NO: 44848
  CDS (1)..(294)

SEQ ID NO: 58607 - protein, 97 aa, Rickettsia akari str. Hartford; identical to SEQ ID NO: 44849

SEQ ID NO: 58608 - DNA, 315 bp, Fritillaria agrestis; identical to SEQ ID NO: 44850
  CDS (1)..(315)

SEQ ID NO: 58609 - protein, 104 aa, Fritillaria agrestis; identical to SEQ ID NO: 6937

SEQ ID NO: 58610 - DNA, 411 bp, Oryza sativa; identical to SEQ ID NO: 44852
  CDS (1)..(411)

SEQ ID NO: 58611 - protein, 136 aa, Oryza sativa; identical to SEQ ID NO: 44853

SEQ ID NO: 58612 - DNA, 420 bp, Populus tremula x Populus tremuloides; identical to SEQ ID NO: 6960
  CDS (1)..(420)

SEQ ID NO: 58613 - protein, 139 aa, Populus tremula x Populus tremuloides; identical to SEQ ID NO: 6961

SEQ ID NO: 58614 - DNA, 342 bp, Deschampsia antarctica; identical to SEQ ID NO: 44856
  CDS (1)..(342)

SEQ ID NO: 58615 - protein, 113 aa, Deschampsia antarctica; identical to SEQ ID NO: 6967

SEQ ID NO: 58616 - DNA, 264 bp, Salmonella typhimurium; identical to SEQ ID NO: 44858
  CDS (1)..(264)

SEQ ID NO: 58617 - protein, 87 aa, Salmonella typhimurium; identical to SEQ ID NO: 44859

SEQ ID NO: 58618 - DNA, 306 bp, Schizosaccharomyces pombe; identical to SEQ ID NO: 44860
  CDS (1)..(306)

SEQ ID NO: 58619 - protein, 101 aa, Schizosaccharomyces pombe; identical to SEQ ID NO: 6925

SEQ ID NO: 58620 - DNA, 264 bp, Haemophilus influenzae; identical to SEQ ID NO: 44862
  CDS (1)..(264)

SEQ ID NO: 58621 - protein, 87 aa, Haemophilus influenzae; identical to SEQ ID NO: 44863

SEQ ID NO: 58622 - DNA, 255 bp, Pseudomonas aeruginosa; identical to SEQ ID NO: 44864
  CDS (1)..(255)

SEQ ID NO: 58623 - protein, 84 aa, Pseudomonas aeruginosa; identical to SEQ ID NO: 44865

SEQ ID NO: 58624 - DNA, 288 bp, Rickettsia prowazekii; identical to SEQ ID NO: 44866
  CDS (1)..(288)

SEQ ID NO: 58625 - protein, 95 aa, Rickettsia prowazekii; identical to SEQ ID NO: 44867

SEQ ID NO: 58626 - DNA, 264 bp, Vibrio cholerae; identical to SEQ ID NO: 44868
  CDS (1)..(264)

SEQ ID NO: 58627 - protein, 87 aa, Vibrio cholerae; identical to SEQ ID NO: 44869

SEQ ID NO: 58628 - DNA, 25 bp, Primer
atgcaaaccgttatttttggtcgtt

SEQ ID NO: 58629 - DNA, 25 bp, Primer
ttaggcgtccagattttctttcacc

SEQ ID NO: 58630 - protein, 64 aa, consensus; identical to SEQ ID NO: 44872
  MISC_FEATURE (1)..(64): consensus for the disclosure of xaa see table XV

SEQ ID NO: 58631 - protein, 73 aa, consensus; identical to SEQ ID NO: 44873
  MISC_FEATURE (1)..(73): consensus for the disclosure of xaa see table XV

SEQ ID NO: 58632 - DNA, 660 bp, Escherichia coli
  CDS (1)..(660)
atggatcgtattgttagttcttcacatgaccgtacatcactgcttagcacccataaggtgctgcgtaatacctattttctgctgagcctgacgctggccttttcggcgattaccgcaactgccagtacggtgctgatgctgccatctccgggtctgattctgacgctggtgggtatgtatggtttgatgttcctgacctataaaacggcgaataagccgaccgggattatctccgcattcgcctttaccggttttctgggttatatcctcggacctattctgaacacctatctgtctgccggaatgggtgacgtaatcgctatggcactgggcggaacggcgttagtgttcttctgctgctctgcatatgtgctgaccacccgcaaagatatgtcgttcctcggcggtatgctgatggcgggtattgtggtggtgctgattggtatggttgcgaatatcttcctgcagctgcctgctctgcatctggcgatcagcgcggtcttcattctgatctcctctggcgctatcttgtttgaaaccagcaacatcattcatggcggtgagacgaactatattcgtgccacggttagcctgtatgtttcgctgtacaacatcttcgtcagcctgctgagcattctgggcttcgctagccgcgattaa

SEQ ID NO: 58633 - protein, 219 aa, Escherichia coli
MDRIVSSSHDRTSLLSTHKVLRNTYFLLSLTLAFSAITATASTVLMLPSPGLILTLVGMYGLMFLTYKTANKPTGIISAFAFTGFLGYILGPILNTYLSAGMGDVIAMALGGTALVFFCCSAYVLTTRKDMSFLGGMLMAGIVVVLIGMVANIFLQLPALHLAISAVFILISSGAILFETSNIIHGGETNYIRATVSLYVSLYNIFVSLLSILGFASRD

SEQ ID NO: 58634 - DNA, 977 bp, Cryptococcus neoformans var. neoformans JEC21
  CDS (27)..(878)
ttcgttgcaacttgcccaaattcacaatgtcctcgcctccacgatacaccgaagagccaaatctacgaccagctccttcaaaggcctatggcacaacccccgccgacactgctgccacgcaaccccttctcgcagctcaggcgtctactaatgcccaacgcgcagccgaggaaggttggcgggacgacgaggataatgtgtcggacaactacaagctcggtgtctctgtctctgactgcgatactgaaatccgaatgctctttatccgcaaagtctactccatcctcttgattcaattgctcgccacggcaggagtgtcaattcttctctccttgccgtcggccaaggactttacccacaccaacccgtggatcatgtggatccctctgattggtagctttaccagcttgttctttgtctactggaagaggcaccaacacccggcgaatttgatcttgttgggtttgttcactttgttcgaagcgacgatgattgggttggctgtgagttactatgagagccgaattgtgattcaagcgctgttcatcactcttggcgtcttcattggtcttacactcttcaccttccaaaccaaatacgacttttcctccttcgcacccatcctcttcattggcatctggggtctcctcaccacctacctcatccagatcttcctcccattcaatgccaccgtcgacctcggtattgcctgtttctcgaccctcttgttctctggtttcgtgttatatgacacacagcagattatgaagaggttaagtgtggatgaggcgattgcgggagcgttgacgctttacttggactttttgaacttgttcttgagcatcttgaggatacttaacaactcgaacgaccgttaattgtctaatacccagatcatcccttttaacaataataaacatgttgatcttgtcaaaaatacggtgtcgtaactagtaatgtatctatgtatctgttgc

SEQ ID NO: 58635 - protein, 283 aa, Cryptococcus neoformans var. neoformans JEC21
MSSPPRYTEEPNLRPAPSKAYGTTPADTAATQPLLAAQASTNAQRAAEEGWRDDEDNVSDNYKLGVSVSDCDTEIRMLFIRKVYSILLIQLLATAGVSILLSLPSAKDFTHTNPWIMWIPLIGSFTSLFFVYWKRHQHPANLILLGLFTLFEATMIGLAVSYYESRIVIQALFITLGVFIGLTLFTFQTKYDFSSFAPILFIGIWGLLTTYLIQIFLPFNATVDLGIACFSTLLFSGFVLYDTQQIMKRLSVDEAIAGALTLYLDFLNLFLSILRILNNSNDR

SEQ ID NO: 58636 - DNA, 663 bp, Azoarcus sp. EbN1
  CDS (1)..(663)
atgcaaaaccgtatgacgatgacgcgcaccgacgcctcggtgctgtcgaccaacaaggtcatccgcaacacctacatgttgctgtcgctaacgctggcgttctcggcgctaaccgccgggctgtcgatggccatgggtgccccgcgcctggggatcatcgttacgctcgcaggctacttcggcctgctgtttgcgaccaccaagttccgcaacagcagcctcggcatcgtgttcgtgttcgcgctgaccggcttcatgggcttcaccctcggcccgatcatctcatcctatttggcgctgcccaacggcgccagcatcgtgatgcaggcgatggccggcacagcggcgatcttcctgggtctgtcggcctacgcggtgacgagcaagaaggacttctccttcatgggcggtttcctgatggtcggcatcctggtcgccttcctggccggcctgggcgcgatcttcttcgagatcccggcgctgtcgctgaccgtgtcggcggccttcgtgctgctgatgtcgggcctcatcctgtacgagaccagcaacatcatccacggcggcgagaccaactacatcatggccacggtgtcgctgttcgtgtcgatcttcaacctcttcaccagcctgctgcacctgcttggcttcgccaacagcgactaa

SEQ ID NO: 58637 - protein, 220 aa, Azoarcus sp. EbN1
MQNRMTMTRTDASVLSTNKVIRNTYMLLSLTLAFSALTAGLSMAMGAPRLGIIVTLAGYFGLLFATTKFRNSSLGIVFVFALTGFMGFTLGPIISSYLALPNGASIVMQAMAGTAAIFLGLSAYAVTSKKDFSFMGGFLMVGILVAFLAGLGAIFFEIPALSLTVSAAFVLLMSGLILYETSNIIHGGETNYIMATVSLFVSIFNLFTSLLHLLGFANSD

SEQ ID NO: 58638 - DNA, 705 bp, Ehrlichia ruminantium str. Welgevonden
  CDS (1)..(705)
atggacaattacagtagtgtacgttttcaaagtgattactatagtgtaggacttaggaattatttgatgaaagtatataattatatggctatggctttaggtttaacaggcttggttgcattttttgtatcttcgtctagttatgctattaatattatatataatactccattgcattgggtaataatgttttctccaatagtacttgtttttttaatgtcatataagttgagtacttttagttttcaaactgtcctagtagtattttttagttttgctgctttgatgggggcatctatatcttccatatttttgatatatacggctgctagtattacaaaagtgttttttatttcttcatctatgtttggtgctatggcgtggtatggtaatgttacgaagaaggatttatctcagtttcagtcatttttgattatgggtattataggggtaattattgcttctttagttaatttatttttgcataatggtccattagattttgctatttcctttattgctgttattttgtttactggtatgactgcttgtgatgctcaaagaataaaggatatgtattatagatttaatgatggtaatagtgtatctcttaataagatggctgtattgggtgcaactaccttatactttaattacattaatatctttctaagcttactaaacttgcaaggtgagcgtaggtaa

SEQ ID NO: 58639 - protein, 234 aa, Ehrlichia ruminantium str. Welgevonden
MDNYSSVRFQSDYYSVGLRNYLMKVYNYMAMALGLTGLVAFFVSSSSYAINIIYNTPLHWVIMFSPIVLVFLMSYKLSTFSFQTVLVVFFSFAALMGASISSIFLIYTAASITKVFFISSSMFGAMAWYGNVTKKDLSQFQSFLIMGIIGVIIASLVNLFLHNGPLDFAISFIAVILFTGMTACDAQRIKDMYYRFNDGNSVSLNKMAVLGATTLYFNYINIFLSLLNLQGERR

SEQ ID NO: 58640 - DNA, 723 bp, Wolbachia endosymbiont strain TRS of Brugia malayi
  CDS (1)..(723)
atgtcttatatgaaaaatgagcaagatatccgctctcaaggcgtttactatagcgctgggcttagaagttatctaactaaagtatataattatatggctttagctttaggtataacagggcttattgcatttctaacggtgttttttgatctctttcaggtaatttattctaaccccgttctttcgattgtggtaatcctatctccaattgtactagtattttacatgtctcatagacttcaatacctaagtgctcagtccacagtcactgtatttttcctgttttcagtcctaatggggctctccctatcttatatctttatagtttatactacagaaaatatagcaagagcattcttcatcacatcaattatgtttggttctatggctttatacggcaatagtacaaaaaaagatttaactagtatgggttcctttttgattatgggaatctgggggttaattattgcatccatagttaatttatttcttggaagtagtcctctctactttgcaatatcgttcatatcagtaatagtctttaccttaatgactgcatacgatgctcagagaattaaagatgtttattatagatataatgatggttcagaagctgtaaccactaagctagctatatttggtgcaactaatctttattttgattttatcaacgtattcctcaatttactcaggttacttaacttgttcaacaatagggattag

SEQ ID NO: 58641 - protein, 240 aa, Wolbachia endosymbiont strain TRS of Brugia malayi
MSYMKNEQDIRSQGVYYSAGLRSYLTKVYNYMALALGITGLIAFLTVFFDLFQVIYSNPVLSIVVILSPIVLVFYMSHRLQYLSAQSTVTVFFLFSVLMGLSLSYIFIVYTTENIARAFFITSIMFGSMALYGNSTKKDLTSMGSFLIMGIWGLIIASIVNLFLGSSPLYFAISFISVIVFTLMTAYDAQRIKDVYYRYNDGSEAVTTKLAIFGATNLYFDFINVFLNLLRLLNLFNNRD

SEQ ID NO: 58642 - DNA, 663 bp, Vibrio fischeri ES114
  CDS (1)..(663)
atgaataatcaaatgttcagccaaactcatacacaagagtcggctctacaaactaacaaagtattacgtaatacttatttcttattatcaatgacactactttggtctgcggtagttgctggtgtttcaatggcaatgaacctacctcgtccaggtatcatcatcatgcttgttggtttctacggcctacttttcttgacggaaaagaaccgtaacaacaacatgggtcttgtatttacgttcctatttacaggcttcttaggctacaccattggtccaatccttaacatgtacattggtgcaggtatgggtgatgtgatcttaactgcacttggcggtactgcgctttctttcatggcagcatctgcttatgcactaacaactaagcgtgacctatcgttccttaacggtgtgttaatggctggttttgttgttctattaattggtatggtagcaaacatcttcctacaaatgccattattacacctagcaatgagtggtatgtttatcctgttctcaacaggtgcaatcttgctaacaacgcaatcaatcattcgtggtggtgaaacaaactacatctcagcaacgattacgctgtatgtttctatctacaatatcttcatcagcctactaagcattcttggtatcatgcgtgatgattaa

SEQ ID NO: 58643 - protein, 220 aa, Vibrio fischeri ES114
MNNQMFSQTHTQESALQTNKVLRNTYFLLSMTLLWSAVVAGVSMAMNLPRPGIIIMLVGFYGLLFLTEKNRNNNMGLVFTFLFTGFLGYTIGPILNMYIGAGMGDVILTALGGTALSFMAASAYALTTKRDLSFLNGVLMAGFVVLLIGMVANIFLQMPLLHLAMSGMFILFSTGAILLTTQSIIRGGETNYISATITLYVSIYNIFISLLSILGIMRDD

SEQ ID NO: 58644 - DNA, 684 bp, Neisseria gonorrhoeae FA 1090
  CDS (1)..(684)
atgcaacacgacgtttacgactacaccgcgcatacggtttctaaaaacaccgtcctgcagaaaacctaccgcctgctcggattttcattcattccggcagccgcaggcgcggcacttgccgccaatgccggtttcaatttttacgccgccttcggttcgcgctggataggatttgccgtcgtattggcgtttttctacggtatgatccacttcatcgaaaaaaaccgttacagcaataccggcgttaccctgctgatggtattcacattcggtatgggcgtattgatcggccccgtgctgcaatacgcactccatattgccgacggtgcgaaaatcgtcggcattgccgccgcgatgaccgccgccgtctttttaacgatgtccgcattggcacgccgaacccggctcgatatgaacgcgctcggacgcttcctgaccgtaggtgcggtcattctgatggtcgccgtggttgccaatctgtttttgggtattcccgcactcgccctgaccatttccgccggttttgtcttgttcagttccttaataattatgtggcaggtacgcaccgtcatcgacggcggcgaagacagttacatcagcgcggcactgacactgtttatctcgctttacaacatcttcagcagcctgctcaacatcctgctgtccttaaacggcgacgactga

SEQ ID NO: 58645 - protein, 227 aa, Neisseria gonorrhoeae FA 1090
MQHDVYDYTAHTVSKNTVLQKTYRLLGFSFIPAAAGAALAANAGFNFYAAFGSRWIGFAVVLAFFYGMIHFIEKNRYSNTGVTLLMVFTFGMGVLIGPVLQYALHIADGAKIVGIAAAMTAAVFLTMSALARRTRLDMNALGRFLTVGAVILMVAVVANLFLGIPALALTISAGFVLFSSLIIMWQVRTVIDGGEDSYISAALTLFISLYNIFSSLLNILLSLNGDD

SEQ ID NO: 58646 - DNA, 708 bp, Xenopus tropicalis
  CDS (1)..(708)
atggcgtctccataccctaggtcttcaatagaggatgattttaactatggcaccaatgtggcgtccgcaagtatacagattcgtatggattttcttaaaaaagtttacagcattctgacaacacagattcttttgactacactaactgcggcgttattcctttactccaaatcaattcaaacatttgttcatgaaagtcctgctctgctcttaatatcagtcattggatctcttggaacagtcattgctttaacaatctacagacagcagcatccagtgaatttgtacctgcttttggcatttactgcttttgaagctgtgactgtagctactgctgttacattctatgatgtagctgtagttcttcaagcctttatactgactacagctgtgttccttggcctgacagcattcacgtttcagtcaaagagagacttcagcaagtttggagctgggcttttcacaggcctttggatcctgatttttgcaagttttctgaggctgttcttttacagcgagacagtagaactgttaattgcagcagcaggagccttgctgttctgtggattcatcatctttgacacacatttattgatgcacaaactgtccccagaggagtacatcctggcatctgtcaacctttatctggacatcattaacctctttcttcatctgcttagaatattacaagctgtaaacaaaaaataa

SEQ ID NO: 58647 - protein, 235 aa, Xenopus tropicalis
MASPYPRSSIEDDFNYGTNVASASIQIRMDFLKKVYSILTTQILLTTLTAALFLYSKSIQTFVHESPALLLISVIGSLGTVIALTIYRQQHPVNLYLLLAFTAFEAVTVATAVTFYDVAVVLQAFILTTAVFLGLTAFTFQSKRDFSKFGAGLFTGLWILIFASFLRLFFYSETVELLIAAAGALLFCGFIIFDTHLLMHKLSPEEYILASVNLYLDIINLFLHLLRILQAVNKK

SEQ ID NO: 58648 - DNA, 714 bp, Sus scrofa
  CDS (1)..(714)
atgaatatatttgatcggaagatcaactttgatgccctcttaaagttttcccacataaccccctcgacacagcagcacctgaagaaggtctatgccagttttgccctttgtatgtttgtggcggctgcgggggcctatgtccatgtggtcacccgtttcattcaggctggcctgctgtctgccttgggctccctggggttgatgatttggctgatggcaacacctcatagccatgaaactgagcaaaaaagactgggacttcttgctggatttgctttccttacaggagttggcctcggccctgcactggacttgtgcattgccattaaccccagcatccttcccaccgccttcatgggcacggcaatgatcttcacctgcttcaccctgagcgcgctctatgccaggcgccgtagctacctctttctgggaggtatcttgatgtcagccatgagcctgatggtcttgtcttccctggggaaccttttctttggatccatttggcttttccaggcaaacctgtatgtggggctggtggtcatgtgtggctttgtcctgtttgatactcaactcattattgaaaaggctgaaaatggagataaagattatatctggcactgtgttgacctcttctcagactttgttactctcttcagaaaactcatgatgattctggctatgaatgagaaggacaagaagaaagagaagaagtga

SEQ ID NO: 58649 - protein, 237 aa, Sus scrofa
MNIFDRKINFDALLKFSHITPSTQQHLKKVYASFALCMFVAAAGAYVHVVTRFIQAGLLSALGSLGLMIWLMATPHSHETEQKRLGLLAGFAFLTGVGLGPALDLCIAINPSILPTAFMGTAMIFTCFTLSALYARRRSYLFLGGILMSAMSLMVLSSLGNLFFGSIWLFQANLYVGLVVMCGFVLFDTQLIIEKAENGDKDYIWHCVDLFSDFVTLFRKLMMILAMNEKDKKKEKK

SEQ ID NO: 58650 - DNA, 975 bp, Danio rerio
  CDS (1)..(975)
atgtctagatcagatttccctccttcttatgatgattctcgactgctgtcaaacactcagccggggccaggttatcctccttctgctcctccatatggatttagtccatatgagggacaaccgggatacccacagcctaatgatccataccgaggacagcccaatgatccataccgaggacagcctaatgatccataccgaggacagccggccggatacccccctccagctatgccagtcatccccgtcatgcctcctcctgggatagatgacaatgaaggatttaccacagctggaggattcgagagcactgatgtccggcacagttttatacgcaaagtttatctgatcctcgctgctcagcttcttgtcactgctgccgtcgtggctattctcacatttgtggaaccagtaggattgtttgtgaggaagaaccccgccatctactgggtttcatatgcagtctattttgtcacacatatagtactggtttgctgtcagggacccaggaggcgttttccatggaacctgctcctgttggccatttttacactggccttacctttcatgactggaaatatagcaagttattacagcactagagcggtgttcctggccctggccatcacagttgtcgtgtgtgtagcagtgactgtgttctgctttcagacgaaggtggacttcaccaaatgttctggctttttctgtgtactcggaatcgtagtgtttgtgaccggcatcatcactgctattgtcctgtcattcaaacatgtcccatggctacacatgctttatgcatctataggagccattgcattcactttgtttctggcctatcacactcagctgctcatcgggaaccggaagctctccatcagcccagaagagtacgtgttcgctgctctctcactttatgttgacattgtgcagatcttcatcttcctcctgcaaatcatcggttacgcagagagatag

SEQ ID NO: 58651 - protein, 324 aa, Danio rerio
MSRSDFPPSYDDSRLLSNTQPGPGYPPSAPPYGFSPYEGQPGYPQPNDPYRGQPNDPYRGQPNDPYRGQPAGYPPPAMPVIPVMPPPGIDDNEGFTTAGGFESTDVRHSFIRKVYLILAAQLLVTAAVVAILTFVEPVGLFVRKNPAIYWVSYAVYFVTHIVLVCCQGPRRRFPWNLLLLAIFTLALPFMTGNIASYYSTRAVFLALAITVVVCVAVTVFCFQTKVDFTKCSGFFCVLGIVVFVTGIITAIVLSFKHVPWLHMLYASIGAIAFTLFLAYHTQLLIGNRKLSISPEEYVFAALSLYVDIVQIFIFLLQIIGYAER

SEQ ID NO: 58652 - DNA, 1116 bp, Homo sapiens
  CDS (1)..(1116)
atgtcccatgaaaagagttttttggtgtctggggacaactatcctccccccaaccctggatatccgggggggccccagccacccatgcccccctatgctcagcctccctaccctggggccccttacccacagccccctttccagccctccccctacggtcagccagggtacccccatggccccagcccctacccccaagggggctacccacagggtccctacccccaagggggctacccacagggcccctacccacaagagggctacccacagggcccctacccccaagggggctacccccaggggccatatccccagagccccttcccccccaacccctatggacagccacaggtcttcccaggacaagaccctgactcaccccagcatggaaactaccaggaggagggtcccccatcctactatgacaaccaggacttccctgccaccaactgggatgacaagagcatccgacaggccttcatccgcaaggtgttcctagtgctgaccttgcagctgtcggtgaccctgtccacggtgtctgtgttcacttttgttgcggaggtgaagggctttgtccgggagaatgtctggacctactatgtctcctatgctgtcttcttcatctctctcatcgtcctcagctgttgtggggacttccggcgaaagcacccctggaaccttgttgcactgtcggtcctgaccgccagcctgtcgtacatggtggggatgatcgccagcttctacaacaccgaggcagtcatcatggccgtgggcatcaccacagccgtctgcttcaccgtcgtcatcttctccatgcagacccgctacgacttcacctcatgcatgggcgtgctcctggtgagcatggtggtgctcttcatcttcgccattctctgcatcttcatccggaaccgcatcctggagatcgtgtacgcctcactgggcgctctgctcttcacctgcttcctcgcagtggacacccagctgctgctggggaacaagcagctgtccctgagcccagaagagtatgtgtttgctgcgctgaacctgtacacagacatcatcaacatcttcctgtacatcctcaccatcattggccgcgccaaggagtag

SEQ ID NO: 58653 - protein, 371 aa, Homo sapiens
MSHEKSFLVSGDNYPPPNPGYPGGPQPPMPPYAQPPYPGAPYPQPPFQPSPYGQPGYPHGPSPYPQGGYPQGPYPQGGYPQGPYPQEGYPQGPYPQGGYPQGPYPQSPFPPNPYGQPQVFPGQDPDSPQHGNYQEEGPPSYYDNQDFPATNWDDKSIRQAFIRKVFLVLTLQLSVTLSTVSVFTFVAEVKGFVRENVWTYYVSYAVFFISLIVLSCCGDFRRKHPWNLVALSVLTASLSYMVGMIASFYNTEAVIMAVGITTAVCFTVVIFSMQTRYDFTSCMGVLLVSMVVLFIFAILCIFIRNRILEIVYASLGALLFTCFLAVDTQLLLGNKQLSLSPEEYVFAALNLYTDIINIFLYILTIIGRAKE

SEQ ID NO: 58654 - DNA, 714 bp, Mus musculus
  CDS (1)..(714)
atgaatatatttgatcggaagatcaactttgatgccctcttaaaattttcccacataactccctcgacacagcagcacctaaagaaggtctatgccagttttgcactatgtatgtttgtggcggcagcaggggcctatgtccatgtggtcacacacttcatccaggctggcctactctccgccctgggctccttggccttgatgatttggctgatggcaacacctcacagccatgagaccgagcaaaagagactgggacttctcgctggcttcgccttcctcacaggagtcggcctgggacctgccctggagctgtgcatcgctgtcaaccccagcatcctccccacggccttcatgggcacggccatgatcttcacctgcttcagcctgagcgccctgtatgcccggcgccggagctacctgtttttaggaggtatcttgatgtcagccatgagcctcatgctcctgtcctctctggggaaccttttctttggctccatttggctgttccaggcaaacctgtacctgggactgctggtcatgtgtggctttgtcctctttgatactcagctcattattgagaaggctgaacacggagataaggattacatctggcactgcgttgacctcttcctagatttcgttaccctcttcaggaagctcatgttgatcctggccttcaatgagaaggacaagaagaaagaaaagaagtga

SEQ ID NO: 58655 - protein, 237 aa, Mus musculus
MNIFDRKINFDALLKFSHITPSTQQHLKKVYASFALCMFVAAAGAYVHVVTHFIQAGLLSALGSLALMIWLMATPHSHETEQKRLGLLAGFAFLTGVGLGPALELCIAVNPSILPTAFMGTAMIFTCFSLSALYARRRSYLFLGGILMSAMSLMLLSSLGNLFFGSIWLFQANLYLGLLVMCGFVLFDTQLIIEKAEHGDKDYIWHCVDLFLDFVTLFRKLMLILAFNEKDKKKEKK

SEQ ID NO: 58656 - DNA, 774 bp, Mesorhizobium loti MAFF303099
  CDS (1)..(774)
atggctgatcccattcgcaactatcagacgtcggcggtgcccggcgtccgcgccgacatcgatcagggtctgcgcgcctatatgatcaaggtttacaatctgatggggcttggcctcctcatcaccggtcttgccgcggtcggcacgatcatgctggccaccaccaccgatccggcctcggctgtcgcaacgctgccgagcggcgagatgctgacgtccttcggctatgcgatcttcggctcgccgctgcgctgggtggtgatgctggcgccgctggccgccgtgttcttcctgtcgttcaggattcagtcgatgagcgtcgctgccgcgcagacgacgttctgggtctatgccggcctcgttggcctgtcgctgtcgtcgatcttcctggtctacaccacggccagcatctcgcagaccttcttcgccaccgccgccgccttcggcgcgctgtcgctttacggctacacgaccaagcgcgacttgacggcgatgggctcgttcctgatcatgggcgtgttcggcatcatcatcgcgacggtgatcaatatcttcctgcagtcgtcggcgctgtccttcgccgtttcggcgatcggcgtgctggtcttcgccggcctcaccgcttacgacacgcagaagatcaaggagatgtatttcgagggcgacgcttccgatatcgccggccgcaaggccatcatgggcgcgctgaggctctatctcgacttcatcaacctgttcatgttcctgctgcagttcatgggcgaccgccgctag

SEQ ID NO: 58657 - protein, 257 aa, Mesorhizobium loti MAFF303099
MADPIRNYQTSAVPGVRADIDQGLRAYMIKVYNLMGLGLLITGLAAVGTIMLATTTDPASAVATLPSGEMLTSFGYAIFGSPLRWVVMLAPLAAVFFLSFRIQSMSVAAAQTTFWVYAGLVGLSLSSIFLVYTTASISQTFFATAAAFGALSLYGYTTKRDLTAMGSFLIMGVFGIIIATVINIFLQSSALSFAVSAIGVLVFAGLTAYDTQKIKEMYFEGDASDIAGRKAIMGALRLYLDFINLFMFLLQFMGDRR

SEQ ID NO: 58658 - DNA, 744 bp, Arabidopsis thaliana
  CDS (1)..(744)
atgtataagtggaatcttccttaccgaaaagatgacgtggagaccggccgtgaaggcggtgagagatctctgtatccgactatgcttgagagccccgaactccgatggggtttcatcagaaaggtatattccataatcgcattccagcttttagcaaccatcgccgtcgcctccacggtggtttttgtccgtccgatcgccgtgttcttcgccactactagtgccggtctcgctctctggattgtcttaatcatcacgcctcttatagtaatgtgtcctttgtactattaccaccagaaacatccagtgaattatttgcttctagggattttcacggtagctttggctttcgccgtcggattaacatgtgctttcaccagcgggaaagtgattcttgaggcagcgattttgacaacagtagtggtgctttccttaaccgtctacaccttttgggcagcaaagaaaggatatgactttaacttcctcggtccattcttgtttggtgctctcatcgttctcatggtctttgcccttattcagattttcttcccgttgggacggatctcagtgatgatctatggatgtttggctgcgataatattctgcgggtacatagtttacgatacagacaatctcatcaaacgttacagctacgatgagtatatttgggcagcagtttcgctctacttagatattatcaacctcttcttggctctccttaccattttcagagctgccgagtga

SEQ ID NO: 58659 - protein, 247 aa, Arabidopsis thaliana
MYKWNLPYRKDDVETGREGGERSLYPTMLESPELRWGFIRKVYSIIAFQLLATIAVASTVVFVRPIAVFFATTSAGLALWIVLIITPLIVMCPLYYYHQKHPVNYLLLGIFTVALAFAVGLTCAFTSGKVILEAAILTTVVVLSLTVYTFWAAKKGYDFNFLGPFLFGALIVLMVFALIQIFFPLGRISVMIYGCLAAIIFCGYIVYDTDNLIKRYSYDEYIWAAVSLYLDIINLFLALLTIFRAAE

SEQ ID NO: 58660 - DNA, 720 bp, Arabidopsis thaliana
  CDS (1)..(720)
atgtggaatcagaagcatgatttggagtcggctcagacgcctctctacccgatgatgtcggagagcccggagctccgatggtctttcatccgcaaggtctattccatcatctccatccagctgctcgttacaatcgccgtcgctgccaccgtcgttaaggttcattctatttctgtattcttcaccaccaccaccgccggcttcgctctctacatacttcttatattgactccattgatcgttatgtgtcctttgtattactatcaccagaagcaccctgtgaactatctgttactcgggattttcaccgtcgctcttgcctttgcggttggcttgacctgcgcctttacaagcgggaaggtgattctggaatctgtgattttgaccgctgttgtggtcatatccctcactctatacactttctgggcggccaaaagaggccatgacttcaacttcctcggacctttcttgttcggtgctgtcattgtcctcatggtgttttccttcatccagattctcttccctttaggaaagatctctgtgatgatctatggttgtttggcatccatcatcttctgtggctacattgtatatgataccgacaacttgatcaagaggcactcctatgacgagtacatctgggctgctgtttctctttatttggatgtcattaatctcttcctatctctcctcactctcttaagggctgttgatagttag

SEQ ID NO: 58661 - protein, 239 aa, Arabidopsis thaliana
MWNQKHDLESAQTPLYPMMSESPELRWSFIRKVYSIISIQLLVTIAVAATVVKVHSISVFFTTTTAGFALYILLILTPLIVMCPLYYYHQKHPVNYLLLGIFTVALAFAVGLTCAFTSGKVILESVILTAVVVISLTLYTFWAAKRGHDFNFLGPFLFGAVIVLMVFSFIQILFPLGKISVMIYGCLASIIFCGYIVYDTDNLIKRHSYDEYIWAAVSLYLDVINLFLSLLTLLRAVDS

SEQ ID NO: 58662 - DNA, 747 bp, Arabidopsis thaliana
  CDS (1)..(747)
atgtatcagtggaacttaccgtaccggaaagatgacgtggaaacaggcgttagctcaagaaggcctttactatacccagcgatgcatgaaaatcccgagctccggtggggatttatacgcaaggtctactctataatcgcctttcagcttctagccaccgtcgctgtcgctgccacggtggtcaccgtccgtccaatcgctctgttcttcgccaccaccggacttggattagctctttacatagtcatcatcatcacacctctcatagtgttgtgtccgttgtactattaccatcagaaacatccggtgaattacttgctcttggggattttcactttggctctggcttttgttgttggattaacatgtgccttcaccaatgggaaagtgattctcgagtcagtgatcttgacatcggtagtggtgctttcgctcacattatatactttttgggctgctaggaaaggatatgactttaatttccttggacccttcttgtttggcgctctcaccgtgcttattttcttcgccttaatacaaattttgttcccattagggagggtatcagtgatgatctatggttgtttggtatcgataatattctgcggatacatagtttacgatacagacaatctgatcaagagacacacgtatgatgagtatatttgggcagcggtttcactctacctagacatcatcaacctcttcttgtatcttcttactgtgttgagagccttacagagatga

SEQ ID NO: 58663 - protein, 248 aa, Arabidopsis thaliana
MYQWNLPYRKDDVETGVSSRRPLLYPAMHENPELRWGFIRKVYSIIAFQLLATVAVAATVVTVRPIALFFATTGLGLALYIVIIITPLIVLCPLYYYHQKHPVNYLLLGIFTLALAFVVGLTCAFTNGKVILESVILTSVVVLSLTLYTFWAARKGYDFNFLGPFLFGALTVLIFFALIQILFPLGRVSVMIYGCLVSIIFCGYIVYDTDNLIKRHTYDEYIWAAVSLYLDIINLFLYLLTVLRALQR

SEQ ID NO: 58664 - DNA, 708 bp, Arabidopsis thaliana
  CDS (1)..(708)
atggcgaaatctgacattgaaactggtggtggtaacgagctgtatccgggaatgaaagagagctcggagcttcgttgggctttcataagaaaactttacagcattttgtctcttcagttgcttgtcaccgtcggagtctccgccgttgtttacttcgtccgtccgatccccgagttcatcaccgagactcaccgtggccttgccgtctttttcgtcatcctcctccttcctctcctcctgttgtggcctctgttggcttttgagaagaagcatccgataaactgcattgtcctgtccatcttcactctctccatttccttctctgtggggatttgctgctctctctcccaagggaggattgttctggaggctgcaattctcacagctgtgatggtctttggtctaacgatctacaccttctgggcagtgaagagaggacatgatttctccttccttggaccattcctctttggtgctctcctcattatccttgtcttcacccttttgcagatattccaccctctggggaagctatcatcgatgatattcagcggaatagcttcaatagtgttctgcggatacatcatcttcgacaccaatcagctgatcaagaaactcaactacgacgaatatatcactgcagcgattcgtctatacctcgacgttatgaatctcttcctcagtctcctcggcattataagcaactga

SEQ ID NO: 58665 - protein, 235 aa, Arabidopsis thaliana
MAKSDIETGGGNELYPGMKESSELRWAFIRKLYSILSLQLLVTVGVSAVVYFVRPIPEFITETHRGLAVFFVILLLPLLLLWPLLAFEKKHPINCIVLSIFTLSISFSVGICCSLSQGRIVLEAAILTAVMVFGLTIYTFWAVKRGHDFSFLGPFLFGALLIILVFTLLQIFHPLGKLSSMIFSGIASIVFCGYIIFDTNQLIKKLNYDEYITAAIRLYLDVMNLFLSLLGIISN

SEQ ID NO: 58666 - DNA, 744 bp, Arabidopsis thaliana
  CDS (1)..(744)
atggaggcgaacggtacgatttggagccatgattatctcagaaactctcatgaattctctccggccgtgcagaatcatcttaagcggttttgtattgttcttggttcgcatcgttgtgttattgatctctatctcacgttattctttgctcttcttgcgtctgcgattggagcttacattcacatggtctggaatatcggtggaaatgtcagtactcttggattcagtggaatcatgatttggttgcgtttcactctttatgaacctaacatgctctaccttctgtttctatttgcccttcttaaaggtgcttcagttggtcccatgatcatgctagtcattgattttgactcaagcgtcctggtcactgcatttgtgggaacagcagtagcatttgtgtgtttctccgctgcagcaatgttggcaacgcgtagagagtacctttaccacggagcttcacttgcttgttgtatgtccatcctttggtgggtacaaattgcctcttccatcttcggaggctctacaactgtcgtcaagtttgagctatactttggactcttgatctttgtgggatacatagtggtggacacacagatgataaccgagaaagcacaccacggtgatatggactatgtgcaacattcttttacctttttcactgactttgcttctctatttgttcaaattctcgttctcaacatgtttaggaagatgaagaaaggaagaaaagaccgaagaaactga

SEQ ID NO: 58667 - protein, 247 aa, Arabidopsis thaliana
MEANGTIWSHDYLRNSHEFSPAVQNHLKRFCIVLGSHRCVIDLYLTLFFALLASAIGAYIHMVWNIGGNVSTLGFSGIMIWLRFTLYEPNMLYLLFLFALLKGASVGPMIMLVIDFDSSVLVTAFVGTAVAFVCFSAAAMLATRREYLYHGASLACCMSILWWVQIASSIFGGSTTVVKFELYFGLLIFVGYIVVDTQMITEKAHHGDMDYVQHSFTFFTDFASLFVQILVLNMFRKMKKGRKDRRN

SEQ ID NO: 58668 - DNA, 714 bp, Lactococcus lactis subsp. lactis Il1403
  CDS (1)..(714)
atgaaaaatatgaatgataataatgttatctttgaccaaagaagcgatggattgaatgcatttttcagtaaaatttatgcgttgatgggagcaggagtattagtttctgcactcgtttcttggataatgattacatttttcttagataacatgacagcaattctccaaagtggaagtttattcttccttgtactctggattattcctttagtgatggtagtatcacttcaagggttagcaatgaaaaactcaaaaatggcactaccgatttttatcggttatgcggcatttatgggattcttgattagttttacacttttgatgtataccgccactgatattactttagcctttgttacggcagcagcaatgttctttggtttatctgtttatggacgatttactaaacgtaatttatcggcaatgggtaaagcatttggtgttgcagtctggggcttgattattgcaatgtttcttaatttcttctttgcaagtacaggacttacaatccttattagcctagtaggtgttgtgattttcgcagggcttatcgcttgggataatcaaaaaattacacaggtttataatgcaaacaatggacaagtaagtgatggttgggcaatttcaatggcactttcactctatcttgacttcatcaacatgtttctcttcctactccgtcttttcggtatcgcaggtggaaatcgcgattaa

SEQ ID NO: 58669 - protein, 237 aa, Lactococcus lactis subsp. lactis Il1403
MKNMNDNNVIFDQRSDGLNAFFSKIYALMGAGVLVSALVSWIMITFFLDNMTAILQSGSLFFLVLWIIPLVMVVSLQGLAMKNSKMALPIFIGYAAFMGFLISFTLLMYTATDITLAFVTAAAMFFGLSVYGRFTKRNLSAMGKAFGVAVWGLIIAMFLNFFFASTGLTILISLVGVVIFAGLIAWDNQKITQVYNANNGQVSDGWAISMALSLYLDFINMFLFLLRLFGIAGGNRD

SEQ ID NO: 58670 - DNA, 705 bp, Escherichia coli O157:H7
  CDS (1)..(705)
atggacagattcccacgttctgattcaattgtacaaccccgggctggcttgcagacttatatggcgcaagtctatggctggatgaccgttggcttattgctgaccgcatttgttgcctggtatgcggctaattccgcggccgtgatggagctgttgttcactaaccgtgtctttttaatcggtctgatcatcgcgcaattagcattggttattgtgttatcagcgatgattcaaaagctgagcgcaggtgtaacgacgatgctctttatgctttattcggcgctgacgggtcttacgctttccagtattttcattgtttataccgctgcttctatcgccagtaccttcgtcgttactgccgggatgttcggcgcaatgagcctgtacggttacaccacgaagcgcgatttaagtggctttggcaatatgctgtttatggcgttaatcggcattgtgttggcatcgctggtcaacttctggctgaaaagcgaagcgttgatgtgggcagtcacctacatcggcgtgattgtctttgtcggattgacggcgtatgacacccagaaactgaaaaatatgggtgagcagatagatacccgcgacgcgtcgaacctgcgcaaatattccattctttgcgcattaaccttgtatctggacttcatcaacctgttcctgatgttgctgcgaatttttggcaatcgtcgttaa

SEQ ID NO: 58671 - protein, 234 aa, Escherichia coli O157:H7
MDRFPRSDSIVQPRAGLQTYMAQVYGWMTVGLLLTAFVAWYAANSAAVMELLFTNRVFLIGLIIAQLALVIVLSAMIQKLSAGVTTMLFMLYSALTGLTLSSIFIVYTAASIASTFVVTAGMFGAMSLYGYTTKRDLSGFGNMLFMALIGIVLASLVNFWLKSEALMWAVTYIGVIVFVGLTAYDTQKLKNMGEQIDTRDASNLRKYSILCALTLYLDFINLFLMLLRIFGNRR

SEQ ID NO: 58672 - DNA, 696 bp, Clostridium acetobutylicum ATCC 824
  CDS (1)..(696)
atggaaaacttaagattaaatcatgaaaatcaagaagctcgcagtttcattcaacaggtttatatgtggatgacattagcccttttaaccactgctggagttgctcttgccgtatcaacttcaccaagcttaattgaaactctttttataaacagatcacttttctttgttttaattttagctgaagttcttattgttgcttttttatcaagaagaataaataaaatgtcttcacaagttgcaacagcaatattctttgtatattcagttgttaatggctttacactttcatggatatttcttgtttatgatttaggctcaatttcaagtgtattttttataactgctggaacctttggtgctatgtgtgcatatggctactttaccaaaaaggatctcacaagcataggtaatatttgtcttatgggtctagtaggactaatacttgcatcaatagttaatatctttataatgaacgatatgttttcatttattatatcctttataggagttattctctttgtagcaatcactgcatatgatactcaaagaattaaggcaatggctttatcttcaagctattctggtgatgtagaagcttctgcgaaaggaagtatacttggagctcttacattgtatcttgattttataaatctttttatctatatcttaagattatttggacgaaaaagataa

SEQ ID NO: 58673 - protein, 231 aa, Clostridium acetobutylicum ATCC 824
MENLRLNHENQEARSFIQQVYMWMTLALLTTAGVALAVSTSPSLIETLFINRSLFFVLILAEVLIVAFLSRRINKMSSQVATAIFFVYSVVNGFTLSWIFLVYDLGSISSVFFITAGTFGAMCAYGYFTKKDLTSIGNICLMGLVGLILASIVNIFIMNDMFSFIISFIGVILFVAITAYDTQRIKAMALSSSYSGDVEASAKGSILGALTLYLDFINLFIYILRLFGRKR

SEQ ID NO: 58674 - DNA, 708 bp, Streptococcus pneumoniae R6
  CDS (1)..(708)
atgttcacagaaaaggagaaaaggatgaatcacactattatacatgaccgtgcaggtctcaatcaattttacgctaaggtttatgcctttgttggtctgggaatcggactatctgctttggtatcaggccttatgttgacggtctttcagtctcagttggtttacttgttgatgcaggggcgtctctggttgaccattgctacttttgcggagttggctttggttttcgttgccagtagcatggcttcaagaaatagtccagctgctcttccagtatttttactttactccgttttaaacggctttacccttagttttgtggtggctttctatactccgggtacagttttatctgcctttgtatcgagcgcccttctcttctttgtcatggcggcagttggtatctttaccaagaaagacttgagtgggattggtcgagcaatgatggcagctctcattggtttactgattgctatggtagtcaatattttcttggctagtggcttctttgattatatgattagcgtagccatggttttggttttttcagggttgattgcttgggataaccaaaagattcgcctcgcctatgaacaatcacaaggtcgtgtagcgacaggctgggtggtgtcaatggctctcagcatctatcttgattttatcaatcttttcctaagtattctacgtatctttggtcgcaatgactaa

SEQ ID NO: 58675 - protein, 235 aa, Streptococcus pneumoniae R6
MFTEKEKRMNHTIIHDRAGLNQFYAKVYAFVGLGIGLSALVSGLMLTVFQSQLVYLLMQGRLWLTIATFAELALVFVASSMASRNSPAALPVFLLYSVLNGFTLSFVVAFYTPGTVLSAFVSSALLFFVMAAVGIFTKKDLSGIGRAMMAALIGLLIAMVVNIFLASGFFDYMISVAMVLVFSGLIAWDNQKIRLAYEQSQGRVATGWVVSMALSIYLDFINLFLSILRIFGRND

SEQ ID NO: 58676 - DNA, 738 bp, Sinorhizobium meliloti 1021
  CDS (1)..(738)
atggctgatctgagaaactaccaaacccgaatgtcgcccgccggcgctcaggcgggtgccgtgatcgacgaaggccttcgcgcttatatgctgaaggtctacaacctgatggctctcggcctggcgattaccggcgtggcagcttacggaacctatgcgcttgccgcctctaatccggcattcgcccagcttatctacgcttcgcccctgaagtgggtcgttatgctggcgccgcttgcgctggtgttcttcctgagcttccgcatcaattccatgagcgtttccgcggcgcagacgaccttctgggtctatgcggcgctgatgggcctgtccctgtcgtcgatcttcctggtcttcaccggccagagcatcgtgcagacgttcttcgtgacggctgcttcgttcggtgccctgtcgctttacggctatacgacgaagaaggacctttcgggcctcggatcgttcctgatcatgggcctcttcggcgtgatcatcgcatccgtcgtcaacatcttccttgcctcttcggcactcggcttcgcgatctcggtgatcggcgtgctcatcttcgcgggcctgaccgcctacgacacgcagaagctcaaggaaatgtactttgaaggcgatgacgccttggtcgccggccgcaaggccatcatgggcgcgctaacgctctacctcgacttcatcaacctgttcatgttcatgctgcagttccttggcaacaagaacgagtag

SEQ ID NO: 58677 - protein, 245 aa, Sinorhizobium meliloti 1021
MADLRNYQTRMSPAGAQAGAVIDEGLRAYMLKVYNLMALGLAITGVAAYGTYALAASNPAFAQLIYASPLKWVVMLAPLALVFFLSFRINSMSVSAAQTTFWVYAALMGLSLSSIFLVFTGQSIVQTFFVTAASFGALSLYGYTTKKDLSGLGSFLIMGLFGVIIASVVNIFLASSALGFAISVIGVLIFAGLTAYDTQKLKEMYFEGDDALVAGRKAIMGALTLYLDFINLFMFMLQFLGNKNE

SEQ ID NO: 58678 - DNA, 645 bp, Bacillus subtilis subsp. subtilis str. 168
  CDS (1)..(645)
atgcaagctacggttcacgagagtaagcaatcgatcatgcaacgcattttgacagtctttgtcttcacattgctgatcgcgactgtcggcctttttatcggccaatttgttcctgtcgctttgatgctgccgctttctattcttgaagtggcgatgattattctggccttctggatgcgcagaagaaaagcggtcgggtatgcgtttgtatatacattcgcgttcgtttccggcattaccttatttccgatcgtcagccattacgcttccatcgccggcgcctatgtcgtgctcgaagcctttggctctacatttgtcatttttgccgtcttgggcacaatcggcgcaaaaatgaagaaggatttatccttcctgtggtcgtttctgctggttgcggtgctcgcactcgcagtggtagggattttcaacattttcagcccgttaaactcagcggcgatgatggcgtattccgtgatcggaaccatcgtcttttccctttacattttgtatgatttgaaccaaatcaagcaccgccacattacggaagacttgattccggttatggcgttatcgctgtacctagactttatcaacttgttcatcaacctgctccgcttcttcggcattttgagcagtgatgattaa

SEQ ID NO: 58679 - protein, 214 aa, Bacillus subtilis subsp. subtilis str. 168
MQATVHESKQSIMQRILTVFVFTLLIATVGLFIGQFVPVALMLPLSILEVAMIILAFWMRRRKAVGYAFVYTFAFVSGITLFPIVSHYASIAGAYVVLEAFGSTFVIFAVLGTIGAKMKKDLSFLWSFLLVAVLALAVVGIFNIFSPLNSAAMMAYSVIGTIVFSLYILYDLNQIKHRHITEDLIPVMALSLYLDFINLFINLLRFFGILSSDD

SEQ ID NO: 58680 - DNA, 705 bp, Salmonella typhimurium LT2
  CDS (1)..(705)
atggacagatttccacgatctgattcaatagtgcaggcgcggtccggcctgcagacctatatggcgcaagtgtatggctggatgacggtcggactgttactgaccgcgtttatcgcgtggtatgcggctaatacgccagccgtcatgatgtttgtcttttccagtaagatcactttctttggcttaattattgcccagcttgcgctggtgtttgttctgtcgggactggtgcataaacttagcgccggaatggcgacgacgctgtttatgctctattcggcgctaaccggattgacgttatccagtatttttatcgtttacacctactcctctatcgccagcacgtttgtggtgacggggggaatgtttggcgccatgagcctgtacgggtacaccactaaacgcgatcttagcggtttcggcaatatgctgtttatggcgcttattggtatcgttctggcgtcgctggtcaatttctggctgaagagtgaagcgctgatgtgggcggtaacctatatcggggtggtggtgtttgtcggtctgaccgcctatgacacgcagaaactgaaaaatatcggcgagcaaatagatacccgagatagcgctaatctgcgtaaatattcgattctcggcgcgttaacgctgtacctggactttatcaacctgttcctgatgttactgcgtatttttggtaatcgccgctaa

SEQ ID NO: 58681 - protein, 234 aa, Salmonella typhimurium LT2
MDRFPRSDSIVQARSGLQTYMAQVYGWMTVGLLLTAFIAWYAANTPAVMMFVFSSKITFFGLIIAQLALVFVLSGLVHKLSAGMATTLFMLYSALTGLTLSSIFIVYTYSSIASTFVVTGGMFGAMSLYGYTTKRDLSGFGNMLFMALIGIVLASLVNFWLKSEALMWAVTYIGVVVFVGLTAYDTQKLKNIGEQIDTRDSANLRKYSILGALTLYLDFINLFLMLLRIFGNRR

SEQ ID NO: 58682 - DNA, 660 bp, Salmonella typhimurium LT2
  CDS (1)..(660)
atggatcgtatcattacatcatcgcgtgatcgtagctcgctactgagtacgcacaaagtactgcgcaacacctattttctgttgagcctgacgctggctttatccgcaattaccgcgacagccagtacggtactgatgctgccctcccccggcctgattctgacgctggtcggtatgtatgggctgatgttcctgacctataaaaccgccaataagccggtcggtatcctgtctgcttttgcgtttaccggcttcctcggctatatcctgggcccgattcttaacgcctatctgtcagcaggcatgggcgatgtcattggcctggcgctgggtggaaccgcgttagtatttttctgctgctccgcttacgttctgaccacccgtaaggatatgtctttcctgggcggtatgttaatggccgggatcgtcgtcgtgctgattggtatggtggcgaatattttcctgcaactgcctgcattgcacctggcgattagcgcggtgtttatcctgatttcctcgggcgctatcctgtatgaaaccagtaacatcattcacggcggtgaaaccaactatattcgtgcgaccgtcagtctgtacgtttcgctgtacaacatctttgtcagcctgctcagcattctgggcttcgccagccgcgactaa

SEQ ID NO: 58683 - protein, 219 aa, Salmonella typhimurium LT2
MDRIITSSRDRSSLLSTHKVLRNTYFLLSLTLALSAITATASTVLMLPSPGLILTLVGMYGLMFLTYKTANKPVGILSAFAFTGFLGYILGPILNAYLSAGMGDVIGLALGGTALVFFCCSAYVLTTRKDMSFLGGMLMAGIVVVLIGMVANIFLQLPALHLAISAVFILISSGAILYETSNIIHGGETNYIRATVSLYVSLYNIFVSLLSILGFASRD

SEQ ID NO: 58684 - DNA, 678 bp, Listeria innocua Clip11262
  CDS (1)..(678)
atgaacgaaatcaatccaacatccgagcgagtaaacacagagaaaagaacaaataaacaaattattatgcaaaaaatacttaattggtttgtattttctttgctacttgcatctatcggtgctgcgattgggagtaaattaagtccagaactttatttgcctcttgtcgtgttagaagtcgcgttacttatcacagcaatggtagtgcgtcgaagtaaaacaattaataaagtggtagggtacccagtagtactagcatttgcgtttgtcacaggcttaacgcttggaccaactttgacatattattttggtgcaggacaaggtgccgccgttctgatggcatttgttacagcaactattacattcacaacattagcttttattggcgcaaaaatgaaaagagacttatctttcttaagtagcgcattattcgcggcgattattattcttatcatctttagttttgctggagtatttttaccactaggttctatgctgacaactattatttcagcaggtgggacaattattttctcattatacattttgtatgattttaaccaaattatgaagcgcgatgtggaacttgcagatgtaccaatgcttgcgctgaatttataccttgatttccttaacttattcatgttcttactccgtctatttacaggtcgtgattaa

SEQ ID NO: 58685 - protein, 225 aa, Listeria innocua Clip11262
MNEINPTSERVNTEKRTNKQIIMQKILNWFVFSLLLASIGAAIGSKLSPELYLPLVVLEVALLITAMVVRRSKTINKVVGYPVVLAFAFVTGLTLGPTLTYYFGAGQGAAVLMAFVTATITFTTLAFIGAKMKRDLSFLSSALFAAIIILIIFSFAGVFLPLGSMLTTIISAGGTIIFSLYILYDFNQIMKRDVELADVPMLALNLYLDFLNLFMFLLRLFTGRD

SEQ ID NO: 58686 - DNA, 702 bp, Ralstonia solanacearum GMI1000
  CDS (1)..(702)
atggacaaccaactcaacacgtacggttttggcgcttccggcaccgccggcgcgttggccgtccgcaaccgcgtgctgcgcaatacctattggctgctcgcactttcgatgatccccaccatcctgggtgcatggatcggtgtcgccacgggcttcaacctgatggccggccggccgctgatgggcttcctgatcttcatgggggtggccttcggcttcttctacgccatcgaacgcttcaagaacagcggcatgggcgttgccttgctgctcggcttcacgttcttcatggggctcatgctgtcgcggctgatcggcatgatcctcggcttctcgaacggcgcagcactgatcatgacggcgttcggcggcacggcaaccatctttgctgtgatggccaccgtggccaccgtcagcaagcgcgatttctccggcctgggcaagtggctgttcatgggcgtgctggtgctgatcgtcggctccgtggccaacatctggctgcagctgccgtcgatgatgctgacgatctcggtactggccatcgccatcttctcggcctacatcctgtacgacgtgcagcgcatcgtgaacggcggcgagaccaactacgtgacggccacgctggcgatctacctggacgtctacaacgtcttcacgaatctgctggcgatcctgggcatctttggcggcaaccgcaactga

SEQ ID NO: 58687 - protein, 233 aa, Ralstonia solanacearum GMI1000
MDNQLNTYGFGASGTAGALAVRNRVLRNTYWLLALSMIPTILGAWIGVATGFNLMAGRPLMGFLIFMGVAFGFFYAIERFKNSGMGVALLLGFTFFMGLMLSRLIGMILGFSNGAALIMTAFGGTATIFAVMATVATVSKRDFSGLGKWLFMGVLVLIVGSVANIWLQLPSMMLTISVLAIAIFSAYILYDVQRIVNGGETNYVTATLAIYLDVYNVFTNLLAILGIFGGNRN

SEQ ID NO: 58688 - DNA, 783 bp, Agrobacterium tumefaciens str. C58
  CDS (1)..(783)
atggctgacttcaataactaccagaaccgcatggcgcagacgcgtgcacagtctggtgcgatgatcgatgaaggtcttcgcgcctatatgctgaaggtttacaacctgatggcgctggctctggtcatcaccggtgtcgcggcgttcggctttgccatgcttgccacgacaactgatcccgccgccgcggtcgcaacgctgccgaatggcaagatgctgacctccctgggtgcccttgtttatgcgtctccgctgcgctgggtcgtcatgctggcaccgctcggactggtcttcttccttagcttccgcattcagaacatgagcgtttccgccgctcagtcgaccttctgggtttatgccgctctgatgggcgtgtcgttgtcctcgatctttctcagatatactgaaggaagcatcgtacagacgttcttcgtgaccgctgcttcgttcggcgcactctcgctttacggttatacgacgaagaaggacctttccggcatcggttcgttcctgatcatgggtctgttcggcctcatcatcgcctccatcgtcaatattttccttggttccggcgccctgcagttcgcgatttcggcgatcggcgtactgatcttcgcaggcctgaccgcctatgacacgcagaagatcaaggaaatgtatttcgatgccgacgatgtcgccgtggctggccgcaaggctatcatgggtgcactgacgctctatctcgacttcatcaacctcttcaccttcctgctgcagttcctcggtaaccgcaacgactaa

SEQ ID NO: 58689 - protein, 260 aa, Agrobacterium tumefaciens str. C58
MADFNNYQNRMAQTRAQSGAMIDEGLRAYMLKVYNLMALALVITGVAAFGFAMLATTTDPAAAVATLPNGKMLTSLGALVYASPLRWVVMLAPLGLVFFLSFRIQNMSVSAAQSTFWVYAALMGVSLSSIFLRYTEGSIVQTFFVTAASFGALSLYGYTTKKDLSGIGSFLIMGLFGLIIASIVNIFLGSGALQFAISAIGVLIFAGLTAYDTQKIKEMYFDADDVAVAGRKAIMGALTLYLDFINLFTFLLQFLGNRND

SEQ ID NO: 58690 - DNA, 771 bp, Arabidopsis thaliana
  CDS (1)..(771)
atggacaaaccgtacggatacgcgagcgtgagcatgagcggcatagatcgttccgccggaaaggatattgatcttgagatgggagtcggagaagcgacgctttatcctgggctaagttacggcgagaatcagctccgatggggatttattcgtaaggtctatgggattctctcagctcagcttcttcttacgacgcttatctccgccgtcgttgttcttaatcctcctgttaacgatctcttgaccggatctcctgggattcttctcttcctctgcatcgttcccttcatcttaatctggcctctgcacatttaccaccagaagcatcctgttaacctgatcctccttgccctcttcactgtttcattgagtttcactgttggtgtcagttgtgctatgacagaaggacgaattgtgctacaagccttgatattgactctgtctgtggtcggatctctaaccgcatacactttctgggctgcaaagaagggaaaagacttcagcttccttggacccattctcttcaccagcctcatcattcttgtagtgaccagcttcatccagatgttcttccctcttggcccgacttctgttgccgtatacggaggattcagtgccttggtattctgcggatacatagtctatgataccgacaacctcatcaagcgtttcacatatgacgaatacatcctagcatcagtagctctctacttggacatcctcaatctcttcttgaccatattgcgtatactgaggcaaggcgacaactga

SEQ ID NO: 58691 - protein, 256 aa, Arabidopsis thaliana
MDKPYGYASVSMSGIDRSAGKDIDLEMGVGEATLYPGLSYGENQLRWGFIRKVYGILSAQLLLTTLISAVVVLNPPVNDLLTGSPGILLFLCIVPFILIWPLHIYHQKHPVNLILLALFTVSLSFTVGVSCAMTEGRIVLQALILTLSVVGSLTAYTFWAAKKGKDFSFLGPILFTSLIILVVTSFIQMFFPLGPTSVAVYGGFSALVFCGYIVYDTDNLIKRFTYDEYILASVALYLDILNLFLTILRILRQGDN

SEQ ID NO: 58692 - DNA, 714 bp, Camelpox virus
  CDS (1)..(714)
atggccatgccgagcctctacgcgtgctcctccatcgaggacgacttcaactatggcagctcggtggcgtctgccagtgtgcacatacgaatggcatttctaagaaaagtctacggtatcctttgtctacaatttcttttaacaacggcaacaactgcagtatttttatactttgactgcatgcggaaaattatacaagggagtcctgttctaatattggcatcaatgttcgtatctataggcttgattttcgcattgactttacacagacataaacatcccctgaatttatacctgctttgtggatttacactgtcggaatctctaacgctggcctctgttgttactttctatgatgtgcatgtcgttatgcaagctttcatgctgactactgcagtgtttcttgctctgactgcatatactctacaatcaaagagagatttcagtaaacttggagcaggattgtttgttactttgtggattttaattttgtcaggacttttgaggatatttgtgcaaagtgaaacagtggagctggtcctgtctgcttttggggcccttgtattctgcggattcattatctatgacacgcactcactaatacataagctctcgcctgaagactatgtgttagcctctatcaatttctacttggatatcatcaatctgttcttgcatctgttacagcttttggaagtatctaataagaaataa

SEQ ID NO: 58693 - protein, 237 aa, Camelpox virus
MAMPSLYACSSIEDDFNYGSSVASASVHIRMAFLRKVYGILCLQFLLTTATTAVFLYFDCMRKIIQGSPVLILASMFVSIGLIFALTLHRHKHPLNLYLLCGFTLSESLTLASVVTFYDVHVVMQAFMLTTAVFLALTAYTLQSKRDFSKLGAGLFVTLWILILSGLLRIFVQSETVELVLSAFGALVFCGFIIYDTHSLIHKLSPEDYVLASINFYLDIINLFLHLLQLLEVSNKK

SEQ ID NO: 58694 - DNA, 690 bp, Streptococcus pyogenes MGAS8232
  CDS (1)..(690)
atgaacgatcacgttatttatacacaatcagatgtgggattaaatcagttttttgctaaaatttatagtctagtgggaatgggagtgggtttatctgcttttgtttcttatttgatgctttatccatttagagaaaatttaatctctattcttgttaatcagccgatgatttactatggtgctgcgattattgaacttattttagtttttgtagccagtggtgcagcacgaaaaaacacaccagctgcattgcccatttttcttatctattctgcgctaaatggctttaccctaagctttattattgtggcatacgctcaaacgacagtttttcaagcatttctttcttcagcagctgtgttttttgccatgtcaatcattggtgtcaagactaaacgggatatgtcaggtcttagaaaggctatgtttgctgctttgattggtgttgttgtggctagtctgattaatctttttattggtagtgggatgatgagttatgtcattagtgtgatttccgtgctaattttctcaggtctcatcgcatcagataatcaaatgattaagcgcgtttatcaagcaacaaatggccaggttggtgatggctgggctgttgctatggccttaagcttgtatttagattttattaacttatttatcagccttcttcgtatttttggaagaaatgattaa

SEQ ID NO: 58695 - protein, 229 aa, Streptococcus pyogenes MGAS8232
MNDHVIYTQSDVGLNQFFAKIYSLVGMGVGLSAFVSYLMLYPFRENLISILVNQPMIYYGAAIIELILVFVASGAARKNTPAALPIFLIYSALNGFTLSFIIVAYAQTTVFQAFLSSAAVFFAMSIIGVKTKRDMSGLRKAMFAALIGVVVASLINLFIGSGMMSYVISVISVLIFSGLIASDNQMIKRVYQATNGQVGDGWAVAMALSLYLDFINLFISLLRIFGRND

SEQ ID NO: 58696 - DNA, 795 bp, Drosophila melanogaster
  CDS (1)..(795)
atgctggatattttacaagaaccagtacatcagtatggaaatcggagccaccaggcggagtgtattccgctgggaagatatacagcttacggatcggaaatcggacaggatgatccagacaagggcttgggattctgcagcgccagcatccggcgaggattcatccggaaggtgtacctcatcctgttggcccaactgatcacttccctggtggttatagtttcacttactgctgataaacgggtgcgtctgatggtggcagaaagcacctggatatttgtggtggccatactaatagtggtcttctctctggtggctctgggctgcaatgaggatctgcgtcgtcagaccccagctaacttcatcttcctatctgccttcacgatagccgagtcctttctgctgggcgtggcagcctgtcgttatgccccaatggagattttcatggccgtgctaatcacggcgtcagtttgccttggactcaccctttttgctctgcagacgcgttacgactttaccgtcatgggtggcctcctggtgagctgcctgataatactgctcttctttggaattgtgaccatcttcgtgggcggacatatggtcaccaccatatatgcctcattgagcgctctgctcttctccgtttatttagtttacgatacacaattgatgatgggaggcaagcataggtactccattagtcccgaggagtacatattcgctgccctaaatatttacatggatgtaatgaacatattcctggacattttgcaattaatcggaggatccgattag

SEQ ID NO: 58697 - protein, 264 aa, Drosophila melanogaster
MLDILQEPVHQYGNRSHQAECIPLGRYTAYGSEIGQDDPDKGLGFCSASIRRGFIRKVYLILLAQLITSLVVIVSLTADKRVRLMVAESTWIFVVAILIVVFSLVALGCNEDLRRQTPANFIFLSAFTIAESFLLGVAACRYAPMEIFMAVLITASVCLGLTLFALQTRYDFTVMGGLLVSCLIILLFFGIVTIFVGGHMVTTIYASLSALLFSVYLVYDTQLMMGGKHRYSISPEEYIFAALNIYMDVMNIFLDILQLIGGSD

SEQ ID NO: 58698 - DNA, 711 bp, Yersinia pestis KIM
  CDS (1)..(711)
atggatcgctatccacgctctaatggttcgattgtcgaacgtgccggctcaggcattcaggcctatatggcgcaggtatacggttggatgacctgtggcttgttattaaccgcagttgtcgcttggtatgccgcgaacactccttcaatcatttttgctttgcaatcaaaccaaatattgttctttggcttgattattgcccagcttggtctggtttttgttatttccggtatggttaaccgcctgagtggaaccgcagcaacatcactgtttatgctgtattccgcgctgaccggcctcaccctttccagcatattgataatgtacacgggcgcgtctatcgccagtactttcgttatatgtgccgggatgtttggtgccatgagcttctatggttacaccaccaaacgtgatctgagcggtatgggcagcatgttgtttatgggcctgatcggtatcattctggcatcccttgttaacatctggctgaaaagcccagcgttgatgtgggttgtgacctatatcggtgtgctcgtgtttgtgggcctgactgcctacgacacacagaaactgaaaaacttgggcgcacagttggatgtcaatgataaagattcattccgcaaatactccattgtgggcgcactgactctgtatctcgatttcattaacctgttcttgatgttattacgaatcttcggtaatcgtcgctaa

SEQ ID NO: 58699 - protein, 236 aa, Yersinia pestis KIM
MDRYPRSNGSIVERAGSGIQAYMAQVYGWMTCGLLLTAVVAWYAANTPSIIFALQSNQILFFGLIIAQLGLVFVISGMVNRLSGTAATSLFMLYSALTGLTLSSILIMYTGASIASTFVICAGMFGAMSFYGYTTKRDLSGMGSMLFMGLIGIILASLVNIWLKSPALMWVVTYIGVLVFVGLTAYDTQKLKNLGAQLDVNDKDSFRKYSIVGALTLYLDFINLFLMLLRIFGNRR

SEQ ID NO: 58700 - DNA, 690 bp, Streptococcus agalactiae 2603V/R
  CDS (1)..(690)
atgaatgataacgtcatttacacacaatctgattcagggctgaatcaattttttgctaagatttacggtcttgtagggataggagtaggtttgtcagctgctgtttctgcgattatgctgtatatgtttccacaaaatatgattgccatcatgcaaaaaatgccagggttgtattttggagcaatcatcttagaattggttttagtctttgttgctagtggagcggcgcgtcgaaacacaccagctgcattaccattatttttgatttattcagctttgaatgggtttactttaagtttcattatcgcaaggtacacgcaaactacagttcttcaagcttttataacatctgcggctgttttctttgcaatggctttgattggagctaagactaaaaaagatttatcaggtatgcgtaaagcgttaatggctgctttaattgggattttaattgcaagtcttgttaatttatttatcggtagtgggggtatgagttatatcattagtatcgtatgtgtcatcatcttttctggattgattgcttacgataaccaaatgattaaatatgtctacaatagccaaggcggccaagtcgcagatggttgggcagtttcgatggcactaagcctttatcttgattttattaatctattcttaaatattcttcgtctttttgcacgaaatgattga

SEQ ID NO: 58701 - protein, 229 aa, Streptococcus agalactiae 2603V/R
MNDNVIYTQSDSGLNQFFAKIYGLVGIGVGLSAAVSAIMLYMFPQNMIAIMQKMPGLYFGAIILELVLVFVASGAARRNTPAALPLFLIYSALNGFTLSFIIARYTQTTVLQAFITSAAVFFAMALIGAKTKKDLSGMRKALMAALIGILIASLVNLFIGSGGMSYIISIVCVIIFSGLIAYDNQMIKYVYNSQGGQVADGWAVSMALSLYLDFINLFLNILRLFARND

SEQ ID NO: 58702 - DNA, 900 bp, Bifidobacterium longum NCC2705
  CDS (1)..(900)
atgacattcggtcagcagccccagaacaacgggcaatacaacccgcaatacaacacgcctgattacaacgccgcccaacagtctggatatggccagcaatacgcacagtccggttacggccagaactactatgcccagccgcagggcgctcccacctaccaatacgtgccgcagggtactggtgccggtgcgggtgcggccaccatcaacacgacgatgacctacaactatgaggaagcccgccgagtctcagtgaccaaggtgtacggcgagatgaccatcggcatcctcgtcaccgccgtggtcgccgtgctcggccagatcactggagcctactacagcttcctcatggccaccggcatggtgggcctcatcggcctgtgcgtggtgcagattgccctggccgtggtgctcggcatgcgcgtcaccaagatgaagtcggccaccgcgcgcgtcatgttctatgtgtacgccgcattgatgggcttcaccttgagctcgatcttcatggtctacgacctcggctcgatcggcgtggcactcggtgtcaccgccgcgttcttctttgcgctgaccatgttcggcatgactaccaagttcaacatgctcaaggccggcccgatcctgatgatcggcctgattgtgctcatcatctcgcagatcgtgctcgccttcgtgcaggtcgacggcatgaccaagatcgtctgcgccatcggcctgatcctgttcgccggcatgaccatctacgacgcgcagtccacgcgcgcgctgctgaccgaatacgaggcccagggcccggaaatggtcaagaagatctccatcctgtgcgccctgaacctgtacctcgacttcgtgaacatgttcctgtacatcctgcagctgctcggcaacagggactag

SEQ ID NO: 58703 - protein, 299 aa, Bifidobacterium longum NCC2705
MTFGQQPQNNGQYNPQYNTPDYNAAQQSGYGQQYAQSGYGQNYYAQPQGAPTYQYVPQGTGAGAGAATINTTMTYNYEEARRVSVTKVYGEMTIGILVTAVVAVLGQITGAYYSFLMATGMVGLIGLCVVQIALAVVLGMRVTKMKSATARVMFYVYAALMGFTLSSIFMVYDLGSIGVALGVTAAFFFALTMFGMTTKFNMLKAGPILMIGLIVLIISQIVLAFVQVDGMTKIVCAIGLILFAGMTIYDAQSTRALLTEYEAQGPEMVKKISILCALNLYLDFVNMFLYILQLLGNRD

SEQ ID NO: 58704 - DNA, 738 bp, Brucella suis 1330
  CDS (1)..(738)
atggctgactttcgtaatattcaggcgcagcaaaggccggtaggcggcgctcgcgccgatgcaggcatcgatcagggcctgcgcagctatatgctgggcgtttataacatgatggcaatcggcctggccgttaccggccttgccgcattcggcaccgccgtgctcgcccagtccaacccggctttccagcagcttctttttgcaagcccgctgcgctgggtcattatgctcgctccgctggcggcagtgtttttcctgagcttccgtatccagagcctttccgtcggcacggcacaggcgatcttctggggttatgcggcgctcgtgggcctgtcgctttcgtcgatcttcatcgtcttcacgggccagagcatcgtgcgcaccttcttcgtgacggctgcgtccttcggcgcgctctcgctctatggctacacgaccaagcgtaacctgtccgccatgggctcgttcctgatgatggggcttttcggccttatccttgcttcggtggtcaatattttccttggctccaccgcattgcagtttgcaatctcggtgattggcgtcctgatctttgcaggcctcaccgcctacgatacgcaggaaatcaaggaaatgtactatgaaggcgacgctgccgacacgcagggccgcaagatcgtgatgggcgcgctgcgtctttatctcgacttcatcaacatgttcatgttcctgctccagttcatgggcaaccgtgaataa

SEQ ID NO: 58705 - protein, 245 aa, Brucella suis 1330
MADFRNIQAQQRPVGGARADAGIDQGLRSYMLGVYNMMAIGLAVTGLAAFGTAVLAQSNPAFQQLLFASPLRWVIMLAPLAAVFFLSFRIQSLSVGTAQAIFWGYAALVGLSLSSIFIVFTGQSIVRTFFVTAASFGALSLYGYTTKRNLSAMGSFLMMGLFGLILASVVNIFLGSTALQFAISVIGVLIFAGLTAYDTQEIKEMYYEGDAADTQGRKIVMGALRLYLDFINMFMFLLQFMGNRE

SEQ ID NO: 58706 - DNA, 870 bp, Plasmodium falciparum 3D7
  CDS (1)..(870)
atggctgatacaaatggaagaaatagtatcgtagggcagaattatggagctgcttataaccaaggaggatataattattcacaaaataaagacaaagaaaattatgacaaatcaaacagtggacagaaaggatattattatgatgccagaacaaatataacagcaaatggtggattgtatgatgaattttcacttaacgaattttcatcaacaaaaataagacatggatttataagaaaagtatattccatattatctcttcaattattattaacatttggatgtgcagcattagcagtattatataaaccatttaatgcttttgttcttacctattattctcctttatttatagttggtgttttattaagtttgcctattatgatagctttagcttgtgcacctcatatggcaagaaaatatccaagtaattattttattttattatccataactttaggtatgtcattaattgtcacattagcaagcgcaagaacaaactcagaaatatttttttatgcctttggtacaacggcggttgttgttattggtcttaccatctttgctttccaaaccaaatgggattttacagggtggtatgtattcttatttatggcctttttaatcttaatagttatgggaattatcggaatatttgttagaagtaaagccttcaatctagtctttgcaggcataagcgcattcatattatctatctccattattgtagacacacaacttatcataggaggaaaacacaaaaaatatgaattctcggttgatgattatatttttgctactttagctttatacatggacattattaatttattcctttctattttgtccatattctcaaacgcagaatga

SEQ ID NO: 58707 - protein, 289 aa, Plasmodium falciparum 3D7
MADTNGRNSIVGQNYGAAYNQGGYNYSQNKDKENYDKSNSGQKGYYYDARTNITANGGLYDEFSLNEFSSTKIRHGFIRKVYSILSLQLLLTFGCAALAVLYKPFNAFVLTYYSPLFIVGVLLSLPIMIALACAPHMARKYPSNYFILLSITLGMSLIVTLASARTNSEIFFYAFGTTAVVVIGLTIFAFQTKWDFTGWYVFLFMAFLILIVMGIIGIFVRSKAFNLVFAGISAFILSISIIVDTQLIIGGKHKKYEFSVDDYIFATLALYMDIINLFLSILSIFSNAE

SEQ ID NO: 58708 - DNA, 705 bp, Shigella flexneri 2a str. 301
  CDS (1)..(705)
atggacagattcccacgttctgattcaatcgtacaaccctgggctggcttgcaaacttatatggcgcaagtctatggctggatgaccgttggcttgttgctgaccgcatttgttgcctggtatgcggctaattccgcggccgtgatggagctgttgttcactaaccgtgtctttttaatcggtctgatcatcgcgcaattagcattggttattgtgttatcagcgatgattcaaaagctgagcgcaggtgtaacgacgatgctctttatgctttattcggcgctgacgggtcttacgctttccagtatattcattgtctataccgctgcttctatcgccagtactttcgtcgttactgccgggatgttcggcgcaatgagcctgtacggttacaccacgaagcgcgatttaagtggctttggcaatatgctgtttatggcgttaatcggcattgtgctggcatcgctggtcaacttctggctgaaaagcgaagcattgatgtgggcagttacctacatcggcgtgattgtctttgtcggattgacggcgtatgacactcagaaattgaaaaatatgggtgagcagattgatacccgcgacacgtcgaacctgcgcaaatattccattcttggtgcgttaaccttgtatctggacttcatcaacctgttcctgatgttgttacggatcttcggcaaccgccgttaa

SEQ ID NO: 58709 - protein, 234 aa, Shigella flexneri 2a str. 301
MDRFPRSDSIVQPWAGLQTYMAQVYGWMTVGLLLTAFVAWYAANSAAVMELLFTNRVFLIGLIIAQLALVIVLSAMIQKLSAGVTTMLFMLYSALTGLTLSSIFIVYTAASIASTFVVTAGMFGAMSLYGYTTKRDLSGFGNMLFMALIGIVLASLVNFWLKSEALMWAVTYIGVIVFVGLTAYDTQKLKNMGEQIDTRDTSNLRKYSILGALTLYLDFINLFLMLLRIFGNRR

SEQ ID NO: 58710 - DNA, 660 bp, Shewanella oneidensis MR-1
  CDS (1)..(660)
atgactcagcaaaccctgtactcaacgagtgcaacaactttagaagtgaacaaacttcttaaaaatacttatttattattggccatgaccctagccttctctgcattatgtgcaggtttagcgatggcgctcaatatcagcccgctgatgtcacttggtttatctatcggtggtttagtgctgctttttgtcacgcttcggaaagccgattcagccgcaggcattttctgggtgtttgcctttacgggcatggaaggcgcctcattaggctatatgcttaaccattacgcaggaatgacaaacggctccgagttgatcatgcaagcctttgggttaacatcggtcatttttattgctctgtcagcctatgccgtcaccaccaagaaggatttctctttcatgcgtggtttcttatttgcaggactgatagtagtgattgctgccgctattattaatatttttgtcggtaacagcgtcgcgtttatggcgattaacgcaggtctggcattgttgatgacaggctttattctgttcgatactagccgaatcgtaaatggcggtgagactaattacatccgtgcaactatctccttgtacttggactttttaaacctgttcattgccattttgcatttgcttggtattggtaacgatgattga

SEQ ID NO: 58711 - protein, 219 aa, Shewanella oneidensis MR-1
MTQQTLYSTSATTLEVNKLLKNTYLLLAMTLAFSALCAGLAMALNISPLMSLGLSIGGLVLLFVTLRKADSAAGIFWVFAFTGMEGASLGYMLNHYAGMTNGSELIMQAFGLTSVIFIALSAYAVTTKKDFSFMRGFLFAGLIVVIAAAIINIFVGNSVAFMAINAGLALLMTGFILFDTSRIVNGGETNYIRATISLYLDFLNLFIAILHLLGIGNDD

SEQ ID NO: 58712 - DNA, 825 bp, Drosophila melanogaster
  CDS (1)..(825)
atggattcacctaaaaaagaaacaggattcctcgataaggcttcactgtacgcccctcctacggaaaacgagtcccaggacacgaattccgatccaaaagatggcgaacacttggtcgaaaatgggatgatttcccatgatttgattgttaaaagtaatgtattcgaggatcccactatacgcatgggattcgtccgcaaggtttttggaatccttttggcccaattactgttcacgttggctgtgatagcaatattttcttaccaccaacccaccaaggacttcatgcatgagaacttccttctagttcttgtcgccatgatcgttaacattatcgttttgagcacaatcgtttgtgtggagaacgtgcgacgaaggcatcctgttaacctgatttgcctcgctctttataccttcaccatgtcgctgctcctggggaccgcatccagccaaatggattccaatgtggtaatctcggccgtggccattaccacacttctagtcatcgcactttccatctacgccgtgcaaaccaaatacgattacacagctgctggaggggtcatattgacctttgtgataatactcatagttctatcagtgtgtggtgtttggatgcccgatttcgtagacagcctgccaataacttgcctatgcacctttattggctgtttttttttaatcgccgatatgcagtcgatagtgggcggcaatcgttcggaacagttggatcccgaggaatatgtattcgcggctctcactctgtacgtcgatgtggttcgcatattcatttacatccttcgaattttggaaaaattttattag

SEQ ID NO: 58713 - protein, 274 aa, Drosophila melanogaster
MDSPKKETGFLDKASLYAPPTENESQDTNSDPKDGEHLVENGMISHDLIVKSNVFEDPTIRMGFVRKVFGILLAQLLFTLAVIAIFSYHQPTKDFMHENFLLVLVAMIVNIIVLSTIVCVENVRRRHPVNLICLALYTFTMSLLLGTASSQMDSNVVISAVAITTLLVIALSIYAVQTKYDYTAAGGVILTFVIILIVLSVCGVWMPDFVDSLPITCLCTFIGCFFLIADMQSIVGGNRSEQLDPEEYVFAALTLYVDVVRIFIYILRILEKFY

SEQ ID NO: 58714 - DNA, 714 bp, Drosophila melanogaster
  CDS (1)..(714)
atggcagatactgcgaattacatcaacgaccgtttccagaccttcatgaacgggctcggtgaccgttatgagccctatgtgcgcgagcacctgtctaaggtttacatggtcctgggcagcactgccgctgccacggccatgggagccatgcttcagatgcgtgactttctcgatcttggagtcctggcggcggtggccactctagtcctggtcttgggtctgcacttctacaaggatgacggcaagaactattatacacgtttgggcatgctctacgccttcggattctgctccggccagacgctcggaccgctcctcggctatatatgcagcataaatccggcaataatcctgtctgcccttacgggcaccttcgtcaccttcatctcgctctccttgtccgcccttctggccgagcagggcaagtacctctatctgggtgggatgctggttagcgtcatcaacaccatggcgctgctgagtctctttaacatggtcttcaagtcctacttcgtgcaagtgactcaactttacgtcggcgttttcgttatggctgccttcatcgtctacgatacacagaacattgtggagaagtgccgaaacggaaatcgagatgtggtgcagcacgctttagatttgttcttcgatgtactcagcatgttccgccgtttgctgattatactgacgcaaaagctcaagaccttcatggtttaa

SEQ ID NO: 58715 - protein, 237 aa, Drosophila melanogaster
MADTANYINDRFQTFMNGLGDRYEPYVREHLSKVYMVLGSTAAATAMGAMLQMRDFLDLGVLAAVATLVLVLGLHFYKDDGKNYYTRLGMLYAFGFCSGQTLGPLLGYICSINPAIILSALTGTFVTFISLSLSALLAEQGKYLYLGGMLVSVINTMALLSLFNMVFKSYFVQVTQLYVGVFVMAAFIVYDTQNIVEKCRNGNRDVVQHALDLFFDVLSMFRRLLIILTQKLKTFMV

SEQ ID NO: 58716 - DNA, 672 bp, Pseudomonas putida KT2440
  CDS (1)..(672)
atgcgcgaacaggattacgccgtccaccacggccagcaggtcgagcagcaggagatcagcaaggtcctgcgcaacacgtacagcctgctggcgcttaccctcgccttcagcggtgtcatggctttcgttgcccagcagatgcgcgtcggctacccgaacgtgttcgtggtgctaatcggcttctacgggctgttcttccttaccaacaaactgcgtgattcggcctggggcctggtgtccaccttcgcgctcaccggtttcatgggcttcatcctcggcccgatcctcaaccgttacctgggcatggccggtggcgccgaggtagtgagctccgcgtttgccatgactgcgctggtgtttggtggtctgtcggcctacgtgctgatcacccgcaaggacatgagcttcctgagtggcttcatcactgcgggcttcttcgttctgctgggtgctgtcgttgccagcttcttcttccagatcagcggcctgcaactggctatcagcgctggcttcgtgctgttctcgtcggtctgcatcctgttccagaccagcgcgatcattcatggtggcgaacgtaactacatcatggcaaccatcagcctgtatgtgtcgatctacaacctgtttgtcagcctgctgcaattgtttggcatcatgggtcgtgacgactga

SEQ ID NO: 58717 - protein, 223 aa, Pseudomonas putida KT2440
MREQDYAVHHGQQVEQQEISKVLRNTYSLLALTLAFSGVMAFVAQQMRVGYPNVFVVLIGFYGLFFLTNKLRDSAWGLVSTFALTGFMGFILGPILNRYLGMAGGAEVVSSAFAMTALVFGGLSAYVLITRKDMSFLSGFITAGFFVLLGAVVASFFFQISGLQLAISAGFVLFSSVCILFQTSAIIHGGERNYIMATISLYVSIYNLFVSLLQLFGIMGRDD

SEQ ID NO: 58718 - DNA, 663 bp, Vibrio vulnificus CMCP6
  CDS (1)..(663)
atgaacagtcctatgtttacccgtacttctacacaagaaagtgctctacagacaaacaaagtactacgtaacacttacgccctactttctatgactttactttggtcagctatcgttgctggtgtcgctatggtgatgaacctccctcaccccggtataatcattacattagttggcttctatggcctactattcctaacagagaagaaccgcaacaacggtcttggccttgtattcacattcgcactaaccggttttatgggttatacacttggaccaatcctaaacgcttatgtgggcgcaggaatgggtgatcttatcgtaacagcactaggcggtaccgctctttcattcttagcggcatcagcttacgcactgacaactaagcgcgacctatctatgatgggcggtttgatgctttcactatttgtagttttgattgttggtatgatcgcaagcatcttcattcagtcaacagtacttcacctagccttaagcagcttgttcattgttttctctacaatggcaatcttaatgaccactcaaagcattgttcgtggtggtgaaacaaactacatttcagcaactgtgactctatacgtatcaatttacaatatcttcgtcagcctacttcaaatcctcggcattatgaacgacgactaa

SEQ ID NO: 58719 - protein, 220 aa, Vibrio vulnificus CMCP6
MNSPMFTRTSTQESALQTNKVLRNTYALLSMTLLWSAIVAGVAMVMNLPHPGIIITLVGFYGLLFLTEKNRNNGLGLVFTFALTGFMGYTLGPILNAYVGAGMGDLIVTALGGTALSFLAASAYALTTKRDLSMMGGLMLSLFVVLIVGMIASIFIQSTVLHLALSSLFIVFSTMAILMTTQSIVRGGETNYISATVTLYVSIYNIFVSLLQILGIMNDD

SEQ ID NO: 58720 - DNA, 837 bp, Bradyrhizobium japonicum USDA 110
  CDS (1)..(837)
atggcgaccctcatgccggaccggccaaccaacgggaattcgaccatgtcggacctagaccgtaactacgcttctcctttcggcagggccgccgggcgtgttgacgccgcgacggtcgatgccggcctgcgcgcctacatgctgcgcatatacaactacatgagcattggcctcgccatcacgggccttgccgcactcggcgtctacatggccgccgtgaccgacgttccgaccccggaagccgtccgcgtcggcaagctgttcctgacgccgttcggctatgcgatgttcgtcagccccctgaagtggctgttcatgctcgcgccgctcgccatggtgttcgtgatctccgctggcatcaaccgtctggcgccctcgaccgcccagatcctgttctgggtgttctcggcgctgatgggcatctcgctgtcgtcgatcttcctggtgttcacgcacacctcgatcgtgcgggtgttcttcatcaccgcggcgaccttcggtgcgctcagcctctacggctacaccaccaagcgtgacctgaccgggatgggctcgttcctgttcatgggcctgatcggcatcatcatcgcgagcttggtgaacctgttcctggcgagctcgatgctgcagttcatcgtgtccgtggtcggcgtgctggtgttcgcgggcctcaccgcctgggatacccagcggctgaagaacgactacatctacggctacgctgcggccggcggtgacatcgcagagcgtgcggccatcaccggcgcgctgtcgctgtacctgaacttcatcaacctgttcacgctgctcctgcagctcctcggccagcgcgattaa

SEQ ID NO: 58721 - protein, 278 aa, Bradyrhizobium japonicum USDA 110
MATLMPDRPTNGNSTMSDLDRNYASPFGRAAGRVDAATVDAGLRAYMLRIYNYMSIGLAITGLAALGVYMAAVTDVPTPEAVRVGKLFLTPFGYAMFVSPLKWLFMLAPLAMVFVISAGINRLAPSTAQILFWVFSALMGISLSSIFLVFTHTSIVRVFFITAATFGALSLYGYTTKRDLTGMGSFLFMGLIGIIIASLVNLFLASSMLQFIVSVVGVLVFAGLTAWDTQRLKNDYIYGYAAAGGDIAERAAITGALSLYLNFINLFTLLLQLLGQRD

SEQ ID NO: 58722 - DNA, 699 bp, Bradyrhizobium japonicum USDA 110
  CDS (1)..(699)
atgtcaaactacgatcagaacctggcgacctctgacgcaatcgcggtggacgctggattgcgcggttacatgctgcgcatctacaactacatggccgccggcgtcggcctgaccgccgttgtggcctggctgacctatcagctcaccggtcccgcattgctgcagagtccgttgatgtgggtcttcatactggcgccgctcgcgctggtctttttcatcagcgcgcgcatcaatacgctgtcggcggcgacggcgcggcttctgttcttcatctatgccgcgctggtcggggtctcgctctcgatactgctgcatatctacaccagcgcctcgatcacgcgcgtgtttttcatcgcggccgcgatgttcggagcgctcagcgtattcggctacaccacaaggcgtgacctgtccggtctcggcactttcctgttcatgggcctgatcggggtcatcattgccagcctggtgaacctcttcctgcaatcaagcgggctcgactggttgatctcggtcgtgggtgtcggcgtctttgcggggctcacggcctacgacacccagcggatcaaggcgatgtacgacagcggggacgatgaaacgtcggctggccgcaagtcggtgatttcagcgctgtcgctctatctcaacttcatcaacctgttcatgatgctgctgcgtctggccggcagccggcgctga

SEQ ID NO: 58723 - protein, 232 aa, Bradyrhizobium japonicum USDA 110
MSNYDQNLATSDAIAVDAGLRGYMLRIYNYMAAGVGLTAVVAWLTYQLTGPALLQSPLMWVFILAPLALVFFISARINTLSAATARLLFFIYAALVGVSLSILLHIYTSASITRVFFIAAAMFGALSVFGYTTRRDLSGLGTFLFMGLIGVIIASLVNLFLQSSGLDWLISVVGVGVFAGLTAYDTQRIKAMYDSGDDETSAGRKSVISALSLYLNFINLFMMLLRLAGSRR

SEQ ID NO: 58724 - DNA, 690 bp, Streptococcus pyogenes SSI-1
  CDS (1)..(690)
atgaacgatcacgttatttatacacaatcagatgtgggattaaatcagttttttgctaaaatttatagtctagtgggaatgggagtgggtttgtctgcttttgtttcttatttgatgctttatccatttagagaaaatttaatctctatccttgttaatcagccgatgatttactatggtgctgcgattattgaacttattttagtttttgtagcaagtggtgcagcacgaaaaaacacaccagctgcattgcccatttttcttatctatgctgcgctaaatggctttaccctaagctttattattgtggcatacgctcaaacgacagtttttcaagcatttctttcttcagcagctgtgttttttgccatgtcaatcattggtgtcaagactaaacgggatatgtcaggtcttagaaaggctatgtttgctgctttgattggtgttgttgtggctagtctgattaatctttttattggtagtgggatgatgagttatgtcattagtgtgatttccgtgctaattttctcaggtctcatcgcatcggataatcaaatgattaagcgcgtttatcaagcaacaaatggccaggttggtgatggctgggctgttgctatggccttaagcttgtatttagattttattaacttatttatcagccttcttcgtatttttggaagaaatgattaa

SEQ ID NO: 58725 - protein, 229 aa, Streptococcus pyogenes SSI-1
MNDHVIYTQSDVGLNQFFAKIYSLVGMGVGLSAFVSYLMLYPFRENLISILVNQPMIYYGAAIIELILVFVASGAARKNTPAALPIFLIYAALNGFTLSFIIVAYAQTTVFQAFLSSAAVFFAMSIIGVKTKRDMSGLRKAMFAALIGVVVASLINLFIGSGMMSYVISVISVLIFSGLIASDNQMIKRVYQATNGQVGDGWAVAMALSLYLDFINLFISLLRIFGRND

SEQ ID NO: 58726 - DNA, 687 bp, Enterococcus faecalis V583
  CDS (1)..(687)
atgaataatcaagagtatatccaaactggcacaggtttgaataaattttatgccaaaatttacggatttttagcgttaggaattggtattagcgcaatcatggcttatgcaatgacaactgtctttttacctgttctagctactttattccaatcaagcttagctttttggatgatttggcttgttgaaattggcttagttttatatctaggcgcaaaagcacagaaaaatccaaccattgcgattgcaggatttgttgcgtatgcattattaaatggtgtcactttatccgtgacgttattaatgtatactggtggaacagtggccggcgcatttttaagtgcagcagctacctttggcgcgatgtcattagtaggtgtctttacgaagaaagacctatcagcagttggtcatgccgcttatagtgccttaatcggaatcatcattgcgatgttgctaaatatgttccttttacacagtaatgctgtagaattctttatttccattttaatggtcctaattttctcagggattactgcttatgataaccaacgtatacgccaagtctatgcgcaaacaggtgatcaagcaggtactgggatggccgttttcttcgcattacaattataccttgacttcatcaacttattcttagctttcttaagaatttttggtaaaaacaactaa

SEQ ID NO: 58727 - protein, 228 aa, Enterococcus faecalis V583
MNNQEYIQTGTGLNKFYAKIYGFLALGIGISAIMAYAMTTVFLPVLATLFQSSLAFWMIWLVEIGLVLYLGAKAQKNPTIAIAGFVAYALLNGVTLSVTLLMYTGGTVAGAFLSAAATFGAMSLVGVFTKKDLSAVGHAAYSALIGIIIAMLLNMFLLHSNAVEFFISILMVLIFSGITAYDNQRIRQVYAQTGDQAGTGMAVFFALQLYLDFINLFLAFLRIFGKNN

SEQ ID NO: 58728 - DNA, 720 bp, Coxiella burnetii RSA 493
  CDS (1)..(720)
atgcgtaatttatcaaatgcctatcagccgagacgatccggcgttcaaagccttacagttgctcagttcatgagtaaggtgtacttatggatggtcctgggtttagcgctttcagcaggcacagggtattatattttttctcatagctatctttttaataaaatcgttcacacgccagggctctttttcggcttgattatcgcgcaatttgcggcggttattggactgacgtggttaaatcagcggttaacggctacgttagcggcgttgatttacgtgctttatacggtattgacgggagtcaccctaagcgtcgttttatacgcttataccaaacaaaacgtcttcgatgcgctggccgtcaccagcgttgctttcttggggttgagcgcctttgggtatgtaacgaaacgtgatttggggcccatcggaacgttttgcatcatgggtctgtttggaatgattgggatgatgctccttgcttttttcatccccggattacgttccgataccatgcagctcaccatctcggccattggtgtattggttttctcaggcttaaccgcttacgacacccaacgtattaaactttcttaccttcaatcgggcggctggggtgaaggccaacaattaaaagcggctgtcaatggcgctttaatgttgtatttggatttcatcaacttatttcttagcttgctgcgacttttttcgcgacgataa

SEQ ID NO: 58729 - protein, 239 aa, Coxiella burnetii RSA 493
MRNLSNAYQPRRSGVQSLTVAQFMSKVYLWMVLGLALSAGTGYYIFSHSYLFNKIVHTPGLFFGLIIAQFAAVIGLTWLNQRLTATLAALIYVLYTVLTGVTLSVVLYAYTKQNVFDALAVTSVAFLGLSAFGYVTKRDLGPIGTFCIMGLFGMIGMMLLAFFIPGLRSDTMQLTISAIGVLVFSGLTAYDTQRIKLSYLQSGGWGEGQQLKAAVNGALMLYLDFINLFLSLLRLFSRR

SEQ ID NO: 58730 - DNA, 696 bp, Nitrosomonas europaea ATCC 19718
  CDS (1)..(696)
atgcaatttaaccccaaatatgcaactcctgtatcaaacaccgttaattcgggcgtacgcaacaaagtattgaaaaatacttacctgatgcttagtttaaccatgattccgactatagtcgggtcagtcattggcaccggtaccaatttctcattcctggcacaatccccaattgtgggttcactcgtaatgctggcggtaatgataggtttaatgtttgccgtcagcgctacacgcaacagtatgtggggaatcattctgcttttcctgtttacctttgttgccggctggtggttaggtcccttgcttcagtacgcactccatttcaaaaatggctcacaactgattggcctggctgctgcaggaacaggtatcatttttttcacgcttgccggtatagccacaaccacacgtaaagactttagttttcttggcaattttttgctggctgggataattctggtaattttggcttctctggtcaatttgttcctggccattccggcaatttcactggcaatttctgccgtagcagtattggttttctccggattcatcctgtttgatgtgaaccgtatcgtaaatggcggtgaaaccaattacgtcatggcaacattgggtatttatctcagcctgtataatttgttcatcagcctgatacagttgctgctggcctttttaggtgaaaaagactga

SEQ ID NO: 58731 - protein, 231 aa, Nitrosomonas europaea ATCC 19718
MQFNPKYATPVSNTVNSGVRNKVLKNTYLMLSLTMIPTIVGSVIGTGTNFSFLAQSPIVGSLVMLAVMIGLMFAVSATRNSMWGIILLFLFTFVAGWWLGPLLQYALHFKNGSQLIGLAAAGTGIIFFTLAGIATTTRKDFSFLGNFLLAGIILVILASLVNLFLAIPAISLAISAVAVLVFSGFILFDVNRIVNGGETNYVMATLGIYLSLYNLFISLIQLLLAFLGEKD

SEQ ID NO: 58732 - DNA, 693 bp, Helicobacter hepaticus ATCC 51449
  CDS (1)..(693)
atgggactttatgataggaattacactaacaacgcgcagtttgcaaatgaagcagtagcagagcgtgatagtgcattagtgaattttgtgaagacgacttacaaattttttggtgcaagtttattctttgctttcatcggtgcgatgattggttttatgtatttagaatttgtagtagaatatcgcttttttatttttattgctgaaattgcagcactttttggggttatgttttctcgttctaaaccgggcttaaatattgcaatgctttttatttttacgacactcacaggtgtaacaatcacacctcttgtggctatggtagcatttaaagctggtgctggtgcggttgcaatggcatttgctatgacaacaattatttttggtgttatgagcatttttggtattaaaactacaaaagatttagctaatatgggcaaaatgctttttattgctcttattgttgtagttgtatgctcaattataaatctctttcttggaagctctatgtttcaagtattgatttcaagtgcagcagctatactttttagtttgtatgtagcgtatgatacgcaaaatattgtgcgtggtttatatactagcccagtagatgcagctattaacctttatttggatttttataatatttttgtgagcttactttcgctcattggcttagcaaatcgcgactaa

SEQ ID NO: 58733 - protein, 230 aa, Helicobacter hepaticus ATCC 51449
MGLYDRNYTNNAQFANEAVAERDSALVNFVKTTYKFFGASLFFAFIGAMIGFMYLEFVVEYRFFIFIAEIAALFGVMFSRSKPGLNIAMLFIFTTLTGVTITPLVAMVAFKAGAGAVAMAFAMTTIIFGVMSIFGIKTTKDLANMGKMLFIALIVVVVCSIINLFLGSSMFQVLISSAAAILFSLYVAYDTQNIVRGLYTSPVDAAINLYLDFYNIFVSLLSLIGLANRD

SEQ ID NO: 58734 - DNA, 660 bp, Wigglesworthia glossinidia endosymbiont of Glossina brevipalpis
  CDS (1)..(660)
atgaatagaatcatagaaatttcttcaaaaagtagatcaaatttatctacaaataaagtattaagaaatacatacttgcttttatccatgacagtagcattttctgcgattgtagctacaattagtagcatttttaactttacttatttaggagccattccaactttaattggattttatggattgttgtttttagtacatcgtttatctaataaaaaatctggaattatagcaatttttctacttactggattcatgggatatactatatctcctttaattaatatgagtataaattacaacagcgggaatagcataattttatctttgataggaactactgttatatttttttcttgtgcattatttacattaaaaagcaaaagagatttatcttttttgtctagcattttaatttcaggaagcattgctttgtttatttgtatgattggaaatatttttttaaatattccatctttatcgttagcaattagcatcatgtttatgattttttcttcagttgcaataatatgggaaataaacaatattattcgtggaggagaacaaaattatataagagccactgttagcttatatgtatctatatacaatatttttgcaagttttcttggaatatttggaggatcaaaaaataattaa

SEQ ID NO: 58735 - protein, 219 aa, Wigglesworthia glossinidia endosymbiont of Glossina brevipalpis
MNRIIEISSKSRSNLSTNKVLRNTYLLLSMTVAFSAIVATISSIFNFTYLGAIPTLIGFYGLLFLVHRLSNKKSGIIAIFLLTGFMGYTISPLINMSINYNSGNSIILSLIGTTVIFFSCALFTLKSKRDLSFLSSILISGSIALFICMIGNIFLNIPSLSLAISIMFMIFSSVAIIWEINNIIRGGEQNYIRATVSLYVSIYNIFASFLGIFGGSKNN

SEQ ID NO: 58736 - DNA, 711 bp, Candidatus Blochmannia floridanus
  CDS (1)..(711)
atggatagatttccccgttttcagggtacattatccgatcgagataacactataatacagccgtatatatcacaagtgttcgggtggatgtcttgtggattattgttaactgcttttgttgcttggtatacgtctataacgcctgctgttttgcaactattattttcaaatcaaattattttttttggtttaattattagccagttagcattggtatttactttatctggtatggtaacccgattaagtggatcattggcaactactttatttatgttatattcagtgttaaccggtttgactttgtctagtatatttatattatatacctcttcttctatatctggaacatttattgtaacatctggtatgtttggagctatgactgtatacggatatactacaaaaaaagatttaagtagcttgggaaacttgttatttatggggttaattggaatggtattagcttcattggttaatatatggttgaaaaatccaacgataatgtggattattacttatattggagttattttatttgttggattaactgcatatgatatgcaaaaaataaaatctattggatcatcattatctatagaagatcaagatcagtttcgtaagtattcaataataggagcgcttactttatatttagattttattaatttatttatgatgatgattcgtatttttggaaataaacgttaa

SEQ ID NO: 58737 - protein, 236 aa, Candidatus Blochmannia floridanus
MDRFPRFQGTLSDRDNTIIQPYISQVFGWMSCGLLLTAFVAWYTSITPAVLQLLFSNQIIFFGLIISQLALVFTLSGMVTRLSGSLATTLFMLYSVLTGLTLSSIFILYTSSSISGTFIVTSGMFGAMTVYGYTTKKDLSSLGNLLFMGLIGMVLASLVNIWLKNPTIMWIITYIGVILFVGLTAYDMQKIKSIGSSLSIEDQDQFRKYSIIGALTLYLDFINLFMMMIRIFGNKR

SEQ ID NO: 58738 - DNA, 711 bp, Bordetella bronchiseptica RB50
  CDS (1)..(711)
atgaacgaaacccgtccgtccccctttaaccgctccggcgcgtatgccggcgccccgggcgaagtcgtccggaacaaggtgctgcgcaatacgtactggctgctcgcgctgtccctggtgccaacggttctgggcgccgcggtcggcctgtacaccggcatcaaccaggtcatgggcgccagccccggcctgagcgccatcgtattcctggtgggcgccttcggcctgatgttcgccatcgagaagaacaagaacaactcgctgggcgtggtcctgctgctggccttcacgttcttcatgggcgtgatgctgtcgcgcctgctggggttcgtgctcggcatgggcaatggcgcccagctggtcatgaccgcattcggcggcaccgccatcgtgttcgggaccatggccacgctggccaccaccatcaagcgtgacctctcgggcatgcagaagtggctgttcaccggcgcggtggtcatcctggtggcggcgctggccaacatcttcctgcagatgccggcgctgatgctgaccatctccgtgctggccatcgtcattttctcggccttcatgctggtggacctgcagcgcgtgatcaacggcggcgaaaccaactatgtgtcggcgaccctggccatctatctggacgtgtacaacgtcttctccaatctgctgatgctgttgggaatctttggcggcgaccgcgaataa

SEQ ID NO: 58739 - protein, 236 aa, Bordetella bronchiseptica RB50
MNETRPSPFNRSGAYAGAPGEVVRNKVLRNTYWLLALSLVPTVLGAAVGLYTGINQVMGASPGLSAIVFLVGAFGLMFAIEKNKNNSLGVVLLLAFTFFMGVMLSRLLGFVLGMGNGAQLVMTAFGGTAIVFGTMATLATTIKRDLSGMQKWLFTGAVVILVAALANIFLQMPALMLTISVLAIVIFSAFMLVDLQRVINGGETNYVSATLAIYLDVYNVFSNLLMLLGIFGGDRE

SEQ ID NO: 58740 - DNA, 690 bp, Chromobacterium violaceum ATCC 12472
  CDS (1)..(690)
atgcacccggattttcaaacggcctaccaatcgaccccgatggccgatgttcgcaacaaggtgttgcgcaacacctacggcttgctgggcctgtcgatgattccgaccgtgatgggcgccatcgtgggcacccacatgagtttcgccttcctggccggcagccccatcatcggcatgctgctgatcatggcggtgttctacggcctggtattcgcgatcgagaagaaccgctacagctcgctgggcgtgttcctgatgctgggcttcaccttcatgatgggcgtgctgctcggacccttgctgcaattcgcgctcaagttctccaacggcggccagctgatcatgaccgccggcgcggccacctccgcggtgttcttcgtgatggccggcatcgccaccaccaccaagcgcgacctgtccggcctgggcaacttcctgaccgtgggcgccatcgtgctgatggtggccgtggtggccaacctgttcctgcgcatgccgggcttccaactgatgatcgccgcggccttcgcgctgttcagctcgctgatgatcctgtggcaggtcaagaccgtggtcgacggcggcgagaacagctacatttccgccgcgctgtccatttacatcagcatctacaacctgttcaccagcttgctgcagctgctgctggccttcgccggcaaccgcgactga

SEQ ID NO: 58741 - protein, 229 aa, Chromobacterium violaceum ATCC 12472
MHPDFQTAYQSTPMADVRNKVLRNTYGLLGLSMIPTVMGAIVGTHMSFAFLAGSPIIGMLLIMAVFYGLVFAIEKNRYSSLGVFLMLGFTFMMGVLLGPLLQFALKFSNGGQLIMTAGAATSAVFFVMAGIATTTKRDLSGLGNFLTVGAIVLMVAVVANLFLRMPGFQLMIAAAFALFSSLMILWQVKTVVDGGENSYISAALSIYISIYNLFTSLLQLLLAFAGNRD

SEQ ID NO: 58742 - DNA, 717 bp, Wolinella succinogenes DSM 1740
  CDS (1)..(717)
atgtcgctttatgacagaaactacctaaatagctccgctcaagatcaaggcgcctttggaggcgctagagagagcttgagcgagagtgcgttagtaggttttgtgaaacagacctaccagctcttcgctggctcgttgttggccgcgaccgttggagcctatgtcggactcggcatggctcctgtgatagcctcttggtattggggcttggtgatcttggagtttgctcttctttttgggatgttcttccttaaagacaagcctggcatcaacctagtggtgcttttcgccttcacgttcatgacaggcctaacgctcactcctcttctctccagaattttcaatatgcctggaggcgcgagtattgtggccaatgccttcttgctcaccacggcgatttttggaatcatgagcatctttgcgctcaaaaccaaaagcgatctagcgagcatgggcaaaatgctcttcatcgcccttattgtagtggtggtggcttccatcatcaatctcttccttggaagccctcttttgcaggtgatcattgcaggggcaggggcgattctctttagtctctatatcgcctatgacactcaaaacattgtccgaggtgtttatgatagtcccgttatggcggctatctcgctctatttgagcttcctgaacctcttcatctctcttcttcagcttctaggaattcttggaaactcggatgagtga

SEQ ID NO: 58743 - protein, 238 aa, Wolinella succinogenes DSM 1740
MSLYDRNYLNSSAQDQGAFGGARESLSESALVGFVKQTYQLFAGSLLAATVGAYVGLGMAPVIASWYWGLVILEFALLFGMFFLKDKPGINLVVLFAFTFMTGLTLTPLLSRIFNMPGGASIVANAFLLTTAIFGIMSIFALKTKSDLASMGKMLFIALIVVVVASIINLFLGSPLLQVIIAGAGAILFSLYIAYDTQNIVRGVYDSPVMAAISLYLSFLNLFISLLQLLGILGNSDE

SEQ ID NO: 58744 - DNA, 711 bp, Photorhabdus luminescens subsp. laumondii TTO1
  CDS (1)..(711)
atggatcgatatccacgctctaatggttcgataatccagcaagctggaaccggcctacaaacttatatggcccaggtttatggttggatgacttgtggtctgttgttaaccgcgtttgtggcttggtatgtgtcacaaaatcagaatgttgttttatatattttctcaaattcaatactattttatgggttgattattgctcagtttgggttggttttcgtcctctctggcatgattaaccgcataggagcttcgttagccacagggttgtttatgctctattcagctctgaccggcctgacgctttccagtattttcgttatctatactattggctccgttgcgagcacttttgtcgtgacggccgggatgtttggtgcgctgagtttttatggctataccaccaaacgtagcctgagtggccttggtagcttcttatttatggggctgatcggcatcattttggcttctctgattaacttatggttaaagagtgaagcgttgacgtgggcggtaacctacattggtgtcgttatttttgcgggcttaaccgcttacgacactcagaagctgaaagagatgggtgaagatttggatgtgaatgacaaagagaatttgcgtaaattttctattgttggtgcattgacgctgtatttagacttcatcaatatgttcttgatgttattgcgtatttttggcgatcgccgttaa

SEQ ID NO: 58745 - protein, 236 aa, Photorhabdus luminescens subsp. laumondii TTO1
MDRYPRSNGSIIQQAGTGLQTYMAQVYGWMTCGLLLTAFVAWYVSQNQNVVLYIFSNSILFYGLIIAQFGLVFVLSGMINRIGASLATGLFMLYSALTGLTLSSIFVIYTIGSVASTFVVTAGMFGALSFYGYTTKRSLSGLGSFLFMGLIGIILASLINLWLKSEALTWAVTYIGVVIFAGLTAYDTQKLKEMGEDLDVNDKENLRKFSIVGALTLYLDFINMFLMLLRIFGDRR

SEQ ID NO: 58746 - DNA, 669 bp, Vibrio vulnificus YJ016
  CDS (1)..(669)
atgaacagtcctatgtttacccgtacttcaagcatggaaagtactcttcaaaccaataaggtattgaaaaacacgtacttcctgctttctatgacactagtaaccagtgctattgcagcggttgcaaccatggcaatcggtatttctccaatgatggcacttgtgatgcaagttgctgctattggtattttatttttcgcactaccacgcagcattaactcatcaatgggcattgtttggacattcgtctttacgacactaatgggtggtgcacttggtccaatgctgacttactacgcttcaatcccaagcggccctactattattgctcaagctctaggtttaaccggtatggtattcctgggtctttcggcatataccatcacaagcaaaaaagatttctcttttatgcgtaacttcttaatggcaggcctgattattgtcatcgttgcagctatcatcaacatctttgttggctcaacgctaggtcagcttgttatcagtagtgtatctgcgttggttttctctggtttcatcctatttgataccagccgtatcgtccgcggtgaagaaactaactacgtaagtgcaacgatttcaatgtacctaaacattttgaacttgttcacaagcctactaagtattctcggcattatgaacgacgactaa

SEQ ID NO: 58747 - protein, 222 aa, Vibrio vulnificus YJ016
MNSPMFTRTSSMESTLQTNKVLKNTYFLLSMTLVTSAIAAVATMAIGISPMMALVMQVAAIGILFFALPRSINSSMGIVWTFVFTTLMGGALGPMLTYYASIPSGPTIIAQALGLTGMVFLGLSAYTITSKKDFSFMRNFLMAGLIIVIVAAIINIFVGSTLGQLVISSVSALVFSGFILFDTSRIVRGEETNYVSATISMYLNILNLFTSLLSILGIMNDD

SEQ ID NO: 58748 - DNA, 792 bp, Rhodopseudomonas palustris CGA009
  CDS (1)..(792)
atgtcggacttggaccgcaactacacttctcccttcggccgggccgccggacgcgtcgaaaccgcgaccgtcgatgccgggctgcgcgcctacatgctgcgcatctacaactacatgacgatcggcttggccatcaccggtctggcggctctcggcgtttatatgggcgccgtgaccaccgacgccggtgcggccgccgcgcgggtcggcaacaccatgctgacctcgttcggtgtggcgatgttcgtcagcccgctgaagtgggtgttcatcctcgcgccgcttgcgatggtgttcgtcatctctttcggcatcaaccggctgaagccggcgaccgcacagctgctgttctgggccttctcggctctgatgggcatctcgctgtcgtcgatcttcctggtgtacacccacacctcgatcgtccgggtgttcttcatcaccgccgccgcgttcggtgcgttgagcctctatggctacaccaccaagcgtgacatgaccgggatgggttcgttcctgatcatgggcctgttcggcgtcgtgatcgccagcctggtgaacctgttcgtcgcctcgtcgatgctgcagttcatcgtgtcggtggtgggcgtgctggtgttcgccggcctgaccgcctgggacacccagcgcctgaagaacgattacatctacggctacggctcgatgggcggcgacgtcgccgagcgggccgccatcaccggcgcgctgtcgctctacctgaacttcatcaacctgttcacgctgctgctccagctgctcggacagaaggaataa

SEQ ID NO: 58749 - protein, 263 aa, Rhodopseudomonas palustris CGA009
MSDLDRNYTSPFGRAAGRVETATVDAGLRAYMLRIYNYMTIGLAITGLAALGVYMGAVTTDAGAAAARVGNTMLTSFGVAMFVSPLKWVFILAPLAMVFVISFGINRLKPATAQLLFWAFSALMGISLSSIFLVYTHTSIVRVFFITAAAFGALSLYGYTTKRDMTGMGSFLIMGLFGVVIASLVNLFVASSMLQFIVSVVGVLVFAGLTAWDTQRLKNDYIYGYGSMGGDVAERAAITGALSLYLNFINLFTLLLQLLGQKE

SEQ ID NO: 58750 - DNA, 714 bp, Lactobacillus johnsonii NCC 533
  CDS (1)..(714)
atgaataacttttcacaagaaccagaacgccgtacaattgtcgacgtaactggtttaaatagattcttaagcagaatgtacggcatgatgacaattgctgttttagtatctgccttaagtgcttacttaacaatgactgtctttagaacacaagttatgaccttatttgctagcaatccagcaatgacttggattttattgctagttccacttgctttaacttttggaattagttttagagcaacgagaaatccggtagctagctttgtaatgctaatgatcatggcaattgtttatggagttgaattttcattaattgctggtgcttatactggccacagcattgcttctgcattcgtagcttcttctactgtattcattacaatggctgtaattggtaccacaactaaaaagaacttaaataatttaggatcatatgcttctgcagctttaattggattaattgttgcaatgctaatcaacatgttcttaagaaatccaatggtttcttacattttctcatttattgcagttattatctttactattttaactgcttgggatgcacaaagaatgaagcaaatctacgaaaactacagtggccaagtttctgttgacggcttagcagttgcgggtgctttggcactttacttagatttcgttaacttattcttacaattcttacagatctttggatttagcgatagaaattaa

SEQ ID NO: 58751 - protein, 237 aa, Lactobacillus johnsonii NCC 533
MNNFSQEPERRTIVDVTGLNRFLSRMYGMMTIAVLVSALSAYLTMTVFRTQVMTLFASNPAMTWILLLVPLALTFGISFRATRNPVASFVMLMIMAIVYGVEFSLIAGAYTGHSIASAFVASSTVFITMAVIGTTTKKNLNNLGSYASAALIGLIVAMLINMFLRNPMVSYIFSFIAVIIFTILTAWDAQRMKQIYENYSGQVSVDGLAVAGALALYLDFVNLFLQFLQIFGFSDRN

SEQ ID NO: 58752 - DNA, 723 bp, Wolbachia endosymbiont of Drosophila melanogaster
  CDS (1)..(723)
atgtcttatatgagaaatgaacaggatattcgctctcaaggcgtttattatagtgctgggcttagaagttacctaactaaagtatataattacatggctttagctttgggcgtcacagggcttgttgcatttttaacagtattttctggtctttttcaagtaatttattctaatcccgttctatcgcttgtggtaatgttatctccggttgcattggtgttctacatgtcttatagaattcaacacctaagtgctcagtctgccgttactatatttttctcgttctcagtgttaatggggctttccttatcttatgtttttatagtttatactgcagaaaatatagcaagggcgtttttcattacatcaatcatgtttggctctatggctttatatggcaatactacaaaaagagatcttacaagtatgggctctttcttgattatgggagtttgggggttaatcattgcgtctatagtaaatttatttcttggaagtagtcctctccactttgcaatatcgttcatatcagtaatagtctttaccttaatgactgcgtatgatgctcaaagaatcaaggacgtttattataaacataatgacggatcagaagttgctactactaaattggcaatactcggtgcaactaatctttattttgactttattaatatatttctcaatctactcaggttacttaacttgttcaacaatagggattag

SEQ ID NO: 58753 - protein, 240 aa, Wolbachia endosymbiont of Drosophila melanogaster
MSYMRNEQDIRSQGVYYSAGLRSYLTKVYNYMALALGVTGLVAFLTVFSGLFQVIYSNPVLSLVVMLSPVALVFYMSYRIQHLSAQSAVTIFFSFSVLMGLSLSYVFIVYTAENIARAFFITSIMFGSMALYGNTTKRDLTSMGSFLIMGVWGLIIASIVNLFLGSSPLHFAISFISVIVFTLMTAYDAQRIKDVYYKHNDGSEVATTKLAILGATNLYFDFINIFLNLLRLLNLFNNRD

SEQ ID NO: 58754 - DNA, 864 bp, Neurospora crassa
  CDS (1)..(864)
atgtcgggacccaagtacacgcctgctccgcaggaggaccccgatgcccacctttactacccgcagcctcctccgtcgtaccaagcaactgccgagagcagcgcagccaacgccgtccttggtgatcaggctcgccttttctctggtgctccgcgcagcagtcaggacgatgatcacgatattcccgatgacttcaagttcggtggttccgtcgccgaagccacggttgaaattcgtcaccaatttatccgcaaggtctataccattctgacggtccagctcatcgccacgggcgccgtgagtgcgctcagcttcctcagcgatggctataggaactggatccagtctcatcccgccatgatttgggtttctttcgccggcgccctcgtcttcatgctcctaaccttctggaagcgtcaatcctaccccactaacttgttgttcctctccggcttcacgctgttggaagcctacacgatctccgtgtgcgtctccttctttgattcgaccacagtgctactcgcagtcgttatcactgccggcatcttcgtcttcctcacagctttcgcctgccaaaccaagtacgacttcacctcctggatgccgtacctcggcggcgccctttggggtttgattatcacgggctttatctacgcctttctgccgcacacaagcacctcggagctggtgtatggtggtgtcgccgcgctggtgttttcggggtacattctggttgatacccagctggtaatgcgcaagtatcatgtggaggaggagattgcggcagcgattagtttgtatctggatatcctgaatctgtttctggctatcttgagaatcttgaacagccagtcggacaactag

SEQ ID NO: 58755 - protein, 287 aa, Neurospora crassa
MSGPKYTPAPQEDPDAHLYYPQPPPSYQATAESSAANAVLGDQARLFSGAPRSSQDDDHDIPDDFKFGGSVAEATVEIRHQFIRKVYTILTVQLIATGAVSALSFLSDGYRNWIQSHPAMIWVSFAGALVFMLLTFWKRQSYPTNLLFLSGFTLLEAYTISVCVSFFDSTTVLLAVVITAGIFVFLTAFACQTKYDFTSWMPYLGGALWGLIITGFIYAFLPHTSTSELVYGGVAALVFSGYILVDTQLVMRKYHVEEEIAAAISLYLDILNLFLAILRILNSQSDN

SEQ ID NO: 58756 - DNA, 849 bp, Magnaporthe grisea 70-15
  CDS (1)..(849)
atggctgcaaatgccaagtacacggctgcccccacgcaggaccccgacgaccacctcgattacacctccgctccgccgtcctaccaggcaacaggctcctccgcagcgcagccctccgatgccgagcgtcttgctagcggtgtcccgcggtcaagcgaggatgacctccccgatgacttcaagtttggcggcaacgtggccgaggccaccgtcgagattcgccaccagttcatccgcaaggtctactcgatcttgaccgtccagctgctcatcaccggcggcgtcagtgccctgggtttcatgagcacttcgtatcgggactgggtgagggcgcatcccggcgtcctctggctttctctcttcggcgccatgggcatgatgctcctgacctactggaagcgcaaatcttaccccaccaacctgctcttcctcggcggcttcacgctgctcgaggcatacaccatctccgtggtcgtgaccttttacgactcgtcgatcgtgctcaacgctgtcctcctgactgccggcatgtttgtcttcctgaccgcgttcgccttccagaccaagtacgacttcacctcgtggatgccttacctctttggcgccctctggggcctcgtactcttcggcttcgtcgccatgttcttgccctacagctccaccgccgagctcatctacggcgccctggccgccctcgtcttcagcggctacatccttgtcgacacccagctcgtcatgcgcacgcaccacgtcgaggaggagatcgcagctgccatcagcctgtacctcgacatcatcaacctgttcctcgccatccttcgtattcttaacagccagcagcagaattaa

SEQ ID NO: 58757 - protein, 282 aa, Magnaporthe grisea 70-15
MAANAKYTAAPTQDPDDHLDYTSAPPSYQATGSSAAQPSDAERLASGVPRSSEDDLPDDFKFGGNVAEATVEIRHQFIRKVYSILTVQLLITGGVSALGFMSTSYRDWVRAHPGVLWLSLFGAMGMMLLTYWKRKSYPTNLLFLGGFTLLEAYTISVVVTFYDSSIVLNAVLLTAGMFVFLTAFAFQTKYDFTSWMPYLFGALWGLVLFGFVAMFLPYSSTAELIYGALAALVFSGYILVDTQLVMRTHHVEEEIAAAISLYLDIINLFLAILRILNSQQQN

SEQ ID NO: 58758 - DNA, 831 bp, Gibberella zeae PH-1
  CDS (1)..(831)
atggcttccaagaccaagtaccagacggcgccccagagcgacccagacgacgactacacccacgcgccccccgcctatgctgagggttccgccgctcgcgatgagacacagggtctgtttggtgcgccccgcgacagcgaggacaacctccccgatgacttcaagttcggcggctctgtagctgaggctacagttgacattcgcaatcagtttgtccgcaaggtttacaccatcctcactgtccaactccttgccactgctggagtgagcagcctcacctttttcagcaccggctacaaggattggatccaaagccatcctggtgtcgtttgggcttcactctttggttctatgatctttatgggcctcacctactggaagcgcaagtcctacccaaccaaccttcttttcctctcgctcttcactcttgccgaagcctacaccatctctgttatagtgtcgttctacaagacgtccatcgtcctaaacgccgttgtcctcactgccggaatctttgtcttcctcacccttttcgcttgccagacaaagtacgactttacctcatggatgccttatcttttcggtgccctctggggtctcgtcatctttggtttcatggccatgttcttcccttacagctccactggtgagcttatctatggtggtcttgccgctctcatcttcagcggttacatcctcgtcgacacccagcttgtcttgcgccaccaccacgttgaggaggagattgccgctgccatcagcctttacctcgacatcatcaacctcttccttgccatcttgcgcattctcaacagccagtctaacaactaa

SEQ ID NO: 58759 - protein, 276 aa, Gibberella zeae PH-1
MASKTKYQTAPQSDPDDDYTHAPPAYAEGSAARDETQGLFGAPRDSEDNLPDDFKFGGSVAEATVDIRNQFVRKVYTILTVQLLATAGVSSLTFFSTGYKDWIQSHPGVVWASLFGSMIFMGLTYWKRKSYPTNLLFLSLFTLAEAYTISVIVSFYKTSIVLNAVVLTAGIFVFLTLFACQTKYDFTSWMPYLFGALWGLVIFGFMAMFFPYSSTGELIYGGLAALIFSGYILVDTQLVLRHHHVEEEIAAAISLYLDIINLFLAILRILNSQSNN

SEQ ID NO: 58760 - DNA, 822 bp, Ustilago maydis 521
  CDS (1)..(822)
atgtcaagcaacgatcctgccgcaccgccctcgtacacggcgcctgcaccaaagggctatcaagccgtacctcaacacgactctccatcttacggagcggcggaaacgagcaccactccgcgtaatgtcgacgaggaaggcgatccggacgatttcaaattcggagtcaccgttgagcaatcatcgccagagatccgcgccatgttcctgcgcaaggtttacaccgttctgttcttccagattctcggcaccaccgcgattgctgctatcatgaccactcgaggtatcgccggctgggtccagcaaaaccaatgggctttcattgtccctctcgtcggtagtctggtcaccatgggttttctctacttcaagcgtcactctcatccaaccaacatgatccttctcggactgttcaccgtcctagagtcactttcgctcggaactgtgatcacctacgtcgaccagaaaatcgtcctccaggctatgattatcaccgcttttactttcttcggcctcacgctcttcacactccagtccaaatgggactttggcagcatgggcggatggctgtttggcgcgctcatggtcttggtaggcgttggatttgtgggagtgtttttgccctacaaccagaccttcgacctcatcatggcggtcgcaggctgcgtcgtgttcagcttgtacattgtgtacgatacatggctgatccagaggaggctgagtgcggaggagtgggtactagctaacatcagcttgtacctcgatattgttaaccttttcatcaacatcttgcgtattctcaacaaccaatcgagggattga

SEQ ID NO: 58761 - protein, 273 aa, Ustilago maydis 521
MSSNDPAAPPSYTAPAPKGYQAVPQHDSPSYGAAETSTTPRNVDEEGDPDDFKFGVTVEQSSPEIRAMFLRKVYTVLFFQILGTTAIAAIMTTRGIAGWVQQNQWAFIVPLVGSLVTMGFLYFKRHSHPTNMILLGLFTVLESLSLGTVITYVDQKIVLQAMIITAFTFFGLTLFTLQSKWDFGSMGGWLFGALMVLVGVGFVGVFLPYNQTFDLIMAVAGCVVFSLYIVYDTWLIQRRLSAEEWVLANISLYLDIVNLFINILRILNNQSRD

SEQ ID NO: 58762 - DNA, 813 bp, Aspergillus nidulans FGSC A4
  CDS (1)..(813)
atggcgactaacgccagatacgagccggctcctcagcgagattcgttcgaggaccagcactacacgcaggccccgccttcttatcaggctactgcgcaagagcctacgcctcgcagcgaggacgacaacgttcctgatgactttaaatttggtggcaccgtcgcggagggcactctgcccatccgtatgcagttcatccgcaaggtctatgcgatcctcaccgtccagctgctcctaaccaccgtcatgagctccatctcattcttcagccccagttactgcgaatggatccgtagcaacgtctggctcatgatggtatccgtctttggcgctttcggattcctactcgtaacatactggaagcgcaaaagctaccccgcaaacctcctgttcctctccgcgttcaccatccttgaggcctactccatcagtgtggttacatcatattaccagcctcggatcgtggtgcaggctttgatcttgactttgggcttgtttgttggtctcacactctttgcatgccagacaaagtatgacttcaccaactggatgccatacctgttcggtgcactgtggttcctcatcctctttggatttgtggctgcctttgttcctcacggcagcaccatggaacttatctacggcagtctggcggccctgattttctcaggctacattctggttgacacccagcttatcatgcgccactaccatgttgaggaggagattgcggcttcgatttcgctctaccttgatatcctcaatctgttcttggccatcctacggattttgaataaccagaataacaactga

SEQ ID NO: 58763 - protein, 270 aa, Aspergillus nidulans FGSC A4
MATNARYEPAPQRDSFEDQHYTQAPPSYQATAQEPTPRSEDDNVPDDFKFGGTVAEGTLPIRMQFIRKVYAILTVQLLLTTVMSSISFFSPSYCEWIRSNVWLMMVSVFGAFGFLLVTYWKRKSYPANLLFLSAFTILEAYSISVVTSYYQPRIVVQALILTLGLFVGLTLFACQTKYDFTNWMPYLFGALWFLILFGFVAAFVPHGSTMELIYGSLAALIFSGYILVDTQLIMRHYHVEEEIAASISLYLDILNLFLAILRILNNQNNN

SEQ ID NO: 58764 - DNA, 555 bp, Oryza sativa (japonica cultivar-group)
  CDS (1)..(555)
atgttgactatgctcgggtgcgtggggagcatcgcctggttgttctcggtgcctgtctttgaggagaggaagaggtttgggattctcttggccgctgccctgctggaaggggcttcagttgggcctctgatcaagcttgctgtagactttgactcaagcattctcgtaacagcatttgttggaactgccattgcatttgggtgcttcacttgcgctgccatcgttgccaagcgtagggagtacctctaccttggtggtttgctctcttctggcctctccatcctgctctggctgcagtttgccgcatccatctttggccactccaccggcagcttcatgtttgaggtttactttggcctgttgatcttcctggggtacatggtgtatgacacgcaggagatcatcgagagggctcaccacggtgacatggactacatcaagcacgcactcaccctcttcactgacttcgtggccgtccttgtccggatcctcgtcatcatgctcaagaacgcgtctgacaagtcggaggagaagaagaggaagaagaggtcttga

SEQ ID NO: 58765 - protein, 184 aa, Oryza sativa (japonica cultivar-group)
MLTMLGCVGSIAWLFSVPVFEERKRFGILLAAALLEGASVGPLIKLAVDFDSSILVTAFVGTAIAFGCFTCAAIVAKRREYLYLGGLLSSGLSILLWLQFAASIFGHSTGSFMFEVYFGLLIFLGYMVYDTQEIIERAHHGDMDYIKHALTLFTDFVAVLVRILVIMLKNASDKSEEKKRKKRS

SEQ ID NO: 58766 - DNA, 690 bp, Oryza sativa (japonica cultivar-group)
  CDS (1)..(690)
atggcgaggccgctgtacccgatgatgctggagagcccgcagctgcggtgggcgttcgtccggaaggtgtacgccatcctctccatccagatgctgctcaccatcgccgtcgcctccgtcgtcgtcttcgtccgccccgtcgccctcttcttcgtctccacccccgccggcttcgccctctacatcttcctcatcatcctccccttcatcgtgctttgcccgctctactactactaccagcgccacccggtgaacctcctcctgctggccctcttcacggcggcgatcagcttcgccgtgggcctcacctgcgcgttcaccaagggcgaggtgatcctcgagtcggcgatcctgacggccgcggtggtggtgagcctgacggcgtacacgttctgggcggcgcggcgcggccacgacttcagcttcctcggcccgttcctcttcgccgccgtcatgatcctcatggtgttcgcgctcatccaggtcttcttcccgctcgggagggtctcgctgatgatctacggtggcctcgccgcgctcgtgttctgcggctacatcgtgtacgacacggataacctcatcaagaggtactcctacgacgagtatgtctgggccgccgtcgcgctctacctcgacgtcatcaacctcttcctctccctcctcaccctcttcagggcatccgattcgtag

SEQ ID NO: 58767 - protein, 229 aa, Oryza sativa (japonica cultivar-group)
MARPLYPMMLESPQLRWAFVRKVYAILSIQMLLTIAVASVVVFVRPVALFFVSTPAGFALYIFLIILPFIVLCPLYYYYQRHPVNLLLLALFTAAISFAVGLTCAFTKGEVILESAILTAAVVVSLTAYTFWAARRGHDFSFLGPFLFAAVMILMVFALIQVFFPLGRVSLMIYGGLAALVFCGYIVYDTDNLIKRYSYDEYVWAAVALYLDVINLFLSLLTLFRASDS

SEQ ID NO: 58768 - DNA, 672 bp, Oryza sativa (japonica cultivar-group)
  CDS (1)..(672)
atgatcgagaggccggagctccggtgggcgttcatccgcaaggtgtacgcgatcgtggcgacgcagctggtggtgaccgtcgccatcgccgccgccgtctactccgtcccggccatccgccgcttcttcctcgcccgcacgccggcgtcgctcgccgccttcgtgctcgtcatcgtcgcccccctcatcgttatgctgccgacgatgtttctccgtaagaagcatccgatcaacctcatccttctagcattgttcaccatttgcatgagctgcgccattggcctgggctgcctctcttccaaagccggcattgctataatcgaagcggcatccctaacgttcgggctggtgttcggcctgacgctctacacattctgggcggccaagagaggccatgacttcagcttcctccgccccttcttggtcgcggccttcctcgtcctcgtcctctacggtctcatccagatgttggtgccaacggggaaagtggcgacgacggtgtacgggtgcgtggcggcgctggtgttctccggcttcatcatctacgacacggacaatctgatcaagaggcacgcctacgatgagtacgtcacggctgccatctcgctctaccttgacaccgtcaacatcttcattgccattttcactgcactcgacgcttcagattcatag

SEQ ID NO: 58769 - protein, 223 aa, Oryza sativa (japonica cultivar-group)
MIERPELRWAFIRKVYAIVATQLVVTVAIAAAVYSVPAIRRFFLARTPASLAAFVLVIVAPLIVMLPTMFLRKKHPINLILLALFTICMSCAIGLGCLSSKAGIAIIEAASLTFGLVFGLTLYTFWAAKRGHDFSFLRPFLVAAFLVLVLYGLIQMLVPTGKVATTVYGCVAALVFSGFIIYDTDNLIKRHAYDEYVTAAISLYLDTVNIFIAIFTALDASDS

SEQ ID NO: 58770 - DNA, 735 bp, Oryza sativa (japonica cultivar-group)
  CDS (1)..(735)
atgttccggtacgagaagggcggggacgtcgaggcggggacctcgggcggggcgagggagctctacccggggatgacggagccgccggagatgcggtgggcgctcatccggaagatctacgtcatcctctccatgcagctcctcctcaccgccgccgtcgccgccgtcgtcgtcaaggtccgcgccatctcccacttcttcgtctcctcccacgccggcctcggcctctacatcttcctcatcatcctccccttcatcgtgctctgcccgctgtactactaccaccagaagcacccggtcaacctgatcctgctcggtctcttcaccgtcgccatcagcttcgcggttgggatgacatgcgccttcaccagtggcaaggtcattctggagtctgcaattcttacaacagttgttgtgtttagcctgactgcctacacattctgggctgcaaagaggggccgtgacttcagcttccttggccctttcctcttcgcctccctcattgtgctgctcgtgtttgcgttcattcagatcctattcccgctgggcaggatctcccagatgatctatggcgggatcgcgtcgctcatcttcagtggctacatcgtctacgacacggacaacatcatcaagcgctacacctacgaccagtacgtctgggccgccgtctccctctacctcgacgtcatcaacctcttcctctccctcatgaccctcttcagggcagccgactga

SEQ ID NO: 58771 - protein, 244 aa, Oryza sativa (japonica cultivar-group)
MFRYEKGGDVEAGTSGGARELYPGMTEPPEMRWALIRKIYVILSMQLLLTAAVAAVVVKVRAISHFFVSSHAGLGLYIFLIILPFIVLCPLYYYHQKHPVNLILLGLFTVAISFAVGMTCAFTSGKVILESAILTTVVVFSLTAYTFWAAKRGRDFSFLGPFLFASLIVLLVFAFIQILFPLGRISQMIYGGIASLIFSGYIVYDTDNIIKRYTYDQYVWAAVSLYLDVINLFLSLMTLFRAAD

SEQ ID NO: 58772 - DNA, 786 bp, Yarrowia lipolytica CLIB99
  CDS (1)..(786)
atgtcagctccacccgcctacgagccccttctcaaccccaatgatcagtccaacctgaacactgcctcttctgcagctgtgcgggatgcagaggataacttgcccgctgacttcaagtacgatacgccagttgttcaatgtgacattgatgttcgaaataacttcatcaagcaagtatacactattgttactgctcagattgctactactgctatttttggagctatcattgttttcaaccctcccatcaccatgtggatcctcgaacacatgtgggtgtattatgtcacaatttttggttcactaggctgccttattgcctgcatttggaagcagaacagctaccctctgaacatgaccttgttgggcgtgtttacgctttgtcagggactggcaattggtactgtgtgttctctcatggactcaaaagtggtccttcaggcagtggcaattaccctggtgctgttcttcggccttactttgttcgctttccagacgaagtatgatctgacatccatggctggtattctttctgcttgtctatggggtcttattggcgtgggccttgttggcatgtttgtgccattctcctcggctgtggagctcatctactcgtctattggagctctagttttctccggctacattctagtggacacccagatgatcattcgaaagttacatcctgaccaggtgattcctgcagcaatcaacatttaccttgatattctcaatttgttcttgtacattttgcgaattctcaatgaaattaaccgggataactag

SEQ ID NO: 58773 - protein, 261 aa, Yarrowia lipolytica CLIB99
MSAPPAYEPLLNPNDQSNLNTASSAAVRDAEDNLPADFKYDTPVVQCDIDVRNNFIKQVYTIVTAQIATTAIFGAIIVFNPPITMWILEHMWVYYVTIFGSLGCLIACIWKQNSYPLNMTLLGVFTLCQGLAIGTVCSLMDSKVVLQAVAITLVLFFGLTLFAFQTKYDLTSMAGILSACLWGLIGVGLVGMFVPFSSAVELIYSSIGALVFSGYILVDTQMIIRKLHPDQVIPAAINIYLDILNLFLYILRILNEINRDN

SEQ ID NO: 58774 - DNA, 657 bp, Pan troglodytes
  CDS (1)..(657)
atggctgaccccgacccccggtaccctcgctcctcgatcgaggacgacttcaactatggcagcagcgtggcctccgccagcgtgcacatccgaatggcctttctgagaaaagtctacagcattctttctctgcaggttctcttaactacagtgacttcaacagtttttttatactttgagtctatacggacatttgtacatgagagtcctgccttaattttgctgtttgccctcggatctctgggtttgatttttgcgttgactttaaacagacataagtatccccttaacctgtacctactttttggatttacgctgttggaagctctgactgtggcagttgttgttactttctatgatgtatatattattctgcaagctttcatactgactactacagtattttttggtttgactgtgtatactctacaatctaagaaggatttcagcaaatttggagcaggtgagataatggagttggtcttagccgctgcaggagcccttcttttctgtggattcatcatctatgacacacactcactgatgcataaactgtcacctgaagagtacgtattagctgccatcagcctctacttggatatcatcaatctattcctgcacctgttacggtttctggaagcagttaataaaaagtaa

SEQ ID NO: 58775 - protein, 218 aa, Pan troglodytes
MADPDPRYPRSSIEDDFNYGSSVASASVHIRMAFLRKVYSILSLQVLLTTVTSTVFLYFESIRTFVHESPALILLFALGSLGLIFALTLNRHKYPLNLYLLFGFTLLEALTVAVVVTFYDVYIILQAFILTTTVFFGLTVYTLQSKKDFSKFGAGEIMELVLAAAGALLFCGFIIYDTHSLMHKLSPEEYVLAAISLYLDIINLFLHLLRFLEAVNKK

SEQ ID NO: 58776 - DNA, 702 bp, Desulfovibrio vulgaris subsp. vulgaris str. Hildenborough
  CDS (1)..(702)
atgtacaacaggacgatgggcagtgccgccagagtggaagccaccaatgcctatatgcgcggcgtctattcgtggatgacccttggccttgccgtgacagcggcggcggcgtggggtgtggccagcagtgaagccctcattgcgttcattttcggcaataccttcgtgttcttcggcctcatcatcgccgagtttgcgctggtgataggcataagcgcgggcatcgcacgcctttcggcgggcatggcctcggggttgttcctgttgtacagcgcactcaacggcctcacgctgtcatcgatattgctggtctatgcgcagagtgccgtgtttcaggcgttcatcaccacggcgggcatgttcgccgtcatgagcatctacggtgccaccacgaagcgtgacctcacctccatgggcagcttcctgatgatgggtctttttggcatcatcctcgcttcggtggtcaacatcttcatgcgtagcagcatgatggagttcatcatcagcgccgtgggcgtactggtgttcaccggcctcaccgcctatgacacccagaagctcaaggccttcggcgaaaacgcccccatggacgacgccgtggccatacgccgtggcaccatcctcggtgcgctgaccctgtaccttgatttcgtgaacctcttcatcatgatggtgcgcctgttcggctcgtcgcgcgactag

SEQ ID NO: 58777 - protein, 233 aa, Desulfovibrio vulgaris subsp. vulgaris str. Hildenborough
MYNRTMGSAARVEATNAYMRGVYSWMTLGLAVTAAAAWGVASSEALIAFIFGNTFVFFGLIIAEFALVIGISAGIARLSAGMASGLFLLYSALNGLTLSSILLVYAQSAVFQAFITTAGMFAVMSIYGATTKRDLTSMGSFLMMGLFGIILASVVNIFMRSSMMEFIISAVGVLVFTGLTAYDTQKLKAFGENAPMDDAVAIRRGTILGALTLYLDFVNLFIMMVRLFGSSRD

SEQ ID NO: 58778 - DNA, 774 bp, Bartonella quintana str. Toulouse
  CDS (1)..(774)
atggctgatttcaaaaatttacgttcggcacctatttctcatgccgatgcttcaattgatcaaggattgcgtagctatatggtgggtgtctacaacacgatggccattggtttgcttgttacagctgctaccgcttatgcaattgcatcattagcaacaacaacggagatgagtcaggcagccgcacaaatcaatagcagtgtctacttaacttcatttggagtaacattttacacatcgccattctcttacattgttatgtttgcaccacttgtggcggtattattccttagtttcaaaattaatacgttgagtacaagtgttgcccggagtctcttttttggttatgctgccctcgttgggctttcactgtcctctatcattttgcgttatacaacagaaagtattgtacaaacatttgttattaccgctgcaacttttggtgctctttcactttatggatatacaacgaagcgcgatctcacagcgatgggctcattcttttttatcggtttggttggcttaatgctttccatgattgttaatatttttcttggatcgagtgctttgcaatttgctatctccgtaattggtgtttttatctttgctggtttaacagcttacgatacacaaaacattaaattgatgtattatgaaggagatggaaatgacacccaaggtcgtaaaattattatgggtgcattaaatctttatcttgacttcatcaatatgtttgtcttcttgctgcaatttctcggctcaaaccgtgattga

SEQ ID NO: 58779 - protein, 257 aa, Bartonella quintana str. Toulouse
MADFKNLRSAPISHADASIDQGLRSYMVGVYNTMAIGLLVTAATAYAIASLATTTEMSQAAAQINSSVYLTSFGVTFYTSPFSYIVMFAPLVAVLFLSFKINTLSTSVARSLFFGYAALVGLSLSSIILRYTTESIVQTFVITAATFGALSLYGYTTKRDLTAMGSFFFIGLVGLMLSMIVNIFLGSSALQFAISVIGVFIFAGLTAYDTQNIKLMYYEGDGNDTQGRKIIMGALNLYLDFINMFVFLLQFLGSNRD

SEQ ID NO: 58780 - DNA, 774 bp, Bartonella henselae str. Houston-1
  CDS (1)..(774)
atggctgatttcaaaaattcacgtccggcgtcactctttcatgccgatgcatcaattgatcaaggattgcgcagctatatgctgggtgtctataatacaatggccattggtttgcttattacagctgcggccgcttatgcagttgcatcattagcaacgacaacggaaatgagccaggcagccgctcaaatcagtagcagtgtttatttaacttcatttggagtaacattttatacatcgccattctcttacattattatgtttgcaccacttgtggcggtattatttcttagtttcaaaatcaatactttgagtacaagtacagcccgtagcctcttttttggttatgctgccctcgttgggctttcattgtcctcgatcattctgcgttatacaacagaaagtatcgtacaaacctttgttattagtgctgcaacttttggtgctctttcactttatggttacacaacaaagcgtgatctcacagcgatgggttcattcttttttatcggtttggttggcttgatgctttctatgattgtgaatatctttctcggatcaagtgctttgcaattcgctatctctgtgattggcgtctttatctttgctggtctcacagcttatgatacgcaaaacattaaattgatgtattatgaaggagatgcaaatgacacccaaggacgtaagattattatgggtgcgttaaatctttaccttgatttcattaatatgtttgtcttcttgctgcaatttcttggttcgaaccgtgattga

SEQ ID NO: 58781 - protein, 257 aa, Bartonella henselae str. Houston-1
MADFKNSRPASLFHADASIDQGLRSYMLGVYNTMAIGLLITAAAAYAVASLATTTEMSQAAAQISSSVYLTSFGVTFYTSPFSYIIMFAPLVAVLFLSFKINTLSTSTARSLFFGYAALVGLSLSSIILRYTTESIVQTFVISAATFGALSLYGYTTKRDLTAMGSFFFIGLVGLMLSMIVNIFLGSSALQFAISVIGVFIFAGLTAYDTQNIKLMYYEGDANDTQGRKIIMGALNLYLDFINMFVFLLQFLGSNRD

SEQ ID NO: 58782 - DNA, 660 bp, Erwinia carotovora subsp. atroseptica SCRI1043
  CDS (1)..(660)
atggatcgtattgttgtttcctctacccgtgaaagttcactactcagcactcacaaagtgctgcgtaatacctatttcctgctgtcgctgacgctgggtttttctgccattactgcaacggcaagtactgtacttaacctgcccgcccctggcttaattctgatgctagttgggttttatggtctgatgttcctgacgcataaactggcgaacagccctgctggtattttggcgacattcgcactgactgggtttatgggttatacgctaggcccaattttaagctcactgatttcttccggtgcaggcgacattgtcatgttggcgttgggcggtacggcactggtgttcttctgctgttcagcctatgtattaacgacacgtaaggatatgtccttcttgtctggcatgatgatggcaggattcgttgtactgattgttgccgtcattgccaatctgttcctacagatcccagccttgcatctggctatcagcaccctgtttattctattttctgcgggtgccatcctgtgggaaaccagtaacatcattcacggtggcgaaaccaactacatccgggcgacggttagcctgtatgtcgcgatatacaatatcttcgttagcctgttgagcattctgggcatcatgcgtaacgactaa

SEQ ID NO: 58783 - protein, 219 aa, Erwinia carotovora subsp. atroseptica SCRI1043
MDRIVVSSTRESSLLSTHKVLRNTYFLLSLTLGFSAITATASTVLNLPAPGLILMLVGFYGLMFLTHKLANSPAGILATFALTGFMGYTLGPILSSLISSGAGDIVMLALGGTALVFFCCSAYVLTTRKDMSFLSGMMMAGFVVLIVAVIANLFLQIPALHLAISTLFILFSAGAILWETSNIIHGGETNYIRATVSLYVAIYNIFVSLLSILGIMRND

SEQ ID NO: 58784 - DNA, 708 bp, Erwinia carotovora subsp. atroseptica SCRI1043
  CDS (1)..(708)
atggacagatatccacgctctggttcaatcgttgagcgctcgcagtctggtctacaggcctatatggcacaggtttatggctggatgacttgtggcctgctgctgacggcattcgtctcctggtatgcggcgaatacgcccgccgtactgaattttgttttctccagccagatcactttctttggactgatcattgcccaactggggctggtatttgtcatttccggcatggtacagcgcctgagcggcacggttgccacgtcgttgtttatgctttattccgcgttgacggggctgacgctctccagcattttcatcatgtactctggtgagtccatcgctagcacctttgtgattacggcagggatgttcggggcgatgagcctgtacggctacaccacgaagcgtgatttaagcggcttcggcagcatgttgtttatggcgctgatcgggattgttctggcttcgctggtgaacctgtggctgaaaagcgaagcgctgatgtgggcagtaacctatatcggtgtggtggtgtttgtcggtctcaccgcgtatgacacccagaaactgaaaaatatcggcgagcagttgtctgttgatgacaaagatagcttccgcaaatactccatcgtcggcgcgttgacgctgtacctcgacttcatcaacctgttcctgatgctgctgcgtattttcggtaatcgtcgttaa

SEQ ID NO: 58785 - protein, 235 aa, Erwinia carotovora subsp. atroseptica SCRI1043
MDRYPRSGSIVERSQSGLQAYMAQVYGWMTCGLLLTAFVSWYAANTPAVLNFVFSSQITFFGLIIAQLGLVFVISGMVQRLSGTVATSLFMLYSALTGLTLSSIFIMYSGESIASTFVITAGMFGAMSLYGYTTKRDLSGFGSMLFMALIGIVLASLVNLWLKSEALMWAVTYIGVVVFVGLTAYDTQKLKNIGEQLSVDDKDSFRKYSIVGALTLYLDFINLFLMLLRIFGNRR

SEQ ID NO: 58786 - DNA, 723 bp, Desulfotalea psychrophila LSv54
  CDS (1)..(723)
atgaggtgtacagatatgtatcaaaatagctcttccattggcattgttcgggcccgtcaagatgccgcttcgatctttttggcgaaggtgtttaactggatggcgcttgggcttggcctgaccggcttggtggccttttttgcagctggtagtggcatcaccgcagccattgttgcaagccctctttttatgatgctgatcattgccgagcttggtatggtcttttttctttcggccagaattgataagattcaggccagcacagcctcggggctatttctgggctactcatttttaaatggtttgaccctctcggcaatttttcttgcctataccagtacctcgattgccgctacattttttataactgctggcatgttcggggcaatggctgtttatggtctcataactaaacgtgatctttccggatttggttcctttctctttatgggacttgtgggaattatcattgcctctgtggtgaatatttttctgaagagtacaggcctttactgggtgatctctctgcttggggtatttatctttacagctcttaccgcctatgatgtccagaagatcaagaccatgggagagaagggcattctcagtcagggtgaggttgccataaaaaaaggtgccattatgggggcccttaccctctatcttgattttattaatctctttttgatgcttctccgcttctttggtggtagcaggaactag

SEQ ID NO: 58787 - protein, 240 aa, Desulfotalea psychrophila LSv54
MRCTDMYQNSSSIGIVRARQDAASIFLAKVFNWMALGLGLTGLVAFFAAGSGITAAIVASPLFMMLIIAELGMVFFLSARIDKIQASTASGLFLGYSFLNGLTLSAIFLAYTSTSIAATFFITAGMFGAMAVYGLITKRDLSGFGSFLFMGLVGIIIASVVNIFLKSTGLYWVISLLGVFIFTALTAYDVQKIKTMGEKGILSQGEVAIKKGAIMGALTLYLDFINLFLMLLRFFGGSRN

SEQ ID NO: 58788 - DNA, 711 bp, Yersinia pseudotuberculosis IP 32953
  CDS (1)..(711)
atggatcgctatccacgctctaatggttcgattgtcgaacgtgccggctcaggcattcaggcctatatggcgcaggtatacggttggatgacctgtggcttgttattaaccgcagttgtcgcttggtatgccgcgaacactccttcaatcatttttgctttgcaatcaaaccaaatattgttctttggcttgattattgcccagcttggtctggtttttgttatttccggtatggttaaccgcctgagtggaaccgcagcaacatcactgtttatgctgtattccgcgctgaccggcctcaccctttccagcatattgataatgtacacgggcgcgtctatcgccagtactttcgttatttgtgccgggatgtttggcgccatgagcttctatggttacaccaccaaacgtgatctgagcggtatgggcagcatgttgtttatgggcctgatcggtatcattctggcatctcttgttaacatctggctgaaaagcccagcgttgatgtgggctgtgacctatatcggtgtgctcgtgtttgtgggcctgactgcctacgacacacagaaactgaaaaacttgggcgcacagttggatgtcaatgataaagattcattccgcaaatactccattgtgggcgcactgactctgtatctcgatttcattaacctgttcttgatgttattacgaatcttcggtaatcgtcgctaa

SEQ ID NO: 58789 - protein, 236 aa, Yersinia pseudotuberculosis IP 32953
MDRYPRSNGSIVERAGSGIQAYMAQVYGWMTCGLLLTAVVAWYAANTPSIIFALQSNQILFFGLIIAQLGLVFVISGMVNRLSGTAATSLFMLYSALTGLTLSSILIMYTGASIASTFVICAGMFGAMSFYGYTTKRDLSGMGSMLFMGLIGIILASLVNIWLKSPALMWAVTYIGVLVFVGLTAYDTQKLKNLGAQLDVNDKDSFRKYSIVGALTLYLDFINLFLMLLRIFGNRR

SEQ ID NO: 58790 - DNA, 699 bp, Borrelia garinii PBi
  CDS (1)..(699)
atgattgaattaacacaagaaaaacaagaaatattaataaaaaacaaatttttagccaaagtttttgggcttatgtcaattggacttttaatttcagcaatatttgcatacgcgacctcagaaaatcaagcaataaaagcaataatattctcaaatccaatgtcatttatggctataatacttatacaatttggacttgtatatgcaataagtggcgctcttaataaaatatcaagcaatactgcaacagctctttttctactctactcagcactaacaggagtaacattatcttctatatttatgatttatacacaaggatcaatagtatttacatttggaattactgctggaacatttcttggaatgtctgtttatggatacaccacaacaacagatctaacaaaaatgggaagctatctaataatgagcttatggggaattattattgcatctcttgttaatatgttttttagaaactcaggccttaatttccttatatctattttaggcgtaatcatattcacaggactaacagcttatgacgttcaaaatattgctaaaatggataaaatgctacaagacgatactgaaataaaaaatagaatggcagttgtagcatcacttaagctttatttagattttataaatttattcttatatcttctaagatttttgggccaaagaagaaacgactaa

SEQ ID NO: 58791 - protein, 232 aa, Borrelia garinii PBi
MIELTQEKQEILIKNKFLAKVFGLMSIGLLISAIFAYATSENQAIKAIIFSNPMSFMAIILIQFGLVYAISGALNKISSNTATALFLLYSALTGVTLSSIFMIYTQGSIVFTFGITAGTFLGMSVYGYTTTTDLTKMGSYLIMSLWGIIIASLVNMFFRNSGLNFLISILGVIIFTGLTAYDVQNIAKMDKMLQDDTEIKNRMAVVASLKLYLDFINLFLYLLRFLGQRRND

SEQ ID NO: 58792 - DNA, 672 bp, Mannheimia succiniciproducens MBEL55E
  CDS (1)..(672)
atggcagattcccgtattgtccttgatgcccgcgagcaatcaacttcattacttagcacacataaagtattacgtaatacttactttttattgggcatgacacttgccttctccgcattcgtcgcctatatttccatctcattaggcttgccgcatcccggtattatcgtgacgttagtcggcttttacggcttattgtttttaaccaattcgttagctaacagcggttggggaattctatccgcctttgcctttaccggttttcttggctataccttagggccgattctgaatgtttatatcggcgcagggttaagcgaaaccgtagttcttgcattgtcaggtacggccgcggtgttctttgcttgctcggcttacgtactgacgacccgcaaagatatgtcattcctttccggcatgattttctcgctctttatcgtgttattgctgggcatggtggcaagcatattcttccaaacgccggctttgcatttggcgattagcggtttgtttgtaattttctcaagtgccgcaatcttatttgaaacaagcaatattattcatggcggtgaaacaaattatatcagagcgaccgttagcctatttgtttcaatctacaacctattcttaagtttgttacaattattgggcatctttggcggtgacgattaa

SEQ ID NO: 58793 - protein, 223 aa, Mannheimia succiniciproducens MBEL55E
MADSRIVLDAREQSTSLLSTHKVLRNTYFLLGMTLAFSAFVAYISISLGLPHPGIIVTLVGFYGLLFLTNSLANSGWGILSAFAFTGFLGYTLGPILNVYIGAGLSETVVLALSGTAAVFFACSAYVLTTRKDMSFLSGMIFSLFIVLLLGMVASIFFQTPALHLAISGLFVIFSSAAILFETSNIIHGGETNYIRATVSLFVSIYNLFLSLLQLLGIFGGDD

SEQ ID NO: 58794 - DNA, 675 bp, Legionella pneumophila subsp. pneumophila str. Philadelphia 1
  CDS (1)..(675)
atgaaccgaaatgatatcaccatacttagtcaacaaagagaatctgtgctcgcaaccaataaggtcctgcgaaatacgtatttactgctaagtttaaccttcatatttagcgcattaactgcctacgtagcctttattagtggagctcgcccaatgaatccactattaatgatagttggcgtttatggtttgatgtttctaactcaagctttaagaaatagcgtttggggtttggtaagcgtctttgcttttacagggtttttaggatataccattggcccattactcaactattacatcacaggcttttcaaatggcccacaaatagtcgctactgctttaggtggtactggaatgatcttttttgctctatcaggatatgccctgacaacgaaaaaagattttagctacctgggtggatttctttttgttggcgttatggttgccttattggcgatgatagcgggaatatttatacaaataccagctttgcaattagtaatttctgctgcttttgtattaatttcatctggattgattctattacaaaccagcgccataattcatgaaggagaaaccaattacataatggcgacaattggtttgtttgtttccatttataacttatttgttagcctgctgaacctgttaagcgcattctcaggtcgcgactaa

SEQ ID NO: 58795 - protein, 224 aa, Legionella pneumophila subsp. pneumophila str. Philadelphia 1
MNRNDITILSQQRESVLATNKVLRNTYLLLSLTFIFSALTAYVAFISGARPMNPLLMIVGVYGLMFLTQALRNSVWGLVSVFAFTGFLGYTIGPLLNYYITGFSNGPQIVATALGGTGMIFFALSGYALTTKKDFSYLGGFLFVGVMVALLAMIAGIFIQIPALQLVISAAFVLISSGLILLQTSAIIHEGETNYIMATIGLFVSIYNLFVSLLNLLSAFSGRD

SEQ ID NO: 58796 - DNA, 714 bp, Burkholderia pseudomallei K96243
  CDS (1)..(714)
atgttaggagaaaccatgaacgactatccgtacaacttcggccgcggcggcgcgatcggcacggccgagacccgcaaccgcgtgctgcgcaacacctactggctcctcgcgctgtcgatggtgccgaccgtgctcggcgcctgggtcggcgtcgcgacgggtttctcgctgttcgccgcgacgagcccgatgatgagcctcctcgcgttcttcgcgatcgcgttcggcttcatgttcgcgatcgagcgcacgaagaacagctcggccggcgtgttcgtgctgctcggcttcacgttcttcatgggcctgatgctgtcgcgcctcttgagcttcatcctcggcttctcgaacggcccgtcgctcatcatgctcgcattcggcggcaccggcgtgatcttcgccgcgatggcgacggtcgcgaccgtcagcaagcgcgacttctcgggcctcggcaaatggctcttcgtcggcgtgatcgtgctgctgctcgcgatggtcgcgaacatgttcctgcaactgccggcgctgatgctgaccgtgtcggtgctcgcgatcgtgatcttctcggcgtacatgctgtttgacgtccagcgcgtcgtgaacggcggcgagacgaattacatcagcgcgacgctcgcgatctacctcgatctgtacaacgtgttcacgaacctgctcgcgctgctcggcatcttcggcggcaaccgcaactga

SEQ ID NO: 58797 - protein, 237 aa, Burkholderia pseudomallei K96243
MLGETMNDYPYNFGRGGAIGTAETRNRVLRNTYWLLALSMVPTVLGAWVGVATGFSLFAATSPMMSLLAFFAIAFGFMFAIERTKNSSAGVFVLLGFTFFMGLMLSRLLSFILGFSNGPSLIMLAFGGTGVIFAAMATVATVSKRDFSGLGKWLFVGVIVLLLAMVANMFLQLPALMLTVSVLAIVIFSAYMLFDVQRVVNGGETNYISATLAIYLDLYNVFTNLLALLGIFGGNRN

SEQ ID NO: 58798 - DNA, 678 bp, Methylococcus capsulatus str. Bath
  CDS (1)..(678)
atgagtattccccgtgaacaggtcttgagccgcggcgcttatgccgtcgtgccccgccacaaggttctgaccaacacctatgcgctgctgtcgctgacgctgctgttcagtgcgttcaccgctggcgtgtccatggtgctggcgctgccccaccccggcatcatcgtcaccctggtgggctatttcggcctgctgtggctgaccaacaaatatgccaacagcgcgctcggtctcctgtgggtgtttgctctgaccggcttcatgggctatacgctgggcccggttctgaacgcctacgtcacgcacttcgccaacggcacccagctggtcatgatggccatgggcggtacgggcgcagtgttcctcggcctctcggcctacgcgctgacgacccgcagggacttcagtgtcctcggcggcctgctgggcgcaggtgtgctggtcgccttcctggccggtctggtcgccgtcttcgtgcccggcctgatggggctcagcctcgccgtgtcggcgatgttcgtggttctgatggccggaatgatcctgttccagaccagcgcgatcatccacggcggcgaaaccaactacatcctcgccacggtgtcgctgtacgtgacgatcttcaacctgtttaccagtctcctgcagttgctcggcgtgttcggcagcgacgattga

SEQ ID NO: 58799 - protein, 225 aa, Methylococcus capsulatus str. Bath
MSIPREQVLSRGAYAVVPRHKVLTNTYALLSLTLLFSAFTAGVSMVLALPHPGIIVTLVGYFGLLWLTNKYANSALGLLWVFALTGFMGYTLGPVLNAYVTHFANGTQLVMMAMGGTGAVFLGLSAYALTTRRDFSVLGGLLGAGVLVAFLAGLVAVFVPGLMGLSLAVSAMFVVLMAGMILFQTSAIIHGGETNYILATVSLYVTIFNLFTSLLQLLGVFGSDD

SEQ ID NO: 58800 - DNA, 666 bp, Photobacterium profundum SS9
  CDS (1)..(666)
atgaacgatcgtatagtgaatcgtactggatcttacgatagcgtactttcaaccaataaggttttaagaaacacgtacttcctactttctctaacattgctttggtctgcggttatcgctggtaccgctatggcaatgaacttgccttacccaggaatcatcattacgttggttggtttctacggtctaatgtttttaactgaaaagaacaaagacagtagccttggtatcgtatttacattcgcattaacgggtttcatgggttataccctagggccaattctgaacatgtacattggcgcaggtatggggcacgcaattgttcctgctctaggcggtacagcccttacatttatggcttgttctgcgtatgcactaacaactaagcgtgatctatcattcttgaatggtatgttaatggctggttttgttgcgattattgttgcggttgttgcaaacatcttcctacaaataccaatgctttcattagcaatcagcggtatgtttgttctgttctcttcagcggcgattctgcttactacgcagtcaatcatccgtggtggtgaaacaaactacatttctgctaccgttacgttatatgtctctatctacaacctattcctaagcttgctacaaatcttaggcatcatgggtaacaacgattaa

SEQ ID NO: 58801 - protein, 221 aa, Photobacterium profundum SS9
MNDRIVNRTGSYDSVLSTNKVLRNTYFLLSLTLLWSAVIAGTAMAMNLPYPGIIITLVGFYGLMFLTEKNKDSSLGIVFTFALTGFMGYTLGPILNMYIGAGMGHAIVPALGGTALTFMACSAYALTTKRDLSFLNGMLMAGFVAIIVAVVANIFLQIPMLSLAISGMFVLFSSAAILLTTQSIIRGGETNYISATVTLYVSIYNLFLSLLQILGIMGNND

SEQ ID NO: 58802 - DNA, 690 bp, Streptococcus thermophilus CNRZ1066
  CDS (1)..(690)
atgaaatcaaatgcaatttatacaactagtgatgcaggattaaatcgctttttcgggaagatttatggccttgttggtattggggtagggctttcagcagtcatttcttatctgatgttattccctctctctcatctttttgtcaacattctcatgaattattcttggatctatatggcagctatttttgttgagttagccttggtttttttggctagtggtgctgcaagaagaaatacgcctgcggctctgcctttattcttagtttattccgctctgaatggctttacacttagttttatcatcgttcaatatacgcaagctattgttttccaagctttcctaagtactgccattgtcttctttgtcatggcacttatcggagtttctattaagcgtgacttgtcaggaatggtcaaatttcttatggcagctttgattggaatcattgtggctagcttagttaatattttctttgcaagtagcacgatgagttttgtgattagtattgtatcagttctcattttctctggtttaattgcttatgacaatcagttaattaaaaaggtttattatagtactaatggtcaagtcacagatggatgggcggtttctatggcgcttagtctttacttggattttattaacttgttcttgaatatcttgcgaatctttgcgaggcatgactag

SEQ ID NO: 58803 - protein, 229 aa, Streptococcus thermophilus CNRZ1066
MKSNAIYTTSDAGLNRFFGKIYGLVGIGVGLSAVISYLMLFPLSHLFVNILMNYSWIYMAAIFVELALVFLASGAARRNTPAALPLFLVYSALNGFTLSFIIVQYTQAIVFQAFLSTAIVFFVMALIGVSIKRDLSGMVKFLMAALIGIIVASLVNIFFASSTMSFVISIVSVLIFSGLIAYDNQLIKKVYYSTNGQVTDGWAVSMALSLYLDFINLFLNILRIFARHD

SEQ ID NO: 58804 - DNA, 639 bp, Geobacillus kaustophilus HTA426
  CDS (1)..(639)
atgaatcattcgaccgtttatcgtccgcatagcccagtggcgaagttggcggtttcctttttagcggcgctggccgtcgcgacggcggggctgtatgccgggcaatgggtgccggctggcctgtatttgcccctttacgggcttgaacttgtgctgctgttggtcatgatgttcgcccgcgtgaaaaaagctgtcggctatccgcttatgtttgcgtttatgtttgtctcgggggcgacgctctatccgctcatcggctattacatttccatcatcggcgcggcggcggtgttcaaagcgtttgcgctggccgttgtatcgttttccggcgttgccatttacgcagcgagaacgaaagaagatttttcgttcctcggcgggtttttgatgctgggcgcgtttgcgctccttggcttgctgatcatccaatggttcatcccattctcaagcgtagggcaaatgggcatcgccgctttggggattctgattttccttggctttacgatttacgacatcaaccgtttggcccgctatggctttacggaagcggacatcccgatgattgtggtcaatatttaccttgatttcatcaacttgtttgtctacattttgcgttttttcgccagcgatgaggattga

SEQ ID NO: 58805 - protein, 212 aa, Geobacillus kaustophilus HTA426
MNHSTVYRPHSPVAKLAVSFLAALAVATAGLYAGQWVPAGLYLPLYGLELVLLLVMMFARVKKAVGYPLMFAFMFVSGATLYPLIGYYISIIGAAAVFKAFALAVVSFSGVAIYAARTKEDFSFLGGFLMLGAFALLGLLIIQWFIPFSSVGQMGIAALGILIFLGFTIYDINRLARYGFTEADIPMIVVNIYLDFINLFVYILRFFASDED

SEQ ID NO: 58806 - DNA, 705 bp, Salmonella enterica subsp. enterica serovar Paratypi A str. ATCC
  CDS (1)..(705)
atggacagatttccacgatctgattcaatagtgcaggcgcggtctggcctgcagacctatatggcgcaagtgtatggctggatgacggtcggactgttactgaccgcgtttatcgcgtggtatgcggctaatacgccagccgtcatgatgtttgtcttttccagtaagatcaccttctttggcttaatcattgctcagcttgcgctggtatttgttctgtcgggactggtgcataaacttagcgccggaatggcgacgacgctgtttatgctctattcggcgctaaccggattgacgttatccagtatttttatcgtttacacctattcctccatcgccagcacgtttgtggtgacgggggaaatgtttggcgccatgagcctgtatgggtacaccactaaacgcgatcttagcggtttcggcaatatgctgtttatggcgcttattggtatcgttctggcctcgctggtcaatttctggctgaagagtgaagcgctgatgtgggcggtaacctatatcggggtgatggtgtttgtcggtctgaccgcctatgacacgcagaaactgaaaaatatcggcgagcaaatagatacccgcgatagcgctaatctgcgtaagtattcgattctcggcgcgttaacgctgtacctggactttatcaacttgttcctgatgttactgcgtatttttggcaatcgccgctaa

SEQ ID NO: 58807 - protein, 234 aa, Salmonella enterica subsp. enterica serovar Paratypi A str. ATCC
MDRFPRSDSIVQARSGLQTYMAQVYGWMTVGLLLTAFIAWYAANTPAVMMFVFSSKITFFGLIIAQLALVFVLSGLVHKLSAGMATTLFMLYSALTGLTLSSIFIVYTYSSIASTFVVTGEMFGAMSLYGYTTKRDLSGFGNMLFMALIGIVLASLVNFWLKSEALMWAVTYIGVMVFVGLTAYDTQKLKNIGEQIDTRDSANLRKYSILGALTLYLDFINLFLMLLRIFGNRR

SEQ ID NO: 58808 - DNA, 702 bp, Anaplasma marginale str. St. Maries
  CDS (1)..(702)
atgaacgattacagtgcccagttccaaggcgcttattactgcgcggggctcaggagctacttggttaaggtgtataactacatggctgcggccctggggcttaccggtgttgttgctttgatgacttccttttctcacgggttgatgagtgttctttacggaaccccactgcactgggtggtgtctcttgcccccatcgtcatggtgttctttctctcctccagggtgcacagcatgagcgtgcaggcggtgtttgcggtgtttttcgggtttgcggccacgatggggctttccctctcgtacatgttcatggtgtacaccgcgcacagtatagccagggttttcttcatatcctccgctatgttcggtgtgatggcattctacgggaatacaaccaagagagacctgtctaaattcggcactttcctcatcatgggggttgtcgggatattgatagcctcggtcgtgaatatattcatggcgagcggtccgctacatttcgctatatcggtggttgctgtggtagtgttcactgcgatgacagcttttgatgctcagcgcatcaaggacatgtactaccggtttaatgatggctctgaggtcacttcgagtaagatggccgttatgggcgcgaccagcttgtacttcaactacataaacattttccttagcctgttgcatctcatgggagatcgcagataa

SEQ ID NO: 58809 - protein, 233 aa, Anaplasma marginale str. St. Maries
MNDYSAQFQGAYYCAGLRSYLVKVYNYMAAALGLTGVVALMTSFSHGLMSVLYGTPLHWVVSLAPIVMVFFLSSRVHSMSVQAVFAVFFGFAATMGLSLSYMFMVYTAHSIARVFFISSAMFGVMAFYGNTTKRDLSKFGTFLIMGVVGILIASVVNIFMASGPLHFAISVVAVVVFTAMTAFDAQRIKDMYYRFNDGSEVTSSKMAVMGATSLYFNYINIFLSLLHLMGDRR

SEQ ID NO: 58810 - DNA, 669 bp, Idiomarina loihiensis L2TR
  CDS (1)..(669)
atgaacaatcgcagtcagacttatgtcggtcagaacgaatcgacgctggccgttaataaggtattacgcaacacctacactttattggcaatgacattagcctttagtgctattgttgctactatcagcacgatgatgaacttgccctatccgggtttcattatcactttagttgcttactttggcttactttttggtattcacaaaaccaaagatagcggcatgggcattgtactaaccttcgctctaacaggctttttaggttacacccttggccctatccttaacatggcattatcaatgcctggtggtggcgagatggttgctactgcgttaggcggtacagctctgaccttctttgcaacttcggcttatgtgttaaccacgaagaaagacatgtctaaactgggtggtctggttactgccggtattatcatggtttttgtggcgatgctggctaacctgttcttccaactgccagcattacagcttgcaatatctgctatcatgattccattgatggcaatgctgattatgtggcagaccagcgacattattaacggtggcgagcgtaattacatccttgcaacagtcactttgtatgtttcgatttataacttgttccttagcttgctacaattgctaatggcgtttagcggcgatgattaa

SEQ ID NO: 58811 - protein, 222 aa, Idiomarina loihiensis L2TR
MNNRSQTYVGQNESTLAVNKVLRNTYTLLAMTLAFSAIVATISTMMNLPYPGFIITLVAYFGLLFGIHKTKDSGMGIVLTFALTGFLGYTLGPILNMALSMPGGGEMVATALGGTALTFFATSAYVLTTKKDMSKLGGLVTAGIIMVFVAMLANLFFQLPALQLAISAIMIPLMAMLIMWQTSDIINGGERNYILATVTLYVSIYNLFLSLLQLLMAFSGDD

SEQ ID NO: 58812 - DNA, 666 bp, Azoarcus sp. EbN1
  CDS (1)..(666)
atggaaaaccgaatcggtacgatgacgaggtcggaggcctcggtcctctcgacgaacagggtcatccgcaacacctacatgctgctgtcgttgacgctggcattctcggcgctcaccgccggcgcgtcgctcgcgctcggcctgccgcacccgggcatcatcctcacgctggtggggtatttcggcctgctgttcctgacgacgaagttccgcgacagcgggctgggcatcctgttcgtgttcgcgctcaccggcttcatgggctacacgctcggcccgatcgtgtcccactacctcgcgatgcccaacggcgggcaggtggtgatgcaggcgatgggcggtaccgcggcgattttccttggcctgtcggcgtacgcgctgaccagccgcaaggacttctcgttcatgggcggcttcctggtggtcggcatcctcgtcgccttcctcgccggcctgggcgccatcttcttcgagatgcccggcttgtcgctcgcggtgtcggcaatgttcgtactgctgatgtccggtctcatcctctacgagaccagcaacatcatccacggcggtgagacgaactacgtgatggcgacggtgactttgtacgtgtcgatctacaacctcttcacgagcctgctgcacatcctcggcgtgatgaacaacgactga

SEQ ID NO: 58813 - protein, 221 aa, Azoarcus sp. EbN1
MENRIGTMTRSEASVLSTNRVIRNTYMLLSLTLAFSALTAGASLALGLPHPGIILTLVGYFGLLFLTTKFRDSGLGILFVFALTGFMGYTLGPIVSHYLAMPNGGQVVMQAMGGTAAIFLGLSAYALTSRKDFSFMGGFLVVGILVAFLAGLGAIFFEMPGLSLAVSAMFVLLMSGLILYETSNIIHGGETNYVMATVTLYVSIYNLFTSLLHILGVMNND

SEQ ID NO: 58814 - DNA, 705 bp, Zymomonas mobilis subsp. mobilis ZM4
  CDS (1)..(705)
atgaccgtgacggaatctgctgcgcgtggccgtaacggagcttcggagcgggacgccggtcttcgctcctatatgctttcggtttataattatatggctggcggtgtattgcttaccggcattgttgcctatcttgtggcacattcagccttaggcgcggccattattttctcacctttgcgttggctggttattctggcgccgctggcttttgttttcgcccttagcgctggtgtaaaccgcttcaagctttcgacgttgaaaacgcttttctggtcttatgcggcggtcatgggactttcgatggcggtgattttcttcgtctataccggcacgtctattgcccagaccttttttgcaacggctgctgcctttgcagggctcagtgtttttggttatctgacgaagaaggacttgtctggtatcggtagcttcctgattatggctgttttcggcttgatcgtagcctctttactgaacatgttcattcactcttcatcgctgcaattcggtatcagtgctttaggcgtgcttatttttgctggccttaccgcttatgatacgcagcaaatcaaaagcatgtatttcatgacttctggtggtgaatacgccggtaaaatggcagtgatgggcgctttaagcctctatctggacttcatcaatatgttcagcttcctgctgaacttcatgggtgaccgtcgctaa

SEQ ID NO: 58815 - protein, 234 aa, Zymomonas mobilis subsp. mobilis ZM4
MTVTESAARGRNGASERDAGLRSYMLSVYNYMAGGVLLTGIVAYLVAHSALGAAIIFSPLRWLVILAPLAFVFALSAGVNRFKLSTLKTLFWSYAAVMGLSMAVIFFVYTGTSIAQTFFATAAAFAGLSVFGYLTKKDLSGIGSFLIMAVFGLIVASLLNMFIHSSSLQFGISALGVLIFAGLTAYDTQQIKSMYFMTSGGEYAGKMAVMGALSLYLDFINMFSFLLNFMGDRR

SEQ ID NO: 58816 - DNA, 687 bp, Francisella tularensis subsp. tularensis Schu 4
  CDS (1)..(687)
atgaacaacttacaaaacaacactcgtgtgatagactccctctctcaagagtctgtactaagagcaaacaaagttcttagaaatacatactggttgctatctatgacactactatttagtgcttttacagcatttatagcaatgagcacaggtgcaacgataatgaatccattattaatgctagtagtttatattggtttattatttggtattaatgctactaaaaactcaccatggggtatagttttaacttttgcgctaacaggtcttttaggctattcgcttggtcctatacttaatatgtaccttactatgtttaaaaacggtgcagaactaatcatgatggcatttggaactactggtctgatttttctaggcttatctgtagttgcaatgagccctgcaagaaattttaatagattaggttcattctgtgcgattggtgcgattgttgcattagtagctttagtaattaatatattcctacaacttcctgctttagctttagttatatcactagtatttgcattcatatctggtggttttatattatggcaaacaaatgctattgtaagaggtgaagaaactaactacatattagctactgtaaatatttatgtgtctttattcaatatctttgtaactctattacaaatctttggtgcagtagctggcgatagagaataa

SEQ ID NO: 58817 - protein, 228 aa, Francisella tularensis subsp. tularensis Schu 4
MNNLQNNTRVIDSLSQESVLRANKVLRNTYWLLSMTLLFSAFTAFIAMSTGATIMNPLLMLVVYIGLLFGINATKNSPWGIVLTFALTGLLGYSLGPILNMYLTMFKNGAELIMMAFGTTGLIFLGLSVVAMSPARNFNRLGSFCAIGAIVALVALVINIFLQLPALALVISLVFAFISGGFILWQTNAIVRGEETNYILATVNIYVSLFNIFVTLLQIFGAVAGDRE

SEQ ID NO: 58818 - DNA, 705 bp, Ehrlichia ruminantium str. Welgevonden
  CDS (1)..(705)
atggacaattacagtagtgtacgttttcaaagtgattactatagtgtaggacttaggaattatttgatgaaagtatataattatatggctatggctttaggtttaacaggcttggttgcattttttgtatcttcgtctagttatgctgttaatattatatataatactccattgcattgggtaataatgttttctccaatagtacttgtttttttaatgtcatataagttgagtacttttagttttcaaactgtcctagtagtattttttagttttgctgctttgatgggggcatctatatcttccatatttttgatatatacggctgctagtattacaaaagtattttttatttcttcatctatgtttggtgctatggcgtggtatggtaatgttacgaagaaggatttatctcagtttcagtcatttttgattatgggtattataggggtaattattgcttctttagttaatttatttttgcataatggtccattagattttgctatttcctttattgctgttattttgtttactggtatgactgcttgtgatgctcaaagaataaaggatatgtattatagatttaatgatggtaatagtgtatctcttaataagatggctgtattgggtgcaactaccttatactttaattacattaatatctttctaagcttactaaacttgcaaggtgagcgtaggtaa

SEQ ID NO: 58819 - protein, 234 aa, Ehrlichia ruminantium str. Welgevonden
MDNYSSVRFQSDYYSVGLRNYLMKVYNYMAMALGLTGLVAFFVSSSSYAVNIIYNTPLHWVIMFSPIVLVFLMSYKLSTFSFQTVLVVFFSFAALMGASISSIFLIYTAASITKVFFISSSMFGAMAWYGNVTKKDLSQFQSFLIMGIIGVIIASLVNLFLHNGPLDFAISFIAVILFTGMTACDAQRIKDMYYRFNDGNSVSLNKMAVLGATTLYFNYINIFLSLLNLQGERR

SEQ ID NO: 58820 - DNA, 714 bp, Rhodobacter sphaeroides 2.4.1
  CDS (1)..(714)
atgaatcccgcccctcacggccgcagcgccggtttcgcgcgctccaccgctgtctatgacgacggcctgcgcgcgcatatgctgcgcatctacaactacatgggcctcgggctcgcgctgacgggcctcgtggccgtcctcgtcgcggccacccccgccatctatgtgccgatcttctcgaccccgctgaaatgggtcgtgatgctggcgccgctcgccttcgtcctgttcctgtccttccgcatcgaggccatctcggcgggcaccgcgcagatgctcttctgggccttctgcggtgtcatgggcctgtcgctcgcctcgatcttcctcgtcttcaccggcacctcgatcgcgcgcgccttcttcggggcggcggccatgttcgccggcatgagcctctacggctacacgaccaagcgcgacctgagccagttcggcagcttcctgatgatgggcctgatcggcgtcatcctggccagcgtcatcaacctcttcctcggctcgtccgcgctgcagttcgcgatctcgatcatcggcatcctcgtcttcgtcggtctgacggcctgggacacgcaggcgatcaagctgcaatatgccgagcatcaggacagcgagacctcgcagaagctcgccgtcatgggggccctgtcgctctacctgaacttcatcaacatcttccagctcctgctctcgctgacgggcgagcgcgagtaa

SEQ ID NO: 58821 - protein, 237 aa, Rhodobacter sphaeroides 2.4.1
MNPAPHGRSAGFARSTAVYDDGLRAHMLRIYNYMGLGLALTGLVAVLVAATPAIYVPIFSTPLKWVVMLAPLAFVLFLSFRIEAISAGTAQMLFWAFCGVMGLSLASIFLVFTGTSIARAFFGAAAMFAGMSLYGYTTKRDLSQFGSFLMMGLIGVILASVINLFLGSSALQFAISIIGILVFVGLTAWDTQAIKLQYAEHQDSETSQKLAVMGALSLYLNFINIFQLLLSLTGERE

SEQ ID NO: 58822 - DNA, 732 bp, Lactobacillus gasseri
  CDS (1)..(732)
atgaaagagggagagcttatgaataacttttcacaagaaccagaacgtcgcacaatcgttgacgtaactggcttaaatagattcttaagcagaatgtacggcatgatgacaatcgccgttttagtttctgctttaagtgcttacttaacgatgactgtctttagaactcaagtaatgaccttatttgctagcaacccagcaatgacttggattttattgttagttccacttgcattaacttttggaattagctttagagcaacaagaaatccggtagctagtttcgtcatgttaatgattatggcaattgtttacggagttgaattttccttaattgctggtgcctatactggccgcagcattgcttctgcattcgttgcttcatctactgttttcattactatggcagtaattggtacaactactaagaagaacttaaataatcttggctcttatgcttctgctgccttgattggtttaattgttgcaatgcttatcaacatgttcttaagaaatccaatggtttcttacatcttttcatttatcgcagttattatctttactattttaactgcttgggatgcacaaagaatgaaacaaatttacgaaaactatggtggtcaagtttcagttgatggtttggctgttgcaggtgctttagcactttacctagacttcgttaacttgttcttacagttcttacaaatctttggatttagcgacagaaattaa

SEQ ID NO: 58823 - protein, 243 aa, Lactobacillus gasseri
MKEGELMNNFSQEPERRTIVDVTGLNRFLSRMYGMMTIAVLVSALSAYLTMTVFRTQVMTLFASNPAMTWILLLVPLALTFGISFRATRNPVASFVMLMIMAIVYGVEFSLIAGAYTGRSIASAFVASSTVFITMAVIGTTTKKNLNNLGSYASAALIGLIVAMLINMFLRNPMVSYIFSFIAVIIFTILTAWDAQRMKQIYENYGGQVSVDGLAVAGALALYLDFVNLFLQFLQIFGFSDRN

SEQ ID NO: 58824 - DNA, 768 bp, Magnetospirillum magnetotacticum MS-1
  CDS (1)..(768)
atggcattcgacaacagcccgttccgctacggcgcccagccgcaggggtacgccggctctcaggtcgaagtcgaccagggcctgcgcagcttcatgctgggcgtctataacaacatggtcgtcggcctcgggatctcgggtctcgtggcgctcggcctcaacatggccgccgtggcgcagaccggcgccgggcgcctcgccctgaccccgttcgggcagttcctctacaccagccccttcaagtgggtgctgatgctggcaccgctcgccttcatcttcgtgttctcgttccggatggatcggatgtcggcggcgtcggcgcgcacgatgttctgggccttcgcggcggtgatgggcgcgtcgatgtccaccctgctgctcgtgttcacgggcgccagcgtggtgcgggtgttcttcatcacggcggcgaccttcggcggcctgagcctctacggctacaccacgaagcgcagcctgtcgggcatgggctcgttcctgatcatgggcctgatcggcctgatcatcgcctcgctggtcaacatcttcctggcgtcctcggcgctgcagttcgcgatctcggtgatcggcgtgctgatcttcgccggcctgaccgcctacgacacgcagaagctcaaggagatgtacctctacagcggcctcgacgccgagggcgctgccaagatgtccgtcaacggcgccctgacgctgtacctggacttcatcaacatgttccagttcctgctctcgctgctcggcgaccgccgctaa

SEQ ID NO: 58825 - protein, 255 aa, Magnetospirillum magnetotacticum MS-1
MAFDNSPFRYGAQPQGYAGSQVEVDQGLRSFMLGVYNNMVVGLGISGLVALGLNMAAVAQTGAGRLALTPFGQFLYTSPFKWVLMLAPLAFIFVFSFRMDRMSAASARTMFWAFAAVMGASMSTLLLVFTGASVVRVFFITAATFGGLSLYGYTTKRSLSGMGSFLIMGLIGLIIASLVNIFLASSALQFAISVIGVLIFAGLTAYDTQKLKEMYLYSGLDAEGAAKMSVNGALTLYLDFINMFQFLLSLLGDRR

SEQ ID NO: 58826 - DNA, 696 bp, Magnetospirillum magnetotacticum MS-1
  CDS (1)..(696)
atgagtgccgcccaggcggaggcgtctcagatcgacgtgggtctgcggcagtacatgctgagtgtgtacaactacatggcctcggccctggctctcaccggcatcgtcgcctgggtgatcgccagcgttcctgccctgaccgccatcgccgtctactcgccactcaaatgggtgttcatgctggctccgctgggtctggtgttcttcatgagcgccaagatcgacagcatgcgcgcttcgaccgcctcgaccctgttctgggtctatgccggtctgatgggtgcttcgctggcttcggtgttcctggtgttcaccggcgcctcggtggcccgcgtgttcttcatcaccgcggcggccttcgcgggcctcagcctctatggctacaccaccaagaaggacctgtcgggcttcggcagcttcctgatcatgggcgtgtggggcctgatgatcgccggcatcgtcaacatcttcctggccagccccatgctgcacttcgtgatgagtgccgcgggcgtgctgatcttcgcgggtctcaccgcctacgacacccagaacatcaagcagatgtactgggagggcgacgacagcgaagtcgcctcgaagaaggcggtgttcggcgccttgcagctctacatggacttcatcaatctgttcatgttcttgctgcagttcatgggcgtgcgccgcgacgagtag

SEQ ID NO: 58827 - protein, 231 aa, Magnetospirillum magnetotacticum MS-1
MSAAQAEASQIDVGLRQYMLSVYNYMASALALTGIVAWVIASVPALTAIAVYSPLKWVFMLAPLGLVFFMSAKIDSMRASTASTLFWVYAGLMGASLASVFLVFTGASVARVFFITAAAFAGLSLYGYTTKKDLSGFGSFLIMGVWGLMIAGIVNIFLASPMLHFVMSAAGVLIFAGLTAYDTQNIKQMYWEGDDSEVASKKAVFGALQLYMDFINLFMFLLQFMGVRRDE

SEQ ID NO: 58828 - DNA, 720 bp, Leuconostoc mesenteroides subsp. mesenteroides ATCC 8293
  CDS (1)..(720)
atggataattttaatatgaacgcccgtcgtgatgtgacgggtgtagatgagggaatgcgcgcattctttaaacagacatatagctttatgggtatagcagttttacttaccgcagtgacaggctttatagtacaaaacttttttttggaacaagttgctaagttgcttgtaggtaatgttattggtcttttggcactgttgggtattcagatgttgattataacgatgattggtcgtgcaacttttaaaaatcctgctcgtgcttttggcttgttgatggcttttgcagtggttgaaggcttgacgcttggtgtcttgttagctgtttatacaggagcttctgtggtgatggctttcgtttctgcatccgcggttttcggtggaatggcagcttatggtgttttcacaaaacgtgatttgacgggactaggttcgattttgtttggtctgttaattggtttgctgatagcatcaattgctaatatgtttttctatagtggaatcgtttcgctattgctctcatgggctagtgtcgttgtcttttccttatttacagcatatgataatcagaacttgaaggtaatgtattcacaatttgctggtcaagcagatacaacaggacttgcagtaaatggcgccttgagattatacctagactttgtcaatattttcttcgcgctgttacgcatcttcggtgttgttagtggctcacgcgactaa

SEQ ID NO: 58829 - protein, 239 aa, Leuconostoc mesenteroides subsp. mesenteroides ATCC 8293
MDNFNMNARRDVTGVDEGMRAFFKQTYSFMGIAVLLTAVTGFIVQNFFLEQVAKLLVGNVIGLLALLGIQMLIITMIGRATFKNPARAFGLLMAFAVVEGLTLGVLLAVYTGASVVMAFVSASAVFGGMAAYGVFTKRDLTGLGSILFGLLIGLLIASIANMFFYSGIVSLLLSWASVVVFSLFTAYDNQNLKVMYSQFAGQADTTGLAVNGALRLYLDFVNIFFALLRIFGVVSGSRD

SEQ ID NO: 58830 - DNA, 672 bp, Azotobacter vinelandii
  CDS (1)..(672)
atgcacgaacccaacagttatgcacttcaatccgcccaggcggagcaactggaagtcagccgcgtcctgcgcaacacctacggtctgctggccctgaccctcggcttcagcggcctggtggcctacgtggcgcagcagatgcgcctgccctacccgaacatcttcgtggtcctgattggcttctacggcctgttcttcctcaccgtgaagctgcgcgactcggcctggggcctgctctcgacgttcgccctgaccggcttcatgggctacaccctgggcccgatcctcaaccactacatcggcatgcccaacggcggcgaagtggtgtcctcggccttcgccatgaccgccttggtgttcggtggcctgtccgcctacgtgctgaccacccgcaaggacatgagcttcctcagcggcttcatcaccgtcggcttcttcgtcctgctcggcgccagcctggccggcctgttcttcgagatcagcggcctgcaactggcgatcagcgccggcttcgtgctgttctcctcggcctgcatcctgttccagaccagcgccatcatccatggcggggagcgcaactacatcatggcgacgatcggcctgtacgtgtcgatctacaacctgttcgtcagcctgctgcagatcctcggcatcatgggcagcgacgactga

SEQ ID NO: 58831 - protein, 223 aa, Azotobacter vinelandii
MHEPNSYALQSAQAEQLEVSRVLRNTYGLLALTLGFSGLVAYVAQQMRLPYPNIFVVLIGFYGLFFLTVKLRDSAWGLLSTFALTGFMGYTLGPILNHYIGMPNGGEVVSSAFAMTALVFGGLSAYVLTTRKDMSFLSGFITVGFFVLLGASLAGLFFEISGLQLAISAGFVLFSSACILFQTSAIIHGGERNYIMATIGLYVSIYNLFVSLLQILGIMGSDD

SEQ ID NO: 58832 - DNA, 702 bp, Desulfovibrio desulfuricans G20
  CDS (1)..(702)
atgttgagaaccgcccagcgcagccagagccgtactgaagtcgtcaatgccttcatgcgcggcgtgtaccagtggatggcggcaggactggccgtaacagccgtatccgcttttgcggtggccagcagccccgcgctgctgcagcttattttcggcacccccatgctgcctcttgtgcttatgatcggccttgtggggctggtgttttatatgtcggcccgcatcggcaccatgtctgcaggcacggcaaccacgctgtttatggtgtacagcgcgctgaacggcgttgtgctctccagcgtgctcattgtttatgccacagcttcggtttttcaggcttttgtcaccgcggcggccatgttcggcgccatgacggtgtatggcatgaccaccaaacgcgaccttacatccatgggcagcttcatgttcatggggcttatcggtattcttatcgcctcggtggttaatatcttcctcggcagctccatgatggagctggttatcagcgccatcggcgtcattgtgtttaccgggcttaccgcgtacgatagccagcagctgcgccagatgggtgaaaccgctcccatggatgatccggtggccatacgccgcggaaccattcttggcgcgttgcggttgtaccttgattttatcaacctgttcctgatgcttctcaggctcttcggcggagcacgggattaa

SEQ ID NO: 58833 - protein, 233 aa, Desulfovibrio desulfuricans G20
MLRTAQRSQSRTEVVNAFMRGVYQWMAAGLAVTAVSAFAVASSPALLQLIFGTPMLPLVLMIGLVGLVFYMSARIGTMSAGTATTLFMVYSALNGVVLSSVLIVYATASVFQAFVTAAAMFGAMTVYGMTTKRDLTSMGSFMFMGLIGILIASVVNIFLGSSMMELVISAIGVIVFTGLTAYDSQQLRQMGETAPMDDPVAIRRGTILGALRLYLDFINLFLMLLRLFGGARD

SEQ ID NO: 58834 - DNA, 711 bp, Rickettsia sibirica 246
  CDS (1)..(711)
atgatcgattatacaaaaactttaactgccgcctcaaaaaataaaacttttgatgaaggcttaagacaatacatgcttaaagtatataattatatggctttagcacttttactaaccggtgtagcagccgtaacgactatatcagttgagcctatttataatttaatgtttcaaacaggtttcggtactattataatgtttgctccgctcggtattgctttatatttctttatgggctttggacaaatgaacctgccaacggcacaaatattattttgggtttatgccggtttaaccggtatgtcgcttgcatatttagctcttatttataccggtgcatcaatagctcgtactttctttatttgctcttccgtttttggagcaatgagtttatacggttatagcacaagtagagatttaacatctatgggttcattttttgcaatgggtcttataggtcttatcattgcttcattagtcaacttgtttctaaaaagctcggctctttcttttgctacttctcttattggaatagtaatatttatgggattaattgcttgggatactcaaaagattaagtctatgtattacatggcaggaaacgatgaagtaggacaaaagctttctattatggcagcctttactttatatttagattttataaatcttttcctatatttaatgagatttttaggcaatagaagagattaa

SEQ ID NO: 58835 - protein, 236 aa, Rickettsia sibirica 246
MIDYTKTLTAASKNKTFDEGLRQYMLKVYNYMALALLLTGVAAVTTISVEPIYNLMFQTGFGTIIMFAPLGIALYFFMGFGQMNLPTAQILFWVYAGLTGMSLAYLALIYTGASIARTFFICSSVFGAMSLYGYSTSRDLTSMGSFFAMGLIGLIIASLVNLFLKSSALSFATSLIGIVIFMGLIAWDTQKIKSMYYMAGNDEVGQKLSIMAAFTLYLDFINLFLYLMRFLGNRRD

SEQ ID NO: 58836 - DNA, 693 bp, Dechloromonas aromatica RCB
  CDS (1)..(693)
atgaacaccaacttcgagattgccaaccagggctcttcggggcttgcactgcagcagaaccgcgttctgcgcaatacctacatgctactcggcctgtccatggtgccgacggttatcggcgcactggtcggcatccagatgggattcagcttcctggcgggcagccctctcatgtctttcctgctcttcatgggcatcgccatgggcttcatgtggggcattgagaaaaacaaggacagcggcctgggtgtcgccctgctgctcggctttaccttcttcatgggcctgatgctgtcgcgcatcctgcaagtcgcgctaggtttctccaatggcggctcgatgattgccatggcggcaggcggcacgggtgccgtgttcttcacgatgtcgaccgtcgccgctgtcagcaagcgggatttcaccggcatgggaaaattcctgttcgtcggcatgatcgtcattttgctcgctgccgttgcgaacatcttcttccagattcctgcgctgtcgctgaccattgccgtcgcagtcgttggcatcttctcggcttatatcctgtacgacatcagccgtatcgtccaaggcggcgaaaccaactacgtcagtgccaccctggcggtctatctggacgtatacaacgtattcgtcagcctactgcagctgatcatggcgttcaccggcgagcgcgactga

SEQ ID NO: 58837 - protein, 230 aa, Dechloromonas aromatica RCB
MNTNFEIANQGSSGLALQQNRVLRNTYMLLGLSMVPTVIGALVGIQMGFSFLAGSPLMSFLLFMGIAMGFMWGIEKNKDSGLGVALLLGFTFFMGLMLSRILQVALGFSNGGSMIAMAAGGTGAVFFTMSTVAAVSKRDFTGMGKFLFVGMIVILLAAVANIFFQIPALSLTIAVAVVGIFSAYILYDISRIVQGGETNYVSATLAVYLDVYNVFVSLLQLIMAFTGERD

SEQ ID NO: 58838 - DNA, 711 bp, Rickettsia rickettsii
  CDS (1)..(711)
atgatcgattatacaaaaactttaactgccgcctcaaaaaataaaacttttgacgaaggcttaagacaatacatgcttaaagtatataattatatggctttagcacttttactaaccggtgtagcagccgtaacgactatatcagttgagcctatttataatttaatgtttcaaacaggtttcggtactattataatgtttgctccgctcggtattgctttatatttctttatgggctttggacaaatgaacctgcaaacggcacaaatattattttgggtttatgccggtttaaccggtatgtcgcttgcatatttagctcttatttataccggtgcatcaatagctcgtactttctttatttgctcttccgtttttggagcaatgagtttatacggttatagtacaagtagagatttaacatctatgggttcattttttgcaatgggtcttataggtcttatcattgcttcattagtcaacttgtttctaaaaagctcggctctttcttttgctacctctcttattggaatagtaatatttatgggattaattgcttgggatactcaaaagattaagtctatgtattacatggcaggaaacgatgaagtaggacaaaagctttctattatggcagcctttactttatatttagattttataaatcttttcctatatttaatgagatttttaggcaatagaagagattaa

SEQ ID NO: 58839 - protein, 236 aa, Rickettsia rickettsii
MIDYTKTLTAASKNKTFDEGLRQYMLKVYNYMALALLLTGVAAVTTISVEPIYNLMFQTGFGTIIMFAPLGIALYFFMGFGQMNLQTAQILFWVYAGLTGMSLAYLALIYTGASIARTFFICSSVFGAMSLYGYSTSRDLTSMGSFFAMGLIGLIIASLVNLFLKSSALSFATSLIGIVIFMGLIAWDTQKIKSMYYMAGNDEVGQKLSIMAAFTLYLDFINLFLYLMRFLGNRRD

SEQ ID NO: 58840 - DNA, 702 bp, Ralstonia eutropha JMP134
  CDS (1)..(702)
atggataacaagctgaacacctacggtttcggcaatgcgtcgacggtcagcgatgtcgtcgtgcgtaatcgggtattgcgcaacacctactggctgctcgccatttcgatgatcccgaccgtgctcggcgcatggatcggcgtggccacgggcttcagcttcatggccggcagccccggcttgtcgctgatcctgttcctcggcatcgcattcgcgttcttctacggcatcgagaagaccaagaacagcagcatgggcgtggtcctgctgctcgccttcacgttcttcatgggcctgatgctgtcgcgcctgatcggcgcggtgctgcagttctcgaatgggccggcgctgatcatgtatgcctttggcggcacagcggcggtgtttggcgccatggctaccattgcgacggtcagcaagcgtgatttctcgggcctcagcaagttcctgttcgtcggcctgattctgctgattctggcgagcgtggccaatatctggctgcaacttccgtcgctgatgatcacggtgtcggtgatcgccatcggcattttctcggcgtacatcctgttcgatgtgcagcgcgtggtaaatggcggcgaaaccaactacatcacggccacgctggcgatctacctcgacgtctacaacgttttcacgaacctgctggccctgctgggcatcttcggcggcagccgcgactga

SEQ ID NO: 58841 - protein, 233 aa, Ralstonia eutropha JMP134
MDNKLNTYGFGNASTVSDVVVRNRVLRNTYWLLAISMIPTVLGAWIGVATGFSFMAGSPGLSLILFLGIAFAFFYGIEKTKNSSMGVVLLLAFTFFMGLMLSRLIGAVLQFSNGPALIMYAFGGTAAVFGAMATIATVSKRDFSGLSKFLFVGLILLILASVANIWLQLPSLMITVSVIAIGIFSAYILFDVQRVVNGGETNYITATLAIYLDVYNVFTNLLALLGIFGGSRD

SEQ ID NO: 58842 - DNA, 606 bp, Methylobacillus flagellatus KT
  CDS (1)..(606)
atgcaaacgaattatcaagtcgccaatacgcaagcgttgccggcgggcgcgcataaagtattgcgtaacacttacatgatgctgggcctgaccatggtgccgaccgtgatcggcgcgctgattggcatgtccatgaatttctcgtggatggctgccagcccgatcatgtcctccctcatcatgctggccgtgatgttcgggctgttctttgccatttctgcaaaccgtaacaatagctttggagtcgtgctgctgtttggcctgacattcttcatgggcctgatgcttggccctatcctgcaggtggcattgaacctgcgtaatggtggtcagctggttggcttggctgcaggcggcactggcctgatcctgctgatcgttgcgtcactggctaacctgttcttccaggtgcctgctgcttcgctggcgatctctgcagtggcagtgctgctgttctccggcttcatcctgtacgatgtgaaccgcatcgtgcgtggaggggaaaccaattacattatggctaccctgtcactgtacatcagcatttatcagctgttcgtcaatttgctgcagttgctgatggcgttcatgggcgagcgtgactga

SEQ ID NO: 58843 - protein, 201 aa, Methylobacillus flagellatus KT
MQTNYQVANTQALPAGAHKVLRNTYMMLGLTMVPTVIGALIGMSMNFSWMAASPIMSSLIMLAVMFGLFFAISANRNNSFGVVLLFGLTFFMGLMLGPILQVALNLRNGGQLVGLAAGGTGLILLIVASLANLFFQVPAASLAISAVAVLLFSGFILYDVNRIVRGGETNYIMATLSLYISIYQLFVNLLQLLMAFMGERD

SEQ ID NO: 58844 - DNA, 645 bp, Exiguobacterium sp. 255-15
  CDS (1)..(645)
atggctcaagtctatggctggatgaccgttggcttgttgctgaccgcatttgttgcctggtatgcggctaattccgcggccgtgatggagctgttgttcactaaccgtgtctttttaatcggtctgatcatcgcgcaattagcattggttattgtgttatcagcgatgattcaaaagctgagcgcaggtgtaacgacgatgctctttatgctttattcggcgctgacgggtcttacgctttccagtatattcattgtctataccgctgcttctatcgccagtactttcgtcgttactgccgggatgttcggcgcaatgagcctgtacggttacaccacgaagcgcgatttaagtggctttggcaatatgctgtttatggcgttaatcggcattgtgctggcatcgctggtcaacttctggttgaaaagcgaagcattgatgtgggcagttacctacatcggcgtgattgtctttgtcggattgacggcgtatgacacgcagaaactgaaaaatatgggtgagcagattgatacccgcgacacgtcgaacctgcgcaaatattccattcttggcgcgttaaccttgtatctggacttcatcaacctgttcctgatgttgttgcggatcttcggcaaccgccgttaa

SEQ ID NO: 58845 - protein, 214 aa, Exiguobacterium sp. 255-15
MAQVYGWMTVGLLLTAFVAWYAANSAAVMELLFTNRVFLIGLIIAQLALVIVLSAMIQKLSAGVTTMLFMLYSALTGLTLSSIFIVYTAASIASTFVVTAGMFGAMSLYGYTTKRDLSGFGNMLFMALIGIVLASLVNFWLKSEALMWAVTYIGVIVFVGLTAYDTQKLKNMGEQIDTRDTSNLRKYSILGALTLYLDFINLFLMLLRIFGNRR

SEQ ID NO: 58846 - DNA, 705 bp, Ehrlichia canis str. Jake
  CDS (1)..(705)
atggataattacagtaatgtacgttttcaaagtgcttactatagtgttggtctgaggaattatctagtgaaagtatataactacatggctatggctttaggattaactggtatagtggcgttttttgtttcttcatcttccgctcttatgtctgcgatatataatactcctttacactgggtagttatgtttgctcctatagggttagtttttttaatgtcgtataaattaaatgttttcagttttcaaactgtactgacggtattttttagctttgcagcattgatgggtgtttccatttcttatatatttctagtgtatacttcagcaagtattgcaaaggtgttttttatatcatcttctatgtttggtatcatggcctggtatggcaatgttaccaagaaggatttgtctcaatttggaacgttcttatttatgggacttgtgggaatagttcttgcttctttagttaatttatttttgcatagtggcccattgcattttgctatatcaattgttgcagtagttttatttactggtatgactgcatatgatgctcaaagaattaaagatgtgtactataagttcaatgatggaactgatgtttctgtcaataaaatggctatattaggtgcaactactttatactttaattatgttaatatatttttaagcttattgaatctacaaggtgaacgtagatag

SEQ ID NO: 58847 - protein, 234 aa, Ehrlichia canis str. Jake
MDNYSNVRFQSAYYSVGLRNYLVKVYNYMAMALGLTGIVAFFVSSSSALMSAIYNTPLHWVVMFAPIGLVFLMSYKLNVFSFQTVLTVFFSFAALMGVSISYIFLVYTSASIAKVFFISSSMFGIMAWYGNVTKKDLSQFGTFLFMGLVGIVLASLVNLFLHSGPLHFAISIVAVVLFTGMTAYDAQRIKDVYYKFNDGTDVSVNKMAILGATTLYFNYVNIFLSLLNLQGERR

SEQ ID NO: 58848 - DNA, 699 bp, Burkholderia cepacia R18194
  CDS (1)..(699)
atgaacgactatccgtacaatttcggccgcggcggttccgtcagcaccgccgaggttcgcaaccgcgtgctgcggaacacgtactggctgctcgcgctgtcgatggtgccgactgtgctgggcgcctgggtcggcgtcgcgacgggcttctcgctgttcgcggccacgagcccgatgatgagcctgctcgcgttcttcgcgatcgcgttcggcttcatgttcgcgatcgagcggaccaaaaacagctcggtcggcgtgttcgtgctgctcggcttcacgttcttcatgggcctgatgctgtcgcggctgctgagcttcatcctcggcttctcgaacggcccgtcgctgatcatgctcgcgttcggcggcaccggcatcatcttcgccacgatggcaacgatcgccaccgtcagcaagcgcgacttctcggggctcggcaagtggctgttcatgggcgtgatcgtgatcctgctcgcatcggtcgcgaacatcttcctgcaactcccggcgctgatgctcaccgtgtcggtgctcgcgatcgcgatcttctccgcctacatgctgttcgacgtccagcgcgtcgtgaacggcggcgagacgaactacatctcggccacgctcgcgatctacctcgacctgtacaacgtgttcacgaacctgctcgcgctgctcggcatcttcggcggcaaccgcaactga

SEQ ID NO: 58849 - protein, 232 aa, Burkholderia cepacia R18194
MNDYPYNFGRGGSVSTAEVRNRVLRNTYWLLALSMVPTVLGAWVGVATGFSLFAATSPMMSLLAFFAIAFGFMFAIERTKNSSVGVFVLLGFTFFMGLMLSRLLSFILGFSNGPSLIMLAFGGTGIIFATMATIATVSKRDFSGLGKWLFMGVIVILLASVANIFLQLPALMLTVSVLAIAIFSAYMLFDVQRVVNGGETNYISATLAIYLDLYNVFTNLLALLGIFGGNRN

SEQ ID NO: 58850 - DNA, 831 bp, Burkholderia cepacia R1808
  CDS (1)..(831)
ttggacgcccggtcgaccgcttttttcgagcagcccgaccaacttgccgcgacgggctggccggcgttcgatggcaacgcgcggccgcgcgcttcggagcttttcgcggccaccgacgcgctggccgacgcggaccccaactggacgctgagcgcgctcgagagtcggcccggcgccgggctcacgcggcgcgcgttcgtgagccagacgcttgccttcctggccgcgagcgtcggcatcacagcggcctgcgcgacctacgtcgccatgctgggcctgccggtcggggattcgatcgtgtgcatgctcgcaggattgttcaccctgtcgggactgctcggcgcgaacgctctcggacgacgcgtctcgaagtggctgtcgctcccgctgatggggcttttctccgtcctccagggcgtcgcggtcggcccgattgtgcatggctattggatgcaagcgggcggggcgttgatcgtcgccggcgcgctggcgacgacggccatcgcgttcgccgcgatcggcgtctacgcgttcggcacgcgacacgcgcgcagggacttcaccgctctgggcggctttctgttcgcgggggctatcgtcgcgctgtcgctctcgatcgcgacgttctacgtctcggctcctggccttgaattcgcgcttgcgggcgttggcgccatggtcttcacgggctacctcttgcacgacctctcgcgtctctggacggccggccaagatgacccagtcatcgcggcgttggggctctacatcaacgtgctcaacgtgtttctctcgctgctgcgcctcttcgagtttttcgtctccggcgattaa

SEQ ID NO: 58851 - protein, 276 aa, Burkholderia cepacia R1808
MDARSTAFFEQPDQLAATGWPAFDGNARPRASELFAATDALADADPNWTLSALESRPGAGLTRRAFVSQTLAFLAASVGITAACATYVAMLGLPVGDSIVCMLAGLFTLSGLLGANALGRRVSKWLSLPLMGLFSVLQGVAVGPIVHGYWMQAGGALIVAGALATTAIAFAAIGVYAFGTRHARRDFTALGGFLFAGAIVALSLSIATFYVSAPGLEFALAGVGAMVFTGYLLHDLSRLWTAGQDDPVIAALGLYINVLNVFLSLLRLFEFFVSGD

SEQ ID NO: 58852 - DNA, 696 bp, Rubrivivax gelatinosus PM1
  CDS (1)..(696)
atgaacgacaccctgcaaaccgcctaccccggctcggccgccgtcggcggcgagcgcaatcgcgtcctgcgcaacacgtactggctgctggcgctgtcgctggtgccgaccgtgctgggtgcctgggtgggggtcgcgaccggcttcagcttcttcgccggcagccccttcatcggcttcctgctgttcatgggcatcgcgttcggcttcttcttcgcgatcgagaagttcaagaactccggcatcggcgtcgcgctgttactgggcttcaccttcttcatgggcctgatgctgtcgcgcctgatcggtggcgtgctgggcaactacagcaacggcgccaccctgatcggcatggccttcggcggcaccgcgctggtgttcttcggcatggccacgctggcgaccaccatcaagcgagacctgtccgggctgggcaagtggttgatggtgggtgtgatcggcctgatcgtggccagcgtcgccaacatctggctgcagatgccggcgctgttcctgacggtctcggtgctcgccatcgtgatcttctcggcgttcatgctgtacgacatcaagcgcgtgatcgatggcggcgaaacgaactacgtgaccgcgacgctggccatctaccttgacgtctacaacgtgttccagagcctgctgagcctgctgggcatcttcggcggcgaacgcgagtaa

SEQ ID NO: 58853 - protein, 231 aa, Rubrivivax gelatinosus PM1
MNDTLQTAYPGSAAVGGERNRVLRNTYWLLALSLVPTVLGAWVGVATGFSFFAGSPFIGFLLFMGIAFGFFFAIEKFKNSGIGVALLLGFTFFMGLMLSRLIGGVLGNYSNGATLIGMAFGGTALVFFGMATLATTIKRDLSGLGKWLMVGVIGLIVASVANIWLQMPALFLTVSVLAIVIFSAFMLYDIKRVIDGGETNYVTATLAIYLDVYNVFQSLLSLLGIFGGERE

SEQ ID NO: 58854 - DNA, 609 bp, Rubrivivax gelatinosus PM1
  CDS (1)..(609)
atgctgcgcaacacatacgccttgctgtcgatgacgttgctgttcagcgcggccatcgctgctgccagcgtgacgttccagctgccggcgccgggcatcctgctgaccctgggcggctacttcggcctgctctttgctgtctacaagttcaagaacagcggctgggccttgccggctgtgtttgcgctgacgggcttcatgggctactccctggggccggtgttggccaagtcgctggcactgcccggcggtgcacaggtcgtgacgatggccctggcggccacgggcgccaccttcctggccttgtcggcctgggtcttgacgacccgtcgcgacttcagcttcatgggcggcttcctgttcgccggcatggtcatcgcgctgattgccggcctgggcgcggtgttcctgcaggttccggcgctgggcctggccgtcgccgcgatggtggcgctgctgtcggccggcctgatcctgtacgagaccagtcgcatcgtcaccggtggcgaaaccaactacgtgctggccaccgtcgggctgtacgtctcgatcttcaacctgttcacgagtctgctcagcctgttcggcttcggcaactcggatgaatga

SEQ ID NO: 58855 - protein, 202 aa, Rubrivivax gelatinosus PM1
MLRNTYALLSMTLLFSAAIAAASVTFQLPAPGILLTLGGYFGLLFAVYKFKNSGWALPAVFALTGFMGYSLGPVLAKSLALPGGAQVVTMALAATGATFLALSAWVLTTRRDFSFMGGFLFAGMVIALIAGLGAVFLQVPALGLAVAAMVALLSAGLILYETSRIVTGGETNYVLATVGLYVSIFNLFTSLLSLFGFGNSDE

SEQ ID NO: 58856 - DNA, 753 bp, Rhodospirillum rubrum
  CDS (1)..(753)
atggtctacgacgtcagacgtgagcatctgtcacgcggccaggccggggtcgcgacggacgcccaggtggatgccggccttcgtacttacatgctgcgtgtgtacaactacctggcatcggggctcgccttgtcgggcgtcatcgccatgtcggtggtctacacgccgctcagcgccgccttttatcaggtctcgcccgaagggcagctgatgggcctgaacatgctgggcatgatcgcggtcttcgcgccgctcggcctgctgttcctggcgatgttcgccgctcagaaaatgagcgccgcggcctcgcagatgttctattgggccttcgtcgccctgcagggcgtcagcctgtcgacccttctgctggtttacaccggcgaaagcatcgtgcgggtgttcttcatcaccgccggtaccttcgccgcgctcagcctttatggctatacgaccaagcgcgaccttgccggctttggcaagttcctgttcatggggttgatcggcatgcttctggctgccgtggtcaatatcttcctgggcagcagcatgctgcagttcgtggtttccgcggttggcgttctggtgttctcggggttgatcgcctatgacacccaggccatcaaggagcgttattacgacggtcttggccgcgacagcgaaaccaagatggcggtgttcagcgctctcgccctctatctgaacttcatcaacctgttgcagttcctgctctacttcctgggtaaccgcgagtag

SEQ ID NO: 58857 - protein, 250 aa, Rhodospirillum rubrum
MVYDVRREHLSRGQAGVATDAQVDAGLRTYMLRVYNYLASGLALSGVIAMSVVYTPLSAAFYQVSPEGQLMGLNMLGMIAVFAPLGLLFLAMFAAQKMSAAASQMFYWAFVALQGVSLSTLLLVYTGESIVRVFFITAGTFAALSLYGYTTKRDLAGFGKFLFMGLIGMLLAAVVNIFLGSSMLQFVVSAVGVLVFSGLIAYDTQAIKERYYDGLGRDSETKMAVFSALALYLNFINLLQFLLYFLGNRE

SEQ ID NO: 58858 - DNA, 708 bp, Ralstonia metallidurans CH34
  CDS (1)..(708)
atgaacaacaagctgaatacctatgggttcggcaatagtgctgcgagcgtcactgatgtagccgtccgcaaccgggtccttcgtaatacttactggctgctggccatttcgatgattccaaccgtgatcggcgcctggatcggcgtggtcactggtttcaccgcgatgatcgctggcagcccgatgatgtcggccgtgctgttcctcgcggtcgccttcggcttcatgttcgccatcgagaagaccaagaacagcggcatgggcgtggtcctgctgctggccttcaccttcttcatgggtctgatgctggcacgcatcctcagcttcacgctgtcgttctcgaacggccccgcgctgatcatgtacgcctttggcggtaccgcagcggttttcggcgtgatggccaccattgccagcgtgagcaagcgtgatttctccggcttggccaagttcctgttcgtcggcgtgatcctgctgatcctggccagcctggccaacatctggctgcaactgccggcgctgatgatcacgctgtcggtgatcgccatcggcatcttctcggcgttcatcctggtggacgtgcagcgcgtggtgaatggcggcgaaaccaactacgtgaccgccacgctcgcgatctacctggacgtgtacaacgtgttcgtgaacctgctggccctgctcggcatcgcaggcggcagccgcgactga

SEQ ID NO: 58859 - protein, 235 aa, Ralstonia metallidurans CH34
MNNKLNTYGFGNSAASVTDVAVRNRVLRNTYWLLAISMIPTVIGAWIGVVTGFTAMIAGSPMMSAVLFLAVAFGFMFAIEKTKNSGMGVVLLLAFTFFMGLMLARILSFTLSFSNGPALIMYAFGGTAAVFGVMATIASVSKRDFSGLAKFLFVGVILLILASLANIWLQLPALMITLSVIAIGIFSAFILVDVQRVVNGGETNYVTATLAIYLDVYNVFVNLLALLGIAGGSRD

SEQ ID NO: 58860 - DNA, 699 bp, Burkholderia fungorum LB400
  CDS (1)..(699)
atgaacgatcatccgtatagctttggccgcaatggcgcggtcagcacggtcgaaacgcgtaaccgcgtgctgcggaacacctactggctgctcgcgctgtccatgattccgacagtgctcggtgcgtgggtgggcctcgccacgggtttctcgctgttcgccgccacgagtcccgccatgagcatgctggcgttcttcgcgatcgccttcggattcatgttcgccatccagaagaccaaagacagcgcggccggcgtgttcgtgctgctaggcttcacgttcttcatgggcctgatgctgtcgcgcatcctgagcttcgtgctcggtttttcgaacggcccgtcgctgatcatgctcgccttcggtggcactggcgtgatcttcgcgtcgatggcgaccatcgccacggtcagcaagcgcgacttctcgggcctcggcaagtggctgttcatgggcgtgatcgtgctgctgctcgcgtcggtcgcgaacgtgttcctgcacctgccggcgctgatgctcacggtgtcggtcatggccatcgtgatcttctcggcctacatgctgttcgacgttcagcgcgtggtgaacggcggtgaaacgaactacattaccgccacgcttgcgatctacctggatctgtacaacgtgttcgtcaaccttctcgcgctgctcggtatcttcggcggcaatcgcaactag

SEQ ID NO: 58861 - protein, 232 aa, Burkholderia fungorum LB400
MNDHPYSFGRNGAVSTVETRNRVLRNTYWLLALSMIPTVLGAWVGLATGFSLFAATSPAMSMLAFFAIAFGFMFAIQKTKDSAAGVFVLLGFTFFMGLMLSRILSFVLGFSNGPSLIMLAFGGTGVIFASMATIATVSKRDFSGLGKWLFMGVIVLLLASVANVFLHLPALMLTVSVMAIVIFSAYMLFDVQRVVNGGETNYITATLAIYLDLYNVFVNLLALLGIFGGNRN

SEQ ID NO: 58862 - DNA, 705 bp, Magnetococcus sp. MC-1
  CDS (1)..(705)
atgaaccaatcttcgcgttttcaaccacgttcgtcactagctggggccgctgcgtcttatgatgttagcgcctcgcgcagtcaggctagtgtgggttatttacaacaggtctacgcctttctcgctgcgggcatgctactggcggtggcggcgggttatgtgggcatgacatcggaactggcgttccagatgcgcggcaatctactggtctcgttgggtgcccttatcggcaccatgctgctggtctcttggaagcccagcgcaccaaccctgtttctcatgaccgcgacttggggctttatgggtggtcccatcatcgcttactacgttaacgctggggcttcgcacattgtggggcaggcggcctttatgaccggggcgatctttaccggcatgaccttctatgccatgaccaccaagcgggattttaacttcctcggtggcatgctcatggcgggttttattgtcatcttggtgggtggattgttaaacttttttatctttgaatccaccgccgtgacctttgccctgtcggctatcggggcgctgttaatgaccggctacttgctttatgaaacccaacaactcaagcaaaatcccggcatgctgcatccagcggcgggggctgccatgctcttttccagcatctataacctgttcatgatgctgctgcaactgctgggtatcatgaattcggatgattga

SEQ ID NO: 58863 - protein, 234 aa, Magnetococcus sp. MC-1
MNQSSRFQPRSSLAGAAASYDVSASRSQASVGYLQQVYAFLAAGMLLAVAAGYVGMTSELAFQMRGNLLVSLGALIGTMLLVSWKPSAPTLFLMTATWGFMGGPIIAYYVNAGASHIVGQAAFMTGAIFTGMTFYAMTTKRDFNFLGGMLMAGFIVILVGGLLNFFIFESTAVTFALSAIGALLMTGYLLYETQQLKQNPGMLHPAAGAAMLFSSIYNLFMMLLQLLGIMNSDD

SEQ ID NO: 58864 - DNA, 744 bp, Novosphingobium aromaticivorans DSM 12444
  CDS (1)..(744)
atggcaaactggaacgaccctcggcccaccggaacgggcttcggcgcgtctccgagcctttccggcgtccaaggccgcagcgaagtgttcgatgcaggcctgcgccgtcacatgctgtcgatctacaactacatggcctcgggcgtcctgctttcgggcatcgtcgcgctgctgttcgccacttcgggcgccgcgctcgccgtgttcggcacgccgctccgctgggtcgtggcgctcgccccgctggccttcgtgatgatcatgagctttggcgtgaaccgcctctcgaccttcgcaatgcaggcgatgttctggggcttcagcgtcgcgatgggtctgtcgctttcggcgatcttcttcatctacaccggcccctcgatcgcggtgacgttcttcgcaacggcgggcgccttcgccggcctcagcctgttcggctacaccaccaagaaggacctgtcgggcttcggcagcttcctcatcatgggcgtgttcggcctgctgattgcttcgctgatcaacatgttcctgcagtcgccgggtctcgcctgggcggtcagcttccttggcgtgctgatcttcgcgggtcttaccgcctatgatacgcagaagctcaaggagcagtatgcctatgtcgcgggaaccgatttcgcgggcaaggccgtggtcctcggcgcgctgaacctctacctcgacttcatcaacatgttccagttcctgctgcagttcatgggcgaccgccgctga

SEQ ID NO: 58865 - protein, 247 aa, Novosphingobium aromaticivorans DSM 12444
MANWNDPRPTGTGFGASPSLSGVQGRSEVFDAGLRRHMLSIYNYMASGVLLSGIVALLFATSGAALAVFGTPLRWVVALAPLAFVMIMSFGVNRLSTFAMQAMFWGFSVAMGLSLSAIFFIYTGPSIAVTFFATAGAFAGLSLFGYTTKKDLSGFGSFLIMGVFGLLIASLINMFLQSPGLAWAVSFLGVLIFAGLTAYDTQKLKEQYAYVAGTDFAGKAVVLGALNLYLDFINMFQFLLQFMGDRR

SEQ ID NO: 58866 - DNA, 627 bp, Microbulbifer degradans 2-40
  CDS (1)..(627)
atgcaaagttccacacaggaagtgagtaaagtattacgcaacacatatgcattattggcaatgaccattgccttttctgcggcaatggccgttacatctatggcattaggcgtaccctacctaggcctatggatgctactaccctatatcggcttactctttcttgtagagaaaaccaagaattccgccatgggtattgtttctgtgtttgcccttaccggctggctgggctttagcattggccccatcatcagctactacattggcgtaagcggtatagagcccattcttacggccttgggcggtacagcactaaccttctttgtactttctggttacacccttgccaccaagaaagacatgagcaagtacactggctttttaatgactggcttagtagtaattctggttgccatggttgctaactggtttttacaaatttctgcacttagcctaaccattagctgcgcattcttgtttttgtcgtccatgctaattatgtggcaaaccagtgaaattattcatggcggtgagcgcaactacatttctgcaaccgttacgctatatgtatcgctgtataacatcttcagcattttgctaagctttttaggcggcagcgacgactaa

SEQ ID NO: 58867 - protein, 208 aa, Microbulbifer degradans 2-40
MQSSTQEVSKVLRNTYALLAMTIAFSAAMAVTSMALGVPYLGLWMLLPYIGLLFLVEKTKNSAMGIVSVFALTGWLGFSIGPIISYYIGVSGIEPILTALGGTALTFFVLSGYTLATKKDMSKYTGFLMTGLVVILVAMVANWFLQISALSLTISCAFLFLSSMLIMWQTSEIIHGGERNYISATVTLYVSLYNIFSILLSFLGGSDD

SEQ ID NO: 58868 - DNA, 639 bp, Pediococcus pentosaceus ATCC 25745
  CDS (1)..(639)
atgtacggatggatggcagctgctgtagccttctctggagtgattgcttacctaggaaccacaatctggcgaccagccgtaatgactttcctttctcaaggaagaatgagtatctgggtaatttttgttgctttgttcttgtttatgatttttggacaaaaggcggccttgcagaatccaacggttagtttcttaatgctatttgccttttcggcattctttggaattacgttgtcgagtgtctttatgctttatagtaccgctactattgcgggggcatttttctcagcagcatcggttttcattgtaatgagtgtgatgggagtaaccacaaagcgtgatctatcaaggatgggtaaccatttaattgcggcattgattgcgatggtggtagtttcagtgattaatttattcttccttcacagttcagccgtaactttcttcttctcaattattggaattgtgatttttgcgggtttgtcaatgtatgatactgcaactatgaaacgtctttacctgaactatggtgaccaagtttctgagactggacttgcaatccaaggggcatttagcctatatctagactttattaacctcttccaatacttcttaactatttttggatggaatcgagactaa

SEQ ID NO: 58869 - protein, 212 aa, Pediococcus pentosaceus ATCC 25745
MYGWMAAAVAFSGVIAYLGTTIWRPAVMTFLSQGRMSIWVIFVALFLFMIFGQKAALQNPTVSFLMLFAFSAFFGITLSSVFMLYSTATIAGAFFSAASVFIVMSVMGVTTKRDLSRMGNHLIAALIAMVVVSVINLFFLHSSAVTFFFSIIGIVIFAGLSMYDTATMKRLYLNYGDQVSETGLAIQGAFSLYLDFINLFQYFLTIFGWNRD

SEQ ID NO: 58870 - DNA, 666 bp, Thiobacillus denitrificans ATCC 25259
  CDS (1)..(666)
atgaatccgcaagtcaccaccctcggccgcagccagactgcggtcacctcgaccaacaaggtcgtcaagaacacctacatgctgctggcgatgacgctggcgttttcggcactcacggccggcctgtcgatggccatgaacctgccgcatcccggcctcatcatcacgctcgtgggttacttcggcctgctgttcctgacgaccaaattccgcgacagcggcctcggcatcgccttcgtcttcgccctgaccggcttcatgggctacacgctcggaccgatcctcaacgcctacctcgcgctgccgaacggtggccaggtcgtgatgatggcgatgggcggcacggcggcgatcttcctcggcctgtcggcctacgtcatgacgacccgccgcgacttcagcttcatgggcggcttcctgatggtcggcatcctggtcgccttcctcgccggcctcggcgcgatcttcttcgaggtgcccgcgctgtcgctcgcggtctcggcgatgttcgtgctcctgatgtcgggtctcatcctctacgagaccagcaacatcatccacggcggcgagaccaactacgtgatggcgaccgtcaccctgttcgtcgcgatcttcaacctcttcacgagcctgctgcatctgctcggcttcgccagcaacgactag

SEQ ID NO: 58871 - protein, 221 aa, Thiobacillus denitrificans ATCC 25259
MNPQVTTLGRSQTAVTSTNKVVKNTYMLLAMTLAFSALTAGLSMAMNLPHPGLIITLVGYFGLLFLTTKFRDSGLGIAFVFALTGFMGYTLGPILNAYLALPNGGQVVMMAMGGTAAIFLGLSAYVMTTRRDFSFMGGFLMVGILVAFLAGLGAIFFEVPALSLAVSAMFVLLMSGLILYETSNIIHGGETNYVMATVTLFVAIFNLFTSLLHLLGFASND

SEQ ID NO: 58872 - DNA, 711 bp, Rickettsia akari str. Hartford
  CDS (1)..(711)
atgatcgattatacaaaaactttaactgctacttcaaagaataaaacttttgatgaaggcttaagaaaatacatgcttaaagtatataattatatggctttagcacttttactaaccggtataacagccataacaactatatcagttgaacctatttataatttaatgtttcaaacaggtttcggcactgttataatgtttgccccgctcggtattgcgttatatttctttatgggcttcggacgaatgaacctaaacacagcacaaatattattttgggtttatgccggtttaaccggtatgtcgcttgcatatttagctcttgtttataccggtacctcaatagctcgtactttctttatttgctcttccgtttttggagcaatgagtttgtacggttataatacaagtagagatttaacatctatgggttcattttttgcaatgggtcttatgggtcttatcattgcttcattagtcaacttgtttctgaaaagctcagctatttcttttgctacttctcttattggaatagtagtatttatgggattaattgcttgggacacacaaaagattaagtctatgtattacatggcaggaaacgatgaagtaggacaaaagttttctattatggcagcctttactttatacttagattttataaatcttttcctatatctaatgaaatttttaggcaatagaagggattaa

SEQ ID NO: 58873 - protein, 236 aa, Rickettsia akari str. Hartford
MIDYTKTLTATSKNKTFDEGLRKYMLKVYNYMALALLLTGITAITTISVEPIYNLMFQTGFGTVIMFAPLGIALYFFMGFGRMNLNTAQILFWVYAGLTGMSLAYLALVYTGTSIARTFFICSSVFGAMSLYGYNTSRDLTSMGSFFAMGLMGLIIASLVNLFLKSSAISFATSLIGIVVFMGLIAWDTQKIKSMYYMAGNDEVGQKFSIMAAFTLYLDFINLFLYLMKFLGNRRD

SEQ ID NO: 58874 - DNA, 690 bp, Polaromonas sp. JS666
  CDS (1)..(690)
atgaatgacaatgttcagaccctcgactatggctcggcctcgtcggccctgcagcgcaacaaggtgctgcgcaacacttattggctgctggcgctgagcctgctgccaaccgtgctgggcgcatgggtgggcgtggcaaccggcattacccttgcgctcacgggaggcctcggcctgatcgtgttcctgggcggtgcattcggcttcatattcgccatcgagaagaccaagaactcggccgcaggcgtgcctgtattgctgggcttcacgttcttcatggggctgatgctttcgcggatgatcggcatgatcctcggcttcaaaaacggctccgaactgatcatgacggccatgggcggaacagccggcgtgttcttcgtgatggcgtcgctggccagcgtgatcaagcgcgacatctccggcatgggcaaatggctgtttgtcggtgccgtggttgtgatgatcggcagcatcatcaacgtttttgtcggctccacggccggcatgatggccatctcggtggccgtgatcgccattttcagcgcctacatgctgtacgacctcaagcagatcctggacggcggcgagaccaattacatcagcgccacgctggcgctgtacctcgacctgttcaacgtgttccaggcgctgctggcgctgctgggcatctttggcggcgagcgcgactga

SEQ ID NO: 58875 - protein, 229 aa, Polaromonas sp. JS666
MNDNVQTLDYGSASSALQRNKVLRNTYWLLALSLLPTVLGAWVGVATGITLALTGGLGLIVFLGGAFGFIFAIEKTKNSAAGVPVLLGFTFFMGLMLSRMIGMILGFKNGSELIMTAMGGTAGVFFVMASLASVIKRDISGMGKWLFVGAVVVMIGSIINVFVGSTAGMMAISVAVIAIFSAYMLYDLKQILDGGETNYISATLALYLDLFNVFQALLALLGIFGGERD

SEQ ID NO: 58876 - DNA, 702 bp, Campylobacter lari RM2100
  CDS (1)..(702)
atgagtctttatgatagagattattctaactctaaaactcaagaatttgaaggttatgctagaagtgatttaagcatttttataaaacaaacttatcagctttttgctgcttcattattagctgcaacagcgggtgcttacataggaatttttgccttagcacatctttttgcgcaatcacaggcaactttttggattttatttattgttgaaattggtttattgtttgcattgcaatggaaaaaaagagaagctcctttaaatcttatattgctttttggctttactttttgttctgggcttactttaacaccacttttatattcagttttagcacttcctgctggcgctagcattatagcccaagcttttgccttaacaacagttgcatttggggcactaagcatatttgctatgaatacaaaaaaagattttactatgatgggtaaaatgttatttgtagctttaattgttatcgtagtagcttctttgattaatttatttttccaaagctcacttttaagtttagctatatcaggaattggagcgatattattttcattttacattctttatgatacacaaaatatcataagaggaaattatgaaactccaatcgaaggtgcggttgcgctttatcttgattttattaaccttttcatctctcttcttaatattttaagaagctttaatagcagataa

SEQ ID NO: 58877 - protein, 233 aa, Campylobacter lari RM2100
MSLYDRDYSNSKTQEFEGYARSDLSIFIKQTYQLFAASLLAATAGAYIGIFALAHLFAQSQATFWILFIVEIGLLFALQWKKREAPLNLILLFGFTFCSGLTLTPLLYSVLALPAGASIIAQAFALTTVAFGALSIFAMNTKKDFTMMGKMLFVALIVIVVASLINLFFQSSLLSLAISGIGAILFSFYILYDTQNIIRGNYETPIEGAVALYLDFINLFISLLNILRSFNSR

SEQ ID NO: 58878 - DNA, 633 bp, Cowpox virus
  CDS (1)..(633)
atggccacaccgagcctctccgcgtgctcctccatcgaggacgacttcaactatggcagctcggtggcgtctgccagcgtgcacatacgaatggcatttctaagaaaagtctacggtatcctttgtctacaatttcttttaacaacggcaacaactgcagtatttttatactttgactgcatgcggacatttatacaagggagtcctgttctaatattggcatcaatgttcggatctataggcttgattttcgcattgactttacacagacataaacatcccctgaatctgtacctgctttgtggatttacactgtcggaatctctaacgctggcctctgttgttactttctatgatgtgcatgtcgttatgcaagctttcatgctgactactgcagcgtttcttgctctgactacatatactctacaatcaaagagagatttcagtaaacttggagcaggattgtttgctgctttgtggattttaattttgtcaggactcttgaggatatttgtgcaaaatgagacagtggagctggtcatgtctgcttttggggcccttgtattctgcggattcattatctatgacacgcactcactaatacataagctctcgctgaagagtatgtgttag

SEQ ID NO: 58879 - protein, 210 aa, Cowpox virus
MATPSLSACSSIEDDFNYGSSVASASVHIRMAFLRKVYGILCLQFLLTTATTAVFLYFDCMRTFIQGSPVLILASMFGSIGLIFALTLHRHKHPLNLYLLCGFTLSESLTLASVVTFYDVHVVMQAFMLTTAAFLALTTYTLQSKRDFSKLGAGLFAALWILILSGLLRIFVQNETVELVMSAFGALVFCGFIIYDTHSLIHKLSLKSMC

SEQ ID NO: 58880 - DNA, 711 bp, Brachydanio rerio
  CDS (1)..(711)
atgaatcaagaaaagcatccgcgatcatccattgaggatgattttaattatggcacgaatgtcgcgacggctagcgtacacatccggatggatttcctccgcaaggtctacaccatcctgtcattgcagattatcatcaccacagctgtatctgccctgttcatgctctgtaaccctattaaaaactttgtgcatgaaagtccctctctggtgctgatatccgctatcggctctcttatcctgctccttgccttggctttttatcgtcaccagcaccccgtcaacctttatttgctgtttggatttactctgctggagtcactgtctgttgctactgcagtgtcattttatgagtacaccatagtcctccaggcttttgtgctgacgtctgctgtgtttctgggcctcactgcatacaccttccagtctaaaagagacttcagcaaactcggagccagtttgtttgctggcctgtggatcttgatcattgccagctttctgaggttcttcttctacaatgacaccatggagctggtgttcgctggggccggagctctgctgttctgcggcttcattattttcgatacccatttgctgatgcacaagctgtccccagaggagcacgtcctggcatccatcaacctctacctggatatcgtcaacctgttcctgtacatcctgcgcatcctcgacgccatgaagaaacactga

SEQ ID NO: 58881 - protein, 236 aa, Brachydanio rerio
MNQEKHPRSSIEDDFNYGTNVATASVHIRMDFLRKVYTILSLQIIITTAVSALFMLCNPIKNFVHESPSLVLISAIGSLILLLALAFYRHQHPVNLYLLFGFTLLESLSVATAVSFYEYTIVLQAFVLTSAVFLGLTAYTFQSKRDFSKLGASLFAGLWILIIASFLRFFFYNDTMELVFAGAGALLFCGFIIFDTHLLMHKLSPEEHVLASINLYLDIVNLFLYILRILDAMKKH

SEQ ID NO: 58882 - DNA, 1008 bp, Xenopus laevis
  CDS (1)..(1008)
atgtcgtacccaaatgctccacctccatactatgatcgagatccactgcatgaagcgggtgcttaccctcaaccaggcgggtacccttcaccaagtggttaccctcagccaggtggatatccgccccctggtgcatacgggcaaccagctggatactaccctcagcctggtgggtacccagcacctgcaggttacgctcaacccggtgggttcccagagcctgggcataatgatcatccaaagcctgtgatgcccattttacctacaatccctctaaacacaggtgataatgaaatgtacaacacaagtgacagagagggaggaaattttggttcgtgggatgacaagactgtacgtcatgccttcatccggagggtctacgctatcatagctgtgcagttactggtcactgttggcatcattgcgatcttcacttacgtggaacctgtcaccacatttatacgaaaaacacctggaatttactatgcatcatatgctgtgttctttgtcacatatatcgtgcttgtctgctgtgagggtcccaggcgacgtttcccatggaatatcatcttgctgagtatatttacacttgccatgtcctttatggctggaaccattgcaagtttctacagctccaaagctgttctgatctccatgggaatcactgccattgtgactataatagtcaccatcttctgtttccagactaaggtggattttacatcctgcgcaggattgtttgctgttttgggaatcgtcatgttcgtgacaggaattgttacagccatcgtcttggcgtttaaatatgtgtattggctgcacatgctctatgctgcactcggagcaatcgtcttcaccctgttccttgcgtttgacactcagctggtgattggaaaccggaagcacaccatcagccctgaagagtacgtctatggcgccctgaagatttacaccgacattgtgtacatcttcctaaacctcctgcagattgtgggcagcaggacgtag

SEQ ID NO: 58883 - protein, 335 aa, Xenopus laevis
MSYPNAPPPYYDRDPLHEAGAYPQPGGYPSPSGYPQPGGYPPPGAYGQPAGYYPQPGGYPAPAGYAQPGGFPEPGHNDHPKPVMPILPTIPLNTGDNEMYNTSDREGGNFGSWDDKTVRHAFIRRVYAIIAVQLLVTVGIIAIFTYVEPVTTFIRKTPGIYYASYAVFFVTYIVLVCCEGPRRRFPWNIILLSIFTLAMSFMAGTIASFYSSKAVLISMGITAIVTIIVTIFCFQTKVDFTSCAGLFAVLGIVMFVTGIVTAIVLAFKYVYWLHMLYAALGAIVFTLFLAFDTQLVIGNRKHTISPEEYVYGALKIYTDIVYIFLNLLQIVGSRT

SEQ ID NO: 58884 - DNA, 795 bp, Oryza sativa
  CDS (1)..(795)
atggcgtcggcggcggagatgcagccgctggccccggcgggctaccgccgggcgccggagatgaaggagaaggtggacgcctccgcggtggacctggaggccggcaccggggagacgctgtacccggggatctcgcgcggggagagcgccctccggtgggggttcgtccgcaaggtgtacggcatcctcgccgcgcagctgctcctcaccaccgccgtctccgcgctcaccgtcctccaccccaccctcaacgccacgctctcctcctccccgaccctcgccctcgtgctcgccgtcctccccttcgtcctgatggtcccattgtatcattatcagcacaaacacccacacaactttgtttacctgggtctgttcacgttgtgcttgagtttcagtattggtgtggcatgtgctaacactcaagggaaaattgtgcttgaggcattaatattgacctcagctgtggttgcctctttgactgcgtatactttctgggcttcaaagaaggggaaagaatttggttatcttggaccaattctgttttctgctcttgttttacttgttgtgataagctttattcaggtgttcttcccattgggctctggaccagttgcattgtttggtggccttggagctttagttttctcaggtttcatcatctacgacacagagaacttgataaagcgccacacttatgacgactacatttgggcctctgttgagctctaccttgacatcctcaacttgttcctttatatcctgaacatgatcaggagcatgcaaagtgataactag

SEQ ID NO: 58885 - protein, 264 aa, Oryza sativa
MASAAEMQPLAPAGYRRAPEMKEKVDASAVDLEAGTGETLYPGISRGESALRWGFVRKVYGILAAQLLLTTAVSALTVLHPTLNATLSSSPTLALVLAVLPFVLMVPLYHYQHKHPHNFVYLGLFTLCLSFSIGVACANTQGKIVLEALILTSAVVASLTAYTFWASKKGKEFGYLGPILFSALVLLVVISFIQVFFPLGSGPVALFGGLGALVFSGFIIYDTENLIKRHTYDDYIWASVELYLDILNLFLYILNMIRSMQSDN

SEQ ID NO: 58886 - DNA, 714 bp, Xenopus laevis
  CDS (1)..(714)
atggatttcttggaccggaacatcaactttaatgctctcctcaagttctcccacatctcctcctctacacagcagcacctgaaaagggtatactccagttttgctatttgcatgttggtggctgctgctggtgcctatgtgaatgtggtcctcaagtttcttcagggaagcttcctctcctttgcaggctcttttggaatgatgatctggttgttggctactccccacactttccaaaatgaaaaaaagcgtctaggaattcttgctgggtttgccttcttttcaggagttggtttgggtccaactttgaatctgtgcatcgccattaaccccagcattattcccactgcttttctgggcacagccatgatcttcatctgcttttcactcagtgctctctatgcacaaaggcgcagcttcctgttcttgggaggtattcttatgtctgctattagcttgctgcttctctcttctttggtgaacttgcttgttggatcagttttactcttcaaaatgcatatgtacattggtctgctggtgatgtgtggctttgtgttgtttgatactcaactcatcatagagaaagctgaacaaggggataaagattatatctggcactgtgtcgatctgtttttggattttatcaccattttcaggaagctcatgataattctggcaatgaatgagaaggagaaaaggaaagagaggaagtaa

SEQ ID NO: 58887 - protein, 237 aa, Xenopus laevis
MDFLDRNINFNALLKFSHISSSTQQHLKRVYSSFAICMLVAAAGAYVNVVLKFLQGSFLSFAGSFGMMIWLLATPHTFQNEKKRLGILAGFAFFSGVGLGPTLNLCIAINPSIIPTAFLGTAMIFICFSLSALYAQRRSFLFLGGILMSAISLLLLSSLVNLLVGSVLLFKMHMYIGLLVMCGFVLFDTQLIIEKAEQGDKDYIWHCVDLFLDFITIFRKLMIILAMNEKEKRKERK

SEQ ID NO: 58888 - DNA, 726 bp, Oryza sativa
  CDS (1)..(726)
atgttcgggaaggggcatgatctcgaggccggcggctcgtcggagccgctgtacccggggatggtggagagccccgacctgaggtgggcgctcatccacaagatctacgtcatcctctccgtgcagctcgcgatgacggcggccgtggcggccttcgtcgtcaaggtccgcggcgtctcggagttcttcgtctcctccaacgccggattcgccctctacatcttcctcctcttcctgcccctcatcgtgttgtgccctctgcgctactaccaccagaagcatccggtgaacttgctgttgctcggcctcttcacggttgccatcagcttcgccgtcggcatgacatgtgcctacaccagcggaaaagtcatttttgaggcggcagctctcacagcagtggtggtgatcagcttgacagcatacactttctgggctgcaaagagaggccatgacttcaatttcctcggccccttcctgttttctgctgtgatggtgctgattttattttcactgatccagatattcttcccattgggcaagatctctgaaatgatatatggcggactggcatcgctcgtcttctctggatacatcatctacgacacggacaatatcatcaagcgctacacttacgatgagtatgtctgggctgctgtctcgctctacctcgacgtgatcaacctcttcttagctctgctgcgagtgttgagggcagctgataactag

SEQ ID NO: 58889 - protein, 241 aa, Oryza sativa
MFGKGHDLEAGGSSEPLYPGMVESPDLRWALIHKIYVILSVQLAMTAAVAAFVVKVRGVSEFFVSSNAGFALYIFLLFLPLIVLCPLRYYHQKHPVNLLLLGLFTVAISFAVGMTCAYTSGKVIFEAAALTAVVVISLTAYTFWAAKRGHDFNFLGPFLFSAVMVLILFSLIQIFFPLGKISEMIYGGLASLVFSGYIIYDTDNIIKRYTYDEYVWAAVSLYLDVINLFLALLRVLRAADN

SEQ ID NO: 58890 - DNA, 747 bp, Chlamydomonas reinhardtii
  CDS (1)..(747)
atggccagcgcattcgagcggccccggcacgcggccggtctggacttcgacgtggagaagggggccgcgctgaatgcctttgcggagcgcaccgtccgccagggctttgtgcggaaggtctttgggctattggcggtacagcttgcgctcacgactgtcattgcggggaccttcgtcacgtcgacagccgtgaagacgttcgtggctgcccacccttgggtgctgatgctcggcatgctggcgggtttcggcattctccttacccttacactgtcgtcttcggctcgccagagccacccaaccaacctgattctcctgtttgtgttcacggccgcggaaggcgttctggtgggcgccgcctcatccgcctcccgcactgacgtagtgctgctggcctttggactgactgcgggcatcacggcggccatgactgtgtacgccctcaccaccaagaacgacctgaccatgtcgggcgcggcgctgtacagctgcctgtggggtctattgctggcgggcctggtggggatgttcgtgcgcacctcggccttcaacatcctgctgtcggcggtgggggcggtggtgttcagtgtgtacatcgcctacgatgtgcagtgccttcttggtggcgagcacaagtacgcggtgtccccggacgagtacgtgctgggcgccatcgcgatctacctggacatcatcaacctgttcatgcacatcctgcgcctgctcaacgaggccaaccggaattag

SEQ ID NO: 58891 - protein, 248 aa, Chlamydomonas reinhardtii
MASAFERPRHAAGLDFDVEKGAALNAFAERTVRQGFVRKVFGLLAVQLALTTVIAGTFVTSTAVKTFVAAHPWVLMLGMLAGFGILLTLTLSSSARQSHPTNLILLFVFTAAEGVLVGAASSASRTDVVLLAFGLTAGITAAMTVYALTTKNDLTMSGAALYSCLWGLLLAGLVGMFVRTSAFNILLSAVGAVVFSVYIAYDVQCLLGGEHKYAVSPDEYVLGAIAIYLDIINLFMHILRLLNEANRN

SEQ ID NO: 58892 - DNA, 747 bp, Lycopersicon esculentum
  CDS (1)..(747)
atggaaggtttcacatcgttcttcgactcgcaatctgcctctcgcaaccgctggagttatgattctctcaaaaacttccgccagatctcacctctcgttcaaactcatctcaagcaggtgtaccttacgctatgctgtgctttagtggcatcggctgctggggcttaccttcacattctatggaatatcggtggcctcctcacaacaatggcttgcatgggaagcatggtgtggcttctctcagctcctccttatcaagagcaaaaaagggtggctcttctgatggcagctgcactttttgaaggcgcctctattggtcctctgattgagctgggcattaacttcgatccaagcattgtgtttggcgcttttgtaggttgtgctgtggtttttggttgcttctcagctgctgccatgttggcaaggcgcagggagtacttgtacctcgggggccttctttcatctggcgtctcccttctcttctggttgcactttgcatcctccatttttggtggttccatggctgttttcaagtttgagttgtattttggactcttggtgtttgtgggctacatcgtctttgacacccaagaaattattgagaaggctcacttgggtgatatggattacgttaagcatgcattgacccttttcacagattttgtcgctgtttttgtgcggattctgatcatcatgttaaagaatgcatctgagaaggaagagaagaagaagaagaggagaaactag

SEQ ID NO: 58893 - protein, 248 aa, Lycopersicon esculentum
MEGFTSFFDSQSASRNRWSYDSLKNFRQISPLVQTHLKQVYLTLCCALVASAAGAYLHILWNIGGLLTTMACMGSMVWLLSAPPYQEQKRVALLMAAALFEGASIGPLIELGINFDPSIVFGAFVGCAVVFGCFSAAAMLARRREYLYLGGLLSSGVSLLFWLHFASSIFGGSMAVFKFELYFGLLVFVGYIVFDTQEIIEKAHLGDMDYVKHALTLFTDFVAVFVRILIIMLKNASEKEEKKKKRRN

SEQ ID NO: 58894 - DNA, 744 bp, Brassica oleracea
  CDS (1)..(744)
atggattcattctcgtccttcttcgattctcaacctggtagcagaagctggagctatgattctctcaaaaacctccgtcagatttctccctccgtccagaatcatctcaagagggtttatctcactctgtgttgtgctctcgttgcgtctgcgtttggagcttacctccacgtgctctggaacataggtggtattctcactaccattggatgctttggaagcatgatttggctgctctcctgtcctccttatgaacaacaaaagaggctttcccttctgtttctgtctgctgttctcgaaggtgcttcagttggtcccttgatcaaagtggcagttgattttgacccaagcatcctcatcactgcgtttgtcggaactgcgatagcctttatctgtttctcaggggcagcgatgttggcaagacgcagagagtacctctacctcggaggactgctttcatctggcttgtccatgcttatgtggcttcagtttgcctcttccatctttggtggctctgcatccatctttaagtttgagctctactttggactcttgatctttgtgggatacatggtggtggacactcaagatattatagagaaggcccacctcggtgacatggattacgtgaaacattcgttgacccttttcaccgattttgtagctgtgtttgttcgtgttctcatcattatgctgaagaactcggcagataaagaagataaaaagaagaggaggaggaactga

SEQ ID NO: 58895 - protein, 247 aa, Brassica oleracea
MDSFSSFFDSQPGSRSWSYDSLKNLRQISPSVQNHLKRVYLTLCCALVASAFGAYLHVLWNIGGILTTIGCFGSMIWLLSCPPYEQQKRLSLLFLSAVLEGASVGPLIKVAVDFDPSILITAFVGTAIAFICFSGAAMLARRREYLYLGGLLSSGLSMLMWLQFASSIFGGSASIFKFELYFGLLIFVGYMVVDTQDIIEKAHLGDMDYVKHSLTLFTDFVAVFVRVLIIMLKNSADKEDKKKRRRN

SEQ ID NO: 58896 - DNA, 741 bp, Cryptosporidium parvum
  CDS (1)..(741)
atggaatcattctttgcaactaattcaagaaagtcccagttcagtggaaacttctttaattcatcagatctgacttcaattcagcaaacccacttgttaaaaatgtactcctctattattgctggttcatttatgacagtatttggggtgactgcatttattaatggaatgttaagaatcaactcatttgttggtcttttggctggaattggtgtcacattctatttgacagcatcatcatctaataagagctctatttccattaaacgtttagcagcctatttgttactatgctttgtaattggtaatggacttggacctttgattctatttagtaactttgttaatcctgttatcattcccacagctcttgcaaccacatgtattatctttatttcgctatcttttggagttttattcactaagaagagactttctctatatactacttcttttattttcacaactattgcatatcttggacttgtatcattctttaatatcttcacaagatccaaatttgttgattcacttttatcctatgcttttgttatggtttactcattttatatttactacgatacccaaaagactcttgaagctattgcatatggtgaaagagatttccttcttcactctattcagctttaccttgatgctgtcaacctctttactaagattgtagtcattctaatcagaaaacaacaagaagaggaggaaaaacgtagaaagaaggaatag

SEQ ID NO: 58897 - protein, 246 aa, Cryptosporidium parvum
MESFFATNSRKSQFSGNFFNSSDLTSIQQTHLLKMYSSIIAGSFMTVFGVTAFINGMLRINSFVGLLAGIGVTFYLTASSSNKSSISIKRLAAYLLLCFVIGNGLGPLILFSNFVNPVIIPTALATTCIIFISLSFGVLFTKKRLSLYTTSFIFTTIAYLGLVSFFNIFTRSKFVDSLLSYAFVMVYSFYIYYDTQKTLEAIAYGERDFLLHSIQLYLDAVNLFTKIVVILIRKQQEEEEKRRKKE

SEQ ID NO: 58898 - DNA, 714 bp, Xenopus laevis
  CDS (1)..(714)
atggatttcatggatcggaatatcaactttaatgctctcctcaagttctcccacatctcctcctccacacagcagcaccttaaaagggtatactcctgttttgctatttgcttgttggtggctgctgctggtgcctatgtgaatgtggtcctcaagtttctgcagggaagcttcatctcatttgcaggctctcttggaatgatgatctggctgatgtccactccacatacttttgaaaatgagaaaaagcgtctaggaattcttgctggatttgccttcttttcaggagttggtttgggtccagctttgaatatgtgcattgccattaaccccagcatcattcccactgcttttctgggcacagccatgatcttcatgtgcttttcactcagtgctctctatgcacaaaggcgcagcttcctgttcttgggaggtattcttatgtctgttcttagcctgctgcttatctcttctttggtgaacttgcttgttggatcagttttactattcaaaatgcatatgtacattggactgctggtgatgtgtggctttgtgttgtttgatactcaacttatcatagagaaagctgaacaaggggataaagattatgtctggcactgtgtggacctgtttttggattttatcaccattttcaggaagctcatggtaatcatggcaatgaacgaaaaggagaaaaagaaagagaggaagtaa

SEQ ID NO: 58899 - protein, 237 aa, Xenopus laevis
MDFMDRNINFNALLKFSHISSSTQQHLKRVYSCFAICLLVAAAGAYVNVVLKFLQGSFISFAGSLGMMIWLMSTPHTFENEKKRLGILAGFAFFSGVGLGPALNMCIAINPSIIPTAFLGTAMIFMCFSLSALYAQRRSFLFLGGILMSVLSLLLISSLVNLLVGSVLLFKMHMYIGLLVMCGFVLFDTQLIIEKAEQGDKDYVWHCVDLFLDFITIFRKLMVIMAMNEKEKKKERK

SEQ ID NO: 58900 - DNA, 660 bp, Schistosoma japonicum
  CDS (1)..(660)
atgtctcgttattcgcagtcccagagattgaatctgggaacaatttttaattttcgggatctagataaaaatgttcaagttcacctgaagaatgtctacagcacactttctgttggcttgattatatcatgtgttggggcatacttatttcaaatcaactcttttctacagtctatggtgacgtctctgatgattttgtcattcatcatatctcttggaagttccttgtttatctatttcacacaacattcaagggaaactctccactctagacttggggctttcttcttgttctccttttctacagggattggtttcggtccacttttccaggttttatctatcatcagtcctgatactattccaactgcccttttgggtaccgccttgatttttgtctcattcactttggcagcattgtttacacgaaagcgatattacatttaccttggagccgctttaatgtctgcagtcagtttgttgacaacttttagctttatgaatttatttatccgttcacctgctatatatgaggctgaactttacatcggattggctatattttgtgcatttgtggttttcgatacgcaattgatcgttgagaaacgccgtaacggagatacggatttttgtgtggcacacattggatttatttattga

SEQ ID NO: 58901 - protein, 219 aa, Schistosoma japonicum
MSRYSQSQRLNLGTIFNFRDLDKNVQVHLKNVYSTLSVGLIISCVGAYLFQINSFLQSMVTSLMILSFIISLGSSLFIYFTQHSRETLHSRLGAFFLFSFSTGIGFGPLFQVLSIISPDTIPTALLGTALIFVSFTLAALFTRKRYYIYLGAALMSAVSLLTTFSFMNLFIRSPAIYEAELYIGLAIFCAFVVFDTQLIVEKRRNGDTDFCVAHIGFIY

SEQ ID NO: 58902 - DNA, 744 bp, Arabidopsis thaliana
  CDS (1)..(744)
atggatgcgttctcttccttcttcgattctcaacctggtagcagaagctggagctatgattctcttaaaaacttccgtcagatttctccagccgttcagaatcatcttaaacgggtttatttgaccttatgttgtgctcttgtggcgtctgcctttggagcttacctccatgtgctctggaatatcggcggtattcttacaacgattggatgtattggaactatgatttggctcctttcatgtcctccttatgaacaccaaaaaaggctttctcttctgtttgcgtctgctgttcttgaaggtgcttctgttggccccttgatcaaagtggcaattgatgttgacccaagcatccttatcactgcgtttgttggaactgcgatagcgtttgtctgtttctcagcagcagcaatgttagcaagacgcagggagtatctctaccttggaggactgctttcatctggcttgtctatgctaatgtggctccagtttgcctcttcgatctttggtggctctgcatctatctttaagtttgagttgtactttggacttttgatctttgtgggatacatggtggtggacacacaagagattatagaaaaggcacacctcggtgacatggactatgtaaaacattcgttgacccttttcactgactttgtagctgtgtttgttcggattctcatcataatgttgaagaactcagcagataaagaagagaagaagaagaaaaggagaaactga

SEQ ID NO: 58903 - protein, 247 aa, Arabidopsis thaliana
MDAFSSFFDSQPGSRSWSYDSLKNFRQISPAVQNHLKRVYLTLCCALVASAFGAYLHVLWNIGGILTTIGCIGTMIWLLSCPPYEHQKRLSLLFASAVLEGASVGPLIKVAIDVDPSILITAFVGTAIAFVCFSAAAMLARRREYLYLGGLLSSGLSMLMWLQFASSIFGGSASIFKFELYFGLLIFVGYMVVDTQEIIEKAHLGDMDYVKHSLTLFTDFVAVFVRILIIMLKNSADKEEKKKKRRN

SEQ ID NO: 58904 - DNA, 714 bp, Camelpox virus
  CDS (1)..(714)
atggccatgccgagcctctacgcgtgctcctccatcgaggacgacttcaactatggcagctcggtggcgtctgccagtgtgcacatacgaatggcatttctaagaaaagtctacggtatcctttgtctacaatttcttttaacaacggcaacaactgcagtatttttatactttgactgcatgcggaaatttatacaagggagtcctgttctaatattggcatcaatgttcgtatctataggcttgattttcgcattgactttacacagacataaacatcccctgaatctatacctgctttgtggatttacactgtcggaatctctaacgctggcctctgttgttactttctatgatgtgcatgtcgttatgcaagctttcatgctgactactgcagtgtttcttgctctgactgcatatactctacaatcaaagagagatttcagtaaacttggagcaggattgtttgttactttgtggattttaattttgtcaggacttttgaggatatttgtgcaaagtgaaacagtggagctggtcctgtctgcttttggggcccttgtattctgcggattcattatctatgacacgcactcactaatacataagctctcgcctgaagactatgtgttagcctctatcaatttctacttggatatcatcaatctgttcttgcatctgttacagcttttggaagtatctaataagaaataa

SEQ ID NO: 58905 - protein, 237 aa, Camelpox virus
MAMPSLYACSSIEDDFNYGSSVASASVHIRMAFLRKVYGILCLQFLLTTATTAVFLYFDCMRKFIQGSPVLILASMFVSIGLIFALTLHRHKHPLNLYLLCGFTLSESLTLASVVTFYDVHVVMQAFMLTTAVFLALTAYTLQSKRDFSKLGAGLFVTLWILILSGLLRIFVQSETVELVLSAFGALVFCGFIIYDTHSLIHKLSPEDYVLASINFYLDIINLFLHLLQLLEVSNKK

SEQ ID NO: 58906 - DNA, 741 bp, Brassica oleracea
  CDS (1)..(741)
atggaatcgttctcgtccttcttcgattctcagccaggcagcagaagctggagctatgaatctctcaagaacctccatcagatctccccgtccgtacagaatcatctcaagcgggtttatctcactttatgctgtgcccttgttgcgtctgcctttggagcttacctccacgtgctctggaacatcggtggtattctcacaaccattgcatgttgtggaaccatgatttggcttctctcatgtcctccttatgagcaacaaaagaggctctcacttctcttcctctctgccgttcttgaaggtgcctctgttggccccttgatcaaagtggctgttgattttgacccaagcatccttatcactgcgtttgtcggaactgcgatagcgtttatctgtttctcaggagcagcgatgttggccagacgcagagagtatctctacctcggaggacttctctcttctggcttgtccatgcttatgtggcttcagtttgcttcttccatctttggtggctctgcgtccatctttaagtttgagctctactttggactcttgatctttgttggatacatggtggtggacacacaagagattatagagaaagcacacctaggggacatggactatgtgaaacatgcattgacccttttcaccgattttgtggctgtgtttgtccgtgttctcatcataatgctgaagaactcggcagataaagaggagaagaagaagaggagaaactga

SEQ ID NO: 58907 - protein, 246 aa, Brassica oleracea
MESFSSFFDSQPGSRSWSYESLKNLHQISPSVQNHLKRVYLTLCCALVASAFGAYLHVLWNIGGILTTIACCGTMIWLLSCPPYEQQKRLSLLFLSAVLEGASVGPLIKVAVDFDPSILITAFVGTAIAFICFSGAAMLARRREYLYLGGLLSSGLSMLMWLQFASSIFGGSASIFKFELYFGLLIFVGYMVVDTQEIIEKAHLGDMDYVKHALTLFTDFVAVFVRVLIIMLKNSADKEEKKKRRN

SEQ ID NO: 58908 - DNA, 750 bp, Nicotiana tabacum
  CDS (1)..(750)
atggagtcttgcacatcgttcttcaattcacagtcggcgtcgtctcgcaatcgctggagttacgattctcttaagaacttccgccagatctctccctttgttcaaactcatctcaaaaaggtctacctttcattatgttgtgctttagttgcttcggctgctggagcttaccttcacattctttggaacattggtggcttacttacgacattgggatgtgtgggaagcatagtgtggctgatggcgacacctctgtatgaagagcaaaagaggatagcacttctgatggcagctgcactgtttaaaggagcatctattggtccactgattgaattggctattgactttgacccaagcattgtgatcggtgcttttgttggttgtgctgtggcttttggttgcttctcagctgctgccatggtggcaaggcgcagagagtacttgtatcttggaggtcttctttcatctggtctctctatccttttctggttgcacttcgcgtcctccatttttggtggttctatggccttgttcaagttcgaggtttattttgggctcttggtgtttgtgggctatatcatttttgacacccaagatataattgagaaggcacaccttggggatttggactacgtgaagcatgctctgaccctctttacagattttgttgctgtttttgtgcgaatattaatcataatgctgaagaatgcatccgacaaggaagagaagaagaagaagaggagaaactaa

SEQ ID NO: 58909 - protein, 249 aa, Nicotiana tabacum
MESCTSFFNSQSASSRNRWSYDSLKNFRQISPFVQTHLKKVYLSLCCALVASAAGAYLHILWNIGGLLTTLGCVGSIVWLMATPLYEEQKRIALLMAAALFKGASIGPLIELAIDFDPSIVIGAFVGCAVAFGCFSAAAMVARRREYLYLGGLLSSGLSILFWLHFASSIFGGSMALFKFEVYFGLLVFVGYIIFDTQDIIEKAHLGDLDYVKHALTLFTDFVAVFVRILIIMLKNASDKEEKKKKRRN

SEQ ID NO: 58910 - DNA, 744 bp, Hordeum vulgare
  CDS (1)..(744)
atggacgccttctactcgacctcgtcggcggcggcgagcggctggggccacgactccctcaagaacttccgccagatctcccccgccgtgcagtcccacctcaagctcgtttacctgactctatgctttgcactggcctcatctgccgtgggtgcttacctacacattgccctgaacatcggcgggatgctgacaatgctcgcttgtgtcggaactatcgcctggatgttctcggtgccagtctatgaggagaggaagaggtttgggctgctgatgggtgcagccctcctggaaggggcttcggttggacctctgattgagcttgccatagactttgacccaagcatcctcgtgacagggtttgtcggaaccgccatcgcctttgggtgcttctctggcgccgccatcatcgccaagcgcagggagtacctgtacctcggtggcctgctctcgtctggcctgtcgatcctgctctggctgcagtttgtcacgtccatctttggccactcctctggcagcttcatgtttgaggtttactttggcctgttgatcttcctggggtacatggtgtacgacacgcaggagatcatcgagagggcgcaccatggcgacatggactacatcaagcacgccctcaccctcttcaccgactttgttgccgtcctcgtccgagtcctcatcatcatgctcaagaacgcaggcgacaagtcggaggacaagaagaagaggaagagggggtcctga

SEQ ID NO: 58911 - protein, 247 aa, Hordeum vulgare
MDAFYSTSSAAASGWGHDSLKNFRQISPAVQSHLKLVYLTLCFALASSAVGAYLHIALNIGGMLTMLACVGTIAWMFSVPVYEERKRFGLLMGAALLEGASVGPLIELAIDFDPSILVTGFVGTAIAFGCFSGAAIIAKRREYLYLGGLLSSGLSILLWLQFVTSIFGHSSGSFMFEVYFGLLIFLGYMVYDTQEIIERAHHGDMDYIKHALTLFTDFVAVLVRVLIIMLKNAGDKSEDKKKRKRGS

SEQ ID NO: 58912 - DNA, 744 bp, Arabidopsis thaliana
  CDS (1)..(744)
atggatgcgttctcttccttcttcgattctcaacctggtagcagaagctggagctatgattctcttaaaaacttccgtcagatttctccagccgttcagaatcatcttaaacgggtttatttgaccttatgttgtgctcttgtggcgtctgcctttggagcttacctccatgtgctctggaatatcggcggtattcttacaacgattggatgtattggaactatgatttggctcctttcatgtcctccttatgaacaccaaaaaaggctttctcttctgtttgtgtctgctgttcttgaaggtgcttctgttggccccttgatcaaagtggcaattgatgttgacccaagcatccttatcactgcatttgttggaactgcgatagcgtttgtctgtttctcagcagcagcaatgttagcaagacgcagggagtatctctaccttggaggactgctttcatctggcttgtctatgctaatgtggctccagtttgcctcttcaatctttggtggctctgcatctatctttaagtttgagttgtactttggacttttgatctttgtgggatacatggtggtggacacacaagagattatagaaaaggcacacctcggtgacatggactatgtaaaacattcgttgacccttttcactgactttgtagctgtgtttgttcggattctcatcataatgttgaagaactcagcagataaagaagagaagaagaagaaaaggagaaactga

SEQ ID NO: 58913 - protein, 247 aa, Arabidopsis thaliana
MDAFSSFFDSQPGSRSWSYDSLKNFRQISPAVQNHLKRVYLTLCCALVASAFGAYLHVLWNIGGILTTIGCIGTMIWLLSCPPYEHQKRLSLLFVSAVLEGASVGPLIKVAIDVDPSILITAFVGTAIAFVCFSAAAMLARRREYLYLGGLLSSGLSMLMWLQFASSIFGGSASIFKFELYFGLLIFVGYMVVDTQEIIEKAHLGDMDYVKHSLTLFTDFVAVFVRILIIMLKNSADKEEKKKKRRN

SEQ ID NO: 58914 - DNA, 750 bp, Oryza sativa
  CDS (1)..(750)
atggacgccttctactcgacctcgtcggcgtacggagcggcggcgagcggctggggctacgactcgctgaagaacttccgccagatctcccccgccgtccagtcccacctcaagctcgtttacctgacactatgcgtcgccctggctgcgtcggcggtgggcgcatacctgcacgtcgccttgaacatcggcgggatgttgactatgctcgggtgcgtggggagcatcgcctggttgttctcggtgcctgtctttgaggagaggaagaggtttgggattctcttggccgctgccctgctggaaggggcttcagttgggcctctgatcaagcttgctgtagactttgactcaagcattctcgtaacagcatttgttggaactgccattgcatttgggtgcttcacttgcgctgccatcgttgccaagcgtagggagtacctctaccttggtggtttgctctcttctggcctctccatcctgctctggctgcagtttgccgcatccatctttggccactccaccggcagcttcatgtttgaggtttactttggcctgttgatcttcctggggtacatggtgtatgacacgcaggagatcatcgagagggctcaccacggtgacatggactacatcaagcacgcactcaccctcttcactgacttcgtggccgtccttgtccggatcctcgtcatcatgctcaagaacgcgtctgacaagtcggaggagaagaagaggaagaagaggtcttga

SEQ ID NO: 58915 - protein, 249 aa, Oryza sativa
MDAFYSTSSAYGAAASGWGYDSLKNFRQISPAVQSHLKLVYLTLCVALAASAVGAYLHVALNIGGMLTMLGCVGSIAWLFSVPVFEERKRFGILLAAALLEGASVGPLIKLAVDFDSSILVTAFVGTAIAFGCFTCAAIVAKRREYLYLGGLLSSGLSILLWLQFAASIFGHSTGSFMFEVYFGLLIFLGYMVYDTQEIIERAHHGDMDYIKHALTLFTDFVAVLVRILVIMLKNASDKSEEKKRKKRS

SEQ ID NO: 58916 - DNA, 714 bp, Paralichthys olivaceus
  CDS (1)..(714): n means a or g or c or t/u
atgaacgtgtttgaccgcaacatcaactttgactccctcttcaagttctcccagatatctcactccactcaggtgcacttgaagaatgtgtactccagtttggcagtttgtatgtttgttgccgccgctggctcctacgtccacgtcgtcacacgcctctttcagggcggcatgctgtcggtgctcggctccctggggatgatgttctggttggccatgacaccacacaactctgagacggagaagaagagactggccatcctcgcaggattcgccttcctcacaggtgtcggtctctgccccacactggactttgtcatcgccatcaacccgagcatcattgtgacggctttcctcgggacctctgtgatcttcgtctgcttcaccctcagcgccctctacgccaagcgcaggagctacctgttcctcggaggcaccctgatgtctggtctctccatcctgttcctgatgtccatgatgaacatgttctttggatctgtgatgctgttcaaggctcacatgtacctggggctgctcatcatgtgcggcttcgtcctgtntgacactcagctcatcatcgagaaagcagagaacggagacaaggactacgtctggcacagtgtggatctgttcctggatttcatcaccatcttcaggaaacttatggtcatcctcgctttgaacgataaggacaagaagaaggaaaagaagtag

SEQ ID NO: 58917 - protein, 237 aa, Paralichthys olivaceus
  misc_feature (187)..(187): Xaa can be Tyr or Ser or Cys or Phe
MNVFDRNINFDSLFKFSQISHSTQVHLKNVYSSLAVCMFVAAAGSYVHVVTRLFQGGMLSVLGSLGMMFWLAMTPHNSETEKKRLAILAGFAFLTGVGLCPTLDFVIAINPSIIVTAFLGTSVIFVCFTLSALYAKRRSYLFLGGTLMSGLSILFLMSMMNMFFGSVMLFKAHMYLGLLIMCGFVLXDTQLIIEKAENGDKDYVWHSVDLFLDFITIFRKLMVILALNDKDKKKEKK

SEQ ID NO: 58918 - DNA, 663 bp, Haemophilus influenzae
  CDS (1)..(663)
atgcaatcacgtcttattgtggatgctcaaaaagaatcgttactcagcacacataaagtgttgcgtaacacgtattttttactgggattaacaatggctttttcagcggttgttgcgtttatttcaatgagcttaaacttgccttatccaaatattattgtgttactagtgggtttttatggcttacttttcttaaccaataaattagctgatcgccctgctggtattttggcggcctttgctttcactggatttatgggatacaccatcgggccaattttaaatatgtatgtggcacgtggaatggaagatttgattatgcttgcattcgcaggaactgctatcgtattttttgcgtgttccgcttatgtattgactacgaaaaaagatatgtcattcttatcaagcgcaatgttcgcattatttattgtgttattgcttggtatggtggcgagtttcttcttccaaattcctgctttatcggtcgcaattagtgcattatttgtagtgttctcaacaatgaccattttgtatgaaaccagtaatattattcacggtggagaaacaaattacattcgcgcaaccgtgaacatctatgtttcaatctacaatttattcttgagtttattaagattactttctatcttttcaagtgatgaataa

SEQ ID NO: 58919 - protein, 220 aa, Haemophilus influenzae
MQSRLIVDAQKESLLSTHKVLRNTYFLLGLTMAFSAVVAFISMSLNLPYPNIIVLLVGFYGLLFLTNKLADRPAGILAAFAFTGFMGYTIGPILNMYVARGMEDLIMLAFAGTAIVFFACSAYVLTTKKDMSFLSSAMFALFIVLLLGMVASFFFQIPALSVAISALFVVFSTMTILYETSNIIHGGETNYIRATVNIYVSIYNLFLSLLRLLSIFSSDE

SEQ ID NO: 58920 - DNA, 672 bp, Vibrio cholerae
  CDS (1)..(672)
atgaatacgccaatgtttaccagaacttccagcttggaacgtactcttgaaaccaacaaggttttgaagaatacctacttcctgctttctatgacccttgtcaccagtgcgattgcagcaatggcgactatggctatcggcatttctcctatcgttgctttggtgatgcagttggctgccattggcattttgtttttcgtgatgccaaaagcgattaactcatcatcaggcctagtatggacgttcgtctttactggactgatgggaggagctcttggccctatgctgaatttctatgcggcgatgccaaatggcccaatcgttattgcgcaagcactcggcctgactggcatggtgtttttaggcctgtcggcttacaccattaccagcaagaaagatttctctttcatgcgtaatttcctgtttgctggcttgatcattgtgattgttgcggcattgattaacatctttgttggctcaacggtagctcatctggctatcagtagcgtttctgcactggtattttcgggtttcattctgtttgataccagccgtattgtgcgtggtgaagaaaccaactatatctcagcaacgatttctatgtacttgaatatcctgaacctgttcactagcttgttgagcattctgggtatcatgaacaataacgattaa

SEQ ID NO: 58921 - protein, 223 aa, Vibrio cholerae
MNTPMFTRTSSLERTLETNKVLKNTYFLLSMTLVTSAIAAMATMAIGISPIVALVMQLAAIGILFFVMPKAINSSSGLVWTFVFTGLMGGALGPMLNFYAAMPNGPIVIAQALGLTGMVFLGLSAYTITSKKDFSFMRNFLFAGLIIVIVAALINIFVGSTVAHLAISSVSALVFSGFILFDTSRIVRGEETNYISATISMYLNILNLFTSLLSILGIMNNND

SEQ ID NO: 58922 - DNA, 711 bp, Rickettsia prowazekii
  CDS (1)..(711)
atgatcgattatacaaaaactctaactactacctcaaaaaataaaacttttgatgaaggcttaagaagatacatgctgaaagtatataattatatggctttagcacttttattaaccggtgtagcagctataacgactatatcagttgagcctatttatcatttaatgtttcaaacaggtttcggcactattataatgtttgctccactcggcattgctttatatttctttatgggcttcggacgaatgaatctccaaacagctcaaatattattttgggtttatgcaggattaactggtatgtcactttcatatttagctctgatttataccggtacatcaatagctcgtactttctttatttgctcttccgtttttggagcaatgagtttatacggttatagtacaagtagagacttaacatccatggggtcattttttgctatgggtcttataggtcttattattgcctcattagtcaacttgtttttaaaaagttcatctctttcttttgctacttctcttattggcatagtagtatttatgggcttaattgcttgggatacgcaaaaaattaagtctatgtattacatagcaggaaacgatgaagtaggacaaaagctttccattatggcagcatttactttatatttagattttatcaatcttttcctatatctaatgagatttttaggcaatagaagagattag

SEQ ID NO: 58923 - protein, 236 aa, Rickettsia prowazekii
MIDYTKTLTTTSKNKTFDEGLRRYMLKVYNYMALALLLTGVAAITTISVEPIYHLMFQTGFGTIIMFAPLGIALYFFMGFGRMNLQTAQILFWVYAGLTGMSLSYLALIYTGTSIARTFFICSSVFGAMSLYGYSTSRDLTSMGSFFAMGLIGLIIASLVNLFLKSSSLSFATSLIGIVVFMGLIAWDTQKIKSMYYIAGNDEVGQKLSIMAAFTLYLDFINLFLYLMRFLGNRRD

SEQ ID NO: 58924 - DNA, 696 bp, Campylobacter jejuni
  CDS (1)..(696)
atgagtctttatgatagagactactcaagatcaaaagaatttgaaaatacacgctcaagcgaattaagtatttttattaaacaaacttatcaactttttgctgcttcattattagctgcaacagtaggtgcgtatgtaggaatttttgctttagcatcattttttatacaatcacaagtaactttttggatcctttttgctgttgaaatcggacttttatttgctttgcaatggaaaaaaagagaagctccattaaatcttgttttactttttggttttactttctgctcaggtttaacgcttacacctttacttatttcagttttagctctaccagctggaggaattatcatcgctcaagcttttgctttaacaacagttgcttttgcaggacttagtgtatttgctatgaatacaaaaaaagattttactgttatgggtaaagctttatttatagtattaatcgttattgtagcagcatctttactaaaccttttcttccaaagcagtatagttaatctagctatttcagcagtagctgcaatattattttcattttacattctttatgatacgcaaaatattatccgcggaaattatgaaactccaatcgaaggtgcagtagcactttatcttgattttgttaatcttttcgtatctttacttaatatcttaagaagcttcaatagcagataa

SEQ ID NO: 58925 - protein, 231 aa, Campylobacter jejuni
MSLYDRDYSRSKEFENTRSSELSIFIKQTYQLFAASLLAATVGAYVGIFALASFFIQSQVTFWILFAVEIGLLFALQWKKREAPLNLVLLFGFTFCSGLTLTPLLISVLALPAGGIIIAQAFALTTVAFAGLSVFAMNTKKDFTVMGKALFIVLIVIVAASLLNLFFQSSIVNLAISAVAAILFSFYILYDTQNIIRGNYETPIEGAVALYLDFVNLFVSLLNILRSFNSR

SEQ ID NO: 58926 - DNA, 669 bp, Pseudomonas aeruginosa
  CDS (1)..(669)
atgcaagaacagcaatatcagctgaactccgccgtcgcggaacagcgtgaagtcagcggcgttctgcgcaatacctacggcctgctggcactcaccctggccttcagcggcctggtggcctacgtttcgcagcagatgcgcctgccctatccgaacgtgttcgtggtgctgatcggcttctacggcctgttcttcctcaccgtgaagctgcgcaacagcgcctggggtctggtcagcactttcgccctgaccggcttcatgggctacacgctcggcccgatcctcaacatgtacctcggcctgcccaacggcggcagcgtcatcacttcggcgttcgccatgaccgccctggtgttcttcggcctgtccgcctatgtgctgaccacccgcaaggacatgagcttcctgtccggcttcatcaccgccggcttcttcgtcctgctgggcgccgtgctggtatcgctgttcttccagatcagtggcctgcaactggcgatcagcgccggcttcgtcctgttctcctcggcgatgatcctctaccagaccagcgcgatcatccacggcggcgaacgcaactacatcatggccaccatcagcctgtacgtgtcgatctacaacctgttcatcagcctgttgcagatcttcggcatcgccggcggcgacgactga

SEQ ID NO: 58927 - protein, 222 aa, Pseudomonas aeruginosa
MQEQQYQLNSAVAEQREVSGVLRNTYGLLALTLAFSGLVAYVSQQMRLPYPNVFVVLIGFYGLFFLTVKLRNSAWGLVSTFALTGFMGYTLGPILNMYLGLPNGGSVITSAFAMTALVFFGLSAYVLTTRKDMSFLSGFITAGFFVLLGAVLVSLFFQISGLQLAISAGFVLFSSAMILYQTSAIIHGGERNYIMATISLYVSIYNLFISLLQIFGIAGGDD

SEQ ID NO: 58928 - DNA, 663 bp, Pasteurella multocida
  CDS (1)..(663)
atggaatctcgcattgttctagatagcagagaaacatctctacttaacacccacaaagtgttacgcaatacttatttcttattaggtttaaccctcgctttttcagcagtggtcgcttacatctcaatgagcctaaacttaccacgcccaggtctcattttgatgctagcaggcttctacggtttattatttttaacttataaattatccaacagtggtttagggattctttctacgttcgcatttaccggctttttaggctatacattaggaccaattttaaatgtctatgtcagtcacggtgcaggtgatattgtcgtcttagcccttgccggcacagcggctgtgttctttgcttgttcagcttatgtgttaacgacaaagaaagacatgtctttcctttctggtaccattttcgctttattcattgtccttttactcggtatggttgccagtttcttcttccaatcaccaatgctttacattgctatcagtggtttattcgtcgtgttctctactttgggtattctctacgaaaccagcaatattattcatggcggagaaaccaactatattcgtgcaacagtcagtattttcgtatcactgtataacttatttattagcttactcaatatcttctcgattttatccaatgaagattaa

SEQ ID NO: 58929 - protein, 220 aa, Pasteurella multocida
MESRIVLDSRETSLLNTHKVLRNTYFLLGLTLAFSAVVAYISMSLNLPRPGLILMLAGFYGLLFLTYKLSNSGLGILSTFAFTGFLGYTLGPILNVYVSHGAGDIVVLALAGTAAVFFACSAYVLTTKKDMSFLSGTIFALFIVLLLGMVASFFFQSPMLYIAISGLFVVFSTLGILYETSNIIHGGETNYIRATVSIFVSLYNLFISLLNIFSILSNED

SEQ ID NO: 58930 - DNA, 699 bp, Borrelia burgdorferi
  CDS (1)..(699)
atgatcgatttaacacaagaaaaacaagaaatactaataaaaaacaagtttttagccaaagttttcgggcttatgtcaattggacttttaatctcagcagtatttgcatatgcaacctcagaaaatcaaacaatcaaagcaataatattctcaaattcaatgtcatttatggctatgatacttatacaatttggacttgtatatgcaataagtggtgctcttaataaaatatcaagcaatactgcaacagctcttttcttgctctactcagcactaacaggagtaacattatcttctatatttatgatttacacacaaggatcaatagtattcacattcggaattactgctggaacatttcttggaatgtctgtttatggatacactacaacaacagatctaacaaaaatgggaagctatttaataatgggcttatggggaatcattattgcatctcttgttaatatgttttttagaagctcaggtcttaatttccttatatctattttgggcgtagttatatttacaggcttaacagcttatgatgttcaaaatatttctaaaatggacaaaatgctacaagacgacactgaaataaaaaacagaatggcggttgtagcctcacttaaactttatttagattttataaatttattcttatatcttctaagatttttgggccaaagaagaaacgattaa

SEQ ID NO: 58931 - protein, 232 aa, Borrelia burgdorferi
MIDLTQEKQEILIKNKFLAKVFGLMSIGLLISAVFAYATSENQTIKAIIFSNSMSFMAMILIQFGLVYAISGALNKISSNTATALFLLYSALTGVTLSSIFMIYTQGSIVFTFGITAGTFLGMSVYGYTTTTDLTKMGSYLIMGLWGIIIASLVNMFFRSSGLNFLISILGVVIFTGLTAYDVQNISKMDKMLQDDTEIKNRMAVVASLKLYLDFINLFLYLLRFLGQRRND

SEQ ID NO: 58932 - DNA, 696 bp, Deinococcus radiodurans
  CDS (1)..(696)
atggtaaagagtatgcagcagatagccatgacccaacaaaagacgctggatcaggtcaggacctttatggcccgcacctactcctggatggcggcgggcctcgcgctcacggccggcgtcgcttacctgaccgcccagaacgaagggctcgcgatgcaagtcgccagcctgcgcctgccgctgatgctcgcgcaactcgcgctggtgttcgtgctgagcatgttcgcccagcgcctcagcgcggcggtggccggcgccctgttcgtcgggtacgcggcgctcaccggcctgaccttcagcgccctgctcttcgcctactcgcccgccgccgtcattacggcctttgccgtgagcgccggcaccttcggcctcatgagcgtggccggtttcgtcatcaaaaaggacctcagcgccatgggccgcttcttcctgtttgcggtgcttggattggtcgtcgccatgctggtcaacctgttcgtgggcagcagcgccctgagcctcggcatcagcatgatcggcgtgtttctgttcgccggcctgactgcctacgacacccagatgctgcggaacctcgccctgagcggtatcagcggtgagcaggccgagcgcgcttccatcaacggggcgctcgcgctgtacctcgacttcatcaacatcttcctgttcctgctgaatatcggcaactcgcgcgactga

SEQ ID NO: 58933 - protein, 231 aa, Deinococcus radiodurans
MVKSMQQIAMTQQKTLDQVRTFMARTYSWMAAGLALTAGVAYLTAQNEGLAMQVASLRLPLMLAQLALVFVLSMFAQRLSAAVAGALFVGYAALTGLTFSALLFAYSPAAVITAFAVSAGTFGLMSVAGFVIKKDLSAMGRFFLFAVLGLVVAMLVNLFVGSSALSLGISMIGVFLFAGLTAYDTQMLRNLALSGISGEQAERASINGALALYLDFINIFLFLLNIGNSRD

SEQ ID NO: 58934 - DNA, 693 bp, Helicobacter pylori J99
  CDS (1)..(693)
atggcattgtatgacagagctaattctcgtaacgcgtatgcagaagattctgtgttgcatgaaagcgagctggtaagttttgttaaaacgacttataagttctttgcgggcagtttgttattagcgactgttggggcgttactgggtttaatgaattttcaagccgtagtgcagtataaatgggtattttttatcgctgaaattgtggcgttttttggtttgatgttttctaaatccaaacccggtttgaatttgttcatgctgtttgctttcacttcattatcaggggttactttagtgcctttgttgggtatggtgattgcaaaagctggtttaggagcggtttggcaagctttgggcatgacaactattgtttttggtttgatgagcgtgtatgcccttaagactaaaaacgatctagcgaatatgggtaaaatgctctttatcgctttgattgtggtggtggtgtgttcgctcattaacttgtttttgggtagccccatgttccaagtcgtcattgcgggagcgagtgcgattttattcagtctttatatcgcttatgacactcaaaacatcgttaaaggcatgtatgatagccccattgatgcggcggtgagcttgtatttagactttttgaatgtcttcatttctatcttgcaaatcattggtattttttcagacagagacaaatag

SEQ ID NO: 58935 - protein, 230 aa, Helicobacter pylori J99
MALYDRANSRNAYAEDSVLHESELVSFVKTTYKFFAGSLLLATVGALLGLMNFQAVVQYKWVFFIAEIVAFFGLMFSKSKPGLNLFMLFAFTSLSGVTLVPLLGMVIAKAGLGAVWQALGMTTIVFGLMSVYALKTKNDLANMGKMLFIALIVVVVCSLINLFLGSPMFQVVIAGASAILFSLYIAYDTQNIVKGMYDSPIDAAVSLYLDFLNVFISILQIIGIFSDRDK

SEQ ID NO: 58936 - DNA, 705 bp, Escherichia coli
  CDS (1)..(705)
atggacagattcccacgttctgattcaatcgtacaaccccgggctggcttgcaaacttatatggctcaagtctatggctggatgaccgttggcttgttgctgaccgcatttgttgcctggtatgcggctaattccgcggccgtgatggagctgttgttcactaaccgtgtctttttaatcggtctgatcatcgcgcaattagcattggttattgtgttatcagcgatgattcaaaagctgagcgcaggtgtaacgacgatgctctttatgctttattcggcgctgacgggtcttacgctttccagtatattcattgtctataccgctgcttctatcgccagtactttcgtcgttactgccgggatgttcggcgcaatgagcctgtacggttacaccacgaagcgcgatttaagtggctttggcaatatgctgtttatggcgttaatcggcattgtgctggcatcgctggtcaacttctggttgaaaagcgaagcattgatgtgggcagttacctacatcggcgtgattgtctttgtcggattgacggcgtatgacacgcagaaactgaaaaatatgggtgagcagattgatacccgcgacacgtcgaacctgcgcaaatattccattcttggcgcgttaaccttgtatctggacttcatcaacctgttcctgatgttgttgcggatcttcggcaaccgccgttaa

SEQ ID NO: 58937 - protein, 234 aa, Escherichia coli
MDRFPRSDSIVQPRAGLQTYMAQVYGWMTVGLLLTAFVAWYAANSAAVMELLFTNRVFLIGLIIAQLALVIVLSAMIQKLSAGVTTMLFMLYSALTGLTLSSIFIVYTAASIASTFVVTAGMFGAMSLYGYTTKRDLSGFGNMLFMALIGIVLASLVNFWLKSEALMWAVTYIGVIVFVGLTAYDTQKLKNMGEQIDTRDTSNLRKYSILGALTLYLDFINLFLMLLRIFGNRR

SEQ ID NO: 58938 - DNA, 705 bp, Lactococcus lactis
  CDS (1)..(705)
atgaatgataataatgttatctttgaccaaagaagcgatggattgaatgcatttttcagtaaaatttatgcgttgatgggagcaggagtattagtttctgcactcgtttcttggataatgattacatttttcttagataacatgacagcaattctccaaagtggaagtttattcttccttgtactctggattattcctttagtgatggtagtatcacttcaagggttagcaatgaaaaactcaaaaatggcactaccgatttttatcggttatgcggcatttatgggattcttgattagttttacacttttgatgtataccgccactgatattactttagcctttgttacggcagcagcaatgttctttggtttatctgtttatggacgatttactaaacgtaatttatcggcaatgggtaaagcatttggtgttgcagtctggggcttgattattgcaatgtttcttaatttcttctttgcaagtacaggacttacaatccttattagcctagtaggtgttgtgattttcgcagggcttatcgcttgggataatcaaaaaattacacaggtttataatgcaaacaatggacaagtaagtgatggttgggcaatttcaatggcactttcactctatcttgacttcatcaacatgtttctcttcctactccgtcttttcggtatcgcaggtggaaatcgcgattaa

SEQ ID NO: 58939 - protein, 234 aa, Lactococcus lactis
MNDNNVIFDQRSDGLNAFFSKIYALMGAGVLVSALVSWIMITFFLDNMTAILQSGSLFFLVLWIIPLVMVVSLQGLAMKNSKMALPIFIGYAAFMGFLISFTLLMYTATDITLAFVTAAAMFFGLSVYGRFTKRNLSAMGKAFGVAVWGLIIAMFLNFFFASTGLTILISLVGVVIFAGLIAWDNQKITQVYNANNGQVSDGWAISMALSLYLDFINMFLFLLRLFGIAGGNRD

SEQ ID NO: 58940 - DNA, 809 bp, Mus musculus
  CDS (22)..(738)
ggggcgggcactgctggcgacatggccgacacggacccgggctatccccgctcgtccatcgaggatgacttcaactacggcagctgcgtggcgtcggccagcgtgcacatccgcatggcctttctcagaaaagtctacagtatcctctctctgcaagtcctcctgactacagtgacctctgccctgttcctgtatttccaagctctgcggacatttgtccatgaaagccctgccttaattgtggtgtttgctctgggatctctgggcttgatctttgcactgactctgcacagacacacgcatcctctgaacctctatctactctttgcatttacactgtcagaatccctggccgtggcagctgttgttaccttctatgatgtatatctggttctgcaagcgtttataatgactactgcagtctttcttggcttgactgcctatactctacaatcaaagagagatttcaccaaattcggagcagggttgtttgctggtttgtggattttgtgcttggcaggattcttgaagctgtttttttacagtgagacgatggagctggtcttggcctctctaggcgccctcctcttctgtgggttcatcatctatgatacacactcgctgatgcacagactctctcccgaagagtacgtgatcgctgccatcagtctctacatggatatcatcaacctcttcctgcacctgttgaagtttctggaagcggttaataaaaagtaaccgagcagtgttcagagacagttctattatgaaagacgcttgaattaaacttaaatgttaatattaaaagc

SEQ ID NO: 58941 - protein, 238 aa, Mus musculus
MADTDPGYPRSSIEDDFNYGSCVASASVHIRMAFLRKVYSILSLQVLLTTVTSALFLYFQALRTFVHESPALIVVFALGSLGLIFALTLHRHTHPLNLYLLFAFTLSESLAVAAVVTFYDVYLVLQAFIMTTAVFLGLTAYTLQSKRDFTKFGAGLFAGLWILCLAGFLKLFFYSETMELVLASLGALLFCGFIIYDTHSLMHRLSPEEYVIAAISLYMDIINLFLHLLKFLEAVNKK

SEQ ID NO: 58942 - DNA, 25 bp, Primer
atggatcgtattgttagttcttcac

SEQ ID NO: 58943 - DNA, 22 bp, Primer
ttaatcgcggctagcgaagccc

SEQ ID NO: 58944 - protein, 228 aa, consensus
  MISC_FEATURE (1)..(228): consensus for the disclosure of xaa see table XV
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 58945 - DNA, 1614 bp, Escherichia coli; identical to SEQ ID NO: 38469
  CDS (130)..(1503)

SEQ ID NO: 58946 - protein, 457 aa, Escherichia coli; identical to SEQ ID NO: 38470

SEQ ID NO: 58947 - DNA, 1221 bp, Thermococcus kodakaraensis; identical to SEQ ID NO: 38471
  CDS (1)..(1221)

SEQ ID NO: 58948 - protein, 406 aa, Thermococcus kodakaraensis; identical to SEQ ID NO: 38472

SEQ ID NO: 58949 - DNA, 1530 bp, Staphylococcus epidermidis RP62A; identical to SEQ ID NO: 38473
  CDS (1)..(1530)

SEQ ID NO: 58950 - protein, 509 aa, Staphylococcus epidermidis RP62A; identical to SEQ ID NO: 38474

SEQ ID NO: 58951 - DNA, 1452 bp, Homo sapiens; identical to SEQ ID NO: 38475
  CDS (1)..(1452)

SEQ ID NO: 58952 - protein, 483 aa, Homo sapiens; identical to SEQ ID NO: 38476

SEQ ID NO: 58953 - DNA, 1107 bp, Archaeoglobus fulgidus DSM 4304; identical to SEQ ID NO: 38477
  CDS (1)..(1107)

SEQ ID NO: 58954 - protein, 368 aa, Archaeoglobus fulgidus DSM 4304; identical to SEQ ID NO: 38478

SEQ ID NO: 58955 - DNA, 1131 bp, Thermoplasma volcanium GSS1; identical to SEQ ID NO: 38479
  CDS (1)..(1131)

SEQ ID NO: 58956 - protein, 376 aa, Thermoplasma volcanium GSS1; identical to SEQ ID NO: 38480

SEQ ID NO: 58957 - DNA, 1506 bp, Arabidopsis thaliana; identical to SEQ ID NO: 38481
  CDS (1)..(1506)

SEQ ID NO: 58958 - protein, 501 aa, Arabidopsis thaliana; identical to SEQ ID NO: 38482

SEQ ID NO: 58959 - DNA, 1833 bp, Arabidopsis thaliana; identical to SEQ ID NO: 38483
  CDS (1)..(1833)

SEQ ID NO: 58960 - protein, 610 aa, Arabidopsis thaliana; identical to SEQ ID NO: 38484

SEQ ID NO: 58961 - DNA, 1851 bp, Arabidopsis thaliana; identical to SEQ ID NO: 38485
  CDS (1)..(1851)

SEQ ID NO: 58962 - protein, 616 aa, Arabidopsis thaliana [sequence omitted]

SEQ ID NO: 58963 - DNA, 1497 bp, Arabidopsis thaliana; identical to SEQ ID NO: 38487
  CDS (1)..(1497)

SEQ ID NO: 58964 - protein, 498 aa, Arabidopsis thaliana; identical to SEQ ID NO: 38488

SEQ ID NO: 58965 - DNA, 2370 bp, Arabidopsis thaliana; identical to SEQ ID NO: 38489
  CDS (1)..(2370)

SEQ ID NO: 58966 - protein, 789 aa, Arabidopsis thaliana; identical to SEQ ID NO: 38490

SEQ ID NO: 58967 - DNA, 2142 bp, Arabidopsis thaliana; identical to SEQ ID NO: 38491
  CDS (1)..(2142)

SEQ ID NO: 58968 - protein, 713 aa, Arabidopsis thaliana; identical to SEQ ID NO: 38492

SEQ ID NO: 58969 - DNA, 1479 bp, Helicobacter pylori 26695; identical to SEQ ID NO: 38493
  CDS (1)..(1479)

SEQ ID NO: 58970 - protein, 492 aa, Helicobacter pylori 26695; identical to SEQ ID NO: 38494

SEQ ID NO: 58971 - DNA, 1950 bp, Treponema pallidum subsp. pallidum str. Nichols; identical to SEQ ID NO: 38495
  CDS (1)..(1950)

SEQ ID NO: 58972 - protein, 649 aa, Treponema pallidum subsp. pallidum str. Nichols; identical to SEQ ID NO: 38496

SEQ ID NO: 58973 - DNA, 1476 bp, Helicobacter pylori J99; identical to SEQ ID NO: 38497
  CDS (1)..(1476)

SEQ ID NO: 58974 - protein, 491 aa, Helicobacter pylori J99; identical to SEQ ID NO: 38498

SEQ ID NO: 58975 - DNA, 1833 bp, Pasteurella multocida subsp. multocida str. Pm70; identical to SEQ ID NO: 38499
  CDS (1)..(1833)

SEQ ID NO: 58976 - protein, 610 aa, Pasteurella multocida subsp. multocida str. Pm70; identical to SEQ ID NO: 38500

SEQ ID NO: 58977 - DNA, 1389 bp, Neisseria meningitidis MC58; identical to SEQ ID NO: 38501
  CDS (1)..(1389)

SEQ ID NO: 58978 - protein, 462 aa, Neisseria meningitidis MC58; identical to SEQ ID NO: 38502

SEQ ID NO: 58979 - DNA, 1278 bp, Methanothermobacter thermautotrophicus str. Delta H; identical to SEQ ID NO: 38503
  CDS (1)..(1278)

SEQ ID NO: 58980 - protein, 425 aa, Methanothermobacter thermautotrophicus str. Delta H; identical to SEQ ID NO: 38504

SEQ ID NO: 58981 - DNA, 1446 bp, Clostridium acetobutylicum ATCC 824; identical to SEQ ID NO: 38505
  CDS (1)..(1446)

SEQ ID NO: 58982 - protein, 481 aa, Clostridium acetobutylicum ATCC 824; identical to SEQ ID NO: 38506

SEQ ID NO: 58983 - DNA, 1167 bp, Thermoplasma acidophilum DSM 1728; identical to SEQ ID NO: 38507
  CDS (1)..(1167)

SEQ ID NO: 58984 - protein, 388 aa, Thermoplasma acidophilum DSM 1728; identical to SEQ ID NO: 38508

SEQ ID NO: 58985 - DNA, 1941 bp, Escherichia coli K12; identical to SEQ ID NO: 38509
  CDS (1)..(1941)

SEQ ID NO: 58986 - protein, 646 aa, Escherichia coli K12; identical to SEQ ID NO: 38510

SEQ ID NO: 58987 - DNA, 1554 bp, Caulobacter crescentus CB15; identical to SEQ ID NO: 38511
  CDS (1)..(1554)

SEQ ID NO: 58988 - protein, 517 aa, Caulobacter crescentus CB15; identical to SEQ ID NO: 38512

SEQ ID NO: 58989 - DNA, 1512 bp, Sinorhizobium meliloti 1021; identical to SEQ ID NO: 38513
  CDS (1)..(1512)

SEQ ID NO: 58990 - protein, 503 aa, Sinorhizobium meliloti 1021; identical to SEQ ID NO: 38514

SEQ ID NO: 58991 - DNA, 1479 bp, Synechocystis sp. PCC 6803; identical to SEQ ID NO: 38515
  CDS (1)..(1479)

SEQ ID NO: 58992 - protein, 492 aa, Synechocystis sp. PCC 6803; identical to SEQ ID NO: 38516

SEQ ID NO: 58993 - DNA, 1374 bp, Salmonella typhimurium LT2; identical to SEQ ID NO: 38517
  CDS (1)..(1374)

SEQ ID NO: 58994 - protein, 457 aa, Salmonella typhimurium LT2; identical to SEQ ID NO: 38518

SEQ ID NO: 58995 - DNA, 1890 bp, Salmonella typhimurium LT2; identical to SEQ ID NO: 38519
  CDS (1)..(1890)

SEQ ID NO: 58996 - protein, 629 aa, Salmonella typhimurium LT2; identical to SEQ ID NO: 38520

SEQ ID NO: 58997 - DNA, 1563 bp, Listeria monocytogenes EGD-e; identical to SEQ ID NO: 38521
  CDS (1)..(1563)

SEQ ID NO: 58998 - protein, 520 aa, Listeria monocytogenes EGD-e; identical to SEQ ID NO: 38522

SEQ ID NO: 58999 - DNA, 1542 bp, Nostoc sp. PCC 7120; identical to SEQ ID NO: 38523
  CDS (1)..(1542)

SEQ ID NO: 59000 - protein, 513 aa, Nostoc sp. PCC 7120; identical to SEQ ID NO: 38524

SEQ ID NO: 59001 - DNA, 1281 bp, Nostoc sp. PCC 7120; identical to SEQ ID NO: 38525
  CDS (1)..(1281)

SEQ ID NO: 59002 - protein, 426 aa, Nostoc sp. PCC 7120; identical to SEQ ID NO: 38526

SEQ ID NO: 59003 - DNA, 1200 bp, Caenorhabditis elegans; identical to SEQ ID NO: 38527
  CDS (1)..(1200)

SEQ ID NO: 59004 - protein, 399 aa, Caenorhabditis elegans; identical to SEQ ID NO: 38528

SEQ ID NO: 59005 - DNA, 1398 bp, Ralstonia solanacearum GMI1000; identical to SEQ ID NO: 38529
  CDS (1)..(1398)

SEQ ID NO: 59006 - protein, 465 aa, Ralstonia solanacearum GMI1000; identical to SEQ ID NO: 38530

SEQ ID NO: 59007 - DNA, 1509 bp, Agrobacterium tumefaciens str. C58; identical to SEQ ID NO: 38531
  CDS (1)..(1509)

SEQ ID NO: 59008 - protein, 502 aa, Agrobacterium tumefaciens str. C58; identical to SEQ ID NO: 38532

SEQ ID NO: 59009 - DNA, 1608 bp, Brucella melitensis 16M; identical to SEQ ID NO: 38533
  CDS (1)..(1608)

SEQ ID NO: 59010 - protein, 535 aa, Brucella melitensis 16M; identical to SEQ ID NO: 38534

SEQ ID NO: 59011 - DNA, 1437 bp, Clostridium perfringens str. 13; identical to SEQ ID NO: 38535
  CDS (1)..(1437)

SEQ ID NO: 59012 - protein, 478 aa, Clostridium perfringens str. 13; identical to SEQ ID NO: 38536

SEQ ID NO: 59013 - DNA, 1587 bp, Clostridium perfringens str. 13; identical to SEQ ID NO: 38537
  CDS (1)..(1587)

SEQ ID NO: 59014 - protein, 528 aa, Clostridium perfringens str. 13; identical to SEQ ID NO: 38538

SEQ ID NO: 59015 - DNA, 1989 bp, Schizosaccharomyces pombe; identical to SEQ ID NO: 38539
  CDS (1)..(1989)

SEQ ID NO: 59016 - protein, 662 aa, Schizosaccharomyces pombe; identical to SEQ ID NO: 38540

SEQ ID NO: 59017 - DNA, 1398 bp, Schizosaccharomyces pombe; identical to SEQ ID NO: 38541
  CDS (1)..(1398)

SEQ ID NO: 59018 - protein, 465 aa, Schizosaccharomyces pombe; identical to SEQ ID NO: 38542

SEQ ID NO: 59019 - DNA, 1362 bp, Schizosaccharomyces pombe; identical to SEQ ID NO: 38543
  CDS (1)..(1362)

SEQ ID NO: 59020 - protein, 453 aa, Schizosaccharomyces pombe; identical to SEQ ID NO: 38544

SEQ ID NO: 59021 - DNA, 1275 bp, Corynebacterium glutamicum ATCC 13032; identical to SEQ ID NO: 38545
  CDS (1)..(1275)

SEQ ID NO: 59022 - protein, 424 aa, Corynebacterium glutamicum ATCC 13032; identical to SEQ ID NO: 38546

SEQ ID NO: 59023 - DNA, 2199 bp, Corynebacterium glutamicum ATCC 13032; identical to SEQ ID NO: 38547
  CDS (1)..(2199)

SEQ ID NO: 59024 - protein, 732 aa, Corynebacterium glutamicum ATCC 13032; identical to SEQ ID NO: 38548

SEQ ID NO: 59025 - DNA, 1668 bp, Methanosarcina acetivorans C2A; identical to SEQ ID NO: 38549
  CDS (1)..(1668)

SEQ ID NO: 59026 - protein, 555 aa, Methanosarcina acetivorans C2A; identical to SEQ ID NO: 38550

SEQ ID NO: 59027 - DNA, 1764 bp, Methanosarcina mazei Go1; identical to SEQ ID NO: 38551
  CDS (1)..(1764)

SEQ ID NO: 59028 - protein, 587 aa, Methanosarcina mazei Go1; identical to SEQ ID NO: 38552

SEQ ID NO: 59029 - DNA, 1290 bp, Methanosarcina mazei Go1; identical to SEQ ID NO: 38553
  CDS (1)..(1290)

SEQ ID NO: 59030 - protein, 429 aa, Methanosarcina mazei Go1; identical to SEQ ID NO: 38554

SEQ ID NO: 59031 - DNA, 1293 bp, Xanthomonas campestris pv. campestris str. ATCC 33913; identical to SEQ ID NO: 38555
  CDS (1)..(1293)

SEQ ID NO: 59032 - protein, 430 aa, Xanthomonas campestris pv. campestris str. ATCC 33913; identical to SEQ ID NO: 38556

SEQ ID NO: 59033 - DNA, 1377 bp, Xanthomonas campestris pv. campestris str. ATCC 33913; identical to SEQ ID NO: 38557
  CDS (1)..(1377)

SEQ ID NO: 59034 - protein, 458 aa, Xanthomonas campestris pv. campestris str. ATCC 33913; identical to SEQ ID NO: 38558

SEQ ID NO: 59035 - DNA, 1293 bp, Xanthomonas axonopodis pv. citri str. 306; identical to SEQ ID NO: 38559
  CDS (1)..(1293)

SEQ ID NO: 59036 - protein, 430 aa, Xanthomonas axonopodis pv. citri str. 306; identical to SEQ ID NO: 38560

SEQ ID NO: 59037 - DNA, 1974 bp, Chlorobium tepidum TLS; identical to SEQ ID NO: 38561
  CDS (1)..(1974)

SEQ ID NO: 59038 - protein, 657 aa, Chlorobium tepidum TLS; identical to SEQ ID NO: 38562

SEQ ID NO: 59039 - DNA, 1245 bp, Chlorobium tepidum TLS; identical to SEQ ID NO: 38563
  CDS (1)..(1245)

SEQ ID NO: 59040 - protein, 414 aa, Chlorobium tepidum TLS; identical to SEQ ID NO: 38564

SEQ ID NO: 59041 - DNA, 1488 bp, Oceanobacillus iheyensis HTE831; identical to SEQ ID NO: 38565
  CDS (1)..(1488)

SEQ ID NO: 59042 - protein, 495 aa, Oceanobacillus iheyensis HTE831; identical to SEQ ID NO: 38566

SEQ ID NO: 59043 - DNA, 1566 bp, Leptospira interrogans serovar Lai str. 56601; identical to SEQ ID NO: 38567
  CDS (1)..(1566)

SEQ ID NO: 59044 - protein, 521 aa, Leptospira interrogans serovar Lai str. 56601; identical to SEQ ID NO: 38568

SEQ ID NO: 59045 - DNA, 1377 bp, Shewanella oneidensis MR-1; identical to SEQ ID NO: 38569
  CDS (1)..(1377)

SEQ ID NO: 59046 - protein, 458 aa, Shewanella oneidensis MR-1; identical to SEQ ID NO: 38570

SEQ ID NO: 59047 - DNA, 1302 bp, Shewanella oneidensis MR-1; identical to SEQ ID NO: 38571
  CDS (1)..(1302)

SEQ ID NO: 59048 - protein, 433 aa, Shewanella oneidensis MR-1; identical to SEQ ID NO: 38572

SEQ ID NO: 59049 - DNA, 1284 bp, Shewanella oneidensis MR-1; identical to SEQ ID NO: 38573
  CDS (1)..(1284)

SEQ ID NO: 59050 - protein, 427 aa, Shewanella oneidensis MR-1; identical to SEQ ID NO: 38574

SEQ ID NO: 59051 - DNA, 1230 bp, Shewanella oneidensis MR-1; identical to SEQ ID NO: 38575
  CDS (1)..(1230)

SEQ ID NO: 59052 - protein, 409 aa, Shewanella oneidensis MR-1; identical to SEQ ID NO: 38576

SEQ ID NO: 59053 - DNA, 1608 bp, Shewanella oneidensis MR-1; identical to SEQ ID NO: 38577
  CDS (1)..(1608)

SEQ ID NO: 59054 - protein, 535 aa, Shewanella oneidensis MR-1; identical to SEQ ID NO: 38578

SEQ ID NO: 59055 - DNA, 1872 bp, Shewanella oneidensis MR-1; identical to SEQ ID NO: 38579
  CDS (1)..(1872)

SEQ ID NO: 59056 - protein, 623 aa, Shewanella oneidensis MR-1; identical to SEQ ID NO: 38580

SEQ ID NO: 59057 - DNA, 1554 bp, Streptococcus mutans UA159; identical to SEQ ID NO: 38581
  CDS (1)..(1554)

SEQ ID NO: 59058 - protein, 517 aa, Streptococcus mutans UA159; identical to SEQ ID NO: 38582

SEQ ID NO: 59059 - DNA, 1446 bp, Clostridium tetani E88; identical to SEQ ID NO: 38583
  CDS (1)..(1446)

SEQ ID NO: 59060 - protein, 481 aa, Clostridium tetani E88; identical to SEQ ID NO: 38584

SEQ ID NO: 59061 - DNA, 1575 bp, Clostridium tetani E88; identical to SEQ ID NO: 38585
  CDS (1)..(1575)

SEQ ID NO: 59062 - protein, 524 aa, Clostridium tetani E88; identical to SEQ ID NO: 38586

SEQ ID NO: 59063 - DNA, 1113 bp, Clostridium tetani E88; identical to SEQ ID NO: 38587
  CDS (1)..(1113)

SEQ ID NO: 59064 - protein, 370 aa, Clostridium tetani E88; identical to SEQ ID NO: 38588

SEQ ID NO: 59065 - DNA, 1587 bp, Lactobacillus plantarum WCFS1; identical to SEQ ID NO: 38589
  CDS (1)..(1587)

SEQ ID NO: 59066 - protein, 528 aa, Lactobacillus plantarum WCFS1; identical to SEQ ID NO: 38590

SEQ ID NO: 59067 - DNA, 1380 bp, Vibrio parahaemolyticus RIMD 2210633; identical to SEQ ID NO: 38591
  CDS (1)..(1380)

SEQ ID NO: 59068 - protein, 459 aa, Vibrio parahaemolyticus RIMD 2210633; identical to SEQ ID NO: 38592

SEQ ID NO: 59069 - DNA, 1932 bp, Vibrio parahaemolyticus RIMD 2210633; identical to SEQ ID NO: 38593
  CDS (1)..(1932)

SEQ ID NO: 59070 - protein, 643 aa, Vibrio parahaemolyticus RIMD 2210633; identical to SEQ ID NO: 38594

SEQ ID NO: 59071 - DNA, 1125 bp, Bacteroides thetaiotaomicron VPI-5482; identical to SEQ ID NO: 38595
  CDS (1)..(1125)

SEQ ID NO: 59072 - protein, 374 aa, Bacteroides thetaiotaomicron VPI-5482; identical to SEQ ID NO: 38596

SEQ ID NO: 59073 - DNA, 1944 bp, Bacteroides thetaiotaomicron VPI-5482; identical to SEQ ID NO: 38597
  CDS (1)..(1944)

SEQ ID NO: 59074 - protein, 647 aa, Bacteroides thetaiotaomicron VPI-5482; identical to SEQ ID NO: 38598

SEQ ID NO: 59075 - DNA, 1611 bp, Enterococcus faecalis V583; identical to SEQ ID NO: 38599
  CDS (1)..(1611)

SEQ ID NO: 59076 - protein, 536 aa, Enterococcus faecalis V583; identical to SEQ ID NO: 38600

SEQ ID NO: 59077 - DNA, 1236 bp, Coxiella burnetii RSA 493; identical to SEQ ID NO: 38601
  CDS (1)..(1236)

SEQ ID NO: 59078 - protein, 411 aa, Coxiella burnetii RSA 493; identical to SEQ ID NO: 38602

SEQ ID NO: 59079 - DNA, 1545 bp, Bacillus cereus ATCC 14579; identical to SEQ ID NO: 38603
  CDS (1)..(1545)

SEQ ID NO: 59080 - protein, 514 aa, Bacillus cereus ATCC 14579; identical to SEQ ID NO: 38604

SEQ ID NO: 59081 - DNA, 1377 bp, Bacillus cereus ATCC 14579; identical to SEQ ID NO: 38605
  CDS (1)..(1377)

SEQ ID NO: 59082 - protein, 458 aa, Bacillus cereus ATCC 14579; identical to SEQ ID NO: 38606

SEQ ID NO: 59083 - DNA, 1446 bp, Bacillus cereus ATCC 14579; identical to SEQ ID NO: 38607
  CDS (1)..(1446)

SEQ ID NO: 59084 - protein, 481 aa, Bacillus cereus ATCC 14579; identical to SEQ ID NO: 38608

SEQ ID NO: 59085 - DNA, 1374 bp, Nitrosomonas europaea ATCC 19718; identical to SEQ ID NO: 38609
  CDS (1)..(1374)

SEQ ID NO: 59086 - protein, 457 aa, Nitrosomonas europaea ATCC 19718; identical to SEQ ID NO: 38610

SEQ ID NO: 59087 - DNA, 1860 bp, Arabidopsis thaliana; identical to SEQ ID NO: 38611
  CDS (1)..(1860)

SEQ ID NO: 59088 - protein, 619 aa, Arabidopsis thaliana; identical to SEQ ID NO: 38612

SEQ ID NO: 59089 - DNA, 1593 bp, Helicobacter hepaticus ATCC 51449; identical to SEQ ID NO: 38613
  CDS (1)..(1593)

SEQ ID NO: 59090 - protein, 530 aa, Helicobacter hepaticus ATCC 51449; identical to SEQ ID NO: 38614

SEQ ID NO: 59091 - DNA, 1359 bp, Rhodopirellula baltica SH 1; identical to SEQ ID NO: 38615
  CDS (1)..(1359)

SEQ ID NO: 59092 - protein, 452 aa, Rhodopirellula baltica SH 1; identical to SEQ ID NO: 38616

SEQ ID NO: 59093 - DNA, 2796 bp, Rhodopirellula baltica SH 1; identical to SEQ ID NO: 38617
  CDS (1)..(2796)

SEQ ID NO: 59094 - protein, 931 aa, Rhodopirellula baltica SH 1; identical to SEQ ID NO: 38618

SEQ ID NO: 59095 - DNA, 1752 bp, Wigglesworthia glossinidia endosymbiont of Glossina brevipalpis; identical to SEQ ID NO: 38619
  CDS (1)..(1752)

SEQ ID NO: 59096 - protein, 583 aa, Wigglesworthia glossinidia endosymbiont of Glossina brevipalpis; identical to SEQ ID NO: 38620

SEQ ID NO: 59097 - DNA, 1821 bp, Haemophilus ducreyi 35000HP; identical to SEQ ID NO: 38621
  CDS (1)..(1821)

SEQ ID NO: 59098 - protein, 606 aa, Haemophilus ducreyi 35000HP; identical to SEQ ID NO: 38622

SEQ ID NO: 59099 - DNA, 1812 bp, Prochlorococcus marinus subsp. marinus str. CCMP1375; identical to SEQ ID NO: 38623
  CDS (1)..(1812)

SEQ ID NO: 59100 - protein, 603 aa, Prochlorococcus marinus subsp. marinus str. CCMP1375; identical to SEQ ID NO: 38624

SEQ ID NO: 59101 - DNA, 1464 bp, Candidatus Blochmannia floridanus; identical to SEQ ID NO: 38625
  CDS (1)..(1464)

SEQ ID NO: 59102 - protein, 487 aa, Candidatus Blochmannia floridanus; identical to SEQ ID NO: 38626

SEQ ID NO: 59103 - DNA, 1725 bp, Bordetella pertussis Tohama I; identical to SEQ ID NO: 38627
  CDS (1)..(1725)

SEQ ID NO: 59104 - protein, 574 aa, Bordetella pertussis Tohama I; identical to SEQ ID NO: 38628

SEQ ID NO: 59105 - DNA, 1389 bp, Bordetella bronchiseptica RB50; identical to SEQ ID NO: 38629
  CDS (1)..(1389)

SEQ ID NO: 59106 - protein, 462 aa, Bordetella bronchiseptica RB50; identical to SEQ ID NO: 38630

SEQ ID NO: 59107 - DNA, 1779 bp, Prochlorococcus marinus subsp. pastoris str. CCMP1986; identical to SEQ ID NO: 38631
  CDS (1)..(1779)

SEQ ID NO: 59108 - protein, 592 aa, Prochlorococcus marinus subsp. pastoris str. CCMP1986; identical to SEQ ID NO: 38632

SEQ ID NO: 59109 - DNA, 1797 bp, Synechococcus sp. WH 8102; identical to SEQ ID NO: 38633
  CDS (1)..(1797)

SEQ ID NO: 59110 - protein, 598 aa, Synechococcus sp. WH 8102; identical to SEQ ID NO: 38634

SEQ ID NO: 59111 - DNA, 1419 bp, Chromobacterium violaceum ATCC 12472; identical to SEQ ID NO: 38635
  CDS (1)..(1419)

SEQ ID NO: 59112 - protein, 472 aa, Chromobacterium violaceum ATCC 12472; identical to SEQ ID NO: 38636

SEQ ID NO: 59113 - DNA, 1326 bp, Chromobacterium violaceum ATCC 12472; identical to SEQ ID NO: 38637
  CDS (1)..(1326)

SEQ ID NO: 59114 - protein, 441 aa, Chromobacterium violaceum ATCC 12472; identical to SEQ ID NO: 38638

SEQ ID NO: 59115 - DNA, 1263 bp, Chromobacterium violaceum ATCC 12472; identical to SEQ ID NO: 38639
  CDS (1)..(1263)

SEQ ID NO: 59116 - protein, 420 aa, Chromobacterium violaceum ATCC 12472; identical to SEQ ID NO: 38640

SEQ ID NO: 59117 - DNA, 1383 bp, Chromobacterium violaceum ATCC 12472; identical to SEQ ID NO: 38641
  CDS (1)..(1383)

SEQ ID NO: 59118 - protein, 460 aa, Chromobacterium violaceum ATCC 12472; identical to SEQ ID NO: 38642

SEQ ID NO: 59119 - DNA, 1320 bp, Chromobacterium violaceum ATCC 12472; identical to SEQ ID NO: 38643
  CDS (1)..(1320)

SEQ ID NO: 59120 - protein, 439 aa, Chromobacterium violaceum ATCC 12472; identical to SEQ ID NO: 38644

SEQ ID NO: 59121 - DNA, 1815 bp, Porphyromonas gingivalis W83; identical to SEQ ID NO: 38645
  CDS (1)..(1815)

SEQ ID NO: 59122 - protein, 604 aa, Porphyromonas gingivalis W83; identical to SEQ ID NO: 38646

SEQ ID NO: 59123 - DNA, 1284 bp, Porphyromonas gingivalis W83; identical to SEQ ID NO: 38647
  CDS (1)..(1284)

SEQ ID NO: 59124 - protein, 427 aa, Porphyromonas gingivalis W83; identical to SEQ ID NO: 38648

SEQ ID NO: 59125 - DNA, 1518 bp, Wolinella succinogenes DSM 1740; identical to SEQ ID NO: 38649
  CDS (1)..(1518)

SEQ ID NO: 59126 - protein, 505 aa, Wolinella succinogenes DSM 1740; identical to SEQ ID NO: 38650

SEQ ID NO: 59127 - DNA, 1215 bp, Oryza sativa (japonica cultivar-group); identical to SEQ ID NO: 38651
  CDS (1)..(1215)

SEQ ID NO: 59128 - protein, 404 aa, Oryza sativa (japonica cultivar-group); identical to SEQ ID NO: 38652

SEQ ID NO: 59129 - DNA, 2277 bp, Oryza sativa (japonica cultivar-group); identical to SEQ ID NO: 38653
  CDS (1)..(2277)

SEQ ID NO: 59130 - protein, 758 aa, Oryza sativa (japonica cultivar-group); identical to SEQ ID NO: 38654

SEQ ID NO: 59131 - DNA, 1485 bp, Oryza sativa (japonica cultivar-group); identical to SEQ ID NO: 38655
  CDS (1)..(1485)

SEQ ID NO: 59132 - protein, 494 aa, Oryza sativa (japonica cultivar-group); identical to SEQ ID NO: 38656

SEQ ID NO: 59133 - DNA, 2676 bp, Oryza sativa (japonica cultivar-group); identical to SEQ ID NO: 38657
  CDS (1)..(2676)

SEQ ID NO: 59134 - protein, 891 aa, Oryza sativa (japonica cultivar-group); identical to SEQ ID NO: 38658

SEQ ID NO: 59135 - DNA, 1155 bp, Gloeobacter violaceus PCC 7421; identical to SEQ ID NO: 38659
  CDS (1)..(1155)

SEQ ID NO: 59136 - protein, 384 aa, Gloeobacter violaceus PCC 7421; identical to SEQ ID NO: 38660

SEQ ID NO: 59137 - DNA, 1314 bp, Gloeobacter violaceus PCC 7421; identical to SEQ ID NO: 38661
  CDS (1)..(1314)

SEQ ID NO: 59138 - protein, 437 aa, Gloeobacter violaceus PCC 7421; identical to SEQ ID NO: 38662

SEQ ID NO: 59139 - DNA, 1305 bp, Photorhabdus luminescens subsp. laumondii TTO1; identical to SEQ ID NO: 38663
  CDS (1)..(1305)

SEQ ID NO: 59140 - protein, 434 aa, Photorhabdus luminescens subsp. laumondii TTO1; identical to SEQ ID NO: 38664

SEQ ID NO: 59141 - DNA, 1935 bp, Photorhabdus luminescens subsp. laumondii TTO1; identical to SEQ ID NO: 38665
  CDS (1)..(1935)

SEQ ID NO: 59142 - protein, 644 aa, Photorhabdus luminescens subsp. laumondii TTO1; identical to SEQ ID NO: 38666

SEQ ID NO: 59143 - DNA, 1380 bp, Vibrio vulnificus YJ016; identical to SEQ ID NO: 38667
  CDS (1)..(1380)

SEQ ID NO: 59144 - protein, 459 aa, Vibrio vulnificus YJ016; identical to SEQ ID NO: 38668

SEQ ID NO: 59145 - DNA, 1407 bp, Danio rerio; identical to SEQ ID NO: 38669
  CDS (1)..(1407)

SEQ ID NO: 59146 - protein, 468 aa, Danio rerio; identical to SEQ ID NO: 38670

SEQ ID NO: 59147 - DNA, 1425 bp, Rhodopseudomonas palustris CGA009; identical to SEQ ID NO: 38671
  CDS (1)..(1425)

SEQ ID NO: 59148 - protein, 474 aa, Rhodopseudomonas palustris CGA009; identical to SEQ ID NO: 38672

SEQ ID NO: 59149 - DNA, 2085 bp, Rhodopseudomonas palustris CGA009; identical to SEQ ID NO: 38673
  CDS (1)..(2085)

SEQ ID NO: 59150 - protein, 694 aa, Rhodopseudomonas palustris CGA009; identical to SEQ ID NO: 38674

SEQ ID NO: 59151 - DNA, 1659 bp, Onion yellows phytoplasma OY-M; identical to SEQ ID NO: 38675
  CDS (1)..(1659)

SEQ ID NO: 59152 - protein, 552 aa, Onion yellows phytoplasma OY-M; identical to SEQ ID NO: 38676

SEQ ID NO: 59153 - DNA, 1383 bp, Geobacter sulfurreducens PCA; identical to SEQ ID NO: 38677
  CDS (1)..(1383)

SEQ ID NO: 59154 - protein, 460 aa, Geobacter sulfurreducens PCA; identical to SEQ ID NO: 38678

SEQ ID NO: 59155 - DNA, 1353 bp, Geobacter sulfurreducens PCA; identical to SEQ ID NO: 38679
  CDS (1)..(1353)

SEQ ID NO: 59156 - protein, 450 aa, Geobacter sulfurreducens PCA; identical to SEQ ID NO: 38680

SEQ ID NO: 59157 - DNA, 1455 bp, Lactobacillus johnsonii NCC 533; identical to SEQ ID NO: 38681
  CDS (1)..(1455)

SEQ ID NO: 59158 - protein, 484 aa, Lactobacillus johnsonii NCC 533; identical to SEQ ID NO: 38682

SEQ ID NO: 59159 - DNA, 1227 bp, Wolbachia endosymbiont of Drosophila melanogaster; identical to SEQ ID NO: 38683
  CDS (1)..(1227)

SEQ ID NO: 59160 - protein, 408 aa, Wolbachia endosymbiont of Drosophila melanogaster; identical to SEQ ID NO: 38684

SEQ ID NO: 59161 - DNA, 1518 bp, Bdellovibrio bacteriovorus HD100; identical to SEQ ID NO: 38685
  CDS (1)..(1518)

SEQ ID NO: 59162 - protein, 505 aa, Bdellovibrio bacteriovorus HD100; identical to SEQ ID NO: 38686

SEQ ID NO: 59163 - DNA, 1518 bp, Bdellovibrio bacteriovorus HD100; identical to SEQ ID NO: 38687
  CDS (1)..(1518)

SEQ ID NO: 59164 - protein, 505 aa, Bdellovibrio bacteriovorus HD100; identical to SEQ ID NO: 38688

SEQ ID NO: 59165 - DNA, 1971 bp, Bdellovibrio bacteriovorus HD100; identical to SEQ ID NO: 38689
  CDS (1)..(1971)

SEQ ID NO: 59166 - protein, 656 aa, Bdellovibrio bacteriovorus HD100; identical to SEQ ID NO: 38690

SEQ ID NO: 59167 - DNA, 1650 bp, Bdellovibrio bacteriovorus HD100; identical to SEQ ID NO: 38691
  CDS (1)..(1650)

SEQ ID NO: 59168 - protein, 549 aa, Bdellovibrio bacteriovorus HD100; identical to SEQ ID NO: 38692

SEQ ID NO: 59169 - DNA, 1776 bp, Arabidopsis thaliana; identical to SEQ ID NO: 38693
  CDS (1)..(1776)

SEQ ID NO: 59170 - protein, 591 aa, Arabidopsis thaliana; identical to SEQ ID NO: 38694

SEQ ID NO: 59171 - DNA, 1446 bp, Bacillus cereus ATCC 10987; identical to SEQ ID NO: 38695
  CDS (1)..(1446)

SEQ ID NO: 59172 - protein, 481 aa, Bacillus cereus ATCC 10987; identical to SEQ ID NO: 38696

SEQ ID NO: 59173 - DNA, 2205 bp, Eremothecium gossypii; identical to SEQ ID NO: 38697
  CDS (1)..(2205)

SEQ ID NO: 59174 - protein, 734 aa, Eremothecium gossypii; identical to SEQ ID NO: 38698

SEQ ID NO: 59175 - DNA, 1197 bp, Eremothecium gossypii; identical to SEQ ID NO: 38699
  CDS (1)..(1197)

SEQ ID NO: 59176 - protein, 398 aa, Eremothecium gossypii; identical to SEQ ID NO: 38700

SEQ ID NO: 59177 - DNA, 1617 bp, Methanococcus maripaludis S2; identical to SEQ ID NO: 38701
  CDS (1)..(1617)

SEQ ID NO: 59178 - protein, 538 aa, Methanococcus maripaludis S2; identical to SEQ ID NO: 38702

SEQ ID NO: 59179 - DNA, 2100 bp, Xenopus tropicalis; identical to SEQ ID NO: 38703
  CDS (1)..(2100)

SEQ ID NO: 59180 - protein, 699 aa, Xenopus tropicalis; identical to SEQ ID NO: 38704

SEQ ID NO: 59181 - DNA, 1440 bp, Xenopus tropicalis; identical to SEQ ID NO: 38705
  CDS (1)..(1440)

SEQ ID NO: 59182 - protein, 479 aa, Xenopus tropicalis; identical to SEQ ID NO: 38706

SEQ ID NO: 59183 - DNA, 1809 bp, Anopheles gambiae str. PEST; identical to SEQ ID NO: 38707
  CDS (1)..(1809)

SEQ ID NO: 59184 - protein, 602 aa, Anopheles gambiae str. PEST; identical to SEQ ID NO: 38708

SEQ ID NO: 59185 - DNA, 1548 bp, Neurospora crassa; identical to SEQ ID NO: 38709
  CDS (1)..(1548)

SEQ ID NO: 59186 - protein, 515 aa, Neurospora crassa; identical to SEQ ID NO: 38710

SEQ ID NO: 59187 - DNA, 1203 bp, Neurospora crassa; identical to SEQ ID NO: 38711
  CDS (1)..(1203)

SEQ ID NO: 59188 - protein, 400 aa, Neurospora crassa; identical to SEQ ID NO: 38712

SEQ ID NO: 59189 - DNA, 1278 bp, Neurospora crassa; identical to SEQ ID NO: 38713
  CDS (1)..(1278)

SEQ ID NO: 59190 - protein, 425 aa, Neurospora crassa; identical to SEQ ID NO: 38714

SEQ ID NO: 59191 - DNA, 1278 bp, Magnaporthe grisea 70-15; identical to SEQ ID NO: 38715
  CDS (1)..(1278)

SEQ ID NO: 59192 - protein, 425 aa, Magnaporthe grisea 70-15; identical to SEQ ID NO: 38716

SEQ ID NO: 59193 - DNA, 2025 bp, Magnaporthe grisea 70-15; identical to SEQ ID NO: 38717
  CDS (1)..(2025)

SEQ ID NO: 59194 - protein, 674 aa, Magnaporthe grisea 70-15; identical to SEQ ID NO: 38718

SEQ ID NO: 59195 - DNA, 1746 bp, Gibberella zeae PH-1; identical to SEQ ID NO: 38719
  CDS (1)..(1746)

SEQ ID NO: 59196 - protein, 581 aa, Gibberella zeae PH-1; identical to SEQ ID NO: 38720

SEQ ID NO: 59197 - DNA, 1461 bp, Gibberella zeae PH-1; identical to SEQ ID NO: 38721
  CDS (1)..(1461)

SEQ ID NO: 59198 - protein, 486 aa, Gibberella zeae PH-1; identical to SEQ ID NO: 38722

SEQ ID NO: 59199 - DNA, 1206 bp, Gibberella zeae PH-1; identical to SEQ ID NO: 38723
  CDS (1)..(1206)

SEQ ID NO: 59200 - protein, 401 aa, Gibberella zeae PH-1; identical to SEQ ID NO: 38724

SEQ ID NO: 59201 - DNA, 1875 bp, Apis mellifera; identical to SEQ ID NO: 38725
  CDS (1)..(1875)

SEQ ID NO: 59202 - protein, 624 aa, Apis mellifera; identical to SEQ ID NO: 38726

SEQ ID NO: 59203 - DNA, 1656 bp, Ustilago maydis 521; identical to SEQ ID NO: 38727
  CDS (1)..(1656)

SEQ ID NO: 59204 - protein, 551 aa, Ustilago maydis 521; identical to SEQ ID NO: 38728

SEQ ID NO: 59205 - DNA, 1194 bp, Ustilago maydis 521; identical to SEQ ID NO: 38729
  CDS (1)..(1194)

SEQ ID NO: 59206 - protein, 397 aa, Ustilago maydis 521; identical to SEQ ID NO: 38730

SEQ ID NO: 59207 - DNA, 1266 bp, Aspergillus nidulans FGSC A4; identical to SEQ ID NO: 38731
  CDS (1)..(1266)

SEQ ID NO: 59208 - protein, 421 aa, Aspergillus nidulans FGSC A4; identical to SEQ ID NO: 38732

SEQ ID NO: 59209 - DNA, 1398 bp, Aspergillus nidulans FGSC A4; identical to SEQ ID NO: 38733
  CDS (1)..(1398)

SEQ ID NO: 59210 - protein, 465 aa, Aspergillus nidulans FGSC A4; identical to SEQ ID NO: 38734

SEQ ID NO: 59211 - DNA, 1497 bp, Aspergillus nidulans FGSC A4; identical to SEQ ID NO: 38735
  CDS (1)..(1497)

SEQ ID NO: 59212 - protein, 498 aa, Aspergillus nidulans FGSC A4; identical to SEQ ID NO: 38736

SEQ ID NO: 59213 - DNA, 1200 bp, Aspergillus nidulans FGSC A4; identical to SEQ ID NO: 38737
  CDS (1)..(1200)

SEQ ID NO: 59214 - protein, 399 aa, Aspergillus nidulans FGSC A4; identical to SEQ ID NO: 38738

SEQ ID NO: 59215 - DNA, 2178 bp, Candida glabrata CBS138; identical to SEQ ID NO: 38739
  CDS (1)..(2178)

SEQ ID NO: 59216 - protein, 725 aa, Candida glabrata CBS138; identical to SEQ ID NO: 38740

SEQ ID NO: 59217 - DNA, 1482 bp, Candida glabrata CBS138; identical to SEQ ID NO: 38741
  CDS (1)..(1482)

SEQ ID NO: 59218 - protein, 493 aa, Candida glabrata CBS138; identical to SEQ ID NO: 38742

SEQ ID NO: 59219 - DNA, 1635 bp, Candida glabrata CBS138; identical to SEQ ID NO: 38743
  CDS (1)..(1635)

SEQ ID NO: 59220 - protein, 544 aa, Candida glabrata CBS138; identical to SEQ ID NO: 38744

SEQ ID NO: 59221 - DNA, 1197 bp, Kluyveromyces lactis NRRL Y-1140; identical to SEQ ID NO: 38745
  CDS (1)..(1197)

SEQ ID NO: 59222 - protein, 398 aa, Kluyveromyces lactis NRRL Y-1140; identical to SEQ ID NO: 38746

SEQ ID NO: 59223 - DNA, 1464 bp, Kluyveromyces lactis NRRL Y-1140; identical to SEQ ID NO: 38747
  CDS (1)..(1464)

SEQ ID NO: 59224 - protein, 487 aa, Kluyveromyces lactis NRRL Y-1140; identical to SEQ ID NO: 38748

SEQ ID NO: 59225 - DNA, 2247 bp, Kluyveromyces lactis NRRL Y-1140; identical to SEQ ID NO: 38749
  CDS (1)..(2247)

SEQ ID NO: 59226 - protein, 748 aa, Kluyveromyces lactis NRRL Y-1140; identical to SEQ ID NO: 38750

SEQ ID NO: 59227 - DNA, 1665 bp, Kluyveromyces lactis NRRL Y-1140; identical to SEQ ID NO: 38751
  CDS (1)..(1665)

SEQ ID NO: 59228 - protein, 554 aa, Kluyveromyces lactis NRRL Y-1140; identical to SEQ ID NO: 38752

SEQ ID NO: 59229 - DNA, 1611 bp, Debaryomyces hansenii CBS767; identical to SEQ ID NO: 38753
  CDS (1)..(1611)

SEQ ID NO: 59230 - protein, 536 aa, Debaryomyces hansenii CBS767; identical to SEQ ID NO: 38754

SEQ ID NO: 59231 - DNA, 1917 bp, Oryza sativa (japonica cultivar-group); identical to SEQ ID NO: 38755
  CDS (1)..(1917)

SEQ ID NO: 59232 - protein, 638 aa, Oryza sativa (japonica cultivar-group); identical to SEQ ID NO: 38756

SEQ ID NO: 59233 - DNA, 1443 bp, Yarrowia lipolytica CLIB99; identical to SEQ ID NO: 38757
  CDS (1)..(1443)

SEQ ID NO: 59234 - protein, 480 aa, Yarrowia lipolytica CLIB99; identical to SEQ ID NO: 38758

SEQ ID NO: 59235 - DNA, 1188 bp, Yarrowia lipolytica CLIB99; identical to SEQ ID NO: 38759
  CDS (1)..(1188)

SEQ ID NO: 59236 - protein, 395 aa, Yarrowia lipolytica CLIB99; identical to SEQ ID NO: 38760

SEQ ID NO: 59237 - DNA, 1659 bp, Yarrowia lipolytica CLIB99; identical to SEQ ID NO: 38761
  CDS (1)..(1659)

SEQ ID NO: 59238 - protein, 552 aa, Yarrowia lipolytica CLIB99; identical to SEQ ID NO: 38762

SEQ ID NO: 59239 - DNA, 1194 bp, Yarrowia lipolytica CLIB99; identical to SEQ ID NO: 38763
  CDS (1)..(1194)

SEQ ID NO: 59240 - protein, 397 aa, Yarrowia lipolytica CLIB99; identical to SEQ ID NO: 38764

SEQ ID NO: 59241 - DNA, 2256 bp, Pan troglodytes; identical to SEQ ID NO: 38765
  CDS (1)..(2256)

SEQ ID NO: 59242 - protein, 751 aa, Pan troglodytes; identical to SEQ ID NO: 38766

SEQ ID NO: 59243 - DNA, 2127 bp, Oryza sativa (japonica cultivar-group); identical to SEQ ID NO: 38767
  CDS (1)..(2127)

SEQ ID NO: 59244 - protein, 708 aa, Oryza sativa (japonica cultivar-group); identical to SEQ ID NO: 38768

SEQ ID NO: 59245 - DNA, 2280 bp, Oryza sativa (japonica cultivar-group); identical to SEQ ID NO: 38769
  CDS (1)..(2280)

SEQ ID NO: 59246 - protein, 759 aa, Oryza sativa (japonica cultivar-group); identical to SEQ ID NO: 38770

SEQ ID NO: 59247 - DNA, 1554 bp, Thermus thermophilus HB27; identical to SEQ ID NO: 38771
  CDS (1)..(1554)

SEQ ID NO: 59248 - protein, 517 aa, Thermus thermophilus HB27; identical to SEQ ID NO: 38772

SEQ ID NO: 59249 - DNA, 1548 bp, Parachlamydia sp. UWE25; identical to SEQ ID NO: 38773
  CDS (1)..(1548)

SEQ ID NO: 59250 - protein, 515 aa, Parachlamydia sp. UWE25; identical to SEQ ID NO: 38774

SEQ ID NO: 59251 - DNA, 1734 bp, Desulfovibrio vulgaris subsp. vulgaris str. Hildenborough; identical to SEQ ID NO: 38775
  CDS (1)..(1734)

SEQ ID NO: 59252 - protein, 577 aa, Desulfovibrio vulgaris subsp. vulgaris str. Hildenborough; identical to SEQ ID NO: 38776

SEQ ID NO: 59253 - DNA, 1599 bp, Desulfovibrio vulgaris subsp. vulgaris str. Hildenborough; identical to SEQ ID NO: 38777
  CDS (1)..(1599)

SEQ ID NO: 59254 - protein, 532 aa, Desulfovibrio vulgaris subsp. vulgaris str. Hildenborough; identical to SEQ ID NO: 38778

SEQ ID NO: 59255 - DNA, 1404 bp, Bartonella quintana str. Toulouse; identical to SEQ ID NO: 38779
  CDS (1)..(1404)

SEQ ID NO: 59256 - protein, 467 aa, Bartonella quintana str. Toulouse; identical to SEQ ID NO: 38780

SEQ ID NO: 59257 - DNA, 1521 bp, Staphylococcus aureus subsp. aureus MRSA252; identical to SEQ ID NO: 38781
  CDS (1)..(1521)

SEQ ID NO: 59258 - protein, 506 aa, Staphylococcus aureus subsp. aureus MRSA252; identical to SEQ ID NO: 38782

SEQ ID NO: 59259 - DNA, 1152 bp, Acinetobacter sp. ADP1; identical to SEQ ID NO: 38783
  CDS (1)..(1152)

SEQ ID NO: 59260 - protein, 383 aa, Acinetobacter sp. ADP1; identical to SEQ ID NO: 38784

SEQ ID NO: 59261 - DNA, 1923 bp, Acinetobacter sp. ADP1; identical to SEQ ID NO: 38785
  CDS (1)..(1923)

SEQ ID NO: 59262 - protein, 640 aa, Acinetobacter sp. ADP1; identical to SEQ ID NO: 38786

SEQ ID NO: 59263 - DNA, 1914 bp, Erwinia carotovora subsp. atroseptica SCRI1043; identical to SEQ ID NO: 38787
  CDS (1)..(1914)

SEQ ID NO: 59264 - protein, 637 aa, Erwinia carotovora subsp. atroseptica SCRI1043; identical to SEQ ID NO: 38788

SEQ ID NO: 59265 - DNA, 1383 bp, Erwinia carotovora subsp. atroseptica SCRI1043; identical to SEQ ID NO: 38789
  CDS (1)..(1383)

SEQ ID NO: 59266 - protein, 460 aa, Erwinia carotovora subsp. atroseptica SCRI1043; identical to SEQ ID NO: 38790

SEQ ID NO: 59267 - DNA, 2001 bp, Mesoplasma florum L1; identical to SEQ ID NO: 38791
  CDS (1)..(2001)

SEQ ID NO: 59268 - protein, 666 aa, Mesoplasma florum L1; identical to SEQ ID NO: 38792

SEQ ID NO: 59269 - DNA, 1686 bp, Propionibacterium acnes KPA171202; identical to SEQ ID NO: 38793
  CDS (1)..(1686)

SEQ ID NO: 59270 - protein, 561 aa, Propionibacterium acnes KPA171202; identical to SEQ ID NO: 38794

SEQ ID NO: 59271 - DNA, 1476 bp, Leifsonia xyli subsp. xyli str. CTCB07; identical to SEQ ID NO: 38795
  CDS (1)..(1476)

SEQ ID NO: 59272 - protein, 491 aa, Leifsonia xyli subsp. xyli str. CTCB07; identical to SEQ ID NO: 38796

SEQ ID NO: 59273 - DNA, 1770 bp, Leifsonia xyli subsp. xyli str. CTCB07; identical to SEQ ID NO: 38797
  CDS (1)..(1770)

SEQ ID NO: 59274 - protein, 589 aa, Leifsonia xyli subsp. xyli str. CTCB07; identical to SEQ ID NO: 38798

SEQ ID NO: 59275 - DNA, 1275 bp, Desulfotalea psychrophila LSv54; identical to SEQ ID NO: 38799
  CDS (1)..(1275)

SEQ ID NO: 59276 - protein, 424 aa, Desulfotalea psychrophila LSv54; identical to SEQ ID NO: 38800

SEQ ID NO: 59277 - DNA, 1410 bp, Desulfotalea psychrophila LSv54; identical to SEQ ID NO: 38801
  CDS (1)..(1410)

SEQ ID NO: 59278 - protein, 469 aa, Desulfotalea psychrophila LSv54; identical to SEQ ID NO: 38802

SEQ ID NO: 59279 - DNA, 1383 bp, Yersinia pseudotuberculosis IP 32953; identical to SEQ ID NO: 38803
  CDS (1)..(1383)

SEQ ID NO: 59280 - protein, 460 aa, Yersinia pseudotuberculosis IP 32953; identical to SEQ ID NO: 38804

SEQ ID NO: 59281 - DNA, 1581 bp, Symbiobacterium thermophilum IAM 14863; identical to SEQ ID NO: 38805
  CDS (1)..(1581)

SEQ ID NO: 59282 - protein, 526 aa, Symbiobacterium thermophilum IAM 14863; identical to SEQ ID NO: 38806

SEQ ID NO: 59283 - DNA, 1587 bp, Bacillus cereus ZK; identical to SEQ ID NO: 38807
  CDS (1)..(1587)

SEQ ID NO: 59284 - protein, 528 aa, Bacillus cereus ZK; identical to SEQ ID NO: 38808

SEQ ID NO: 59285 - DNA, 1842 bp, Mannheimia succiniciproducens MBEL55E; identical to SEQ ID NO: 38809
  CDS (1)..(1842)

SEQ ID NO: 59286 - protein, 613 aa, Mannheimia succiniciproducens MBEL55E; identical to SEQ ID NO: 38810

SEQ ID NO: 59287 - DNA, 1254 bp, Mannheimia succiniciproducens MBEL55E; identical to SEQ ID NO: 38811
  CDS (1)..(1254)

SEQ ID NO: 59288 - protein, 417 aa, Mannheimia succiniciproducens MBEL55E; identical to SEQ ID NO: 38812

SEQ ID NO: 59289 - DNA, 1446 bp, Bacillus licheniformis ATCC 14580; identical to SEQ ID NO: 38813
  CDS (1)..(1446)

SEQ ID NO: 59290 - protein, 481 aa, Bacillus licheniformis ATCC 14580; identical to SEQ ID NO: 38814

SEQ ID NO: 59291 - DNA, 1911 bp, Bacteroides fragilis YCH46; identical to SEQ ID NO: 38815
  CDS (1)..(1911)

SEQ ID NO: 59292 - protein, 636 aa, Bacteroides fragilis YCH46; identical to SEQ ID NO: 38816

SEQ ID NO: 59293 - DNA, 1284 bp, Bacteroides fragilis YCH46; identical to SEQ ID NO: 38817
  CDS (1)..(1284)

SEQ ID NO: 59294 - protein, 427 aa, Bacteroides fragilis YCH46; identical to SEQ ID NO: 38818

SEQ ID NO: 59295 - DNA, 1362 bp, Methylococcus capsulatus str. Bath; identical to SEQ ID NO: 38819
  CDS (1)..(1362)

SEQ ID NO: 59296 - protein, 453 aa, Methylococcus capsulatus str. Bath; identical to SEQ ID NO: 38820

SEQ ID NO: 59297 - DNA, 1809 bp, Nocardia farcinica IFM 10152; identical to SEQ ID NO: 38821
  CDS (1)..(1809)

SEQ ID NO: 59298 - protein, 602 aa, Nocardia farcinica IFM 10152; identical to SEQ ID NO: 38822

SEQ ID NO: 59299 - DNA, 1770 bp, Legionella pneumophila str. Paris; identical to SEQ ID NO: 38823
  CDS (1)..(1770)

SEQ ID NO: 59300 - protein, 589 aa, Legionella pneumophila str. Paris; identical to SEQ ID NO: 38824

SEQ ID NO: 59301 - DNA, 1407 bp, Legionella pneumophila str. Lens; identical to SEQ ID NO: 38825
  CDS (1)..(1407)

SEQ ID NO: 59302 - protein, 468 aa, Legionella pneumophila str. Lens; identical to SEQ ID NO: 38826

SEQ ID NO: 59303 - DNA, 1368 bp, Photobacterium profundum SS9; identical to SEQ ID NO: 38827
  CDS (1)..(1368)

SEQ ID NO: 59304 - protein, 455 aa, Photobacterium profundum SS9; identical to SEQ ID NO: 38828

SEQ ID NO: 59305 - DNA, 1389 bp, Photobacterium profundum SS9; identical to SEQ ID NO: 38829
  CDS (1)..(1389)

SEQ ID NO: 59306 - protein, 462 aa, Photobacterium profundum SS9; identical to SEQ ID NO: 38830

SEQ ID NO: 59307 - DNA, 1872 bp, Photobacterium profundum SS9; identical to SEQ ID NO: 38831
  CDS (1)..(1872)

SEQ ID NO: 59308 - protein, 623 aa, Photobacterium profundum SS9; identical to SEQ ID NO: 38832

SEQ ID NO: 59309 - DNA, 1587 bp, Streptococcus thermophilus LMG 18311; identical to SEQ ID NO: 38833
  CDS (1)..(1587)

SEQ ID NO: 59310 - protein, 528 aa, Streptococcus thermophilus LMG 18311; identical to SEQ ID NO: 38834

SEQ ID NO: 59311 - DNA, 1554 bp, Thermus thermophilus HB8; identical to SEQ ID NO: 38835
  CDS (1)..(1554)

SEQ ID NO: 59312 - protein, 517 aa, Thermus thermophilus HB8; identical to SEQ ID NO: 38836

SEQ ID NO: 59313 - DNA, 1404 bp, Geobacillus kaustophilus HTA426; identical to SEQ ID NO: 38837
  CDS (1)..(1404)

SEQ ID NO: 59314 - protein, 467 aa, Geobacillus kaustophilus HTA426; identical to SEQ ID NO: 38838

SEQ ID NO: 59315 - DNA, 1425 bp, Idiomarina loihiensis L2TR; identical to SEQ ID NO: 38839
  CDS (1)..(1425)

SEQ ID NO: 59316 - protein, 474 aa, Idiomarina loihiensis L2TR; identical to SEQ ID NO: 38840

SEQ ID NO: 59317 - DNA, 1251 bp, Idiomarina loihiensis L2TR; identical to SEQ ID NO: 38841
  CDS (1)..(1251)

SEQ ID NO: 59318 - protein, 416 aa, Idiomarina loihiensis L2TR; identical to SEQ ID NO: 38842

SEQ ID NO: 59319 - DNA, 1785 bp, Idiomarina loihiensis L2TR; identical to SEQ ID NO: 38843
  CDS (1)..(1785)

SEQ ID NO: 59320 - protein, 594 aa, Idiomarina loihiensis L2TR; identical to SEQ ID NO: 38844

SEQ ID NO: 59321 - DNA, 1392 bp, Azoarcus sp. EbN1; identical to SEQ ID NO: 38845
  CDS (1)..(1392)

SEQ ID NO: 59322 - protein, 463 aa, Azoarcus sp. EbN1; identical to SEQ ID NO: 38846

SEQ ID NO: 59323 - DNA, 1527 bp, Azoarcus sp. EbN1; identical to SEQ ID NO: 38847
  CDS (1)..(1527)

SEQ ID NO: 59324 - protein, 508 aa, Azoarcus sp. EbN1; identical to SEQ ID NO: 38848

SEQ ID NO: 59325 - DNA, 1977 bp, Azoarcus sp. EbN1; identical to SEQ ID NO: 38849
  CDS (1)..(1977)

SEQ ID NO: 59326 - protein, 658 aa, Azoarcus sp. EbN1; identical to SEQ ID NO: 38850

SEQ ID NO: 59327 - DNA, 1479 bp, Zymomonas mobilis subsp. mobilis ZM4; identical to SEQ ID NO: 38851
  CDS (1)..(1479)

SEQ ID NO: 59328 - protein, 492 aa, Zymomonas mobilis subsp. mobilis ZM4; identical to SEQ ID NO: 38852

SEQ ID NO: 59329 - DNA, 1416 bp, Silicibacter pomeroyi DSS-3; identical to SEQ ID NO: 38853
  CDS (1)..(1416)

SEQ ID NO: 59330 - protein, 471 aa, Silicibacter pomeroyi DSS-3; identical to SEQ ID NO: 38854

SEQ ID NO: 59331 - DNA, 1326 bp, Francisella tularensis subsp. tularensis Schu 4; identical to SEQ ID NO: 38855
  CDS (1)..(1326)

SEQ ID NO: 59332 - protein, 441 aa, Francisella tularensis subsp. tularensis Schu 4; identical to SEQ ID NO: 38856

SEQ ID NO: 59333 - DNA, 1710 bp, Francisella tularensis subsp. tularensis Schu 4; identical to SEQ ID NO: 38857
  CDS (1)..(1710)

SEQ ID NO: 59334 - protein, 569 aa, Francisella tularensis subsp. tularensis Schu 4; identical to SEQ ID NO: 38858

SEQ ID NO: 59335 - DNA, 1614 bp, Bacillus clausii KSM-K16; identical to SEQ ID NO: 38859
  CDS (1)..(1614)

SEQ ID NO: 59336 - protein, 537 aa, Bacillus clausii KSM-K16; identical to SEQ ID NO: 38860

SEQ ID NO: 59337 - DNA, 1683 bp, Dehalococcoides ethenogenes 195; identical to SEQ ID NO: 38861
  CDS (1)..(1683)

SEQ ID NO: 59338 - protein, 560 aa, Dehalococcoides ethenogenes 195; identical to SEQ ID NO: 38862

SEQ ID NO: 59339 - DNA, 1362 bp, Rhodobacter sphaeroides 2.4.1; identical to SEQ ID NO: 38863
  CDS (1)..(1362)

SEQ ID NO: 59340 - protein, 453 aa, Rhodobacter sphaeroides 2.4.1; identical to SEQ ID NO: 38864

SEQ ID NO: 59341 - DNA, 1830 bp, Xylella fastidiosa Dixon; identical to SEQ ID NO: 38865
  CDS (1)..(1830)

SEQ ID NO: 59342 - protein, 609 aa, Xylella fastidiosa Dixon; identical to SEQ ID NO: 38866

SEQ ID NO: 59343 - DNA, 1656 bp, Magnetospirillum magnetotacticum MS-1; identical to SEQ ID NO: 38867
  CDS (1)..(1656)

SEQ ID NO: 59344 - protein, 551 aa, Magnetospirillum magnetotacticum MS-1; identical to SEQ ID NO: 38868

SEQ ID NO: 59345 - DNA, 1623 bp, Leuconostoc mesenteroides subsp. mesenteroides ATCC 8293; identical to SEQ ID NO: 38869
  CDS (1)..(1623)

SEQ ID NO: 59346 - protein, 540 aa, Leuconostoc mesenteroides subsp. mesenteroides ATCC 8293; identical to SEQ ID NO: 38870

SEQ ID NO: 59347 - DNA, 1260 bp, Azotobacter vinelandii; identical to SEQ ID NO: 38871
  CDS (1)..(1260)

SEQ ID NO: 59348 - protein, 419 aa, Azotobacter vinelandii; identical to SEQ ID NO: 38872

SEQ ID NO: 59349 - DNA, 1452 bp, Azotobacter vinelandii; identical to SEQ ID NO: 38873
  CDS (1)..(1452)

SEQ ID NO: 59350 - protein, 483 aa, Azotobacter vinelandii; identical to SEQ ID NO: 38874

SEQ ID NO: 59351 - DNA, 1677 bp, Azotobacter vinelandii; identical to SEQ ID NO: 38875
  CDS (1)..(1677)

SEQ ID NO: 59352 - protein, 558 aa, Azotobacter vinelandii; identical to SEQ ID NO: 38876

SEQ ID NO: 59353 - DNA, 1470 bp, Desulfitobacterium hafniense DCB-2; identical to SEQ ID NO: 38877
  CDS (1)..(1470)

SEQ ID NO: 59354 - protein, 489 aa, Desulfitobacterium hafniense DCB-2; identical to SEQ ID NO: 38878

SEQ ID NO: 59355 - DNA, 1530 bp, Nostoc punctiforme PCC 73102; identical to SEQ ID NO: 38879
  CDS (1)..(1530)

SEQ ID NO: 59356 - protein, 509 aa, Nostoc punctiforme PCC 73102; identical to SEQ ID NO: 38880

SEQ ID NO: 59357 - DNA, 1674 bp, Pseudomonas syringae pv. syringae B728a; identical to SEQ ID NO: 38881
  CDS (1)..(1674)

SEQ ID NO: 59358 - protein, 557 aa, Pseudomonas syringae pv. syringae B728a; identical to SEQ ID NO: 38882

SEQ ID NO: 59359 - DNA, 1860 bp, Actinobacillus pleuropneumoniae serovar 1 str. 4074; identical to SEQ ID NO: 38883
  CDS (1)..(1860)

SEQ ID NO: 59360 - protein, 619 aa, Actinobacillus pleuropneumoniae serovar 1 str. 4074; identical to SEQ ID NO: 38884

SEQ ID NO: 59361 - DNA, 1671 bp, Pseudomonas aeruginosa UCBPP-PA14; identical to SEQ ID NO: 38885
  CDS (1)..(1671)

SEQ ID NO: 59362 - protein, 556 aa, Pseudomonas aeruginosa UCBPP-PA14; identical to SEQ ID NO: 38886

SEQ ID NO: 59363 - DNA, 1377 bp, Pseudomonas aeruginosa UCBPP-PA14; identical to SEQ ID NO: 38887
  CDS (1)..(1377)

SEQ ID NO: 59364 - protein, 458 aa, Pseudomonas aeruginosa UCBPP-PA14; identical to SEQ ID NO: 38888

SEQ ID NO: 59365 - DNA, 1587 bp, Fusobacterium nucleatum subsp. vincentii ATCC 49256; identical to SEQ ID NO: 38889
  CDS (1)..(1587)

SEQ ID NO: 59366 - protein, 528 aa, Fusobacterium nucleatum subsp. vincentii ATCC 49256; identical to SEQ ID NO: 38890

SEQ ID NO: 59367 - DNA, 1704 bp, Psychrobacter sp. 273-4; identical to SEQ ID NO: 38891
  CDS (1)..(1704)

SEQ ID NO: 59368 - protein, 567 aa, Psychrobacter sp. 273-4; identical to SEQ ID NO: 38892

SEQ ID NO: 59369 - DNA, 1569 bp, Methanococcoides burtonii DSM 6242; identical to SEQ ID NO: 38893
  CDS (1)..(1569)

SEQ ID NO: 59370 - protein, 522 aa, Methanococcoides burtonii DSM 6242; identical to SEQ ID NO: 38894

SEQ ID NO: 59371 - DNA, 1821 bp, Dechloromonas aromatica RCB; identical to SEQ ID NO: 38895
  CDS (1)..(1821)

SEQ ID NO: 59372 - protein, 606 aa, Dechloromonas aromatica RCB; identical to SEQ ID NO: 38896

SEQ ID NO: 59373 - DNA, 1524 bp, Dechloromonas aromatica RCB; identical to SEQ ID NO: 38897
  CDS (1)..(1524)

SEQ ID NO: 59374 - protein, 507 aa, Dechloromonas aromatica RCB; identical to SEQ ID NO: 38898

SEQ ID NO: 59375 - DNA, 1401 bp, Dechloromonas aromatica RCB; identical to SEQ ID NO: 38899
  CDS (1)..(1401)

SEQ ID NO: 59376 - protein, 466 aa, Dechloromonas aromatica RCB; identical to SEQ ID NO: 38900

SEQ ID NO: 59377 - DNA, 1233 bp, Rickettsia rickettsii; identical to SEQ ID NO: 38901
  CDS (1)..(1233)

SEQ ID NO: 59378 - protein, 410 aa, Rickettsia rickettsii; identical to SEQ ID NO: 38902

SEQ ID NO: 59379 - DNA, 1842 bp, Haemophilus influenzae R2846; identical to SEQ ID NO: 38903
  CDS (1)..(1842)

SEQ ID NO: 59380 - protein, 613 aa, Haemophilus influenzae R2846; identical to SEQ ID NO: 38904

SEQ ID NO: 59381 - DNA, 1842 bp, Haemophilus influenzae R2866; identical to SEQ ID NO: 38905
  CDS (1)..(1842)

SEQ ID NO: 59382 - protein, 613 aa, Haemophilus influenzae R2866; identical to SEQ ID NO: 38906

SEQ ID NO: 59383 - DNA, 1248 bp, Haemophilus influenzae R2866; identical to SEQ ID NO: 38907
  CDS (1)..(1248)

SEQ ID NO: 59384 - protein, 415 aa, Haemophilus influenzae R2866; identical to SEQ ID NO: 38908

SEQ ID NO: 59385 - DNA, 1281 bp, Anabaena variabilis ATCC 29413; identical to SEQ ID NO: 38909
  CDS (1)..(1281)

SEQ ID NO: 59386 - protein, 426 aa, Anabaena variabilis ATCC 29413; identical to SEQ ID NO: 38910

SEQ ID NO: 59387 - DNA, 1542 bp, Anabaena variabilis ATCC 29413; identical to SEQ ID NO: 38911
  CDS (1)..(1542)

SEQ ID NO: 59388 - protein, 513 aa, Anabaena variabilis ATCC 29413; identical to SEQ ID NO: 38912

SEQ ID NO: 59389 - DNA, 1425 bp, Ralstonia eutropha JMP134; identical to SEQ ID NO: 38913
  CDS (1)..(1425)

SEQ ID NO: 59390 - protein, 474 aa, Ralstonia eutropha JMP134; identical to SEQ ID NO: 38914

SEQ ID NO: 59391 - DNA, 1521 bp, Ralstonia eutropha JMP134; identical to SEQ ID NO: 38915
  CDS (1)..(1521)

SEQ ID NO: 59392 - protein, 506 aa, Ralstonia eutropha JMP134; identical to SEQ ID NO: 38916

SEQ ID NO: 59393 - DNA, 1356 bp, Methylobacillus flagellatus KT; identical to SEQ ID NO: 38917
  CDS (1)..(1356)

SEQ ID NO: 59394 - protein, 451 aa, Methylobacillus flagellatus KT; identical to SEQ ID NO: 38918

SEQ ID NO: 59395 - DNA, 1383 bp, Methylobacillus flagellatus KT; identical to SEQ ID NO: 38919
  CDS (1)..(1383)

SEQ ID NO: 59396 - protein, 460 aa, Methylobacillus flagellatus KT; identical to SEQ ID NO: 38920

SEQ ID NO: 59397 - DNA, 1548 bp, Methylobacillus flagellatus KT; identical to SEQ ID NO: 38921
  CDS (1)..(1548)

SEQ ID NO: 59398 - protein, 515 aa, Methylobacillus flagellatus KT; identical to SEQ ID NO: 38922

SEQ ID NO: 59399 - DNA, 1443 bp, Crocosphaera watsonii WH 8501; identical to SEQ ID NO: 38923
  CDS (1)..(1443)

SEQ ID NO: 59400 - protein, 480 aa, Crocosphaera watsonii WH 8501; identical to SEQ ID NO: 38924

SEQ ID NO: 59401 - DNA, 1233 bp, Exiguobacterium sp. 255-15; identical to SEQ ID NO: 38925
  CDS (1)..(1233)

SEQ ID NO: 59402 - protein, 410 aa, Exiguobacterium sp. 255-15; identical to SEQ ID NO: 38926

SEQ ID NO: 59403 - DNA, 1536 bp, Exiguobacterium sp. 255-15; identical to SEQ ID NO: 38927
  CDS (1)..(1536)

SEQ ID NO: 59404 - protein, 511 aa, Exiguobacterium sp. 255-15; identical to SEQ ID NO: 38928

SEQ ID NO: 59405 - DNA, 1446 bp, Exiguobacterium sp. 255-15; identical to SEQ ID NO: 38929
  CDS (1)..(1446)

SEQ ID NO: 59406 - protein, 481 aa, Exiguobacterium sp. 255-15; identical to SEQ ID NO: 38930

SEQ ID NO: 59407 - DNA, 1398 bp, Burkholderia cepacia R1808; identical to SEQ ID NO: 38931
  CDS (1)..(1398)

SEQ ID NO: 59408 - protein, 465 aa, Burkholderia cepacia R1808; identical to SEQ ID NO: 38932

SEQ ID NO: 59409 - DNA, 1413 bp, Listeria monocytogenes str. 1/2a F6854; identical to SEQ ID NO: 38933
  CDS (1)..(1413)

SEQ ID NO: 59410 - protein, 470 aa, Listeria monocytogenes str. 1/2a F6854; identical to SEQ ID NO: 38934

SEQ ID NO: 59411 - DNA, 1467 bp, Rubrivivax gelatinosus PM1; identical to SEQ ID NO: 38935
  CDS (1)..(1467)

SEQ ID NO: 59412 - protein, 488 aa, Rubrivivax gelatinosus PM1; identical to SEQ ID NO: 38936

SEQ ID NO: 59413 - DNA, 1422 bp, Rubrivivax gelatinosus PM1; identical to SEQ ID NO: 38937
  CDS (1)..(1422)

SEQ ID NO: 59414 - protein, 473 aa, Rubrivivax gelatinosus PM1; identical to SEQ ID NO: 38938

SEQ ID NO: 59415 - DNA, 1182 bp, Rhodospirillum rubrum; identical to SEQ ID NO: 38939
  CDS (1)..(1182)

SEQ ID NO: 59416 - protein, 393 aa, Rhodospirillum rubrum; identical to SEQ ID NO: 38940

SEQ ID NO: 59417 - DNA, 2034 bp, Rhodospirillum rubrum; identical to SEQ ID NO: 38941
  CDS (1)..(2034)

SEQ ID NO: 59418 - protein, 677 aa, Rhodospirillum rubrum; identical to SEQ ID NO: 38942

SEQ ID NO: 59419 - DNA, 1905 bp, Ralstonia metallidurans CH34; identical to SEQ ID NO: 38943
  CDS (1)..(1905)

SEQ ID NO: 59420 - protein, 634 aa, Ralstonia metallidurans CH34; identical to SEQ ID NO: 38944

SEQ ID NO: 59421 - DNA, 1476 bp, Burkholderia fungorum LB400; identical to SEQ ID NO: 38945
  CDS (1)..(1476)

SEQ ID NO: 59422 - protein, 491 aa, Burkholderia fungorum LB400; identical to SEQ ID NO: 38946

SEQ ID NO: 59423 - DNA, 1512 bp, Thermobifida fusca; identical to SEQ ID NO: 38947
  CDS (1)..(1512)

SEQ ID NO: 59424 - protein, 503 aa, Thermobifida fusca; identical to SEQ ID NO: 38948

SEQ ID NO: 59425 - DNA, 1713 bp, Thermobifida fusca; identical to SEQ ID NO: 38949
  CDS (1)..(1713)

SEQ ID NO: 59426 - protein, 570 aa, Thermobifida fusca; identical to SEQ ID NO: 38950

SEQ ID NO: 59427 - DNA, 1740 bp, Methanosarcina barkeri str. fusaro; identical to SEQ ID NO: 38951
  CDS (1)..(1740)

SEQ ID NO: 59428 - protein, 579 aa, Methanosarcina barkeri str. fusaro; identical to SEQ ID NO: 38952

SEQ ID NO: 59429 - DNA, 1359 bp, Geobacter metallireducens GS-15; identical to SEQ ID NO: 38953
  CDS (1)..(1359)

SEQ ID NO: 59430 - protein, 452 aa, Geobacter metallireducens GS-15; identical to SEQ ID NO: 38954

SEQ ID NO: 59431 - DNA, 1395 bp, Novosphingobium aromaticivorans DSM 12444; identical to SEQ ID NO: 38955
  CDS (1)..(1395)

SEQ ID NO: 59432 - protein, 464 aa, Novosphingobium aromaticivorans DSM 12444; identical to SEQ ID NO: 38956

SEQ ID NO: 59433 - DNA, 1497 bp, Novosphingobium aromaticivorans DSM 12444; identical to SEQ ID NO: 38957
  CDS (1)..(1497)

SEQ ID NO: 59434 - protein, 498 aa, Novosphingobium aromaticivorans DSM 12444; identical to SEQ ID NO: 38958

SEQ ID NO: 59435 - DNA, 1260 bp, Cytophaga hutchinsonii; identical to SEQ ID NO: 38959
  CDS (1)..(1260)

SEQ ID NO: 59436 - protein, 419 aa, Cytophaga hutchinsonii; identical to SEQ ID NO: 38960

SEQ ID NO: 59437 - DNA, 1743 bp, Cytophaga hutchinsonii; identical to SEQ ID NO: 38961
  CDS (1)..(1743)

SEQ ID NO: 59438 - protein, 580 aa, Cytophaga hutchinsonii; identical to SEQ ID NO: 38962

SEQ ID NO: 59439 - DNA, 1395 bp, Microbulbifer degradans 2-40; identical to SEQ ID NO: 38963
  CDS (1)..(1395)

SEQ ID NO: 59440 - protein, 464 aa, Microbulbifer degradans 2-40; identical to SEQ ID NO: 38964

SEQ ID NO: 59441 - DNA, 1179 bp, Microbulbifer degradans 2-40; identical to SEQ ID NO: 38965
  CDS (1)..(1179)

SEQ ID NO: 59442 - protein, 392 aa, Microbulbifer degradans 2-40; identical to SEQ ID NO: 38966

SEQ ID NO: 59443 - DNA, 1788 bp, Microbulbifer degradans 2-40; identical to SEQ ID NO: 38967
  CDS (1)..(1788)

SEQ ID NO: 59444 - protein, 595 aa, Microbulbifer degradans 2-40; identical to SEQ ID NO: 38968

SEQ ID NO: 59445 - DNA, 1311 bp, Microbulbifer degradans 2-40; identical to SEQ ID NO: 38969
  CDS (1)..(1311)

SEQ ID NO: 59446 - protein, 436 aa, Microbulbifer degradans 2-40; identical to SEQ ID NO: 38970

SEQ ID NO: 59447 - DNA, 1197 bp, Microbulbifer degradans 2-40; identical to SEQ ID NO: 38971
  CDS (1)..(1197)

SEQ ID NO: 59448 - protein, 398 aa, Microbulbifer degradans 2-40; identical to SEQ ID NO: 38972

SEQ ID NO: 59449 - DNA, 1566 bp, Oenococcus oeni PSU-1; identical to SEQ ID NO: 38973
  CDS (1)..(1566)

SEQ ID NO: 59450 - protein, 521 aa, Oenococcus oeni PSU-1; identical to SEQ ID NO: 38974

SEQ ID NO: 59451 - DNA, 1626 bp, Haemophilus influenzae 86-028NP; identical to SEQ ID NO: 38975
  CDS (1)..(1626)

SEQ ID NO: 59452 - protein, 541 aa, Haemophilus influenzae 86-028NP; identical to SEQ ID NO: 38976

SEQ ID NO: 59453 - DNA, 1581 bp, Pediococcus pentosaceus ATCC 25745; identical to SEQ ID NO: 38977
  CDS (1)..(1581)

SEQ ID NO: 59454 - protein, 526 aa, Pediococcus pentosaceus ATCC 25745; identical to SEQ ID NO: 38978

SEQ ID NO: 59455 - DNA, 1362 bp, Pediococcus pentosaceus ATCC 25745; identical to SEQ ID NO: 38979
  CDS (1)..(1362)

SEQ ID NO: 59456 - protein, 453 aa, Pediococcus pentosaceus ATCC 25745; identical to SEQ ID NO: 38980

SEQ ID NO: 59457 - DNA, 1365 bp, Trichodesmium erythraeum IMS101; identical to SEQ ID NO: 38981
  CDS (1)..(1365)

SEQ ID NO: 59458 - protein, 454 aa, Trichodesmium erythraeum IMS101; identical to SEQ ID NO: 38982

SEQ ID NO: 59459 - DNA, 1488 bp, Trichodesmium erythraeum IMS101; identical to SEQ ID NO: 38983
  CDS (1)..(1488)

SEQ ID NO: 59460 - protein, 495 aa, Trichodesmium erythraeum IMS101; identical to SEQ ID NO: 38984

SEQ ID NO: 59461 - DNA, 1602 bp, Thiobacillus denitrificans ATCC 25259; identical to SEQ ID NO: 38985
  CDS (1)..(1602)

SEQ ID NO: 59462 - protein, 533 aa, Thiobacillus denitrificans ATCC 25259; identical to SEQ ID NO: 38986

SEQ ID NO: 59463 - DNA, 1434 bp, Thiobacillus denitrificans ATCC 25259; identical to SEQ ID NO: 38987
  CDS (1)..(1434)

SEQ ID NO: 59464 - protein, 477 aa, Thiobacillus denitrificans ATCC 25259; identical to SEQ ID NO: 38988

SEQ ID NO: 59465 - DNA, 1383 bp, Thiobacillus denitrificans ATCC 25259; identical to SEQ ID NO: 38989
  CDS (1)..(1383)

SEQ ID NO: 59466 - protein, 460 aa, Thiobacillus denitrificans ATCC 25259; identical to SEQ ID NO: 38990

SEQ ID NO: 59467 - DNA, 1338 bp, Silicibacter sp. TM1040; identical to SEQ ID NO: 38991
  CDS (1)..(1338)

SEQ ID NO: 59468 - protein, 445 aa, Silicibacter sp. TM1040; identical to SEQ ID NO: 38992

SEQ ID NO: 59469 - DNA, 1587 bp, Desulfovibrio desulfuricans G20; identical to SEQ ID NO: 38993
  CDS (1)..(1587)

SEQ ID NO: 59470 - protein, 528 aa, Desulfovibrio desulfuricans G20; identical to SEQ ID NO: 38994

SEQ ID NO: 59471 - DNA, 1659 bp, Chloroflexus aurantiacus; identical to SEQ ID NO: 38995
  CDS (1)..(1659)

SEQ ID NO: 59472 - protein, 552 aa, Chloroflexus aurantiacus; identical to SEQ ID NO: 38996

SEQ ID NO: 59473 - DNA, 1407 bp, Polaromonas sp. JS666; identical to SEQ ID NO: 38997
  CDS (1)..(1407)

SEQ ID NO: 59474 - protein, 468 aa, Polaromonas sp. JS666; identical to SEQ ID NO: 38998

SEQ ID NO: 59475 - DNA, 1269 bp, Polaromonas sp. JS666; identical to SEQ ID NO: 38999
  CDS (1)..(1269)

SEQ ID NO: 59476 - protein, 422 aa, Polaromonas sp. JS666; identical to SEQ ID NO: 39000

SEQ ID NO: 59477 - DNA, 1533 bp, Thermus thermophilus; identical to SEQ ID NO: 39001
  CDS (1)..(1533)

SEQ ID NO: 59478 - protein, 510 aa, Thermus thermophilus; identical to SEQ ID NO: 39002

SEQ ID NO: 59479 - DNA, 1407 bp, Brachydanio rerio; identical to SEQ ID NO: 39003
  CDS (1)..(1407)

SEQ ID NO: 59480 - protein, 468 aa, Brachydanio rerio; identical to SEQ ID NO: 39004

SEQ ID NO: 59481 - DNA, 2199 bp, Corynebacterium glutamicum; identical to SEQ ID NO: 39005
  CDS (1)..(2199)

SEQ ID NO: 59482 - protein, 732 aa, Corynebacterium glutamicum; identical to SEQ ID NO: 39006

SEQ ID NO: 59483 - DNA, 1908 bp, uncultured marine proteobacterium ANT8C10; identical to SEQ ID NO: 39007
  CDS (1)..(1908)

SEQ ID NO: 59484 - protein, 635 aa, uncultured marine proteobacterium ANT8C10; identical to SEQ ID NO: 39008

SEQ ID NO: 59485 - DNA, 1974 bp, Yersinia enterocolitica; identical to SEQ ID NO: 39009
  CDS (1)..(1974)

SEQ ID NO: 59486 - protein, 657 aa, Yersinia enterocolitica; identical to SEQ ID NO: 39010

SEQ ID NO: 59487 - DNA, 2247 bp, Arabidopsis thaliana; identical to SEQ ID NO: 39011
  CDS (1)..(2247)

SEQ ID NO: 59488 - protein, 748 aa, Arabidopsis thaliana; identical to SEQ ID NO: 39012

SEQ ID NO: 59489 - DNA, 1239 bp, Arabidopsis thaliana; identical to SEQ ID NO: 39013
  CDS (1)..(1239)

SEQ ID NO: 59490 - protein, 412 aa, Arabidopsis thaliana; identical to SEQ ID NO: 39014

SEQ ID NO: 59491 - DNA, 1860 bp, Arabidopsis thaliana; identical to SEQ ID NO: 39015
  CDS (1)..(1860)

SEQ ID NO: 59492 - protein, 619 aa, Arabidopsis thaliana; identical to SEQ ID NO: 39016

SEQ ID NO: 59493 - DNA, 1569 bp, Streptococcus sobrinus; identical to SEQ ID NO: 39017
  CDS (1)..(1569)

SEQ ID NO: 59494 - protein, 522 aa, Streptococcus sobrinus; identical to SEQ ID NO: 39018

SEQ ID NO: 59495 - DNA, 1464 bp, Synechococcus sp; identical to SEQ ID NO: 39019
  CDS (1)..(1464)

SEQ ID NO: 59496 - protein, 487 aa, Synechococcus sp; identical to SEQ ID NO: 39020

SEQ ID NO: 59497 - DNA, 1869 bp, Pisum sativum; identical to SEQ ID NO: 39021
  CDS (1)..(1869)

SEQ ID NO: 59498 - protein, 622 aa, Pisum sativum; identical to SEQ ID NO: 39022

SEQ ID NO: 59499 - DNA, 1494 bp, Lactobacillus reuteri; identical to SEQ ID NO: 39023
  CDS (1)..(1494)

SEQ ID NO: 59500 - protein, 497 aa, Lactobacillus reuteri; identical to SEQ ID NO: 39024

SEQ ID NO: 59501 - DNA, 1641 bp, Saccharomyces cerevisiae; identical to SEQ ID NO: 39025
  CDS (1)..(1641)

SEQ ID NO: 59502 - protein, 546 aa, Saccharomyces cerevisiae; identical to SEQ ID NO: 39026

SEQ ID NO: 59503 - DNA, 1440 bp, Bacillus subtilis; identical to SEQ ID NO: 39027
  CDS (1)..(1440)

SEQ ID NO: 59504 - protein, 479 aa, Bacillus subtilis; identical to SEQ ID NO: 39028

SEQ ID NO: 59505 - DNA, 1446 bp, Xenopus laevis; identical to SEQ ID NO: 39029
  CDS (1)..(1446)

SEQ ID NO: 59506 - protein, 481 aa, Xenopus laevis; identical to SEQ ID NO: 39030

SEQ ID NO: 59507 - DNA, 2336 bp, Klebsiella pneumoniae; identical to SEQ ID NO: 39031
  CDS (266)..(2197)

SEQ ID NO: 59508 - protein, 643 aa, Klebsiella pneumoniae; identical to SEQ ID NO: 39032

SEQ ID NO: 59509 - DNA, 2259 bp, Saccharomyces cerevisiae; identical to SEQ ID NO: 39033
  CDS (1)..(2259)

SEQ ID NO: 59510 - protein, 752 aa, Saccharomyces cerevisiae; identical to SEQ ID NO: 39034

SEQ ID NO: 59511 - DNA, 1575 bp, Streptococcus pneumoniae; identical to SEQ ID NO: 39035
  CDS (1)..(1575)

SEQ ID NO: 59512 - protein, 524 aa, Streptococcus pneumoniae; identical to SEQ ID NO: 39036

SEQ ID NO: 59513 - DNA, 1104 bp, Methanococcus jannaschii; identical to SEQ ID NO: 39037
  CDS (1)..(1104)

SEQ ID NO: 59514 - protein, 367 aa, Methanococcus jannaschii; identical to SEQ ID NO: 39038

SEQ ID NO: 59515 - DNA, 1239 bp, Arabidopsis thaliana; identical to SEQ ID NO: 39039
  CDS (1)..(1239)

SEQ ID NO: 59516 - protein, 412 aa, Arabidopsis thaliana; identical to SEQ ID NO: 39040

SEQ ID NO: 59517 - DNA, 1242 bp, Nicotiana tabacum; identical to SEQ ID NO: 39041
  CDS (1)..(1242)

SEQ ID NO: 59518 - protein, 413 aa, Nicotiana tabacum; identical to SEQ ID NO: 39042

SEQ ID NO: 59519 - DNA, 1185 bp, Schizosaccharomyces pombe; identical to SEQ ID NO: 39043
  CDS (1)..(1185)

SEQ ID NO: 59520 - protein, 394 aa, Schizosaccharomyces pombe; identical to SEQ ID NO: 39044

SEQ ID NO: 59521 - DNA, 1242 bp, Nicotiana tabacum; identical to SEQ ID NO: 39045
  CDS (1)..(1242)

SEQ ID NO: 59522 - protein, 413 aa, Nicotiana tabacum; identical to SEQ ID NO: 39046

SEQ ID NO: 59523 - DNA, 1242 bp, Nicotiana tabacum; identical to SEQ ID NO: 39047
  CDS (1)..(1242)

SEQ ID NO: 59524 - protein, 413 aa, Nicotiana tabacum; identical to SEQ ID NO: 39048

SEQ ID NO: 59525 - DNA, 1632 bp, Xylella fastidiosa; identical to SEQ ID NO: 39049
  CDS (1)..(1632)

SEQ ID NO: 59526 - protein, 543 aa, Xylella fastidiosa; identical to SEQ ID NO: 39050

SEQ ID NO: 59527 - DNA, 1365 bp, Escherichia coli; identical to SEQ ID NO: 39051
  CDS (1)..(1365)

SEQ ID NO: 59528 - protein, 454 aa, Escherichia coli; identical to SEQ ID NO: 39052

SEQ ID NO: 59529 - DNA, 2285 bp, Drosophila melanogaster; identical to SEQ ID NO: 39053
  CDS (152)..(2137)

SEQ ID NO: 59530 - protein, 661 aa, Drosophila melanogaster; identical to SEQ ID NO: 39054

SEQ ID NO: 59531 - DNA, 25 bp, Primer
atgaccgctttttctaccctgaatg

SEQ ID NO: 59532 - DNA, 24 bp, Primer
ttattttaataaccgcacccggca

SEQ ID NO: 59533 - protein, 414 aa, consensus; identical to SEQ ID NO: 39057
  MISC_FEATURE (1)..(414): consensus for the disclosure of xaa see table XV

SEQ ID NO: 59534 - protein, 94 aa, consensus; identical to SEQ ID NO: 39058
  MISC_FEATURE (1)..(94): consensus for the disclosure of xaa see table XV

SEQ ID NO: 59535 - protein, 116 aa, consensus; identical to SEQ ID NO: 39059
  MISC_FEATURE (1)..(116): consensus for the disclosure of xaa see table XV

SEQ ID NO: 59536 - protein, 99 aa, consensus; identical to SEQ ID NO: 39060
  MISC_FEATURE (1)..(99): consensus for the disclosure of xaa see table XV

SEQ ID NO: 59537 - DNA, 747 bp, Escherichia coli; identical to SEQ ID NO: 40395
  CDS (1)..(747)

SEQ ID NO: 59538 - protein, 248 aa, Escherichia coli; identical to SEQ ID NO: 40396

SEQ ID NO: 59539 - DNA, 783 bp, Escherichia coli; identical to SEQ ID NO: 40397
  CDS (1)..(783)

SEQ ID NO: 59540 - protein, 260 aa, Escherichia coli; identical to SEQ ID NO: 40398

SEQ ID NO: 59541 - DNA, 783 bp, Streptococcus thermophilus bacteriophage 7201; identical to SEQ ID NO: 40399
  CDS (1)..(783)

SEQ ID NO: 59542 - protein, 260 aa, Streptococcus thermophilus bacteriophage 7201; identical to SEQ ID NO: 40400

SEQ ID NO: 59543 - DNA, 786 bp, Plasmid R100; identical to SEQ ID NO: 40401
  CDS (1)..(786)

SEQ ID NO: 59544 - protein, 261 aa, Plasmid R100; identical to SEQ ID NO: 40402

SEQ ID NO: 59545 - DNA, 774 bp, Staphylococcus aureus prophage phiPV83; identical to SEQ ID NO: 40403
  CDS (1)..(774)

SEQ ID NO: 59546 - protein, 257 aa, Staphylococcus aureus prophage phiPV83; identical to SEQ ID NO: 40404

SEQ ID NO: 59547 - DNA, 780 bp, Staphylococcus aureus temperate phage phiSLT; identical to SEQ ID NO: 40405
  CDS (1)..(780)

SEQ ID NO: 59548 - protein, 259 aa, Staphylococcus aureus temperate phage phiSLT; identical to SEQ ID NO: 40406

SEQ ID NO: 59549 - DNA, 885 bp, Bacteriophage bIL309; identical to SEQ ID NO: 40407
  CDS (1)..(885)

SEQ ID NO: 59550 - protein, 294 aa, Bacteriophage bIL309; identical to SEQ ID NO: 40408

SEQ ID NO: 59551 - DNA, 804 bp, Bacillus halodurans C-125; identical to SEQ ID NO: 40409
  CDS (1)..(804)

SEQ ID NO: 59552 - protein, 267 aa, Bacillus halodurans C-125; identical to SEQ ID NO: 40410

SEQ ID NO: 59553 - DNA, 747 bp, Escherichia coli O157:H7; identical to SEQ ID NO: 40411
  CDS (1)..(747)

SEQ ID NO: 59554 - protein, 248 aa, Escherichia coli O157:H7; identical to SEQ ID NO: 40412

SEQ ID NO: 59555 - DNA, 1386 bp, Mycoplasma pulmonis UAB CTIP; identical to SEQ ID NO: 40413
  CDS (1)..(1386)

SEQ ID NO: 59556 - protein, 461 aa, Mycoplasma pulmonis UAB CTIP; identical to SEQ ID NO: 40414

SEQ ID NO: 59557 - DNA, 849 bp, Clostridium acetobutylicum ATCC 824; identical to SEQ ID NO: 40415
  CDS (1)..(849)

SEQ ID NO: 59558 - protein, 282 aa, Clostridium acetobutylicum ATCC 824; identical to SEQ ID NO: 40416

SEQ ID NO: 59559 - DNA, 990 bp, Clostridium acetobutylicum ATCC 824; identical to SEQ ID NO: 40417
  CDS (1)..(990)

SEQ ID NO: 59560 - protein, 329 aa, Clostridium acetobutylicum ATCC 824; identical to SEQ ID NO: 40418

SEQ ID NO: 59561 - DNA, 738 bp, Sinorhizobium meliloti 1021; identical to SEQ ID NO: 40419
  CDS (1)..(738)

SEQ ID NO: 59562 - protein, 245 aa, Sinorhizobium meliloti 1021; identical to SEQ ID NO: 40420

SEQ ID NO: 59563 - DNA, 747 bp, Salmonella enterica subsp. enterica serovar Typhi str. CT18; identical to SEQ ID NO: 40421
  CDS (1)..(747)

SEQ ID NO: 59564 - protein, 248 aa, Salmonella enterica subsp. enterica serovar Typhi str. CT18; identical to SEQ ID NO: 40422

SEQ ID NO: 59565 - DNA, 750 bp, Salmonella typhimurium LT2; identical to SEQ ID NO: 40423
  CDS (1)..(750)

SEQ ID NO: 59566 - protein, 249 aa, Salmonella typhimurium LT2; identical to SEQ ID NO: 40424

SEQ ID NO: 59567 - DNA, 738 bp, Salmonella typhimurium LT2; identical to SEQ ID NO: 40425
  CDS (1)..(738)

SEQ ID NO: 59568 - protein, 245 aa, Salmonella typhimurium LT2; identical to SEQ ID NO: 40426

SEQ ID NO: 59569 - DNA, 864 bp, Listeria innocua Clip11262; identical to SEQ ID NO: 40427
  CDS (1)..(864)

SEQ ID NO: 59570 - protein, 287 aa, Listeria innocua Clip11262; identical to SEQ ID NO: 40428

SEQ ID NO: 59571 - DNA, 780 bp, Bacteriophage phi ETA; identical to SEQ ID NO: 40429
  CDS (1)..(780)

SEQ ID NO: 59572 - protein, 259 aa, Bacteriophage phi ETA; identical to SEQ ID NO: 40430

SEQ ID NO: 59573 - DNA, 759 bp, Bacteriophage P27; identical to SEQ ID NO: 40431
  CDS (1)..(759)

SEQ ID NO: 59574 - protein, 252 aa, Bacteriophage P27; identical to SEQ ID NO: 40432

SEQ ID NO: 59575 - DNA, 996 bp, Clostridium perfringens str. 13; identical to SEQ ID NO: 40433
  CDS (1)..(996)

SEQ ID NO: 59576 - protein, 331 aa, Clostridium perfringens str. 13; identical to SEQ ID NO: 40434

SEQ ID NO: 59577 - DNA, 735 bp, uncultured bacterium; identical to SEQ ID NO: 40435
  CDS (1)..(735)

SEQ ID NO: 59578 - protein, 244 aa, uncultured bacterium; identical to SEQ ID NO: 40436

SEQ ID NO: 59579 - DNA, 774 bp, Methanosarcina acetivorans C2A; identical to SEQ ID NO: 40437
  CDS (1)..(774)

SEQ ID NO: 59580 - protein, 257 aa, Methanosarcina acetivorans C2A; identical to SEQ ID NO: 40438

SEQ ID NO: 59581 - DNA, 984 bp, Thermoanaerobacter tengcongensis MB4; identical to SEQ ID NO: 40439
  CDS (1)..(984)

SEQ ID NO: 59582 - protein, 327 aa, Thermoanaerobacter tengcongensis MB4; identical to SEQ ID NO: 40440

SEQ ID NO: 59583 - DNA, 588 bp, Methanosarcina mazei Go1; identical to SEQ ID NO: 40441
  CDS (1)..(588)

SEQ ID NO: 59584 - protein, 195 aa, Methanosarcina mazei Go1; identical to SEQ ID NO: 40442

SEQ ID NO: 59585 - DNA, 798 bp, Methanosarcina mazei Go1; identical to SEQ ID NO: 40443
  CDS (1)..(798)

SEQ ID NO: 59586 - protein, 265 aa, Methanosarcina mazei Go1; identical to SEQ ID NO: 40444

SEQ ID NO: 59587 - DNA, 831 bp, Bacillus anthracis str. A2012; identical to SEQ ID NO: 40445
  CDS (1)..(831)

SEQ ID NO: 59588 - protein, 276 aa, Bacillus anthracis str. A2012; identical to SEQ ID NO: 40446

SEQ ID NO: 59589 - DNA, 894 bp, Rhizobium etli; identical to SEQ ID NO: 40447
  CDS (1)..(894)

SEQ ID NO: 59590 - protein, 297 aa, Rhizobium etli; identical to SEQ ID NO: 40448

SEQ ID NO: 59591 - DNA, 1362 bp, Streptococcus agalactiae 2603V/R; identical to SEQ ID NO: 40449
  CDS (1)..(1362)

SEQ ID NO: 59592 - protein, 453 aa, Streptococcus agalactiae 2603V/R; identical to SEQ ID NO: 40450

SEQ ID NO: 59593 - DNA, 891 bp, Bacteriophage r1t; identical to SEQ ID NO: 40451
  CDS (1)..(891)

SEQ ID NO: 59594 - protein, 296 aa, Bacteriophage r1t; identical to SEQ ID NO: 40452

SEQ ID NO: 59595 - DNA, 879 bp, Shigella flexneri 2a str. 301; identical to SEQ ID NO: 40453
  CDS (1)..(879)

SEQ ID NO: 59596 - protein, 292 aa, Shigella flexneri 2a str. 301; identical to SEQ ID NO: 40454

SEQ ID NO: 59597 - DNA, 705 bp, Pseudomonas putida KT2440; identical to SEQ ID NO: 40455
  CDS (1)..(705)

SEQ ID NO: 59598 - protein, 234 aa, Pseudomonas putida KT2440; identical to SEQ ID NO: 40456

SEQ ID NO: 59599 - DNA, 786 bp, Pseudomonas resinovorans; identical to SEQ ID NO: 40457
  CDS (1)..(786)

SEQ ID NO: 59600 - protein, 261 aa, Pseudomonas resinovorans; identical to SEQ ID NO: 40458

SEQ ID NO: 59601 - DNA, 990 bp, Clostridium tetani E88; identical to SEQ ID NO: 40459
  CDS (1)..(990)

SEQ ID NO: 59602 - protein, 329 aa, Clostridium tetani E88; identical to SEQ ID NO: 40460

SEQ ID NO: 59603 - DNA, 843 bp, Enterococcus faecalis V583; identical to SEQ ID NO: 40461
  CDS (1)..(843)

SEQ ID NO: 59604 - protein, 280 aa, Enterococcus faecalis V583; identical to SEQ ID NO: 40462

SEQ ID NO: 59605 - DNA, 852 bp, Enterococcus faecalis V583; identical to SEQ ID NO: 40463
  CDS (1)..(852)

SEQ ID NO: 59606 - protein, 283 aa, Enterococcus faecalis V583; identical to SEQ ID NO: 40464

SEQ ID NO: 59607 - DNA, 885 bp, Lactococcus phage P335; identical to SEQ ID NO: 40465
  CDS (1)..(885)

SEQ ID NO: 59608 - protein, 294 aa, Lactococcus phage P335; identical to SEQ ID NO: 40466

SEQ ID NO: 59609 - DNA, 804 bp, Bacillus anthracis str. Ames; identical to SEQ ID NO: 40467
  CDS (1)..(804)

SEQ ID NO: 59610 - protein, 267 aa, Bacillus anthracis str. Ames; identical to SEQ ID NO: 40468

SEQ ID NO: 59611 - DNA, 849 bp, Pseudomonas sp. ADP; identical to SEQ ID NO: 40469
  CDS (1)..(849)

SEQ ID NO: 59612 - protein, 282 aa, Pseudomonas sp. ADP; identical to SEQ ID NO: 40470

SEQ ID NO: 59613 - DNA, 771 bp, Streptococcus mitis phage SM1; identical to SEQ ID NO: 40471
  CDS (1)..(771)

SEQ ID NO: 59614 - protein, 256 aa, Streptococcus mitis phage SM1; identical to SEQ ID NO: 40472

SEQ ID NO: 59615 - DNA, 798 bp, Burkholderia cepacia phage Bcep22; identical to SEQ ID NO: 40473
  CDS (1)..(798)

SEQ ID NO: 59616 - protein, 265 aa, Burkholderia cepacia phage Bcep22; identical to SEQ ID NO: 40474

SEQ ID NO: 59617 - DNA, 813 bp, Bacteriophage EJ-1; identical to SEQ ID NO: 40475
  CDS (1)..(813)

SEQ ID NO: 59618 - protein, 270 aa, Bacteriophage EJ-1; identical to SEQ ID NO: 40476

SEQ ID NO: 59619 - DNA, 1524 bp, Onion yellows phytoplasma OY-M; identical to SEQ ID NO: 40477
  CDS (1)..(1524)

SEQ ID NO: 59620 - protein, 507 aa, Onion yellows phytoplasma OY-M; identical to SEQ ID NO: 40478

SEQ ID NO: 59621 - DNA, 780 bp, Bacteriophage 77; identical to SEQ ID NO: 40479
  CDS (1)..(780)

SEQ ID NO: 59622 - protein, 259 aa, Bacteriophage 77; identical to SEQ ID NO: 40480

SEQ ID NO: 59623 - DNA, 756 bp, Symbiobacterium thermophilum IAM 14863; identical to SEQ ID NO: 40481
  CDS (1)..(756)

SEQ ID NO: 59624 - protein, 251 aa, Symbiobacterium thermophilum IAM 14863; identical to SEQ ID NO: 40482

SEQ ID NO: 59625 - DNA, 774 bp, Symbiobacterium thermophilum IAM 14863; identical to SEQ ID NO: 40483
  CDS (1)..(774)

SEQ ID NO: 59626 - protein, 257 aa, Symbiobacterium thermophilum IAM 14863; identical to SEQ ID NO: 40484

SEQ ID NO: 59627 - DNA, 783 bp, Symbiobacterium thermophilum IAM 14863; identical to SEQ ID NO: 40485
  CDS (1)..(783)

SEQ ID NO: 59628 - protein, 260 aa, Symbiobacterium thermophilum IAM 14863; identical to SEQ ID NO: 40486

SEQ ID NO: 59629 - DNA, 774 bp, Symbiobacterium thermophilum IAM 14863; identical to SEQ ID NO: 40487
  CDS (1)..(774)

SEQ ID NO: 59630 - protein, 257 aa, Symbiobacterium thermophilum IAM 14863; identical to SEQ ID NO: 40488

SEQ ID NO: 59631 - DNA, 831 bp, Bacillus cereus ZK; identical to SEQ ID NO: 40489
  CDS (1)..(831)

SEQ ID NO: 59632 - protein, 276 aa, Bacillus cereus ZK; identical to SEQ ID NO: 40490

SEQ ID NO: 59633 - DNA, 753 bp, Geobacillus kaustophilus HTA426; identical to SEQ ID NO: 40491
  CDS (1)..(753)

SEQ ID NO: 59634 - protein, 250 aa, Geobacillus kaustophilus HTA426; identical to SEQ ID NO: 40492

SEQ ID NO: 59635 - DNA, 798 bp, Azoarcus sp. EbN1; identical to SEQ ID NO: 40493
  CDS (1)..(798)

SEQ ID NO: 59636 - protein, 265 aa, Azoarcus sp. EbN1; identical to SEQ ID NO: 40494

SEQ ID NO: 59637 - DNA, 780 bp, Azoarcus sp. EbN1; identical to SEQ ID NO: 40495
  CDS (1)..(780)

SEQ ID NO: 59638 - protein, 259 aa, Azoarcus sp. EbN1; identical to SEQ ID NO: 40496

SEQ ID NO: 59639 - DNA, 690 bp, Chloroflexus aurantiacus; identical to SEQ ID NO: 40497
  CDS (1)..(690)

SEQ ID NO: 59640 - protein, 229 aa, Chloroflexus aurantiacus; identical to SEQ ID NO: 40498

SEQ ID NO: 59641 - DNA, 780 bp, Azotobacter vinelandii; identical to SEQ ID NO: 40499
  CDS (1)..(780)

SEQ ID NO: 59642 - protein, 259 aa, Azotobacter vinelandii; identical to SEQ ID NO: 40500

SEQ ID NO: 59643 - DNA, 654 bp, Desulfitobacterium hafniense DCB-2; identical to SEQ ID NO: 40501
  CDS (1)..(654)

SEQ ID NO: 59644 - protein, 217 aa, Desulfitobacterium hafniense DCB-2; identical to SEQ ID NO: 40502

SEQ ID NO: 59645 - DNA, 600 bp, Bifidobacterium longum DJO10A; identical to SEQ ID NO: 40503
  CDS (1)..(600)

SEQ ID NO: 59646 - protein, 199 aa, Bifidobacterium longum DJO10A; identical to SEQ ID NO: 40504

SEQ ID NO: 59647 - DNA, 774 bp, Desulfovibrio desulfuricans G20; identical to SEQ ID NO: 40505
  CDS (1)..(774)

SEQ ID NO: 59648 - protein, 257 aa, Desulfovibrio desulfuricans G20; identical to SEQ ID NO: 40506

SEQ ID NO: 59649 - DNA, 675 bp, Burkholderia cepacia R1808; identical to SEQ ID NO: 40507
  CDS (1)..(675)

SEQ ID NO: 59650 - protein, 224 aa, Burkholderia cepacia R1808; identical to SEQ ID NO: 40508

SEQ ID NO: 59651 - DNA, 699 bp, Burkholderia cepacia R1808; identical to SEQ ID NO: 40509
  CDS (1)..(699)

SEQ ID NO: 59652 - protein, 232 aa, Burkholderia cepacia R1808; identical to SEQ ID NO: 40510

SEQ ID NO: 59653 - DNA, 750 bp, Burkholderia cepacia R1808; identical to SEQ ID NO: 40511
  CDS (1)..(750)

SEQ ID NO: 59654 - protein, 249 aa, Burkholderia cepacia R1808; identical to SEQ ID NO: 40512

SEQ ID NO: 59655 - DNA, 810 bp, Bacillus cereus G9241; identical to SEQ ID NO: 40513
  CDS (1)..(810)

SEQ ID NO: 59656 - protein, 269 aa, Bacillus cereus G9241; identical to SEQ ID NO: 40514

SEQ ID NO: 59657 - DNA, 834 bp, Rubrivivax gelatinosus PM1; identical to SEQ ID NO: 40515
  CDS (1)..(834)

SEQ ID NO: 59658 - protein, 277 aa, Rubrivivax gelatinosus PM1; identical to SEQ ID NO: 40516

SEQ ID NO: 59659 - DNA, 819 bp, Burkholderia fungorum LB400; identical to SEQ ID NO: 40517
  CDS (1)..(819)

SEQ ID NO: 59660 - protein, 272 aa, Burkholderia fungorum LB400; identical to SEQ ID NO: 40518

SEQ ID NO: 59661 - DNA, 744 bp, Enterococcus faecium; identical to SEQ ID NO: 40519
  CDS (1)..(744)

SEQ ID NO: 59662 - protein, 247 aa, Enterococcus faecium; identical to SEQ ID NO: 40520

SEQ ID NO: 59663 - DNA, 720 bp, Magnetococcus sp. MC-1; identical to SEQ ID NO: 40521
  CDS (1)..(720)

SEQ ID NO: 59664 - protein, 239 aa, Magnetococcus sp. MC-1; identical to SEQ ID NO: 40522

SEQ ID NO: 59665 - DNA, 795 bp, Geobacter metallireducens GS-15; identical to SEQ ID NO: 40523
  CDS (1)..(795)

SEQ ID NO: 59666 - protein, 264 aa, Geobacter metallireducens GS-15; identical to SEQ ID NO: 40524

SEQ ID NO: 59667 - DNA, 759 bp, Clostridium thermocellum ATCC 27405; identical to SEQ ID NO: 40525
  CDS (1)..(759)

SEQ ID NO: 59668 - protein, 252 aa, Clostridium thermocellum ATCC 27405; identical to SEQ ID NO: 40526

SEQ ID NO: 59669 - DNA, 837 bp, Clostridium thermocellum ATCC 27405; identical to SEQ ID NO: 40527
  CDS (1)..(837)

SEQ ID NO: 59670 - protein, 278 aa, Clostridium thermocellum ATCC 27405; identical to SEQ ID NO: 40528

SEQ ID NO: 59671 - DNA, 819 bp, Pediococcus pentosaceus ATCC 25745; identical to SEQ ID NO: 40529
  CDS (1)..(819)

SEQ ID NO: 59672 - protein, 272 aa, Pediococcus pentosaceus ATCC 25745; identical to SEQ ID NO: 40530

SEQ ID NO: 59673 - DNA, 813 bp, Moorella thermoacetica ATCC 39073; identical to SEQ ID NO: 40531
  CDS (1)..(813)

SEQ ID NO: 59674 - protein, 270 aa, Moorella thermoacetica ATCC 39073; identical to SEQ ID NO: 40532

SEQ ID NO: 59675 - DNA, 759 bp, Moorella thermoacetica ATCC 39073; identical to SEQ ID NO: 40533
  CDS (1)..(759)

SEQ ID NO: 59676 - protein, 252 aa, Moorella thermoacetica ATCC 39073; identical to SEQ ID NO: 40534

SEQ ID NO: 59677 - DNA, 726 bp, Rubrobacter xylanophilus DSM 9941; identical to SEQ ID NO: 40535
  CDS (1)..(726)

SEQ ID NO: 59678 - protein, 241 aa, Rubrobacter xylanophilus DSM 9941; identical to SEQ ID NO: 40536

SEQ ID NO: 59679 - DNA, 828 bp, Polaromonas sp. JS666; identical to SEQ ID NO: 40537
  CDS (1)..(828)

SEQ ID NO: 59680 - protein, 275 aa, Polaromonas sp. JS666; identical to SEQ ID NO: 40538

SEQ ID NO: 59681 - DNA, 951 bp, Pseudomonas alcaligenes; identical to SEQ ID NO: 40539
  CDS (1)..(951)

SEQ ID NO: 59682 - protein, 316 aa, Pseudomonas alcaligenes; identical to SEQ ID NO: 40540

SEQ ID NO: 59683 - DNA, 660 bp, Pseudomonas alcaligenes; identical to SEQ ID NO: 40541
  CDS (1)..(660)

SEQ ID NO: 59684 - protein, 219 aa, Pseudomonas alcaligenes; identical to SEQ ID NO: 40542

SEQ ID NO: 59685 - DNA, 780 bp, Azoarcus sp; identical to SEQ ID NO: 40543
  CDS (1)..(780)

SEQ ID NO: 59686 - protein, 259 aa, Azoarcus sp; identical to SEQ ID NO: 40544

SEQ ID NO: 59687 - DNA, 768 bp, Azoarcus sp; identical to SEQ ID NO: 40545
  CDS (1)..(768)

SEQ ID NO: 59688 - protein, 255 aa, Azoarcus sp; identical to SEQ ID NO: 40546

SEQ ID NO: 59689 - DNA, 750 bp, Burkholderia multivorans; identical to SEQ ID NO: 40547
  CDS (1)..(750)

SEQ ID NO: 59690 - protein, 249 aa, Burkholderia multivorans; identical to SEQ ID NO: 40548

SEQ ID NO: 59691 - DNA, 702 bp, Rhizobium sp; identical to SEQ ID NO: 40549
  CDS (1)..(702)

SEQ ID NO: 59692 - protein, 233 aa, Rhizobium sp; identical to SEQ ID NO: 40550

SEQ ID NO: 59693 - DNA, 741 bp, Enterococcus faecium; identical to SEQ ID NO: 40551
  CDS (1)..(741)

SEQ ID NO: 59694 - protein, 246 aa, Enterococcus faecium; identical to SEQ ID NO: 40552

SEQ ID NO: 59695 - DNA, 660 bp, Aeromonas hydrophila; identical to SEQ ID NO: 40553
  CDS (1)..(660)

SEQ ID NO: 59696 - protein, 219 aa, Aeromonas hydrophila; identical to SEQ ID NO: 40554

SEQ ID NO: 59697 - DNA, 792 bp, Pseudomonas stutzeri; identical to SEQ ID NO: 40555
  CDS (1)..(792)

SEQ ID NO: 59698 - protein, 263 aa, Pseudomonas stutzeri; identical to SEQ ID NO: 40556

SEQ ID NO: 59699 - DNA, 744 bp, Pseudomonas aeruginosa; identical to SEQ ID NO: 40557
  CDS (1)..(744)

SEQ ID NO: 59700 - protein, 247 aa, Pseudomonas aeruginosa; identical to SEQ ID NO: 40558

SEQ ID NO: 59701 - DNA, 780 bp, Rhizobium sp; identical to SEQ ID NO: 40559
  CDS (1)..(780)

SEQ ID NO: 59702 - protein, 259 aa, Rhizobium sp; identical to SEQ ID NO: 40560

SEQ ID NO: 59703 - DNA, 780 bp, Salmonella enterica subsp; identical to SEQ ID NO: 40561
  CDS (1)..(780)

SEQ ID NO: 59704 - protein, 259 aa, Salmonella enterica subsp; identical to SEQ ID NO: 40562

SEQ ID NO: 59705 - DNA, 804 bp, Lactococcus delbrueckii bacteriophage LL; identical to SEQ ID NO: 40563
  CDS (1)..(804)

SEQ ID NO: 59706 - protein, 267 aa, Lactococcus delbrueckii bacteriophage LL; identical to SEQ ID NO: 40564

SEQ ID NO: 59707 - DNA, 876 bp, Lactococcus lactis; identical to SEQ ID NO: 40565
  CDS (1)..(876)

SEQ ID NO: 59708 - protein, 291 aa, Lactococcus lactis; identical to SEQ ID NO: 40566

SEQ ID NO: 59709 - DNA, 843 bp, Pseudomonas sp; identical to SEQ ID NO: 40567
  CDS (1)..(843)

SEQ ID NO: 59710 - protein, 280 aa, Pseudomonas sp; identical to SEQ ID NO: 40568

SEQ ID NO: 59711 - DNA, 1368 bp, Lactococcus lactis; identical to SEQ ID NO: 40569
  CDS (1)..(1368)

SEQ ID NO: 59712 - protein, 455 aa, Lactococcus lactis; identical to SEQ ID NO: 40570

SEQ ID NO: 59713 - DNA, 1545 bp, Pseudomonas aeruginosa; identical to SEQ ID NO: 40571
  CDS (1)..(1545)

SEQ ID NO: 59714 - protein, 514 aa, Pseudomonas aeruginosa; identical to SEQ ID NO: 40572

SEQ ID NO: 59715 - DNA, 741 bp, Buchnera aphidicola; identical to SEQ ID NO: 40573
  CDS (1)..(741)

SEQ ID NO: 59716 - protein, 246 aa, Buchnera aphidicola; identical to SEQ ID NO: 40574

SEQ ID NO: 59717 - DNA, 741 bp, Escherichia coli; identical to SEQ ID NO: 40575
  CDS (1)..(738)

SEQ ID NO: 59718 - protein, 245 aa, Escherichia coli; identical to SEQ ID NO: 40576

SEQ ID NO: 59719 - DNA, 22 bp, Primer
atgaaaaatattgcgacaggcg

SEQ ID NO: 59720 - DNA, 23 bp, Primer
ttacttcgcaattcctggctgga

SEQ ID NO: 59721 - protein, 156 aa, consensus; identical to SEQ ID NO: 40579
  MISC_FEATURE (1)..(156): consensus for the disclosure of xaa see table XV

SEQ ID NO: 59722 - protein, 14 aa, consensus
  MISC_FEATURE (1)..(14): consensus for the disclosure of xaa see table XV
GXXGXGKXXXXXXX

SEQ ID NO: 59723 - protein, 73 aa, consensus; identical to SEQ ID NO: 40581
  MISC_FEATURE (1)..(73): consensus for the disclosure of xaa see table XV

SEQ ID NO: 59724 - DNA, 759 bp, Escherichia coli (strain K-12); identical to SEQ ID NO: 29326
  CDS (1)..(759)

SEQ ID NO: 59725 - protein, 252 aa, Escherichia coli (strain K-12); identical to SEQ ID NO: 29327

SEQ ID NO: 59726 - DNA, 678 bp, Streptococcus thermophilus LMG 18311; identical to SEQ ID NO: 29328
  CDS (1)..(678)

SEQ ID NO: 59727 - protein, 225 aa, Streptococcus thermophilus LMG 18311; identical to SEQ ID NO: 29329

SEQ ID NO: 59728 - DNA, 1812 bp, Arabidopsis thaliana; identical to SEQ ID NO: 29330
  CDS (1)..(1812)

SEQ ID NO: 59729 - protein, 603 aa, Arabidopsis thaliana; identical to SEQ ID NO: 29331

SEQ ID NO: 59730 - DNA, 798 bp, Neisseria meningitidis Z2491; identical to SEQ ID NO: 29332
  CDS (1)..(798)

SEQ ID NO: 59731 - protein, 265 aa, Neisseria meningitidis Z2491; identical to SEQ ID NO: 29333

SEQ ID NO: 59732 - DNA, 678 bp, Streptococcus agalactiae 2603V/R; identical to SEQ ID NO: 29334
  CDS (1)..(678)

SEQ ID NO: 59733 - protein, 225 aa, Streptococcus agalactiae 2603V/R; identical to SEQ ID NO: 29335

SEQ ID NO: 59734 - DNA, 774 bp, Oceanobacillus iheyensis HTE831; identical to SEQ ID NO: 29336
  CDS (1)..(774)

SEQ ID NO: 59735 - protein, 257 aa, Oceanobacillus iheyensis HTE831; identical to SEQ ID NO: 29337

SEQ ID NO: 59736 - DNA, 759 bp, Oceanobacillus iheyensis HTE831; identical to SEQ ID NO: 29338
  CDS (1)..(759)

SEQ ID NO: 59737 - protein, 252 aa, Oceanobacillus iheyensis HTE831; identical to SEQ ID NO: 29339

SEQ ID NO: 59738 - DNA, 759 bp, Shigella flexneri 2a str. 301; identical to SEQ ID NO: 29340
  CDS (1)..(759)

SEQ ID NO: 59739 - protein, 252 aa, Shigella flexneri 2a str. 301; identical to SEQ ID NO: 29341

SEQ ID NO: 59740 - DNA, 678 bp, Streptococcus mutans UA159; identical to SEQ ID NO: 29342
  CDS (1)..(678)

SEQ ID NO: 59741 - protein, 225 aa, Streptococcus mutans UA159; identical to SEQ ID NO: 29343

SEQ ID NO: 59742 - DNA, 750 bp, Lactobacillus plantarum WCFS1; identical to SEQ ID NO: 29344
  CDS (1)..(750)

SEQ ID NO: 59743 - protein, 249 aa, Lactobacillus plantarum WCFS1; identical to SEQ ID NO: 29345

SEQ ID NO: 59744 - DNA, 702 bp, Coxiella burnetii RSA 493; identical to SEQ ID NO: 29346
  CDS (1)..(702)

SEQ ID NO: 59745 - protein, 233 aa, Coxiella burnetii RSA 493; identical to SEQ ID NO: 29347

SEQ ID NO: 59746 - DNA, 1491 bp, Rhodopirellula baltica SH 1; identical to SEQ ID NO: 29348
  CDS (1)..(1491)

SEQ ID NO: 59747 - protein, 496 aa, Rhodopirellula baltica SH 1; identical to SEQ ID NO: 29349

SEQ ID NO: 59748 - DNA, 1596 bp, Oryza sativa (japonica cultivar-group); identical to SEQ ID NO: 29350
  CDS (1)..(1596)

SEQ ID NO: 59749 - protein, 531 aa, Oryza sativa (japonica cultivar-group); identical to SEQ ID NO: 29351

SEQ ID NO: 59750 - DNA, 1503 bp, Oryza sativa (japonica cultivar-group); identical to SEQ ID NO: 29352
  CDS (1)..(1503)

SEQ ID NO: 59751 - protein, 500 aa, Oryza sativa (japonica cultivar-group); identical to SEQ ID NO: 29353

SEQ ID NO: 59752 - DNA, 657 bp, Methanococcus maripaludis S2; identical to SEQ ID NO: 29354
  CDS (1)..(657)

SEQ ID NO: 59753 - protein, 218 aa, Methanococcus maripaludis S2; identical to SEQ ID NO: 29355

SEQ ID NO: 59754 - DNA, 681 bp, Desulfotalea psychrophila LSv54; identical to SEQ ID NO: 29356
  CDS (1)..(681)

SEQ ID NO: 59755 - protein, 226 aa, Desulfotalea psychrophila LSv54; identical to SEQ ID NO: 29357

SEQ ID NO: 59756 - DNA, 765 bp, Bacillus licheniformis DSM 13; identical to SEQ ID NO: 29358
  CDS (1)..(765)

SEQ ID NO: 59757 - protein, 254 aa, Bacillus licheniformis DSM 13; identical to SEQ ID NO: 29359

SEQ ID NO: 59758 - DNA, 882 bp, Leuconostoc mesenteroides subsp. mesenteroides ATCC 8293; identical to SEQ ID NO: 29360
  CDS (1)..(882)

SEQ ID NO: 59759 - protein, 293 aa, Leuconostoc mesenteroides subsp. mesenteroides ATCC 8293; identical to SEQ ID NO: 29361

SEQ ID NO: 59760 - DNA, 702 bp, Methanococcoides burtonii DSM 6242; identical to SEQ ID NO: 29362
  CDS (1)..(702)

SEQ ID NO: 59761 - protein, 233 aa, Methanococcoides burtonii DSM 6242; identical to SEQ ID NO: 29363

SEQ ID NO: 59762 - DNA, 759 bp, Enterococcus faecium; identical to SEQ ID NO: 29364
  CDS (1)..(759)

SEQ ID NO: 59763 - protein, 252 aa, Enterococcus faecium; identical to SEQ ID NO: 29365

SEQ ID NO: 59764 - DNA, 801 bp, Methanosarcina barkeri str. fusaro; identical to SEQ ID NO: 29366
  CDS (1)..(801)

SEQ ID NO: 59765 - protein, 266 aa, Methanosarcina barkeri str. fusaro; identical to SEQ ID NO: 29367

SEQ ID NO: 59766 - DNA, 2195 bp, Lycopersicon esculentum; identical to SEQ ID NO: 29368
  CDS (80)..(1717)

SEQ ID NO: 59767 - protein, 545 aa, Lycopersicon esculentum; identical to SEQ ID NO: 29369

SEQ ID NO: 59768 - DNA, 690 bp, Haloarcula marismortui ATCC 43049; identical to SEQ ID NO: 29370
  CDS (1)..(690)

SEQ ID NO: 59769 - protein, 229 aa, Haloarcula marismortui ATCC 43049; identical to SEQ ID NO: 29371

SEQ ID NO: 59770 - DNA, 1710 bp, Nicotiana tabacum; identical to SEQ ID NO: 29372
  CDS (1)..(1710)

SEQ ID NO: 59771 - protein, 569 aa, Nicotiana tabacum; identical to SEQ ID NO: 29373

SEQ ID NO: 59772 - DNA, 819 bp, Acinetobacter sp; identical to SEQ ID NO: 29374
  CDS (1)..(819)

SEQ ID NO: 59773 - protein, 272 aa, Acinetobacter sp; identical to SEQ ID NO: 29375

SEQ ID NO: 59774 - DNA, 660 bp, Aquifex aeolicus; identical to SEQ ID NO: 29376
  CDS (1)..(660)

SEQ ID NO: 59775 - protein, 219 aa, Aquifex aeolicus; identical to SEQ ID NO: 29377

SEQ ID NO: 59776 - DNA, 768 bp, Bacillus subtilis; identical to SEQ ID NO: 29378
  CDS (1)..(768)

SEQ ID NO: 59777 - protein, 255 aa, Bacillus subtilis; identical to SEQ ID NO: 29379

SEQ ID NO: 59778 - DNA, 681 bp, Halobacterium sp; identical to SEQ ID NO: 29380
  CDS (1)..(681)

SEQ ID NO: 59779 - protein, 226 aa, Halobacterium sp; identical to SEQ ID NO: 29381

SEQ ID NO: 59780 - DNA, 681 bp, Lactococcus lactis; identical to SEQ ID NO: 29382
  CDS (1)..(681)

SEQ ID NO: 59781 - protein, 226 aa, Lactococcus lactis; identical to SEQ ID NO: 29383

SEQ ID NO: 59782 - DNA, 759 bp, Lactobacillus plantarum; identical to SEQ ID NO: 29384
  CDS (1)..(759)

SEQ ID NO: 59783 - protein, 252 aa, Lactobacillus plantarum; identical to SEQ ID NO: 29385

SEQ ID NO: 59784 - DNA, 759 bp, Listeria innocua; identical to SEQ ID NO: 29386
  CDS (1)..(759)

SEQ ID NO: 59785 - protein, 252 aa, Listeria innocua; identical to SEQ ID NO: 29387

SEQ ID NO: 59786 - DNA, 759 bp, Listeria monocytogenes; identical to SEQ ID NO: 29388
  CDS (1)..(759)

SEQ ID NO: 59787 - protein, 252 aa, Listeria monocytogenes; identical to SEQ ID NO: 29389

SEQ ID NO: 59788 - DNA, 729 bp, Methanosarcina acetivorans; identical to SEQ ID NO: 29390
  CDS (1)..(729)

SEQ ID NO: 59789 - protein, 242 aa, Methanosarcina acetivorans; identical to SEQ ID NO: 29391

SEQ ID NO: 59790 - DNA, 663 bp, Methanococcus jannaschii; identical to SEQ ID NO: 29392
  CDS (1)..(663)

SEQ ID NO: 59791 - protein, 220 aa, Methanococcus jannaschii; identical to SEQ ID NO: 29393

SEQ ID NO: 59792 - DNA, 648 bp, Methanopyrus kandleri; identical to SEQ ID NO: 29394
  CDS (1)..(648)

SEQ ID NO: 59793 - protein, 215 aa, Methanopyrus kandleri; identical to SEQ ID NO: 29395

SEQ ID NO: 59794 - DNA, 729 bp, Methanosarcina mazei; identical to SEQ ID NO: 29396
  CDS (1)..(729)

SEQ ID NO: 59795 - protein, 242 aa, Methanosarcina mazei; identical to SEQ ID NO: 29397

SEQ ID NO: 59796 - DNA, 666 bp, Methanobacterium thermoautotrophicum; identical to SEQ ID NO: 29398
  CDS (1)..(666)

SEQ ID NO: 59797 - protein, 221 aa, Methanobacterium thermoautotrophicum; identical to SEQ ID NO: 29399

SEQ ID NO: 59798 - DNA, 648 bp, Pyrococcus abyssi; identical to SEQ ID NO: 29400
  CDS (1)..(648)

SEQ ID NO: 59799 - protein, 215 aa, Pyrococcus abyssi; identical to SEQ ID NO: 29401

SEQ ID NO: 59800 - DNA, 906 bp, Pyrobaculum aerophilum; identical to SEQ ID NO: 29402
  CDS (1)..(906)

SEQ ID NO: 59801 - protein, 301 aa, Pyrobaculum aerophilum; identical to SEQ ID NO: 29403

SEQ ID NO: 59802 - DNA, 654 bp, Pyrococcus furiosus; identical to SEQ ID NO: 29404
  CDS (1)..(654)

SEQ ID NO: 59803 - protein, 217 aa, Pyrococcus furiosus; identical to SEQ ID NO: 29405

SEQ ID NO: 59804 - DNA, 759 bp, Salmonella enteritidis; identical to SEQ ID NO: 29406
  CDS (1)..(759)

SEQ ID NO: 59805 - protein, 252 aa, Salmonella enteritidis; identical to SEQ ID NO: 29407

SEQ ID NO: 59806 - DNA, 759 bp, Salmonella typhi; identical to SEQ ID NO: 29408
  CDS (1)..(759)

SEQ ID NO: 59807 - protein, 252 aa, Salmonella typhi; identical to SEQ ID NO: 29409

SEQ ID NO: 59808 - DNA, 759 bp, Shigella dysenteriae; identical to SEQ ID NO: 29410
  CDS (1)..(759)

SEQ ID NO: 59809 - protein, 252 aa, Shigella dysenteriae; identical to SEQ ID NO: 29411

SEQ ID NO: 59810 - DNA, 717 bp, Staphylococcus aureus; identical to SEQ ID NO: 29412
  CDS (1)..(717)

SEQ ID NO: 59811 - protein, 238 aa, Staphylococcus aureus; identical to SEQ ID NO: 29413

SEQ ID NO: 59812 - DNA, 717 bp, Staphylococcus aureus; identical to SEQ ID NO: 29414
  CDS (1)..(717)

SEQ ID NO: 59813 - protein, 238 aa, Staphylococcus aureus; identical to SEQ ID NO: 29415

SEQ ID NO: 59814 - DNA, 717 bp, Staphylococcus epidermidis; identical to SEQ ID NO: 29416
  CDS (1)..(717)

SEQ ID NO: 59815 - protein, 238 aa, Staphylococcus epidermidis; identical to SEQ ID NO: 29417

SEQ ID NO: 59816 - DNA, 687 bp, Streptococcus pyogenes; identical to SEQ ID NO: 29418
  CDS (1)..(687)

SEQ ID NO: 59817 - protein, 228 aa, Streptococcus pyogenes; identical to SEQ ID NO: 29419

SEQ ID NO: 59818 - DNA, 678 bp, Streptococcus pneumoniae; identical to SEQ ID NO: 29420
  CDS (1)..(678)

SEQ ID NO: 59819 - protein, 225 aa, Streptococcus pneumoniae; identical to SEQ ID NO: 29421

SEQ ID NO: 59820 - DNA, 762 bp, Enterococcus faecalis; identical to SEQ ID NO: 29422
  CDS (1)..(762)

SEQ ID NO: 59821 - protein, 253 aa, Enterococcus faecalis; identical to SEQ ID NO: 29423

SEQ ID NO: 59822 - DNA, 26 bp, Primer
atgaaaaccgtaactgtaaaagatct

SEQ ID NO: 59823 - DNA, 27 bp, Primer
ttatgcctggtgtaaaatagttaatac

SEQ ID NO: 59824 - protein, 163 aa, consensus; identical to SEQ ID NO: 29426
  MISC_FEATURE (1)..(163): consensus for the disclosure of xaa see table XV

SEQ ID NO: 59825 - protein, 8 aa, consensus
  MISC_FEATURE (1)..(8): consensus for the disclosure of xaa see table XV
XXXEXRXD

SEQ ID NO: 59826 - protein, 37 aa, consensus; identical to SEQ ID NO: 29428
  MISC_FEATURE (1)..(37): consensus for the disclosure of xaa see table XV

SEQ ID NO: 59827 - protein, 47 aa, consensus; identical to SEQ ID NO: 29429
  MISC_FEATURE (1)..(47): consensus for the disclosure of xaa see table XV

SEQ ID NO: 59828 - protein, 42 aa, consensus; identical to SEQ ID NO: 29430
  MISC_FEATURE (1)..(42): consensus for the disclosure of xaa see table XV

SEQ ID NO: 59829 - DNA, 351 bp, Escherichia coli
  CDS (1)..(351)
atgatggatctcgataatattcccgatacgcaaacggaagctgaagagctggaagaagtggtgatggggcttatcatcaactccggacaagcgcgcagcttggcgtatgccgcactgaaacaggcgaagcagggcgattttgccgcagcaaaagccatgatggatcagtcacggatggcattgaatgaagcgcatctggtacagacgaaactgattgaaggcgatgcgggcgaaggtaagatgaaagtgagtctggtgctggtccacgctcaggatcatttaatgacgtccatgcttgcgcgtgaactgattactgaattaattgagcttcatgaaaaactgaaggcataa

SEQ ID NO: 59830 - protein, 116 aa, Escherichia coli
MMDLDNIPDTQTEAEELEEVVMGLIINSGQARSLAYAALKQAKQGDFAAAKAMMDQSRMALNEAHLVQTKLIEGDAGEGKMKVSLVLVHAQDHLMTSMLARELITELIELHEKLKA

SEQ ID NO: 59831 - DNA, 372 bp, Lactobacillus acidophilus NCFM
  CDS (1)..(372)
atggcagaagaaaaacaaactccagaacaaaaggaccaagaaaccttgatggctgctatgggcttaattgcaaatggtggaaatgcaaaaagtttagcttttgaagcaattcgtcttgcaaagactggtgatatcgaaggcgcacgtgaaaagttaaaggaaagtgataagtcacttcttgaggcacacaattcacagacaagtatgcttactcaagaagcacaaggtgatcatatgcacgtgaccttattggtagtacactcacaagatcacttgatgaatgctattacctttagagatttggctggagaaatggtggatctttacgaaaagctatataattctggcgctcttaaaaaagaagataagtaa

SEQ ID NO: 59832 - protein, 123 aa, Lactobacillus acidophilus NCFM
MAEEKQTPEQKDQETLMAAMGLIANGGNAKSLAFEAIRLAKTGDIEGAREKLKESDKSLLEAHNSQTSMLTQEAQGDHMHVTLLVVHSQDHLMNAITFRDLAGEMVDLYEKLYNSGALKKEDK

SEQ ID NO: 59833 - DNA, 348 bp, Borrelia burgdorferi B31
  CDS (1)..(348)
atgaataaaaaaatatatagcatagaagaattaatagacaaaataagcatgcctgttgtagcttactctggtgaggctaaaagctttctaagagaagctttagaatatgccaaaaacaaagaatatgacaaggcagagcttactatacaagaaagtaaaaaatccattgcaaaggcccatgaagcacacagagaaataatacatcaatcagccactaatccaaactctgtcaaaacgccttttattttaattcatgctgaagatcatttaatgtctgcaatttcagaattaagcatttttgaagaattaatcaatgtttacaaaataataaatgaaataaaaaaatag

SEQ ID NO: 59834 - protein, 115 aa, Borrelia burgdorferi B31
MNKKIYSIEELIDKISMPVVAYSGEAKSFLREALEYAKNKEYDKAELTIQESKKSIAKAHEAHREIIHQSATNPNSVKTPFILIHAEDHLMSAISELSIFEELINVYKIINEIKK

SEQ ID NO: 59835 - DNA, 333 bp, Bacillus halodurans C-125
  CDS (1)..(333)
atgccgacacaacaaaagcctcttgaagaaattgcctttcaaatcattcttcattcagggaatgctcgctcatgtgccatggaaggcattcaattagcaaaagcaggaaaattcgctgctgcacgagaacgtatggagcaagcagataaggaatttcataaagcccatcatgcacagacgagcttaattcaacaggaagcaagtggtgatgccgtctccccttccctgctcttgatccatgcccaagatcatttaatgacctcgatgacgacgaaggacctttgtctagagatcatcgagcttcacgaaaaagtcgataaggagtgtgaatag

SEQ ID NO: 59836 - protein, 110 aa, Bacillus halodurans C-125
MPTQQKPLEEIAFQIILHSGNARSCAMEGIQLAKAGKFAAARERMEQADKEFHKAHHAQTSLIQQEASGDAVSPSLLLIHAQDHLMTSMTTKDLCLEIIELHEKVDKECE

SEQ ID NO: 59837 - DNA, 330 bp, Bacillus halodurans C-125
  CDS (1)..(330)
atggaagcgattgattttgaccaattatcgagtgatcaaattccgtttatgattattctccatagcggaaacgggagaagcaaaatactgcaagcattgcgggagtatcgtgaagggaaggaagcggaagcaaacgaccttctcgtggaggcggaaaaggatttgaatgtagctcacgaaattcactttaagctcgtacaacaagaggctactggagaaaaaacggagctgtccttgttgctcatgcatgcagaggatcatctaatgtctacgttaacaatgaaagatttagtgaaagagttgttagagattttcaaaatgaaaaagtaa

SEQ ID NO: 59838 - protein, 109 aa, Bacillus halodurans C-125
MEAIDFDQLSSDQIPFMIILHSGNGRSKILQALREYREGKEAEANDLLVEAEKDLNVAHEIHFKLVQQEATGEKTELSLLLMHAEDHLMSTLTMKDLVKELLEIFKMKK

SEQ ID NO: 59839 - DNA, 351 bp, Lactococcus lactis subsp. lactis Il1403
  CDS (1)..(351)
atgactgataaatacgagaatccaacaagtgatgactacatgggtgttgtaatgggcattatcatgagtggaggaaatgccaaaggtttagccttccaagccattcaacaagccaaagctggtgaatttgccgaagctgaaagttcattaaacgaagcgagtgaacaacttcgtgaagcacatgatgttcagactgaccttttgacacgtttagctcaaggcgaaaaaattggttggaatctttacatggttcatgctcaagaccacttaatgaatgcgattacctttaaagaccttgctgtagaagttgtcggtcaagaacaacgcctgcaagcacttgaaaacaaataa

SEQ ID NO: 59840 - protein, 116 aa, Lactococcus lactis subsp. lactis Il1403
MTDKYENPTSDDYMGVVMGIIMSGGNAKGLAFQAIQQAKAGEFAEAESSLNEASEQLREAHDVQTDLLTRLAQGEKIGWNLYMVHAQDHLMNAITFKDLAVEVVGQEQRLQALENK

SEQ ID NO: 59841 - DNA, 336 bp, Streptococcus pyogenes M1 GAS
  CDS (1)..(336)
atgacggaaccatccaacttagaagctattatgggcttaatcatgtatggaggcgaagccaagggcaaggccgtagaggctattcatgcagcacgagatgggcagtttgaggaggctcagcacttacttcaagaagcgacaaactcgttaaatattgcccataaatcgcagacacatttgctgtcccaagaagcagctggtgatgcggttgaattgtctttattgatggtgcatgggcaagatcacatgatgactgccttagcctttattgatttagccaaggaattggttaccgtttacgacaaaatgtcagcaatacaaagaggtgagtcatga

SEQ ID NO: 59842 - protein, 111 aa, Streptococcus pyogenes M1 GAS
MTEPSNLEAIMGLIMYGGEAKGKAVEAIHAARDGQFEEAQHLLQEATNSLNIAHKSQTHLLSQEAAGDAVELSLLMVHGQDHMMTALAFIDLAKELVTVYDKMSAIQRGES

SEQ ID NO: 59843 - DNA, 318 bp, Streptococcus pyogenes M1 GAS
  CDS (1)..(318)
atgaatagagaagaaactactcttttaggttttgaaatcgtagcctatgctggtgatgcccgttcaaaatttttggaagcgcttaaagcagcgcaagaaggagattatgctaaagcagaagaattaatcgctgcaggtagtgactgcttgaatgatgctcacaatgctcagacaagtctactacaaaaagaagcagctggagatgacttagcttatagtgtcactttaatgcatggtcaagatcatttaatgacgaccattttattacaagatttaatgaaacacatgattgaactttataagagaggagcaaaataa

SEQ ID NO: 59844 - protein, 105 aa, Streptococcus pyogenes M1 GAS
MNREETTLLGFEIVAYAGDARSKFLEALKAAQEGDYAKAEELIAAGSDCLNDAHNAQTSLLQKEAAGDDLAYSVTLMHGQDHLMTTILLQDLMKHMIELYKRGAK

SEQ ID NO: 59845 - DNA, 321 bp, Streptococcus pyogenes M1 GAS
  CDS (1)..(321)
atgcaagttattgtaccagaccaaatcattatgggcttaattttaaatgcaggcgatgccaaacaacatatctaccaagctctgaaatgtgctaaagaggacgattatgccactagtgaaaaagaaatggccttagcagatgatgccttattagaagcccacaatttacagacccagtttcttgcccaagaagctagtggtaataagtcagagattacagctctttttgttcactcacaggatcacttgatgacgaccattacagaaattaatctcatcaaagagattattgaccttcgtaaagaattggcaactaaataa

SEQ ID NO: 59846 - protein, 106 aa, Streptococcus pyogenes M1 GAS
MQVIVPDQIIMGLILNAGDAKQHIYQALKCAKEDDYATSEKEMALADDALLEAHNLQTQFLAQEASGNKSEITALFVHSQDHLMTTITEINLIKEIIDLRKELATK

SEQ ID NO: 59847 - DNA, 321 bp, Streptococcus pneumoniae TIGR4
  CDS (1)..(321)
atggaaatgattgttccagatcaaattatcatgggtttaattttatatgctggtgatgcgaaacaacatatttataaagcgttagattacataaaaaatggtacatgtgaacggtgtgaagaagaaatacagttagctgatgcagccttattagaagctcataatctacaaacaaaatttttggcacaggaagcgtctggtacaaagacagaaattacagctctctttgttcattcacaagatcatctcatgaccagtatgacggagattaatttaatcaaagaaattattagtttgagaaaagaacttcataaaaaataa

SEQ ID NO: 59848 - protein, 106 aa, Streptococcus pneumoniae TIGR4
MEMIVPDQIIMGLILYAGDAKQHIYKALDYIKNGTCERCEEEIQLADAALLEAHNLQTKFLAQEASGTKTEITALFVHSQDHLMTSMTEINLIKEIISLRKELHKK

SEQ ID NO: 59849 - DNA, 315 bp, Streptococcus pneumoniae TIGR4
  CDS (1)..(315)
atgaatcaagaggaactgcaggttgcagcatttgaaattatcctgcattcgggaaatgcaaggtcagaaatacatgaagcatttgcaaaaatgagagaaggtagttttgatgatgcagaaagtaaattaaatcaatcaaatgagataattcttgaagcgcatcatgcacaaaccaaactcttgcaagaatacgcaagtggagtggaaattaaaattgaaattatcatggtacatgctcaagatcatttaatgaccactatgacattattagaagtagcaaaggaaatgttagctctttataagaaagttaactaa

SEQ ID NO: 59850 - protein, 104 aa, Streptococcus pneumoniae TIGR4
MNQEELQVAAFEIILHSGNARSEIHEAFAKMREGSFDDAESKLNQSNEIILEAHHAQTKLLQEYASGVEIKIEIIMVHAQDHLMTTMTLLEVAKEMLALYKKVN

SEQ ID NO: 59851 - DNA, 345 bp, Streptococcus pneumoniae TIGR4
  CDS (1)..(345)
atgaaatcaaaagaagaaataaatatgcttggttttacaattgtcgcttacgcaggagatgcaaggtcagatttgatggatgctttggcgtttgcgagagatggatattttgaacaggcaagagaattggttgagtctgcaaacgactcaatagtgtctgcccatcgagaacagactaatttattagcggaggaggcatatggagataattttgaagtgagctttattatgattcatggtcaagatactttgatgacaacgatgctattgtatgatcaggtaaagttttttattgatgaatatgaacgaattcgaaagattgaagaacatattggtttgcaatga

SEQ ID NO: 59852 - protein, 114 aa, Streptococcus pneumoniae TIGR4
MKSKEEINMLGFTIVAYAGDARSDLMDALAFARDGYFEQARELVESANDSIVSAHREQTNLLAEEAYGDNFEVSFIMIHGQDTLMTTMLLYDQVKFFIDEYERIRKIEEHIGLQ

SEQ ID NO: 59853 - DNA, 327 bp, Streptococcus pneumoniae TIGR4
  CDS (1)..(327)
atggataggagaaataagatgacagaagaaatggaatatatctgttttcagctcattgccaatagtggagcagccaaatcatcctttattgaagccatccaactagctaaggcaggaaatttaaaagaagcgaaaattaaagttgaagaagcggaagactccttagtagaagcgcacaagattcactctaatctcatacaaaaagaagctactggagaaaaaataggattctccttgctatttatgcatgcagaagaccaaatggcttcaacagagattattcagttgctatctaaagaattcatcgatctctatcaaaataaatag

SEQ ID NO: 59854 - protein, 108 aa, Streptococcus pneumoniae TIGR4
MDRRNKMTEEMEYICFQLIANSGAAKSSFIEAIQLAKAGNLKEAKIKVEEAEDSLVEAHKIHSNLIQKEATGEKIGFSLLFMHAEDQMASTEIIQLLSKEFIDLYQNK

SEQ ID NO: 59855 - DNA, 321 bp, Clostridium acetobutylicum ATCC 824
  CDS (1)..(321)
atggatatagagcaaataataatgaatataataatttattccggcgatgctaggagctacatgtatgaagcgcttagcaaggcaagagaaggaaagtatgatgagataaatggcttaataaagcaagcaaatgatgctataggaaaggctcatgatatacagacttcaatgcttcaaaaagaagcagagggcgaggcactaaaggtttcaatattatttgtacatgcgcaggatcaattaatgaccacaatttcagaaaaaaatcttataactgaaatgattgaaatgacaaaggatataaatgctttgtccaataaataa

SEQ ID NO: 59856 - protein, 106 aa, Clostridium acetobutylicum ATCC 824
MDIEQIIMNIIIYSGDARSYMYEALSKAREGKYDEINGLIKQANDAIGKAHDIQTSMLQKEAEGEALKVSILFVHAQDQLMTTISEKNLITEMIEMTKDINALSNK

SEQ ID NO: 59857 - DNA, 315 bp, Clostridium acetobutylicum ATCC 824
  CDS (1)..(315)
atgaataaggaagaattagaattaactacaatggagatagtggcttatgcaggagatgcaagatcaaaatatttggaagctttaaatgcagctaatggcggagattatgataaggcacagcaattagttttagagggaaatgatcttataactgaagcacataacgttcaaactaaaatgattcaaatggaagctcaaggtaagaagatagaggtaggattcttagttgtccatgcgcaggatcatttaatgacagtaatgcttttaagagaccttgtaaagaatttaataaatttatacaagaaggtaaattag

SEQ ID NO: 59858 - protein, 104 aa, Clostridium acetobutylicum ATCC 824
MNKEELELTTMEIVAYAGDARSKYLEALNAANGGDYDKAQQLVLEGNDLITEAHNVQTKMIQMEAQGKKIEVGFLVVHAQDHLMTVMLLRDLVKNLINLYKKVN

SEQ ID NO: 59859 - DNA, 318 bp, Streptococcus pneumoniae R6
  CDS (1)..(318)
atgaatagagaagaagtaacattgttaggttttgaaatcgtagcctatgctggcgatgctcgttcaaaactattggaagccttgaaggctgctgaagctggtgattttgaaaaagcggacgctctggtagaggaagctggtagctgtattgcagaggctcaccacgcgcaaacaagtctattgactaaggaagcttctggtgaggacttagcgtatagtgtgaccatgatgcatggccaagaccacttgatgacaactatcttgttaaaggatttgatgcaccatttgatcgaactctataagagaggagttaaataa

SEQ ID NO: 59860 - protein, 105 aa, Streptococcus pneumoniae R6
MNREEVTLLGFEIVAYAGDARSKLLEALKAAEAGDFEKADALVEEAGSCIAEAHHAQTSLLTKEASGEDLAYSVTMMHGQDHLMTTILLKDLMHHLIELYKRGVK

SEQ ID NO: 59861 - DNA, 333 bp, Bacillus subtilis subsp. subtilis str. 168
  CDS (1)..(333)
atggaacagatgaaaatcacgaatttaacaggcgagcaaatcagttttcagctaatcctgcacagcggaaatgcccgcagctgcatcatacaatcactgcgcgcctataaagaagggaaaaaggacgaggctgatgccctcattgccaaggcggagcaggatttatccgcggcccatgacattcactttcaaatgatacagaaggaatccggcggagaagcaacagctttttcattgctgcttatgcatgcagaggatcatctgatgtcaacattatccatgaaagaattagtgaaagagatgcttgatctctttaaaaccaagaatatataa

SEQ ID NO: 59862 - protein, 110 aa, Bacillus subtilis subsp. subtilis str. 168
MEQMKITNLTGEQISFQLILHSGNARSCIIQSLRAYKEGKKDEADALIAKAEQDLSAAHDIHFQMIQKESGGEATAFSLLLMHAEDHLMSTLSMKELVKEMLDLFKTKNI

SEQ ID NO: 59863 - DNA, 348 bp, Salmonella typhimurium LT2
  CDS (1)..(348)
atgtttgatcttgaaaatgttgtagataaccagaccgcggctgaggaactcgaagaagtcgttatggggcttatcatcaattctggtcaggcgcgcagcctggcatatggcgcgctcagaaaagcgaaagaaggcgattttgaggcggcgaaagcgatgatggaccagtcgcgcatagcgctcaatgaagcgcatcttgtgcagacaaaactcatcgaaggcgatcagggcgaaggcaaaatgaaagtcagtctggtcctggttcacgctcaggatcatttgatgacatcaatgctggctcgtgaactgatcgccgagttgattgagctccatgagaaactgaaataa

SEQ ID NO: 59864 - protein, 115 aa, Salmonella typhimurium LT2
MFDLENVVDNQTAAEELEEVVMGLIINSGQARSLAYGALRKAKEGDFEAAKAMMDQSRIALNEAHLVQTKLIEGDQGEGKMKVSLVLVHAQDHLMTSMLARELIAELIELHEKLK

SEQ ID NO: 59865 - DNA, 330 bp, Listeria monocytogenes EGD-e
  CDS (1)..(330)
atggacatagaaaaaatatcgttttcattaatttcactggcgggggattcgttttctaaattaattgaagcactacaggctgcaaaagaatcagattcagaactagttgaacaacttttaaaagaagcagatgacttaatgattgaagcacacaaggtacaaacggaaatgctgattcaagaaacaagaggggaacaagcaaatttttccgtcttactcgtgcatgcgcaagatactctaatgaataccatcttagcatcaactttaattcgcgaaatgattgaaatgcatcaagagattaaaacattaagaaaagaggaggaaaagtaa

SEQ ID NO: 59866 - protein, 109 aa, Listeria monocytogenes EGD-e
MDIEKISFSLISLAGDSFSKLIEALQAAKESDSELVEQLLKEADDLMIEAHKVQTEMLIQETRGEQANFSVLLVHAQDTLMNTILASTLIREMIEMHQEIKTLRKEEEK

SEQ ID NO: 59867 - DNA, 303 bp, Listeria monocytogenes EGD-e
  CDS (1)..(303)
atggaattagaacaaacaattatgcaattaatcgtacacgggggaaacgctaaaagtgacgcaatgctagcaatcgaagcggcaaaaaaaggggattttgacgttgcagatgagcaaatcaaaaatgcagaagcggcactacttgaggcgcatcattcacaaacttcattaattcaaggtgaagcacgtggcgaaaaagcagaagtatcattactacttgttcacgcgcaagatcacttaatgaacgctattacttttaaagacttagcgaaggaaattgttgatttataccgctctaaataa

SEQ ID NO: 59868 - protein, 100 aa, Listeria monocytogenes EGD-e
MELEQTIMQLIVHGGNAKSDAMLAIEAAKKGDFDVADEQIKNAEAALLEAHHSQTSLIQGEARGEKAEVSLLLVHAQDHLMNAITFKDLAKEIVDLYRSK

SEQ ID NO: 59869 - DNA, 303 bp, Listeria monocytogenes EGD-e
  CDS (1)..(303)
atggatttagagcaaactattatgagcttgatcgtgttcggtggtaacgctaaaagcgatgctatgttagccattgattccgctaaaaaaggggatttcgctcaagcagacgaacaaatcgcccaagcagaacaagcactacttgaagcgcatcattctcaaacaaaacttatacaaggtgaagcacgtggcgaaaaaacagaagtttcccttctactcgttcacgcacaagaccacttaatgaatgcaattactttcaaagatttagcgaaagaaattgttgacctttataagaataaataa

SEQ ID NO: 59870 - protein, 100 aa, Listeria monocytogenes EGD-e
MDLEQTIMSLIVFGGNAKSDAMLAIDSAKKGDFAQADEQIAQAEQALLEAHHSQTKLIQGEARGEKTEVSLLLVHAQDHLMNAITFKDLAKEIVDLYKNK

SEQ ID NO: 59871 - DNA, 309 bp, Listeria monocytogenes EGD-e
  CDS (1)..(309)
atggaaggaatggaactcgcatcatttcaaataattagttctgttggcgccgcaagaagttgcattattgaggcgatgaaattgggaagacaaagaaaattcacagaagcatataaaaaaattgatgaggctaatgaatttcttagcgaaggtcataaaaatcatgtgcagctaattcaaaaagaggcagatggtggagacgtacaaatttctatcctcttcatgcacgcggaagatcaatttatgacaacatatacattacgcgatgtagcttatgagatgattgctatttggaaagaaatgaaataa

SEQ ID NO: 59872 - protein, 102 aa, Listeria monocytogenes EGD-e
MEGMELASFQIISSVGAARSCIIEAMKLGRQRKFTEAYKKIDEANEFLSEGHKNHVQLIQKEADGGDVQISILFMHAEDQFMTTYTLRDVAYEMIAIWKEMK

SEQ ID NO: 59873 - DNA, 354 bp, Listeria innocua Clip11262
  CDS (1)..(354)
atggaaattcaagtagaagaagctgttgtaaaactcattttacatgggggaaacacacgtaaagaagcatataaagcaattgattatgctgaaaaataccaatttgatcaggcagacaagcatttgcaaatggcccaagaacagtttcaagaaggtcacgtttggcaaacaaaactagtctcaattcgcgacactgaaaccgtagcacacccgtcatttttattaattcatggacaagaccatttaatgactgcccaagccgaactacaactagccaaaagaatcattgaacaatataaacatcaacaaaacttagaaaaacgcctaacaaaattagaaaatcagctagcttaa

SEQ ID NO: 59874 - protein, 117 aa, Listeria innocua Clip11262
MEIQVEEAVVKLILHGGNTRKEAYKAIDYAEKYQFDQADKHLQMAQEQFQEGHVWQTKLVSIRDTETVAHPSFLLIHGQDHLMTAQAELQLAKRIIEQYKHQQNLEKRLTKLENQLA

SEQ ID NO: 59875 - DNA, 315 bp, Listeria innocua Clip11262
  CDS (1)..(315)
atggaaggcactgaattacaatcttttaaaataatatcaagtgcaggagatgcgtcttccttgtttctaaaagccgttcaacacgctgaaaaaagtgaatttgcagaagcagaagcatgtatcgagcaagcaaatcaatctttaagagaagcacatcatgttcaaacgtctttgattcaagaagaagcaaacggtagctcaaaagaactttctttactgctgattcacgcacaagatcatctaatgaatgcttttgtatactctgacttagttaaatccgtgcttaatttgtataagcgtttagatgaaaagtaa

SEQ ID NO: 59876 - protein, 104 aa, Listeria innocua Clip11262
MEGTELQSFKIISSAGDASSLFLKAVQHAEKSEFAEAEACIEQANQSLREAHHVQTSLIQEEANGSSKELSLLLIHAQDHLMNAFVYSDLVKSVLNLYKRLDEK

SEQ ID NO: 59877 - DNA, 312 bp, Clostridium perfringens str. 13
  CDS (1)..(312)
atgaaagaaataatcatggatttaataattcatagtggagaagctagaagttatgccatggaagctattcagcttgctaaagcaggagaggtagacggggctagaagcttaatagaaaaagcgtcaatgcaattaggcaaagctcataaatcacaaacagctttgattcaagatgaggctagtgataataaaatagaaatatccatgctattaattcatgcacaggatcaattaatgactactatgacattaaaagatttagcaaatgaaataatagatttgtatgaaaaattaaatcaaaaaaatttttag

SEQ ID NO: 59878 - protein, 103 aa, Clostridium perfringens str. 13
MKEIIMDLIIHSGEARSYAMEAIQLAKAGEVDGARSLIEKASMQLGKAHKSQTALIQDEASDNKIEISMLLIHAQDQLMTTMTLKDLANEIIDLYEKLNQKNF

SEQ ID NO: 59879 - DNA, 336 bp, Streptococcus pyogenes MGAS8232
  CDS (1)..(336)
atgacgggaccatccaacttagaagctattatgggcttaatcatgtatggaggcgaagccaagggcaaggccgtagaggctattcatgcagcacgagatgggcagtttgaggaggctcagcacttacttcaagaagcgacaaactcgttaaatattgcccataaatcgcagacacatttgctctcccaagaagcagctggtgatgcggttgaattgtctttattgatggtgcatgggcaagatcacatgatgactgccttagcctttattgatttagccaaggaattggttaccgtttacgacaaaatgtcagcaatacagaggggcgagtcatga

SEQ ID NO: 59880 - protein, 111 aa, Streptococcus pyogenes MGAS8232
MTGPSNLEAIMGLIMYGGEAKGKAVEAIHAARDGQFEEAQHLLQEATNSLNIAHKSQTHLLSQEAAGDAVELSLLMVHGQDHMMTALAFIDLAKELVTVYDKMSAIQRGES

SEQ ID NO: 59881 - DNA, 333 bp, Thermoanaerobacter tengcongensis MB4
  CDS (1)..(333)
atggatttggaacagattgtatttaccattatatctcatgcagggaatgcacggagtaattcttttgaagcattgaaatacgcaagagaaggcaattttgaagaagcagaaaaatgtttagaaaaagcgagtgaagagcttttagaagctcatcacgtacaaacagatatgatacacaaggaagcggcaggagaaaaacaagagataactttgcttttagttcatgctgaggatcatctcatgaatgctatccttgcgaaagagttgataactgaaatgattgagctctataaaattatttatcaaacaaagggggctacttataatgtctaa

SEQ ID NO: 59882 - protein, 110 aa, Thermoanaerobacter tengcongensis MB4
MDLEQIVFTIISHAGNARSNSFEALKYAREGNFEEAEKCLEKASEELLEAHHVQTDMIHKEAAGEKQEITLLLVHAEDHLMNAILAKELITEMIELYKIIYQTKGATYNV

SEQ ID NO: 59883 - DNA, 318 bp, Thermoanaerobacter tengcongensis MB4
  CDS (1)..(318)
atggatttggaacagataatatacaatttagtgctgcatggaggaaatgcaagagcagaagcatatgaggcattggatgcagcggagaaaggagattttgaagaagcagaaaggcatttacaaaaagcagatgaagagttttacgaagggcataaataccagaacatgctgacacaaggagagcagagtcagacgcctaattttttggtaatacatgcacaggaccagctgatgacagcacttgcagaaaaaaatctgataaagaggatgattgaactgtataaaagggtaagtcaattagaaaaaagattaggttaa

SEQ ID NO: 59884 - protein, 105 aa, Thermoanaerobacter tengcongensis MB4
MDLEQIIYNLVLHGGNARAEAYEALDAAEKGDFEEAERHLQKADEEFYEGHKYQNMLTQGEQSQTPNFLVIHAQDQLMTALAEKNLIKRMIELYKRVSQLEKRLG

SEQ ID NO: 59885 - DNA, 348 bp, Yersinia pestis KIM
  CDS (1)..(348)
atgtttgatttaagtagcatcgttgataacgaacaaaccagtgatgcgctggaagatgtggtcatggggcttatcatcaacgcgggccaagcccgtagcctggcctataacgcactgaaacaggccaaagccggtgattttgcacaagcagatgaactgatggcgcagtcccggagcgccttgaatgacgcccacttggtgcagacacaattgattgaagccgatcagggcgaagggaaaaccaaagttaccctggtgctggtacatgctcaggatcatttgatgaatgccatgttagcgcgagaattgattactgagcttatcgagctgcatcaaaaaattcagtga

SEQ ID NO: 59886 - protein, 115 aa, Yersinia pestis KIM
MFDLSSIVDNEQTSDALEDVVMGLIINAGQARSLAYNALKQAKAGDFAQADELMAQSRSALNDAHLVQTQLIEADQGEGKTKVTLVLVHAQDHLMNAMLARELITELIELHQKIQ

SEQ ID NO: 59887 - DNA, 324 bp, Streptococcus agalactiae 2603V/R
  CDS (1)..(324)
atggaaatcatagtcgcagaccaaattattatggggctcattttgaatgctggggatgctaaacaacatatctatcaagccttaaaacttgcaaaagaaggaaattttgcagaaagtaagattgaaatagaactagcagatagtgcactcctagaagctcataatcttcaaacacaattccttgcacaagaagcaggagggacaaggacagatatctcagcactctttattcattctcaggatcatttgatgacaagtattactgagattaacttgattaaagaaattattgatttacgccaggaattacatattcaaaaataa

SEQ ID NO: 59888 - protein, 107 aa, Streptococcus agalactiae 2603V/R
MEIIVADQIIMGLILNAGDAKQHIYQALKLAKEGNFAESKIEIELADSALLEAHNLQTQFLAQEAGGTRTDISALFIHSQDHLMTSITEINLIKEIIDLRQELHIQK

SEQ ID NO: 59889 - DNA, 336 bp, Oceanobacillus iheyensis HTE831
  CDS (1)..(336)
atggccacacaacaggaagaattacaaatgctttcatttcaaattatattacatgctggaaatgccagatcagaagcaatggaagcattacagcttgctagaaaaggagaatttaaagaagcagaattaaaattagaggctgctgataaagaatttaccgaagcgcatcatatacaaacttccttattacaggatgaagctaatggaaacagccctgacttttctataattcttatccatgctcaagatcatttaatgaatgctcttacagttaaagatttagcaatcgaaatgattgcaatgcaaaaacaaataaaaaaattggaggagagataa

SEQ ID NO: 59890 - protein, 111 aa, Oceanobacillus iheyensis HTE831
MATQQEELQMLSFQIILHAGNARSEAMEALQLARKGEFKEAELKLEAADKEFTEAHHIQTSLLQDEANGNSPDFSIILIHAQDHLMNALTVKDLAIEMIAMQKQIKKLEER

SEQ ID NO: 59891 - DNA, 312 bp, Oceanobacillus iheyensis HTE831
  CDS (1)..(312)
atgaatcagacacaattaacagaaactgcatttcaaatcatcctttttgcaggaaatggcaaatcaagtgcgatggaagcaatacatgcagcaaaggaaggaaattttgcagtggcagatgatctaattaaaactgcgagtgatgaattaacaaatgcgcataactttcaaacaaaacttttgcacgatgaagccaatggagataaaaaggacatcaatcttatccttattcattcacaagatcacttaatgaatgcgatgaccattaaagacttagcaatcgaaatcatagatatatacagaaataagtag

SEQ ID NO: 59892 - protein, 103 aa, Oceanobacillus iheyensis HTE831
MNQTQLTETAFQIILFAGNGKSSAMEAIHAAKEGNFAVADDLIKTASDELTNAHNFQTKLLHDEANGDKKDINLILIHSQDHLMNAMTIKDLAIEIIDIYRNK

SEQ ID NO: 59893 - DNA, 312 bp, Streptococcus mutans UA159
  CDS (1)..(312)
atgaatacagaagaattacaagttgccgcatttgaaattattttaaattctggcaatgcgcgctcaattgtccatgaagcatttgatgcaatgcgtgaaaaaaattacattctagctgaacagaagcttcaggaagcgaatgatgaactgctcaaagctcatcaagcacagactgatctactgcaagagtacgctagcggaacggaaattaaaattgaaatcatcatggttcatgcgcaagatcatttaatgacaaccatgacacttcgcgaagtagctattgaaatgttggaattgtataaaaaaagttga

SEQ ID NO: 59894 - protein, 103 aa, Streptococcus mutans UA159
MNTEELQVAAFEIILNSGNARSIVHEAFDAMREKNYILAEQKLQEANDELLKAHQAQTDLLQEYASGTEIKIEIIMVHAQDHLMTTMTLREVAIEMLELYKKS

SEQ ID NO: 59895 - DNA, 309 bp, Vibrio vulnificus CMCP6
  CDS (1)..(309)
atggaacaagaactggtggtgatggaaatcatttgtaatgcaggtgaagcaagaagtttgtgctttgaagcattgaaattatcacggcagaaagagtttgtgctggcggacgaaaaactggctcaagcaaaggagtgtttgaacaagtcacacttagtgcaaacgcagctgattgaagaagatcaaggtgaaggcaaagtgcctatgacattggtcatggtgcatgcacaggatcaccttatgacgacaatcttggctcatgagcttgcagtagaaatggtcgaacttcataagcagttggctggatga

SEQ ID NO: 59896 - protein, 102 aa, Vibrio vulnificus CMCP6
MEQELVVMEIICNAGEARSLCFEALKLSRQKEFVLADEKLAQAKECLNKSHLVQTQLIEEDQGEGKVPMTLVMVHAQDHLMTTILAHELAVEMVELHKQLAG

SEQ ID NO: 59897 - DNA, 315 bp, Staphylococcus epidermidis ATCC 12228
  CDS (1)..(315)
atgaatagagatgaggtacaattactcggatttgaaattgttgcctatgctggggatgcacgttcaaaattattagaagctttaaatgctgctaaagatagtgaatttgataaagcagaacaacttgtagaggaagcgaatgaatgtattgctaatgcacataaagcacaaaccaatcttctagctcaagaggctaaaggcgaggatatcgcatatagtatcactatgattcatggtcaagaccatttaatgacaacattacttttaaaagatttaatgaagcatttaattgaattatacaaaaaagggagctga

SEQ ID NO: 59898 - protein, 104 aa, Staphylococcus epidermidis ATCC 12228
MNRDEVQLLGFEIVAYAGDARSKLLEALNAAKDSEFDKAEQLVEEANECIANAHKAQTNLLAQEAKGEDIAYSITMIHGQDHLMTTLLLKDLMKHLIELYKKGS

SEQ ID NO: 59899 - DNA, 339 bp, Lactobacillus plantarum WCFS1
  CDS (1)..(339)
atgacattagccaataatactgaaactcaagatattgcaatgacacttatcgcgtattctggtgaaggtcgtacgctggcttttaatgcgttagatgcgatgcatcgcgatgctttctccgaatctaagatgttattgaagaaatctagtgaagcactggggaaagcacatgatgttcaaacccaactactggtggctgaggcgaatggtcaacaagtttccattgatattttactaattcatgctcaagatcattttatgacgagtctgttagctaacgagttaatcgctgagatgttaaagatgtctcaaaaatttgaaaggatggtcgatttatga

SEQ ID NO: 59900 - protein, 112 aa, Lactobacillus plantarum WCFS1
MTLANNTETQDIAMTLIAYSGEGRTLAFNALDAMHRDAFSESKMLLKKSSEALGKAHDVQTQLLVAEANGQQVSIDILLIHAQDHFMTSLLANELIAEMLKMSQKFERMVDL

SEQ ID NO: 59901 - DNA, 348 bp, Lactobacillus plantarum WCFS1
  CDS (1)..(348)
atggcagaagaacaaacaaaagaagttgaagcaagtctcgaaaccattatgggtttgatcgttaatggtggtaatgcaaagagttccgctttcgaagcaattaaagctgctaaggaaggcgactttgaaaccgctgatgccaagttaaaggaagcagataactttctaaccgaagcacacaattcacaaacctcaatgttaacggcggaagcacaaggggaacatacccacgtgtcattgttattagtacattcacaagatcacatcatgaatgccatcaccttccgcgacttagctggtgaagttgtagacgtttatcggcgtttagctgccgatgaggcgaagtag

SEQ ID NO: 59902 - protein, 115 aa, Lactobacillus plantarum WCFS1
MAEEQTKEVEASLETIMGLIVNGGNAKSSAFEAIKAAKEGDFETADAKLKEADNFLTEAHNSQTSMLTAEAQGEHTHVSLLLVHSQDHIMNAITFRDLAGEVVDVYRRLAADEAK

SEQ ID NO: 59903 - DNA, 312 bp, Vibrio parahaemolyticus RIMD 2210633
  CDS (1)..(312)
atggaacaagaactggttgtaatggaaatcatctgtaatgcgggtgaagccagaagtttaagttatgaagcactccgtttggcgagagagcaaaaatttgaagcagcagaagagaaattgttgcaagccagagagtgcattaacaaggcgcatttaattcagacgcaactgatcgaagaagatcagggggaaggcaaagtgccgatgactctggttatggtgcacgctcaagatcatttaatgacaacgattctagcgcaagaaatggctgttgagattgtcgctttgaacaagcaactcgcgaacaagtaa

SEQ ID NO: 59904 - protein, 103 aa, Vibrio parahaemolyticus RIMD 2210633
MEQELVVMEIICNAGEARSLSYEALRLAREQKFEAAEEKLLQARECINKAHLIQTQLIEEDQGEGKVPMTLVMVHAQDHLMTTILAQEMAVEIVALNKQLANK

SEQ ID NO: 59905 - DNA, 336 bp, Streptococcus pyogenes SSI-1
  CDS (1)..(336)
atgacggaaccatccaacttagaagctattatgggcttaatcatgtatggaggtgaagccaagggcaaggccgtagaggctattcatgcagcacgagatgggcagtttgaggaggctcagcacttacttcaagaagcgacaaactcgttaaatattgcccataaatcgcagacacatttgctgtcccaagaagcagctggtgatgcggttgaattgtctttattgatggtgcatgggcaagatcacatgatgactgccttagcctttattgatttagccaaggaattggttatcgtttacgataaaatgtcagcaatacaaagaggtgagtcatga

SEQ ID NO: 59906 - protein, 111 aa, Streptococcus pyogenes SSI-1
MTEPSNLEAIMGLIMYGGEAKGKAVEAIHAARDGQFEEAQHLLQEATNSLNIAHKSQTHLLSQEAAGDAVELSLLMVHGQDHMMTALAFIDLAKELVIVYDKMSAIQRGES

SEQ ID NO: 59907 - DNA, 321 bp, Enterococcus faecalis V583
  CDS (1)..(321)
atggacggacaacagaacttagaagcaatcatgggtttaatcatgtatggcggaaatgctaaaagcgatgcaatggaagcgattgccgcagcaaaatcgggggattttgaattagcagacaaaaaaattgcagatgcagaagaatcacttgtacatgcacatcattcgcaaacaggaatgttaacagaagaagcaaaaggcaataacatgcaagtaacattgttaacagtgcacagtcaagatcatttaatgactgcgattgcatttacagatttagcaaaagaaattatcgatctttatcgccgtattgataacgagtaa

SEQ ID NO: 59908 - protein, 106 aa, Enterococcus faecalis V583
MDGQQNLEAIMGLIMYGGNAKSDAMEAIAAAKSGDFELADKKIADAEESLVHAHHSQTGMLTEEAKGNNMQVTLLTVHSQDHLMTAIAFTDLAKEIIDLYRRIDNE

SEQ ID NO: 59909 - DNA, 324 bp, Bacillus cereus ATCC 14579
  CDS (1)..(324)
atgatgactacagcagaacaaattccattccaattgattttaaatagtggtaacgcacgaagctttgcgatggaggcacttcaatttgccaaacaggggaaaatggtagaagcagatgaagcgatggtaaaggcaaaagaagcgattaatgaagcgcatcatttccaaacagagctcatacaatcagaagcaagaggagaaaaaacagaggttagtgttcttttaattcacgcacaagatcatttaatgaatgcgattacagtgaaagaattagcagcagagtttatcgatctttataaaaagcttgaagcgaaaggggaataa

SEQ ID NO: 59910 - protein, 107 aa, Bacillus cereus ATCC 14579
MMTTAEQIPFQLILNSGNARSFAMEALQFAKQGKMVEADEAMVKAKEAINEAHHFQTELIQSEARGEKTEVSVLLIHAQDHLMNAITVKELAAEFIDLYKKLEAKGE

SEQ ID NO: 59911 - DNA, 318 bp, Bacillus cereus ATCC 14579
  CDS (1)..(318)
atggatacgatagagacgaaagcttttcatttaatcttgcatgggggaaacgcgagaagttgttcaatggaagcaattgattgtgcgaagcgtggggagtttacagaagctgaagctaaattacaagaagcactagaggaattaaaagaggcgcaccgtgtacaaacggagcttatccagaaagaagctggtggtgaaaagaccgaagttactcttttaatggtacacgcacaagaccatttaatgaatgcaattacggtgaaagaattagcgagtgagtttgtagagttatataggaagatgtcggtggatgaatga

SEQ ID NO: 59912 - protein, 105 aa, Bacillus cereus ATCC 14579
MDTIETKAFHLILHGGNARSCSMEAIDCAKRGEFTEAEAKLQEALEELKEAHRVQTELIQKEAGGEKTEVTLLMVHAQDHLMNAITVKELASEFVELYRKMSVDE

SEQ ID NO: 59913 - DNA, 360 bp, Photorhabdus luminescens subsp. laumondii TTO1
  CDS (1)..(360)
atggatttagaacaagctattgatttagaaaaaactattgatttagaaaaaactattgtagaactgctggtttatgccggaagcgcacgcagtcatgcactaatggcattacaacatgccagaaacggtgattttcaaacagcacaaacactgatggctgaatctcaacaggcgatcaaagaagcacacacgattcagactaccctcattggattagatgaaggctgcggtaaattacctgtcaatctcatcaccgtccatgcgcaagatcatttaatgaacgcaatggttattcaagatcttgccagcgatatgattgaactctatcgccgaatgtcatcacaagaggaaaaaacatga

SEQ ID NO: 59914 - protein, 119 aa, Photorhabdus luminescens subsp. laumondii TTO1
MDLEQAIDLEKTIDLEKTIVELLVYAGSARSHALMALQHARNGDFQTAQTLMAESQQAIKEAHTIQTTLIGLDEGCGKLPVNLITVHAQDHLMNAMVIQDLASDMIELYRRMSSQEEKT

SEQ ID NO: 59915 - DNA, 327 bp, Lactobacillus johnsonii NCC 533
  CDS (1)..(327)
atggcacaagaaaatagcgataacatgcaagttgtaatgggaattattatgcaagctggtaatgcaaaggctgctgctatgcaagcaatccaagctgctaaaaaaggcgactttgaaaaggctgatgagtttattaagcaagcaaacgaaggcttagtaaatgcccacaatgttcaaactgatatgttaacccaagaagcacaaggtaaccatgtaaaagttgacctttacatggttcatgctcaagaccacttaatgacagctattacttttattgatttagctaaggaagtagtagctgtttacaaaaaaatggctgaaaaataa

SEQ ID NO: 59916 - protein, 108 aa, Lactobacillus johnsonii NCC 533
MAQENSDNMQVVMGIIMQAGNAKAAAMQAIQAAKKGDFEKADEFIKQANEGLVNAHNVQTDMLTQEAQGNHVKVDLYMVHAQDHLMTAITFIDLAKEVVAVYKKMAEK

SEQ ID NO: 59917 - DNA, 321 bp, Bacillus cereus ATCC 10987
  CDS (1)..(321)
atgactgatatgcaaacaccatttgcgttaattttacatggtggcaacgcgagaagcgcgtcacttgaagcaattgcttttgcaagacaaggagattttgagaatgcgagtgaaaagatgacacttgctagggaagaaatttcagcagctcatcgtattcaaacagacttaattcaagaggaagcaagaggaaatcatgcagaaatcagtttactgttagtgcatgcacaagatcatttaatgaatgcaattacagtgaaagaacttgctgaagaatttatcactcttcataaacgaatagaagagaaagtgacagtataa

SEQ ID NO: 59918 - protein, 106 aa, Bacillus cereus ATCC 10987
MTDMQTPFALILHGGNARSASLEAIAFARQGDFENASEKMTLAREEISAAHRIQTDLIQEEARGNHAEISLLLVHAQDHLMNAITVKELAEEFITLHKRIEEKVTV

SEQ ID NO: 59919 - DNA, 351 bp, Listeria monocytogenes str. 4b F2365
  CDS (1)..(351)
atgtcagagcaagactatgttgaagaaacagatagcttaaatgaactatccatgaatatattaatccatgctggaaacgcaagaaatgacctagtgaaaggtcttaaccatttagaggaactagcgtttaacgaagccgaggaatttatcgcctctgccaaaaaagaaattgtcatcgcacatagtctgcaaacagatacacttcaattagaagcatcaggcaatcaaatccgttattccacgctgttctgtcatgcgcaagatacactcatgacagccaaaagtgaaatattaatcggcgagcatatgctacgtttattcaaaaaaatgaccgaacttacgaaaaaatag

SEQ ID NO: 59920 - protein, 116 aa, Listeria monocytogenes str. 4b F2365
MSEQDYVEETDSLNELSMNILIHAGNARNDLVKGLNHLEELAFNEAEEFIASAKKEIVIAHSLQTDTLQLEASGNQIRYSTLFCHAQDTLMTAKSEILIGEHMLRLFKKMTELTKK

SEQ ID NO: 59921 - DNA, 351 bp, Listeria monocytogenes str. 4b F2365
  CDS (1)..(351)
atggaaattcaagtagaagaagctgttgtaaaactcattttgcatggcggaaacacacgaaaagaagcatacaaagcaattgattttgcggaaaagtatcaatttgatgaagccgataaacatttgcaaatcgcacaggatcaattccaagaaggtcatatttggcaaacaaaattagtatccattcgcgactcagaaacggtagctcatccttcctttttacttattcatgggcaggatcacttaatgacggcacaagcggaattgcaacttgccaaaagaatcattaaacaatacaaacatcaacaacgtatcgaagaacgacttactaaacttgaaaatcaagcgtga

SEQ ID NO: 59922 - protein, 116 aa, Listeria monocytogenes str. 4b F2365
MEIQVEEAVVKLILHGGNTRKEAYKAIDFAEKYQFDEADKHLQIAQDQFQEGHIWQTKLVSIRDSETVAHPSFLLIHGQDHLMTAQAELQLAKRIIKQYKHQQRIEERLTKLENQA

SEQ ID NO: 59923 - DNA, 309 bp, Listeria monocytogenes str. 4b F2365
  CDS (1)..(309)
atgaatgaaatggaaacagtaatttttggcatgattagccaagttggttctgcgagaagcagttacttagaagggcttcgtgcggctcgtgaaggcaatttcgaggaagcagaagcaaaactacaagaaggtagcgaaactcttgcaaatgggcaccacgagcatcataagctaatccaaaaagaagcttccggtgaaaaagtggaaatccaattacttttaatccatgcggaagacttactcatcacaaccgaaactttaagagaagttgtcactgagttcgtgcatgtatataaaaaaataagctaa

SEQ ID NO: 59924 - protein, 102 aa, Listeria monocytogenes str. 4b F2365
MNEMETVIFGMISQVGSARSSYLEGLRAAREGNFEEAEAKLQEGSETLANGHHEHHKLIQKEASGEKVEIQLLLIHAEDLLITTETLREVVTEFVHVYKKIS

SEQ ID NO: 59925 - DNA, 309 bp, Listeria monocytogenes str. 4b F2365
  CDS (1)..(309)
atggaaggaatggaactcgcatcatttcaaataattagttctgttggcgccgcaagaagttgcattattgaggcgatgaaattcggaagacaaagaaaattcacagaagcatataaaaaaattgacgaggctaatgaatttcttagcgaaggtcataaaaatcatgtgcaactaattcaaaaagaggcagatggcggagacgtacaaatttctatcctcttcatgcacgcggaagatcaatttatgacaacttatacattacgcgatgtagcttatgagatgattgctatttggaaagagatgaagtaa

SEQ ID NO: 59926 - protein, 102 aa, Listeria monocytogenes str. 4b F2365
MEGMELASFQIISSVGAARSCIIEAMKFGRQRKFTEAYKKIDEANEFLSEGHKNHVQLIQKEADGGDVQISILFMHAEDQFMTTYTLRDVAYEMIAIWKEMK

SEQ ID NO: 59927 - DNA, 321 bp, Bacillus thuringiensis serovar konkukian str. 97-27
  CDS (1)..(321)
atggctgatatgcaaactccatttgcgttaattttacatggtggcaacgcgagaagtgcagcgcttgaagcaattgcttttgcaagacaaggagattttgagaatgcgagtgaaaagatgacacttgctagtgaagaaatttcagcagctcatcgcattcaaacggacttaattcaagaagaagcaagaggaaatcatgcagaaatcagtttactgttagtacatgcacaagatcatttaatgaatgcaattacagtgaaagaacttgcggaagaatttattactcttcataaacgaatggaagagaaagtgatagcataa

SEQ ID NO: 59928 - protein, 106 aa, Bacillus thuringiensis serovar konkukian str. 97-27
MADMQTPFALILHGGNARSAALEAIAFARQGDFENASEKMTLASEEISAAHRIQTDLIQEEARGNHAEISLLLVHAQDHLMNAITVKELAEEFITLHKRMEEKVIA

SEQ ID NO: 59929 - DNA, 309 bp, Erwinia carotovora subsp. atroseptica SCRI1043
  CDS (1)..(309)
atgatgattacattagaagatgcagtaatggaaattatcgtcaatgctgggcagtcacgcagcctgtgttttgaggcactgcacgctgcacgtaaaggcaacattgatgaagccaaaaatctgttgaaagaagccgatggctacgcgcgcaaggcacaccatatgcaaactcagctgatcgaacaggatgcaggtgaagccagacagccgatgacgttaattatggttcatgctcaagatcatttaatgacatcattactcgcccgcgaattatcagaagaaataattcacctttatcaacgacaataa

SEQ ID NO: 59930 - protein, 102 aa, Erwinia carotovora subsp. atroseptica SCRI1043
MMITLEDAVMEIIVNAGQSRSLCFEALHAARKGNIDEAKNLLKEADGYARKAHHMQTQLIEQDAGEARQPMTLIMVHAQDHLMTSLLARELSEEIIHLYQRQ

SEQ ID NO: 59931 - DNA, 324 bp, Erwinia carotovora subsp. atroseptica SCRI1043
  CDS (1)..(324)
atggatgtagaaacgcggatgattgagcttatcgttaaatctggcgaaacacgttcctgcgcaatggaagcacttagagcagctcgccggggcgagtgggatcacgtcgatgaactattaaaaatggctgcggtggcgctgaatcgggcgcaattgatccagaccggatttattggctatcagagtaaggaaaaaaccaatctcgaacttattgtggtgcatgcacaggatcatctgatgaatgcgatgctgtgccgtgaactggctgaagagattattgaactcaggaaagatgtatctggcgtcaatatgcacatgcgctaa

SEQ ID NO: 59932 - protein, 107 aa, Erwinia carotovora subsp. atroseptica SCRI1043
MDVETRMIELIVKSGETRSCAMEALRAARRGEWDHVDELLKMAAVALNRAQLIQTGFIGYQSKEKTNLELIVVHAQDHLMNAMLCRELAEEIIELRKDVSGVNMHMR

SEQ ID NO: 59933 - DNA, 345 bp, Erwinia carotovora subsp. atroseptica SCRI1043
  CDS (1)..(345)
atgaaagacacagagaacctccctgaattcgatatggaacaaaccgtgatggagttgctgatcaacgcgggtgaagcccgctcaaacgccatgatggcaattcaggccgcgcgtcagcgagagtggcaacaggccgacgcgctgcttgccgcgtcacaagagacggcgcgtgccgctcaccgcgttcaaacacggctaatcggtttggatgaaggagaaggaaaggtgcccgtcaacctgatcatggtacatgcgcaggatcatctgatgaccgccatgctatgccgggatttggcggaagagattgtcttgttacggcgagaaatggctacatcacaaaactga

SEQ ID NO: 59934 - protein, 114 aa, Erwinia carotovora subsp. atroseptica SCRI1043
MKDTENLPEFDMEQTVMELLINAGEARSNAMMAIQAARQREWQQADALLAASQETARAAHRVQTRLIGLDEGEGKVPVNLIMVHAQDHLMTAMLCRDLAEEIVLLRREMATSQN

SEQ ID NO: 59935 - DNA, 348 bp, Erwinia carotovora subsp. atroseptica SCRI1043
  CDS (1)..(348)
atgctcgatgaaaccattcttgatgaaactacagtgatggaactaattatttatgcgggagaggcgcgctcaagctcgatggaagcactgagcgctgccagaaaatacgactgggacaaggccgaggaactgctgaatgcggcttctgtggcggcgcgcaaagcccatcaaattcagacggccttgatcggtgccgatgagggtagcggaaaaatccaggtcaacttgattctggttcacgcgcaagatcacctgatgaacgcgatgttatgccgtgaactggttgaggaactgattcaactgcatcgggaaatatcctccctgaaacaacatgtaaacctgaaatga

SEQ ID NO: 59936 - protein, 115 aa, Erwinia carotovora subsp. atroseptica SCRI1043
MLDETILDETTVMELIIYAGEARSSSMEALSAARKYDWDKAEELLNAASVAARKAHQIQTALIGADEGSGKIQVNLILVHAQDHLMNAMLCRELVEELIQLHREISSLKQHVNLK

SEQ ID NO: 59937 - DNA, 321 bp, Propionibacterium acnes KPA171202
  CDS (1)..(321)
atgccagagatcgaaaccgccatttttaccatcatcacgagcgctggtgaggcgcgtgcgtcgctgtatcaggctcttgacaaagcacgggctggcgagatggctgagagtgaacagtgcatgattagggcggacacacagttgaagaaagcccatgatatgcagaccgagctcatcacgcgtgatctcaacggctcgctgccgatgtcgcttttactcgtccatgcccaagaccagttgatgacgacgatgtcagaacagtctctcattgagcacatgattggactaattcgagacataggtatcaacggtgggaagtga

SEQ ID NO: 59938 - protein, 106 aa, Propionibacterium acnes KPA171202
MPEIETAIFTIITSAGEARASLYQALDKARAGEMAESEQCMIRADTQLKKAHDMQTELITRDLNGSLPMSLLLVHAQDQLMTTMSEQSLIEHMIGLIRDIGINGGK

SEQ ID NO: 59939 - DNA, 348 bp, Borrelia garinii PBi
  CDS (1)..(348)
atgaataaaaaaatatacagcatagaagaattaatagataaaataagcatgcctgttgtagcttatgctggtgaagctaaaagctttctaagagaagctttggaatacgctaaaaacaaagactatgaaaaagcagatcttagcatacaagaaagtagaaactctattgcaaaggcgcatgaagcacatagggaaataatacagcaatcagccactaatccaagctctgttaaaccgccttttattttaattcatgccgaagatcatttaatgtctgcaatttcagaattaagcatttttgaagaattaatcaatgtttacaaaataataaatgaaataaaaaaatag

SEQ ID NO: 59940 - protein, 115 aa, Borrelia garinii PBi
MNKKIYSIEELIDKISMPVVAYAGEAKSFLREALEYAKNKDYEKADLSIQESRNSIAKAHEAHREIIQQSATNPSSVKPPFILIHAEDHLMSAISELSIFEELINVYKIINEIKK

SEQ ID NO: 59941 - DNA, 348 bp, Symbiobacterium thermophilum IAM 14863
  CDS (1)..(348)
atggagaacctggaacagctcaacctcattgcgatgcgcatcatcctcgacgccggcgacgcccgggacttcgtcaccaaggccttcgaggccatggggcagcgggacttcgagtctgcggacgagcacctgcgtgcggctttcgagaagctgaagtcggctcaccgtcagcagacggaggtcatccagcacgaagtggctgccgggtcgttgccgccgtcactgctgtttaaccatgctcaggacacgttgatggtggtcggttcggaactgaacctcgcgcgcagtctgctggccatcttcatcaacatcgaccggcggctggcgcagctggaggcaggccgatga

SEQ ID NO: 59942 - protein, 115 aa, Symbiobacterium thermophilum IAM 14863
MENLEQLNLIAMRIILDAGDARDFVTKAFEAMGQRDFESADEHLRAAFEKLKSAHRQQTEVIQHEVAAGSLPPSLLFNHAQDTLMVVGSELNLARSLLAIFINIDRRLAQLEAGR

SEQ ID NO: 59943 - DNA, 342 bp, Bacillus licheniformis ATCC 14580
  CDS (1)..(342)
ttgacgataatggaaaaattaaagctcgatgaattaacaggcgaacaaatttgctttcagctcattcttcacagcggaaacgcccgcagcaaggttattcagtccatcagggaataccgcgccggcagcgttcagaaagcagaggagctgctacaacaggcagaagacgatttgcagcagtcccacgatattcattttcaaatgatccaaaaagaagcgggcgggggaaaaaatgagttctctttgctgctcttgcatgccgaggaccatttgatgtcgacgctcacgatgaaggaactcgtttctgaattattggaattgttcaaagagaaaagtctatga

SEQ ID NO: 59944 - protein, 113 aa, Bacillus licheniformis ATCC 14580
MTIMEKLKLDELTGEQICFQLILHSGNARSKVIQSIREYRAGSVQKAEELLQQAEDDLQQSHDIHFQMIQKEAGGGKNEFSLLLLHAEDHLMSTLTMKELVSELLELFKEKSL

SEQ ID NO: 59945 - DNA, 324 bp, Bacillus cereus ZK
  CDS (1)..(324)
atgatgactacagcagaacaaattccattccaattgattttaaatagtggtaatgcacgaagctttgcaatggaggcacttcaatttgccaaacaggggaaaatggcagaggctgatgaagcgatggtaaaggcgaaagaagcgatcaatgaagcgcatcatttccaaacagagctcatacaatcagaagcaagaggagaaaaaacagagattagtgttcttttaattcacgcacaagatcatttaatgaatgcgattacagtaaaagaattagcagcagagtttattgatctttataaaaaattagaagtgaaaggggaataa

SEQ ID NO: 59946 - protein, 107 aa, Bacillus cereus ZK
MMTTAEQIPFQLILNSGNARSFAMEALQFAKQGKMAEADEAMVKAKEAINEAHHFQTELIQSEARGEKTEISVLLIHAQDHLMNAITVKELAAEFIDLYKKLEVKGE

SEQ ID NO: 59947 - DNA, 333 bp, Bacillus licheniformis ATCC 14580
  CDS (1)..(333)
atggcagatacacttcaattggaacaggtctcatttgaaatcatccttcacgccggaaatgcgcgttcttctgcaatggaagcgttgcagcttgtgaaacatcacgaatgcgaaaccggttatcaaaagatacaagaagcagaatcggagctgaaccaagcgcatcaggcacaaacccgcctcctgcaaaaagaagcacagggcgcaggcctttcacccaatctattattaatccatgctcaggaccatttaatgacagccataactgtaaaagatttggcgaaagaaatgattgatttatatcaagagcttgggaaaggaagagaaaaatga

SEQ ID NO: 59948 - protein, 110 aa, Bacillus licheniformis ATCC 14580
MADTLQLEQVSFEIILHAGNARSSAMEALQLVKHHECETGYQKIQEAESELNQAHQAQTRLLQKEAQGAGLSPNLLLIHAQDHLMTAITVKDLAKEMIDLYQELGKGREK

SEQ ID NO: 59949 - DNA, 330 bp, Bacillus licheniformis ATCC 14580
  CDS (1)..(330)
atgtccgaggaattggaacaaacgatatttcaaattatccttcacggaggaaacggcaggagcttttgcatggaagcgatagccgaagccaaaaagggagatttcgcagctgcaaaagaaaagatccgggcggctgacgaagaactgatcagggcgcatcactttcagacagctttgattcaaaatgaagcgaagggtgcgaaaaccgaaccttcactgctcatgattcatgcccaggatcatttaatgaatgcgatgaccatgaaagatttggccgcggagattgtcgagctctatgaaaaaatgaatatccacggaggtgtcaattga

SEQ ID NO: 59950 - protein, 109 aa, Bacillus licheniformis ATCC 14580
MSEELEQTIFQIILHGGNGRSFCMEAIAEAKKGDFAAAKEKIRAADEELIRAHHFQTALIQNEAKGAKTEPSLLMIHAQDHLMNAMTMKDLAAEIVELYEKMNIHGGVN

SEQ ID NO: 59951 - DNA, 339 bp, Photobacterium profundum SS9
  CDS (1)..(339)
atgactttcgaaattaatactcaagaagatattactgaagaatttttaatgacactactttgcaaagcaggtgaagcacgttcagcggttatgcaagcgatgagtgaggctcgtaatggtgagtttgagcgttctgaagcaatgttagtcgctgccgaagaagcacttaccgaagtacacaaaacgcaaacaggcttaattggtttcgatgaaggtgaaggtaaggtcacgatgactcttattcttactcacattcaggatcacattatgacagctatgttatgccgcgatatggcaaatgagatcattgctattcaccgtcagctaaacaacgcatag

SEQ ID NO: 59952 - protein, 112 aa, Photobacterium profundum SS9
MTFEINTQEDITEEFLMTLLCKAGEARSAVMQAMSEARNGEFERSEAMLVAAEEALTEVHKTQTGLIGFDEGEGKVTMTLILTHIQDHIMTAMLCRDMANEIIAIHRQLNNA

SEQ ID NO: 59953 - DNA, 312 bp, Photobacterium profundum SS9
  CDS (1)..(312)
atggatttagaagaacaagtcatgggtattattattaatgccggtcaatcacgcagcttatgttatgaagccctacgacatgctaaaaaagctgaatttactgaagctgaaggtttgttaaaagaagctcaagaatttgcaaatcaagctcaccttgttcaaacccagctaattgaagcggatgaaggtgaagggaaaacgaagatgacgttaatcatggttcatgcacaagatcatttaatgacctcaatgctggcgaaagaacttgtgattgaaatcattgagttgcatcgtcgtattgctgtcgaataa

SEQ ID NO: 59954 - protein, 103 aa, Photobacterium profundum SS9
MDLEEQVMGIIINAGQSRSLCYEALRHAKKAEFTEAEGLLKEAQEFANQAHLVQTQLIEADEGEGKTKMTLIMVHAQDHLMTSMLAKELVIEIIELHRRIAVE

SEQ ID NO: 59955 - DNA, 333 bp, Geobacillus kaustophilus HTA426
  CDS (1)..(333)
atggaaaaaatcgatgtcaatcaactcaccaatgaacaagtcgctttccagttgattttgcatagcggcaatgcccgcagcaaaatcgtccaagccatccgtgaataccggaccggacaggtcggagaagcggagcggctgattcaagaagcagagcaagacttaagcatcgcccatgatgtccatttccaacttattcaaaaagaggccagcggcgagcaaacaaatattacgttgcttctcatgcatgccgaagatcacgtcatgtcgacgctggcgatgaaagaagttgtcaaagaaatgctcgcactgttgaaggaacgaaacgtataa

SEQ ID NO: 59956 - protein, 110 aa, Geobacillus kaustophilus HTA426
MEKIDVNQLTNEQVAFQLILHSGNARSKIVQAIREYRTGQVGEAERLIQEAEQDLSIAHDVHFQLIQKEASGEQTNITLLLMHAEDHVMSTLAMKEVVKEMLALLKERNV

SEQ ID NO: 59957 - DNA, 336 bp, Bacillus clausii KSM-K16
  CDS (1)..(336)
gtgagaaaagtggagaaatcgacggatataacagaggtttccttccgtatcattttgcacgctggaaatgggaaaggaagcgcgatggaagcaattcaagcggcaaaagcaggctcatttgaacaagcggacgagttaatagaagaggcaggaagagagctggccaaagcccatgaatttcagacaaatttaatccagcaagaagcaaatggagggcggacagagttaaacgtgctgctgatccattcccaagaccacttgatgacgtcgatgaccgtacgtgatttagcaattgaaatcattgaaatataccgtacgaaaaggggacttttataa

SEQ ID NO: 59958 - protein, 111 aa, Bacillus clausii KSM-K16
MRKVEKSTDITEVSFRIILHAGNGKGSAMEAIQAAKAGSFEQADELIEEAGRELAKAHEFQTNLIQQEANGGRTELNVLLIHSQDHLMTSMTVRDLAIEIIEIYRTKRGLL

SEQ ID NO: 59959 - DNA, 357 bp, Lactobacillus gasseri
  CDS (1)..(357)
atggatgcagaaaagcaaattactaaagaagaaatttcaatgactggtttttcaattgtcgcttattcaggagatgcaagaacttacttgatgcaggcaatggataaggcaagtgaagggaaaatcactgaagcaaaggaacttgttaagaaagcagaagaatcaattaacttagctcataatgaacagactaagctcttgagtaaagaagctggaggagatgatatggatgtaaccttcattatggtccatggacaagatacattgatgaccacaatgcttttaaaggatcagatgaagacaattattaacctttatgaacgagtaaataagctcgaaggaaatagtattgaataa

SEQ ID NO: 59960 - protein, 118 aa, Lactobacillus gasseri
MDAEKQITKEEISMTGFSIVAYSGDARTYLMQAMDKASEGKITEAKELVKKAEESINLAHNEQTKLLSKEAGGDDMDVTFIMVHGQDTLMTTMLLKDQMKTIINLYERVNKLEGNSIE

SEQ ID NO: 59961 - DNA, 360 bp, Lactobacillus gasseri
  CDS (1)..(360)
atggttagtaaagaagaaatttcgatggttggatttacaattgttgcttatgctggagatgccaaaacagacttgttaaatgctcttaaattagcacgtgaagggaagtttgaagaagctgaaaaactgatcgaagaagcaaataattcattagttgatgcgcataatgcacagactaagttaatgagtcaagaagctagtggtgaagaattagaaacaacttttattatgtctcatggacaagatacattaatgactacaatgcttttacgtgatgaagtgaaatattttattgatttgtataagcaaaatttagctttgcgagctgaaattgagcagcttaaagaaaaaatgaactaa

SEQ ID NO: 59962 - protein, 119 aa, Lactobacillus gasseri
MVSKEEISMVGFTIVAYAGDAKTDLLNALKLAREGKFEEAEKLIEEANNSLVDAHNAQTKLMSQEASGEELETTFIMSHGQDTLMTTMLLRDEVKYFIDLYKQNLALRAEIEQLKEKMN

SEQ ID NO: 59963 - DNA, 336 bp, Leuconostoc mesenteroides subsp. mesenteroides ATCC 8293
  CDS (1)..(336)
atggatatgaacagcaaatatgatttaacaaatgatgccatgcaaatcattgtatgggctggagatgctagacagttgattatgacagcactagaaaaaatcgcgcagcatcaattttctaaaacacgatctttattagatgaagccgaatcactattaaataatgcgcacaaaatacaaagtcgttatatgagcttagaagcgtcgggtacacatattccatattctgttttatttaatcatgcgcaagattctttgatgattacaatgagcgagttaaacatcgccaaaaaaatgtcaattattatgaaaagtgaagtgaaaaatcatgagtaa

SEQ ID NO: 59964 - protein, 111 aa, Leuconostoc mesenteroides subsp. mesenteroides ATCC 8293
MDMNSKYDLTNDAMQIIVWAGDARQLIMTALEKIAQHQFSKTRSLLDEAESLLNNAHKIQSRYMSLEASGTHIPYSVLFNHAQDSLMITMSELNIAKKMSIIMKSEVKNHE

SEQ ID NO: 59965 - DNA, 360 bp, Leuconostoc mesenteroides subsp. mesenteroides ATCC 8293
  CDS (1)..(360)
atgaaatcagaagacattcaagttgtcgcttttgaaattattttacacagtggaaatgcgcgcacaatggttcataaggcttttgaagccatgagagaaaaaaactttaagttatctaacgaaaatctaaaattatcaaatgacgaattactattagctcataaatcgcaaacaaacttgttacaagaatacgctgagggtagtcatattgatatggaaattatattagtccatgcacaagaccacttaatgacaacgatgactttacgtgagatggctattgaaatgcagactctttatgaggaggtacaagacattgaaaaaaggaatcaaacgagggccaaaaaagccacaggataa

SEQ ID NO: 59966 - protein, 119 aa, Leuconostoc mesenteroides subsp. mesenteroides ATCC 8293
MKSEDIQVVAFEIILHSGNARTMVHKAFEAMREKNFKLSNENLKLSNDELLLAHKSQTNLLQEYAEGSHIDMEIILVHAQDHLMTTMTLREMAIEMQTLYEEVQDIEKRNQTRAKKATG

SEQ ID NO: 59967 - DNA, 309 bp, Haemophilus somnus 2336
  CDS (1)..(309)
atgagtgagcaacttgaaatgcaattgatgaatttaattcttcaagcgggaatatgtcgtagtgctttaatggaagcactacaacatgctaaaaaacagcagtttgaggaagtagatagattacttaaacaggcggatgatgctttgttagcagcacatcacgctcaaacagaactcatcggacaggatgaaggtgaggggaaactacccgtcactattattatggtgcatgcacaagatcatgtaatgaatgctgttttgttaatggacatcatcaaagaatttattgagctatatcgaaaaaaataa

SEQ ID NO: 59968 - protein, 102 aa, Haemophilus somnus 2336
MSEQLEMQLMNLILQAGICRSALMEALQHAKKQQFEEVDRLLKQADDALLAAHHAQTELIGQDEGEGKLPVTIIMVHAQDHVMNAVLLMDIIKEFIELYRKK

SEQ ID NO: 59969 - DNA, 315 bp, Listeria monocytogenes str. 1/2a F6854
  CDS (1)..(315)
ttggataacaaaaatttagaagccattatggggctaatcatgcacggcggaaatgctaaaagtaatgctatggaagcaattcaagctgcgaaaaatggtgcgtttgaattagcagaagaaaaaatcagtgaagcagagcaatcaattgtggaagcacatcattcccaaacaggattactaacagaagaagcaaaaggaaatcatatggaagtaacacttcttactgtacacagccaagatcacttaatgacagccatgacatttacagatttagcgaaagagcttatcgatgtttacagaaagctgttaaaataa

SEQ ID NO: 59970 - protein, 104 aa, Listeria monocytogenes str. 1/2a F6854
MDNKNLEAIMGLIMHGGNAKSNAMEAIQAAKNGAFELAEEKISEAEQSIVEAHHSQTGLLTEEAKGNHMEVTLLTVHSQDHLMTAMTFTDLAKELIDVYRKLLK

SEQ ID NO: 59971 - DNA, 321 bp, Bacillus cereus G9241
  CDS (1)..(321)
atgactgatatgcaaactccatttgcgttaattttacatggtggcaacgcgagaagcgcggcacttgaagcaattgcttttgcaagacaaagagattttgagagtgcgagtgaaaagatgacacttgctagtgaagaaatttcagcagctcatcgtattcaaacggacttaattcaagaagaagcaagaggaaatcatgcagaaataagtttactgttagtgcatgcacaagatcatttaatgaatgcaattacagtgaaagaacttgcggaagaatttattactcttcataaacgagtagaagagaaagtgacagtataa

SEQ ID NO: 59972 - protein, 106 aa, Bacillus cereus G9241
MTDMQTPFALILHGGNARSAALEAIAFARQRDFESASEKMTLASEEISAAHRIQTDLIQEEARGNHAEISLLLVHAQDHLMNAITVKELAEEFITLHKRVEEKVTV

SEQ ID NO: 59973 - DNA, 324 bp, Bacillus cereus G9241
  CDS (1)..(324)
atgatgactacagcagaacaaattccattccaattaattttaaatagtggtaatgcacgaagctttgcgatggaggcacttcaatttgctaaacaggggaaaatggcagaagcggatgaagcgatggtaaaggcgaaagaagcgattaatgaagcgcatcatttccaaacagagctcatacaatcagaagcaagaggagaaaaaacagaggttagtgttcttttaatccacgcacaagatcatttaatgaatgcgattacagtaaaagaattagcagcagagtttattgacctttataaaaagttagaagcgaaaggggaataa

SEQ ID NO: 59974 - protein, 107 aa, Bacillus cereus G9241
MMTTAEQIPFQLILNSGNARSFAMEALQFAKQGKMAEADEAMVKAKEAINEAHHFQTELIQSEARGEKTEVSVLLIHAQDHLMNAITVKELAAEFIDLYKKLEAKGE

SEQ ID NO: 59975 - DNA, 333 bp, Enterococcus faecium
  CDS (1)..(333)
atggaggaagaaaagatgaataaagaggaattacaaatgcttggttttgagatcgttgcatattcaggcgacgctcgcagtacattattgaaattattgaaagaagtaagacaaggaaactttgaacatgttgattcggcgttgaaagaagccgacgaaaatttaacccttgcacataattcgcaaacaaaaattttagcggaagaagcatctgggaaagagatggagatgggattcatttttatccatgggcaggatcatttaatgaccactttattgctgagagatctgattcaagactttattgtactgtacagacagaatcaaggatag

SEQ ID NO: 59976 - protein, 110 aa, Enterococcus faecium
MEEEKMNKEELQMLGFEIVAYSGDARSTLLKLLKEVRQGNFEHVDSALKEADENLTLAHNSQTKILAEEASGKEMEMGFIFIHGQDHLMTTLLLRDLIQDFIVLYRQNQG

SEQ ID NO: 59977 - DNA, 318 bp, Enterococcus faecium
  CDS (1)..(318)
atggaagatcaaaaaaatctagaagccatcatgggtctgatcatgtttggcggaaatgcaaaaagcgatgcaatggaagcgattgctgctgcgaaaaaaggtgatttcactttagcagatgaaaaaatcaaagatgcagaggaatctttagtccaagcacatcactctcaaacagagatgctgacacaagaagcacaaggaaatcacgttgaagtcacgcttttgacggtccacagtcaagatcatctgatgacatctatagcttttacagatttagcaaaagagatcattgatctgtatcgtcgattgaacgcgtaa

SEQ ID NO: 59978 - protein, 105 aa, Enterococcus faecium
MEDQKNLEAIMGLIMFGGNAKSDAMEAIAAAKKGDFTLADEKIKDAEESLVQAHHSQTEMLTQEAQGNHVEVTLLTVHSQDHLMTSIAFTDLAKEIIDLYRRLNA

SEQ ID NO: 59979 - DNA, 441 bp, Enterococcus faecium
  CDS (121)..(441)
aggtattccattagatgtcatcaatatgcaagactatggcatgatgaacggagaaaaagttcttgcacaagcagaaaatctaatgaaataaatcaagtatgcagttgggggtataacaacatggaagatcaacaaaatctagaagccatcatggggttaatcatgtttggcggtaatgcaaagagcgatgcaatggaagcgattgcggctgctaaaatcggtgattttgagttagcggataggaaaatcgctgatgcagaagaatcacttatacaagcgcatcatgcacaaacagacatgttgacacaagaagcacaaggaaatcatatgcaagtgacattattgactgttcacagtcaagatcacttaatgacatctattgcgtttactgatttagcaaaagaaatcatcgaactttatcgtcgcgtatacagcgaataa

SEQ ID NO: 59980 - protein, 106 aa, Enterococcus faecium
MEDQQNLEAIMGLIMFGGNAKSDAMEAIAAAKIGDFELADRKIADAEESLIQAHHAQTDMLTQEAQGNHMQVTLLTVHSQDHLMTSIAFTDLAKEIIELYRRVYSE

SEQ ID NO: 59981 - DNA, 327 bp, Enterococcus faecium
  CDS (1)..(327)
atggctgaaaaaataaacagtgaaacactacaagtgacttcttttgatatcattttccatagcggaaatgcacggacactgatacatgaagcatttcgctcgatgcgtaaagagatgtttgaagaagtagaagagaagttgcgacaagcaaatgaagagattcttcatgcgcatcagtcacaaactcaacttctgaaagaatatgccagcgggacaaaaatagaaatggaaattatcatggtccatgcacaagatcatctgatgacgacgatgacattattggaagttgcacaggaaatgaattatttgtatcaaaaaaataaatag

SEQ ID NO: 59982 - protein, 108 aa, Enterococcus faecium
MAEKINSETLQVTSFDIIFHSGNARTLIHEAFRSMRKEMFEEVEEKLRQANEEILHAHQSQTQLLKEYASGTKIEMEIIMVHAQDHLMTTMTLLEVAQEMNYLYQKNK

SEQ ID NO: 59983 - DNA, 312 bp, Enterococcus faecium
  CDS (1)..(312)
atgacaatgacaacggatgaaatatctttcgccttgatttctaaggctggtacagctttttcaatgatgatcgaggcattgggagatgcccgcgaaaaggattttgaaaaagcagaagaaaagaaacaagaagccgaggctttgatgaatgaagcccataatttacaaacgagtttgatcgtaaatgaagtcaatggcgatgataatcaaatcaatgccttattgattcacgcccaagacacattaatgaatacaatcttgatgtcgacgattgtcgatgaatttcttaatttatataaggcaggagaataa

SEQ ID NO: 59984 - protein, 103 aa, Enterococcus faecium
MTMTTDEISFALISKAGTAFSMMIEALGDAREKDFEKAEEKKQEAEALMNEAHNLQTSLIVNEVNGDDNQINALLIHAQDTLMNTILMSTIVDEFLNLYKAGE

SEQ ID NO: 59985 - DNA, 336 bp, Oenococcus oeni PSU-1
  CDS (1)..(336)
atggcagaagaacaacatgatgaacaactacaaacagttatgggactaattattaacggaggaaatgctaagagttcatcttttgaagctatcaatgctgctaaaaaaggtcactttacagttgctgaccaaaaattgaaggaagctgacaagttcttagttgacgctcacaattctcaaacagatatgctaactaaagaagctaatggtgatcacgctaaagttactttgctaatggtacattcacaagatcatattatgaatgctattacatttagagacttagccggagaaattgttgatctatataagaaacttgctaaagaaggagaataa

SEQ ID NO: 59986 - protein, 111 aa, Oenococcus oeni PSU-1
MAEEQHDEQLQTVMGLIINGGNAKSSSFEAINAAKKGHFTVADQKLKEADKFLVDAHNSQTDMLTKEANGDHAKVTLLMVHSQDHIMNAITFRDLAGEIVDLYKKLAKEGE

SEQ ID NO: 59987 - DNA, 324 bp, Oenococcus oeni PSU-1
  CDS (1)..(324)
atgagtgaagagattgaaaaccaaaaggtcatcatgagcctgatcatcgccggcggcaatgccaaaggagcatccttcttagccattaaggccgcaaaagaaaaagacttcaaagaagccgaactaaaactaacagaagccgatcgttttctagcccaggcccataacgcccagactgatatgttgactaaagaagcaaacggagaacacgcccaaatgtgtctgttaatggtccatgcccaggaccatgtcatgaccgcgattacctttcgtgatctggccggtgagatagttgagctgtataaaaggatcgaggataaatga

SEQ ID NO: 59988 - protein, 107 aa, Oenococcus oeni PSU-1
MSEEIENQKVIMSLIIAGGNAKGASFLAIKAAKEKDFKEAELKLTEADRFLAQAHNAQTDMLTKEANGEHAQMCLLMVHAQDHVMTAITFRDLAGEIVELYKRIEDK

SEQ ID NO: 59989 - DNA, 351 bp, Pediococcus pentosaceus ATCC 25745
  CDS (1)..(351)
atgatagataaagagagtagctctacagtagccgtaaaagaaaccatggaaattattattaatgcaggtgatgcacgtgattttatatttaaagctttagatgaagttgcaaatagtaactatcaaaaagcaagagaattgataaaaaaggctaatgaaaagttggtagtagcacataggatccaaacaaaaaaactacaagaagaggctgagggagatgatgtgacgtattcagtattatttacccatgcccaagacacagtaatgacgattatgagtgaatataatcttgctaaacgattaatcaatatttttgaaaaaaaagaagagaaatttagggggagtaaataa

SEQ ID NO: 59990 - protein, 116 aa, Pediococcus pentosaceus ATCC 25745
MIDKESSSTVAVKETMEIIINAGDARDFIFKALDEVANSNYQKARELIKKANEKLVVAHRIQTKKLQEEAEGDDVTYSVLFTHAQDTVMTIMSEYNLAKRLINIFEKKEEKFRGSK

SEQ ID NO: 59991 - DNA, 324 bp, Pediococcus pentosaceus ATCC 25745
  CDS (1)..(324)
atgggcgaacaagaacaaaatctagaagtgatcatgggactaattattaatggtgggaacgcaaagagctctgcatttgaagctatcaacgctgctaaagcaggagactttgaaaaagcagatgaaaaattaaaagaatctgatggttttttgactgaagctcataacgtccaaaccgggatgttaactgaagaagctaagggaaaccatgctaaagtttcactgctaacggttcattcacaagaccacatcatgaatgccattacttttagagatttagctggagaaattgttgatttatataaaaaaatggccgaaaaataa

SEQ ID NO: 59992 - protein, 107 aa, Pediococcus pentosaceus ATCC 25745
MGEQEQNLEVIMGLIINGGNAKSSAFEAINAAKAGDFEKADEKLKESDGFLTEAHNVQTGMLTEEAKGNHAKVSLLTVHSQDHIMNAITFRDLAGEIVDLYKKMAEK

SEQ ID NO: 59993 - DNA, 315 bp, Streptococcus suis 89/1591
  CDS (1)..(315)
atgaattctccagagtatcttgaagcgattatggggttaatcatgtacggtggtgaagcaaagggcttcgctagccaggcgattcaagcagccaaagaaggtcgtattgacgaagcggaacagctgctccaagacgcaatagcttcattgaatattgcccataaatcgcaaacacaattattagcaaaagaagcaagtggagagtctgttgaattatctttgttaatggtacatggacaagatcacttgatgaatgctttgacatttattgatttagcgaaagagttcgtagatctttataaacagattggataa

SEQ ID NO: 59994 - protein, 104 aa, Streptococcus suis 89/1591
MNSPEYLEAIMGLIMYGGEAKGFASQAIQAAKEGRIDEAEQLLQDAIASLNIAHKSQTQLLAKEASGESVELSLLMVHGQDHLMNALTFIDLAKEFVDLYKQIG

SEQ ID NO: 59995 - DNA, 315 bp, Streptococcus suis 89/1591
  CDS (1)..(315)
atgaatacagaagaattacaaatggctgcatttgggatcatcctcagtagtggcaatgcaagaagtgttatccacgaagcttttgctgctatgagagaaggtgattatgataaggcagaagagttattggaagccgccaatgctgacatgcttgaagcccaccattctcaaacgggtctcctacaggaatacgcaagcggtactgaagtgaaggtagagattattatggttcatgcgcaagatcatttgatgacaacaatgactttacgtgaggtagcgcttgaaatgttagctttgtatcgtaaagttggttag

SEQ ID NO: 59996 - protein, 104 aa, Streptococcus suis 89/1591
MNTEELQMAAFGIILSSGNARSVIHEAFAAMREGDYDKAEELLEAANADMLEAHHSQTGLLQEYASGTEVKVEIIMVHAQDHLMTTMTLREVALEMLALYRKVG

SEQ ID NO: 59997 - DNA, 324 bp, Streptococcus suis 89/1591
  CDS (1)..(324)
atggaaatgattgttgcagatcaattgatcatgggattgattatttatgctggagatgcgaaaagtcacgcctaccaagctttgtcgcttgtcaaagcaggtgaagaagagcgagcagaagaggaattagaattggcagatgcagcattattagaagctcacaatatgcagacaaaattcttagcacaagaagctgggggaacaaaatctgatattacagcactatttgtccattcgcaagatcatttgatgacatctattacagagatcaatttgattaaagaaatcattgatttgcggaaagaactaaaaaaagttggctaa

SEQ ID NO: 59998 - protein, 107 aa, Streptococcus suis 89/1591
MEMIVADQLIMGLIIYAGDAKSHAYQALSLVKAGEEERAEEELELADAALLEAHNMQTKFLAQEAGGTKSDITALFVHSQDHLMTSITEINLIKEIIDLRKELKKVG

SEQ ID NO: 59999 - DNA, 318 bp, Streptococcus suis 89/1591
  CDS (1)..(318)
atgaacagagaagaaattactttattaggttttgagattgttgcattcgctggtgatgctcgctctcgtttgatggaggcactggctgctgctcaaaaaggtgattacgcaaaagcagaagaactagttgaagctgccaatgcttgtattgttgaagcccaccatgctcagacaagtttgttgcagaaagaagcggctggtgaggatttagcctttagtgtgacgctcatgcatggtcaagaccatctcatgacgacattattattgaaagatatgatgggtcatatgattgaactttacaaacgaggtgataagtaa

SEQ ID NO: 60000 - protein, 105 aa, Streptococcus suis 89/1591
MNREEITLLGFEIVAFAGDARSRLMEALAAAQKGDYAKAEELVEAANACIVEAHHAQTSLLQKEAAGEDLAFSVTLMHGQDHLMTTLLLKDMMGHMIELYKRGDK

SEQ ID NO: 60001 - DNA, 336 bp, Streptococcus pyogenes M49 591
  CDS (1)..(336)
atgacggaaccatccaacttagaagctattatgggcttaatcatgtatggaggcgaagccaagggcaaggccgtagaggctattcatgcagcacgagatgggcagtttgaggaggctcagcacttacttcaagaagcgacaaactcgttaaatattgcccataaatcgcagacacatttgctctcccaagaagcagctggtgatgcgattgaattgtctttattgatggtgcatgggcaagatcacatgatgactgccttagcctttattgatttagccaaggaattggttaccgtttacgacaaaatgtcagcaatacagaggggcgagtcatga

SEQ ID NO: 60002 - protein, 111 aa, Streptococcus pyogenes M49 591
MTEPSNLEAIMGLIMYGGEAKGKAVEAIHAARDGQFEEAQHLLQEATNSLNIAHKSQTHLLSQEAAGDAIELSLLMVHGQDHMMTALAFIDLAKELVTVYDKMSAIQRGES

SEQ ID NO: 60003 - DNA, 327 bp, Pectobacterium carotovorum
  CDS (1)..(327): transl_table=11
atgctcgatgaaaccacgataatggaattgattatttatgcgggagaggcgcgctccagctcaatggaggcgctgagcgccgccagaaaatatgactgggacaaggctgaagaactgctgaacgcggcttctgtggcggcgcgcaaagcccatcaaatccagactgctttgattggtgccgatgagggcagcggaaaaatcccgatcaatctgattttggttcacgcgcaagatcacctgatgaacgcgatgctatgccgtgaactggtggaggagctgattcaactgcatcgggaaatctcctccctgaaacagcttataaattaa

SEQ ID NO: 60004 - protein, 108 aa, Pectobacterium carotovorum
MLDETTIMELIIYAGEARSSSMEALSAARKYDWDKAEELLNAASVAARKAHQIQTALIGADEGSGKIPINLILVHAQDHLMNAMLCRELVEELIQLHREISSLKQLIN

SEQ ID NO: 60005 - DNA, 333 bp, Bacillus pumilus
  CDS (1)..(333): transl_table=11
atggaaaagaaaacactcgaagggctcacggaggaacaagtgagctttcaattgatcttacacagcgggaatgcacgcagcaaattgcttcaggctctaaaacaatatcgagaaggtctagaagaagaagcttttgatcttatgaaagaagcggaagaagatttacggcttgcacatgacatccattttcaactcgtgcagaaagaggcaggcggagaaagggcatccttttccttactgctcatgcacgctgaagatcacttaatgtcgaccattaccatcaaggagcttgtgggagagctcctgccgatattccaatcgcttaaacaataa

SEQ ID NO: 60006 - protein, 110 aa, Bacillus pumilus
MEKKTLEGLTEEQVSFQLILHSGNARSKLLQALKQYREGLEEEAFDLMKEAEEDLRLAHDIHFQLVQKEAGGERASFSLLLMHAEDHLMSTITIKELVGELLPIFQSLKQ

SEQ ID NO: 60007 - DNA, 327 bp, Bacillus stearothermophilus
  CDS (1)..(327): transl_table=11
atgcaaacgtatgaacaaactgtattccaactgattcttcatggcggaaacggccgcagttatgcaatggaggcgattacggcggcgaaaaaaggggaatttgccgaggcgcgcaggctgcttgaacaggcgggagcagaactgcaggcggcccatgggctgcagaccgcgttgctgcaacaagaagcgagcggcgggcagccggtggtgacgcttctgatggtgcatgcccaagatcatttaatgacggcgatcacggtcaaggatttagccgctgaattcgtggagctgtatgaagcgctcaagcggcaaacaaccgaatcataa

SEQ ID NO: 60008 - protein, 108 aa, Bacillus stearothermophilus
MQTYEQTVFQLILHGGNGRSYAMEAITAAKKGEFAEARRLLEQAGAELQAAHGLQTALLQQEASGGQPVVTLLMVHAQDHLMTAITVKDLAAEFVELYEALKRQTTES

SEQ ID NO: 60009 - DNA, 333 bp, Bacillus subtilis
  CDS (1)..(333): transl_table=11
gtgaatgaggaaatggaacaaatcatttttcaaatcatccttcacggaggaaacggtaggagctccgcaatggaggccattgccgctgcgaaaagcggtgacgcagaagaagcgcggaaaaagcttcaagacgctgctgaagaattgtcaaaagcccatcattatcagacagagctgatccaaaatgaagcgggcggagaaaagacggaaatgacgcttctgatggttcatgcacaggatcatttaatgaatgcaatgacagtgaaggatatggctgcagagatcattgagttatatgaaaaaatcaccgagcaaaggggagcaagcatatga

SEQ ID NO: 60010 - protein, 110 aa, Bacillus subtilis
MNEEMEQIIFQIILHGGNGRSSAMEAIAAAKSGDAEEARKKLQDAAEELSKAHHYQTELIQNEAGGEKTEMTLLMVHAQDHLMNAMTVKDMAAEIIELYEKITEQRGASI

SEQ ID NO: 60011 - DNA, 339 bp, Lactobacillus casei
  CDS (1)..(339): transl_table=11
atgatggctactaaagaagaaatttcaatggttggttttgcacttgtggcgtatgcaggcgatgctcgaacggctgctgtgcatgcacttgatgccgctgaagcaggcgatttcgataaggcaaacgaattggttgagaaggcccaacaggatatcaatgaagcccacaaccaacagacccagcttctaagtcaagaagctggcggtgctgaaatggatgtcacctttatcatggttcatggtcaagatacgttgatgacaaccatgttgctcattgatgaaacacgctacatgattcgcatgtttaagcggatcaaagaacttgagaacaagcagtaa

SEQ ID NO: 60012 - protein, 112 aa, Lactobacillus casei
MMATKEEISMVGFALVAYAGDARTAAVHALDAAEAGDFDKANELVEKAQQDINEAHNQQTQLLSQEAGGAEMDVTFIMVHGQDTLMTTMLLIDETRYMIRMFKRIKELENKQ

SEQ ID NO: 60013 - DNA, 318 bp, Lactococcus lactis
  CDS (1)..(318): transl_table=11
gtgaacagagaagagatgactctcttagggtttgaaattgttgcttatgctggagatgctcgctctaagcttttagaagcgcttaaagcggctgaaaatggtgatttcgctaaggcagatagtcttgtagtagaagcaggaagctgtattgcagaggctcacagttctcagacaggtatgttggctcgagaagcttctggggaggaacttccatacagtgttactatgatgcatggtcaggatcacttgatgactacgatcttattaaaagatgtgattcatcacctcatcgaactttataaaagaggagcaaagtaa

SEQ ID NO: 60014 - protein, 105 aa, Lactococcus lactis
MNREEMTLLGFEIVAYAGDARSKLLEALKAAENGDFAKADSLVVEAGSCIAEAHSSQTGMLAREASGEELPYSVTMMHGQDHLMTTILLKDVIHHLIELYKRGAK

SEQ ID NO: 60015 - DNA, 312 bp, Staphylococcus aureus
  CDS (1)..(312): transl_table=11
atgaatagagaagaagtccaattattaggttttgaaattgttgcatttgcaggggatgcacgttctaagtttttagaagcattaacagcagctcaagctggagattttgcaaaagcagatgcactgattgaagaaggaaacaattgcattgcggaagcgcatagagcacaaacaagcctgttggctaaagaagcgcaaggtgatgatattgcatacagtgtaacgatgatgcatggtcaagatcatttaatgacaacaattttactgaaagatttaatgaagcatttattagaattttataaaagagggtga

SEQ ID NO: 60016 - protein, 103 aa, Staphylococcus aureus
MNREEVQLLGFEIVAFAGDARSKFLEALTAAQAGDFAKADALIEEGNNCIAEAHRAQTSLLAKEAQGDDIAYSVTMMHGQDHLMTTILLKDLMKHLLEFYKRG

SEQ ID NO: 60017 - DNA, 315 bp, Streptococcus mutans
  CDS (1)..(315): transl_table=11
atgaacagagaagaagcgactcttttggggtttgaaattgtagcctatgcaggagatgcacgttctaaattacttgaagctttgaatgcggcacaggccggtgagtacgatagggcagaagagcttgtagctgcggcagatgactgtattgttgatgcccataaagctcaaacaagccttttggctaaggaagcacaaggtgatgatattgaacttagtgttactttaatgcacggacaagatcacctgatgacaaccatacttctaaaagatttgatgaaacatttaattgaattgtacaaaagagggagctaa

SEQ ID NO: 60018 - protein, 104 aa, Streptococcus mutans
MNREEATLLGFEIVAYAGDARSKLLEALNAAQAGEYDRAEELVAAADDCIVDAHKAQTSLLAKEAQGDDIELSVTLMHGQDHLMTTILLKDLMKHLIELYKRGS

SEQ ID NO: 60019 - DNA, 24 bp, Primer
atgatggatctcgataacattccc

SEQ ID NO: 60020 - DNA, 25 bp, Primer
ttatgccttcagtttttcatgaagc

SEQ ID NO: 60021 - protein, 68 aa, consensus
  MISC_FEATURE (1)..(68): consensus for the disclosure of xaa see table XV
GXAXXXXXXAXXXXXXXXXXXAXXXXXXAXXXXXXAHXXQTXXXXXXXXXXXXXXXXXXXXHXQDHLM

SEQ ID NO: 60022 - protein, 88 aa, consensus
  MISC_FEATURE (1)..(88): consensus for the disclosure of xaa see table XV
XXXXXGXXXXXXXXXXXXXXXXXXXXXXXXXXXXXXXXXXXHXXXXXXXXXXXXXXXXXXXXXXXXHXXDXXMXXXXXXXXXXXXXXX

SEQ ID NO: 60023 - DNA, 321 bp, Escherichia coli; identical to SEQ ID NO: 40582
  CDS (1)..(321)

SEQ ID NO: 60024 - protein, 106 aa, Escherichia coli; identical to SEQ ID NO: 40583

SEQ ID NO: 60025 - DNA, 336 bp, Lactobacillus acidophilus NCFM; identical to SEQ ID NO: 40584
  CDS (1)..(336)

SEQ ID NO: 60026 - protein, 111 aa, Lactobacillus acidophilus NCFM; identical to SEQ ID NO: 40585

SEQ ID NO: 60027 - DNA, 318 bp, Borrelia burgdorferi B31; identical to SEQ ID NO: 40586
  CDS (1)..(318): transl_table=11

SEQ ID NO: 60028 - protein, 105 aa, Borrelia burgdorferi B31; identical to SEQ ID NO: 40587

SEQ ID NO: 60029 - DNA, 306 bp, Vibrio cholerae O1 biovar eltor str. N16961; identical to SEQ ID NO: 40588
  CDS (1)..(306): transl_table=11

SEQ ID NO: 60030 - protein, 101 aa, Vibrio cholerae O1 biovar eltor str. N16961; identical to SEQ ID NO: 40589

SEQ ID NO: 60031 - DNA, 312 bp, Bacillus halodurans C-125; identical to SEQ ID NO: 40590
  CDS (1)..(312): transl_table=11

SEQ ID NO: 60032 - protein, 103 aa, Bacillus halodurans C-125; identical to SEQ ID NO: 40591

SEQ ID NO: 60033 - DNA, 327 bp, Lactococcus lactis subsp. lactis Il1403; identical to SEQ ID NO: 40592
  CDS (1)..(327): transl_table=11

SEQ ID NO: 60034 - protein, 108 aa, Lactococcus lactis subsp. lactis Il1403; identical to SEQ ID NO: 40593

SEQ ID NO: 60035 - DNA, 309 bp, Streptococcus pneumoniae TIGR4; identical to SEQ ID NO: 40594
  CDS (1)..(309): transl_table=11

SEQ ID NO: 60036 - protein, 102 aa, Streptococcus pneumoniae TIGR4; identical to SEQ ID NO: 40595

SEQ ID NO: 60037 - DNA, 309 bp, Clostridium acetobutylicum ATCC 824; identical to SEQ ID NO: 40596
  CDS (1)..(309): transl_table=11

SEQ ID NO: 60038 - protein, 102 aa, Clostridium acetobutylicum ATCC 824; identical to SEQ ID NO: 40597

SEQ ID NO: 60039 - DNA, 309 bp, Streptococcus pneumoniae R6; identical to SEQ ID NO: 40598
  CDS (1)..(309): transl_table=11

SEQ ID NO: 60040 - protein, 102 aa, Streptococcus pneumoniae R6; identical to SEQ ID NO: 40599

SEQ ID NO: 60041 - DNA, 309 bp, Streptococcus pneumoniae R6; identical to SEQ ID NO: 40600
  CDS (1)..(309): transl_table=11

SEQ ID NO: 60042 - protein, 102 aa, Streptococcus pneumoniae R6; identical to SEQ ID NO: 40601

SEQ ID NO: 60043 - DNA, 312 bp, Bacillus subtilis subsp. subtilis str. 168; identical to SEQ ID NO: 40602
  CDS (1)..(312): transl_table=11

SEQ ID NO: 60044 - protein, 103 aa, Bacillus subtilis subsp. subtilis str. 168; identical to SEQ ID NO: 40603

SEQ ID NO: 60045 - DNA, 321 bp, Salmonella typhimurium LT2; identical to SEQ ID NO: 40604
  CDS (1)..(321): transl_table=11

SEQ ID NO: 60046 - protein, 106 aa, Salmonella typhimurium LT2; identical to SEQ ID NO: 40605

SEQ ID NO: 60047 - DNA, 336 bp, Listeria innocua Clip11262; identical to SEQ ID NO: 40606
  CDS (1)..(336): transl_table=11

SEQ ID NO: 60048 - protein, 111 aa, Listeria innocua Clip11262; identical to SEQ ID NO: 40607

SEQ ID NO: 60049 - DNA, 306 bp, Listeria innocua Clip11262; identical to SEQ ID NO: 40608
  CDS (1)..(306): transl_table=11

SEQ ID NO: 60050 - protein, 101 aa, Listeria innocua Clip11262; identical to SEQ ID NO: 40609

SEQ ID NO: 60051 - DNA, 357 bp, Listeria innocua Clip11262; identical to SEQ ID NO: 40610
  CDS (1)..(357): transl_table=11

SEQ ID NO: 60052 - protein, 118 aa, Listeria innocua Clip11262; identical to SEQ ID NO: 40611

SEQ ID NO: 60053 - DNA, 330 bp, Clostridium perfringens str. 13; identical to SEQ ID NO: 40612
  CDS (1)..(330): transl_table=11

SEQ ID NO: 60054 - protein, 109 aa, Clostridium perfringens str. 13; identical to SEQ ID NO: 40613

SEQ ID NO: 60055 - DNA, 312 bp, Thermoanaerobacter tengcongensis MB4; identical to SEQ ID NO: 40614
  CDS (1)..(312): transl_table=11

SEQ ID NO: 60056 - protein, 103 aa, Thermoanaerobacter tengcongensis MB4; identical to SEQ ID NO: 40615

SEQ ID NO: 60057 - DNA, 327 bp, Thermoanaerobacter tengcongensis MB4; identical to SEQ ID NO: 40616
  CDS (1)..(327): transl_table=11

SEQ ID NO: 60058 - protein, 108 aa, Thermoanaerobacter tengcongensis MB4; identical to SEQ ID NO: 40617

SEQ ID NO: 60059 - DNA, 321 bp, Streptococcus agalactiae 2603V/R; identical to SEQ ID NO: 40618
  CDS (1)..(321): transl_table=11

SEQ ID NO: 60060 - protein, 106 aa, Streptococcus agalactiae 2603V/R; identical to SEQ ID NO: 40619

SEQ ID NO: 60061 - DNA, 306 bp, Oceanobacillus iheyensis HTE831; identical to SEQ ID NO: 40620
  CDS (1)..(306): transl_table=11

SEQ ID NO: 60062 - protein, 101 aa, Oceanobacillus iheyensis HTE831; identical to SEQ ID NO: 40621

SEQ ID NO: 60063 - DNA, 306 bp, Oceanobacillus iheyensis HTE831; identical to SEQ ID NO: 40622
  CDS (1)..(306): transl_table=11

SEQ ID NO: 60064 - protein, 101 aa, Oceanobacillus iheyensis HTE831; identical to SEQ ID NO: 40623

SEQ ID NO: 60065 - DNA, 300 bp, Lactobacillus plantarum WCFS1; identical to SEQ ID NO: 40624
  CDS (1)..(300): transl_table=11

SEQ ID NO: 60066 - protein, 99 aa, Lactobacillus plantarum WCFS1; identical to SEQ ID NO: 40625

SEQ ID NO: 60067 - DNA, 318 bp, Lactobacillus plantarum WCFS1; identical to SEQ ID NO: 40626
  CDS (1)..(318): transl_table=11

SEQ ID NO: 60068 - protein, 105 aa, Lactobacillus plantarum WCFS1; identical to SEQ ID NO: 40627

SEQ ID NO: 60069 - DNA, 327 bp, Lactobacillus plantarum WCFS1; identical to SEQ ID NO: 40628
  CDS (1)..(327): transl_table=11

SEQ ID NO: 60070 - protein, 108 aa, Lactobacillus plantarum WCFS1; identical to SEQ ID NO: 40629

SEQ ID NO: 60071 - DNA, 306 bp, Vibrio parahaemolyticus RIMD 2210633; identical to SEQ ID NO: 40630
  CDS (1)..(306): transl_table=11

SEQ ID NO: 60072 - protein, 101 aa, Vibrio parahaemolyticus RIMD 2210633; identical to SEQ ID NO: 40631

SEQ ID NO: 60073 - DNA, 330 bp, Enterococcus faecalis V583; identical to SEQ ID NO: 40632
  CDS (1)..(330): transl_table=11

SEQ ID NO: 60074 - protein, 109 aa, Enterococcus faecalis V583; identical to SEQ ID NO: 40633

SEQ ID NO: 60075 - DNA, 336 bp, Enterococcus faecalis V583; identical to SEQ ID NO: 40634
  CDS (1)..(336): transl_table=11

SEQ ID NO: 60076 - protein, 111 aa, Enterococcus faecalis V583; identical to SEQ ID NO: 40635

SEQ ID NO: 60077 - DNA, 303 bp, Bacillus cereus ATCC 14579; identical to SEQ ID NO: 40636
  CDS (1)..(303): transl_table=11

SEQ ID NO: 60078 - protein, 100 aa, Bacillus cereus ATCC 14579; identical to SEQ ID NO: 40637

SEQ ID NO: 60079 - DNA, 306 bp, Photorhabdus luminescens subsp. laumondii TTO1; identical to SEQ ID NO: 40638
  CDS (1)..(306): transl_table=11

SEQ ID NO: 60080 - protein, 101 aa, Photorhabdus luminescens subsp. laumondii TTO1; identical to SEQ ID NO: 40639

SEQ ID NO: 60081 - DNA, 324 bp, Lactobacillus johnsonii NCC 533; identical to SEQ ID NO: 40640
  CDS (1)..(324): transl_table=11

SEQ ID NO: 60082 - protein, 107 aa, Lactobacillus johnsonii NCC 533; identical to SEQ ID NO: 40641

SEQ ID NO: 60083 - DNA, 306 bp, Bacillus cereus ATCC 10987; identical to SEQ ID NO: 40642
  CDS (1)..(306): transl_table=11

SEQ ID NO: 60084 - protein, 101 aa, Bacillus cereus ATCC 10987; identical to SEQ ID NO: 40643

SEQ ID NO: 60085 - DNA, 306 bp, Listeria monocytogenes str. 4b F2365; identical to SEQ ID NO: 40644
  CDS (1)..(306): transl_table=11

SEQ ID NO: 60086 - protein, 101 aa, Listeria monocytogenes str. 4b F2365; identical to SEQ ID NO: 40645

SEQ ID NO: 60087 - DNA, 303 bp, Bacillus thuringiensis serovar konkukian str. 97-27; identical to SEQ ID NO: 40646
  CDS (1)..(303): transl_table=11

SEQ ID NO: 60088 - protein, 100 aa, Bacillus thuringiensis serovar konkukian str. 97-27; identical to SEQ ID NO: 40647

SEQ ID NO: 60089 - DNA, 318 bp, Erwinia carotovora subsp. atroseptica SCRI1043; identical to SEQ ID NO: 40648
  CDS (1)..(318)

SEQ ID NO: 60090 - protein, 105 aa, Erwinia carotovora subsp. atroseptica SCRI1043; identical to SEQ ID NO: 40649

SEQ ID NO: 60091 - DNA, 312 bp, Erwinia carotovora subsp. atroseptica SCRI1043; identical to SEQ ID NO: 40650
  CDS (1)..(312)

SEQ ID NO: 60092 - protein, 103 aa, Erwinia carotovora subsp. atroseptica SCRI1043; identical to SEQ ID NO: 40651

SEQ ID NO: 60093 - DNA, 306 bp, Erwinia carotovora subsp. atroseptica SCRI1043; identical to SEQ ID NO: 40652
  CDS (1)..(306)

SEQ ID NO: 60094 - protein, 101 aa, Erwinia carotovora subsp. atroseptica SCRI1043; identical to SEQ ID NO: 40653

SEQ ID NO: 60095 - DNA, 318 bp, Borrelia garinii PBi; identical to SEQ ID NO: 40654
  CDS (1)..(318): transl_table=11

SEQ ID NO: 60096 - protein, 105 aa, Borrelia garinii PBi; identical to SEQ ID NO: 40655

SEQ ID NO: 60097 - DNA, 318 bp, Yersinia pseudotuberculosis IP 32953; identical to SEQ ID NO: 40656
  CDS (1)..(318): transl_table=11

SEQ ID NO: 60098 - protein, 105 aa, Yersinia pseudotuberculosis IP 32953; identical to SEQ ID NO: 40657

SEQ ID NO: 60099 - DNA, 303 bp, Bacillus cereus ZK; identical to SEQ ID NO: 40658
  CDS (1)..(303): transl_table=11

SEQ ID NO: 60100 - protein, 100 aa, Bacillus cereus ZK; identical to SEQ ID NO: 40659

SEQ ID NO: 60101 - DNA, 300 bp, Bacillus licheniformis ATCC 14580; identical to SEQ ID NO: 40660
  CDS (1)..(300): transl_table=11

SEQ ID NO: 60102 - protein, 99 aa, Bacillus licheniformis ATCC 14580; identical to SEQ ID NO: 40661

SEQ ID NO: 60103 - DNA, 309 bp, Bacillus licheniformis ATCC 14580; identical to SEQ ID NO: 40662
  CDS (1)..(309): transl_table=11

SEQ ID NO: 60104 - protein, 102 aa, Bacillus licheniformis ATCC 14580; identical to SEQ ID NO: 40663

SEQ ID NO: 60105 - DNA, 336 bp, Photobacterium profundum SS9; identical to SEQ ID NO: 40664
  CDS (1)..(336): transl_table=11

SEQ ID NO: 60106 - protein, 111 aa, Photobacterium profundum SS9; identical to SEQ ID NO: 40665

SEQ ID NO: 60107 - DNA, 318 bp, Photobacterium profundum SS9; identical to SEQ ID NO: 40666
  CDS (1)..(318): transl_table=11

SEQ ID NO: 60108 - protein, 105 aa, Photobacterium profundum SS9; identical to SEQ ID NO: 40667

SEQ ID NO: 60109 - DNA, 312 bp, Geobacillus kaustophilus HTA426; identical to SEQ ID NO: 40668
  CDS (1)..(312): transl_table=11

SEQ ID NO: 60110 - protein, 103 aa, Geobacillus kaustophilus HTA426; identical to SEQ ID NO: 40669

SEQ ID NO: 60111 - DNA, 297 bp, Bacillus clausii KSM-K16; identical to SEQ ID NO: 40670
  CDS (1)..(297): transl_table=11

SEQ ID NO: 60112 - protein, 98 aa, Bacillus clausii KSM-K16; identical to SEQ ID NO: 40671

SEQ ID NO: 60113 - DNA, 324 bp, Lactobacillus gasseri; identical to SEQ ID NO: 40672
  CDS (1)..(324)

SEQ ID NO: 60114 - protein, 107 aa, Lactobacillus gasseri; identical to SEQ ID NO: 40673

SEQ ID NO: 60115 - DNA, 312 bp, Haemophilus somnus 2336; identical to SEQ ID NO: 40674
  CDS (1)..(312)

SEQ ID NO: 60116 - protein, 103 aa, Haemophilus somnus 2336; identical to SEQ ID NO: 40675

SEQ ID NO: 60117 - DNA, 303 bp, Listeria monocytogenes str. 1/2a F6854; identical to SEQ ID NO: 40676
  CDS (1)..(303): transl_table=11

SEQ ID NO: 60118 - protein, 100 aa, Listeria monocytogenes str. 1/2a F6854; identical to SEQ ID NO: 40677

SEQ ID NO: 60119 - DNA, 324 bp, Listeria monocytogenes str. 1/2a F6854; identical to SEQ ID NO: 40678
  CDS (1)..(324): transl_table=11

SEQ ID NO: 60120 - protein, 107 aa, Listeria monocytogenes str. 1/2a F6854; identical to SEQ ID NO: 40679

SEQ ID NO: 60121 - DNA, 321 bp, Enterococcus faecium; identical to SEQ ID NO: 40680
  CDS (1)..(321)

SEQ ID NO: 60122 - protein, 106 aa, Enterococcus faecium; identical to SEQ ID NO: 40681

SEQ ID NO: 60123 - DNA, 318 bp, Enterococcus faecium; identical to SEQ ID NO: 40682
  CDS (1)..(318)

SEQ ID NO: 60124 - protein, 105 aa, Enterococcus faecium; identical to SEQ ID NO: 40683

SEQ ID NO: 60125 - DNA, 309 bp, Oenococcus oeni PSU-1; identical to SEQ ID NO: 40684
  CDS (1)..(309)

SEQ ID NO: 60126 - protein, 102 aa, Oenococcus oeni PSU-1; identical to SEQ ID NO: 40685

SEQ ID NO: 60127 - DNA, 324 bp, Oenococcus oeni PSU-1; identical to SEQ ID NO: 40686
  CDS (1)..(324)

SEQ ID NO: 60128 - protein, 107 aa, Oenococcus oeni PSU-1; identical to SEQ ID NO: 40687

SEQ ID NO: 60129 - DNA, 312 bp, Pediococcus pentosaceus ATCC 25745; identical to SEQ ID NO: 40688
  CDS (1)..(312)

SEQ ID NO: 60130 - protein, 103 aa, Pediococcus pentosaceus ATCC 25745; identical to SEQ ID NO: 40689

SEQ ID NO: 60131 - DNA, 312 bp, Streptococcus suis 89/1591; identical to SEQ ID NO: 40690
  CDS (1)..(312)

SEQ ID NO: 60132 - protein, 103 aa, Streptococcus suis 89/1591; identical to SEQ ID NO: 40691

SEQ ID NO: 60133 - DNA, 306 bp, Streptococcus suis 89/1591; identical to SEQ ID NO: 40692
  CDS (1)..(306)

SEQ ID NO: 60134 - protein, 101 aa, Streptococcus suis 89/1591; identical to SEQ ID NO: 40693

SEQ ID NO: 60135 - DNA, 306 bp, Pectobacterium carotovorum; identical to SEQ ID NO: 40694
  CDS (1)..(306): transl_table=11

SEQ ID NO: 60136 - protein, 101 aa, Pectobacterium carotovorum; identical to SEQ ID NO: 40695

SEQ ID NO: 60137 - DNA, 312 bp, Bacillus pumilus; identical to SEQ ID NO: 40696
  CDS (1)..(312): transl_table=11

SEQ ID NO: 60138 - protein, 103 aa, Bacillus pumilus; identical to SEQ ID NO: 40697

SEQ ID NO: 60139 - DNA, 318 bp, Serratia marcescens; identical to SEQ ID NO: 40698
  CDS (1)..(318): transl_table=11

SEQ ID NO: 60140 - protein, 105 aa, Serratia marcescens; identical to SEQ ID NO: 40699

SEQ ID NO: 60141 - DNA, 309 bp, Bacillus subtilis; identical to SEQ ID NO: 40700
  CDS (1)..(309): transl_table=11

SEQ ID NO: 60142 - protein, 102 aa, Bacillus subtilis; identical to SEQ ID NO: 40701

SEQ ID NO: 60143 - DNA, 27 bp, Primer
atggaaaagaaacacatttatctgttt

SEQ ID NO: 60144 - DNA, 26 bp, Primer
ttaatttgctgcggcttttttaatcg

SEQ ID NO: 60145 - protein, 107 aa, consensus; identical to SEQ ID NO: 40704
  MISC_FEATURE (1)..(107): consensus for the disclosure of xaa see table XV

SEQ ID NO: 60146 - protein, 18 aa, consensus
  MISC_FEATURE (1)..(18): consensus for the disclosure of xaa see table XV
XXXXCXXGXXXXXXXXXX

SEQ ID NO: 60147 - protein, 11 aa, consensus
  MISC_FEATURE (1)..(11): consensus for the disclosure of xaa see table XV
DXXXXXPXXXX

SEQ ID NO: 60148 - protein, 21 aa, consensus
  MISC_FEATURE (1)..(21): consensus for the disclosure of xaa see table XV
XXXIXXXXYXXXXGXXXXXXX

SEQ ID NO: 60149 - DNA, 1662 bp, Escherichia coli K12; identical to SEQ ID NO: 20332
  CDS (1)..(1662)

SEQ ID NO: 60150 - protein, 553 aa, Escherichia coli K12; identical to SEQ ID NO: 20333

SEQ ID NO: 60151 - DNA, 2040 bp, Pseudomonas aeruginosa; identical to SEQ ID NO: 20334
  CDS (1)..(2040)

SEQ ID NO: 60152 - protein, 679 aa, Pseudomonas aeruginosa; identical to SEQ ID NO: 20335

SEQ ID NO: 60153 - DNA, 1797 bp, Caulobacter crescentus; identical to SEQ ID NO: 20336
  CDS (1)..(1797)

SEQ ID NO: 60154 - protein, 598 aa, Caulobacter crescentus; identical to SEQ ID NO: 20337

SEQ ID NO: 60155 - DNA, 2148 bp, Agrobacterium tumefaciens; identical to SEQ ID NO: 20338
  CDS (1)..(2148)

SEQ ID NO: 60156 - protein, 715 aa, Agrobacterium tumefaciens; identical to SEQ ID NO: 20339

SEQ ID NO: 60157 - DNA, 1500 bp, Agrobacterium tumefaciens; identical to SEQ ID NO: 20340
  CDS (1)..(1500)

SEQ ID NO: 60158 - protein, 499 aa, Agrobacterium tumefaciens; identical to SEQ ID NO: 20341

SEQ ID NO: 60159 - DNA, 2010 bp, Agrobacterium tumefaciens; identical to SEQ ID NO: 20342
  CDS (1)..(2010)

SEQ ID NO: 60160 - protein, 669 aa, Agrobacterium tumefaciens; identical to SEQ ID NO: 20343

SEQ ID NO: 60161 - DNA, 1941 bp, Agrobacterium tumefaciens; identical to SEQ ID NO: 20344
  CDS (1)..(1941)

SEQ ID NO: 60162 - protein, 646 aa, Agrobacterium tumefaciens; identical to SEQ ID NO: 20345

SEQ ID NO: 60163 - DNA, 1956 bp, Agrobacterium tumefaciens; identical to SEQ ID NO: 20346
  CDS (1)..(1956)

SEQ ID NO: 60164 - protein, 651 aa, Agrobacterium tumefaciens; identical to SEQ ID NO: 20347

SEQ ID NO: 60165 - DNA, 1674 bp, Yersinia pestis; identical to SEQ ID NO: 20348
  CDS (1)..(1674)

SEQ ID NO: 60166 - protein, 557 aa, Yersinia pestis; identical to SEQ ID NO: 20349

SEQ ID NO: 60167 - DNA, 1569 bp, Salmonella enterica subsp. enterica serovar Typhi; identical to SEQ ID NO: 20350
  CDS (1)..(1569)

SEQ ID NO: 60168 - protein, 522 aa, Salmonella enterica subsp. enterica serovar Typhi; identical to SEQ ID NO: 20351

SEQ ID NO: 60169 - DNA, 1815 bp, Agrobacterium tumefaciens; identical to SEQ ID NO: 20352
  CDS (1)..(1815)

SEQ ID NO: 60170 - protein, 604 aa, Agrobacterium tumefaciens; identical to SEQ ID NO: 20353

SEQ ID NO: 60171 - DNA, 1950 bp, Agrobacterium tumefaciens; identical to SEQ ID NO: 20354
  CDS (1)..(1950)

SEQ ID NO: 60172 - protein, 649 aa, Agrobacterium tumefaciens; identical to SEQ ID NO: 20355

SEQ ID NO: 60173 - DNA, 1950 bp, Yersinia pestis; identical to SEQ ID NO: 20356
  CDS (1)..(1950)

SEQ ID NO: 60174 - protein, 649 aa, Yersinia pestis; identical to SEQ ID NO: 20357

SEQ ID NO: 60175 - DNA, 1644 bp, Salmonella enterica subsp. enterica serovar Typhi; identical to SEQ ID NO: 20358
  CDS (1)..(1644)

SEQ ID NO: 60176 - protein, 547 aa, Salmonella enterica subsp. enterica serovar Typhi; identical to SEQ ID NO: 20359

SEQ ID NO: 60177 - DNA, 1960 bp, Clostridium thermocellum; identical to SEQ ID NO: 20360
  CDS (189)..(1862)

SEQ ID NO: 60178 - protein, 557 aa, Clostridium thermocellum; identical to SEQ ID NO: 20361

SEQ ID NO: 60179 - DNA, 1674 bp, Enterobacter aerogenes; identical to SEQ ID NO: 20362
  CDS (1)..(1674)

SEQ ID NO: 60180 - protein, 557 aa, Enterobacter aerogenes; identical to SEQ ID NO: 20363

SEQ ID NO: 60181 - DNA, 1614 bp, Caulobacter crescentus; identical to SEQ ID NO: 20364
  CDS (1)..(1614)

SEQ ID NO: 60182 - protein, 537 aa, Caulobacter crescentus; identical to SEQ ID NO: 20365

SEQ ID NO: 60183 - DNA, 1770 bp, Caulobacter crescentus; identical to SEQ ID NO: 20366
  CDS (1)..(1770)

SEQ ID NO: 60184 - protein, 589 aa, Caulobacter crescentus; identical to SEQ ID NO: 20367

SEQ ID NO: 60185 - DNA, 1818 bp, Agrobacterium tumefaciens; identical to SEQ ID NO: 20368
  CDS (1)..(1818)

SEQ ID NO: 60186 - protein, 605 aa, Agrobacterium tumefaciens; identical to SEQ ID NO: 20369

SEQ ID NO: 60187 - DNA, 1752 bp, Agrobacterium tumefaciens; identical to SEQ ID NO: 20370
  CDS (1)..(1752)

SEQ ID NO: 60188 - protein, 583 aa, Agrobacterium tumefaciens; identical to SEQ ID NO: 20371

SEQ ID NO: 60189 - DNA, 1539 bp, Enterobacter aerogenes; identical to SEQ ID NO: 20372
  CDS (1)..(1539)

SEQ ID NO: 60190 - protein, 512 aa, Enterobacter aerogenes; identical to SEQ ID NO: 20373

SEQ ID NO: 60191 - DNA, 1668 bp, Caulobacter crescentus; identical to SEQ ID NO: 20374
  CDS (1)..(1668)

SEQ ID NO: 60192 - protein, 555 aa, Caulobacter crescentus; identical to SEQ ID NO: 20375

SEQ ID NO: 60193 - DNA, 750 bp, Caulobacter crescentus; identical to SEQ ID NO: 20376
  CDS (1)..(750)

SEQ ID NO: 60194 - protein, 249 aa, Caulobacter crescentus; identical to SEQ ID NO: 20377

SEQ ID NO: 60195 - DNA, 1794 bp, Caulobacter crescentus; identical to SEQ ID NO: 20378
  CDS (1)..(1794)

SEQ ID NO: 60196 - protein, 597 aa, Caulobacter crescentus; identical to SEQ ID NO: 20379

SEQ ID NO: 60197 - DNA, 1869 bp, Agrobacterium tumefaciens; identical to SEQ ID NO: 20380
  CDS (1)..(1869)

SEQ ID NO: 60198 - protein, 622 aa, Agrobacterium tumefaciens; identical to SEQ ID NO: 20381

SEQ ID NO: 60199 - DNA, 2307 bp, Agrobacterium tumefaciens; identical to SEQ ID NO: 20382
  CDS (1)..(2307)

SEQ ID NO: 60200 - protein, 768 aa, Agrobacterium tumefaciens; identical to SEQ ID NO: 20383

SEQ ID NO: 60201 - DNA, 1506 bp, Caulobacter crescentus; identical to SEQ ID NO: 20384
  CDS (1)..(1506)

SEQ ID NO: 60202 - protein, 501 aa, Caulobacter crescentus; identical to SEQ ID NO: 20385

SEQ ID NO: 60203 - DNA, 2352 bp, Agrobacterium tumefaciens; identical to SEQ ID NO: 20386
  CDS (1)..(2352)

SEQ ID NO: 60204 - protein, 783 aa, Agrobacterium tumefaciens; identical to SEQ ID NO: 20387

SEQ ID NO: 60205 - DNA, 2154 bp, Agrobacterium tumefaciens; identical to SEQ ID NO: 20388
  CDS (1)..(2154)

SEQ ID NO: 60206 - protein, 717 aa, Agrobacterium tumefaciens; identical to SEQ ID NO: 20389

SEQ ID NO: 60207 - DNA, 2004 bp, Caulobacter crescentus; identical to SEQ ID NO: 20390
  CDS (1)..(2004)

SEQ ID NO: 60208 - protein, 667 aa, Caulobacter crescentus; identical to SEQ ID NO: 20391

SEQ ID NO: 60209 - DNA, 1668 bp, Clostridium acetobutylicum; identical to SEQ ID NO: 20392
  CDS (1)..(1668)

SEQ ID NO: 60210 - protein, 555 aa, Clostridium acetobutylicum; identical to SEQ ID NO: 20393

SEQ ID NO: 60211 - DNA, 2358 bp, Agrobacterium tumefaciens; identical to SEQ ID NO: 20394
  CDS (1)..(2358)

SEQ ID NO: 60212 - protein, 785 aa, Agrobacterium tumefaciens; identical to SEQ ID NO: 20395

SEQ ID NO: 60213 - DNA, 2367 bp, Agrobacterium tumefaciens; identical to SEQ ID NO: 20396
  CDS (1)..(2367)

SEQ ID NO: 60214 - protein, 788 aa, Agrobacterium tumefaciens; identical to SEQ ID NO: 20397

SEQ ID NO: 60215 - DNA, 1980 bp, Vibrio cholerae; identical to SEQ ID NO: 20398
  CDS (1)..(1980)

SEQ ID NO: 60216 - protein, 659 aa, Vibrio cholerae; identical to SEQ ID NO: 20399

SEQ ID NO: 60217 - DNA, 1869 bp, Caulobacter crescentus; identical to SEQ ID NO: 20400
  CDS (1)..(1869)

SEQ ID NO: 60218 - protein, 622 aa, Caulobacter crescentus; identical to SEQ ID NO: 20401

SEQ ID NO: 60219 - DNA, 1827 bp, Caulobacter crescentus; identical to SEQ ID NO: 20402
  CDS (1)..(1827)

SEQ ID NO: 60220 - protein, 608 aa, Caulobacter crescentus; identical to SEQ ID NO: 20403

SEQ ID NO: 60221 - DNA, 2037 bp, Vibrio cholerae; identical to SEQ ID NO: 20404
  CDS (1)..(2037)

SEQ ID NO: 60222 - protein, 678 aa, Vibrio cholerae; identical to SEQ ID NO: 20405

SEQ ID NO: 60223 - DNA, 1608 bp, Pseudomonas aeruginosa; identical to SEQ ID NO: 20406
  CDS (1)..(1608)

SEQ ID NO: 60224 - protein, 535 aa, Pseudomonas aeruginosa; identical to SEQ ID NO: 20407

SEQ ID NO: 60225 - DNA, 1515 bp, Caulobacter crescentus; identical to SEQ ID NO: 20408
  CDS (1)..(1515)

SEQ ID NO: 60226 - protein, 504 aa, Caulobacter crescentus; identical to SEQ ID NO: 20409

SEQ ID NO: 60227 - DNA, 2295 bp, Rhodobacter capsulatus; identical to SEQ ID NO: 20410
  CDS (1)..(2295)

SEQ ID NO: 60228 - protein, 764 aa, Rhodobacter capsulatus; identical to SEQ ID NO: 20411

SEQ ID NO: 60229 - DNA, 1602 bp, Escherichia coli; identical to SEQ ID NO: 20412
  CDS (1)..(1602)

SEQ ID NO: 60230 - protein, 533 aa, Escherichia coli; identical to SEQ ID NO: 20413

SEQ ID NO: 60231 - DNA, 1656 bp, Escherichia coli; identical to SEQ ID NO: 20414
  CDS (1)..(1656)

SEQ ID NO: 60232 - protein, 551 aa, Escherichia coli; identical to SEQ ID NO: 20415

SEQ ID NO: 60233 - DNA, 2076 bp, Rhodobacter sphaeroides; identical to SEQ ID NO: 20416
  CDS (1)..(2076)

SEQ ID NO: 60234 - protein, 691 aa, Rhodobacter sphaeroides; identical to SEQ ID NO: 20417

SEQ ID NO: 60235 - DNA, 1917 bp, Rhodobacter capsulatus; identical to SEQ ID NO: 20418
  CDS (1)..(1917)

SEQ ID NO: 60236 - protein, 638 aa, Rhodobacter capsulatus; identical to SEQ ID NO: 20419

SEQ ID NO: 60237 - DNA, 3696 bp, Rhizobium leguminosarum; identical to SEQ ID NO: 20420
  CDS (482)..(2401)

SEQ ID NO: 60238 - protein, 639 aa, Rhizobium leguminosarum; identical to SEQ ID NO: 20421

SEQ ID NO: 60239 - DNA, 2399 bp, Rhizobium leguminosarum; identical to SEQ ID NO: 20422
  CDS (174)..(2321)

SEQ ID NO: 60240 - protein, 715 aa, Rhizobium leguminosarum; identical to SEQ ID NO: 20423

SEQ ID NO: 60241 - DNA, 2149 bp, Rhizobium leguminosarum; identical to SEQ ID NO: 20424
  CDS (202)..(2079)

SEQ ID NO: 60242 - protein, 625 aa, Rhizobium leguminosarum; identical to SEQ ID NO: 20425

SEQ ID NO: 60243 - DNA, 2362 bp, Rhizobium leguminosarum; identical to SEQ ID NO: 20426
  CDS (326)..(2200)

SEQ ID NO: 60244 - protein, 624 aa, Rhizobium leguminosarum; identical to SEQ ID NO: 20427

SEQ ID NO: 60245 - DNA, 2220 bp, Agrobacterium tumefaciens; identical to SEQ ID NO: 20428
  CDS (1)..(2220)

SEQ ID NO: 60246 - protein, 739 aa, Agrobacterium tumefaciens; identical to SEQ ID NO: 20429

SEQ ID NO: 60247 - DNA, 2379 bp, Rhodobacter sphaeroides; identical to SEQ ID NO: 20430
  CDS (1)..(2379)

SEQ ID NO: 60248 - protein, 792 aa, Rhodobacter sphaeroides; identical to SEQ ID NO: 20431

SEQ ID NO: 60249 - DNA, 1647 bp, Erwinia carotovora subsp; identical to SEQ ID NO: 20432
  CDS (1)..(1647)

SEQ ID NO: 60250 - protein, 548 aa, Erwinia carotovora subsp; identical to SEQ ID NO: 20433

SEQ ID NO: 60251 - DNA, 1671 bp, Erwinia carotovora subsp; identical to SEQ ID NO: 20434
  CDS (1)..(1671)

SEQ ID NO: 60252 - protein, 556 aa, Erwinia carotovora subsp; identical to SEQ ID NO: 20435

SEQ ID NO: 60253 - DNA, 1680 bp, Erwinia carotovora subsp; identical to SEQ ID NO: 20436
  CDS (1)..(1680)

SEQ ID NO: 60254 - protein, 559 aa, Erwinia carotovora subsp; identical to SEQ ID NO: 20437

SEQ ID NO: 60255 - DNA, 1572 bp, Erwinia carotovora subsp; identical to SEQ ID NO: 20438
  CDS (1)..(1572)

SEQ ID NO: 60256 - protein, 523 aa, Erwinia carotovora subsp; identical to SEQ ID NO: 20439

SEQ ID NO: 60257 - DNA, 1941 bp, Erwinia carotovora subsp; identical to SEQ ID NO: 20440
  CDS (1)..(1941)

SEQ ID NO: 60258 - protein, 646 aa, Erwinia carotovora subsp; identical to SEQ ID NO: 20441

SEQ ID NO: 60259 - DNA, 1536 bp, Erwinia carotovora subsp; identical to SEQ ID NO: 20442
  CDS (1)..(1536)

SEQ ID NO: 60260 - protein, 511 aa, Erwinia carotovora subsp; identical to SEQ ID NO: 20443

SEQ ID NO: 60261 - DNA, 1941 bp, Erwinia carotovora subsp; identical to SEQ ID NO: 20444
  CDS (1)..(1941)

SEQ ID NO: 60262 - protein, 646 aa, Erwinia carotovora subsp; identical to SEQ ID NO: 20445

SEQ ID NO: 60263 - DNA, 1935 bp, Erwinia carotovora subsp; identical to SEQ ID NO: 20446
  CDS (1)..(1935)

SEQ ID NO: 60264 - protein, 644 aa, Erwinia carotovora subsp; identical to SEQ ID NO: 20447

SEQ ID NO: 60265 - DNA, 1797 bp, Erwinia carotovora subsp; identical to SEQ ID NO: 20448
  CDS (1)..(1797)

SEQ ID NO: 60266 - protein, 598 aa, Erwinia carotovora subsp; identical to SEQ ID NO: 20449

SEQ ID NO: 60267 - DNA, 1836 bp, Erwinia carotovora subsp; identical to SEQ ID NO: 20450
  CDS (1)..(1836)

SEQ ID NO: 60268 - protein, 611 aa, Erwinia carotovora subsp; identical to SEQ ID NO: 20451

SEQ ID NO: 60269 - DNA, 1680 bp, Erwinia carotovora subsp; identical to SEQ ID NO: 20452
  CDS (1)..(1680)

SEQ ID NO: 60270 - protein, 559 aa, Erwinia carotovora subsp; identical to SEQ ID NO: 20453

SEQ ID NO: 60271 - DNA, 1791 bp, Erwinia carotovora subsp; identical to SEQ ID NO: 20454
  CDS (1)..(1791)

SEQ ID NO: 60272 - protein, 596 aa, Erwinia carotovora subsp; identical to SEQ ID NO: 20455

SEQ ID NO: 60273 - DNA, 1620 bp, Erwinia carotovora subsp; identical to SEQ ID NO: 20456
  CDS (1)..(1620)

SEQ ID NO: 60274 - protein, 539 aa, Erwinia carotovora subsp; identical to SEQ ID NO: 20457

SEQ ID NO: 60275 - DNA, 1662 bp, Erwinia carotovora subsp; identical to SEQ ID NO: 20458
  CDS (1)..(1662)

SEQ ID NO: 60276 - protein, 553 aa, Erwinia carotovora subsp; identical to SEQ ID NO: 20459

SEQ ID NO: 60277 - DNA, 1953 bp, Erwinia carotovora subsp; identical to SEQ ID NO: 20460
  CDS (1)..(1953)

SEQ ID NO: 60278 - protein, 650 aa, Erwinia carotovora subsp; identical to SEQ ID NO: 20461

SEQ ID NO: 60279 - DNA, 2796 bp, Photobacterium profundum; identical to SEQ ID NO: 20462
  CDS (1)..(2796)

SEQ ID NO: 60280 - protein, 931 aa, Photobacterium profundum; identical to SEQ ID NO: 20463

SEQ ID NO: 60281 - DNA, 1464 bp, Bdellovibrio bacteriovorus; identical to SEQ ID NO: 20464
  CDS (1)..(1464)

SEQ ID NO: 60282 - protein, 487 aa, Bdellovibrio bacteriovorus; identical to SEQ ID NO: 20465

SEQ ID NO: 60283 - DNA, 1539 bp, Bdellovibrio bacteriovorus; identical to SEQ ID NO: 20466
  CDS (1)..(1539)

SEQ ID NO: 60284 - protein, 512 aa, Bdellovibrio bacteriovorus; identical to SEQ ID NO: 20467

SEQ ID NO: 60285 - DNA, 1647 bp, Bdellovibrio bacteriovorus; identical to SEQ ID NO: 20468
  CDS (1)..(1647)

SEQ ID NO: 60286 - protein, 548 aa, Bdellovibrio bacteriovorus; identical to SEQ ID NO: 20469

SEQ ID NO: 60287 - DNA, 1449 bp, Bdellovibrio bacteriovorus; identical to SEQ ID NO: 20470
  CDS (1)..(1449)

SEQ ID NO: 60288 - protein, 482 aa, Bdellovibrio bacteriovorus; identical to SEQ ID NO: 20471

SEQ ID NO: 60289 - DNA, 1815 bp, Bdellovibrio bacteriovorus; identical to SEQ ID NO: 20472
  CDS (1)..(1815)

SEQ ID NO: 60290 - protein, 604 aa, Bdellovibrio bacteriovorus; identical to SEQ ID NO: 20473

SEQ ID NO: 60291 - DNA, 1599 bp, Bdellovibrio bacteriovorus; identical to SEQ ID NO: 20474
  CDS (1)..(1599)

SEQ ID NO: 60292 - protein, 532 aa, Bdellovibrio bacteriovorus; identical to SEQ ID NO: 20475

SEQ ID NO: 60293 - DNA, 1680 bp, Bdellovibrio bacteriovorus; identical to SEQ ID NO: 20476
  CDS (1)..(1680)

SEQ ID NO: 60294 - protein, 559 aa, Bdellovibrio bacteriovorus; identical to SEQ ID NO: 20477

SEQ ID NO: 60295 - DNA, 1905 bp, Bdellovibrio bacteriovorus; identical to SEQ ID NO: 20478
  CDS (1)..(1905)

SEQ ID NO: 60296 - protein, 634 aa, Bdellovibrio bacteriovorus; identical to SEQ ID NO: 20479

SEQ ID NO: 60297 - DNA, 1536 bp, Bdellovibrio bacteriovorus; identical to SEQ ID NO: 20480
  CDS (1)..(1536)

SEQ ID NO: 60298 - protein, 511 aa, Bdellovibrio bacteriovorus; identical to SEQ ID NO: 20481

SEQ ID NO: 60299 - DNA, 1650 bp, Bdellovibrio bacteriovorus; identical to SEQ ID NO: 20482
  CDS (1)..(1650)

SEQ ID NO: 60300 - protein, 549 aa, Bdellovibrio bacteriovorus; identical to SEQ ID NO: 20483

SEQ ID NO: 60301 - DNA, 1950 bp, Rhizobium sp; identical to SEQ ID NO: 20484
  CDS (1)..(1950)

SEQ ID NO: 60302 - protein, 649 aa, Rhizobium sp; identical to SEQ ID NO: 20485

SEQ ID NO: 60303 - DNA, 1959 bp, Desulfovibrio vulgaris; identical to SEQ ID NO: 20486
  CDS (1)..(1959)

SEQ ID NO: 60304 - protein, 652 aa, Desulfovibrio vulgaris; identical to SEQ ID NO: 20487

SEQ ID NO: 60305 - DNA, 1701 bp, Geobacter sulfurreducens; identical to SEQ ID NO: 20488
  CDS (1)..(1701)

SEQ ID NO: 60306 - protein, 566 aa, Geobacter sulfurreducens; identical to SEQ ID NO: 20489

SEQ ID NO: 60307 - DNA, 1485 bp, Geobacter sulfurreducens; identical to SEQ ID NO: 20490
  CDS (1)..(1485)

SEQ ID NO: 60308 - protein, 494 aa, Geobacter sulfurreducens; identical to SEQ ID NO: 20491

SEQ ID NO: 60309 - DNA, 1692 bp, Geobacter sulfurreducens; identical to SEQ ID NO: 20492
  CDS (1)..(1692)

SEQ ID NO: 60310 - protein, 563 aa, Geobacter sulfurreducens; identical to SEQ ID NO: 20493

SEQ ID NO: 60311 - DNA, 1707 bp, Geobacter sulfurreducens; identical to SEQ ID NO: 20494
  CDS (1)..(1707)

SEQ ID NO: 60312 - protein, 568 aa, Geobacter sulfurreducens; identical to SEQ ID NO: 20495

SEQ ID NO: 60313 - DNA, 2889 bp, Geobacter sulfurreducens; identical to SEQ ID NO: 20496
  CDS (1)..(2889)

SEQ ID NO: 60314 - protein, 962 aa, Geobacter sulfurreducens; identical to SEQ ID NO: 20497

SEQ ID NO: 60315 - DNA, 1590 bp, Geobacter sulfurreducens; identical to SEQ ID NO: 20498
  CDS (1)..(1590)

SEQ ID NO: 60316 - protein, 529 aa, Geobacter sulfurreducens; identical to SEQ ID NO: 20499

SEQ ID NO: 60317 - DNA, 2184 bp, Geobacter sulfurreducens; identical to SEQ ID NO: 20500
  CDS (1)..(2184)

SEQ ID NO: 60318 - protein, 727 aa, Geobacter sulfurreducens; identical to SEQ ID NO: 20501

SEQ ID NO: 60319 - DNA, 1701 bp, Yersinia pestis; identical to SEQ ID NO: 20502
  CDS (1)..(1701)

SEQ ID NO: 60320 - protein, 566 aa, Yersinia pestis; identical to SEQ ID NO: 20503

SEQ ID NO: 60321 - DNA, 1641 bp, Shigella flexneri; identical to SEQ ID NO: 20504
  CDS (1)..(1641)

SEQ ID NO: 60322 - protein, 546 aa, Shigella flexneri; identical to SEQ ID NO: 20505

SEQ ID NO: 60323 - DNA, 1995 bp, Wolinella succinogenes; identical to SEQ ID NO: 20506
  CDS (1)..(1995)

SEQ ID NO: 60324 - protein, 664 aa, Wolinella succinogenes; identical to SEQ ID NO: 20507

SEQ ID NO: 60325 - DNA, 1635 bp, Photorhabdus luminescens; identical to SEQ ID NO: 20508
  CDS (1)..(1635)

SEQ ID NO: 60326 - protein, 544 aa, Photorhabdus luminescens; identical to SEQ ID NO: 20509

SEQ ID NO: 60327 - DNA, 1695 bp, Photorhabdus luminescens; identical to SEQ ID NO: 20510
  CDS (1)..(1695)

SEQ ID NO: 60328 - protein, 564 aa, Photorhabdus luminescens; identical to SEQ ID NO: 20511

SEQ ID NO: 60329 - DNA, 2955 bp, Chromobacterium violaceum; identical to SEQ ID NO: 20512
  CDS (1)..(2955)

SEQ ID NO: 60330 - protein, 984 aa, Chromobacterium violaceum; identical to SEQ ID NO: 20513

SEQ ID NO: 60331 - DNA, 1620 bp, Chromobacterium violaceum; identical to SEQ ID NO: 20514
  CDS (1)..(1620)

SEQ ID NO: 60332 - protein, 539 aa, Chromobacterium violaceum; identical to SEQ ID NO: 20515

SEQ ID NO: 60333 - DNA, 1542 bp, Bordetella pertussis; identical to SEQ ID NO: 20516
  CDS (1)..(1542)

SEQ ID NO: 60334 - protein, 513 aa, Bordetella pertussis; identical to SEQ ID NO: 20517

SEQ ID NO: 60335 - DNA, 1620 bp, Bordetella pertussis; identical to SEQ ID NO: 20518
  CDS (1)..(1620)

SEQ ID NO: 60336 - protein, 539 aa, Bordetella pertussis; identical to SEQ ID NO: 20519

SEQ ID NO: 60337 - DNA, 1821 bp, Bordetella pertussis; identical to SEQ ID NO: 20520
  CDS (1)..(1821)

SEQ ID NO: 60338 - protein, 606 aa, Bordetella pertussis; identical to SEQ ID NO: 20521

SEQ ID NO: 60339 - DNA, 1707 bp, Bordetella pertussis; identical to SEQ ID NO: 20522
  CDS (1)..(1707)

SEQ ID NO: 60340 - protein, 568 aa, Bordetella pertussis; identical to SEQ ID NO: 20523

SEQ ID NO: 60341 - DNA, 1638 bp, Bordetella parapertussis; identical to SEQ ID NO: 20524
  CDS (1)..(1638)

SEQ ID NO: 60342 - protein, 545 aa, Bordetella parapertussis; identical to SEQ ID NO: 20525

SEQ ID NO: 60343 - DNA, 1668 bp, Bordetella parapertussis; identical to SEQ ID NO: 20526
  CDS (1)..(1668)

SEQ ID NO: 60344 - protein, 555 aa, Bordetella parapertussis; identical to SEQ ID NO: 20527

SEQ ID NO: 60345 - DNA, 1497 bp, Bordetella parapertussis; identical to SEQ ID NO: 20528
  CDS (1)..(1497)

SEQ ID NO: 60346 - protein, 498 aa, Bordetella parapertussis; identical to SEQ ID NO: 20529

SEQ ID NO: 60347 - DNA, 1659 bp, Bordetella bronchiseptica; identical to SEQ ID NO: 20530
  CDS (1)..(1659)

SEQ ID NO: 60348 - protein, 552 aa, Bordetella bronchiseptica; identical to SEQ ID NO: 20531

SEQ ID NO: 60349 - DNA, 1740 bp, Bordetella bronchiseptica; identical to SEQ ID NO: 20532
  CDS (1)..(1740)

SEQ ID NO: 60350 - protein, 579 aa, Bordetella bronchiseptica; identical to SEQ ID NO: 20533

SEQ ID NO: 60351 - DNA, 1599 bp, Bordetella bronchiseptica; identical to SEQ ID NO: 20534
  CDS (1)..(1599)

SEQ ID NO: 60352 - protein, 532 aa, Bordetella bronchiseptica; identical to SEQ ID NO: 20535

SEQ ID NO: 60353 - DNA, 1611 bp, Bordetella bronchiseptica; identical to SEQ ID NO: 20536
  CDS (1)..(1611)

SEQ ID NO: 60354 - protein, 536 aa, Bordetella bronchiseptica; identical to SEQ ID NO: 20537

SEQ ID NO: 60355 - DNA, 1842 bp, Treponema hyodysenteriae; identical to SEQ ID NO: 20538
  CDS (1)..(1842)

SEQ ID NO: 60356 - protein, 613 aa, Treponema hyodysenteriae; identical to SEQ ID NO: 20539

SEQ ID NO: 60357 - DNA, 1557 bp, Erwinia sp; identical to SEQ ID NO: 20540
  CDS (1)..(1557)

SEQ ID NO: 60358 - protein, 518 aa, Erwinia sp; identical to SEQ ID NO: 20541

SEQ ID NO: 60359 - DNA, 2259 bp, Nitrosomonas europaea; identical to SEQ ID NO: 20542
  CDS (1)..(2259)

SEQ ID NO: 60360 - protein, 752 aa, Nitrosomonas europaea; identical to SEQ ID NO: 20543

SEQ ID NO: 60361 - DNA, 2331 bp, Nitrosomonas europaea; identical to SEQ ID NO: 20544
  CDS (1)..(2331)

SEQ ID NO: 60362 - protein, 776 aa, Nitrosomonas europaea; identical to SEQ ID NO: 20545

SEQ ID NO: 60363 - DNA, 1863 bp, Erwinia chrysanthemi; identical to SEQ ID NO: 20546
  CDS (1)..(1863)

SEQ ID NO: 60364 - protein, 620 aa, Erwinia chrysanthemi; identical to SEQ ID NO: 20547

SEQ ID NO: 60365 - DNA, 1533 bp, Janthinobacterium sp; identical to SEQ ID NO: 20548
  CDS (1)..(1533)

SEQ ID NO: 60366 - protein, 510 aa, Janthinobacterium sp; identical to SEQ ID NO: 20549

SEQ ID NO: 60367 - DNA, 1656 bp, Pseudomonas syringae; identical to SEQ ID NO: 20550
  CDS (1)..(1656)

SEQ ID NO: 60368 - protein, 551 aa, Pseudomonas syringae; identical to SEQ ID NO: 20551

SEQ ID NO: 60369 - DNA, 1815 bp, Yersinia pestis; identical to SEQ ID NO: 20552
  CDS (1)..(1815)

SEQ ID NO: 60370 - protein, 604 aa, Yersinia pestis; identical to SEQ ID NO: 20553

SEQ ID NO: 60371 - DNA, 1611 bp, Yersinia pestis; identical to SEQ ID NO: 20554
  CDS (1)..(1611)

SEQ ID NO: 60372 - protein, 536 aa, Yersinia pestis; identical to SEQ ID NO: 20555

SEQ ID NO: 60373 - DNA, 1638 bp, Yersinia pestis; identical to SEQ ID NO: 20556
  CDS (1)..(1638)

SEQ ID NO: 60374 - protein, 545 aa, Yersinia pestis; identical to SEQ ID NO: 20557

SEQ ID NO: 60375 - DNA, 2424 bp, Vibrio vulnificus; identical to SEQ ID NO: 20558
  CDS (1)..(2424)

SEQ ID NO: 60376 - protein, 807 aa, Vibrio vulnificus; identical to SEQ ID NO: 20559

SEQ ID NO: 60377 - DNA, 1941 bp, Shewanella oneidensis; identical to SEQ ID NO: 20560
  CDS (1)..(1941)

SEQ ID NO: 60378 - protein, 646 aa, Shewanella oneidensis; identical to SEQ ID NO: 20561

SEQ ID NO: 60379 - DNA, 1965 bp, Shewanella oneidensis; identical to SEQ ID NO: 20562
  CDS (1)..(1965)

SEQ ID NO: 60380 - protein, 654 aa, Shewanella oneidensis; identical to SEQ ID NO: 20563

SEQ ID NO: 60381 - DNA, 2931 bp, Leptospira interrogans; identical to SEQ ID NO: 20564
  CDS (1)..(2931)

SEQ ID NO: 60382 - protein, 976 aa, Leptospira interrogans; identical to SEQ ID NO: 20565

SEQ ID NO: 60383 - DNA, 1521 bp, Escherichia coli O6; identical to SEQ ID NO: 20566
  CDS (1)..(1521)

SEQ ID NO: 60384 - protein, 506 aa, Escherichia coli O6; identical to SEQ ID NO: 20567

SEQ ID NO: 60385 - DNA, 2010 bp, Rhizobium etli; identical to SEQ ID NO: 20568
  CDS (1)..(2010)

SEQ ID NO: 60386 - protein, 669 aa, Rhizobium etli; identical to SEQ ID NO: 20569

SEQ ID NO: 60387 - DNA, 2535 bp, Rhizobium etli; identical to SEQ ID NO: 20570
  CDS (1)..(2535)

SEQ ID NO: 60388 - protein, 844 aa, Rhizobium etli; identical to SEQ ID NO: 20571

SEQ ID NO: 60389 - DNA, 2262 bp, Rhizobium etli; identical to SEQ ID NO: 20572
  CDS (1)..(2262)

SEQ ID NO: 60390 - protein, 753 aa, Rhizobium etli; identical to SEQ ID NO: 20573

SEQ ID NO: 60391 - DNA, 786 bp, Azotobacter vinelandii; identical to SEQ ID NO: 20574
  CDS (1)..(786)

SEQ ID NO: 60392 - protein, 261 aa, Azotobacter vinelandii; identical to SEQ ID NO: 20575

SEQ ID NO: 60393 - DNA, 1953 bp, Xanthomonas campestris; identical to SEQ ID NO: 20576
  CDS (1)..(1953)

SEQ ID NO: 60394 - protein, 650 aa, Xanthomonas campestris; identical to SEQ ID NO: 20577

SEQ ID NO: 60395 - DNA, 1869 bp, Xanthomonas campestris; identical to SEQ ID NO: 20578
  CDS (1)..(1869)

SEQ ID NO: 60396 - protein, 622 aa, Xanthomonas campestris; identical to SEQ ID NO: 20579

SEQ ID NO: 60397 - DNA, 1659 bp, Xanthomonas campestris; identical to SEQ ID NO: 20580
  CDS (1)..(1659)

SEQ ID NO: 60398 - protein, 552 aa, Xanthomonas campestris; identical to SEQ ID NO: 20581

SEQ ID NO: 60399 - DNA, 2040 bp, Xanthomonas campestris; identical to SEQ ID NO: 20582
  CDS (1)..(2040)

SEQ ID NO: 60400 - protein, 679 aa, Xanthomonas campestris; identical to SEQ ID NO: 20583

SEQ ID NO: 60401 - DNA, 1638 bp, Xanthomonas campestris; identical to SEQ ID NO: 20584
  CDS (1)..(1638)

SEQ ID NO: 60402 - protein, 545 aa, Xanthomonas campestris; identical to SEQ ID NO: 20585

SEQ ID NO: 60403 - DNA, 2058 bp, Xanthomonas campestris; identical to SEQ ID NO: 20586
  CDS (1)..(2058)

SEQ ID NO: 60404 - protein, 685 aa, Xanthomonas campestris; identical to SEQ ID NO: 20587

SEQ ID NO: 60405 - DNA, 2259 bp, Xanthomonas campestris; identical to SEQ ID NO: 20588
  CDS (1)..(2259)

SEQ ID NO: 60406 - protein, 752 aa, Xanthomonas campestris; identical to SEQ ID NO: 20589

SEQ ID NO: 60407 - DNA, 2019 bp, Xanthomonas campestris; identical to SEQ ID NO: 20590
  CDS (1)..(2019)

SEQ ID NO: 60408 - protein, 672 aa, Xanthomonas campestris; identical to SEQ ID NO: 20591

SEQ ID NO: 60409 - DNA, 2100 bp, Xanthomonas campestris; identical to SEQ ID NO: 20592
  CDS (1)..(2100)

SEQ ID NO: 60410 - protein, 699 aa, Xanthomonas campestris; identical to SEQ ID NO: 20593

SEQ ID NO: 60411 - DNA, 1356 bp, Xanthomonas campestris; identical to SEQ ID NO: 20594
  CDS (1)..(1356)

SEQ ID NO: 60412 - protein, 451 aa, Xanthomonas campestris; identical to SEQ ID NO: 20595

SEQ ID NO: 60413 - DNA, 2373 bp, Xanthomonas campestris; identical to SEQ ID NO: 20596
  CDS (1)..(2373)

SEQ ID NO: 60414 - protein, 790 aa, Xanthomonas campestris; identical to SEQ ID NO: 20597

SEQ ID NO: 60415 - DNA, 1974 bp, Xanthomonas campestris; identical to SEQ ID NO: 20598
  CDS (1)..(1974)

SEQ ID NO: 60416 - protein, 657 aa, Xanthomonas campestris; identical to SEQ ID NO: 20599

SEQ ID NO: 60417 - DNA, 2133 bp, Xanthomonas axonopodis; identical to SEQ ID NO: 20600
  CDS (1)..(2133)

SEQ ID NO: 60418 - protein, 710 aa, Xanthomonas axonopodis; identical to SEQ ID NO: 20601

SEQ ID NO: 60419 - DNA, 1911 bp, Xanthomonas axonopodis; identical to SEQ ID NO: 20602
  CDS (1)..(1911)

SEQ ID NO: 60420 - protein, 636 aa, Xanthomonas axonopodis; identical to SEQ ID NO: 20603

SEQ ID NO: 60421 - DNA, 1992 bp, Xanthomonas axonopodis; identical to SEQ ID NO: 20604
  CDS (1)..(1992)

SEQ ID NO: 60422 - protein, 663 aa, Xanthomonas axonopodis; identical to SEQ ID NO: 20605

SEQ ID NO: 60423 - DNA, 2001 bp, Xanthomonas axonopodis; identical to SEQ ID NO: 20606
  CDS (1)..(2001)

SEQ ID NO: 60424 - protein, 666 aa, Xanthomonas axonopodis; identical to SEQ ID NO: 20607

SEQ ID NO: 60425 - DNA, 2112 bp, Xanthomonas axonopodis; identical to SEQ ID NO: 20608
  CDS (1)..(2112)

SEQ ID NO: 60426 - protein, 703 aa, Xanthomonas axonopodis; identical to SEQ ID NO: 20609

SEQ ID NO: 60427 - DNA, 1989 bp, Xanthomonas axonopodis; identical to SEQ ID NO: 20610
  CDS (1)..(1989)

SEQ ID NO: 60428 - protein, 662 aa, Xanthomonas axonopodis; identical to SEQ ID NO: 20611

SEQ ID NO: 60429 - DNA, 2061 bp, Xanthomonas axonopodis; identical to SEQ ID NO: 20612
  CDS (1)..(2061)

SEQ ID NO: 60430 - protein, 686 aa, Xanthomonas axonopodis; identical to SEQ ID NO: 20613

SEQ ID NO: 60431 - DNA, 2304 bp, Xanthomonas axonopodis; identical to SEQ ID NO: 20614
  CDS (1)..(2304)

SEQ ID NO: 60432 - protein, 767 aa, Xanthomonas axonopodis; identical to SEQ ID NO: 20615

SEQ ID NO: 60433 - DNA, 2085 bp, Xanthomonas axonopodis; identical to SEQ ID NO: 20616
  CDS (1)..(2085)

SEQ ID NO: 60434 - protein, 694 aa, Xanthomonas axonopodis; identical to SEQ ID NO: 20617

SEQ ID NO: 60435 - DNA, 2079 bp, Xanthomonas axonopodis; identical to SEQ ID NO: 20618
  CDS (1)..(2079)

SEQ ID NO: 60436 - protein, 692 aa, Xanthomonas axonopodis; identical to SEQ ID NO: 20619

SEQ ID NO: 60437 - DNA, 2070 bp, Xanthomonas axonopodis; identical to SEQ ID NO: 20620
  CDS (1)..(2070)

SEQ ID NO: 60438 - protein, 689 aa, Xanthomonas axonopodis; identical to SEQ ID NO: 20621

SEQ ID NO: 60439 - DNA, 2064 bp, Xanthomonas axonopodis; identical to SEQ ID NO: 20622
  CDS (1)..(2064)

SEQ ID NO: 60440 - protein, 687 aa, Xanthomonas axonopodis; identical to SEQ ID NO: 20623

SEQ ID NO: 60441 - DNA, 1965 bp, Xanthomonas axonopodis; identical to SEQ ID NO: 20624
  CDS (1)..(1965)

SEQ ID NO: 60442 - protein, 654 aa, Xanthomonas axonopodis; identical to SEQ ID NO: 20625

SEQ ID NO: 60443 - DNA, 2088 bp, Xanthomonas axonopodis; identical to SEQ ID NO: 20626
  CDS (1)..(2088)

SEQ ID NO: 60444 - protein, 695 aa, Xanthomonas axonopodis; identical to SEQ ID NO: 20627

SEQ ID NO: 60445 - DNA, 2043 bp, Xanthomonas axonopodis; identical to SEQ ID NO: 20628
  CDS (1)..(2043)

SEQ ID NO: 60446 - protein, 680 aa, Xanthomonas axonopodis; identical to SEQ ID NO: 20629

SEQ ID NO: 60447 - DNA, 2013 bp, Xanthomonas axonopodis; identical to SEQ ID NO: 20630
  CDS (1)..(2013)

SEQ ID NO: 60448 - protein, 670 aa, Xanthomonas axonopodis; identical to SEQ ID NO: 20631

SEQ ID NO: 60449 - DNA, 1560 bp, Rhodovulum sulfidophilum; identical to SEQ ID NO: 20632
  CDS (1)..(1560)

SEQ ID NO: 60450 - protein, 519 aa, Rhodovulum sulfidophilum; identical to SEQ ID NO: 20633

SEQ ID NO: 60451 - DNA, 1422 bp, Burkholderia cepacia; identical to SEQ ID NO: 20634
  CDS (1)..(1422)

SEQ ID NO: 60452 - protein, 473 aa, Burkholderia cepacia; identical to SEQ ID NO: 20635

SEQ ID NO: 60453 - DNA, 1632 bp, Ralstonia solanacearum; identical to SEQ ID NO: 20636
  CDS (1)..(1632)

SEQ ID NO: 60454 - protein, 543 aa, Ralstonia solanacearum; identical to SEQ ID NO: 20637

SEQ ID NO: 60455 - DNA, 1545 bp, Ralstonia solanacearum; identical to SEQ ID NO: 20638
  CDS (1)..(1545)

SEQ ID NO: 60456 - protein, 514 aa, Ralstonia solanacearum; identical to SEQ ID NO: 20639

SEQ ID NO: 60457 - DNA, 1575 bp, Ralstonia solanacearum; identical to SEQ ID NO: 20640
  CDS (1)..(1575)

SEQ ID NO: 60458 - protein, 524 aa, Ralstonia solanacearum; identical to SEQ ID NO: 20641

SEQ ID NO: 60459 - DNA, 1542 bp, Ralstonia solanacearum; identical to SEQ ID NO: 20642
  CDS (1)..(1542)

SEQ ID NO: 60460 - protein, 513 aa, Ralstonia solanacearum; identical to SEQ ID NO: 20643

SEQ ID NO: 60461 - DNA, 1575 bp, Ralstonia solanacearum; identical to SEQ ID NO: 20644
  CDS (1)..(1575)

SEQ ID NO: 60462 - protein, 524 aa, Ralstonia solanacearum; identical to SEQ ID NO: 20645

SEQ ID NO: 60463 - DNA, 1557 bp, Ralstonia solanacearum; identical to SEQ ID NO: 20646
  CDS (1)..(1557)

SEQ ID NO: 60464 - protein, 518 aa, Ralstonia solanacearum; identical to SEQ ID NO: 20647

SEQ ID NO: 60465 - DNA, 1803 bp, Ralstonia solanacearum; identical to SEQ ID NO: 20648
  CDS (1)..(1803)

SEQ ID NO: 60466 - protein, 600 aa, Ralstonia solanacearum; identical to SEQ ID NO: 20649

SEQ ID NO: 60467 - DNA, 1548 bp, Ralstonia solanacearum; identical to SEQ ID NO: 20650
  CDS (1)..(1548)

SEQ ID NO: 60468 - protein, 515 aa, Ralstonia solanacearum; identical to SEQ ID NO: 20651

SEQ ID NO: 60469 - DNA, 1590 bp, Ralstonia solanacearum; identical to SEQ ID NO: 20652
  CDS (1)..(1590)

SEQ ID NO: 60470 - protein, 529 aa, Ralstonia solanacearum; identical to SEQ ID NO: 20653

SEQ ID NO: 60471 - DNA, 1548 bp, Ralstonia solanacearum; identical to SEQ ID NO: 20654
  CDS (1)..(1548)

SEQ ID NO: 60472 - protein, 515 aa, Ralstonia solanacearum; identical to SEQ ID NO: 20655

SEQ ID NO: 60473 - DNA, 1941 bp, Ralstonia solanacearum; identical to SEQ ID NO: 20656
  CDS (1)..(1941)

SEQ ID NO: 60474 - protein, 646 aa, Ralstonia solanacearum; identical to SEQ ID NO: 20657

SEQ ID NO: 60475 - DNA, 1986 bp, Ralstonia solanacearum; identical to SEQ ID NO: 20658
  CDS (1)..(1986)

SEQ ID NO: 60476 - protein, 661 aa, Ralstonia solanacearum; identical to SEQ ID NO: 20659

SEQ ID NO: 60477 - DNA, 1548 bp, Ralstonia solanacearum; identical to SEQ ID NO: 20660
  CDS (1)..(1548)

SEQ ID NO: 60478 - protein, 515 aa, Ralstonia solanacearum; identical to SEQ ID NO: 20661

SEQ ID NO: 60479 - DNA, 990 bp, Ralstonia solanacearum; identical to SEQ ID NO: 20662
  CDS (1)..(990)

SEQ ID NO: 60480 - protein, 329 aa, Ralstonia solanacearum; identical to SEQ ID NO: 20663

SEQ ID NO: 60481 - DNA, 1608 bp, Ralstonia solanacearum; identical to SEQ ID NO: 20664
  CDS (1)..(1608)

SEQ ID NO: 60482 - protein, 535 aa, Ralstonia solanacearum; identical to SEQ ID NO: 20665

SEQ ID NO: 60483 - DNA, 1542 bp, Ralstonia solanacearum; identical to SEQ ID NO: 20666
  CDS (1)..(1542)

SEQ ID NO: 60484 - protein, 513 aa, Ralstonia solanacearum; identical to SEQ ID NO: 20667

SEQ ID NO: 60485 - DNA, 1545 bp, Ralstonia solanacearum; identical to SEQ ID NO: 20668
  CDS (1)..(1545)

SEQ ID NO: 60486 - protein, 514 aa, Ralstonia solanacearum; identical to SEQ ID NO: 20669

SEQ ID NO: 60487 - DNA, 1803 bp, Ralstonia solanacearum; identical to SEQ ID NO: 20670
  CDS (1)..(1803)

SEQ ID NO: 60488 - protein, 600 aa, Ralstonia solanacearum; identical to SEQ ID NO: 20671

SEQ ID NO: 60489 - DNA, 1890 bp, Ralstonia solanacearum; identical to SEQ ID NO: 20672
  CDS (1)..(1890)

SEQ ID NO: 60490 - protein, 629 aa, Ralstonia solanacearum; identical to SEQ ID NO: 20673

SEQ ID NO: 60491 - DNA, 1854 bp, Ralstonia solanacearum; identical to SEQ ID NO: 20674
  CDS (1)..(1854)

SEQ ID NO: 60492 - protein, 617 aa, Ralstonia solanacearum; identical to SEQ ID NO: 20675

SEQ ID NO: 60493 - DNA, 1662 bp, Salmonella typhimurium; identical to SEQ ID NO: 20676
  CDS (1)..(1662)

SEQ ID NO: 60494 - protein, 553 aa, Salmonella typhimurium; identical to SEQ ID NO: 20677

SEQ ID NO: 60495 - DNA, 1521 bp, Salmonella typhimurium; identical to SEQ ID NO: 20678
  CDS (1)..(1521)

SEQ ID NO: 60496 - protein, 506 aa, Salmonella typhimurium; identical to SEQ ID NO: 20679

SEQ ID NO: 60497 - DNA, 1644 bp, Salmonella typhimurium; identical to SEQ ID NO: 20680
  CDS (1)..(1644)

SEQ ID NO: 60498 - protein, 547 aa, Salmonella typhimurium; identical to SEQ ID NO: 20681

SEQ ID NO: 60499 - DNA, 1155 bp, Salmonella typhimurium; identical to SEQ ID NO: 20682
  CDS (1)..(1155)

SEQ ID NO: 60500 - protein, 384 aa, Salmonella typhimurium; identical to SEQ ID NO: 20683

SEQ ID NO: 60501 - DNA, 1626 bp, Salmonella typhimurium; identical to SEQ ID NO: 20684
  CDS (1)..(1626)

SEQ ID NO: 60502 - protein, 541 aa, Salmonella typhimurium; identical to SEQ ID NO: 20685

SEQ ID NO: 60503 - DNA, 1782 bp, Rhizobium meliloti; identical to SEQ ID NO: 20686
  CDS (1)..(1782)

SEQ ID NO: 60504 - protein, 593 aa, Rhizobium meliloti; identical to SEQ ID NO: 20687

SEQ ID NO: 60505 - DNA, 2070 bp, Rhizobium meliloti; identical to SEQ ID NO: 20688
  CDS (1)..(2070)

SEQ ID NO: 60506 - protein, 689 aa, Rhizobium meliloti; identical to SEQ ID NO: 20689

SEQ ID NO: 60507 - DNA, 2526 bp, Rhizobium meliloti; identical to SEQ ID NO: 20690
  CDS (1)..(2526)

SEQ ID NO: 60508 - protein, 841 aa, Rhizobium meliloti; identical to SEQ ID NO: 20691

SEQ ID NO: 60509 - DNA, 1998 bp, Rhizobium meliloti; identical to SEQ ID NO: 20692
  CDS (1)..(1998)

SEQ ID NO: 60510 - protein, 665 aa, Rhizobium meliloti; identical to SEQ ID NO: 20693

SEQ ID NO: 60511 - DNA, 2367 bp, Rhizobium meliloti; identical to SEQ ID NO: 20694
  CDS (1)..(2367)

SEQ ID NO: 60512 - protein, 788 aa, Rhizobium meliloti; identical to SEQ ID NO: 20695

SEQ ID NO: 60513 - DNA, 1665 bp, Rahnella aquatilis; identical to SEQ ID NO: 20696
  CDS (1)..(1665)

SEQ ID NO: 60514 - protein, 554 aa, Rahnella aquatilis; identical to SEQ ID NO: 20697

SEQ ID NO: 60515 - DNA, 1587 bp, Agrobacterium tumefaciens; identical to SEQ ID NO: 20698
  CDS (1)..(1587)

SEQ ID NO: 60516 - protein, 528 aa, Agrobacterium tumefaciens; identical to SEQ ID NO: 20699

SEQ ID NO: 60517 - DNA, 1857 bp, Agrobacterium rhizogenes; identical to SEQ ID NO: 20700
  CDS (1)..(1857)

SEQ ID NO: 60518 - protein, 618 aa, Agrobacterium rhizogenes; identical to SEQ ID NO: 20701

SEQ ID NO: 60519 - DNA, 1815 bp, Rhizobium meliloti; identical to SEQ ID NO: 20702
  CDS (1)..(1815)

SEQ ID NO: 60520 - protein, 604 aa, Rhizobium meliloti; identical to SEQ ID NO: 20703

SEQ ID NO: 60521 - DNA, 2124 bp, Rhizobium meliloti; identical to SEQ ID NO: 20704
  CDS (1)..(2124)

SEQ ID NO: 60522 - protein, 707 aa, Rhizobium meliloti; identical to SEQ ID NO: 20705

SEQ ID NO: 60523 - DNA, 1524 bp, Erwinia amylovora; identical to SEQ ID NO: 20706
  CDS (1)..(1524)

SEQ ID NO: 60524 - protein, 507 aa, Erwinia amylovora; identical to SEQ ID NO: 20707

SEQ ID NO: 60525 - DNA, 2172 bp, Agrobacterium rhizogenes; identical to SEQ ID NO: 20708
  CDS (1)..(2172)

SEQ ID NO: 60526 - protein, 723 aa, Agrobacterium rhizogenes; identical to SEQ ID NO: 20709

SEQ ID NO: 60527 - DNA, 2277 bp, Agrobacterium rhizogenes; identical to SEQ ID NO: 20710
  CDS (1)..(2277)

SEQ ID NO: 60528 - protein, 758 aa, Agrobacterium rhizogenes; identical to SEQ ID NO: 20711

SEQ ID NO: 60529 - DNA, 1725 bp, Agrobacterium tumefaciens; identical to SEQ ID NO: 20712
  CDS (1)..(1725)

SEQ ID NO: 60530 - protein, 574 aa, Agrobacterium tumefaciens; identical to SEQ ID NO: 20713

SEQ ID NO: 60531 - DNA, 2410 bp, Rhizobium leguminosarum; identical to SEQ ID NO: 20714
  CDS (37)..(1998)

SEQ ID NO: 60532 - protein, 653 aa, Rhizobium leguminosarum; identical to SEQ ID NO: 20715

SEQ ID NO: 60533 - DNA, 3600 bp, Desulfovibrio gigas; identical to SEQ ID NO: 20716
  CDS (302)..(2251)

SEQ ID NO: 60534 - protein, 649 aa, Desulfovibrio gigas; identical to SEQ ID NO: 20717

SEQ ID NO: 60535 - DNA, 1662 bp, Salmonella typhimurium; identical to SEQ ID NO: 20718
  CDS (1)..(1662)

SEQ ID NO: 60536 - protein, 553 aa, Salmonella typhimurium; identical to SEQ ID NO: 20719

SEQ ID NO: 60537 - DNA, 24 bp, Primer
atgattaaccgtatccgcgtagtc

SEQ ID NO: 60538 - DNA, 27 bp, Primer
ttaaaatgtttcccagtttggatcttg

SEQ ID NO: 60539 - protein, 350 aa, consensus; identical to SEQ ID NO: 30281
  MISC_FEATURE (1)..(350): consensus for the disclosure of xaa see table XV

SEQ ID NO: 60540 - protein, 71 aa, consensus; identical to SEQ ID NO: 22551
  MISC_FEATURE (1)..(71): consensus for the disclosure of xaa see table XV

SEQ ID NO: 60541 - DNA, 2200 bp, Escherichia coli K12; identical to SEQ ID NO: 17198
  CDS (776)..(2200)

SEQ ID NO: 60542 - protein, 474 aa, Escherichia coli K12; identical to SEQ ID NO: 17199

SEQ ID NO: 60543 - DNA, 3053 bp, Arabidopsis thaliana (mouse-ear cress); identical to SEQ ID NO: 17200
  CDS (1)..(2556)

SEQ ID NO: 60544 - protein, 851 aa, Arabidopsis thaliana (mouse-ear cress); identical to SEQ ID NO: 17201

SEQ ID NO: 60545 - DNA, 1422 bp, Salmonella enterica subsp. enterica serovar Typhi; identical to SEQ ID NO: 17202
  CDS (1)..(1422)

SEQ ID NO: 60546 - protein, 473 aa, Salmonella enterica subsp. enterica serovar Typhi; identical to SEQ ID NO: 17203

SEQ ID NO: 60547 - DNA, 1497 bp, Mycobacterium leprae; identical to SEQ ID NO: 17204
  CDS (1)..(1497)

SEQ ID NO: 60548 - protein, 498 aa, Mycobacterium leprae; identical to SEQ ID NO: 17205

SEQ ID NO: 60549 - DNA, 2829 bp, Arabidopsis thaliana (mouse-ear cress); identical to SEQ ID NO: 17206
  CDS (1)..(2829)

SEQ ID NO: 60550 - protein, 942 aa, Arabidopsis thaliana (mouse-ear cress); identical to SEQ ID NO: 17207

SEQ ID NO: 60551 - DNA, 1491 bp, Methanobacterium thermoautotrophicum; identical to SEQ ID NO: 17208
  CDS (1)..(1491)

SEQ ID NO: 60552 - protein, 496 aa, Methanobacterium thermoautotrophicum; identical to SEQ ID NO: 17209

SEQ ID NO: 60553 - DNA, 1392 bp, Sinorhizobium meliloti; identical to SEQ ID NO: 17210
  CDS (1)..(1392)

SEQ ID NO: 60554 - protein, 463 aa, Sinorhizobium meliloti; identical to SEQ ID NO: 17211

SEQ ID NO: 60555 - DNA, 1503 bp, Mycobacterium tuberculosis; identical to SEQ ID NO: 17212
  CDS (1)..(1503)

SEQ ID NO: 60556 - protein, 500 aa, Mycobacterium tuberculosis; identical to SEQ ID NO: 17213

SEQ ID NO: 60557 - DNA, 2091 bp, Saccharomyces cerevisiae; identical to SEQ ID NO: 17214
  CDS (233)..(1720)

SEQ ID NO: 60558 - protein, 495 aa, Saccharomyces cerevisiae; identical to SEQ ID NO: 17215

SEQ ID NO: 60559 - DNA, 5981 bp, Saccharomyces cerevisiae; identical to SEQ ID NO: 17216
  CDS (2282)..(5578)

SEQ ID NO: 60560 - protein, 1098 aa, Saccharomyces cerevisiae; identical to SEQ ID NO: 17217

SEQ ID NO: 60561 - DNA, 2358 bp, Kluyveromyces marxianus var. lactis, Candida sphaerica; identical to SEQ ID NO: 17218
  CDS (722)..(2188)

SEQ ID NO: 60562 - protein, 488 aa, Kluyveromyces marxianus var. lactis, Candida sphaerica; identical to SEQ ID NO: 17219

SEQ ID NO: 60563 - DNA, 3170 bp, Saccharomyces cerevisiae; identical to SEQ ID NO: 17220
  CDS (147)..(2837)

SEQ ID NO: 60564 - protein, 896 aa, Saccharomyces cerevisiae; identical to SEQ ID NO: 17221

SEQ ID NO: 60565 - DNA, 1500 bp, Synechocystis sp; identical to SEQ ID NO: 17222
  CDS (1)..(1500)

SEQ ID NO: 60566 - protein, 499 aa, Synechocystis sp; identical to SEQ ID NO: 17223

SEQ ID NO: 60567 - DNA, 2586 bp, Arabidopsis thaliana (mouse-ear cress); identical to SEQ ID NO: 17224
  CDS (1)..(2586)

SEQ ID NO: 60568 - protein, 861 aa, Arabidopsis thaliana (mouse-ear cress); identical to SEQ ID NO: 17225

SEQ ID NO: 60569 - DNA, 2388 bp, Arabidopsis thaliana (mouse-ear cress); identical to SEQ ID NO: 17226
  CDS (1)..(2388)

SEQ ID NO: 60570 - protein, 795 aa, Arabidopsis thaliana (mouse-ear cress); identical to SEQ ID NO: 17227

SEQ ID NO: 60571 - DNA, 2676 bp, Schizosaccharomyces pombe; identical to SEQ ID NO: 17228
  CDS (1)..(2676)

SEQ ID NO: 60572 - protein, 891 aa, Schizosaccharomyces pombe; identical to SEQ ID NO: 17229

SEQ ID NO: 60573 - DNA, 2550 bp, Schizosaccharomyces pombe; identical to SEQ ID NO: 17230
  CDS (1)..(2550)

SEQ ID NO: 60574 - protein, 849 aa, Schizosaccharomyces pombe; identical to SEQ ID NO: 17231

SEQ ID NO: 60575 - DNA, 2835 bp, Schizosaccharomyces pombe; identical to SEQ ID NO: 17232
  CDS (1)..(2835)

SEQ ID NO: 60576 - protein, 944 aa, Schizosaccharomyces pombe; identical to SEQ ID NO: 17233

SEQ ID NO: 60577 - DNA, 2580 bp, Schizosaccharomyces pombe; identical to SEQ ID NO: 17234
  CDS (52)..(2505)

SEQ ID NO: 60578 - protein, 817 aa, Schizosaccharomyces pombe; identical to SEQ ID NO: 17235

SEQ ID NO: 60579 - DNA, 1993 bp, Schizosaccharomyces pombe; identical to SEQ ID NO: 17236
  CDS (266)..(1705)

SEQ ID NO: 60580 - protein, 479 aa, Schizosaccharomyces pombe; identical to SEQ ID NO: 17237

SEQ ID NO: 60581 - DNA, 2621 bp, unidentified; identical to SEQ ID NO: 17238
  CDS (25)..(2487)

SEQ ID NO: 60582 - protein, 820 aa, unidentified; identical to SEQ ID NO: 17239

SEQ ID NO: 60583 - DNA, 2640 bp, Helianthus annuus; identical to SEQ ID NO: 17240
  CDS (171)..(2510)

SEQ ID NO: 60584 - protein, 779 aa, Helianthus annuus; identical to SEQ ID NO: 17241

SEQ ID NO: 60585 - DNA, 1913 bp, Selaginella lepidophylla; identical to SEQ ID NO: 17242
  CDS (111)..(1913)

SEQ ID NO: 60586 - protein, 600 aa, Selaginella lepidophylla; identical to SEQ ID NO: 17243

SEQ ID NO: 60587 - DNA, 4351 bp, Caenorhabditis elegans; identical to SEQ ID NO: 17244
  CDS (112)..(3996)

SEQ ID NO: 60588 - protein, 1294 aa, Caenorhabditis elegans; identical to SEQ ID NO: 17245

SEQ ID NO: 60589 - DNA, 2637 bp, Debaryomyces hansenii; identical to SEQ ID NO: 17246
  CDS (1)..(2637)

SEQ ID NO: 60590 - protein, 878 aa, Debaryomyces hansenii; identical to SEQ ID NO: 17247

SEQ ID NO: 60591 - DNA, 1443 bp, Debaryomyces hansenii; identical to SEQ ID NO: 17248
  CDS (1)..(1443)

SEQ ID NO: 60592 - protein, 480 aa, Debaryomyces hansenii; identical to SEQ ID NO: 17249

SEQ ID NO: 60593 - DNA, 2403 bp, Yarrowia lipolytica; identical to SEQ ID NO: 17250
  CDS (1)..(2403)

SEQ ID NO: 60594 - protein, 800 aa, Yarrowia lipolytica; identical to SEQ ID NO: 17251

SEQ ID NO: 60595 - DNA, 3447 bp, Kluyveromyces lactis; identical to SEQ ID NO: 17252
  CDS (1)..(3447)

SEQ ID NO: 60596 - protein, 1148 aa, Kluyveromyces lactis; identical to SEQ ID NO: 17253

SEQ ID NO: 60597 - DNA, 2631 bp, Kluyveromyces lactis; identical to SEQ ID NO: 17254
  CDS (1)..(2631)

SEQ ID NO: 60598 - protein, 876 aa, Kluyveromyces lactis; identical to SEQ ID NO: 17255

SEQ ID NO: 60599 - DNA, 1437 bp, Acinetobacter sp; identical to SEQ ID NO: 17256
  CDS (1)..(1437)

SEQ ID NO: 60600 - protein, 478 aa, Acinetobacter sp; identical to SEQ ID NO: 17257

SEQ ID NO: 60601 - DNA, 1476 bp, Candida glabrata; identical to SEQ ID NO: 17258
  CDS (1)..(1476)

SEQ ID NO: 60602 - protein, 491 aa, Candida glabrata; identical to SEQ ID NO: 17259

SEQ ID NO: 60603 - DNA, 3198 bp, Candida glabrata; identical to SEQ ID NO: 17260
  CDS (1)..(3198)

SEQ ID NO: 60604 - protein, 1065 aa, Candida glabrata; identical to SEQ ID NO: 17261

SEQ ID NO: 60605 - DNA, 3345 bp, Candida glabrata; identical to SEQ ID NO: 17262
  CDS (1)..(3345)

SEQ ID NO: 60606 - protein, 1114 aa, Candida glabrata; identical to SEQ ID NO: 17263

SEQ ID NO: 60607 - DNA, 2673 bp, Candida glabrata; identical to SEQ ID NO: 17264
  CDS (1)..(2673)

SEQ ID NO: 60608 - protein, 890 aa, Candida glabrata; identical to SEQ ID NO: 17265

SEQ ID NO: 60609 - DNA, 2013 bp, Cryptococcus neoformans var; identical to SEQ ID NO: 17266
  CDS (1)..(2013)

SEQ ID NO: 60610 - protein, 670 aa, Cryptococcus neoformans var; identical to SEQ ID NO: 17267

SEQ ID NO: 60611 - DNA, 1302 bp, Picrophilus torridus; identical to SEQ ID NO: 17268
  CDS (1)..(1302)

SEQ ID NO: 60612 - protein, 433 aa, Picrophilus torridus; identical to SEQ ID NO: 17269

SEQ ID NO: 60613 - DNA, 1482 bp, Rhodopseudomonas palustris; identical to SEQ ID NO: 17270
  CDS (1)..(1482)

SEQ ID NO: 60614 - protein, 493 aa, Rhodopseudomonas palustris; identical to SEQ ID NO: 17271

SEQ ID NO: 60615 - DNA, 1440 bp, Corynebacterium diphtheriae; identical to SEQ ID NO: 17272
  CDS (1)..(1440)

SEQ ID NO: 60616 - protein, 479 aa, Corynebacterium diphtheriae; identical to SEQ ID NO: 17273

SEQ ID NO: 60617 - DNA, 2589 bp, Oryza sativa; identical to SEQ ID NO: 17274
  CDS (1)..(2589)

SEQ ID NO: 60618 - protein, 862 aa, Oryza sativa; identical to SEQ ID NO: 17275

SEQ ID NO: 60619 - DNA, 2812 bp, Oryza sativa; identical to SEQ ID NO: 17276
  CDS (53)..(2527)

SEQ ID NO: 60620 - protein, 824 aa, Oryza sativa; identical to SEQ ID NO: 17277

SEQ ID NO: 60621 - DNA, 2208 bp, Thermoproteus tenax; identical to SEQ ID NO: 17278
  CDS (1)..(2208)

SEQ ID NO: 60622 - protein, 735 aa, Thermoproteus tenax; identical to SEQ ID NO: 17279

SEQ ID NO: 60623 - DNA, 1479 bp, Mycobacterium paratuberculosis; identical to SEQ ID NO: 17280
  CDS (1)..(1479)

SEQ ID NO: 60624 - protein, 492 aa, Mycobacterium paratuberculosis; identical to SEQ ID NO: 17281

SEQ ID NO: 60625 - DNA, 1461 bp, Geobacter sulfurreducens; identical to SEQ ID NO: 17282
  CDS (1)..(1461)

SEQ ID NO: 60626 - protein, 486 aa, Geobacter sulfurreducens; identical to SEQ ID NO: 17283

SEQ ID NO: 60627 - DNA, 3333 bp, Ashbya gossypii; identical to SEQ ID NO: 17284
  CDS (1)..(3333)

SEQ ID NO: 60628 - protein, 1110 aa, Ashbya gossypii; identical to SEQ ID NO: 17285

SEQ ID NO: 60629 - DNA, 1485 bp, Ashbya gossypii; identical to SEQ ID NO: 17286
  CDS (1)..(1485)

SEQ ID NO: 60630 - protein, 494 aa, Ashbya gossypii; identical to SEQ ID NO: 17287

SEQ ID NO: 60631 - DNA, 3498 bp, Oryza sativa; identical to SEQ ID NO: 17288
  CDS (176)..(2875)

SEQ ID NO: 60632 - protein, 899 aa, Oryza sativa; identical to SEQ ID NO: 17289

SEQ ID NO: 60633 - DNA, 3048 bp, Neurospora crassa; identical to SEQ ID NO: 17290
  CDS (1)..(3048)

SEQ ID NO: 60634 - protein, 1015 aa, Neurospora crassa; identical to SEQ ID NO: 17291

SEQ ID NO: 60635 - DNA, 1572 bp, Neurospora crassa; identical to SEQ ID NO: 17292
  CDS (1)..(1572)

SEQ ID NO: 60636 - protein, 523 aa, Neurospora crassa; identical to SEQ ID NO: 17293

SEQ ID NO: 60637 - DNA, 2730 bp, Neurospora crassa; identical to SEQ ID NO: 17294
  CDS (1)..(2730)

SEQ ID NO: 60638 - protein, 909 aa, Neurospora crassa; identical to SEQ ID NO: 17295

SEQ ID NO: 60639 - DNA, 1488 bp, Synechococcus sp; identical to SEQ ID NO: 17296
  CDS (1)..(1488)

SEQ ID NO: 60640 - protein, 495 aa, Synechococcus sp; identical to SEQ ID NO: 17297

SEQ ID NO: 60641 - DNA, 1350 bp, Thermus thermophilus; identical to SEQ ID NO: 17298
  CDS (1)..(1350)

SEQ ID NO: 60642 - protein, 449 aa, Thermus thermophilus; identical to SEQ ID NO: 17299

SEQ ID NO: 60643 - DNA, 3862 bp, Caenorhabditis elegans; identical to SEQ ID NO: 17300
  CDS (30)..(3722)

SEQ ID NO: 60644 - protein, 1230 aa, Caenorhabditis elegans; identical to SEQ ID NO: 17301

SEQ ID NO: 60645 - DNA, 1590 bp, Magnaporthe grisea; identical to SEQ ID NO: 17302
  CDS (1)..(1590)

SEQ ID NO: 60646 - protein, 529 aa, Magnaporthe grisea; identical to SEQ ID NO: 17303

SEQ ID NO: 60647 - DNA, 1485 bp, Bradyrhizobium japonicum; identical to SEQ ID NO: 17304
  CDS (1)..(1485)

SEQ ID NO: 60648 - protein, 494 aa, Bradyrhizobium japonicum; identical to SEQ ID NO: 17305

SEQ ID NO: 60649 - DNA, 1449 bp, Corynebacterium efficiens; identical to SEQ ID NO: 17306
  CDS (1)..(1449)

SEQ ID NO: 60650 - protein, 482 aa, Corynebacterium efficiens; identical to SEQ ID NO: 17307

SEQ ID NO: 60651 - DNA, 2774 bp, Arabidopsis thaliana; identical to SEQ ID NO: 17308
  CDS (102)..(2690)

SEQ ID NO: 60652 - protein, 862 aa, Arabidopsis thaliana; identical to SEQ ID NO: 17309

SEQ ID NO: 60653 - DNA, 2583 bp, Oryza sativa; identical to SEQ ID NO: 17310
  CDS (1)..(2583)

SEQ ID NO: 60654 - protein, 860 aa, Oryza sativa; identical to SEQ ID NO: 17311

SEQ ID NO: 60655 - DNA, 1458 bp, Corynebacterium glutamicum; identical to SEQ ID NO: 17312
  CDS (1)..(1458)

SEQ ID NO: 60656 - protein, 485 aa, Corynebacterium glutamicum; identical to SEQ ID NO: 17313

SEQ ID NO: 60657 - DNA, 2358 bp, Xanthomonas campestris; identical to SEQ ID NO: 17314
  CDS (1)..(2358)

SEQ ID NO: 60658 - protein, 785 aa, Xanthomonas campestris; identical to SEQ ID NO: 17315

SEQ ID NO: 60659 - DNA, 1368 bp, Xanthomonas axonopodis; identical to SEQ ID NO: 17316
  CDS (1)..(1368)

SEQ ID NO: 60660 - protein, 455 aa, Xanthomonas axonopodis; identical to SEQ ID NO: 17317

SEQ ID NO: 60661 - DNA, 2574 bp, Solanum tuberosum; identical to SEQ ID NO: 17318
  CDS (1)..(2574)

SEQ ID NO: 60662 - protein, 857 aa, Solanum tuberosum; identical to SEQ ID NO: 17319

SEQ ID NO: 60663 - DNA, 1380 bp, Encephalitozoon cuniculi; identical to SEQ ID NO: 17320
  CDS (1)..(1380)

SEQ ID NO: 60664 - protein, 459 aa, Encephalitozoon cuniculi; identical to SEQ ID NO: 17321

SEQ ID NO: 60665 - DNA, 1398 bp, Ralstonia solanacearum; identical to SEQ ID NO: 17322
  CDS (1)..(1398)

SEQ ID NO: 60666 - protein, 465 aa, Ralstonia solanacearum; identical to SEQ ID NO: 17323

SEQ ID NO: 60667 - DNA, 1674 bp, Ralstonia solanacearum; identical to SEQ ID NO: 17324
  CDS (1)..(1674)

SEQ ID NO: 60668 - protein, 557 aa, Ralstonia solanacearum; identical to SEQ ID NO: 17325

SEQ ID NO: 60669 - DNA, 2214 bp, Pyrobaculum aerophilum; identical to SEQ ID NO: 17326
  CDS (1)..(2214)

SEQ ID NO: 60670 - protein, 737 aa, Pyrobaculum aerophilum; identical to SEQ ID NO: 17327

SEQ ID NO: 60671 - DNA, 3001 bp, Arabidopsis thaliana; identical to SEQ ID NO: 17328
  CDS (204)..(2306)

SEQ ID NO: 60672 - protein, 700 aa, Arabidopsis thaliana; identical to SEQ ID NO: 17329

SEQ ID NO: 60673 - DNA, 3272 bp, Oryza sativa; identical to SEQ ID NO: 17330
  CDS (247)..(2985)

SEQ ID NO: 60674 - protein, 912 aa, Oryza sativa; identical to SEQ ID NO: 17331

SEQ ID NO: 60675 - DNA, 1681 bp, Amanita muscaria; identical to SEQ ID NO: 17332
  CDS (101)..(1552)

SEQ ID NO: 60676 - protein, 483 aa, Amanita muscaria; identical to SEQ ID NO: 17333

SEQ ID NO: 60677 - DNA, 1344 bp, Thermoplasma volcanium; identical to SEQ ID NO: 17334
  CDS (1)..(1344)

SEQ ID NO: 60678 - protein, 447 aa, Thermoplasma volcanium; identical to SEQ ID NO: 17335

SEQ ID NO: 60679 - DNA, 1563 bp, Rhizobium loti; identical to SEQ ID NO: 17336
  CDS (1)..(1563)

SEQ ID NO: 60680 - protein, 520 aa, Rhizobium loti; identical to SEQ ID NO: 17337

SEQ ID NO: 60681 - DNA, 2637 bp, Oryza sativa; identical to SEQ ID NO: 17338
  CDS (1)..(2637)

SEQ ID NO: 60682 - protein, 878 aa, Oryza sativa; identical to SEQ ID NO: 17339

SEQ ID NO: 60683 - DNA, 1326 bp, Thermoplasma acidophilum; identical to SEQ ID NO: 17340
  CDS (1)..(1326)

SEQ ID NO: 60684 - protein, 441 aa, Thermoplasma acidophilum; identical to SEQ ID NO: 17341

SEQ ID NO: 60685 - DNA, 1389 bp, Streptomyces coelicolor; identical to SEQ ID NO: 17342
  CDS (1)..(1389)

SEQ ID NO: 60686 - protein, 462 aa, Streptomyces coelicolor; identical to SEQ ID NO: 17343

SEQ ID NO: 60687 - DNA, 2635 bp, Arabidopsis thaliana; identical to SEQ ID NO: 17344
  CDS (1)..(2604)

SEQ ID NO: 60688 - protein, 867 aa, Arabidopsis thaliana; identical to SEQ ID NO: 17345

SEQ ID NO: 60689 - DNA, 2843 bp, Zygosaccharomyces rouxii; identical to SEQ ID NO: 17346
  CDS (24)..(2726)

SEQ ID NO: 60690 - protein, 900 aa, Zygosaccharomyces rouxii; identical to SEQ ID NO: 17347

SEQ ID NO: 60691 - DNA, 3197 bp, Drosophila melanogaster; identical to SEQ ID NO: 17348
  CDS (662)..(3091)

SEQ ID NO: 60692 - protein, 809 aa, Drosophila melanogaster; identical to SEQ ID NO: 17349

SEQ ID NO: 60693 - DNA, 1503 bp, Pseudomonas anguilliseptica; identical to SEQ ID NO: 17350
  CDS (1)..(1503)

SEQ ID NO: 60694 - protein, 500 aa, Pseudomonas anguilliseptica; identical to SEQ ID NO: 17351

SEQ ID NO: 60695 - DNA, 1503 bp, Synechococcus sp; identical to SEQ ID NO: 17352
  CDS (1)..(1503)

SEQ ID NO: 60696 - protein, 500 aa, Synechococcus sp; identical to SEQ ID NO: 17353

SEQ ID NO: 60697 - DNA, 1395 bp, Rhizobium sp; identical to SEQ ID NO: 17354
  CDS (1)..(1395)

SEQ ID NO: 60698 - protein, 464 aa, Rhizobium sp; identical to SEQ ID NO: 17355

SEQ ID NO: 60699 - DNA, 1437 bp, Candida albicans; identical to SEQ ID NO: 17356
  CDS (1)..(1437)

SEQ ID NO: 60700 - protein, 478 aa, Candida albicans; identical to SEQ ID NO: 17357

SEQ ID NO: 60701 - DNA, 1515 bp, Emericella nidulans; identical to SEQ ID NO: 17358
  CDS (1)..(1515)

SEQ ID NO: 60702 - protein, 504 aa, Emericella nidulans; identical to SEQ ID NO: 17359

SEQ ID NO: 60703 - DNA, 2695 bp, Pichia angusta; identical to SEQ ID NO: 17360
  CDS (793)..(2220)

SEQ ID NO: 60704 - protein, 475 aa, Pichia angusta; identical to SEQ ID NO: 17361

SEQ ID NO: 60705 - DNA, 1542 bp, Schizosaccharomyces pombe; identical to SEQ ID NO: 17362
  CDS (1)..(1542)

SEQ ID NO: 60706 - protein, 513 aa, Schizosaccharomyces pombe; identical to SEQ ID NO: 17363

SEQ ID NO: 60707 - DNA, 1520 bp, Yarrowia lipolytica; identical to SEQ ID NO: 17364
  CDS (27)..(1436)

SEQ ID NO: 60708 - protein, 469 aa, Yarrowia lipolytica; identical to SEQ ID NO: 17365

SEQ ID NO: 60709 - DNA, 1645 bp, Zygosaccharomyces rouxii; identical to SEQ ID NO: 17366
  CDS (77)..(1534)

SEQ ID NO: 60710 - protein, 485 aa, Zygosaccharomyces rouxii; identical to SEQ ID NO: 17367

SEQ ID NO: 60711 - DNA, 3069 bp, Saccharomyces cerevisiae; identical to SEQ ID NO: 17368
  CDS (1)..(3069)

SEQ ID NO: 60712 - protein, 1022 aa, Saccharomyces cerevisiae; identical to SEQ ID NO: 17369

SEQ ID NO: 60713 - DNA, 1554 bp, Aspergillus niger; identical to SEQ ID NO: 17370
  CDS (1)..(1554)

SEQ ID NO: 60714 - protein, 517 aa, Aspergillus niger; identical to SEQ ID NO: 17371

SEQ ID NO: 60715 - DNA, 25 bp, Primer
atgagtcgtttagtcgtagtatcta

SEQ ID NO: 60716 - DNA, 24 bp, Primer
ttacgcaagctttggaaaggtagc

SEQ ID NO: 60717 - protein, 98 aa, consensus; identical to SEQ ID NO: 18676
  MISC_FEATURE (1)..(98): consensus for the disclosure of xaa see table XV

SEQ ID NO: 60718 - protein, 47 aa, consensus; identical to SEQ ID NO: 18677
  MISC_FEATURE (1)..(47): consensus for the disclosure of xaa see table XV

SEQ ID NO: 60719 - protein, 117 aa, consensus; identical to SEQ ID NO: 18678
  MISC_FEATURE (1)..(117): consensus for the disclosure of xaa see table XV

SEQ ID NO: 60720 - protein, 75 aa, consensus; identical to SEQ ID NO: 18679
  MISC_FEATURE (1)..(75): consensus for the disclosure of xaa see table XV

SEQ ID NO: 60721 - DNA, 366 bp, Escherichia coli (strain K-12); identical to SEQ ID NO: 30283
  CDS (1)..(366)

SEQ ID NO: 60722 - protein, 121 aa, Escherichia coli (strain K-12); identical to SEQ ID NO: 30284

SEQ ID NO: 60723 - DNA, 363 bp, Yersinia pestis CO92; identical to SEQ ID NO: 30285
  CDS (1)..(363)

SEQ ID NO: 60724 - protein, 120 aa, Yersinia pestis CO92; identical to SEQ ID NO: 30286

SEQ ID NO: 60725 - DNA, 366 bp, Shigella flexneri 2a str. 301; identical to SEQ ID NO: 30287
  CDS (1)..(366): transl_table=11

SEQ ID NO: 60726 - protein, 121 aa, Shigella flexneri 2a str. 301; identical to SEQ ID NO: 30288

SEQ ID NO: 60727 - DNA, 378 bp, Photorhabdus luminescens subsp. laumondii TTO1; identical to SEQ ID NO: 30289
  CDS (1)..(378): transl_table=11

SEQ ID NO: 60728 - protein, 125 aa, Photorhabdus luminescens subsp. laumondii TTO1; identical to SEQ ID NO: 30290

SEQ ID NO: 60729 - DNA, 381 bp, Erwinia carotovora subsp. atroseptica SCRI1043; identical to SEQ ID NO: 30291
  CDS (1)..(381)

SEQ ID NO: 60730 - protein, 126 aa, Erwinia carotovora subsp. atroseptica SCRI1043; identical to SEQ ID NO: 30292

SEQ ID NO: 60731 - DNA, 363 bp, Yersinia pseudotuberculosis IP 32953; identical to SEQ ID NO: 30293
  CDS (1)..(363): transl_table=11

SEQ ID NO: 60732 - protein, 120 aa, Yersinia pseudotuberculosis IP 32953; identical to SEQ ID NO: 30294

SEQ ID NO: 60733 - DNA, 363 bp, Erwinia chrysanthemi; identical to SEQ ID NO: 30295
  CDS (1)..(363): transl_table=11

SEQ ID NO: 60734 - protein, 120 aa, Erwinia chrysanthemi; identical to SEQ ID NO: 30296

SEQ ID NO: 60735 - DNA, 369 bp, Salmonella typhimurium; identical to SEQ ID NO: 30297
  CDS (1)..(369): transl_table=11

SEQ ID NO: 60736 - protein, 122 aa, Salmonella typhimurium; identical to SEQ ID NO: 30298

SEQ ID NO: 60737 - DNA, 25 bp, Primer
atgaaccatgcaccgcatttatatt

SEQ ID NO: 60738 - DNA, 25 bp, Primer
ttaaaagaggttatcctgcggagcc

SEQ ID NO: 60739 - protein, 106 aa, consensus; identical to SEQ ID NO: 30301
  MISC_FEATURE (1)..(106): consensus for the disclosure of xaa see table XV

SEQ ID NO: 60740 - protein, 106 aa, consensus; identical to SEQ ID NO: 30302
  MISC_FEATURE (1)..(106): consensus for the disclosure of xaa see table XV

SEQ ID NO: 60741 - protein, 44 aa, consensus; identical to SEQ ID NO: 30303
  MISC_FEATURE (1)..(44): consensus for the disclosure of xaa see table XV

SEQ ID NO: 60742 - protein, 48 aa, consensus; identical to SEQ ID NO: 30304
  MISC_FEATURE (1)..(48): consensus for the disclosure of xaa see table XV

SEQ ID NO: 60743 - DNA, 717 bp, Escherichia coli
  CDS (1)..(717)
atgatcgaaatcttacatgaatactggaaaccgctgctgtggaccgacggttatcgctttactggtgtggcgatcactctgtggctgcttattttgtcggtagtgataggcggagtcctggcgctgtttctggcgattggtcgtgtctccagtaataaatacatccagtttccaatctggttatttacctatatttttcgcggtacgccgctgtatgttcagttgctggtgttctattccggcatgtatacgctggagattgttaaggggaccgagtttcttaacgcctttttccgcagtggcctgaactgtaccgtgctggcgctgacgcttaacacctgcgcttacactaccgagatttttgctggggcaatccgttcggtgccgcatggggaaattgaagccgccagagcctatggcttctcgacttttaaaatgtatcgctgcattattttgccttctgcgctgcgtattgcgttaccggcatacagcaacgaagtgatcctgatgctgcactctactgcgttggcatttactgccacggtgccggatctgctgaaaatagcccgcgatattaacgccgccacgtatcaaccttttaccgccttcggcattgccgcggtgctctatttaatcatctcttatgtcctgatcagcctctttcgcagagcggaaaaacgctggttgcagcatgtgaaaccttcttcaacgcactga

SEQ ID NO: 60744 - protein, 238 aa, Escherichia coli
MIEILHEYWKPLLWTDGYRFTGVAITLWLLILSVVIGGVLALFLAIGRVSSNKYIQFPIWLFTYIFRGTPLYVQLLVFYSGMYTLEIVKGTEFLNAFFRSGLNCTVLALTLNTCAYTTEIFAGAIRSVPHGEIEAARAYGFSTFKMYRCIILPSALRIALPAYSNEVILMLHSTALAFTATVPDLLKIARDINAATYQPFTAFGIAAVLYLIISYVLISLFRRAEKRWLQHVKPSSTH

SEQ ID NO: 60745 - DNA, 720 bp, Staphylococcus epidermidis RP62A
  CDS (1)..(720)
atgtttctaaacctgaataatgaacaacaacatgcattagatgcagccaaacaagcatttggtccaatgttagagggattggtgaaatactcaatccctattactttggtcactttcattctaggtttaatcattgcattgtttactgcacttatgcgtatatcaaccagtaaattgcttagaggtattgcgcgtgtctatgtatcaattattcgtggtacacctatgattgtacagttatttattattttttacggtataccggagcttggaagattggtaactaacaatgctgataatcaatggacacttgcacctgttattgctgcagtcattggtttatctttaaatgttggtgcttatgcttctgaaattatacgaggaggtatattgtctattcctaaaggacaaacagaagcggcttattctataggtatgaactatagacaaactgtgcaacgtattatcttaccacaagctattcgtgtatctataccagcactaggaaacacatttttaagtttaattaaagatacatcattacttggatttattcttgttgcagaaatgtttagaaaggcacaagaagttgcttcgacaacgtatgagtatctaactatttatttgttagtagctttaatgtattgggtcgtatgttttgtcatctcaattatccaaggatggtatgaatcacgcattgaaagagggtatcgctcatga

SEQ ID NO: 60746 - protein, 239 aa, Staphylococcus epidermidis RP62A
MFLNLNNEQQHALDAAKQAFGPMLEGLVKYSIPITLVTFILGLIIALFTALMRISTSKLLRGIARVYVSIIRGTPMIVQLFIIFYGIPELGRLVTNNADNQWTLAPVIAAVIGLSLNVGAYASEIIRGGILSIPKGQTEAAYSIGMNYRQTVQRIILPQAIRVSIPALGNTFLSLIKDTSLLGFILVAEMFRKAQEVASTTYEYLTIYLLVALMYWVVCFVISIIQGWYESRIERGYRS

SEQ ID NO: 60747 - DNA, 648 bp, Lactobacillus acidophilus NCFM
  CDS (1)..(648)
atgtctttaacttatatcaatgaaattttgccggctttatttagcggtgctggtatgactttgagtattttctttttgacaataatcttagcaacaccattaggaatattggtatcactcggagaaatgagcaaaatcaagccgcttaagtggttagttaatttttatgtttggattatgagaggtacgccgttacttttacaattaatttttgtgttttatggtttaccaattattcatattgtttttcctagatatcaagcagcattgtttgcttttgttttgaattatgcagcatatttcgctgaaatttttcgtggtggttttcaatcaattgatgaaggacaatttgaggcagctaaagtcttgcgcttaactcgtttccaaacaatgactaagattattattccccaggtaattaagattgttttgccatcaattggtaacgaagtaattaacttgattaaggattcatctttagtttatgtgatcggtttaggtgatcttcttagagcaggtaatgtggctatggccagagatgtaactctagtaccgcttgttttagttgggataatttatttattgctaatcagtatttgtgcatttgtaatgaaaaaacttgaaaagcacttttcttattacaagtag

SEQ ID NO: 60748 - protein, 215 aa, Lactobacillus acidophilus NCFM
MSLTYINEILPALFSGAGMTLSIFFLTIILATPLGILVSLGEMSKIKPLKWLVNFYVWIMRGTPLLLQLIFVFYGLPIIHIVFPRYQAALFAFVLNYAAYFAEIFRGGFQSIDEGQFEAAKVLRLTRFQTMTKIIIPQVIKIVLPSIGNEVINLIKDSSLVYVIGLGDLLRAGNVAMARDVTLVPLVLVGIIYLLLISICAFVMKKLEKHFSYYK

SEQ ID NO: 60749 - DNA, 717 bp, Neisseria gonorrhoeae FA 1090
  CDS (1)..(717)
atgttcaataatttccttgcctctctgccgtttatgacggaaacacgcgctgatatgctcatcagcgcgttttggcccatggttaaagccggctttacagtgtctttgcctttggcgatcgcttctttcgttatcggcatgattattgccgtagccgttgctttggtaagaatcatgccttccggcggtattttccaaaaatgcttgttgaagctggtggaattttatatttccgtcgttcgcggtacgccgctgttggttcagcttgtgattgtgttttacgggctgccgtccgtcggcatctatatcaatccgattcccgccgccatcatcggcttttcgctcaatgtcggcgcatacgcttccgaaaccatacgcgcggcgattttgtccgtgccgaaagggcagtgggaagcaggtttctccatcggtatgacctatatgcagacgttccgccgcatcgtcgcaccgcaggcattccgcgtcgccgttccgccgttgagcaacgagtttatcggcttgttcaaaaacacctcgcttgccgccgtggtaacggtaacggagcttttccgtgtcgcacaggaaacggcaaaccgcacttatgactttttgcctgtctatatcgaagctgcattggtttattggtgtttctgtaaagtgctgtttttgattcaggcgcgtttggaaaaacgtttcgaccgttatgtcgccaaataa

SEQ ID NO: 60750 - protein, 238 aa, Neisseria gonorrhoeae FA 1090
MFNNFLASLPFMTETRADMLISAFWPMVKAGFTVSLPLAIASFVIGMIIAVAVALVRIMPSGGIFQKCLLKLVEFYISVVRGTPLLVQLVIVFYGLPSVGIYINPIPAAIIGFSLNVGAYASETIRAAILSVPKGQWEAGFSIGMTYMQTFRRIVAPQAFRVAVPPLSNEFIGLFKNTSLAAVVTVTELFRVAQETANRTYDFLPVYIEAALVYWCFCKVLFLIQARLEKRFDRYVAK

SEQ ID NO: 60751 - DNA, 663 bp, Agrobacterium rhizogenes
  CDS (1)..(663): transl_table=11
atgacctatcttgagatcgcatctgaagttgcgcgcggcatcccggtctctctcggggtcgcagttggcggtatcgtgatcggatgcgtgctggcatgttttctggtgatggcgcgcctgagtaggaataacgtttcgaggttcctttcctggattttcctcgaaatcattcgctgcattccgatgattgcgctgcttttcctactctattacggcctcagccagttcagtgcggtacgatcaagcatcttctggccgatccttcgcgagccgctatggtgtgcgataattgccctatctcttaaggcttgcgcctatatctcggagatttaccgcataggcatcatgtctgtgcctgaaggcgagatccttgcagcacggagtttcggtttcaagggtttccggctctatcggtccatcatcgtgtcccacgcagcgcgcatcgtgcttcccgctctaagcaacgagtttgtggttttgatcaaggcctcgtcgctggcctctctgattacgctgatggacatcaccggactggcgtcgggcctcgcaagcgaactgtttcagcccctacccgcgctgacagtcgccgcaatctactatctcgttttcaacacgctggttttgtcagcattccagcatctcgaacggcgcctcgccatttga

SEQ ID NO: 60752 - protein, 220 aa, Agrobacterium rhizogenes
MTYLEIASEVARGIPVSLGVAVGGIVIGCVLACFLVMARLSRNNVSRFLSWIFLEIIRCIPMIALLFLLYYGLSQFSAVRSSIFWPILREPLWCAIIALSLKACAYISEIYRIGIMSVPEGEILAARSFGFKGFRLYRSIIVSHAARIVLPALSNEFVVLIKASSLASLITLMDITGLASGLASELFQPLPALTVAAIYYLVFNTLVLSAFQHLERRLAI

SEQ ID NO: 60753 - DNA, 675 bp, Archaeoglobus fulgidus DSM 4304
  CDS (1)..(675): transl_table=11
atggcagctataaaccagttcgacattgacctattcatacggatacttcccgacctcgcattcggggcgagcgtgacgctgaagctaactctaatctccattttcttcggacttatcattggcaccattgccggccttggaagggtttcaaaaaatcccctgcccttcgcaatctctactgcctacgtggaggtaatcagaggaacacctctgctcgtgcagatactcatcgtctacttcggccttccagccatcggcatcaacctccagccagagccagccggaataattgcgctcagcatctgcagcggtgcctacattgccgaaattgtgagggcaggaatagagtcgattccaatcggccagatggaggctgcaagaagcctcggcatgacctaccttcaggccatgaggtacgtgatttttccgcaggctttcaggaacattctgcctgccttgggcaacgagttcatagccctgctgaaggactcttcgctgctgtcggtcatctccattgtggagctgacaagagtgggaaggcagatagtcaacacaaccttcaacgcctggactcccttcctcggggtggctctcttctacctgatgatgaccatccccctcagcaggctcgtcgcatactcgcagaaaaagcttggcacgtatcaggtgaagtag

SEQ ID NO: 60754 - protein, 224 aa, Archaeoglobus fulgidus DSM 4304
MAAINQFDIDLFIRILPDLAFGASVTLKLTLISIFFGLIIGTIAGLGRVSKNPLPFAISTAYVEVIRGTPLLVQILIVYFGLPAIGINLQPEPAGIIALSICSGAYIAEIVRAGIESIPIGQMEAARSLGMTYLQAMRYVIFPQAFRNILPALGNEFIALLKDSSLLSVISIVELTRVGRQIVNTTFNAWTPFLGVALFYLMMTIPLSRLVAYSQKKLGTYQVK

SEQ ID NO: 60755 - DNA, 822 bp, Mesorhizobium loti MAFF303099
  CDS (1)..(822): transl_table=11
atgagcgccaccgccgccatggtcgaacggccgccaccgcggacccgcggctggccgcgaccgcgcatcgtcggctacgcgctggtctgcctatggatcgcctttggccttggcatcgtcggctatcttgtctttgcctggaacccggtcttcttcgccaaatatgcgccggcctatctgagcggactgggcgttaccttgtcgctggtcgccatttcaatggtgcttggcgccgtcctgtcgatgcccgttgcttacgggcgcatgtccagaaaccggatcctgtccggccttgcttactgttacgtctatttctttcgaggcacgccgctgctggttcagacgttcctgatctattacgggctggggtcgttcaggccggaactccagatgatcgggctttgggatttcttcaaggacgccttcaactgcggcgtcttcgcctttgcgctcaacaccgccgcctaccaggccgaaatcctgcgcggcgccatcgaaagcgtgcacaggggccaatgggaaggcgctgcatccctcggcctgcacaaattgcagacgctgcgcaagatcatcctgccgcaagctctgatcgtcgccttgcggccctacggcaatgagctgatcctgatggtcaaggcgtccgccatcgtcgccatcatcaccgtctacgacctgatgggcaatgcgaaactcgcctttgccaattccttcgatatccaggcctatatctgggtcgccctggtgtacctggtgatggtcgagttgttgcgccatgcgatcgaatggatcgagcgccggatcaccattcacctgaagcgttga

SEQ ID NO: 60756 - protein, 273 aa, Mesorhizobium loti MAFF303099
MSATAAMVERPPPRTRGWPRPRIVGYALVCLWIAFGLGIVGYLVFAWNPVFFAKYAPAYLSGLGVTLSLVAISMVLGAVLSMPVAYGRMSRNRILSGLAYCYVYFFRGTPLLVQTFLIYYGLGSFRPELQMIGLWDFFKDAFNCGVFAFALNTAAYQAEILRGAIESVHRGQWEGAASLGLHKLQTLRKIILPQALIVALRPYGNELILMVKASAIVAIITVYDLMGNAKLAFANSFDIQAYIWVALVYLVMVELLRHAIEWIERRITIHLKR

SEQ ID NO: 60757 - DNA, 663 bp, Aeropyrum pernix K1
  CDS (1)..(663): transl_table=11
atgctagacctggctgtagagtatcagagcttcatattaagggggataatgtatactctagccataactatcatatcgctctccatgggcttcacaatatccctcatactgactgctgcaaggttcctcggcttcaaacccctgcgaatggcggcggaggcgtatataaacttcttcagggggactcccctactcgttcagatactcatggtgttcttcggcctcccaagcctaggagtcaatctatcagccttctactccgcggtcatagcaatagggttaaacagcggcgcctaccaggctgagatactgagggttgcgatcaaggggatacccgaggagcagatgcttgtggcacggagcctgggcctctcagagatagagattatgaagggcgtcgttatacctcaggccgtgaggaacgccataccaggcttgactaacgaaaccgtcatactattgaaggagagtagcctggccagcgtcataggcgtgatggagcttacgagggtgggggagtatatggttagcgcgacgttcagggctctcgaggcctacctgctaatagcgcttatatacctagcgctctcaatgatcgcattcaggatgctgaagagggctgagaagagcctggctatacctggcttcgagaggtgggtgtag

SEQ ID NO: 60758 - protein, 220 aa, Aeropyrum pernix K1
MLDLAVEYQSFILRGIMYTLAITIISLSMGFTISLILTAARFLGFKPLRMAAEAYINFFRGTPLLVQILMVFFGLPSLGVNLSAFYSAVIAIGLNSGAYQAEILRVAIKGIPEEQMLVARSLGLSEIEIMKGVVIPQAVRNAIPGLTNETVILLKESSLASVIGVMELTRVGEYMVSATFRALEAYLLIALIYLALSMIAFRMLKRAEKSLAIPGFERWV

SEQ ID NO: 60759 - DNA, 651 bp, Thermotoga maritima MSB8
  CDS (1)..(651): transl_table=11
atgccggaatggttgagcgtaattgtggataatctaccgctccttctgaagggtgccctgcgcacccttcagcttacttctctggccgttctcatagggctcgccatagggatcttcgtcggcatgggaaggctctcgaagtaccggatcataaggtacccgtcttctgtctacgtggagtttctcaggggaacacccctgatggtccagctgtttctcgtgtactttggacttcccgaactggggctcgaattcgacaggttcacagccgccgttattgctctcggaataaacagcggtgcgtacgtcgccgagatcgtgagggcggggatacaatccgtcccaaagggacagtacgaggcggcgagatctctcggcatgtcacacgcacaggcgatgatctacgtgattcttccccaggccttcaggcacatacttccggctcttggaaacgaattcattgccctcgcaaaggacagttcccttgccatggtgataggaaccgtcgaactcatgagaagcgcccagtacatcgtgagcagaacattcatgagctttcccatatacggtggtgtggcgctgatctacttcgccatcaccttctccgtttccaggctggtgaagttcgtggaaggcaggttgaaagtatga

SEQ ID NO: 60760 - protein, 216 aa, Thermotoga maritima MSB8
MPEWLSVIVDNLPLLLKGALRTLQLTSLAVLIGLAIGIFVGMGRLSKYRIIRYPSSVYVEFLRGTPLMVQLFLVYFGLPELGLEFDRFTAAVIALGINSGAYVAEIVRAGIQSVPKGQYEAARSLGMSHAQAMIYVILPQAFRHILPALGNEFIALAKDSSLAMVIGTVELMRSAQYIVSRTFMSFPIYGGVALIYFAITFSVSRLVKFVEGRLKV

SEQ ID NO: 60761 - DNA, 783 bp, Vibrio cholerae O1 biovar eltor str. N16961
  CDS (1)..(783): transl_table=11
atgtcaccaacaacccgtaatccaactcagggaacgagtcatatgctggatttacaaggctatgaagcctctattctgaaaggcgcgctgctgactattgaagttgccgtgctgtcacttttgctagcgatgctgctaggcatgttaggcgcactcgctaaaatggcaccctaccgctgggctcgagccattgcgacactctataccaccatcattcgcggtattccggatttagtactcatgatgctgattttctttggtgggcagattttactcaacaatggtctcagttggtttaatgagttcatcaaccaatggctgacagcccgagatccgaatcatgaatgggtagcctatctgcccgattatgtagatatcagcccttttgtcgcgggcgtgttaaccatcggcttcatttttggggcttatatggcggaaacgtttcgtggcgcgatccttgccgtggataaaggtgaactcgaggcggcgaaagcttacggcatgagtgctgccatgagctttcggcgaattttattaccgcagatgattcgccatgctattcctggttttggcaataactggctggtgctgctgaaaacgaccgctcttgtctcaatcatcggccttgaagatatggtacgcatcagttcactggcggctggctcgaccaagatgccgtttaccttttatatggcggtggccatcatctttctattttttaccagtgtgtcgaccggtttgctcaagctgctagaacgtaaattcagtattcatacgaggtaa

SEQ ID NO: 60762 - protein, 260 aa, Vibrio cholerae O1 biovar eltor str. N16961
MSPTTRNPTQGTSHMLDLQGYEASILKGALLTIEVAVLSLLLAMLLGMLGALAKMAPYRWARAIATLYTTIIRGIPDLVLMMLIFFGGQILLNNGLSWFNEFINQWLTARDPNHEWVAYLPDYVDISPFVAGVLTIGFIFGAYMAETFRGAILAVDKGELEAAKAYGMSAAMSFRRILLPQMIRHAIPGFGNNWLVLLKTTALVSIIGLEDMVRISSLAAGSTKMPFTFYMAVAIIFLFFTSVSTGLLKLLERKFSIHTR

SEQ ID NO: 60763 - DNA, 669 bp, Vibrio cholerae O1 biovar eltor str. N16961
  CDS (1)..(669): transl_table=11
atgaaagagcaacacctatggcaactgcttgaaggcttaggcaccagtttgcaactgacggcagcttcgctgctggtgggttgcatattgtcactcttgatgaccgtaagcttagtgatgcgcacgcccgtcgtgcattggtttagccgtgcggtgatcaccttgtttaccggcactccgctgctggtgcaaattttcttggtgtattacggccctggacagtttgaatggatccgcgaaagcgtactttgggtatggctcagccaaccttggttttgcgctatgctggctttggcgctcaacactgcggcgtacagcacgcaactgtttaaaggcgcatttaacgccattcctagcggacagtggcaagcgtgccgcgcgttaggcatgaataaaatcgctacgctgcgagtactgctgccttatgcattacgcagagctgtgcctgcttattccaacgaagtgattcttgtctttaaaggcacttcgctggccagcacgatcaccattatggatttgatgggctacgcgcagcgcatcaacgcccaaacctacgatacgttgacagtctttgggattgccggggcattttaccttgcagtgaacggcattctgaccctgatcttccgccaaatcgagaaaaaagcgttagcgtttgaggcgtattag

SEQ ID NO: 60764 - protein, 222 aa, Vibrio cholerae O1 biovar eltor str. N16961
MKEQHLWQLLEGLGTSLQLTAASLLVGCILSLLMTVSLVMRTPVVHWFSRAVITLFTGTPLLVQIFLVYYGPGQFEWIRESVLWVWLSQPWFCAMLALALNTAAYSTQLFKGAFNAIPSGQWQACRALGMNKIATLRVLLPYALRRAVPAYSNEVILVFKGTSLASTITIMDLMGYAQRINAQTYDTLTVFGIAGAFYLAVNGILTLIFRQIEKKALAFEAY

SEQ ID NO: 60765 - DNA, 672 bp, Pasteurella multocida subsp. multocida str. Pm70
  CDS (1)..(672): transl_table=11
atgttttttgattatctttctttaatgtacaccgcaaccctaatgaccttagggttagcggtttgttcgttaattgttggtttaattttatccattatctttgtggtattagaaaccagcaagtggcaatggattcgtaaaccaacctccgtgtttgttacccttctacgtggcttaccggaaattttagtggttttactgatttactttggttcgaccgaagtcgtggaaatgctcaccggtgaatttattcaatttagtgcctttagttgtggtgtgtttgccctgtcaattatttttgcagcctatgcctcacagtctttgcggggagccattcaagccattccgttgggacaatgggagtcgggggcggctttagggttgagtcgtggttatacctttgtacagattattatgccgcaagtgtggcgtcatgctttgcccggattgagtaatcaatggttagtcttattgaaagatacggcattggtttcgttaattggtgtggaagatttaatgcgtcaagccgagttagtgaatacggtgactcatcagcctttcacttggtatggcattgcagcgttattgtatttgacaatcaccttaatcagccaatttattattcgcaagttagagttccgttttactcgttttgaaagaggcgtggaataa

SEQ ID NO: 60766 - protein, 223 aa, Pasteurella multocida subsp. multocida str. Pm70
MFFDYLSLMYTATLMTLGLAVCSLIVGLILSIIFVVLETSKWQWIRKPTSVFVTLLRGLPEILVVLLIYFGSTEVVEMLTGEFIQFSAFSCGVFALSIIFAAYASQSLRGAIQAIPLGQWESGAALGLSRGYTFVQIIMPQVWRHALPGLSNQWLVLLKDTALVSLIGVEDLMRQAELVNTVTHQPFTWYGIAALLYLTITLISQFIIRKLEFRFTRFERGVE

SEQ ID NO: 60767 - DNA, 684 bp, Pasteurella multocida subsp. multocida str. Pm70
  CDS (1)..(684): transl_table=11
atgtttcaagactattttatggtgattgcacaaggtattcccaccagtttgttattaacttttgtttcgcttgttgttgctttctttttagctttattactgacatttggcttgtctatcggcaataaactagtcaagtgcggtattcacacttatttaaccttgtttacgggcactccattattagtgcaatttttcttaatttatgccggtcctggtcagtttgaatggttagttgacagtgcattgtggccattgttatcgaatgcgtggttttgtgcgatgctaacattggcgttaaatagtgcagcctattcgacattactgtttcatggtgcggtgaaagcgattagcaaaggacaatgggaaagttgtgctgcattgggtttaacgcgaatggaaacactaaaaattttaattccttatgcgctaaaaagagcgttgccttcttatagcaatgaaatcattctcgtgtttaaaggtacggcattagcctcgacgatcaccattatggatattatggggtatgctagacagttatatggaacagaatatgatgcgttaacaatttacgggattgccggcatgatttatttaatcattaccgctattgcgaccctactattacgtaaattggaaagtaaagtcctctcttttgagcgtcttgaagtagaaaaagcctaa

SEQ ID NO: 60768 - protein, 227 aa, Pasteurella multocida subsp. multocida str. Pm70
MFQDYFMVIAQGIPTSLLLTFVSLVVAFFLALLLTFGLSIGNKLVKCGIHTYLTLFTGTPLLVQFFLIYAGPGQFEWLVDSALWPLLSNAWFCAMLTLALNSAAYSTLLFHGAVKAISKGQWESCAALGLTRMETLKILIPYALKRALPSYSNEIILVFKGTALASTITIMDIMGYARQLYGTEYDALTIYGIAGMIYLIITAIATLLLRKLESKVLSFERLEVEKA

SEQ ID NO: 60769 - DNA, 693 bp, Pseudomonas aeruginosa PAO1
  CDS (1)..(693): transl_table=11
atgaattcgctgcagaaattgctcgaatggctcgccaacctggtcgagctgctcgggatggcctggcccttcctgctccagggcgcgatgtataccgtgctgttcgccgcggtatcgatggtcctgggcctgatcctcggcttcagcgtcgcggtggtccgggtgaccaaggtgccggtggtctcgcagatcgccgcggtctacgtcagcgccttccgcgggacgccactgctggtgcagatcttcgtcctgtactacgggctgccgagcgtaggcatcgagttcaccccggtcaccgcgggcatcctggcgctgaccctgaatgtcgcggcctatctctcggagtccatgcgcggggcgatcctcggcatcgacaagggacaatgggaagccgggctctcggtcggcctgacctggggccagaccctgtggaacatcatcaccccgcaggccctgcgcctggcggtgccgagcctgtcgaacagcctgatcagcctgatcaaggacacctcgctgatctccgtgatcaccgtgaccgaactgatgctggcgaccaaggaggtcatcgccgagaccttccagccgctgccgctctatctcgccgccgccgggatctactggctgctttcggcactcttcgagcgtgtgcagaaagccctggagaaccgcctgaccgcgccgctgcggcgctga

SEQ ID NO: 60770 - protein, 230 aa, Pseudomonas aeruginosa PAO1
MNSLQKLLEWLANLVELLGMAWPFLLQGAMYTVLFAAVSMVLGLILGFSVAVVRVTKVPVVSQIAAVYVSAFRGTPLLVQIFVLYYGLPSVGIEFTPVTAGILALTLNVAAYLSESMRGAILGIDKGQWEAGLSVGLTWGQTLWNIITPQALRLAVPSLSNSLISLIKDTSLISVITVTELMLATKEVIAETFQPLPLYLAAAGIYWLLSALFERVQKALENRLTAPLRR

SEQ ID NO: 60771 - DNA, 699 bp, Pseudomonas aeruginosa PAO1
  CDS (1)..(699): transl_table=11
gtgatcttcgatttctccgtcatctgggacagccttccgctctatttcgacggcctgctggtcaccctcaagctgctctcgatctccctgctgatcggcctgctgctggcggtgccgctagcgctgatgcgggtctccaagcagccgctggtgaacttcccggcctggctctatacctacgtgatccgcggcacgccgatgctggtccagctgttcctgatctactacggcctggcgcagttcgacgcggtgcgcgagagcgcgctgtggccctggttgtcgaacgcctccttctgcgcctgcctggcgttcgccatcaacaccagcgcctataccgccgagatcctcgccggcagcctgaaggccacgccccatggcgagatcgaggcggccaaggcgatgggcatgtcgcgcctgaagatgtaccgccgcatcctcctgccgtcggcactgcggcgcgccctgccgcagtacagcaacgaagtgatcatgatgctgcagaccaccagcctggcgtccatcgtcaccctggtggacatcaccggcgccgcgcggaccgtctactcgcagtactacctgccgttcgaggcgttcatcaccgctggcctgttctacctgtgcctgaccttcatcctggtgcgcctgttcaagcttgccgagcgccgctggctggcctacctggcgccgcgcaaatcctga

SEQ ID NO: 60772 - protein, 232 aa, Pseudomonas aeruginosa PAO1
MIFDFSVIWDSLPLYFDGLLVTLKLLSISLLIGLLLAVPLALMRVSKQPLVNFPAWLYTYVIRGTPMLVQLFLIYYGLAQFDAVRESALWPWLSNASFCACLAFAINTSAYTAEILAGSLKATPHGEIEAAKAMGMSRLKMYRRILLPSALRRALPQYSNEVIMMLQTTSLASIVTLVDITGAARTVYSQYYLPFEAFITAGLFYLCLTFILVRLFKLAERRWLAYLAPRKS

SEQ ID NO: 60773 - DNA, 714 bp, Pseudomonas aeruginosa PAO1
  CDS (1)..(714): transl_table=11
atgaacgcggtactcgacgaatactggcaggcctacctgtggaccgacggcctgcaactgaccggactggcgatgaccctgtggctgctgatcctcgccgtggcgcttggcttcctgctggccatcccgctggcggtggcgcggacctgcggcaacccgctgctgcgctacccggtctggctctacacctacgtgttccgcggcaccccgctgtacatccagttgctgttcttctacaccggcgtctacagcctgaatgccatacgcgcccaggactttctcaacgcgttcttccgcgacggcttcaactgcacggtgctggccttcgtcctcaacacctgcgcctacatgacggaaatcttcgccggcgcgatcaggaacacgccccacggcgaagtggaagcggcgcgcgcctacggcatgggcggcttcaccctctaccggcgcatcgtcctgccctcggcgctgcgccgggcactgccgtacttcagcaacgaagtgatcctgatgctgcattccacctcggtggcgttcaccgccaccgtgccggacctgctcaaggtggcccgcgacgtcaattccgccacctatgcgccgttcctgtccttcggcatcgccggcgcgctctacgccggcaccgccttcctgctgatctggctgttccgccgtggcgagctgcgctggctggcctacctcagaccgcaaacccactga

SEQ ID NO: 60774 - protein, 237 aa, Pseudomonas aeruginosa PAO1
MNAVLDEYWQAYLWTDGLQLTGLAMTLWLLILAVALGFLLAIPLAVARTCGNPLLRYPVWLYTYVFRGTPLYIQLLFFYTGVYSLNAIRAQDFLNAFFRDGFNCTVLAFVLNTCAYMTEIFAGAIRNTPHGEVEAARAYGMGGFTLYRRIVLPSALRRALPYFSNEVILMLHSTSVAFTATVPDLLKVARDVNSATYAPFLSFGIAGALYAGTAFLLIWLFRRGELRWLAYLRPQTH

SEQ ID NO: 60775 - DNA, 963 bp, Pseudomonas aeruginosa PAO1
  CDS (1)..(963): transl_table=11
gtgaccaagaagaaacgttccgtctggccctggcacctgctgaccgggctgatcctgctggtcctggcctgggcgctgtggttctccacctcgctgatttcctatgaatggcgctggaaccgcgttccgcagtacttcgcctaccaggccgaggagccgttacgggccaacgagatcggccgggtcgaggctatcgaggaacagggcagggacgcgcgcgtcacgctgcttggcgagagcggcgagaagcaggtcgtgaccgttgcccaggacagcctgcaattctccgaaggcgacgacgtggccgagggcgacgcggtcggggtgacccgccactgggccgccggcccactgctctggggcctgtggaccaccctctggctatcgctggtgtccggtgccatcggtctggctatcggcctggtcgccggcctctgccggctgtcgaagaacccgaccctgcacgacctgtcgacgatctacgtcgagctggtgcgcggcacgccgttgctggtgcagatcttcatcttctacttcttcatcggcaccgtgctcaacctgtcccgcgagttcgccggggttgcggcgctggcgctgttcaccggcgcctacgtggccgagatcatccgggccggcgtgcagtccatcgcccgcggacagaacgaggccgcccgctccctgggcctgaacgccggccagtcgatgcgctacgtgatcctgccgcaggccttcaagcgcgtgctgccgccgctggccgggcagttcatcagcctggtcaaggacacctcgctggtctcggtgatcgccatcaccgaactgaccaagagcggccgcgaggcgatcaccacctcgttctccaccttcgagatctggttctgcgtcgccgcgttgtacctgctgttgaacctgcccctttcgcacatggcatcccgactggagcggaggctcggacaaagtgattga

SEQ ID NO: 60776 - protein, 320 aa, Pseudomonas aeruginosa PAO1
MTKKKRSVWPWHLLTGLILLVLAWALWFSTSLISYEWRWNRVPQYFAYQAEEPLRANEIGRVEAIEEQGRDARVTLLGESGEKQVVTVAQDSLQFSEGDDVAEGDAVGVTRHWAAGPLLWGLWTTLWLSLVSGAIGLAIGLVAGLCRLSKNPTLHDLSTIYVELVRGTPLLVQIFIFYFFIGTVLNLSREFAGVAALALFTGAYVAEIIRAGVQSIARGQNEAARSLGLNAGQSMRYVILPQAFKRVLPPLAGQFISLVKDTSLVSVIAITELTKSGREAITTSFSTFEIWFCVAALYLLLNLPLSHMASRLERRLGQSD

SEQ ID NO: 60777 - DNA, 696 bp, Pseudomonas aeruginosa PAO1
  CDS (1)..(696): transl_table=11
atgattctcgacctgcatgggttcggcgagcaactgctcgccggtacctggatgaccctcaagctgtcgctggcggcggtctgcgtggggctgttgctcggcctcctcggcgccatcgcgaagacttcgaagtacgcggccctgcgtttcctcggcggcacctacaccaccatcgtccgtggcgtgccggaaacgctctgggtactgatgatctatttcggcacggtgagcggcctgaacgccctcggcgaccttttcggcaagccggacctggcgctctcgccgttcgccgccggcaccctggccctcggcctgtgcttcggcgcctacgccaccgaggtgttccgcggcgcgctgttgtccattccgcgcggccatcgcgaggccggccaggcgctcggcctgtcgcccggacggatcttctggcgcatcgtcctgccgcagatctggcgggtcgccctgcccggcctcggcaacctgtacctgatcctgctgaaggacaccgcgctggtgtcgctgatcaccctcgacgagatcatgcgcaaggcgcaggtcgcctccaacgcgaccaaggaacccttcaccttctacatgaccgcggccgccatctacctgagcctcacggtcgtcatcatggtcgccctgcacttcctcgaacgtcgcgccggccgtggtttcgtgaggaacgagctatga

SEQ ID NO: 60778 - protein, 231 aa, Pseudomonas aeruginosa PAO1
MILDLHGFGEQLLAGTWMTLKLSLAAVCVGLLLGLLGAIAKTSKYAALRFLGGTYTTIVRGVPETLWVLMIYFGTVSGLNALGDLFGKPDLALSPFAAGTLALGLCFGAYATEVFRGALLSIPRGHREAGQALGLSPGRIFWRIVLPQIWRVALPGLGNLYLILLKDTALVSLITLDEIMRKAQVASNATKEPFTFYMTAAAIYLSLTVVIMVALHFLERRAGRGFVRNEL

SEQ ID NO: 60779 - DNA, 693 bp, Pseudomonas aeruginosa PAO1
  CDS (1)..(693): transl_table=11
atgagcgagtgggagctgatcctcaagtggatgccgaagatgctccagggcgcggcgctgaccctggagctgctggcgatcgcggtggtcgccgggctcgccctggccctgccgctgggcatcgcccgcgcctcgcggcactggtacgtgcgcgcggtgccgtacgcctacatcttcttcttccgcggcacgccgctgctgctgcaactgttcatcgtctactacggcctggcgcagttcgaggaagtgcgcaagagcgccttctggccctacctgcgcgatccgtactggtgcgcgctgctgaccatgaccctgcacaccgccgcctatatcgccgagatcctccgcggcgcgatccactcggtgccggtcggcgaggtggaggccgcccgcgccctcggcatgtcgcggcgccaggcgctctggcacatcatcctgccgcgcgcggtgcgcatcggcctgccggcctacagcaacgaagtgatcctgatgctcaaggccagcgcggtggtctacaccgtgaccctgttcgacatcatgggcatggcccggaccatcatcgcccgcacctacgaatcgatgctgttcttctgcctggccggcgcgctgtacctggtgatcaccatcgtgctgacgcggatcttccgcctgatcgaacgctggttgcgggtcgacgccacccagggccgctga

SEQ ID NO: 60780 - protein, 230 aa, Pseudomonas aeruginosa PAO1
MSEWELILKWMPKMLQGAALTLELLAIAVVAGLALALPLGIARASRHWYVRAVPYAYIFFFRGTPLLLQLFIVYYGLAQFEEVRKSAFWPYLRDPYWCALLTMTLHTAAYIAEILRGAIHSVPVGEVEAARALGMSRRQALWHIILPRAVRIGLPAYSNEVILMLKASAVVYTVTLFDIMGMARTIIARTYESMLFFCLAGALYLVITIVLTRIFRLIERWLRVDATQGR

SEQ ID NO: 60781 - DNA, 651 bp, Streptococcus pyogenes M1 GAS
  CDS (1)..(651): transl_table=11
atgattaatatcccattaatgaaagatagtttaggatttgtgttatcgggattaccttatacccttggtatttcgttgctcagtttttttacgggtctgtttttaggtttaggcctagcccttctgggaaggtcacgtcagccgttgattcattatcttgttagagcgtacatctctattatgcgaggtgtgccgatgatcgtggtgctctttgttctttatttcgggttgccttattatggtttagaattgccagctttactttgcgcttatcttggtttttctatggttagcgctgcctatatttctgaagtttttcgctcttctatagaagctattgacaagggacaatgggaagcagctaaggctttagggttgccatatgctcttatggttaagaaaattattcttcctcaagcctttcgaattgcagttcctcctttaggaaatgtcattattgatatggttaaaagttcgtcgctagctgccatgattaccgtaccagatatttttcaaaatgccaaaattattggcggtagagagtgggattacatgtccatgtatattttagtagcctttatctattggcttattgcttttttgttagaacgttaccaagaattcttagaaaataagctagcacttgtttaa

SEQ ID NO: 60782 - protein, 216 aa, Streptococcus pyogenes M1 GAS
MINIPLMKDSLGFVLSGLPYTLGISLLSFFTGLFLGLGLALLGRSRQPLIHYLVRAYISIMRGVPMIVVLFVLYFGLPYYGLELPALLCAYLGFSMVSAAYISEVFRSSIEAIDKGQWEAAKALGLPYALMVKKIILPQAFRIAVPPLGNVIIDMVKSSSLAAMITVPDIFQNAKIIGGREWDYMSMYILVAFIYWLIAFLLERYQEFLENKLALV

SEQ ID NO: 60783 - DNA, 717 bp, Neisseria meningitidis Z2491
  CDS (1)..(717): transl_table=11
gtgttcaataatttccttgcttcgctgccgtttatgacggaaacacgcgccgatatgattgtcagcgcgtttttgcctatggtcaaagccggcttcgcggtctctctgcctttggcggcagcttctttcgttatcggtatgatgattgcggtagccgtggctttggtgcggattatgcccgccggcggcatcgtgcggaaaatcctgctgaaattggtggaattttatatttccgtcattcgcggtacgccgctgttggttcagcttgtgattgtgttttacgggctgccttccgtcggcatctatatcgacccgattcctgccgccatcatcggcttttcgctcaatgtcggcgcatatgcttccgaaaccatacgcgcggcaattttgtccgtaccgaaaggccaatgggaagcaggtttctccatcggcatgacctatatgcagacgttccgccgcatcgtcgcgccgcaggcatttcgcgttgccgtgccgcctttgagcaacgagtttatcggtttgtttaaaaacacctcgctcgcggcagtcgtgacggtaacggaattattccgcgtcgcgcaggaaacggcaaaccgcacttatgactttttgcccgtctatatcgaagccgctttggtttactggtgtttttgtaaagtgctgttcctgattcaggcgcgtttggaaaaacgtttcgaccgctacgtcgccaaataa

SEQ ID NO: 60784 - protein, 238 aa, Neisseria meningitidis Z2491
MFNNFLASLPFMTETRADMIVSAFLPMVKAGFAVSLPLAAASFVIGMMIAVAVALVRIMPAGGIVRKILLKLVEFYISVIRGTPLLVQLVIVFYGLPSVGIYIDPIPAAIIGFSLNVGAYASETIRAAILSVPKGQWEAGFSIGMTYMQTFRRIVAPQAFRVAVPPLSNEFIGLFKNTSLAAVVTVTELFRVAQETANRTYDFLPVYIEAALVYWCFCKVLFLIQARLEKRFDRYVAK

SEQ ID NO: 60785 - DNA, 651 bp, Deinococcus radiodurans R1
  CDS (1)..(651): transl_table=11
atggacttcaacctcattgttcagaatctgccctttttgcttcagggcgccctgatgaccatcaaaatcacggcgctttcgctggtgctgggggtggtcgggggcacgctggtggcgctggcgcggctgtcgccttttaagccgctctcgtggctggcgctcacctttatcgaactggtgcgcggcacgccgctgctggtgcagattttcgtcatcttcttcgggctgccgcaactgctggagcatcccatcaacgaattctgggcgggcgtggcggcgttttcggtcaactcggcggcgtatgtggccgaaatcgtgcgcgcgggcattcagggtctcccgaaagggcagaccgaagcctcgcgctcgctgggcctgagccccgcgcagaccatgcggcacatcatcttgccgcaggcgtttacgcgggtgctgccgccgctggtcaacgaggccatcagcctgctcaaaaactcgtcgctgctctcggccatttccatcgtcgaactcacgcgcgcggggcaactggtgtcgagccgcaccttcaagccgttcgagatgtacctcgccgtgtcgctgatttatctcgccatgacgctgtttctgagctgggtggcccgccgcctcgaagcccgctggcaggtgcgctga

SEQ ID NO: 60786 - protein, 216 aa, Deinococcus radiodurans R1
MDFNLIVQNLPFLLQGALMTIKITALSLVLGVVGGTLVALARLSPFKPLSWLALTFIELVRGTPLLVQIFVIFFGLPQLLEHPINEFWAGVAAFSVNSAAYVAEIVRAGIQGLPKGQTEASRSLGLSPAQTMRHIILPQAFTRVLPPLVNEAISLLKNSSLLSAISIVELTRAGQLVSSRTFKPFEMYLAVSLIYLAMTLFLSWVARRLEARWQVR

SEQ ID NO: 60787 - DNA, 876 bp, Deinococcus radiodurans R1
  CDS (1)..(876): transl_table=11
gtgtcccgcgatgctcagggtctttcctccgctgttctcagccgcttgccacatctggagccgccgatgaccacctctgccccgcctcccccgccccgacttcccggcaaaggcccgcagggcgccggcaccctcgcgctgtggctgctgggggccgccgccgccttcacggcgctgtttttcctgatcacgctggtgctgcgccagatgcccgagccggtggggcagtacgccgacctgttcgtggaaggcgcccagatgacgctgaaactcaccctggtcagcggactgatcgggttgctggtggggatgatcgctggaatcatgcggagcagcccgagcgcgctggtgcgggcgcccgccagttttttcatctggctgattcgcggcacgccactgctggtgcagattctgttcgtgtacaacgcgctgccgccactgctcaagaccatcgggattaacttagagctcaacgagttctggtcggcggtcatcgcgctcgccctgaacgtgggcgcctacaacgccgaggtcattcgcgccgggattctggcagtgccgcgcggtcagagcgaggccgcccgcagcctgggcctgagcgccgggcagaccatgaacgcggtggtgctgccgcaggcgctgcggatcgtggtgccgccgctggtgaacaacctggtggcgctgctcaaggattcctcgctggcgtccaccatcgcgctgcttgaactcacgctctcgggccagcgcgtgagcagcgagagctttcagccggtgccggtgctgaccaccgtggccgccgtgtatctggcgctgaccacggtgctgaccctctttaccgaccaactggaaaagcgggtgaaaatcgccagccgctga

SEQ ID NO: 60788 - protein, 291 aa, Deinococcus radiodurans R1
MSRDAQGLSSAVLSRLPHLEPPMTTSAPPPPPRLPGKGPQGAGTLALWLLGAAAAFTALFFLITLVLRQMPEPVGQYADLFVEGAQMTLKLTLVSGLIGLLVGMIAGIMRSSPSALVRAPASFFIWLIRGTPLLVQILFVYNALPPLLKTIGINLELNEFWSAVIALALNVGAYNAEVIRAGILAVPRGQSEAARSLGLSAGQTMNAVVLPQALRIVVPPLVNNLVALLKDSSLASTIALLELTLSGQRVSSESFQPVPVLTTVAAVYLALTTVLTLFTDQLEKRVKIASR

SEQ ID NO: 60789 - DNA, 720 bp, Deinococcus radiodurans R1
  CDS (1)..(720): transl_table=11
ttgtccagaagtaagcccggcggcatgactgatctgctgactggcttccagacggccctctccggcgactacccccagctgctgctctcggggttgggtgtcacgttggcggtcagcctgtgtgcactggtcgtctcagtggtggtcggtactgcgttggggctggtgcgggtttaccgggtgccgctgctcggcccaataggaaacatttatgtcgaggtggtgcgcggcattccgctcatcgtgctgctgagcgtcatctacttcgggctgcccacgctcggcctcacgctcgcgggcttcccggcggcggtgctggcgctgggactgtacagcgcggcctacacgtctgaaattgtgcgcggcgggctgggaagtgtgcctgcgggacaaattgaggcggcccgtagcctgggcctctcgcgggggcaagcgctgcgcttcgtggtactgccgcaggcgtggcgggtggcgctgcccgcgctcggcaacgagttcgtgagcctgattctgggcagcagcctggcgagcgccgtcaccttgcaggagctgttcagccaggggcgttacatcaccaacgccacttaccgtcagttcgaggtctacgccgtgctggccgtcatctactttgtgctgaccttcacgctgacccgcgcggtaagggcactcgaacaccgcctgagccggggccaaagcctgccggagcggcgagtgatttag

SEQ ID NO: 60790 - protein, 239 aa, Deinococcus radiodurans R1
MSRSKPGGMTDLLTGFQTALSGDYPQLLLSGLGVTLAVSLCALVVSVVVGTALGLVRVYRVPLLGPIGNIYVEVVRGIPLIVLLSVIYFGLPTLGLTLAGFPAAVLALGLYSAAYTSEIVRGGLGSVPAGQIEAARSLGLSRGQALRFVVLPQAWRVALPALGNEFVSLILGSSLASAVTLQELFSQGRYITNATYRQFEVYAVLAVIYFVLTFTLTRAVRALEHRLSRGQSLPERRVI

SEQ ID NO: 60791 - DNA, 690 bp, Streptococcus pneumoniae TIGR4
  CDS (1)..(690): transl_table=11
gtgactatgaatttttcttttttacctaagtatttaccttattttaactatggggctgttgtgacgattcttatttctatctgtgttatctttttgggaactattttgggtgttgtcttggcttttgggcaacgttcaaagtttaaaccgcttgtttggttggccaacttgtacgtttggattttccgtgggacaccgatgatggttcaaattatgattgcctttgctcttatgcatatcaatgctccgactattcagattggaattttaggtgttgatttttcgcgtctgattccagggattttgattatctctatgaatagtggtgcttatgtttcggagactgttcgtgccggaatcaatgcggttccaaaaggtcagctagaagcggcttattcgctagggattcgtcctaaaaatgcgatgcgttatgtgattttgccacaagcagtcaaaaatatcttgccagcattggggaacgaatttatcaccattatcaaggacagctccctcttatcagctattggggtcatggagttgtggaatggggctacaacagtttctacaacaacctatctacctttaacaccacttttatttgcagcattttactacttgattatgacctctattctgacagtagccttgaaagcttttgaaaaacatatgggacaaggagataagaaataa

SEQ ID NO: 60792 - protein, 229 aa, Streptococcus pneumoniae TIGR4
MTMNFSFLPKYLPYFNYGAVVTILISICVIFLGTILGVVLAFGQRSKFKPLVWLANLYVWIFRGTPMMVQIMIAFALMHINAPTIQIGILGVDFSRLIPGILIISMNSGAYVSETVRAGINAVPKGQLEAAYSLGIRPKNAMRYVILPQAVKNILPALGNEFITIIKDSSLLSAIGVMELWNGATTVSTTTYLPLTPLLFAAFYYLIMTSILTVALKAFEKHMGQGDKK

SEQ ID NO: 60793 - DNA, 801 bp, Streptococcus pneumoniae TIGR4
  CDS (1)..(801): transl_table=11
atgaatgttacaacgattttagcatcagattggtaccaaaacttgatgcaattgattccggatggcaagctgtttagcctacgttcggtctttgatggaatccctagaattgtccaacaacttccaacaacaattatgttgacaattggtggtgccctttttggcttggttttggcgcttctttttgccattgtgaagatcaatcgtgtcaagattttatatcccttgcaggccttctttgttagtttcttaaaagggacaccgattttggtgcaactcatgttgacctactacggaatccctttggctttgaaagccctcaatcagcaatggggaactggtctcaatatcaatgcgattccagctgcagcttttgcgattgtcgcctttgcctttaatgaggcagcttatgctagtgaaaccattcgtgcagccattctctcagttaatcctggtgagattgaggcggcacgcagtctgggtatgacccgagcgcaagtttatcgacgagtgattattcctaatgcagcggtggtagctactccaaccttgattaattccctcatcggtttgaccaagggaacatctctagcttttagtgcgggtgttgtggaagtctttgcccaagctcagattctaggtggagctgattatcgctattttgaacgcttcatctccgttgcccttgtttattgggtagtcaatatcggaattgaaagcctcggtcgtttcatcgagagaaaaatggctatttctgcacctgatacagtgcaaacagatgtgaaaggagaccttcgttaa

SEQ ID NO: 60794 - protein, 266 aa, Streptococcus pneumoniae TIGR4
MNVTTILASDWYQNLMQLIPDGKLFSLRSVFDGIPRIVQQLPTTIMLTIGGALFGLVLALLFAIVKINRVKILYPLQAFFVSFLKGTPILVQLMLTYYGIPLALKALNQQWGTGLNINAIPAAAFAIVAFAFNEAAYASETIRAAILSVNPGEIEAARSLGMTRAQVYRRVIIPNAAVVATPTLINSLIGLTKGTSLAFSAGVVEVFAQAQILGGADYRYFERFISVALVYWVVNIGIESLGRFIERKMAISAPDTVQTDVKGDLR

SEQ ID NO: 60795 - DNA, 651 bp, Clostridium acetobutylicum ATCC 824
  CDS (1)..(651): transl_table=11
atggattttaatacattggataaggtaataccagtattactacggggaacacttgtaacaataaagcttaccttcatggcaataatttttggatgcataatagctcttttagtagcaatcttaaaggtatcagctaataagtttctaaatgcagtaggaggattttatacatggatatttagggggaccccactcctactacaattatatgtattctactatgggcttccagcgttaaatataaatataagtgcaactcaggctgcaatattaggccttagtctaaattcgggagcttatatagcagagataataagaggaggaataattgctatagataagggacagtttgaggcgtcaaaagcgttaggattcccggaagggcccaccaatgaggaaggttatatttgcctcaagctgttagaggtcattaaccccccaatgggaaatgagtttatagcacttataaaagatacatcattagtttcagtaataacgatggaggaacttttaagaaaagctcagcttttggtttcgtcttcaggtgatgcagttacaccatatgttataacaggagtattttatcttgtacttacaacagtatttacatttttattttcacgtatcgagaaaaaattatctttgtattag

SEQ ID NO: 60796 - protein, 216 aa, Clostridium acetobutylicum ATCC 824
MDFNTLDKVIPVLLRGTLVTIKLTFMAIIFGCIIALLVAILKVSANKFLNAVGGFYTWIFRGTPLLLQLYVFYYGLPALNINISATQAAILGLSLNSGAYIAEIIRGGIIAIDKGQFEASKALGFPEGPTNEEGYICLKLLEVINPPMGNEFIALIKDTSLVSVITMEELLRKAQLLVSSSGDAVTPYVITGVFYLVLTTVFTFLFSRIEKKLSLY

SEQ ID NO: 60797 - DNA, 666 bp, Clostridium acetobutylicum ATCC 824
  CDS (1)..(666): transl_table=11
atgaattttagcgttggatattttttgaattcatttccggatttattaaagtatattcattatacgatatttatggcggtaatatcaacaattataggacttgttatagcaactattcttgcacctataaagatgcttaaaataaagggattatctcaagttataggagtgtatatatctttttttagaggaacaccgcttttggtacaattatttgttttttattatggacttccacaactaataaaacctctgaaaaatgtaacgccacttgaggcaatgattttaggacttagtttatgtggttcagcttatatggcagaaataataagaggagctatagagtcagttgaaaaaggacaaatggaggcagctttgtcagttggaatgactaaatttcaagcgtttactagaataatttatcctcaagcaataagagtggcaatcccaggaataggaaatcaatttgtggatttgttaaaaagttcatctcttgcttttgttctaggtttaacagaaattttagccagagcacaaatgaatgcggcttctagttttaaggttatggaaagttatctttctttagcaataatatattgggtgactgttgagatatttaactttcttcaaagaattattgaaaaaagaatatcaagggcatactaa

SEQ ID NO: 60798 - protein, 221 aa, Clostridium acetobutylicum ATCC 824
MNFSVGYFLNSFPDLLKYIHYTIFMAVISTIIGLVIATILAPIKMLKIKGLSQVIGVYISFFRGTPLLVQLFVFYYGLPQLIKPLKNVTPLEAMILGLSLCGSAYMAEIIRGAIESVEKGQMEAALSVGMTKFQAFTRIIYPQAIRVAIPGIGNQFVDLLKSSSLAFVLGLTEILARAQMNAASSFKVMESYLSLAIIYWVTVEIFNFLQRIIEKRISRAY

SEQ ID NO: 60799 - DNA, 684 bp, Clostridium acetobutylicum ATCC 824
  CDS (1)..(684): transl_table=11
atgaatttcgatactaacacattaagaataataaaaattttagaagattctttcttaccattattaacagcgggactgaaatttacagtccctcttacacttatttcatttattttaggcctactccttgcattggttacagctttagctagaatatcaaatattaagcctttagagcttttagctagattttacgtatcaattataagaggtactccactacttgttcaattattcataatcttttttggacttccaactgttggagtaactataaaacctttgacagcggcaataataggttttactttaagcgtaggagcctacaattcagaggttatacgtgctgcaattttatctattcctaagggacaatgggaagctgcttcttctataggaatgacctatactcaatcgcttgtaagagtagtactacctcaagctgcaagagtttctgttccacctctagctaattcctttataagccttgttaaggatacttcacttgcagctactatcactgtagcagaaatgtttcaagttgctcaaagaataactgcaacaacctatgagcctctttggatgtatattgaagctgctttcatttactatattttctgtagtcttcttacattaattcaacactatttagaaaagaaactggctagatatacaacaagatag

SEQ ID NO: 60800 - protein, 227 aa, Clostridium acetobutylicum ATCC 824
MNFDTNTLRIIKILEDSFLPLLTAGLKFTVPLTLISFILGLLLALVTALARISNIKPLELLARFYVSIIRGTPLLVQLFIIFFGLPTVGVTIKPLTAAIIGFTLSVGAYNSEVIRAAILSIPKGQWEAASSIGMTYTQSLVRVVLPQAARVSVPPLANSFISLVKDTSLAATITVAEMFQVAQRITATTYEPLWMYIEAAFIYYIFCSLLTLIQHYLEKKLARYTTR

SEQ ID NO: 60801 - DNA, 654 bp, Clostridium acetobutylicum ATCC 824
  CDS (1)..(654): transl_table=11
atggatataagctctttaaataaagtaattccagttttactagatggaacacgtattactttactactaacttgttcttcaataattattggatgtattataggaactattatagctatgtttaaaacttcatcagttaaggtattaaatcttataggtaagttttacacatggattttaaggggaacgcctcttttactgcaattatatgtttattattatggactaccatttttgagtgataaactcactatgactccaatgaaggcagcaatattaggcttaagcttgaactctggagcgtatattgcagagataataaggggtggaatacttgctattgataatggacaatttgaagcttcaaaagctttgggtttaacatatggacagacaatgaaaagaattatattaccacaagcaataagagtagtaattccaccttgtggtaatgagttcatagcaatgataaaagatacttctttggtttcagtaataactatggaggaacttttaagaaaagcacaacttttggtttcctcatctggtgatgcagttactccttacttgtttgcaggaatattctatttaattttgacaactatattcacagggatattctcaaagatagagaaaaaattatccgtatattaa

SEQ ID NO: 60802 - protein, 217 aa, Clostridium acetobutylicum ATCC 824
MDISSLNKVIPVLLDGTRITLLLTCSSIIIGCIIGTIIAMFKTSSVKVLNLIGKFYTWILRGTPLLLQLYVYYYGLPFLSDKLTMTPMKAAILGLSLNSGAYIAEIIRGGILAIDNGQFEASKALGLTYGQTMKRIILPQAIRVVIPPCGNEFIAMIKDTSLVSVITMEELLRKAQLLVSSSGDAVTPYLFAGIFYLILTTIFTGIFSKIEKKLSVY

SEQ ID NO: 60803 - DNA, 702 bp, Agrobacterium tumefaciens str. C58
  CDS (1)..(702): transl_table=11
ttggagaaagacgtgaagggttggaactgggaaggtttcttcgaatatctgacgaattattatctgttcgagggcgcgctggtgacgctcggtctcacggtgtttgccatgacggcgggtcttgcgctgggtttcgtcattgcggtcatgcgcatgtctaaataccggttcttgtccggtccggcctatttctacacctggatctttcgcggcactccgcttctggtgcagctcatcatcatctataccggcctgccgcaaatgggcatcaagctgacggtgctgcaatccacccttatcggcctgtcgctctgcgaagcggcctatctttctgaaatcgtccgggcgggcatcgccgccgtgccgaagggccagatcaatgcggcgcgggccatcggcatgaccgaggcgcaggtgatgcgctacatcgttgccccgcaggccttccgcatcatcatcccgccgcttggcaactccgtgaacggcgttttgaagacgacatcgatcgcctcgatcatttccatggaggagcttctgcgccgcacgcaggtgctcattcaggaaaagttcctcgtgctggagctgttcaccgtcgcggcgctttattatctggccatgacgaccgcctgggaactcattcagcgccgtatcgagaagcgcttcggcaaggcctatggtcccatgtcgactgacatacattaa

SEQ ID NO: 60804 - protein, 233 aa, Agrobacterium tumefaciens str. C58
MEKDVKGWNWEGFFEYLTNYYLFEGALVTLGLTVFAMTAGLALGFVIAVMRMSKYRFLSGPAYFYTWIFRGTPLLVQLIIIYTGLPQMGIKLTVLQSTLIGLSLCEAAYLSEIVRAGIAAVPKGQINAARAIGMTEAQVMRYIVAPQAFRIIIPPLGNSVNGVLKTTSIASIISMEELLRRTQVLIQEKFLVLELFTVAALYYLAMTTAWELIQRRIEKRFGKAYGPMSTDIH

SEQ ID NO: 60805 - DNA, 657 bp, Rickettsia conorii str. Malish 7
  CDS (1)..(657): transl_table=11
atgtttgagtatttaataaaattctatccaaaaatcttttttattgtagagggaactttggtaactttaaaatatagcgttattgccgttatattcggtttagtaatagggatgctgctcgctatttgtaaggtaaataaaaatcgtgctttaaggctttttgcaaatttctatacttctattttcagaggaacgcctttattaattcaattaagtattatttattttgcttcaccttatatcataggcattaaatttagtgtgtttatggcgggagctattgctttttctcttaattcgggagcatatgtttccgaagtaatcagggcagggattaatgcagttgataaagggcagtttgaagcggctgaagctcttgctattccaaagtttttaataacgaaagatataattctgccgcaagcagttaaaaatatttttccgtcattagtaaatgagcttgtaaatttgattaaagaatcagccattatttctatgcttggagaaatggatttaatgcgtagagcacaaattgtatcaattgaaacatataattatttttttccaatgcttattgctgcgtgctgttactatattttagtgatgttaatcagctttatagcaaaaataattgagaaaaaaatgattgttaattaa

SEQ ID NO: 60806 - protein, 218 aa, Rickettsia conorii str. Malish 7
MFEYLIKFYPKIFFIVEGTLVTLKYSVIAVIFGLVIGMLLAICKVNKNRALRLFANFYTSIFRGTPLLIQLSIIYFASPYIIGIKFSVFMAGAIAFSLNSGAYVSEVIRAGINAVDKGQFEAAEALAIPKFLITKDIILPQAVKNIFPSLVNELVNLIKESAIISMLGEMDLMRRAQIVSIETYNYFFPMLIAACCYYILVMLISFIAKIIEKKMIVN

SEQ ID NO: 60807 - DNA, 825 bp, Sinorhizobium meliloti 1021
  CDS (1)..(825): transl_table=11
atgaccgacgaaaccacccacgcgctcgcatacacgccggaagacctcccgagaaaggagagtttcctcaagcctcatcgcatcgtgctgatgcttctcctcgcggcgctcgtggtggcggtcgcggtcttcatgcgctgggactggctgccgcgctacctgccgaggctcggctccggcattctcgtgagcctggcgatgctcttcagcacggcgatcctcggcttcctcctggcagtgccgcttggcctcgcccaggtgaccgggccatggttcttcaaggctccggcccgcatcttctgtaccgtcatccgcgggacgccgctgctgctgcagctatggctcctctattacgggctcggctcgctgtttccgcagttcccggccatccggcaatcctttctctggccgtatctgcgcgaggcctggccctatggggtggcggcgctcacggtatccttcgccgcctatgagggcgaggtcatgcgcggcgcgttcgccggcgtgccgtccggggaattggaggccgcccgtgcctacggcatgggccgctggacgatgttccggcgcatctggctgccgcgggcgatccaccgcgcgctgcccaccctcaatggcgagaccgtgctgcagctgaaatccacgccgctcgtcgcgacgatcaccgtcgtcgacgtctatgcggtgatctcgaaggtgcggcaggaaacctacctgacctatgagccgctcctgctgctcgcggccatctacatgtgcctgaccgcaatcctggtcgtggccttccgttacttcgaaaaccgcatacccacccgtggtgcctga

SEQ ID NO: 60808 - protein, 274 aa, Sinorhizobium meliloti 1021
MTDETTHALAYTPEDLPRKESFLKPHRIVLMLLLAALVVAVAVFMRWDWLPRYLPRLGSGILVSLAMLFSTAILGFLLAVPLGLAQVTGPWFFKAPARIFCTVIRGTPLLLQLWLLYYGLGSLFPQFPAIRQSFLWPYLREAWPYGVAALTVSFAAYEGEVMRGAFAGVPSGELEAARAYGMGRWTMFRRIWLPRAIHRALPTLNGETVLQLKSTPLVATITVVDVYAVISKVRQETYLTYEPLLLLAAIYMCLTAILVVAFRYFENRIPTRGA

SEQ ID NO: 60809 - DNA, 804 bp, Sinorhizobium meliloti 1021
  CDS (1)..(804): transl_table=11
atgagcggactgtttgccgccctttccgccggtctcgcctggatcggtgcgatcatcgatccgctatgcggtcccgcggggatctttcgctggttcggctcgggaacgctacttgcatgcggagacgcgggttggggcgatgaaatcgcctatggcttcctggtcaccgccagtctcgcggtcgcaacgcttccggtgggcttggtcatcggcttcttcgtcgcgctcgccaagcaatctgaggaaaaatccctgcgactggcgggcaacatctatacgacgatttttcggggcctgccggaactcctcacgcttttcatcgtctattacggcctgcagatcctggttcaacagttcctcgcgacggtcggctatgagggagcggtcgagatcaatgccttcgtagcgggaatgatcgcactcggagtggtgttttcggcctattgctccgaggtgctgctttcggccttcaaggccattcctcacgggcagtacgaagccggtgacgcgctcgggctgcaccggggcaagacgatgcgcctcatcatcctgccgcagctcatccgaatcgcgctgcccggcctcggcaatctctggatggcgctgctcaaggataccgcccttgtctcggtcatcggccttccggacattctccggcaaaccgggatcgcggcgcgcgtcaccaagcatgccttcgagttcttcggcatcgcctgcgttctcttcctcgtcctggcgatgatttcctccgtcgtattctcggcgctcgagcgctcgaccaaacgcgcggaggcgggccgatga

SEQ ID NO: 60810 - protein, 267 aa, Sinorhizobium meliloti 1021
MSGLFAALSAGLAWIGAIIDPLCGPAGIFRWFGSGTLLACGDAGWGDEIAYGFLVTASLAVATLPVGLVIGFFVALAKQSEEKSLRLAGNIYTTIFRGLPELLTLFIVYYGLQILVQQFLATVGYEGAVEINAFVAGMIALGVVFSAYCSEVLLSAFKAIPHGQYEAGDALGLHRGKTMRLIILPQLIRIALPGLGNLWMALLKDTALVSVIGLPDILRQTGIAARVTKHAFEFFGIACVLFLVLAMISSVVFSALERSTKRAEAGR

SEQ ID NO: 60811 - DNA, 831 bp, Sinorhizobium meliloti 1021
  CDS (1)..(831): transl_table=11
atgagcattgccgagaccatgatcccgccgcaggcgccgccgccctccccgccgaagccctacaccttctcgcgctttttcggcagtgtggcgctcggcatctggctggcgctcggcgtcggcatcttcctgacggtcgtcaatggctgggacccggaaaaattctcccgctacggaccgagtttcctctccggcctcggagtaacgctgacactcgtcatctcgtcgattctcatgggcgccgtcctttcgctgcccgtggcgctcgggcgcatgtcgaagaacaggctctggggctggctcgcctatgcctatgtctatttcttccgcggcacgccgctcatcacccagctcttcctcatctattacgggctcggcagcttccgtccgcagctcgaaaccgttggactgtggtggttcttccgcgatgcctggaactgcgcgctcttcaccttcactctgaacaccgccgcctatcaggcggaaatcctgcgcggcgccatcgaaagcgtgccgcgcggccagcgcgagggggccgccgcgctcggcctgccggaacgcgtagccttcttcaaggtcattctgccccaggcgatgatcgtagcgctgcgcccctacggcaacgaaatcatcctgatgatcaagggctcggcaatcgtggcgatcgtcacggtcttcgatctcatgggtgagacgcggcgcgctttctcccggaccttcgactaccagatgtatatctgggcggcgatcctctatctgctgatggtggaattgctgcgcaacatctggggctggctggaagcccgcctgacccgccatctgaagcgctaa

SEQ ID NO: 60812 - protein, 276 aa, Sinorhizobium meliloti 1021
MSIAETMIPPQAPPPSPPKPYTFSRFFGSVALGIWLALGVGIFLTVVNGWDPEKFSRYGPSFLSGLGVTLTLVISSILMGAVLSLPVALGRMSKNRLWGWLAYAYVYFFRGTPLITQLFLIYYGLGSFRPQLETVGLWWFFRDAWNCALFTFTLNTAAYQAEILRGAIESVPRGQREGAAALGLPERVAFFKVILPQAMIVALRPYGNEIILMIKGSAIVAIVTVFDLMGETRRAFSRTFDYQMYIWAAILYLLMVELLRNIWGWLEARLTRHLKR

SEQ ID NO: 60813 - DNA, 972 bp, Sinorhizobium meliloti 1021
  CDS (1)..(972): transl_table=11
atgatcggtcgtatgattctgacttatccggatgcagcgcggcgcaccgggacgtttctcctgctcgcgctgataaccctgacggtctacagcctgggtgtcagcccggcctggatcggccttgttctgccgacgagctcggagtggctggccgccaatcccgcgctcggacggttggtcggcgcggtgatgatcgcggtgatagcggcgctgaactggaaggccctgcggcagctgcctcgccgctggcaggtggccggcgtctggctggagctcttcgcgctcctgatgctcttcttctattccttcaatctttcctttgcctttatcgccaagaagctcagcttcctgatctcgcagggcgtcgtcaccacgctctacatttcggtgatctcgatcgctgtcgcgaccgtcatcgcgcttgtgggcgcaattgcgaaactgtcgaagaacggtgtgatctacggtctcgccaccttctacacgtcgctctttcgcggcctgccgctcctgatgcagatctatatcatctatctcggtctgccgcaggtgggttacgtcatcagcgccgtgccggccggcatccttgcgctctcgctctgctacggcgcttatatgaccgaaatcttccgggcggggatcgagagcattccgcgggggcagacggaaggtgcgaccgcgctcggcctgagcccgagccagacgatggggctggtgatcctcccgcaggcgatgcgtgtgatcattccgccgaccggaaaccagttcatcgcgatgctgaaggattcctcgctgatctccgtcgtcggcgtctgggaactgatgtatctcgcccgcacccagggacagaccgagttccgtcacatcgaaatgctgatcacggcctccatgatctactggatcctttcgatcggcctcgaatatatgcagtcccgtgtcgaggcacggttcggacgcttcaatgtccgttga

SEQ ID NO: 60814 - protein, 323 aa, Sinorhizobium meliloti 1021
MIGRMILTYPDAARRTGTFLLLALITLTVYSLGVSPAWIGLVLPTSSEWLAANPALGRLVGAVMIAVIAALNWKALRQLPRRWQVAGVWLELFALLMLFFYSFNLSFAFIAKKLSFLISQGVVTTLYISVISIAVATVIALVGAIAKLSKNGVIYGLATFYTSLFRGLPLLMQIYIIYLGLPQVGYVISAVPAGILALSLCYGAYMTEIFRAGIESIPRGQTEGATALGLSPSQTMGLVILPQAMRVIIPPTGNQFIAMLKDSSLISVVGVWELMYLARTQGQTEFRHIEMLITASMIYWILSIGLEYMQSRVEARFGRFNVR

SEQ ID NO: 60815 - DNA, 660 bp, Caulobacter crescentus CB15
  CDS (1)..(660): transl_table=11
atggataccggcctcgacctgctgcgccagtccgcaccgctcctgttgaagggcgcgggctacacgatcgtcctcagcgtcatcggcatgagcatcggggtggtcctcggtttcttgctggccttgatgcgcctgtcgcgttcggcgctgctccgctggcccgccggcgtctatgtctcggcgtttcgcggcacgccgctcctggtgcagctcttcctgatctattacggcctgccgcaattcggtctggagatgccgccgctggtcgccgccgggatcggcttttcactgaacgtggccgcctacagctgcgagatcctgcgcagcgccatcgccgctgtcgacaagggtcagtgggaagccgccagcgtgctgggcatgagccggggccagaccctgcgccgggtgatcctgccccaggccgcgcgcaccgccgtcgcgccgctgtcgaacagcttcatcagcctggtcaaggacacctcactggccgccacgatccaggtgccagaactcttccgccaggcgcagctgatcaccgcgcggacctacgagatcttcaccctgtatctggccgcagcggcgatctactggatcctctccacgatcctggccgccgcccagacgcgccttgagcgccgcgccgcggagggccgccgatga

SEQ ID NO: 60816 - protein, 219 aa, Caulobacter crescentus CB15
MDTGLDLLRQSAPLLLKGAGYTIVLSVIGMSIGVVLGFLLALMRLSRSALLRWPAGVYVSAFRGTPLLVQLFLIYYGLPQFGLEMPPLVAAGIGFSLNVAAYSCEILRSAIAAVDKGQWEAASVLGMSRGQTLRRVILPQAARTAVAPLSNSFISLVKDTSLAATIQVPELFRQAQLITARTYEIFTLYLAAAAIYWILSTILAAAQTRLERRAAEGRR

SEQ ID NO: 60817 - DNA, 657 bp, Sinorhizobium meliloti 1021
  CDS (1)..(657): transl_table=11
atgatcagagccttcggctggaacgagtttctcgtcatcgtcgccgcggcacagtggacgatcgccctttccgcgatcgcctttgccggcggcagcgtcggcggactgctggtggcattgatgcgcgtctccgagacgcgagcgctgcgccttttcgccacgggcttcatccgcgtcttccaggggacgccgcttctgatgcagctctttctggtattcttcggcatgaacatcttcggctttgcgatcaatccctggattgccgcgaccattgcgctcgcgctccacgccagcgccttcctgggcgagatctggcgcggctgcatcgaggccgtgccgaagggacagcgcgaggcggcgactgcgctcggcctgcgctatttccggtcgatgcgtcatgtgatcctgcctcaggcggcccgtatcgccgtcgcacccaccgtcggtttcctggtgcagctcataaagggcacctcgctcgcatcgatcatcggctttaccgagctgacccggcaagggcagatcatcaacaatgcgacgttcagtccgttcctggtgttcggtaccgtcgccgccgtctattttctgctttgctggccgctgtcgctgatcgcacgccgaatggaaacacgtttttcccgggcaacggcacgttga

SEQ ID NO: 60818 - protein, 218 aa, Sinorhizobium meliloti 1021
MIRAFGWNEFLVIVAAAQWTIALSAIAFAGGSVGGLLVALMRVSETRALRLFATGFIRVFQGTPLLMQLFLVFFGMNIFGFAINPWIAATIALALHASAFLGEIWRGCIEAVPKGQREAATALGLRYFRSMRHVILPQAARIAVAPTVGFLVQLIKGTSLASIIGFTELTRQGQIINNATFSPFLVFGTVAAVYFLLCWPLSLIARRMETRFSRATAR

SEQ ID NO: 60819 - DNA, 684 bp, Sinorhizobium meliloti 1021
  CDS (1)..(684): transl_table=11
ttgaatatcggcatcgtattcgacgcgatacctcggatgctaggcggcatcgtgatgacattccagctattgctgctctccctggcgatcgggacaatgattgccgtcttgctgctcctgatgcggatcagcggccgctggtggctgtcgtggcctgcccagttctatacctatgtctttaggggcacgccgatcctggtgcagattttcatcgtctactacgggttgccccagttcgaatggattcgcgaaagcatattctggccgatactgcgagacccgttcggctgcgcgattctggcgctttcgctgaacaccggcgcttacctctcggaaatcttccgcggcggcgtgctcgccgtcgagcgcggccttctcgaggcgggcgcggccctcgggatgagcgcgacgcaccgcttcatttatataacgacgccgcttgccatccgcattgcccttccggcctatggcaacgaagtcatcagcctgatgaaatcgaccgctctcgccagtaccatcacgctcgtcgacatgaccggcatcgggcggacgatcgtcgccgagacctttgccccctaccaagtatttctctcactggcgatcgtctacgtggccataacgtggatcatccaacgatcggtgaagcgcctggaggtttacctcggccggtccaccgcacgctga

SEQ ID NO: 60820 - protein, 227 aa, Sinorhizobium meliloti 1021
MNIGIVFDAIPRMLGGIVMTFQLLLLSLAIGTMIAVLLLLMRISGRWWLSWPAQFYTYVFRGTPILVQIFIVYYGLPQFEWIRESIFWPILRDPFGCAILALSLNTGAYLSEIFRGGVLAVERGLLEAGAALGMSATHRFIYITTPLAIRIALPAYGNEVISLMKSTALASTITLVDMTGIGRTIVAETFAPYQVFLSLAIVYVAITWIIQRSVKRLEVYLGRSTAR

SEQ ID NO: 60821 - DNA, 687 bp, Sinorhizobium meliloti 1021
  CDS (1)..(687): transl_table=11
ctgtcccatgaaacggctgcttccatgacatactccttgaacttcgcggctgtgtggcgctcgttcgacctgcttctcgaaggcctggcgctcagcctcggcctggcatttgtcgcgatcctcgccggttgcgtgatcgggctgatcacggctttcgggctcatttccaggagggcgttgctgcgcaagcctgccgggctctacgtcacggtgatccgcaacacgccgatcctcgtcctcgtcctcttcagctatttcgcgcttcctgaactcggagtccgtcttggcaagatcgagagcttcgttgccacgcttgcaatctattcgggggcctatcttgccgaagtgtttcgcggcggcctcatcgccataccgcccggccagcgcgaggcggggctcgcgattgggcttacggagatgcagatacgcacgtcgatcatcattccgctgatgctgcgcagcgtcctgccctcgctcggcagtacgatgatctcgctcttcaaggatacctcgctcgccgcagcgatcgcggttccggaactcaccttcgaggcacgcaagatcaacgtcgagaccttccgcgtgatcgagacctggatcgttgcgagttgcctctatgtcgcgacctgctcgctgctggccgcgctgatgcgcgccgcggagcggcgtcttgcagtgccgaggtaa

SEQ ID NO: 60822 - protein, 228 aa, Sinorhizobium meliloti 1021
MSHETAASMTYSLNFAAVWRSFDLLLEGLALSLGLAFVAILAGCVIGLITAFGLISRRALLRKPAGLYVTVIRNTPILVLVLFSYFALPELGVRLGKIESFVATLAIYSGAYLAEVFRGGLIAIPPGQREAGLAIGLTEMQIRTSIIIPLMLRSVLPSLGSTMISLFKDTSLAAAIAVPELTFEARKINVETFRVIETWIVASCLYVATCSLLAALMRAAERRLAVPR

SEQ ID NO: 60823 - DNA, 669 bp, Salmonella typhimurium LT2
  CDS (1)..(669): transl_table=11
atgcttgagtatttacctgaactgctaaaagggctacacaccagcctgacgctgaccgtggcttctattgccgtcgctttggtgctggcgttagtttttaccatcatcctgacgctaaaaacaccgttcgtggtgtggctggtgcgcggctatatcacgctgtttaccggtacgccgttgttggtgcaaattttcctgatctactacggacccggtcaattcccgacgctgcaagagtatccactactctggcatctactgtctgaaccgtggctgtgcgcactgatcgcgttgtcgctaaacagcgccgcttacaccacgcagctattttatggcgcgattcgcgcgattccggaaggtcagtggcagtcctgtagcgcgctggggatgagtaagaaagatacgctggcgattttgttgccctatgcgtttaaacgcgccctctcctcctattctaatgaggtggtactggtcttcaaaagtacctcgctggcctataccatcaccttgatggaagtcatggggtacagtcagttgctctatggtcgtacctacgatgtggtggtatttggcgcggcaggcgtaatttacctggtcgtcaacggtctattgacgctgatgatgcgtttgattgagcgtaaagctctggcgtttgagcggcgcaattaa

SEQ ID NO: 60824 - protein, 222 aa, Salmonella typhimurium LT2
MLEYLPELLKGLHTSLTLTVASIAVALVLALVFTIILTLKTPFVVWLVRGYITLFTGTPLLVQIFLIYYGPGQFPTLQEYPLLWHLLSEPWLCALIALSLNSAAYTTQLFYGAIRAIPEGQWQSCSALGMSKKDTLAILLPYAFKRALSSYSNEVVLVFKSTSLAYTITLMEVMGYSQLLYGRTYDVVVFGAAGVIYLVVNGLLTLMMRLIERKALAFERRN

SEQ ID NO: 60825 - DNA, 669 bp, Salmonella typhimurium LT2
  CDS (1)..(669): transl_table=11
atgcaagaaagtatccaactggttattgaatcgctgccgtatttgcttaaaggcgccgtctttaccctgcaactgagtattggcggtatgttttttggtctgctgctgggatttgtgctggcgctgatgcggatgtctccgctatggccggttcgctggctggcgcgcttttatatctcgatttttcgcggtacgccgcttatcgcccagttatttatgatctattacggcctgccgcaatttggtattgagctggaccctatcccggcggcgatgattggtttatcgctcaataccgcggcttacacgtccgagacgctgcgcgcggcgatctcggctatcgacaagggacaatgggaagcggcggcgagcattggcatgacgccgtggcaaacgctacgtcgcgctattttgccgcaggccgctcgcgtcgcgcttccgccgttgagcaacagctttatcagcctggtgaaagatacgtcgctcgccgcgacgattcaggtgccggagttgttccgccaggcgcagttaattacctcgcgaacgctggaggtgtttaccatgtatctggccgcgtcgttaatctactgggtaatggcgaccgtcttatcggcactgcaaaactattttgaaaaccagcttaaccgccaggagagagagccaaaatga

SEQ ID NO: 60826 - protein, 222 aa, Salmonella typhimurium LT2
MQESIQLVIESLPYLLKGAVFTLQLSIGGMFFGLLLGFVLALMRMSPLWPVRWLARFYISIFRGTPLIAQLFMIYYGLPQFGIELDPIPAAMIGLSLNTAAYTSETLRAAISAIDKGQWEAAASIGMTPWQTLRRAILPQAARVALPPLSNSFISLVKDTSLAATIQVPELFRQAQLITSRTLEVFTMYLAASLIYWVMATVLSALQNYFENQLNRQEREPK

SEQ ID NO: 60827 - DNA, 642 bp, Listeria innocua Clip11262
  CDS (1)..(642): transl_table=11
atggattatatcatggaaattttaccagcattacttgacggggcgaaaacaaccttactcgtttttgtcgtcacgctagtttgttctatcccgctaggagctatagtggcagtaggaaacattagtaaaatagcccctctgaaatttattttaaacatttatatctggataatgcgaggtacaccattacttttacaattaatttttatctattatggtttgccgattatcggagttgtgtttgaccggatggacgcggtgtttattgcttttattttaaattatgctgcttatttcgcagagattttccggggtggctttctatcaatcgaaaacggacaatatgaaagtgctaaagttcttggtctaacttacggtcaaacgcttcgaaaaattgttttaccgcaagttgtcaaacgtgttttgccggcgatcggaaatgaagttatcaatttagtaaaagactcttcgttagtttacatccttggcattggtgatttactaagagcaggaaaaattgctatgagtagagacgttactttaattccactcgtattagtggctgcaatatacttagcgttaacggctatcctaacgctactatttaaacaattagaaaaacgttttagttattataaatga

SEQ ID NO: 60828 - protein, 213 aa, Listeria innocua Clip11262
MDYIMEILPALLDGAKTTLLVFVVTLVCSIPLGAIVAVGNISKIAPLKFILNIYIWIMRGTPLLLQLIFIYYGLPIIGVVFDRMDAVFIAFILNYAAYFAEIFRGGFLSIENGQYESAKVLGLTYGQTLRKIVLPQVVKRVLPAIGNEVINLVKDSSLVYILGIGDLLRAGKIAMSRDVTLIPLVLVAAIYLALTAILTLLFKQLEKRFSYYK

SEQ ID NO: 60829 - DNA, 672 bp, Ralstonia solanacearum GMI1000
  CDS (1)..(672): transl_table=11
atgagtgcagcggcatttcttgagcacgcgcgggagttcctgccgatcctgctgcagggggcggtggtcacggtggaggtgaccgtgctgtcgttcctgctgtccagcgtgatcgggctggcgctggcgctgatgcggctctcgcccatcaaggccgtgtcggcggccggggcgaccatcgtcaacatcatccgcgggctgccgatcatcgtgcagctgttctacatctacttcgtgctgccggacatcggcatccagctcaccgcgttccaggcgggcgtgatcgggctgggcattgcgtactcggcgtaccaggcggagaacttccgcgcgggcatcgaggcggtggacccgggccagcgcgaggcggcgcaggcgatgggcatgcgcggggcgctgatcatgcggcgcgtgatcctgccgcaggcgttccgcatcgcgctgccgccgtacggcaatacgctggtgatgatgctcaaggattcgtcgctggtgtccaccatcacggtggcggagatgacgcgcgcggggcagctgatcgcgtcgtccacgttccagaacatgacggtctatacgctggtggcgctgctgtacctgctgatgagcctgccgctggtgttcggcctgcgccggctggagcgccgcatgggcgcgggaaggggccagcgatga

SEQ ID NO: 60830 - protein, 223 aa, Ralstonia solanacearum GMI1000
MSAAAFLEHAREFLPILLQGAVVTVEVTVLSFLLSSVIGLALALMRLSPIKAVSAAGATIVNIIRGLPIIVQLFYIYFVLPDIGIQLTAFQAGVIGLGIAYSAYQAENFRAGIEAVDPGQREAAQAMGMRGALIMRRVILPQAFRIALPPYGNTLVMMLKDSSLVSTITVAEMTRAGQLIASSTFQNMTVYTLVALLYLLMSLPLVFGLRRLERRMGAGRGQR

SEQ ID NO: 60831 - DNA, 789 bp, Ralstonia solanacearum GMI1000
  CDS (1)..(789): transl_table=11
atgaccttcatctttgcaagctggccggtcgggtggagccggcagcagcgcagcacgctggcgatggccgcggcggcggcgctgctgctggtgctgctgtggctgatcgccattccgctggcggcggcgcccgagccgatcgccgccaatgcccagatctttgccgacggcacgcgcaccaccgtcaagctgacgctggcctcagccctggcgggcgtgctgctgggcatcgtggcggcgctgggcaagctctcgccggtgtcgctgctgcggcaggcggcgtcgttctatatctgggtgatccggggcacgccgctgctggtgcagatcctgttcgtcttcctggcgctgccggcctggctgccgtggctgcagatggacgacttcacctcggcctgcgtggcgctggccttcaacgccggtgcctacaacgccgaatcgatccgcgcggggctgctggcggtgccgaagggccagttggaggccgcgcactcgctcggcctgtcgcgctggcacacctttgccgacgtgatctttccccaggcgttcaaggttgccctgccgccgctggtcaacaacttcatctcgctgctcaaggactcctcgctggcgtatgcgatcggggtggtggagctgaccaacgtcggcaaccgcctgcaggccgccaccttccagccgctgccggccctggtgacgacggccgtcatctacctggccctgactacggtgctgacccagttctccaatgccgtggaacaacgcatggacgtggagggccgtcggcgatga

SEQ ID NO: 60832 - protein, 262 aa, Ralstonia solanacearum GMI1000
MTFIFASWPVGWSRQQRSTLAMAAAAALLLVLLWLIAIPLAAAPEPIAANAQIFADGTRTTVKLTLASALAGVLLGIVAALGKLSPVSLLRQAASFYIWVIRGTPLLVQILFVFLALPAWLPWLQMDDFTSACVALAFNAGAYNAESIRAGLLAVPKGQLEAAHSLGLSRWHTFADVIFPQAFKVALPPLVNNFISLLKDSSLAYAIGVVELTNVGNRLQAATFQPLPALVTTAVIYLALTTVLTQFSNAVEQRMDVEGRRR

SEQ ID NO: 60833 - DNA, 831 bp, Agrobacterium tumefaciens str. C58
  CDS (1)..(831): transl_table=11
atgagccatatccaggaactcattccgccgcggcccgcccccgttgtcgccgacaagccgctcaatctttcccgcgtcgtcggcattgccgtcatcacgctttggctgctgctcgccgccgggctgatcttcgccatgatcgaaggctgggactgggataaattccaacgttatggccctcgttacatcgatggcctcatcaccaccatcacgctggtcggcagctcgatcattctcggcgcaatcctgtccgtgccgatcgcctttgcccgcatgtcggaaaaccgcatcatcggcgcgttcgcttatgcctatgtctatgtgttccgcagcacgccgttgctcgcacagctcttcctgatctattacggccttggcagcttccgcccggcgctggaagccgtcgatctgtggtggttcttccgcgaagcctggtattgcggcctcctgtcgctaacgctcaacaccgccgcctatcaggccgagatcctgcgcggcgccatccggagcgtgccgcgcggccagcatgagggggccgcctccctcggcatttcgaaattcattaccttccgcaaggtcatcctgccgcaggcgctgatcgtcgcattgcgcccctatggcaacgagatcatcctgatgatcaagggctcggcagtcgtttccatcgtcacggtcttcgacctgatgggacagacccgttacgccttttcccgcaccttcgattatcaggcctatctctgggccgcgatcttctacctgacgatcgtcgaaacgctgcggcatatctgggcgtggctggaagcccgcctgacgcgacacctcaagcgctga

SEQ ID NO: 60834 - protein, 276 aa, Agrobacterium tumefaciens str. C58
MSHIQELIPPRPAPVVADKPLNLSRVVGIAVITLWLLLAAGLIFAMIEGWDWDKFQRYGPRYIDGLITTITLVGSSIILGAILSVPIAFARMSENRIIGAFAYAYVYVFRSTPLLAQLFLIYYGLGSFRPALEAVDLWWFFREAWYCGLLSLTLNTAAYQAEILRGAIRSVPRGQHEGAASLGISKFITFRKVILPQALIVALRPYGNEIILMIKGSAVVSIVTVFDLMGQTRYAFSRTFDYQAYLWAAIFYLTIVETLRHIWAWLEARLTRHLKR

SEQ ID NO: 60835 - DNA, 621 bp, Agrobacterium tumefaciens str. C58
  CDS (1)..(621): transl_table=11
gtgacgctcggtctcacggtgtttgccatgacggcgggtcttgcgctgggtttcgtcattgcggtcatgcgcatgtctaaataccggttcttgtccggtccggcctatttctacacctggatctttcgcggcactccgcttctggtgcagctcatcatcatctataccggcctgccgcaaatgggcatcaagctgacggtgctgcaatccacccttatcggcctgtcgctctgcgaagcggcctatctttctgaaatcgtccgggcgggcatcgccgccgtgccgaagggccagatcaatgcggcgcgggccatcggcatgaccgaggcgcaggtgatgcgctacatcgttgccccgcaggccttccgcatcatcatcccgccgcttggcaactccgtgaacggcgttttgaagacgacatcgatcgcctcgatcatttccatggaggagcttctgcgccgcacgcaggtgctcattcaggaaaagttcctcgtgctggagctgttcaccgtcgcggcgctttattatctggccatgacgaccgcctgggaactcattcagcgccgtatcgagaagcgcttcggcaaggcctatggtcccatgtcgactgacatacattaa

SEQ ID NO: 60836 - protein, 206 aa, Agrobacterium tumefaciens str. C58
MTLGLTVFAMTAGLALGFVIAVMRMSKYRFLSGPAYFYTWIFRGTPLLVQLIIIYTGLPQMGIKLTVLQSTLIGLSLCEAAYLSEIVRAGIAAVPKGQINAARAIGMTEAQVMRYIVAPQAFRIIIPPLGNSVNGVLKTTSIASIISMEELLRRTQVLIQEKFLVLELFTVAALYYLAMTTAWELIQRRIEKRFGKAYGPMSTDIH

SEQ ID NO: 60837 - DNA, 651 bp, Agrobacterium tumefaciens str. C58
  CDS (1)..(651): transl_table=11
atggcatcaatcggtcccaacgaactcttcttcctgatgcaaggcctgaaatggacccttgcgctgaccttgatcggcttcataggcggcggtgtcttcggcctttgcgtggcgctggcccgcgtcgcggacagcccggcaatccagcgtgcgagcatggctttcatcgccgttttccagggcacgccgctcctgatgcagcttttcgtggtttattacggcgtggcgcttgcgggcctcaacgtcgatgcctggatcgcggtcgccattgcctttaccctgcatgccagcgccttcctcggcgaaatctggcgcggcggcatccaggcagtgccgaagggccagaccgaggctgccaatgcgctcggcctgcattacgtgtcacgcatgaaggacgtggttctgccgcaggccttcaagatttcgctgccggccaccatcggtttcctcgtgcagctcatcaagggcacctcgcttgcggcaatcgtcggcttcgtcgagctgtcgcgcgccggccagatcgtctccaaccagacgttccgtccgctcaccgtcttcgccatcgtcggcatcatttatttcctgatctgctggccgctttccctgtggggcgccggcgttgaaaagcggctgcaggccgcatcccgctaa

SEQ ID NO: 60838 - protein, 216 aa, Agrobacterium tumefaciens str. C58
MASIGPNELFFLMQGLKWTLALTLIGFIGGGVFGLCVALARVADSPAIQRASMAFIAVFQGTPLLMQLFVVYYGVALAGLNVDAWIAVAIAFTLHASAFLGEIWRGGIQAVPKGQTEAANALGLHYVSRMKDVVLPQAFKISLPATIGFLVQLIKGTSLAAIVGFVELSRAGQIVSNQTFRPLTVFAIVGIIYFLICWPLSLWGAGVEKRLQAASR

SEQ ID NO: 60839 - DNA, 660 bp, Agrobacterium tumefaciens str. C58
  CDS (1)..(660): transl_table=11
atgacgcttcgaacattcggctggaacgaattcggcttcctcttgaccgccctgcaatggaccgtgcttctgacgatcattgcgcttgtcggcggcggcatcgtcggctttttcatcgcactcgcccgtacctcggataacaagctgctgcgtattgctgctggaacctatatccaggtcatccagggcattcctgtactgatgatcctgttcctgtcctattacggcctcagccttgctggactggaactgccgccactgatcgccgccggcgcatcgatgacgatctatacatcgggttatctcgccgaaatctggcgcggctgcatccaggcggtgccgaagcaacagtgggaagcgtccgagtcgctggcgctcacccgcgcccagcaatatcgctacgtcatcctgccgcaggcgatccgcatttccctgccgccgaccgtcggttttgccgttcaggtcgtcaagaatacgtccatcgcatcgatcatcggtttcgtcgaactggcaagagcggggcagctcatcaacaatgccacgttccagccgttccgtgtcttcgtcgcggtggccgtgctttatttcatcgtctgctacccgttgtcccagctgtcgcgttggctggaaaggaggcttcatgccggaagtaatcgttga

SEQ ID NO: 60840 - protein, 219 aa, Agrobacterium tumefaciens str. C58
MTLRTFGWNEFGFLLTALQWTVLLTIIALVGGGIVGFFIALARTSDNKLLRIAAGTYIQVIQGIPVLMILFLSYYGLSLAGLELPPLIAAGASMTIYTSGYLAEIWRGCIQAVPKQQWEASESLALTRAQQYRYVILPQAIRISLPPTVGFAVQVVKNTSIASIIGFVELARAGQLINNATFQPFRVFVAVAVLYFIVCYPLSQLSRWLERRLHAGSNR

SEQ ID NO: 60841 - DNA, 735 bp, Brucella melitensis 16M
  CDS (1)..(735): transl_table=11
atgttcattccggcccgatttattatcccaattactgcgaaggagccgaaactagtgccagactggcttcaactcatggcggattccctgcctacacttctctgggccgggttgatcttcaccattccgctcatcctgctttcctttaccttcggccttgcgctcggcctgctgaccgcgctcgtgcgtcttttcgcacccgtctggctatcctccgtcgcacggttctatgtctggattttccgtggcacaccgcttctcgtccagcttttcgtgatcttctatggcctgccgagcatcggtgtctatcttgatgcatttcccgccgcgctgatcggtttcacgctcaatatcggcgcctatagttccgaaatcattcgcgccgtcatttcctcggtgccgaaaggccaatgggaggccgcctattccatcggcatgagctggcggcaggcgcttatccgcaccattcttccgcaagcgacacgaaccgccgtaccgccgctttccaacaccttcatctcgctgatcaaggacacgtcactggcggccgcaatcaccgtgccggagctgttccagtccgcgcagcgcatcgtcgccaccacctatgagccgctcattctctatatcgaagcagcactcatctatctggcgctgagttccattctatcggccctgcaagtgcgtctggaacggcgcttcggacgttatggcggcacgctggagacaaacgcatga

SEQ ID NO: 60842 - protein, 244 aa, Brucella melitensis 16M
MFIPARFIIPITAKEPKLVPDWLQLMADSLPTLLWAGLIFTIPLILLSFTFGLALGLLTALVRLFAPVWLSSVARFYVWIFRGTPLLVQLFVIFYGLPSIGVYLDAFPAALIGFTLNIGAYSSEIIRAVISSVPKGQWEAAYSIGMSWRQALIRTILPQATRTAVPPLSNTFISLIKDTSLAAAITVPELFQSAQRIVATTYEPLILYIEAALIYLALSSILSALQVRLERRFGRYGGTLETNA

SEQ ID NO: 60843 - DNA, 690 bp, Pyrobaculum aerophilum str. IM2
  CDS (1)..(690): transl_table=11
atggcctttgaaaattatttagaagcgctgtggtacgtagtggggggcatcccaacgactatgtctctggctctcctctcatttgcaataggactagcgctgggctctatcctcttattagtgagatttttcctgccgaagccgcttccctggctggcctcagcctacgtggaggccttccggggaactcccctgctagtccaaatttttattgtctattttggagtcgggggatacctcaagggctatggaataaatattgaccccttcaccgcgggggtaatagccctggggctgaacagcgctgcctatcaggcggagatattcagatcggctgtgcaggcaataccagtagagcagtatttaaccgccgaggcctacgcgtttacaaagacacagacttttagatacataatcctcccccaagcgcttagaatcgcgttgccagctttaatgaacgagttagtgttgttaattaaagactcgtctttagtggccgtgataggcgtcacccctcctgacattttcagaagagctgactactattctgcgtcaaaattcgcgtattttgaggcgtatatggccgcggccactgtgtactttctgatttgctacgccatggtgaaaataagccattacattgagaggaaatacgccataccgggttatttaagaaggggtataatttag

SEQ ID NO: 60844 - protein, 229 aa, Pyrobaculum aerophilum str. IM2
MAFENYLEALWYVVGGIPTTMSLALLSFAIGLALGSILLLVRFFLPKPLPWLASAYVEAFRGTPLLVQIFIVYFGVGGYLKGYGINIDPFTAGVIALGLNSAAYQAEIFRSAVQAIPVEQYLTAEAYAFTKTQTFRYIILPQALRIALPALMNELVLLIKDSSLVAVIGVTPPDIFRRADYYSASKFAYFEAYMAAATVYFLICYAMVKISHYIERKYAIPGYLRRGII

SEQ ID NO: 60845 - DNA, 642 bp, Clostridium perfringens str. 13
  CDS (1)..(642): transl_table=11
ttgaattatattattactttaatgccctcaataatagaaggcttaaaaaatacattaggtgtttttatattaacactacttttatctattcctttaggaataatagttgcaatacttagattatcaaatattaaaatagtaaactttatatcatctttatatgttttagttatgcgtggaacccctttattattacaactaatatttatattttttggactaccaataataggagttagcatagatagattcccagctgccataatagcattcaccttaaattacgcagcttattttggcgaaatatttagatctggtataaaagatattgatagaggacaatttgaagcaagtaaaatcctaggtctttcaaaatggtttacctttaaaaagataattcttcctcaatcatttaaaaagactttaccttcaattgccaatgaagttattaccttagttaaagatacatccttagtttatgtagttggcataggtgaacttttaagagctggtaaaattgcaagtaacagagacgcttctctccttcccttgtttttaataggcataatatatctactgttaataggaattctaactaaaatatttaataggttagagaaaaaatattcatattataattag

SEQ ID NO: 60846 - protein, 213 aa, Clostridium perfringens str. 13
MNYIITLMPSIIEGLKNTLGVFILTLLLSIPLGIIVAILRLSNIKIVNFISSLYVLVMRGTPLLLQLIFIFFGLPIIGVSIDRFPAAIIAFTLNYAAYFGEIFRSGIKDIDRGQFEASKILGLSKWFTFKKIILPQSFKKTLPSIANEVITLVKDTSLVYVVGIGELLRAGKIASNRDASLLPLFLIGIIYLLLIGILTKIFNRLEKKYSYYN

SEQ ID NO: 60847 - DNA, 951 bp, Corynebacterium glutamicum ATCC 13032
  CDS (1)..(951): transl_table=11
atgtcagatcttaatcaagggcctggagcttcaacggcccaaccgaaaccgattgaagccaagccactacgccaccctggccggtgggtcgcagccgctatcatcgtggcactgctcgcatggtttatcatcagcgcgctcaacaatgaggcctacggttgggatacctaccgctcgtatctttttgacacccgcattgccaccgcggcacttcacaccattgcgctgaccttgctgtccatgatcttgggtgtggttctcggcgcaatcttggccgtcatgcgtatgtccggcaaccctgtcatgcagggcgtagcgtggctgtacctgtggattttccgcggcaccccaatttatgtgcagttggtgttctggggcctgctgggttccttgtaccagtcgatcaacctcggtttcgcagagatcgatctgcaaagcttgctgtctaatatgttcctgctcgcggtgatcggtctgggtctcaacgaggctgcgtacatggcggaaatcgtgcgctcgggcatccaagcggtgcctgagggccagatggaggcgtcgaaagctttgggtatgaactggtcaatgaccatgcgtcgcaccatcttgccgcaggccatgcgcatcatcattccgccaaccggcaatgaactgatctccatgctcaagaccacctctctggttgttgcgattccttattctctcgagctgtacggccgcagcatggatattgcgtactccctcttcgagccagttccaatgcttctggttgctgcgagctggtacttggtcatcacctctattcttatggttggtcagtactacctggagaagcacttcgaaaagggcagcacccgcaccctgaccgcacgtcagctcgctgcgttggctgatgctgaaggcgcaatcccgggcaatgtcaccgttgttcctgaaacttccaaggagaactag

SEQ ID NO: 60848 - protein, 316 aa, Corynebacterium glutamicum ATCC 13032
MSDLNQGPGASTAQPKPIEAKPLRHPGRWVAAAIIVALLAWFIISALNNEAYGWDTYRSYLFDTRIATAALHTIALTLLSMILGVVLGAILAVMRMSGNPVMQGVAWLYLWIFRGTPIYVQLVFWGLLGSLYQSINLGFAEIDLQSLLSNMFLLAVIGLGLNEAAYMAEIVRSGIQAVPEGQMEASKALGMNWSMTMRRTILPQAMRIIIPPTGNELISMLKTTSLVVAIPYSLELYGRSMDIAYSLFEPVPMLLVAASWYLVITSILMVGQYYLEKHFEKGSTRTLTARQLAALADAEGAIPGNVTVVPETSKEN

SEQ ID NO: 60849 - DNA, 651 bp, Streptococcus pyogenes MGAS8232
  CDS (1)..(651): transl_table=11
atgattaatatcccattaatgaaagatagtttaggatttgtgttatcgggattaccttatacccttggcatatcgttgcttagctttttaacggggctggtctttggtttgctccttgccctactaggaaggtcacgtcagccattgctacactatcttgttaggacctacatttctatcatgcggggtgtgccgatgattgtggtgctctttgttctttatttcgggttgccttattatggtttagaattaccagccttactttgcgcttaccttggtttttctatggtcagcgctgcctacatttctgaagtttttcgctcttctatagaagctattgacaagggacagtgggaagcagctaaggctttagggttgccatatgctcttatggttaagaaaattattcttcctcaagcctttcgaattgcagttcctcctctaggcaatgtcattattgatatggttaaaagttcgtcgctagctgccatgattaccgtaccagatatttttcaaaatgccaaaattatcggtggtagagagtgggattacatgtccatgtatattttagtggcctttatttattggcttattgcttttttgttagaacgttaccaagaattcttagaaaataagctagcacttgtttaa

SEQ ID NO: 60850 - protein, 216 aa, Streptococcus pyogenes MGAS8232
MINIPLMKDSLGFVLSGLPYTLGISLLSFLTGLVFGLLLALLGRSRQPLLHYLVRTYISIMRGVPMIVVLFVLYFGLPYYGLELPALLCAYLGFSMVSAAYISEVFRSSIEAIDKGQWEAAKALGLPYALMVKKIILPQAFRIAVPPLGNVIIDMVKSSSLAAMITVPDIFQNAKIIGGREWDYMSMYILVAFIYWLIAFLLERYQEFLENKLALV

SEQ ID NO: 60851 - DNA, 687 bp, Streptococcus pyogenes MGAS8232
  CDS (1)..(687): transl_table=11
atggatttgtcatttttgcccaaatactgggcctactttaactacggtgtacttgtcaccattatgatttcaatcagcgttgtcttttttggaacccttattggtgtcttggtaaccctgattaagcgtagtcatgtgaagccgttgacctgggtcgttaatctttacgtttggatctttcggggaacacctatggtggttcaaatcatgattgcctttgcttggatgcattttaacaatatgcctactattggttttggggttttagacttggacttttcaagactacttcctggaattattatcatttcattgaatagcggtgcttatatttcagaaattgttagagcaggtattgaggctgtaccaaaagggcaattagaagcagcttattcactaggtattcgtcctcaaaatgccatgcgttatgtgattttgcctcaggcctttaaaaatattttgccagccttaggaaatgaatttattaccattattaaggatagtgctcttttacaaaccattggagtgatggaactttggaatggtgcccaatcggtggtaacggctacttattctccaatttcccctttactggtggctgctttttactacttaatgatcacaacagtgatggcacagttattggcagtcttagaacgtcacatggcgcaaggaggtaatcattga

SEQ ID NO: 60852 - protein, 228 aa, Streptococcus pyogenes MGAS8232
MDLSFLPKYWAYFNYGVLVTIMISISVVFFGTLIGVLVTLIKRSHVKPLTWVVNLYVWIFRGTPMVVQIMIAFAWMHFNNMPTIGFGVLDLDFSRLLPGIIIISLNSGAYISEIVRAGIEAVPKGQLEAAYSLGIRPQNAMRYVILPQAFKNILPALGNEFITIIKDSALLQTIGVMELWNGAQSVVTATYSPISPLLVAAFYYLMITTVMAQLLAVLERHMAQGGNH

SEQ ID NO: 60853 - DNA, 663 bp, Thermoanaerobacter tengcongensis MB4
  CDS (1)..(663): transl_table=11
atgacagtagactttttgagcatggtaaaatacacgccactttttataagcggacttataatgacccttaaactgactttccttgcagtgacaattggagttctgatggggctttttatagctctgatgaagatgtcctcaataaaacctataaagcttgtcgcttcaagctatatagaagtgataaggggaactcctcttttagtgcaattacttctcatatacaatggacttatgcagtttggcatgaacattcctgcttttacagcaggagtttcagcactggcaataaacagttccgcatatgtggcagaaattataagggcagggatacaggctgttgacccggggcaaaatgaagcagcccgttctcttgggatgactcatgcaatggccatgaggtatgtcataataccccaggccataaaaaatatccttccggctttgggaaatgaatttattgtgatgctcaaagaatcggctatagtttcagtgataggctttgcagaccttacgcgtcaggcagacatcatacagagtgtgacttacaggtattttgagccttatataataatcgctgccatatactttgtaatgactttgactttttcaaaacttctttctctcttcgaaaggaggttgagggcaggtgatattcgttaa

SEQ ID NO: 60854 - protein, 220 aa, Thermoanaerobacter tengcongensis MB4
MTVDFLSMVKYTPLFISGLIMTLKLTFLAVTIGVLMGLFIALMKMSSIKPIKLVASSYIEVIRGTPLLVQLLLIYNGLMQFGMNIPAFTAGVSALAINSSAYVAEIIRAGIQAVDPGQNEAARSLGMTHAMAMRYVIIPQAIKNILPALGNEFIVMLKESAIVSVIGFADLTRQADIIQSVTYRYFEPYIIIAAIYFVMTLTFSKLLSLFERRLRAGDIR

SEQ ID NO: 60855 - DNA, 951 bp, Streptomyces coelicolor A3(2)
  CDS (1)..(951)
atgactgttgacatcgacaagacggcgggcggcccggccggcaccccgccgaccccgcccgaggccatcaaggccatcccggtgaggcactacgggcggtacgtctccgcggtcgtcgcgatcgcgctgctggccgcggtcgtctacgccttctcccagggcaagatcaactggggcgcgatcccggactacttcttcgacgaccgtgtcctgaccggcatgggcaagacgctcctgatcaccgtcctcgcgatgctgatcggtgtcgtcggcggcatcctgctcgccgtgatgcggctgtcgaagaacccggtgacctcgtccatcgcgtggttctacatctggttcttccgcggcaccccggtcctggtgcagctggtggtctggttcaacctcggcctggtcttcgagtacatcaacctcggcccgttctaccgcgacgagtggtcggacttcatgacgccgttcctgacggcgctgctcggcctcggcctcaacgaggcggcgtacatggcggagatctgccgcgccggcctgctcgcggtcgacgagggccagaccgaggcggcgcacgcgctcggcatgagccacaccaagacgctgcgccggatcgtggtcccgcaggcgatgcgcgtgatcgtgccgccgacgggcaacgaggtcatcaacatgctgaagacgacctcgctggtgtcggtcgtccagtacgccgagttgttcagagtcgcccaggacatcggccagacctctggcgcaccggccgagatgctgttcctcgcggcggcctggtacctgctgctgacctccgtcttcagcgtcggccagtactacctggagcgctactacgcccgcggctccagccgcagtctgccgcccaccccgatgcagaagatcagggccaacctgttctccctgtcgaaccgctccagcacgacgggaggtgcggcatga

SEQ ID NO: 60856 - protein, 316 aa, Streptomyces coelicolor A3(2)
MTVDIDKTAGGPAGTPPTPPEAIKAIPVRHYGRYVSAVVAIALLAAVVYAFSQGKINWGAIPDYFFDDRVLTGMGKTLLITVLAMLIGVVGGILLAVMRLSKNPVTSSIAWFYIWFFRGTPVLVQLVVWFNLGLVFEYINLGPFYRDEWSDFMTPFLTALLGLGLNEAAYMAEICRAGLLAVDEGQTEAAHALGMSHTKTLRRIVVPQAMRVIVPPTGNEVINMLKTTSLVSVVQYAELFRVAQDIGQTSGAPAEMLFLAAAWYLLLTSVFSVGQYYLERYYARGSSRSLPPTPMQKIRANLFSLSNRSSTTGGAA

SEQ ID NO: 60857 - DNA, 696 bp, Rhizobium etli
  CDS (1)..(696): transl_table=11
gtgcgctcgcaagaatattggagacttgcattgtacgcatttgtagatcaatttttatctggattgaagaacacacttttagtgtttgccttgagctgcgctttcgggaccctattaggtttgcttattgccgttctccgcaactcgacccgtaagtcggtttcatcgtgcatgcgggcctacacgggcatcatccggggtgttccggaacttctgatcatcctcctgacgtatttcggcggaaccgcccttttgagcgcgattgccggtggctacatcgagattaatgcatttgcggccggtgtcgcggcactgaccgtcgtgttcagcgggtacgccgcggaaatattccgtggtgcgatcaacgcggttgcaccaggccaacgagaggctgcagcggcgctcgggctttcgaacgcgcagatttggtttctgatcatcattccccagatgatcccgatcgctctgccggcattctgtaacctttgcatctccttgataaaggatacatcgctgatttccgtcgtcgggctgacggatgtcatgcgcgtcgcctatataggcgcaggctcactgcgcgctccactccccttctatctcgcagcgtctgcaatctacctcgccctcacaagcctgtcccttctttcgttccggttattggagcgccgctattcgctcccggcgatgaaaggttga

SEQ ID NO: 60858 - protein, 231 aa, Rhizobium etli
MRSQEYWRLALYAFVDQFLSGLKNTLLVFALSCAFGTLLGLLIAVLRNSTRKSVSSCMRAYTGIIRGVPELLIILLTYFGGTALLSAIAGGYIEINAFAAGVAALTVVFSGYAAEIFRGAINAVAPGQREAAAALGLSNAQIWFLIIIPQMIPIALPAFCNLCISLIKDTSLISVVGLTDVMRVAYIGAGSLRAPLPFYLAASAIYLALTSLSLLSFRLLERRYSLPAMKG

SEQ ID NO: 60859 - DNA, 750 bp, Rhizobium etli
  CDS (1)..(750): transl_table=11
atgagcatgaccatcgcgcttgaagcgtttctcacccttccccgcggccttcttctcactctggttctgacattcgcatcgcttgccgcaggcttcgccgtctcggtcccgctcgccttcctacgggcatcatcaaatccgtgggcttccgcgcccgtgctggcatatacctatgcgttccgcggcacgccacttctggttcagcttttcctgatttactacgggattggccagcttcccctcgtccgccaaagctttctatgggccgtgatgcgagagccgttctggtgcgccttcattgctttcaccctgaacagcgccgcccatacgacagaagttgtgcgcggcgggatccaggcggtcccgcgtgggcagattgaagcggccaaagccttgggcctttcccgtttccacactgcccgtcttatcgtgttccctttgaccctcaggatcgctcttcccgcctatgcaaatgaggtggttggaatgctgaaggcaagctcccttgcaagcaccatcacgctgcttgaggtgaccgggctcgcccgacagctggtgtcggagacattcgccccatacgaggtcttcattgccgcgggggctttctatctgctgcttaccctcttgatcacgcaaggtttccagatgctggagacgcgttggacgccgacggcaaaccgtccaccgccggcgcaacctgtacctcgaagagcgaacggaaagccgcctctcgcctcggctgaaacttga

SEQ ID NO: 60860 - protein, 249 aa, Rhizobium etli
MSMTIALEAFLTLPRGLLLTLVLTFASLAAGFAVSVPLAFLRASSNPWASAPVLAYTYAFRGTPLLVQLFLIYYGIGQLPLVRQSFLWAVMREPFWCAFIAFTLNSAAHTTEVVRGGIQAVPRGQIEAAKALGLSRFHTARLIVFPLTLRIALPAYANEVVGMLKASSLASTITLLEVTGLARQLVSETFAPYEVFIAAGAFYLLLTLLITQGFQMLETRWTPTANRPPPAQPVPRRANGKPPLASAET

SEQ ID NO: 60861 - DNA, 687 bp, Yersinia pestis KIM
  CDS (1)..(687): transl_table=11
atgctggatggatattccaaactgatatttgaaggtgcgctggtgacactggagttagcattgttctcggtgctgctgtcagtggttatcggcttgatgggggccggtggcaagttatcgtcaaaccggttggtatcgggcttgtttgagtgctacaccacactgatccgtggcgtacctgatttggttttgatgctgcttatcttctacggtttgcagattaccctcaatagcattaccgagtcccttggttttgtacaaattgatattgaccctctctctgccggggttatcacccttggctttatctatggcgcttacttcactgaaacgtttcgtggcgcttatatggcggtctctaaagggcaaattgaggccgcgacggcctttggttttacctccagccagatctttcgtcgcattatgttcccagccatgatgcgctatgcgttgccgggcatcggtaataattggcaagtgatcctgaaagcgacggcgctggtgtcaattttaggcttgaatgacgtggtcaaagccacccaattggcgggaaaaggcacttatcagccgtttttctttgctttggttgctggtgcgatttatctgttctttaccactctctctaacggtgtcttgtggtggctggaaaggcgctattcccatggggtgaagagggctgagctatga

SEQ ID NO: 60862 - protein, 228 aa, Yersinia pestis KIM
MLDGYSKLIFEGALVTLELALFSVLLSVVIGLMGAGGKLSSNRLVSGLFECYTTLIRGVPDLVLMLLIFYGLQITLNSITESLGFVQIDIDPLSAGVITLGFIYGAYFTETFRGAYMAVSKGQIEAATAFGFTSSQIFRRIMFPAMMRYALPGIGNNWQVILKATALVSILGLNDVVKATQLAGKGTYQPFFFALVAGAIYLFFTTLSNGVLWWLERRYSHGVKRAEL

SEQ ID NO: 60863 - DNA, 717 bp, Yersinia pestis KIM
  CDS (1)..(717): transl_table=11
atgattgaaatcttacatcaatattggcaggcattactttggagtgatggctaccgctttaccggcatggcggtcactctctggttattaatttcttcggtcgtcatgggggggttactggcgctcccattggcggttgctcgggtgtctgaacggagatggatccgtttaccagtatggatttttacctatatattccgtggtacaccgctgtatgtgcagctattggtgttctattccggaatgtatagtttggagataatccgaggcaatgatctgctcaatgctttttttcgcagtggattaaattgcactattttagcgctgacgcttaatacctgtgcttataccactgagatttttgccggtgcgatccgttcggtacctcatggtgaaatagaagcagcacgcgcctatggtttctcacgttttaaattataccgctgcattatcttacctgctgcattgcgtatctctttaccggcatacagcaatgaagtgatcttaatgctgcactccaccgcgctggcttttaccgcgaccgtacccgatatattgaaaatagctcgcgatattaacgcggcgacttaccaacccttttatgcgttcagtattgccgctgtactttatttgagcatctcctttacgctaattagcctgttccgccaggcagaaaaacgttggttagcccatattcaacctcaggcatcgcattag

SEQ ID NO: 60864 - protein, 238 aa, Yersinia pestis KIM
MIEILHQYWQALLWSDGYRFTGMAVTLWLLISSVVMGGLLALPLAVARVSERRWIRLPVWIFTYIFRGTPLYVQLLVFYSGMYSLEIIRGNDLLNAFFRSGLNCTILALTLNTCAYTTEIFAGAIRSVPHGEIEAARAYGFSRFKLYRCIILPAALRISLPAYSNEVILMLHSTALAFTATVPDILKIARDINAATYQPFYAFSIAAVLYLSISFTLISLFRQAEKRWLAHIQPQASH

SEQ ID NO: 60865 - DNA, 669 bp, Yersinia pestis KIM
  CDS (1)..(669): transl_table=11
atgttggaatatatacccgagatactgaaagggctgcataccagcctgaccttgaccatcgtctctttgctggtggcgttggtgctgtcagtggtgtttaccatcgttctgacgctgaaaacccccattgccaccccgctggtcaaaatttatatcaccttgttcaccggtaccccgctgttggtacagatctttttgatctattacggtccagggcaattcccggcaatccgcgaatatccgtggttgtggagtctgctgtcacagccatggctgtgcgcaatgattgctctggcattgaacagtgcggcgtataccactcaactgttctacggtgcagtacgggctattccctctggccaatggcaatcctgtgaagcgctggggatgtcaaaacgtcaatcgttacgtattctgctgccttttgcctttaaacgggcgctatcatcctattccaacgaagtggtcttggtcttcaaagggacctcgctggcatacactatcaccttgatggaggtcatggggtatagccaactgatgtatggccgaacctatgacgtgatggtgtttggtgccgccggggttgtttacctgtgcgtgaatggtttgctgacgttgctgatgcggttagtggagcgcaaagccctggcctttgagcgacggaattaa

SEQ ID NO: 60866 - protein, 222 aa, Yersinia pestis KIM
MLEYIPEILKGLHTSLTLTIVSLLVALVLSVVFTIVLTLKTPIATPLVKIYITLFTGTPLLVQIFLIYYGPGQFPAIREYPWLWSLLSQPWLCAMIALALNSAAYTTQLFYGAVRAIPSGQWQSCEALGMSKRQSLRILLPFAFKRALSSYSNEVVLVFKGTSLAYTITLMEVMGYSQLMYGRTYDVMVFGAAGVVYLCVNGLLTLLMRLVERKALAFERRN

SEQ ID NO: 60867 - DNA, 804 bp, Streptococcus agalactiae 2603V/R
  CDS (1)..(804): transl_table=11
atgaatcaatttatcttgacgggtggatggtcttggtataataatttggttagtcaggttccagcggggaaattatttagttggaaggctgttttagatgcaataccctcaattttagagcgattacccataacactattattgacagtagcaggagccttatttggactcattttagctttgatttttgcagtagtgaaaattaaccgtgtcaaaattttatatccgattcaagctttatttgttagttttttacgtgggactccaatacttgttcaattaatgctgagttattatggaattccacttttcttgaaatttttaaaccaaaaatatggttttgattggaacattaatgctataccggcttctgtatttgctattactgcatttgcttttaatgaagcggcttatacaagtgaaactatacgagcggcgattttgtcggttgatcaaggtgaaattgaggcagcacgtagtttagggatgacctcagcgcaagtttatcgtcgtgttattattccaaacgcagcagtagtcgcaacacctactttgataaacacgttaattggtctaactaagggaacctctttagcttttaatgctggtattgttgaaatgtttgcccaagcacaaattatgggtggtagcgattatcgctattttgaacgttatatctctgtggcacttgtttactgggcggttagtttcttaattgaacaattgggaaatgctattgaacgaaaaatggcaattaaggctccacgccatttaactgatgagattccaggaggagtacgctaa

SEQ ID NO: 60868 - protein, 267 aa, Streptococcus agalactiae 2603V/R
MNQFILTGGWSWYNNLVSQVPAGKLFSWKAVLDAIPSILERLPITLLLTVAGALFGLILALIFAVVKINRVKILYPIQALFVSFLRGTPILVQLMLSYYGIPLFLKFLNQKYGFDWNINAIPASVFAITAFAFNEAAYTSETIRAAILSVDQGEIEAARSLGMTSAQVYRRVIIPNAAVVATPTLINTLIGLTKGTSLAFNAGIVEMFAQAQIMGGSDYRYFERYISVALVYWAVSFLIEQLGNAIERKMAIKAPRHLTDEIPGGVR

SEQ ID NO: 60869 - DNA, 693 bp, Streptococcus agalactiae 2603V/R
  CDS (1)..(693): transl_table=11
atgaatttttcatttttaccacaatattggtcctattttaattatggtgtgatggtaaccattatgatttcaacatgtgttgttttttttggaactattataggtgtgttaattgctttagtaaagcgtactaatttacattttctcacaatattagctaatttctatgtatgggtatttcgtgggacaccgatggtagttcaaattatgattgctttcgcatggatgcattttaacaatttaccaacgattagctttggtgttttagatttagattttacacgacttttacctggtatcattatcatttccttaaatagtggtgcctatatttcggaaattgtacgtgcagggattgaggctgtaccatctggacaaatagaagcagcttactcgttggggattcgacctaaaaatacacttcgctatgttatcttaccccaagcttttaaaaatattttacctgctctagggaatgaatttattacaattattaaagatagtgctctccttcaaactattggtgtcatggaattatggaacggagcacaatcagttgtaacggctacttactcaccagttgcaccgttattatttgcagcattttactatttaatgttgacaacgattctctcagctttgttaaaacaaatggagaaatatcttgggaaaggggtaaaaatagatggttga

SEQ ID NO: 60870 - protein, 230 aa, Streptococcus agalactiae 2603V/R
MNFSFLPQYWSYFNYGVMVTIMISTCVVFFGTIIGVLIALVKRTNLHFLTILANFYVWVFRGTPMVVQIMIAFAWMHFNNLPTISFGVLDLDFTRLLPGIIIISLNSGAYISEIVRAGIEAVPSGQIEAAYSLGIRPKNTLRYVILPQAFKNILPALGNEFITIIKDSALLQTIGVMELWNGAQSVVTATYSPVAPLLFAAFYYLMLTTILSALLKQMEKYLGKGVKIDG

SEQ ID NO: 60871 - DNA, 693 bp, Oceanobacillus iheyensis HTE831
  CDS (1)..(693): transl_table=11
atgactattattttaatgacaaagttgtttaatatttttgatgttgaacttgctttacaaaatttacctttcatattagaggggttaccctatacaatcatgattgccgtagcaggtatggcaattggattaatttttggcttatttcttgcattggcgagagattcaaaaacaatactattacgttggccgtctagaatctatatatcctttatgaggggaacaccaatgcttgtctttctctttattatatattttggattaccttacatggggattgagctatcggctatttcagctgcgattctagggtttgggcttaatagtgctgcttatattgcggaaattaatcgttcatcgttaaatagtgttgatagaggacaatgggaatcagcaaaagcacttaatatgacttattggcatacattacgaaaaattattttgccacaagcaacaagaatagcaattccaccattgaccaatgtttttatggatatcgttaaggcgacatcattaactgcggtaataactgtgcccgaacttttccaaaaagcacagattgtaacaggtcgagaatttgatgcgatgacagtgtatattttagttgctttaatatattggccgatttgtattttgattggaatgcttcaagaaagattagaaaaaagatacagcgtttatgtagctaaataa

SEQ ID NO: 60872 - protein, 230 aa, Oceanobacillus iheyensis HTE831
MTIILMTKLFNIFDVELALQNLPFILEGLPYTIMIAVAGMAIGLIFGLFLALARDSKTILLRWPSRIYISFMRGTPMLVFLFIIYFGLPYMGIELSAISAAILGFGLNSAAYIAEINRSSLNSVDRGQWESAKALNMTYWHTLRKIILPQATRIAIPPLTNVFMDIVKATSLTAVITVPELFQKAQIVTGREFDAMTVYILVALIYWPICILIGMLQERLEKRYSVYVAK

SEQ ID NO: 60873 - DNA, 834 bp, Brucella suis 1330
  CDS (1)..(834): transl_table=11
atgaaccaagtcgcctccaatccgtccgccgagataatggctcctccgccagtcgtgaaaacatggacgcgaacgcggatagccggccatatcattgtcggcgtgtggttcctgctttttgcagggcttgcaatctatctctataatggctggcgtatcgaccttatcgaaacctatgggccgcgatactggtccggcctgctcatcacgctaaaactggtcgccatttccattgtcatcggagcgctgttatcgctgcccatcacggcagcgcgcatgtcgaacagccggtggttgcgttcccttgctttcggctatgtctattttttccgcgggacgccgctgctcgcccagaccttcctgatctattacggcttcggcacgttccgtccgtttctggaaagcgtcgggctttgggtgttcttccgcgatgcgtggaattgcgccattctggccttttcgctcaacacggccgcttatcaggctgaaatcctgcgcggcgccatcgaaagcgtagcggtcggccaatgggaaggcgctgccgcattgggcatctcgaagcgcgtcaccttctggaaggtcattcttccacaggccctcatcgtcgcgctgcgcccttatggcaatgaaattatcctgatgatcaagggatcggccattgtcgcgatcatcacagtgcttgatctgatgggcgaaacacgccgcgcctattcgcgtacgttcgattttcagacctatctatgggcagccgtgatctatcttctgatggtcgaaattctgcgccacatatgggatgcgcttgagcggcgcctgacccggcatctcaaacgctag

SEQ ID NO: 60874 - protein, 277 aa, Brucella suis 1330
MNQVASNPSAEIMAPPPVVKTWTRTRIAGHIIVGVWFLLFAGLAIYLYNGWRIDLIETYGPRYWSGLLITLKLVAISIVIGALLSLPITAARMSNSRWLRSLAFGYVYFFRGTPLLAQTFLIYYGFGTFRPFLESVGLWVFFRDAWNCAILAFSLNTAAYQAEILRGAIESVAVGQWEGAAALGISKRVTFWKVILPQALIVALRPYGNEIILMIKGSAIVAIITVLDLMGETRRAYSRTFDFQTYLWAAVIYLLMVEILRHIWDALERRLTRHLKR

SEQ ID NO: 60875 - DNA, 723 bp, Brucella suis 1330
  CDS (1)..(723): transl_table=11
atggaacactacgccaccttgttgagtttcggtcccgatggctggggtatcagcattgccaaaggacttcttgttaccgtcagtctggcactcgccacacttcccgttggtctcatccttggttttctggtcgctctgggcaagcagtccagcgaaccttcgatgcggcttgcggctaatatctacaccaccatctttcgcggtctgccggaactcctgacgctcttcctggtctatttcggggcctcgcttgggcttcagcgtttgctccatctgttcggcatcgacgcgaatatcgagatcaatgccttcgtagcgggcatggtggctctcggtttcgtcttctcatcctattccagcgaggtattcctttccgctttccgcgccatcccgcacgggcaatatgaaggcggatacgcggtgggcctgtcacgccggcagacgatgcgcatggtcattttcccgcaattgatccgcattgcacttccgggccttgccaatctgtggctggtgctgctcaaggatacgtcgcttgtttcggtcatcaccctgtccgacattcttcgccagacctcgattgctgcgcgcgtaaccaaggaacccttcctgttcttcggcatcgcctgcctgctctatctggcgcttgcgatcatttcgtcctatttcatcaaccgtatcgcccgctgggccgattccggcgccaatcgcccgcggggagcgtaa

SEQ ID NO: 60876 - protein, 240 aa, Brucella suis 1330
MEHYATLLSFGPDGWGISIAKGLLVTVSLALATLPVGLILGFLVALGKQSSEPSMRLAANIYTTIFRGLPELLTLFLVYFGASLGLQRLLHLFGIDANIEINAFVAGMVALGFVFSSYSSEVFLSAFRAIPHGQYEGGYAVGLSRRQTMRMVIFPQLIRIALPGLANLWLVLLKDTSLVSVITLSDILRQTSIAARVTKEPFLFFGIACLLYLALAIISSYFINRIARWADSGANRPRGA

SEQ ID NO: 60877 - DNA, 681 bp, Brucella suis 1330
  CDS (1)..(681): transl_table=11
gtgccagactggcttcaactcatggcggattccctgcctacacttctctgggccgggttgatcttcaccattccgctcaccctgctttcctttaccttcggccttgcgctcggcctgctgaccgcgctcgtgcgtcttttcgcacccgtctggctatcctccgtcgcacggttctatgtctggattttccgtggcacaccgcttctcgtccagcttttcgtgatcttctatggcctgccgagcatcggtatctatcttgatgcatttcccgccgcgctgatcagtttcacgctcaatatcggcgcctatagttccgaaatcattcgcgccgtcatttcctcggtgccgaaaggccaatgggaggccgcctattccatcggcatgagctggcggcaggcgcttatccgcaccattcttccgcaagcgacacgaaccgccgtaccgccgctttccaacaccttcatctcgctgatcaaggacacgtcgctggcggccgcaatcaccgtgccggagctgttccagtccgcgcagcgcatcgtcgccaccacctatgagccgctcattctctatatcgaagcagcactcatctatctggcgctgagttccattctatcggccctgcaagtgcgtctggaacggcgcttcggacgttatggcggcacgctggagacaaacgcatga

SEQ ID NO: 60878 - protein, 226 aa, Brucella suis 1330
MPDWLQLMADSLPTLLWAGLIFTIPLTLLSFTFGLALGLLTALVRLFAPVWLSSVARFYVWIFRGTPLLVQLFVIFYGLPSIGIYLDAFPAALISFTLNIGAYSSEIIRAVISSVPKGQWEAAYSIGMSWRQALIRTILPQATRTAVPPLSNTFISLIKDTSLAAAITVPELFQSAQRIVATTYEPLILYIEAALIYLALSSILSALQVRLERRFGRYGGTLETNA

SEQ ID NO: 60879 - DNA, 687 bp, Shigella flexneri 2a str. 301
  CDS (1)..(687): transl_table=11
atgttgtatgggttttcaggtgttattttacagggtgcgctcgtcacgctggagctggctatcagctctgtagtgctcgctgtaatcatcggtttaattggcgctggcggtaagctctcgcaaaatcggctttcggggctgattttcgaagggtacaccacgctgattcgaggcgtgccggacttggtgttgatgctgctgattttctatggtttgcagattgcgctaaacatggtgacggaggcgatgggcgtcgggcagattgatatcgatccgatggtcgctggtattatcactctcggttttatctacggtgcttattttaccgaaacgttccgtggcgcgtttatggcagtgccgaaagggcatatagaggcggcgacggcgttcggttttactcgcgggcaagtgtttcggcggatcatgtttccggcgatgatgcgttacgccctgccaggcattggcaacaactggcaggtgatcctcaaatctaccgcactggtttcgttactcggcctggaagatgtggtcaaagccacgcagctggcaggcaaaagtacctgggaaccgttctatttcgccatcgtctgtggcgtgatttacctggttttcaccaccgtttccaatggtgtgctgctgttccttgagcgccgctactccgtgggtgtgaagagggctgacctgtga

SEQ ID NO: 60880 - protein, 228 aa, Shigella flexneri 2a str. 301
MLYGFSGVILQGALVTLELAISSVVLAVIIGLIGAGGKLSQNRLSGLIFEGYTTLIRGVPDLVLMLLIFYGLQIALNMVTEAMGVGQIDIDPMVAGIITLGFIYGAYFTETFRGAFMAVPKGHIEAATAFGFTRGQVFRRIMFPAMMRYALPGIGNNWQVILKSTALVSLLGLEDVVKATQLAGKSTWEPFYFAIVCGVIYLVFTTVSNGVLLFLERRYSVGVKRADL

SEQ ID NO: 60881 - DNA, 681 bp, Shewanella oneidensis MR-1
  CDS (1)..(681): transl_table=11
atgttagaagcaatcaatacttcgctgtttagccccattggcgacgacggcatgataggcatactgctcattttaaatggcttgaaagtcactttgattgtgaccttcttcgccatgttactaggcgcagtattaggcgtgggcaccacactgatgaagatgtcatctaagtggtatatccgcttccccgccgaactctatgtgggcgtgatccgcggcacgcctgtggtggtgcagttagtgatcctttacttcatcgtgctggcagcattggatgtcgataaaatcaccgctgccattatcgcctttggcttaaacagtggcgcttatatctctgagattattcgtgctggcattcaagccgtcgataaaggccaaaccgaagccgcgcgctcgcttggtctgtcacaagcgatgacaatgaagctgattattctgccgcaggcgattaagaatattctgcccgcattaggcaatgagtttattgtgctactcaaggaaaccgcagtgattggctttattggcggtgtggacttgatgcgggcgggagaaattattcgcagccgcacctttgaagacagtgttccactctttacctgcgcgctgatttatctgttcctaacctacagcttcacatttatgctgtcgaaattcgaaaagaggttgaagcaaagtgattaa

SEQ ID NO: 60882 - protein, 226 aa, Shewanella oneidensis MR-1
MLEAINTSLFSPIGDDGMIGILLILNGLKVTLIVTFFAMLLGAVLGVGTTLMKMSSKWYIRFPAELYVGVIRGTPVVVQLVILYFIVLAALDVDKITAAIIAFGLNSGAYISEIIRAGIQAVDKGQTEAARSLGLSQAMTMKLIILPQAIKNILPALGNEFIVLLKETAVIGFIGGVDLMRAGEIIRSRTFEDSVPLFTCALIYLFLTYSFTFMLSKFEKRLKQSD

SEQ ID NO: 60883 - DNA, 804 bp, Streptococcus mutans UA159
  CDS (1)..(804): transl_table=11
atgtttaatctattattaacgataaattggtatgacaaacttgttgccagtttacctaacggtaaattattcagttggcgggcagtctttgatgccattccatctattttagaaaagctgccaacaactttaattttgactttaggtggatccatttttggtcttgttttggcgcttttatttgccattgttaaacttaatcgtgttaaaattctctatcccatccaagctttctttgtttcttttttaagggggacgccgatcttggttcaactgatgttgacctattatggtattcctttgttactgaaagccctcaatcaaaagatggggactgattttaatattaatgctattccagcatctgtttttgcgattacagcctttgcttttaatgaagctgcctacactagtgaaaccattcgtgcagctattcaatctgtcaattctggggaaattgaagcagctaagagtttggggatgacaactgctcaggtttaccgacgtgttatcattcctaatgcagctgtggtggcaactccaaccttgattaatacgttaattggcttgaccaagggaacctctcttgcctttaatgccggaattgttgaaatgtttgctcaggctcagattctcggtggtagtgattatcgttactttgaacgtttcatttccgtagctattatttattggggtgttagcattattattgaacaagttggtcgtcttatcgaaaagaaaatggagattgtttctcctgatcacattgttaaggatcaagctgtggaaggaggtgtgcgttaa

SEQ ID NO: 60884 - protein, 267 aa, Streptococcus mutans UA159
MFNLLLTINWYDKLVASLPNGKLFSWRAVFDAIPSILEKLPTTLILTLGGSIFGLVLALLFAIVKLNRVKILYPIQAFFVSFLRGTPILVQLMLTYYGIPLLLKALNQKMGTDFNINAIPASVFAITAFAFNEAAYTSETIRAAIQSVNSGEIEAAKSLGMTTAQVYRRVIIPNAAVVATPTLINTLIGLTKGTSLAFNAGIVEMFAQAQILGGSDYRYFERFISVAIIYWGVSIIIEQVGRLIEKKMEIVSPDHIVKDQAVEGGVR

SEQ ID NO: 60885 - DNA, 687 bp, Streptococcus mutans UA159
  CDS (1)..(687): transl_table=11
atggatttttcatttttatctaaatattgggcttattttaattatggtgttcttgtaaccatcatgatttcagcctgtgttgtcttttttgggacgattattggtgttcttgtggctttgattaaacgcagtcgtatcaaggttttagattggctggtttccttttacgtgtggatttttcgtggtactcctatggttgtgcaaattatgatttcttttgtccttttacattttaccaatatgccaattgttaaatttggtgttttagatttggatttttcccgtcttttgccagggattattgtcctgtcacttaatagtggggcctatatttcagaagttgttcgtgcaggaattgaagcagtgcctaaaggacaattagaagccgcttattctttaggaattaagccggtaaatgccatgcgctatgtcatcttgccgcaagctttcaaaaatattttgcctgctttggggaatgaatttatcacaattatcaaagacagctctcttttacaaacgattggggttatggaactatggaatggcgctcaatcagtcgtaacggcaacctatctgcctttgaccccacttttatttggtgccttttattatttgatggtgacaaccttgatgtcagcacttgttaaattacttgaaaatcgttttggtaaaggagatgccagctaa

SEQ ID NO: 60886 - protein, 228 aa, Streptococcus mutans UA159
MDFSFLSKYWAYFNYGVLVTIMISACVVFFGTIIGVLVALIKRSRIKVLDWLVSFYVWIFRGTPMVVQIMISFVLLHFTNMPIVKFGVLDLDFSRLLPGIIVLSLNSGAYISEVVRAGIEAVPKGQLEAAYSLGIKPVNAMRYVILPQAFKNILPALGNEFITIIKDSSLLQTIGVMELWNGAQSVVTATYLPLTPLLFGAFYYLMVTTLMSALVKLLENRFGKGDAS

SEQ ID NO: 60887 - DNA, 675 bp, Streptococcus mutans UA159
  CDS (1)..(675): transl_table=11
atggatttttcttatatttttcatacatttttactttccttaaagggtgttcctgtgaccttagtcatcatgatagtctctatactgctgagctttttaccggctttgtttttggctttgggcagaatttacaaggtaaaaggtgtgacgactttttcgattgtttatctagcttttattagagcaacaccgcctattcttttgattctctttttttacagtcttttacccagtgttttaaataccattttaaaatcaagcggattagatatttttaaacttaatcctatttattatgcttttattatctttagtctaatgacaacagggagtctatcagaaattttacgctctgctattttaacggttgataagggacagttggaagcagctcagtctattggtttaacaacgacacaaagttatctcagaattatttttccacaggctttgaggtctgctcttcccaatctttgtaatttggtgattaatattgttaaaggaacttcgcttgtttttgtcatgacagttaaggatattacagcaatagctaaggttgaagcggctcatggttaccaatattttgaatcttatcttgtgattttcattatttatattattatttgtggtttgattcagtggagcttttcaactttagaaaagcgttttgcttaa

SEQ ID NO: 60888 - protein, 224 aa, Streptococcus mutans UA159
MDFSYIFHTFLLSLKGVPVTLVIMIVSILLSFLPALFLALGRIYKVKGVTTFSIVYLAFIRATPPILLILFFYSLLPSVLNTILKSSGLDIFKLNPIYYAFIIFSLMTTGSLSEILRSAILTVDKGQLEAAQSIGLTTTQSYLRIIFPQALRSALPNLCNLVINIVKGTSLVFVMTVKDITAIAKVEAAHGYQYFESYLVIFIIYIIICGLIQWSFSTLEKRFA

SEQ ID NO: 60889 - DNA, 723 bp, Corynebacterium efficiens YS-314
  CDS (1)..(723): transl_table=11
gtgttgtccatgatcatcggtgtggtgttcggtgccaccctggcggtgatgcgcatgtccggcaacccggtgctgcagggtgtggcctggctgtacctgtggatcttccgtggcaccccgatctacgtccagctggtgttctggggtctgctcggttcgctctaccagaccgtgaacctcggattcgcggagattgatctacagaacttcctgtccaacatgttcatcctcgctgtcctgggtctgggtctgaacgaggccgcctacatggccgagatcgtccgttccggtatccaggccgtgccggagggccagatggaggcgtccaaggccctgggcatgggctggtcgctgaccatgcgccgcacggtgctgccccaggcgatgcgcatcatcatcccgccaaccggcaatgagctgatctccatgctgaagaccacctccctggtggtggcggtgccgtattccctggagctctacggccgcagcatggacatcgcctactccctgttcgagccggtcccgatgctgctggtggccgccacctggtacctggtgatcacctcggtgctcatggtgggtcagtactacctggagaagcactttgaaaagggcagcacccgcaacctcaccgcccgccagctcgccgcgctggccgatgccgaaggtgccatccccggcaacgtcaatgtcgtgcctgatacgccgaaggagaacagatag

SEQ ID NO: 60890 - protein, 240 aa, Corynebacterium efficiens YS-314
MLSMIIGVVFGATLAVMRMSGNPVLQGVAWLYLWIFRGTPIYVQLVFWGLLGSLYQTVNLGFAEIDLQNFLSNMFILAVLGLGLNEAAYMAEIVRSGIQAVPEGQMEASKALGMGWSLTMRRTVLPQAMRIIIPPTGNELISMLKTTSLVVAVPYSLELYGRSMDIAYSLFEPVPMLLVAATWYLVITSVLMVGQYYLEKHFEKGSTRNLTARQLAALADAEGAIPGNVNVVPDTPKENR

SEQ ID NO: 60891 - DNA, 669 bp, Pseudomonas putida KT2440
  CDS (1)..(669): transl_table=11
atgatcgctgaaagcctgcaactcgttgtcgactccgcgcccttcctgctgaagggcgcgggttatacggtgctgctcagtgtcggcggcatgttcttcggtctggtgctgggctttgccctggcgctgatgcggctgtcgaagattctgccgctgaactggctggcgcgggtctacgtgtcgttcttccgcggcacgccgctgctggtgcagctgttcgtcatctatttcggcatgccgcaaatcggcatcgagctggacccgatccccgcttcgctgatcggcctgtcgctgaacatggcggcctatatctgcgagatcctgcgcgcagccatttcctcgatcgaccggggccagtgggaagcagccgccagcatcggcatgacccgcgtgcaagccatgcgccgggcgatcctgccacaggccttgcgcaccgcgttgccaccgctgggcaacagcttcatctcgctggtaaaggacaccgccctggcggcgaccatccaggtgcccgagctgttccgccaagcccagctgattaccgcgcgcacgttcgaagtgttcaccatgtacgtggcggtcgcggtcatctactgggtgctgtgcagcatccttgcgcacttccagaaccgcatggaagcgcgggtcaaccagcatgaccaggagcattga

SEQ ID NO: 60892 - protein, 222 aa, Pseudomonas putida KT2440
MIAESLQLVVDSAPFLLKGAGYTVLLSVGGMFFGLVLGFALALMRLSKILPLNWLARVYVSFFRGTPLLVQLFVIYFGMPQIGIELDPIPASLIGLSLNMAAYICEILRAAISSIDRGQWEAAASIGMTRVQAMRRAILPQALRTALPPLGNSFISLVKDTALAATIQVPELFRQAQLITARTFEVFTMYVAVAVIYWVLCSILAHFQNRMEARVNQHDQEH

SEQ ID NO: 60893 - DNA, 822 bp, Pseudomonas putida KT2440
  CDS (1)..(822): transl_table=11
atgagcaccttccctcactcccccaagcccgtggcaaagcctgcgggcgccggcctgttcggctttcgcacccggttactgctgacctggctggcgctgttcgggctgtttgtcgccttcttcctcagctttgacctgaagttcgccatcattctggagaagtttcccaacctggccggtttcaagctggggcccaatggttttctgcaaggcgccgcactgaccctgttcctgtgcctgtgctcgatggtggtatccgtgctgctcggctttgccgccgcgctggcacggttatccaacagcgcggtgctggtgggtgtggccagcttctacacctcgttcttccgtggcacgccgctgctgatccagattctgctgatctacctggggctgccgcaggtgggcctggtacccggcgccatcagcgccggcatcattgccttgtcgctgaactacggggcctacctgagcgagatcttccgcgccggcatcctcggcgtggcccgtgggcaacgtgaagcagcattggcgctgggcatgcgcacgccgcagatcttctgccacatcatcctgccccaggccatgcgggtgatcattccgcccaccgccaaccagttcatttcgatgctcaaggactcgtcgctgatttccgtgatgggggtttgggaggtgatgtttctggcgcagtcgtatgggcgttcgagctatcgctacctggaaatgctgaccaccgccgccgtgatctactgggtgctgtcgatactgctggagctgctgcaggcgcgcctggaacggcattttggcaaggcttatcagcgctga

SEQ ID NO: 60894 - protein, 273 aa, Pseudomonas putida KT2440
MSTFPHSPKPVAKPAGAGLFGFRTRLLLTWLALFGLFVAFFLSFDLKFAIILEKFPNLAGFKLGPNGFLQGAALTLFLCLCSMVVSVLLGFAAALARLSNSAVLVGVASFYTSFFRGTPLLIQILLIYLGLPQVGLVPGAISAGIIALSLNYGAYLSEIFRAGILGVARGQREAALALGMRTPQIFCHIILPQAMRVIIPPTANQFISMLKDSSLISVMGVWEVMFLAQSYGRSSYRYLEMLTTAAVIYWVLSILLELLQARLERHFGKAYQR

SEQ ID NO: 60895 - DNA, 711 bp, Pseudomonas putida KT2440
  CDS (1)..(711): transl_table=11
atgagcttcgatcaactgctggcaatggtgctcgaccccgacctgctggagcgctatggcccgcgcttcatcgacggcctgctggtaactgccaagctggtggcgatttccttcagcctgggtgctgtgctcggtcttctgctggcccttgcacgcctgtctcgcagcctggtgctgcagcgcatggctgccggctacgtgtacttcttccgcggttcgccgctgctggcgcaattgttcctgctgtattacggcctgggctcgctcaaaggtttctggcaggacgtcggcctgtggtggttcttccgggatgcgtggttttgcaccttgctggcgttcaccctgaacactgccgcctatcaggccgagatcttccgcggcagcctgatggcggttgcgcctggccagcatgaagcggcgcgggcgctgaacctgaagcgctcgaccaccttcttcaaggtgatattgccgcagtcgctgctggtggccattggcccgttgggcaacgaactgatcctgatgatcaaggccagcgcgatcgcctcgctggtgacgatctacgacctgatgggcgtgaccaaactggccttctcgcgcagtttcgacttccagatctacctgtgggccgctgtgctctacctggtgatcgtcgaactggtgcggcgcctgctgaaacacctggaggcccgcctgggccgccacctgaactga

SEQ ID NO: 60896 - protein, 236 aa, Pseudomonas putida KT2440
MSFDQLLAMVLDPDLLERYGPRFIDGLLVTAKLVAISFSLGAVLGLLLALARLSRSLVLQRMAAGYVYFFRGSPLLAQLFLLYYGLGSLKGFWQDVGLWWFFRDAWFCTLLAFTLNTAAYQAEIFRGSLMAVAPGQHEAARALNLKRSTTFFKVILPQSLLVAIGPLGNELILMIKASAIASLVTIYDLMGVTKLAFSRSFDFQIYLWAAVLYLVIVELVRRLLKHLEARLGRHLN

SEQ ID NO: 60897 - DNA, 699 bp, Pseudomonas putida KT2440
  CDS (1)..(699): transl_table=11
atgatcttcgactacaacgtcgtgtgggaagcgctgccgatgtacttcggcggcctgctgaccaccctgaaactgctggcgatttcgcttttcttcggcctgttggcagccattccgctgggcctgatgcgggtatccaggcagccggtggtcaaccttgctgcatggctgtacacctacgtcatccgtggcacgccgatgctggtgcagctgttcctgatctactacggcctggcccagttcgaggcagtgcgcgagagtatcttctggccgctgctgtccagcgctaccttctgcgcctgcctggcgttcggcatcaataccagtgcctacaccgccgaaatcattgccggcagcctcaaggcgacgccgcatggcgagatcgaagctgccaaggccatgggaatgtcgcgcatgaaaatgtaccgccgcatcctgctgccttcggcactgcgtcgggcactgccgcagtacagcaatgaagtgatcatgatgctgcagaccaccagcctggcgtcgatcgtcaccctgatcgacatcaccggtgctgcgcgcacggtcaatgcccagtactacctgcctttcgaggcctatatcacggcgggcgtgttctacctgtgcctgaccttcatcctggtgcgcctgttcaagatggccgaacgccgctggctcggctacctggcgccgcgcaagcactga

SEQ ID NO: 60898 - protein, 232 aa, Pseudomonas putida KT2440
MIFDYNVVWEALPMYFGGLLTTLKLLAISLFFGLLAAIPLGLMRVSRQPVVNLAAWLYTYVIRGTPMLVQLFLIYYGLAQFEAVRESIFWPLLSSATFCACLAFGINTSAYTAEIIAGSLKATPHGEIEAAKAMGMSRMKMYRRILLPSALRRALPQYSNEVIMMLQTTSLASIVTLIDITGAARTVNAQYYLPFEAYITAGVFYLCLTFILVRLFKMAERRWLGYLAPRKH

SEQ ID NO: 60899 - DNA, 660 bp, Pseudomonas putida KT2440
  CDS (1)..(660): transl_table=11
atgagcgaactgctgacgatgtggatgcaatggttgccggagttgtggaagggctttgtgctgtcgatgcaggtcacggcggtcagcctgggcctgggcgttgtgctggggctgttgctggcactgggcgtttcgtcgccgagccgctggttgcgttacccctccctggtggtggtggaactggggcgtggcgcaccggcgttgatcctgctgcagtatttctactttggcctgcccagcgtcaacctcaccctgacctcgttctgggctgctgcgctggccatggcgtactgcacggccgcctacaccagtgaaatcattcgcggtggcatcgagtcggtggccgcggggcaaaccgaggccgccgaagtgatcggcctcaaccggttcgacgcgctgcgctttgtgatcctgcctcaggccttgcgggtggcgctgccatcgctgctggggttctcgatcatgatgttccaggcctcgtcgctgtgtttcaccatcgccctgccagaaattgtcagccgggcgtcctccattggctcttccacgttcgagtacatgccggtgctgatactggccggtttgatgtatgccgctgtctgcgccccggcgaccctgggtgtggcagcgctggaaaaaagactggcccccagccagccataa

SEQ ID NO: 60900 - protein, 219 aa, Pseudomonas putida KT2440
MSELLTMWMQWLPELWKGFVLSMQVTAVSLGLGVVLGLLLALGVSSPSRWLRYPSLVVVELGRGAPALILLQYFYFGLPSVNLTLTSFWAAALAMAYCTAAYTSEIIRGGIESVAAGQTEAAEVIGLNRFDALRFVILPQALRVALPSLLGFSIMMFQASSLCFTIALPEIVSRASSIGSSTFEYMPVLILAGLMYAAVCAPATLGVAALEKRLAPSQP

SEQ ID NO: 60901 - DNA, 963 bp, Pseudomonas putida KT2440
  CDS (1)..(963): transl_table=11
gtgatcaaacacaagaaagcccagtggccttggcatgggttgactgccctggtcctggtaggcctggcgctcagcctttacatggccacctcgatgatttcctacgagtggcgctggaaccgcgtaccgcagtacttcgcctacaaggccgaggaaacacaacgcgctgccggctacggcactgtgcaggaaatcgtcatttccggtgacaacgcccgcgtcacgctgaaggacgaaagtggtgccgagcaagtgctcgatgtggacaaggacagcctgcaactgagccgcggcgacgatgttgccgaaggcgaccagatcggggtaacccgccattgggccgcgggcccgctggcatggggcctgtggaccaccttgtggatctcggtggtgtccggggcgctgggcctggtgatcggcctgttcgccggattgtgccggttgtcgaacaacccgaccctgcgcgacctgtcgaccgtgtatgtcgagctggtgcgcggcacgccgctgctggtgcaaatcttcatcttctacttcttcatcggcaccgtgctcaacctgtcccgcgagtttgccggggtagcggcgctggcattgttcaccggtgcttacgtggccgagatcgtccgtgcaggcgtgcagtcgatcgccaaaggtcagaacgaggctgcccggtcgctgggcctgaacgctggccagtcgatgcgccatgtgatcttgccgcaggccttcaagcgcgtgcttccgcccctggccggccagttcatcagcctggtcaaggacacctcgctggtgtcggtgatcgccatcaccgaactgaccaagagtggccgtgaggctatcaccacctcgttctctactttcgagatctggttctgcgtggcaggcctgtacctgctgatcaacctgccgctgtcgcacatcgccagccggctcgagcggaggcttgcgcaaagtgattga

SEQ ID NO: 60902 - protein, 320 aa, Pseudomonas putida KT2440
MIKHKKAQWPWHGLTALVLVGLALSLYMATSMISYEWRWNRVPQYFAYKAEETQRAAGYGTVQEIVISGDNARVTLKDESGAEQVLDVDKDSLQLSRGDDVAEGDQIGVTRHWAAGPLAWGLWTTLWISVVSGALGLVIGLFAGLCRLSNNPTLRDLSTVYVELVRGTPLLVQIFIFYFFIGTVLNLSREFAGVAALALFTGAYVAEIVRAGVQSIAKGQNEAARSLGLNAGQSMRHVILPQAFKRVLPPLAGQFISLVKDTSLVSVIAITELTKSGREAITTSFSTFEIWFCVAGLYLLINLPLSHIASRLERRLAQSD

SEQ ID NO: 60903 - DNA, 690 bp, Vibrio vulnificus CMCP6
  CDS (1)..(690): transl_table=11
atggcattaacgggttactctctttctctcgtccaagcaagctggatgaccatccagcttgcgctggtcagcttagccgtcggtttagtgttagcggttgttttcgctggtggcgagatgactcgccaccgattagtgaaatggccaactactgcgctggtgacggtgctacgcggcttgcctgagcttttggtggtgctgttcatctactttggctcaacacaagttctgtttctactgactggcgattttatcgaggtaagcccgtttctttctggtgtgattgccctttctttgatttttgcttcttacgcttctcagaccattcgcggcgcattgaaagccgttaataaaggccaacgtgaagcggccagtgctctaggcatgagtaaaagtcgtactttttttagaattgtgttaccccaagcggtgcgccatgcgctgccaggactcaccaaccaatggttggtgttattgaaagacacggcgttggtgtcattaatcggcgtgacggatcttctcaaacaagcgcaactgacgtcggcggccactcatgaagcgtttacttggtatgccaccgctgcggccatttacttagtcatcacgcttgtaacccagcgcgcagtaaaaatcatcgatgccaaattttccgcacaaggattgagtcttgatcaaggagccaaagcatga

SEQ ID NO: 60904 - protein, 229 aa, Vibrio vulnificus CMCP6
MALTGYSLSLVQASWMTIQLALVSLAVGLVLAVVFAGGEMTRHRLVKWPTTALVTVLRGLPELLVVLFIYFGSTQVLFLLTGDFIEVSPFLSGVIALSLIFASYASQTIRGALKAVNKGQREAASALGMSKSRTFFRIVLPQAVRHALPGLTNQWLVLLKDTALVSLIGVTDLLKQAQLTSAATHEAFTWYATAAAIYLVITLVTQRAVKIIDAKFSAQGLSLDQGAKA

SEQ ID NO: 60905 - DNA, 654 bp, Bradyrhizobium japonicum USDA 110
  CDS (1)..(654)
atgaaaggcttttggcacgacgctgccgagttcttcccgatcctgatgagcggcgtcgcgctgacgatcgtcgtcaccatcggctcgctgctgctctcgacggtgctcggcctgatctgggcgatgatgcgggtctccggcatcaaggtcctgtcgatgctcagcgccagcctgatcaacgtgatccgcggcatcccgatcatcgtgctcctgttctacctctacttcgtgatgcccgatctcggtgtcacgctgtcggccttgcaggccgccatcctcgggctcggcatcgcctattcggcctaccaggcggaaaacttccgcgccggcatcgaggcgatcgacaagggccagatcgaggcggcgcagtcgatcggcatgggctggtggctcaccatgcgccgcgtggtgctgccgcaggcggtgcgcatcgtgctacctccctacggcaacgtcatgatcatgatgctgaaggattcgtcgcaggcctcgaccatcacggtcgccgagcttgcgctgcagggcaagctgatcgcgtcctcgaccttcaagaacaccagcgtgttcacgctggtggcgctgatgtacctgaccatgagcattccgctgatcctgctggtccgtcacttcgaaaagcgggcgggcaagaaatga

SEQ ID NO: 60906 - protein, 217 aa, Bradyrhizobium japonicum USDA 110
MKGFWHDAAEFFPILMSGVALTIVVTIGSLLLSTVLGLIWAMMRVSGIKVLSMLSASLINVIRGIPIIVLLFYLYFVMPDLGVTLSALQAAILGLGIAYSAYQAENFRAGIEAIDKGQIEAAQSIGMGWWLTMRRVVLPQAVRIVLPPYGNVMIMMLKDSSQASTITVAELALQGKLIASSTFKNTSVFTLVALMYLTMSIPLILLVRHFEKRAGKK

SEQ ID NO: 60907 - DNA, 669 bp, Bradyrhizobium japonicum USDA 110
  CDS (1)..(669)
atgacctatcacttcgacttcagcagcctgcttccctattggcgggacttgctgttcggctgcgggcttaccctcgcaatgacctccatctcggttctgctgggcttcacgattggcttgttgaccgtgctcgctcgccgcagcagcctgagggcgctgaacgtcctggccatcggctacatcgagatcatccggaatacgcccttcttggtgcaagtgctgttcatctattttggcctgcccgcgttgggattgagcctcgctgcatggccggcgggcgtgatcgcgctcagcttgaatgccggtgcgttcgcggcagagatcattcgcggcggcatcgacggtattccaagaggccagttcgaggctggcgccgcgctaggtctgcatccttttcaggttttgcgtttcattgtcttcaagcccgcgctgcgcgcgatctaccccgccctcgcaagccagttcgttctgttgcttctgacctcgagcatcgtttcggcgatctcggccgaagaactcaccgcagcagcccagtccgtcgacacgctgacattccgcagcttcgagatctacatcgttgccacgctactgtacctgctaatggcgctggttttctcccaggcgttcaaggcaatcgaacgccatgcgctcgcctaccccgtaaggtga

SEQ ID NO: 60908 - protein, 222 aa, Bradyrhizobium japonicum USDA 110
MTYHFDFSSLLPYWRDLLFGCGLTLAMTSISVLLGFTIGLLTVLARRSSLRALNVLAIGYIEIIRNTPFLVQVLFIYFGLPALGLSLAAWPAGVIALSLNAGAFAAEIIRGGIDGIPRGQFEAGAALGLHPFQVLRFIVFKPALRAIYPALASQFVLLLLTSSIVSAISAEELTAAAQSVDTLTFRSFEIYIVATLLYLLMALVFSQAFKAIERHALAYPVR

SEQ ID NO: 60909 - DNA, 912 bp, Bradyrhizobium japonicum USDA 110
  CDS (1)..(912)
atggggccttggcgcgaacgcggtcgcccagcccatgctgaacgcggcgccgcaatgaagccggcgccggcactcgcggagggtttccctgatttgtcggggatgcggatcgcgcgcgagccgcactggttccgctggctcagcgcggccctgatcgtcctcgtgctggcggcgatcgtgcgcgcgtttgcgaacggtcagatcgaatggtcctatgtcagccgcttcctgaccgtgaaggttatcctcgaaggcatcgtcaacaccatggtgatggcggtgctggcgatgatgctcggcatctttctcggcatcgttgtggcgatcatgcggctgtcgcccaacccggttctgaagacggtggccgccggctacacctggctgtttcgcggcacgccgctgatcctgcaactgctgctctggttcaacctcgcactggtgtttccgaccatcggcatcccgggcctgtggagcgcgcgcgccgtcgacgtcatgacaccgttcctcgccgcgctgctcgggctcggcatcaaccagggcgcctacacctccgaagtgatgcgcgccggcatgctgtcggtcgacatcgggcaatatgaggcagcgcaggcgatcggcatggggcggctgcgtgcgctgcgccggatcgtcctgccgcaggcgatgcgcgtggtgatcccgccgctcggcaacgagttcatcggcatggtgaaggcgacctcgctcgcgagcgtcatccagtatccggagctgctgcataacgccgagaacatctactacgcgaattcccgcgtcatcgagctcttgatcgtcgccgggctctggtacctgctcgtggtctcgatcctgaccccgcttcagatgctgctcgaacgccgttttgcacgcggcacattgcggctggcgcgatga

SEQ ID NO: 60910 - protein, 303 aa, Bradyrhizobium japonicum USDA 110
MGPWRERGRPAHAERGAAMKPAPALAEGFPDLSGMRIAREPHWFRWLSAALIVLVLAAIVRAFANGQIEWSYVSRFLTVKVILEGIVNTMVMAVLAMMLGIFLGIVVAIMRLSPNPVLKTVAAGYTWLFRGTPLILQLLLWFNLALVFPTIGIPGLWSARAVDVMTPFLAALLGLGINQGAYTSEVMRAGMLSVDIGQYEAAQAIGMGRLRALRRIVLPQAMRVVIPPLGNEFIGMVKATSLASVIQYPELLHNAENIYYANSRVIELLIVAGLWYLLVVSILTPLQMLLERRFARGTLRLAR

SEQ ID NO: 60911 - DNA, 663 bp, Bradyrhizobium japonicum USDA 110
  CDS (1)..(663)
atgtatcactgggacttcggcattctctggagctatcgctggctctttctcaacgggctcggcgtcaccgtcggcttcaccgtggtcatcgtggtgctcggactggtgttcggcctgttcggcgcattcggcagcctgtcgcgtctcaaggcggtgcgcctcgtcgccctcaccttcatcgaggcgttccgctgcacgccgattctggtgcagctgatctggttctattacgcgctgccgatcctcgccggcgtcgagatgacgccgatcacggcctcggcgctggcgctgtcgctctatggcggctcgttctattcggagatcatccgcggcggcatcgtctcgatcgacaagggccagtccgaagcgggtgccgcgctcggcatgacccctggccaggcgatgcggcgcatcgtgctgccgcaggcgatcaagcgcatgatcccggcgctgatgaaccagtcgatcatccagttcaagaacacctcgctggtctcggtgctggcggtgcctgacctcgtctatcagagccaggtcgcggcccatgacagctaccggccgctggagacctacacggcggtcgcggtcgcctatgccgcaatcctgattccgctcaccatcatcgtccggcgcggcgagaagcgattggcggtcggcgaatga

SEQ ID NO: 60912 - protein, 220 aa, Bradyrhizobium japonicum USDA 110
MYHWDFGILWSYRWLFLNGLGVTVGFTVVIVVLGLVFGLFGAFGSLSRLKAVRLVALTFIEAFRCTPILVQLIWFYYALPILAGVEMTPITASALALSLYGGSFYSEIIRGGIVSIDKGQSEAGAALGMTPGQAMRRIVLPQAIKRMIPALMNQSIIQFKNTSLVSVLAVPDLVYQSQVAAHDSYRPLETYTAVAVAYAAILIPLTIIVRRGEKRLAVGE

SEQ ID NO: 60913 - DNA, 651 bp, Clostridium tetani E88
  CDS (1)..(651): transl_table=11
atggatatgaatttacttaagaatataattccattattaattaaagctacaggaagaactatagaattaacaataatttctgtagtacttggaagtttaattggagtttttgttgcacttttaaaactttcaaaaataaaagtattaaatggattggcatcattttatacatggataataagaggaactcctatgttattgcaattatattttttctattatggattaccttttctaaatatagaattaagtgctatgactgcagctattataggacttagtttaaactcaggagcttatatggcagaaataataagaggcggaataatatccgttgataaagggcaatttgaagcatgtaaagccttaggatttagctatggacaaactatgaaaagaataattttacctcaagcagtaagagttttagttccacctactggaaatgaatttataactatattaaaggatacatcattagtatctgtattaggtggtatggaagaggtaatgagggtagctcaacaaagctattctgcaacttttagaccattagaaccttttttagtggcagcatgtatatatcttatattaactacagtatttactatagtatttggcaaaatagagaaaaaggtttctgtttattaa

SEQ ID NO: 60914 - protein, 216 aa, Clostridium tetani E88
MDMNLLKNIIPLLIKATGRTIELTIISVVLGSLIGVFVALLKLSKIKVLNGLASFYTWIIRGTPMLLQLYFFYYGLPFLNIELSAMTAAIIGLSLNSGAYMAEIIRGGIISVDKGQFEACKALGFSYGQTMKRIILPQAVRVLVPPTGNEFITILKDTSLVSVLGGMEEVMRVAQQSYSATFRPLEPFLVAACIYLILTTVFTIVFGKIEKKVSVY

SEQ ID NO: 60915 - DNA, 708 bp, Lactobacillus plantarum WCFS1
  CDS (1)..(708): transl_table=11
atggattcaatctggcacatcattgtcacatcaacgccgcaaattgctgcagcgggtttaaaatataccattccgattgccattatttcgtttattctcggtttgatacttgcgattttcacggccctcgtcaagatttcgactcgtcgtggttggtttttaattctaaaagccatcgctaacttctacgtctggctctttcggagtaccccactgctagtacaactctttatcgtctatttcgggcttccctaccttaaaatcaaagggctctttccaaatggggtccagctcgacccctggactgctgggattgccactttttcactgaacaccggggcttactgtgcggaaacgattcgagcagccattctctccattcctcaaggtcagtgggaagcggcctactcgattggcatgaccaagtcacaagtactcaaacgaattattttgccgcaagctgcgcgagtctcactaccgccactatccaatagttttattagcttagtcaaggacacctccttggccgcttcaatcacgattattgaaatgttcgaagtcagccaacaaattgctgctcaaaattatcaaccacttgtgatgtactccctggttgctgccctatacgcaattctatgtacgattctcagctggctacaaggctacttggaaaaacggacgtcacgttacttacggccacttaattag

SEQ ID NO: 60916 - protein, 235 aa, Lactobacillus plantarum WCFS1
MDSIWHIIVTSTPQIAAAGLKYTIPIAIISFILGLILAIFTALVKISTRRGWFLILKAIANFYVWLFRSTPLLVQLFIVYFGLPYLKIKGLFPNGVQLDPWTAGIATFSLNTGAYCAETIRAAILSIPQGQWEAAYSIGMTKSQVLKRIILPQAARVSLPPLSNSFISLVKDTSLAASITIIEMFEVSQQIAAQNYQPLVMYSLVAALYAILCTILSWLQGYLEKRTSRYLRPLN

SEQ ID NO: 60917 - DNA, 732 bp, Pseudomonas syringae pv. tomato str. DC3000
  CDS (1)..(732): transl_table=11
atgtttgtgctattcgccgggttcttcctgagtttcgatctgaagcttgcgatcattctcgacaaactgcccaatctgatcggcctgcatctggcacccaacggtttcctgcaaggcgcggcgctgacgctgtttgtgtcggtgtgctcgattgtggtttcagtgctgctgggttttgtcaccgcgctggcgaggctgtccagcagcgccgtagcgtttggtatcgccagtttttatgcgtcgttttttcgcggaacgccgctgctgatccagattctgctgatttatctcggcttgccgcaactgggcatcgtgcccggcgcaatcgcggcgggggttattgcgctgtcgctcaactacggcgcctacctgagcgagatctttcgggcaggcatcatcggcgttgcggccggccagcgtgaggcagccttggctctggcgctgcgcccgacgcagatcttctggcgcgtcaccctgccccaggcaatgcgcacgattatcccgccgaccaccaaccagttcatctccatgctcaaggattcgtcactgatctcggtgatgggcgtctgggaagtgatgttcctggcacagtcctacggccgctccagctatcgatacatcgaaatgctgaccaccgcagcggtgctgtactggatcatgtcgatcggtctggagttgttgcagtcgcggctggaaaaacactacggcaaggcgtatcaggcgcgcaaatga

SEQ ID NO: 60918 - protein, 243 aa, Pseudomonas syringae pv. tomato str. DC3000
MFVLFAGFFLSFDLKLAIILDKLPNLIGLHLAPNGFLQGAALTLFVSVCSIVVSVLLGFVTALARLSSSAVAFGIASFYASFFRGTPLLIQILLIYLGLPQLGIVPGAIAAGVIALSLNYGAYLSEIFRAGIIGVAAGQREAALALALRPTQIFWRVTLPQAMRTIIPPTTNQFISMLKDSSLISVMGVWEVMFLAQSYGRSSYRYIEMLTTAAVLYWIMSIGLELLQSRLEKHYGKAYQARK

SEQ ID NO: 60919 - DNA, 711 bp, Pseudomonas syringae pv. tomato str. DC3000
  CDS (1)..(711): transl_table=11
atgatcgagttgttacaggaatactggaaacccttcctttatacagacggcgtgaatatcaccggtctggccatgacgatgtggctgctcagcgcctcgattgccatcggcttctgcgtgtcgatcccgctgtcgattgcgcgggtgtcgagaaatcgctgggtgcgctggcccgtgcagttctacacctacctgtttcgcggcacaccgctctatatacagctgctgatttgctacaccggcatttacagcattgctgccgtgcgcgagcaaccgatgctggatgcgttctttcgcgacgcgatgaactgcacgatcttggccttcaccctgaacacctgcgcgtacaccacggaaatttttgccggtgccatccgcagcatggcccacggcgaagtcgaagcggccaaagcctacggcctgaccggctggaagctttatgcctacgtgatcatgccatcagtgctacgccgttcgctgccgtactacagcaacgaagtgatcctgatgctgcactcgaccacggtagccttcaccgccaccgtgccagacatcttgaaagtggcgcgggatgccaactccgcgacgttcatgaccttccagtccttcggtatcgccgccgtcatgtacctgaccgttacgttcattctggtcgggctgttccgtcttgccgaacgccgctggctggcctttctcggcccggctcattaa

SEQ ID NO: 60920 - protein, 236 aa, Pseudomonas syringae pv. tomato str. DC3000
MIELLQEYWKPFLYTDGVNITGLAMTMWLLSASIAIGFCVSIPLSIARVSRNRWVRWPVQFYTYLFRGTPLYIQLLICYTGIYSIAAVREQPMLDAFFRDAMNCTILAFTLNTCAYTTEIFAGAIRSMAHGEVEAAKAYGLTGWKLYAYVIMPSVLRRSLPYYSNEVILMLHSTTVAFTATVPDILKVARDANSATFMTFQSFGIAAVMYLTVTFILVGLFRLAERRWLAFLGPAH

SEQ ID NO: 60921 - DNA, 741 bp, Vibrio parahaemolyticus RIMD 2210633
  CDS (1)..(741): transl_table=11
atgctggatttacaaggatatgaagcctccatttttaaaggggctttggtaaccatcgaagtagctgtgctgtcactactgcttgcggtgatattgggaatgcttggcgcgcttgctaagcttgctccctacaaatgggcaagagcaattgccacactttacaccaccattattcgcggcattccagacttagttctgatgatgttgattttctttggtgggcaaatacttttaaacaatagcctctattccatcaacgaaacgctcaatgaatggtttgcatctagcgacccaaatcatgagtggacttcttacttacctgactacattgatgtgagcccgtttattgccggtgtgctgacaattggttttatctttggagcttacatggcggaaactttccgtggtgcgatcatggccgtcgataaaggtgagttggaagcagcaaaagcttatggcatgagcccagtgttgtcgttcagaagaatccttcttcctcagatgattcgccatgcactaccgggatttggtaacaactggctggtattgttaaaaaccaccgcgcttgtctccatcatcgggcttgaagatatggtgagaatgagctctctggcggctggtacaacaaaaatgccgttcacgttctacatggccgttgcactgattttccttttcttcaccagtatttcgacggggttgttaaaactcgttgaacgcaaattcagtattcatgcgaggtaa

SEQ ID NO: 60922 - protein, 246 aa, Vibrio parahaemolyticus RIMD 2210633
MLDLQGYEASIFKGALVTIEVAVLSLLLAVILGMLGALAKLAPYKWARAIATLYTTIIRGIPDLVLMMLIFFGGQILLNNSLYSINETLNEWFASSDPNHEWTSYLPDYIDVSPFIAGVLTIGFIFGAYMAETFRGAIMAVDKGELEAAKAYGMSPVLSFRRILLPQMIRHALPGFGNNWLVLLKTTALVSIIGLEDMVRMSSLAAGTTKMPFTFYMAVALIFLFFTSISTGLLKLVERKFSIHAR

SEQ ID NO: 60923 - DNA, 678 bp, Vibrio parahaemolyticus RIMD 2210633
  CDS (1)..(678): transl_table=11
atggatttttcgttgattattgaaagcttccctgtttactttcaagggctttggacgaccgtttggctggtgggcatttcattggtgattggcttgtgcgtctcagttccactcgccattgcgagaaacagtaccaactacgctttgagccttccttcttggggattcatttactttttccgaggaacgccactgcttgttcagttgtatctgatttactatggcatggatcagtttttcccagtgaaagataccttatgggaacacgcgtggttttgtgctctggttgcgtttgtactaaacacatcagcgtatacggcagagatcattcgtggtgcgattaacggtttgccgaaaggcgaagtggaagccgcaaaagcgtatggcatgagtaaatttatgacttacaaacgcatcatcttgccaagtgcgttacgccgagcactacctgcttattctaatgaagtgatcttcatgcttcacggcagtgcggttgcagggatcgtaaccatcgtggacttaactggtgcagcgcgcttagttaactctcgttattacgcaccatttgagtcgttcttgacggctggacttttctatatgtcgcttacgtttatcattctttggtgctttaaacgcgcggaaaaacgtttcttagcgtacctgcgtcctctgagctaa

SEQ ID NO: 60924 - protein, 225 aa, Vibrio parahaemolyticus RIMD 2210633
MDFSLIIESFPVYFQGLWTTVWLVGISLVIGLCVSVPLAIARNSTNYALSLPSWGFIYFFRGTPLLVQLYLIYYGMDQFFPVKDTLWEHAWFCALVAFVLNTSAYTAEIIRGAINGLPKGEVEAAKAYGMSKFMTYKRIILPSALRRALPAYSNEVIFMLHGSAVAGIVTIVDLTGAARLVNSRYYAPFESFLTAGLFYMSLTFIILWCFKRAEKRFLAYLRPLS

SEQ ID NO: 60925 - DNA, 690 bp, Vibrio parahaemolyticus RIMD 2210633
  CDS (1)..(690): transl_table=11
atggcgtttacgggttactctttatcgcttgtacaagctagctggatgacggttcagctagccttcacaagccttttagtcggtttgattctggcagtggtattcgccagtggtgaaatggctcgtcgcgcattcgtgaaatggcctacaacggcgtttgttacggtggtgcgtggcttgccagaaatccttgtcgtgttgttcatctattttggttcgactcaggttctgtttttaatcaccggagactttattgaggttagcccgttcttgtctggtgtggtggcgttatcgttgatcttcgcttcctatgcttctcaaactctgcgcggcgcattaaaagccgtaggcagaggacagagagaagctgcaagcgcactcggtatcagtcagtttcacgcgtttgtgcgcattgtgttgccacaagccgtgcgacatgcgcttcctggtttaaccaaccaatggttggttttgctaaaagacacggcgctggtttctttgattggcgtgacggatctgctgaaacaagctcagcttacgtcggcagcaacgcacgaagcgtttacttggtatgcgacggcagcggcgatttacttagtgatcacgcttatcacgcagcgcgcggtcaaagtgattgataagaaattctcaatccaaggcatgagtatggggcaggaggcaaacgcatga

SEQ ID NO: 60926 - protein, 229 aa, Vibrio parahaemolyticus RIMD 2210633
MAFTGYSLSLVQASWMTVQLAFTSLLVGLILAVVFASGEMARRAFVKWPTTAFVTVVRGLPEILVVLFIYFGSTQVLFLITGDFIEVSPFLSGVVALSLIFASYASQTLRGALKAVGRGQREAASALGISQFHAFVRIVLPQAVRHALPGLTNQWLVLLKDTALVSLIGVTDLLKQAQLTSAATHEAFTWYATAAAIYLVITLITQRAVKVIDKKFSIQGMSMGQEANA

SEQ ID NO: 60927 - DNA, 687 bp, Streptococcus pyogenes SSI-1
  CDS (1)..(687): transl_table=11
atggatttgtcatttttgcccaaatactgggcctactttaactacggtgtacttgtcaccattatgatttcaatcagcgttgtcttttttggaacccttattggtgtcttggtaaccctgattaagcgtagtcatgtgaagccgttgacctgggtcgttaatctttacgtttggatctttcggggaacacctatggtggttcaaatcatgattgcctttgcttggatgcattttaacaatatgcctactattggttttggggttttagacttggacttttcaagactacttcctggaattattatcatttcattgaatagcggtgcttatatttcagaaattgttagagcaggtattgaggctgtaccaaaagggcaattagaagcagcttattcactaggtattcgtcctcaaaatgccatgcgttatgtgattttgcctcaggcctttaaaaatattttgccagccttaggaaatgaatttattaccattattaaggatagtgctcttttacaaaccattggagtgatggaactttggaatggtgcccaatcggtggtaacggctacttattctccaatttcccctttactggtggctgctttttactacttaatggtcacaacagtgatggcacagttattggcagtcttagaacgtcacatggcgcaaggaggtaatcattga

SEQ ID NO: 60928 - protein, 228 aa, Streptococcus pyogenes SSI-1
MDLSFLPKYWAYFNYGVLVTIMISISVVFFGTLIGVLVTLIKRSHVKPLTWVVNLYVWIFRGTPMVVQIMIAFAWMHFNNMPTIGFGVLDLDFSRLLPGIIIISLNSGAYISEIVRAGIEAVPKGQLEAAYSLGIRPQNAMRYVILPQAFKNILPALGNEFITIIKDSALLQTIGVMELWNGAQSVVTATYSPISPLLVAAFYYLMVTTVMAQLLAVLERHMAQGGNH

SEQ ID NO: 60929 - DNA, 651 bp, Streptococcus pyogenes SSI-1
  CDS (1)..(651): transl_table=11
atgattaatatcccattaatgaaagatagtttaggatttgtattatcgggattaccttatacccttggcatatcgttgcttagctttttaacggggctggtctttggtttgctccttgccctactaggaaggtcacatcagccactgctacactatcttgttagggcctacatctctattatgcgaggtgtgccgatgatcgtggtgctctttgttctttatttcgggttgccttattatggtttagaattgccagctttactttgcgcttatcttggtttttctatggttagcgctgcctatatttctgaagtttttcgctcttctatagaagctattgacaagggacagtgggaagcagctaaggctttagggttgccatatgctcttatggttaagaaaattattcttcctcaagcctttcgaattgcagttcctcctctaggcaatgtcattattgatatggttaaaagttcgtcgctagctgccatgattaccgtaccagatatttttcaaaatgccaaaattatcggtggtagggagtgggactacatgtccatgtacattttagtagcctttatctattggattattgcttttttgttagaacgttaccaagaattcttagaaaataagctagcacttgtttaa

SEQ ID NO: 60930 - protein, 216 aa, Streptococcus pyogenes SSI-1
MINIPLMKDSLGFVLSGLPYTLGISLLSFLTGLVFGLLLALLGRSHQPLLHYLVRAYISIMRGVPMIVVLFVLYFGLPYYGLELPALLCAYLGFSMVSAAYISEVFRSSIEAIDKGQWEAAKALGLPYALMVKKIILPQAFRIAVPPLGNVIIDMVKSSSLAAMITVPDIFQNAKIIGGREWDYMSMYILVAFIYWIIAFLLERYQEFLENKLALV

SEQ ID NO: 60931 - DNA, 669 bp, Salmonella enterica subsp. enterica serovar Typhi Ty2
  CDS (1)..(669): transl_table=11
atgcttgagtacttacctgaactgctaaaagggctacacaccagcctgacgctgaccgtggcttctattgccgtcgctttggtgctggcgttagtttttaccatcatcctgacgctaaaaacgccgttcgtggtgtggctggtgcgcggctatatcacgttgtttaccggtacgccgttgttggtgcaaattttcctgatctactacggacccggtcaattcccgacactgcaagagtatccgctactctggcatctactgtctgaaccgtggctgtgcgcactgatcgcgttgtcgctaaacagcgccgcttacaccacgcagctattttatggcgcgattcgcgcgattccggaaggtcagtggcagtcctgcggcgcgctggggatgagtaagaaagatacgctggcgattttgttgccctatgcgtttaaacgcgccctctcctcctattctaatgaggtggtactggtcttcaaaagtacctcgctggcctataccatcaccttgatggaggtcatggggtacagtcagttgctctatggtcgtacctacgatgtggtggtatttggcgcggcaggcgtaatttacctggtcgtcaacggtctattgacgctgatgatgcgtttgattgagcgtaaagccctggcgtttgagcggcgcaattaa

SEQ ID NO: 60932 - protein, 222 aa, Salmonella enterica subsp. enterica serovar Typhi Ty2
MLEYLPELLKGLHTSLTLTVASIAVALVLALVFTIILTLKTPFVVWLVRGYITLFTGTPLLVQIFLIYYGPGQFPTLQEYPLLWHLLSEPWLCALIALSLNSAAYTTQLFYGAIRAIPEGQWQSCGALGMSKKDTLAILLPYAFKRALSSYSNEVVLVFKSTSLAYTITLMEVMGYSQLLYGRTYDVVVFGAAGVIYLVVNGLLTLMMRLIERKALAFERRN

SEQ ID NO: 60933 - DNA, 672 bp, Coxiella burnetii RSA 493
  CDS (1)..(672): transl_table=11
atgaatattttgcaatattggccccaattattatctagcgttgtgataacaattgagttaatgttatctgcgctcgtgttgggtttatttttagcggcgctattaaccgtattttctgagagtggtttttcttttttagaagcaccggtaaatgtttttgtttttattattcgtggaacgccattgctcgttcagatttttattatttattatggcagcggtcagtttcattggttgcgggaaaccattttgtggtccgtgctaaaacgaccttttggctgtgccattatcgctttggctattaatacgagcgcttacacaactgttttattgcgtggcgctatccgttccattccgactggcgaaattgaagcggctaaagcattaggtttatcgcgttggaaagcttatcagagaattattattcctcgagcgatccgcattgtattgcccgcttattcaaatgaagttattatgattttaaaaggaacttcattagcaggtacaatcacattaatggatattatgggagtcacgcgtcacttaatcgccatgacgtatgaagttatcccgctattttttctggccggaattatttattttgttttaaacgctttaattatgagcgtattttatttcctcgaaaaaaaattaacatttcaatattattaa

SEQ ID NO: 60934 - protein, 223 aa, Coxiella burnetii RSA 493
MNILQYWPQLLSSVVITIELMLSALVLGLFLAALLTVFSESGFSFLEAPVNVFVFIIRGTPLLVQIFIIYYGSGQFHWLRETILWSVLKRPFGCAIIALAINTSAYTTVLLRGAIRSIPTGEIEAAKALGLSRWKAYQRIIIPRAIRIVLPAYSNEVIMILKGTSLAGTITLMDIMGVTRHLIAMTYEVIPLFFLAGIIYFVLNALIMSVFYFLEKKLTFQYY

SEQ ID NO: 60935 - DNA, 939 bp, Streptomyces avermitilis MA-4680
  CDS (1)..(939)
atgactgttgacatcgacaagacgacgggcccggagggcactcccccgggcgggccggaagccatcaaggccattccggtcaggcactacgggcgctatgtctccgccgtcatcgccatcgcgatcctgatcgcgatcatctacgcgttcggccagggcaagatcaactggcacgccgtaccggactacttcttcgacgaccgcatcctcacgggcgtcggcaagacgctcctgctgacggtgctgtcgatgctgatcggcatcgtcggcggcatcctgctggccgtcatgcgcctgtcgaagaacccggtgacgtcgtccatcgcctggttctacatctggttcttccgcggcaccccggtcctggtccagctcatcatctggttcaacctgggcctggtcttcgagtacatcaacctcggtccgatctacaaggactactggtcgagcttcatgacgccgttgctgacggcgctcctgggactcggtctgaacgaggccgcgtacatggcggagatctgccgcgcgggcctgctctcggtcgacgagggccagaccgaggcctcgcacgcgctcggcatgagtcacaacaaaaccctgcgccggatcgtgatcccgcaggcgatgcgtgtgatcgtgccgcccacgggcaacgaggtcatcaacatgctgaagacgacctcgctggtgtcggtcgtccagtatccggaactcttccgctacgcccaggacatcggccagacgtccggcgcgcccgtggagatgctcttcctcgccgccgcctggtacctgatcatgacctcggtcctcagcatcgggcagtactacgtcgagcggtactacgcacgcggttccagccgtagtctgccggccacaccgttccagaagatcaaggccaacatgctctcgctgggccgcccgaggggaggcacggcatga

SEQ ID NO: 60936 - protein, 312 aa, Streptomyces avermitilis MA-4680
MTVDIDKTTGPEGTPPGGPEAIKAIPVRHYGRYVSAVIAIAILIAIIYAFGQGKINWHAVPDYFFDDRILTGVGKTLLLTVLSMLIGIVGGILLAVMRLSKNPVTSSIAWFYIWFFRGTPVLVQLIIWFNLGLVFEYINLGPIYKDYWSSFMTPLLTALLGLGLNEAAYMAEICRAGLLSVDEGQTEASHALGMSHNKTLRRIVIPQAMRVIVPPTGNEVINMLKTTSLVSVVQYPELFRYAQDIGQTSGAPVEMLFLAAAWYLIMTSVLSIGQYYVERYYARGSSRSLPATPFQKIKANMLSLGRPRGGTA

SEQ ID NO: 60937 - DNA, 846 bp, Streptomyces avermitilis MA-4680
  CDS (1)..(846)
atgtcctccgacaccctcgccaaacccgccgcggcagcagaagccgcacccgtgcgcatcgtcgcccagcgccggctcggccagtggaccgcggccgccgtcgttctggtcctgctcgggctcgccgtcaactccgtcgtgcgcaacgacgcgttccagtgggacgtcgtcgccgactacttcacctcggcctccgtgctgcggggcctgtggctcacgctctggctgaccgcggtcgtgatggtgttgggcttcgcgctcggcaccctgctcgccgcgggccggctgtccgccaacccggttctcagatcggtgagttggggatacgtctggctgttcaggtcgatgccgatcctggtgcagctgctgctctggttcaacatcggggcgctgtatccgcagatcctcggcgtgaagacggtgaacctgctcggcccggtcaccgtcgccatcgtcggactgacgctccacgaggccgcgtacgccgccgaggtcgtgcgcgggggcatcctctccgtcgaccgcggccagatcgaggccgctcaggcactcggcctgagccggtggcgccgctggtggaggatcgtgctgccgcaggcgatgcggtccatcgtgccgccggccggcaacatgctgatcggcaccctcaagggcacctccatcgtcagcgtcatcgccgtacaggacctgctctactcggtgcagctcgtctaccaccgcacctaccaggtcatcccgctgctgatggtggccaccgtctggtacgtcgtggtcacctcggtgctcagcgtcggccagtactacgtcgagaagtactacgcgcgtggttcggagcggacccgatga

SEQ ID NO: 60938 - protein, 281 aa, Streptomyces avermitilis MA-4680
MSSDTLAKPAAAAEAAPVRIVAQRRLGQWTAAAVVLVLLGLAVNSVVRNDAFQWDVVADYFTSASVLRGLWLTLWLTAVVMVLGFALGTLLAAGRLSANPVLRSVSWGYVWLFRSMPILVQLLLWFNIGALYPQILGVKTVNLLGPVTVAIVGLTLHEAAYAAEVVRGGILSVDRGQIEAAQALGLSRWRRWWRIVLPQAMRSIVPPAGNMLIGTLKGTSIVSVIAVQDLLYSVQLVYHRTYQVIPLLMVATVWYVVVTSVLSVGQYYVEKYYARGSERTR

SEQ ID NO: 60939 - DNA, 705 bp, Bacillus cereus ATCC 14579
  CDS (1)..(705): transl_table=11
gtgaaaatgtatctaagtagtgcattagtttcagatcgattgtctacttggatagatattatgcagacttccttcatgcctatgctgaaggaagctgtttttacaacaattccattaacgcttattacatttattatcggtcttatacttgcgacgttaacagcgctcgcacgtatttcaggtagtcgtattttacaatggattgctcgtatctatgtatctatcattcgcggaacgccacttcttgtacagttatttattattttctatggtcttccaactcttaatattgaagttgagccatatacagcagcagttgttggattttcattaaatgtcggtgcatatgcatctgaaattattcgtgcttctatcctttccattccgaaagggcagtgggaagcagcttatacaattgggatgacatatccacaagcattaaaacgtgttattttaccacaagcaacgcgcgtatcaatcccgccgctttcaaatacatttattagcttagtgaaggatacttcattagcatcgttaattttagtaacagaaatgttccgaaaagcgcaggaaattgcggcgatgaactacgagtttttaattgtttattttgaagcaggtcttatttactgggttatttgtttcttattatcaatcgtacaacagatgttagaaaagcgttcagaacgctatacattaaaataa

SEQ ID NO: 60940 - protein, 234 aa, Bacillus cereus ATCC 14579
MKMYLSSALVSDRLSTWIDIMQTSFMPMLKEAVFTTIPLTLITFIIGLILATLTALARISGSRILQWIARIYVSIIRGTPLLVQLFIIFYGLPTLNIEVEPYTAAVVGFSLNVGAYASEIIRASILSIPKGQWEAAYTIGMTYPQALKRVILPQATRVSIPPLSNTFISLVKDTSLASLILVTEMFRKAQEIAAMNYEFLIVYFEAGLIYWVICFLLSIVQQMLEKRSERYTLK

SEQ ID NO: 60941 - DNA, 666 bp, Haemophilus ducreyi 35000HP
  CDS (1)..(666): transl_table=11
atgtttacagagtattttccgcttctttatagtgctactttggtaacattaggcttagcggtctgttcactgctagttggtttatgtttatcgattttgtttgttgcattagaaatgaataaacaagcatttattcgccaaccgactacggtgtttcttacattatcacgcgggctacctgaaattctagtggtattacttatcttctttggttcgacagaattagtggaaaaaataaccggtgagtatgtcgaatttagtgcctttggctgtggggtgttggcattgtcacttatttttgcggcctatgcttcacaatcattacgtggtgctattcaagcggtgccgaatggtcaatggcaaagtggtgccgctttagggctaagtcgtagctatactttttggcatattgtgatgccacaagtttggcgccatgcgttaccggggttaagtaaccaatggctagttttgctaaaagataccgcattgatctctttaattggtgtaaatgatttaatgcgtcagacggatttaattaataccaatgaacatcagccttttacttggtatggtttttcagccttaatttatttggctatcacgctgataagtcaagtgattatcgctaaattagcacagcattttacgcgttttgagagagggtaa

SEQ ID NO: 60942 - protein, 221 aa, Haemophilus ducreyi 35000HP
MFTEYFPLLYSATLVTLGLAVCSLLVGLCLSILFVALEMNKQAFIRQPTTVFLTLSRGLPEILVVLLIFFGSTELVEKITGEYVEFSAFGCGVLALSLIFAAYASQSLRGAIQAVPNGQWQSGAALGLSRSYTFWHIVMPQVWRHALPGLSNQWLVLLKDTALISLIGVNDLMRQTDLINTNEHQPFTWYGFSALIYLAITLISQVIIAKLAQHFTRFERG

SEQ ID NO: 60943 - DNA, 684 bp, Haemophilus ducreyi 35000HP
  CDS (1)..(684): transl_table=11
atgtttcaagattattttttgatcattgcacaaggtattccaacgagtcttatgctgacagcagccgccttaatgaccgcttttattttagcggtgttttttacttttttgcttgcaatgggaaatcagtggctgaaaatgcttataaatagttatttaatgcttttcactggcacgccgttattaatccagttttttttaatttattatgggcctggtcagtttaaatggatcactgaaagtgtggtttggcaatttttatcagatgcttggttttgtgcggtattggcattagcgctcaatagtgctgcgtattctacacagctattttatggtgcgctaaaagcggtgccaaaagggaaatggcaagcttgttcagctttagggttaagtcgtttagataccttgaaaattatgattccatatgcattacgccgagcattaccttcgtatagtaatgaaattatcttggtttttaaaggcacctcattagcttctacgatcaccttattagatataatgggttatgctcgccagctgtatgggatagagtatgatgctttagctatttatggtatagcggggctaatttatttaataattaccggcattatgacgtttattttacgtaaagttgaaactagggtcttggcttttgaaacgttttcgaccgcaaaatcttag

SEQ ID NO: 60944 - protein, 227 aa, Haemophilus ducreyi 35000HP
MFQDYFLIIAQGIPTSLMLTAAALMTAFILAVFFTFLLAMGNQWLKMLINSYLMLFTGTPLLIQFFLIYYGPGQFKWITESVVWQFLSDAWFCAVLALALNSAAYSTQLFYGALKAVPKGKWQACSALGLSRLDTLKIMIPYALRRALPSYSNEIILVFKGTSLASTITLLDIMGYARQLYGIEYDALAIYGIAGLIYLIITGIMTFILRKVETRVLAFETFSTAKS

SEQ ID NO: 60945 - DNA, 693 bp, Bordetella pertussis Tohama I
  CDS (1)..(693): transl_table=11
atgaatctcgaaaccttgcgcatgtacctgacgccgctggccgaaggcacgatgtggatgctggcgctgttcttctgttcggcggtgctggccgtcgccctgggcctgctggtctgcctgtgccgcttgtccaagtcgcgcgtgctcagccgcggcgcgcgcctgtacatcgacatcatccggggcaccccgctgctgctgcagctgttctacatctactacggcatgccggagctgggggtggtgatcaatgcgttcgtggccggcgtgctgggcctgacgctgaacttcggcgcctacctggccgagctgtttcgcagcggcatccagtcggtcgattccggccagtacgaggcggcgcgcgcgctgggcctgaacaaggtcgaccgcctgcgccgcgtggtgctgccgcaggccgtgcgcacggtgtttccggcgctgggcaactacgcgctggtgctgatcaaggaaacctcgctggtggccgtgatcagcgtgtacgagctgatgcgcgccggcgagatgctggcgggcgccaccttccaggccctgacggtctacacgatggtcggcgccatctacttcgccatgtgcagcgtgctggcgcacctgttccgccgctcggagaagcgcctgacggtgccgggctactggagcggggcgggcgagaaccacgacatctccaaggcatag

SEQ ID NO: 60946 - protein, 230 aa, Bordetella pertussis Tohama I
MNLETLRMYLTPLAEGTMWMLALFFCSAVLAVALGLLVCLCRLSKSRVLSRGARLYIDIIRGTPLLLQLFYIYYGMPELGVVINAFVAGVLGLTLNFGAYLAELFRSGIQSVDSGQYEAARALGLNKVDRLRRVVLPQAVRTVFPALGNYALVLIKETSLVAVISVYELMRAGEMLAGATFQALTVYTMVGAIYFAMCSVLAHLFRRSEKRLTVPGYWSGAGENHDISKA

SEQ ID NO: 60947 - DNA, 651 bp, Bordetella parapertussis 12822
  CDS (1)..(651): transl_table=11
atgatcgaattgctgcacaaggcggcgcccatcatccagggcgccttgctgatgacgctgctgctcggcctcagttccgcggtgctgggcaccgcgctggggctggtgctggcgttgttccggctgtcgccggtcgcgcccttgcgctggctggcgttctggtatgtgtccatctttcgcggcacgccgctgttgctgcaattgctgctgatctatttcggcctgccgcactacggcatcgagctcgagccggtgccgacggcaatcctggccttgttgctgtgctcggccgcctacctgagcgagaatttccgctcgggcatcctgggcgtggaccgtggccagatcgaggcggcgcagtcgctgggcatgggggcggcgcgcagcctgttccgcatcatcctgccgcaggcgatccggatcgccgcgcccaccatgggcacgcgctacatcgcgctgatgaaggacacgtcgctggcctcgaccatcaccgtggtcaaactgaccaagatggccgagcagatcggctccaatacgttccgctacatggagatgttcatcatcgccggcgcgctgtactgggtgatcaaccagatgctgacgttcatccaggtctgggtggagagcaagctgggcaagggggtggcatga

SEQ ID NO: 60948 - protein, 216 aa, Bordetella parapertussis 12822
MIELLHKAAPIIQGALLMTLLLGLSSAVLGTALGLVLALFRLSPVAPLRWLAFWYVSIFRGTPLLLQLLLIYFGLPHYGIELEPVPTAILALLLCSAAYLSENFRSGILGVDRGQIEAAQSLGMGAARSLFRIILPQAIRIAAPTMGTRYIALMKDTSLASTITVVKLTKMAEQIGSNTFRYMEMFIIAGALYWVINQMLTFIQVWVESKLGKGVA

SEQ ID NO: 60949 - DNA, 651 bp, Bordetella bronchiseptica RB50
  CDS (1)..(651): transl_table=11
atgatcgaattgctgcacaaggcggcgcccatcatccagggcgccttgctgatgacgctgctgctcggcctcagttccgcggtgctgggtaccgcgctggggctggtgctggcgttgttccggctgtcgccggtcgcgcccttgcgctggctggcgttctggtatgtgtccatctttcgcggcacgccgctgttgctgcaattgctgctgatctatttcggcctgccgcactacggcatcgagctcgagccggtgccgacggcaatcctggccttgtcgctgtgctcggccgcctacctgagcgagaatttccgctcgggcatcctgggcgtggaccgtggccagatcgaggcggcgcagtcgctgggcatgggggcggcgcgcagcctgttccgcatcatcctgccgcaggcgatccggatcgccgcgcccaccatgggcacgcgctacatcgcgctgatgaaggacacgtcgctggcctcgaccatcaccgtggtcgaactgaccaagatggccgagcaggtcggctccaatacgttccgctacatggagatgttcatcatcgccggcgcgctgtactgggtgatcaaccagatgctgacgttcatccaggtctgggtggagagcaagctgggcaagggggtggcatga

SEQ ID NO: 60950 - protein, 216 aa, Bordetella bronchiseptica RB50
MIELLHKAAPIIQGALLMTLLLGLSSAVLGTALGLVLALFRLSPVAPLRWLAFWYVSIFRGTPLLLQLLLIYFGLPHYGIELEPVPTAILALSLCSAAYLSENFRSGILGVDRGQIEAAQSLGMGAARSLFRIILPQAIRIAAPTMGTRYIALMKDTSLASTITVVELTKMAEQVGSNTFRYMEMFIIAGALYWVINQMLTFIQVWVESKLGKGVA

SEQ ID NO: 60951 - DNA, 681 bp, Bordetella bronchiseptica RB50
  CDS (1)..(681): transl_table=11
gtgccggcctggctacagctcatgctcgattcgttctggcccctgctgcatgcggggttgatgttcaccgtgccgctgacgctgctgtcgttcgccgcgggcctggcgctggccttcgtggtggcgctgctgcggctgttcggcccctggcccatcgtggcgctgatgcgcttctacgtctggctgatccgcggcacgccgctgctggtgcagttgttcgtgatcttctatggcctgcccagcgtcggcatcgtgctcgacccgctgccggccgccctgatcggcttcacgctgaacgtcggcgcctacaactcggaagtgattcgcggcgccatcgaatccatccccaggggccaatgggaagcggcctattcgctgagcatgacgcgcggccaggccatgcgccgcaccgtgctgccgcaggccgcgcgggtggcggtgccgccgctggccaattcgttcatcgcgctggtcaaggacacctcgctggcggcggtgctgaccgtgcccgaaatcttccaggccgcccagcgcatcgcggcggtgacctacgagccgctcattctctataccgaggcggcgctgatctacctggtgttcagttcggccctgtcctcgctgcaggtgcgcctggaaaaacgcttcggccagcacgccgtcttcgcggagcaacatcgatga

SEQ ID NO: 60952 - protein, 226 aa, Bordetella bronchiseptica RB50
MPAWLQLMLDSFWPLLHAGLMFTVPLTLLSFAAGLALAFVVALLRLFGPWPIVALMRFYVWLIRGTPLLVQLFVIFYGLPSVGIVLDPLPAALIGFTLNVGAYNSEVIRGAIESIPRGQWEAAYSLSMTRGQAMRRTVLPQAARVAVPPLANSFIALVKDTSLAAVLTVPEIFQAAQRIAAVTYEPLILYTEAALIYLVFSSALSSLQVRLEKRFGQHAVFAEQHR

SEQ ID NO: 60953 - DNA, 669 bp, Bordetella bronchiseptica RB50
  CDS (1)..(669): transl_table=11
atgatgctggatttcgcgcctgtctttgccgacttcgacgcattgctgcgcggcgcggtcgtcaccgtggaggtgacggcctgcgcgctgctgctgggctgcgtcatcggcctgctggtcggggtcggccgcctcaacccgcaacgccgcttcatctacaacctgtgcagcgtatacctgctgttctttcgcggcacgccgctgctggtgcagctgttcatctggttcttcgggctgccgcagttcggcatcacgctgccggcgttcgcctgcggcgtgctcggcctgggcatctattccggcgcctacgtctcggagatcgtgcgcggcgccatccagtcggtcgaccgcggccagatggaagcggcccgctcgctgggcatgtcctcggcgcaggcgatgcgcatcatcatcctgccgcaggccgtggtgcgcatgattccgccgctgggcaacgagttcatcgccctgatcaagaattccgcgctggtttcgctgctgacgatccacgatctgatgcacgaaggccagaagatcatcagcgtgtcgtatcgctcgctggagacctatctggtggtggccctgatttacctggtgttgacgaccgcgacgacgacgatcctgcgccggatcgagcatcgcctgcgcgcgggagggatggtgcaatga

SEQ ID NO: 60954 - protein, 222 aa, Bordetella bronchiseptica RB50
MMLDFAPVFADFDALLRGAVVTVEVTACALLLGCVIGLLVGVGRLNPQRRFIYNLCSVYLLFFRGTPLLVQLFIWFFGLPQFGITLPAFACGVLGLGIYSGAYVSEIVRGAIQSVDRGQMEAARSLGMSSAQAMRIIILPQAVVRMIPPLGNEFIALIKNSALVSLLTIHDLMHEGQKIISVSYRSLETYLVVALIYLVLTTATTTILRRIEHRLRAGGMVQ

SEQ ID NO: 60955 - DNA, 654 bp, Bordetella bronchiseptica RB50
  CDS (1)..(654): transl_table=11
atggactacgtaatttccctcctggggccgatggcgcaaggcgcccaggtcaccctcacgctgttcttcatcacgctggccctggcggtgccgctgggcctggtgctggcgctggcgcgcatctcgcgctggcgcctgctgtcgcgcctggtcaacggctatatctggctgatgcgcggcacgccgctgatgctgcagctgctgttcatctacttcgcgctgccgttcgtgccggtggtcggcatccgcctgccggatttcccggcggcggtggtcgccttcgcgctcaactacgcggcgtatttcgccgagatcttccgcgccggcatccagtcggtggatcgcggccagtacgagggcagcaaggtgctgggcatgacctacctgcagaccatgcggcgcatcgtcctgccgcagatggtgcagcgcgtgctgccgcccatgagcaacgaaaccatcaccctggtcaaggacacctcgctcatctacgtactggcgctcaacgacatcctgcgcaccgcgcgcggcatcgtgcagcgcgacttcaccaccacgccgttcctggtcgccgccgccttctacctgatcatgacgctgatcctcacctggttctttcaacacatggaaaagcgctatgccaaatacgaccagtaa

SEQ ID NO: 60956 - protein, 217 aa, Bordetella bronchiseptica RB50
MDYVISLLGPMAQGAQVTLTLFFITLALAVPLGLVLALARISRWRLLSRLVNGYIWLMRGTPLMLQLLFIYFALPFVPVVGIRLPDFPAAVVAFALNYAAYFAEIFRAGIQSVDRGQYEGSKVLGMTYLQTMRRIVLPQMVQRVLPPMSNETITLVKDTSLIYVLALNDILRTARGIVQRDFTTTPFLVAAAFYLIMTLILTWFFQHMEKRYAKYDQ

SEQ ID NO: 60957 - DNA, 690 bp, Bordetella bronchiseptica RB50
  CDS (1)..(690): transl_table=11
gtgttttttctagacgcccattatctgtcccagctcgccgatggcatgatgaccacggtgcagctgttcctggtggcctgggtgctggccttcacactggccgtgctgctggtcgtgatacgcaccaccaacctggcgccgtgccgctggttcgtggacgcctacgtcgaataccaccgcaacgtgccgctgctggtgcaggtgctgttctggtacttcggcatgcccgaactgctgcccgaaggcgtgcgcggctggctctaccagcacaacgcggagctctcgctggccgccatcgcgctgggcctgggctctgccgcctacatcgccgaggacatacgcagcggcctgcgcgcgatccccggcacccagttcgaggcggcccgcgcgctgggctcgtcgtacctgcaatgcatgcgccacgtcatcgtgccgcaggcgctgcgcatttcgatcccgccgctggtcggccgggccctgctgctgttcaagaacaccagtgtggccatggcgatcggcgtggtcgagctgacctaccaggcgcgcgagatcgagaacgagacctaccgcaccttcgccaccttcggcgccgccaccctcatgtacctgctcggatccttcctgctgatgttcatcggctcgcgcgtgtacgcccgctacaacatcggaagcggaggccgccgtgcttga

SEQ ID NO: 60958 - protein, 229 aa, Bordetella bronchiseptica RB50
MFFLDAHYLSQLADGMMTTVQLFLVAWVLAFTLAVLLVVIRTTNLAPCRWFVDAYVEYHRNVPLLVQVLFWYFGMPELLPEGVRGWLYQHNAELSLAAIALGLGSAAYIAEDIRSGLRAIPGTQFEAARALGSSYLQCMRHVIVPQALRISIPPLVGRALLLFKNTSVAMAIGVVELTYQAREIENETYRTFATFGAATLMYLLGSFLLMFIGSRVYARYNIGSGGRRA

SEQ ID NO: 60959 - DNA, 690 bp, Bordetella bronchiseptica RB50
  CDS (1)..(690): transl_table=11
gtgcttgatatcctgcatgactactggcccatgctgctggtgggccaatatcccaacggcccgctgggcggcctggccctcaccctgatactggcgctgctgggcctgctgctgtccatgccgctggccctgctgatcgccatcgcccgggtcagcccgtttcgcggcctgcgggtggccagccgcctgctggtcaacaccgtgcgcggcatgccgctgctgatgctgatcttctgggcctacttcgccgtgcccaagctgacgggcggaagcatcagcggcttctggaccctggtcaccgcgctggtgatctacgaaagcgcctatctgtccgaggtcatccgctccggcatcgaggccattcccaaggggcagatcgaagcgtcgcgctcgctgggcgtgggctactggacgaccatgcgcaaagtggtgctgccgcaggcgctgttcaacgtgctgcccagcatgaccagccagttcgtctccaccatcaaggagacctcgctgggctatgtgatcagcgtcaatgagctgaccttcgcggccaaccaggtcaacaacctggtgctgacccagccgctgcaggtgttcggcatcctggccattatttacttcctggtgtgtttcagcctgagccgcagcgtggcctggctggacagctgggtacgccgcagccgcagcatggcgtga

SEQ ID NO: 60960 - protein, 229 aa, Bordetella bronchiseptica RB50
MLDILHDYWPMLLVGQYPNGPLGGLALTLILALLGLLLSMPLALLIAIARVSPFRGLRVASRLLVNTVRGMPLLMLIFWAYFAVPKLTGGSISGFWTLVTALVIYESAYLSEVIRSGIEAIPKGQIEASRSLGVGYWTTMRKVVLPQALFNVLPSMTSQFVSTIKETSLGYVISVNELTFAANQVNNLVLTQPLQVFGILAIIYFLVCFSLSRSVAWLDSWVRRSRSMA

SEQ ID NO: 60961 - DNA, 714 bp, Chromobacterium violaceum ATCC 12472
  CDS (1)..(714): transl_table=11
atgatagacatcatccagcaatactggcgggccttcctgtggagcgacggctaccacctgtccggcctggccgtcaccatgtggctgttggtgctgtccatcgccttcggtttcgtcgtgtccatcccgctggcggtggcgcgcgtgtccaaggtcaaatggctggcgcgcgcggtgtggctgtacacctacgtgttccgcggcaccccgctctacgtgcagctgatcttcttctacagcggcatgtacagcctggaggtggtgcgcgaggtgggcttcctcaaccactttttccgcgaaggctacaactgcaccatcctggcgttcgcgctgaacacctgcgcctacaccaccgagatcttcgccggcgcgatcaaggccacgccctacggcgagatcgaggccgggcgcgcctacggcatgagccccttcacgctgtaccgccgggtgatcatcccgtcggcgctgcgccgggcgctgccggcgtacagcaacgaggtgatcctgatgctgcacgccaccaccgtggctttcaccgccaccgtgccggatatcctgaaggtcgcgcgcgacgtcaacgccgccacatacgattccttcaacgccttcggcctggcagccttgctgtatctgagcatcacctttattctggtcggcctgttccgcaaggctgaagcccgctggctcgcttacctgcatccgaccaagagctga

SEQ ID NO: 60962 - protein, 237 aa, Chromobacterium violaceum ATCC 12472
MIDIIQQYWRAFLWSDGYHLSGLAVTMWLLVLSIAFGFVVSIPLAVARVSKVKWLARAVWLYTYVFRGTPLYVQLIFFYSGMYSLEVVREVGFLNHFFREGYNCTILAFALNTCAYTTEIFAGAIKATPYGEIEAGRAYGMSPFTLYRRVIIPSALRRALPAYSNEVILMLHATTVAFTATVPDILKVARDVNAATYDSFNAFGLAALLYLSITFILVGLFRKAEARWLAYLHPTKS

SEQ ID NO: 60963 - DNA, 681 bp, Chromobacterium violaceum ATCC 12472
  CDS (1)..(681): transl_table=11
atgcctccgtggttgcagttgatggcagattcgctgccatctcttttatatgccggcctggtgttcaccgtgccgttgacgctgctgtccttcgccggcggcctggcgctgggtttgctggtggccttgatccggctgttcgggccgcgcccgctggtgctgctggtgcgcggctactcctggctggtgcgcggcacgccgctgttggtgcagctgttcgtgatcttctacggcttgccgcgggtcggcatcgtgttcgatccgttcccggcggcgctgctcggcttcgtgctcagcgtcggcgcctacacctcggaagtgatacgggcggcgatctcgtcggtgcccagggcgcagtgggaggcggcgtattcgctgggcatgagctggtcgcaggcgatgcgccgcaccatcctgccgcaggcgggcagggtggcggtgccgccgctggccaactccttcatctcgctggtgaaggacacctcgctggcggcggtgctgacggtgccggaaatgttccaggcggcgcagcgcatcgcggccaccacgtacgagccgctgctgctgtatctggagaccgcgctgatctatctgttgttgagcactgtattgacctggctgcaggagcggctggaaaaacgttttgaccggcatgtggcgccggtgggggctgcgtcgtga

SEQ ID NO: 60964 - protein, 226 aa, Chromobacterium violaceum ATCC 12472
MPPWLQLMADSLPSLLYAGLVFTVPLTLLSFAGGLALGLLVALIRLFGPRPLVLLVRGYSWLVRGTPLLVQLFVIFYGLPRVGIVFDPFPAALLGFVLSVGAYTSEVIRAAISSVPRAQWEAAYSLGMSWSQAMRRTILPQAGRVAVPPLANSFISLVKDTSLAAVLTVPEMFQAAQRIAATTYEPLLLYLETALIYLLLSTVLTWLQERLEKRFDRHVAPVGAAS

SEQ ID NO: 60965 - DNA, 666 bp, Chromobacterium violaceum ATCC 12472
  CDS (1)..(666): transl_table=11
atgctgtccagcaccgacggtctgatcctgacgctggagctgctggccctgtcgctgctgctgggcctggccatggcggttccgctggcggtggcccgcgtctccaggaggcgcgcgctgtccggcgccgtctggctgttcggctacgtgttccgcggcacgccgctgttggtgcagctgttcatcatctactacggcctggcgcaattcgactgggtgcgcgacagctgggcctggcattacctgcaggacgcctatgtctgcgcgatcctggctttcacgctgaacaccgccgcctacaccaccgaaatcatcgccggccagatccgcgccacccactggggcgagatcgaggcggcgcgctcgatgggcatgagccactggctgatgctgcgccggatcgtgctgccttcggcgctgcgccgcgcgctgcccgcctacagcaacgaagtgatcatgatgctgcaaagcaccgcgatcgccggcctggtgacgctggccgacctcaccggcgtggcccggcgcatctacagcgagagctatatgccgttcgagcccttcctcaccgccgcgctgatctacctggccctgaccttcgccctggtctggctgatgaagcgcgccgaacgccgctatctggccttcctcgccccccgcaagccatga

SEQ ID NO: 60966 - protein, 221 aa, Chromobacterium violaceum ATCC 12472
MLSSTDGLILTLELLALSLLLGLAMAVPLAVARVSRRRALSGAVWLFGYVFRGTPLLVQLFIIYYGLAQFDWVRDSWAWHYLQDAYVCAILAFTLNTAAYTTEIIAGQIRATHWGEIEAARSMGMSHWLMLRRIVLPSALRRALPAYSNEVIMMLQSTAIAGLVTLADLTGVARRIYSESYMPFEPFLTAALIYLALTFALVWLMKRAERRYLAFLAPRKP

SEQ ID NO: 60967 - DNA, 663 bp, Chromobacterium violaceum ATCC 12472
  CDS (1)..(663): transl_table=11
atgggcgagtggatggctctgttcgaggcggcgctgccggtgctgctgcagggcgcggcgcatacgctgctgttcgcgctggtggcgatggtgctgggcctggcgctgggtttcgcggtggcgatggtgcgggtggcgaagctgccggtcttgtcgcagctggcggcgttctacgtcagcgcgatgcgcggcacgccgctcttggtgcagattttcgtcatctattacggcctgcccggcgtcggcctggaactggacccggtgccggccggcgtgctggccctgacgctgaacgtggcggcctacctgtcggaaagcctgcgcggcggcatcgccggcgtggccaaggggcagtgggacgcggcgttctcgctgggcttcacctggtggcagacgatgcgccacatcatcgcgccgcaggcgctgcggctgtcggtgcccagcctgtccaatagcctgatctcgctgatcaaggacacctcgctggtgtcggtgatcaccgtcaccgagctgatgctggcgacgaaagaggtgatcgcccagaccttccagccgctgccgctgtacctggccgccgccgccatctattggctgctcagcgccttgttcgagcgcttgcagcgccacgtggaaaaccggctcaacctggcgcaccagcgctga

SEQ ID NO: 60968 - protein, 220 aa, Chromobacterium violaceum ATCC 12472
MGEWMALFEAALPVLLQGAAHTLLFALVAMVLGLALGFAVAMVRVAKLPVLSQLAAFYVSAMRGTPLLVQIFVIYYGLPGVGLELDPVPAGVLALTLNVAAYLSESLRGGIAGVAKGQWDAAFSLGFTWWQTMRHIIAPQALRLSVPSLSNSLISLIKDTSLVSVITVTELMLATKEVIAQTFQPLPLYLAAAAIYWLLSALFERLQRHVENRLNLAHQR

SEQ ID NO: 60969 - DNA, 966 bp, Wolinella succinogenes DSM 1740
  CDS (1)..(966): transl_table=11
atgaaaagacaccaatcgattctagaaaaccgacctttagggcatctgctcgcctttcttttctttgtggcgttgggctactccatgtatttggcaggctctagcatcaactatatttggaaatggaatacgattcctaaatattttgcctacgagcacacggtcgcgcttgaatcgaccctagaggggagggtgaaaatcctctcccctaaagaggtcgaggtcgtgggcgaagaggggagcgagaagttcctagtggcaggctatgaacttgcctacgaagagggggagatcatctatcccggtgaggcgctcgccaaaaaagaggagtataaggcaggtccgcttcttctagggctctggatgacgatcaagatttcgctcatttcaggggtgattgccttttttatcggcgccattcttgccctcatgaaaatctccaaagcacaggtgtttcgcgatattgctacggtctatatcgaagtgattcgcggcacgcctcttttggtgcagatttttatcttctattttattattgcgaccatttttgagattgacagcttctacgcaggggctatctcgttagcgattttttatggagcctatatcgctgaggtgcttcgtggagcgattcaatccattgataagggtcagcaagaggcggcgctctctttggggatgaactatttccaaacaatgacgctcatcattatccctcaagccctcaagcgctcgctcccctcactcacgggtgagatgatcgctctgattaaagattcgtctcttgtctcagtcatctcagtgaccgacctcaccaaggtgggccgtgagatggtggctaataccttctctccctttgagacttggattgtggtggcgatcatgtattttgctatcacctcttcgctctcacttctagcccatcgactcgaagacaacatgaaaaagagagggggaatgtcctaa

SEQ ID NO: 60970 - protein, 321 aa, Wolinella succinogenes DSM 1740
MKRHQSILENRPLGHLLAFLFFVALGYSMYLAGSSINYIWKWNTIPKYFAYEHTVALESTLEGRVKILSPKEVEVVGEEGSEKFLVAGYELAYEEGEIIYPGEALAKKEEYKAGPLLLGLWMTIKISLISGVIAFFIGAILALMKISKAQVFRDIATVYIEVIRGTPLLVQIFIFYFIIATIFEIDSFYAGAISLAIFYGAYIAEVLRGAIQSIDKGQQEAALSLGMNYFQTMTLIIIPQALKRSLPSLTGEMIALIKDSSLVSVISVTDLTKVGREMVANTFSPFETWIVVAIMYFAITSSLSLLAHRLEDNMKKRGGMS

SEQ ID NO: 60971 - DNA, 702 bp, Photorhabdus luminescens subsp. laumondii TTO1
  CDS (1)..(702): transl_table=11
atggaaccctcttggttcaatctagtactcgattctttttggcctatgctttatgcgggctttgcttttactattccactaactcttattacttttactctcggtatcatactgggttttattgttgcgctcatccggctttacgggccaaaaccacttattgctgtcgccaaattctacgtctggctgatccgtggcacaccgttgctggtacaactgtttcttattttttatgccttacctagcgtcggcattacgttaggtgcatttacctcggcagtgattggtttcacattaaatattggtgcctatacctctgagataattcgcgccactttattgtctgtaccaaaagggcagtgggaagcagcttattctatcggcatgagctggacacaatcattgcgtcggatcattctacctcaagccgcaagaatcgccattccaccactctcaaacacatttatttcactggtgaaagatacttcactggcttcagtcattaccgtaccggagcttttccttgctgcacaacgtattgcagcggtgacttatcaacctctcattctttatactgaggcggcaatactttatctgataatcagttcagtattgtcatcactacaaacccgtctggaaaagaagttttcgcaaaagagtgacatacaggaattaaaagatgattcaactctccggcattga

SEQ ID NO: 60972 - protein, 233 aa, Photorhabdus luminescens subsp. laumondii TTO1
MEPSWFNLVLDSFWPMLYAGFAFTIPLTLITFTLGIILGFIVALIRLYGPKPLIAVAKFYVWLIRGTPLLVQLFLIFYALPSVGITLGAFTSAVIGFTLNIGAYTSEIIRATLLSVPKGQWEAAYSIGMSWTQSLRRIILPQAARIAIPPLSNTFISLVKDTSLASVITVPELFLAAQRIAAVTYQPLILYTEAAILYLIISSVLSSLQTRLEKKFSQKSDIQELKDDSTLRH

SEQ ID NO: 60973 - DNA, 741 bp, Vibrio vulnificus YJ016
  CDS (1)..(741): transl_table=11
atgctggatttacaaggatatgaagcctctatctttaaaggggccgtgttaaccattgaagtggcattactttcccttgtgctcgccatgttacttggcatgttgggcgcgcttgctaaaatggcgccttatcgttgggcgcgtgctatcgccacactttacaccaccatcatcagagggattcctgatcttgtcttgatgatgctgattttcttcggcggccagatttttcttaacaactctctctatgccgtcaatgaatggctcaacgagtggtttacatcaagcgaccccacgcatgaatgggtctcctaccttcctgactatgtagacgtgagcccttttattgccggtgttctgaccataggctttatcttcggcgcgtacatggcggaaaccttccgcggtgccatcatggcggtcgataagggggagcttgaggcggcaaaagcgtacggcatgagctcggcgttggcgtttcgccgcatattgctgccgcaaatgattcgtcacgcgttgcctggttttggtaataactggctagtgttactcaaaacgaccgcgttagtttccatcatcggtttagaggatatggttcgcgtcggcgctttagccgcaggatcaaccaaaatgccatttaccttttatatggcggtggctctgattttcctcttctttaccagcgtttctacgggctgtttgaaagtcctagaacgtaaattcagcattcatacgaggtag

SEQ ID NO: 60974 - protein, 246 aa, Vibrio vulnificus YJ016
MLDLQGYEASIFKGAVLTIEVALLSLVLAMLLGMLGALAKMAPYRWARAIATLYTTIIRGIPDLVLMMLIFFGGQIFLNNSLYAVNEWLNEWFTSSDPTHEWVSYLPDYVDVSPFIAGVLTIGFIFGAYMAETFRGAIMAVDKGELEAAKAYGMSSALAFRRILLPQMIRHALPGFGNNWLVLLKTTALVSIIGLEDMVRVGALAAGSTKMPFTFYMAVALIFLFFTSVSTGCLKVLERKFSIHTR

SEQ ID NO: 60975 - DNA, 690 bp, Vibrio vulnificus YJ016
  CDS (1)..(690): transl_table=11
atggcattaacgggttactctctttctctcgcccaagcaagctggatgaccatccagcttgcgctggtcagcttagccgtcggtttagtgttagcggttgttttcgccggtggcgagatgactcgccacccactagtgaaatggccaactactgcgctggtgacggtgctacgcggcttgcctgagcttttggtggtgctgttcatctactttggctcaacacaagttctgtttttactgactggcgattttatcgaggtaagcccgtttctttctggtgtgattgccctttctttgatttttgcttcttacgcttctcagaccattcgcggcgcattgaaagccgttaataaaggccaacgtgaagcggccagtgctctaggcatgagcaaaagtcgtactttttttagaattgtgttaccgcaagcggtgcgccatgcgctgccaggactcaccaaccaatggttggtgttattgaaagacacggcgttggtgtcattaatcggcgtgacggatcttctcaagcaagcgcaactgacgtcggcggccactcatgaagcgtttacttggtatgccaccgctgcggccatttacttagtcatcacgcttgtaacccagcgcgttgtaaaaatcatcgatgccaaattttccgcacaaggattgagccttgagcaaggagccaaagcatga

SEQ ID NO: 60976 - protein, 229 aa, Vibrio vulnificus YJ016
MALTGYSLSLAQASWMTIQLALVSLAVGLVLAVVFAGGEMTRHPLVKWPTTALVTVLRGLPELLVVLFIYFGSTQVLFLLTGDFIEVSPFLSGVIALSLIFASYASQTIRGALKAVNKGQREAASALGMSKSRTFFRIVLPQAVRHALPGLTNQWLVLLKDTALVSLIGVTDLLKQAQLTSAATHEAFTWYATAAAIYLVITLVTQRVVKIIDAKFSAQGLSLEQGAKA

SEQ ID NO: 60977 - DNA, 945 bp, Corynebacterium diphtheriae NCTC 13129
  CDS (1)..(945): transl_table=11
atgacttccccacaacctattcaggcaaaaccattgcggcatccgggccgctgggtcgctgccattattattctcgccctgtttgtttggtttcttattagcgctgccaccaacgatgcatacggctgggatatttatcgccagtatctttttgatactcgtattgcttctgctgcagtgcatacgctagctattacgatcttgtcgatgctcatgggtgtcgttttaggctgcatagtagcaattatgcgtatgtcgccaaaccctgttttgcgtggtatttcgtggttctatttgtggatcttccgaggtaccccggtctacgttcagttggtgttctggggactattgggctctatttacagcggcatcaacttgggctttaccgaaatttcattggaaaacctgctttccaacatgtttattcttgcagtcgtaggtcttgggcttaacgaggctgcttacatgtctgagattgtccgctcaggtatccaagcagttcccgagggacagacagaagcatctaaagctttaggtatgagctggtggatgaccattcgtcgtactgtattgccacaagcaatgcgtatcatcgtcccgcctactggcaatgagtttatttcattgctgaagaccacctcactggttgtggcaatcccttacacctctgagctctatggtcgtgcaaccgatatcgcagcagcgcttttcgacccagtaccacttttgctcgttgcggcaacgtggtacctagtgattacctcgttgctcatggtggcccaacactacttggagaagtattacgaccgtggcgcaacgcgccagctcactgcacgtcaactcgcggcacttgctgacgctgaaggcactcttcccaaaaatgttgacatcattgcagaaacacccaagccgcacactccccgcactcctaagaaaggcgcctaa

SEQ ID NO: 60978 - protein, 314 aa, Corynebacterium diphtheriae NCTC 13129
MTSPQPIQAKPLRHPGRWVAAIIILALFVWFLISAATNDAYGWDIYRQYLFDTRIASAAVHTLAITILSMLMGVVLGCIVAIMRMSPNPVLRGISWFYLWIFRGTPVYVQLVFWGLLGSIYSGINLGFTEISLENLLSNMFILAVVGLGLNEAAYMSEIVRSGIQAVPEGQTEASKALGMSWWMTIRRTVLPQAMRIIVPPTGNEFISLLKTTSLVVAIPYTSELYGRATDIAAALFDPVPLLLVAATWYLVITSLLMVAQHYLEKYYDRGATRQLTARQLAALADAEGTLPKNVDIIAETPKPHTPRTPKKGA

SEQ ID NO: 60979 - DNA, 801 bp, Geobacter sulfurreducens PCA
  CDS (1)..(801): transl_table=11
atgcagatcgccaagctccacttcgcggccaaggagatggacgaggccctggccgcggcccgggaggtgctttccctctaccccgacaacagtgaggcgaaaaacttcacggcctcggtggagcgggagaagaagcccggctacgtcacgttccttcaggactgcctgaagttcctgccggtgcttctcaagggtgcggtgatgacgctcctgctggtgctctgcaccatgttcatctctcccatcggcgggctcctcatcgccttggggcggatcagcaccttcaggcccctgtcggccctctgctggttcgtcatctggctcttccggggcacccccctcctgcttcagctcttcttcatctactacggcctcccctccctcggcatcaccctcaaacccatcaccgccgcggtcatcggcctggggctcaactactcggcctaccttggcgagatcatccggggagccattcagagcatcgaccacggccagaccgaggcagccaaggccctgggcatgacctatggccaaaccatgcgccgggtcgtcatcccccagacctacaagcggctcatgccccccatcggcaacgagttcatcgccctgatcaaggacacggccctggtttccaccattgccatggtagagctgatgcgggccgcggaccagatgttcaacacctacttcaacgtgacggccctcgtcctggccgccgtcatctacctgatcttcacgaccttcttcaccttcctcttcgaaaagatcgagcaccgggcagggatctatgagcgacgttaa

SEQ ID NO: 60980 - protein, 266 aa, Geobacter sulfurreducens PCA
MQIAKLHFAAKEMDEALAAAREVLSLYPDNSEAKNFTASVEREKKPGYVTFLQDCLKFLPVLLKGAVMTLLLVLCTMFISPIGGLLIALGRISTFRPLSALCWFVIWLFRGTPLLLQLFFIYYGLPSLGITLKPITAAVIGLGLNYSAYLGEIIRGAIQSIDHGQTEAAKALGMTYGQTMRRVVIPQTYKRLMPPIGNEFIALIKDTALVSTIAMVELMRAADQMFNTYFNVTALVLAAVIYLIFTTFFTFLFEKIEHRAGIYERR

SEQ ID NO: 60981 - DNA, 792 bp, Geobacter sulfurreducens PCA
  CDS (1)..(792): transl_table=11
atggttgatcaggacagggtacggccggcggttgtcgaggtcggtgacggcgcagctattccgagcaaaagcgacatcgggcttttcactgcctggcgcatcgcctttgtcggcgcgatcggcattctggtcgttctgacaatcacgaagccggatccctatctcaacatcctcaagttcgttcccgacggtatcctggtcaccttccaggttaccgtcggggccattctcctcgctttggtcatcggtcttgtggccggccttgggcgcatctcctccaaccggatcatcaacggcatcgcctctctctacgtggagatcatccgcggcattccgctgctggttcaactcttttacatctactacgccctgggccgcttcgtccatgtccccgacatggcaagcgccatcatcgccatggccgtctgttacggtgcctacatgggcgaggtgatcagggccggcatccagtcgattcccaaggggcagatggaggcggcccgttccctcggcatgaccaaggggcaggccatgcgccacgtgatcctgccccaggccgccaaagtcgtgctcccccccatcggtaacgaattcatcgctctactcaaggattcctcgctggtgtccatactggcggttgccgatatcctgcgccggggacgggagttcgcctcggagagcttcacctatttcgagacctatacggtcattgccctcgtctatttgatcattaccctcttcttgtcaaagcttatcggaatcatggaggaacggatcagtgcggggagctga

SEQ ID NO: 60982 - protein, 263 aa, Geobacter sulfurreducens PCA
MVDQDRVRPAVVEVGDGAAIPSKSDIGLFTAWRIAFVGAIGILVVLTITKPDPYLNILKFVPDGILVTFQVTVGAILLALVIGLVAGLGRISSNRIINGIASLYVEIIRGIPLLVQLFYIYYALGRFVHVPDMASAIIAMAVCYGAYMGEVIRAGIQSIPKGQMEAARSLGMTKGQAMRHVILPQAAKVVLPPIGNEFIALLKDSSLVSILAVADILRRGREFASESFTYFETYTVIALVYLIITLFLSKLIGIMEERISAGS

SEQ ID NO: 60983 - DNA, 744 bp, Bdellovibrio bacteriovorus HD100
  CDS (1)..(744): transl_table=11
atgttttcgtggtttcgcactgacatcatcatcgaatactggcctctcttcatgcaggggctggccaccaccctgcaactgactttgatcggaatcttttttggcaccatcctgggcctgtttttgggactggggaaaatcgcccgcatagaacgtggcccctggcgctggccgactcacttgttcgtccgtctgccatcgcaaatctatattggctttttccgtggcactcccctgtttgtgcaaatcctgctgattcattttgccctggtccctttgctgattcatcccgaagacgggctgctgatctcgggtgacatggctctttacctgaaacgggaatacggcgcgcttatttccggtgcgttggcattaagtcttaattcagcggcttatatcgccgaaatattccgtgccgggatccagtccattgatcgcggccaatttgaagcggcaagatctctgggcctgagttacttccacacgatgaagtccatcatcattccgcaggcgtttcgtcgcatgctgcctccgttgggaaatgaagccatcaccctgctgaaggattcttctttggtgtcggccatcggtttggcagaactggcttacgccgcccgcaccgctgcgggagcctatgcccgctattgggaaccatatctgtttatttcgttgatttatctgatcatcaccctgggcatgtcctttgtggttcaccgtcttgagaaaaggtaccaatccgcatga

SEQ ID NO: 60984 - protein, 247 aa, Bdellovibrio bacteriovorus HD100
MFSWFRTDIIIEYWPLFMQGLATTLQLTLIGIFFGTILGLFLGLGKIARIERGPWRWPTHLFVRLPSQIYIGFFRGTPLFVQILLIHFALVPLLIHPEDGLLISGDMALYLKREYGALISGALALSLNSAAYIAEIFRAGIQSIDRGQFEAARSLGLSYFHTMKSIIIPQAFRRMLPPLGNEAITLLKDSSLVSAIGLAELAYAARTAAGAYARYWEPYLFISLIYLIITLGMSFVVHRLEKRYQSA

SEQ ID NO: 60985 - DNA, 660 bp, Bacillus cereus ATCC 10987
  CDS (1)..(660): transl_table=11
atgtcttttgattatattaattcaattcttatgccaatgctggaaggagcacaaatgacagtcctcttatttttgattgccattgtggtgtcaattccaatgggttttttattaacactggctgtaagaagtaatttaaagccactgtcttggcttgctcaaggttatatttacgtattgcgtggaactccactattacttcaattactatttatatgcttcggattgccgttgctacctgtgattggtgaatatttggttatggatcgatttgtcgctgcctgtttagggtttattttgaactatgctgcatattttgcagaaatctttcgtggcggtcttttagcgattgataaaggccaatatgaggcatctcaagttctcggtttgagtaaatggcagacgatgagaagagttatacttcctcaaatgtttcgtatagcacttcccgctgtagctaacgaatctgtaacactcattaaggataccgccctgctctatgcggttgctgtaccagaattgttacattttgctcaaactgctgtcaatcgggactttacaatcacaccatttttcgtggcaggtctcatttatttaatcatgacgctcgtattaactatgttctttaaatggttggaacgtcgattcaaatttgaatag

SEQ ID NO: 60986 - protein, 219 aa, Bacillus cereus ATCC 10987
MSFDYINSILMPMLEGAQMTVLLFLIAIVVSIPMGFLLTLAVRSNLKPLSWLAQGYIYVLRGTPLLLQLLFICFGLPLLPVIGEYLVMDRFVAACLGFILNYAAYFAEIFRGGLLAIDKGQYEASQVLGLSKWQTMRRVILPQMFRIALPAVANESVTLIKDTALLYAVAVPELLHFAQTAVNRDFTITPFFVAGLIYLIMTLVLTMFFKWLERRFKFE

SEQ ID NO: 60987 - DNA, 786 bp, Thermus thermophilus HB27
  CDS (1)..(786): transl_table=11
atgcggtacctccgctttttcgccctcttccttctcctcgtcctcgggtatttcgccctcttccacgccctctcctgggctttggagcgctacttcctcctcacgggcttcggccccgagcgggcggcctccgccgggcggatcatggcccagggggccgaggtgaccctgaagctcaccctcctctcgggggcggcggggctcgtcatcggcgtcttcgccgggatggcgcggctttccgcccgggcctgggtgcgcctgcccgccgccttctacatctgggtcatccggggtacgccccttctcgtccagatcctcttcgcctacaacgcccttcccctcctcctccagcccctctggccgggggcgcagcaggccctcaccccctactgggcggccttcatcgccctcgccttcaacgtgggggcctacaacgccgaggtggtccgcgccggcatccaggcgatccccaaggggcagtgggaggccgcttggtccttggggttttccgccgcggacaccatgcgcttcgtcatcctgccccaggccctgaggatcgtggtgccccccttggtcaacaacgtggtggccctcctcaaggactcctccctggcgagcgtcatcaccctcttggagctcgccctctccggccagcgcatcatctccgccaccttccgccccgtggaggtctacttggcggtggccgcggtctacctcctcctcaccaccctcctcaccttcttcaccaacctcctggagcggcgcctcgccctgcccggccgctaa

SEQ ID NO: 60988 - protein, 261 aa, Thermus thermophilus HB27
MRYLRFFALFLLLVLGYFALFHALSWALERYFLLTGFGPERAASAGRIMAQGAEVTLKLTLLSGAAGLVIGVFAGMARLSARAWVRLPAAFYIWVIRGTPLLVQILFAYNALPLLLQPLWPGAQQALTPYWAAFIALAFNVGAYNAEVVRAGIQAIPKGQWEAAWSLGFSAADTMRFVILPQALRIVVPPLVNNVVALLKDSSLASVITLLELALSGQRIISATFRPVEVYLAVAAVYLLLTTLLTFFTNLLERRLALPGR

SEQ ID NO: 60989 - DNA, 678 bp, Desulfovibrio vulgaris subsp. vulgaris str. Hildenborough
  CDS (1)..(678): transl_table=11
atgctggacaaactcttggtcatatgggacgcgcttccctatattctcgaaggctcggccgtcaccatcgccacggtgctggggtcgctggccctcgggttctgtatgggcgtacccatggccgtggcgcaggtctacggcggtcgccctgtgcggtatctcgtggggctgtatgtctggttcttccggggtatgcccattctcgtgctgctctttctcttctatttcggtctgtttcaggctctcgacctcaatctgagcgcgttcacggcctcgtgtctcgtgcttggcatggcgagtgccgcctaccagtcgcagatattccgcggttcgatactcgccttgccgcaagggcagctgaaggcggcccgcgcactgggcatgagcgacggtgcggccatccgcagcatcgtcctgccgcaggcgttgcgtctttccattccggcgtggtccaacgaatactccatcctgctcaaggactcggcacttgccttcgtgcttggcaccccggaaatcatggcccgcacccacttcgtggcatcgcggacgtatgagcacctgccattgtacatgacggcgggggccctctacttcatcatcacgctggcggggctgaaggtgctgcgccacctcgaacgcaagacccgtatccccggttacgccgggtacggcatctga

SEQ ID NO: 60990 - protein, 225 aa, Desulfovibrio vulgaris subsp. vulgaris str. Hildenborough
MLDKLLVIWDALPYILEGSAVTIATVLGSLALGFCMGVPMAVAQVYGGRPVRYLVGLYVWFFRGMPILVLLFLFYFGLFQALDLNLSAFTASCLVLGMASAAYQSQIFRGSILALPQGQLKAARALGMSDGAAIRSIVLPQALRLSIPAWSNEYSILLKDSALAFVLGTPEIMARTHFVASRTYEHLPLYMTAGALYFIITLAGLKVLRHLERKTRIPGYAGYGI

SEQ ID NO: 60991 - DNA, 1014 bp, Desulfovibrio vulgaris subsp. vulgaris str. Hildenborough
  CDS (1)..(1014): transl_table=11
atgacgcagtacaggggtttggacaaaccgcgggggcagggctacttcctgttctggaaagcagtgttcgtgggcatcatgctctgcacggtggccttcttctggtacgcttccagttccgtcgagtatatctggcgctggaacagggtgcctcaatatttctgggtggccgagaagaccgatgtccgcgccgaggtcagcggcgatgtggtctccgtcgagaccacggccgagggtgccacacgcatcacggtcaagggcgacgacggttcggagacctacaccgttcctccggcagggaaggtgctcatctccggtggtgactacatctacagcggcgacccggtgggccgctacgaggtcagcaagccgggcatcctgctcgagggtctgtggataacccttgaggtgagcatgctcgccatcatcatcggtatcgtcctcggtgtggtcacggggcttgcccgcatctcggtcaacccggccctgcgctggctggccatcacctacatcgagatcatccgtggttcgccgctgctggtacaggtgttcctgtggtacttcgtggtgggcacgctgctcaacgccctgttcgaaaaggtgggcctctccgccattccgccgctgtggtacggcgtcatggcccttgccatcttcaccggcgcctatgtggccgagatcgtgcgtgcaggcatccagtcggtgcaccgcgggcagatggaggccgcgcggtcgctgggcatgagctacgcccagtccatgcgcaaggtcatcctgccgcaggcgttccggcgcatcatgccgcctcttgccgggcagttcatcagccttgtgaaggactcgtcgctgcttggcgtcatcgccgtgcgcgaactcaccaaggccacgcgcgaggtcgtcaccacctcgctgcaaccgttcgaactgtggatcgtctgcgcactgctctatcttgtgctgacgttcaccctgtcgctttgcgtgcaataccttgagagaagggccgtccgatga

SEQ ID NO: 60992 - protein, 337 aa, Desulfovibrio vulgaris subsp. vulgaris str. Hildenborough
MTQYRGLDKPRGQGYFLFWKAVFVGIMLCTVAFFWYASSSVEYIWRWNRVPQYFWVAEKTDVRAEVSGDVVSVETTAEGATRITVKGDDGSETYTVPPAGKVLISGGDYIYSGDPVGRYEVSKPGILLEGLWITLEVSMLAIIIGIVLGVVTGLARISVNPALRWLAITYIEIIRGSPLLVQVFLWYFVVGTLLNALFEKVGLSAIPPLWYGVMALAIFTGAYVAEIVRAGIQSVHRGQMEAARSLGMSYAQSMRKVILPQAFRRIMPPLAGQFISLVKDSSLLGVIAVRELTKATREVVTTSLQPFELWIVCALLYLVLTFTLSLCVQYLERRAVR

SEQ ID NO: 60993 - DNA, 771 bp, Desulfovibrio vulgaris subsp. vulgaris str. Hildenborough
  CDS (1)..(771): transl_table=11
gtgcgcatagagatcaccgacggcgcctccatccccgacccgaaagaacgacgactgatcacagcatggtcgctctcgttccttgccgccatcggtaccctcatctatctttgcgcctcgcaacccgacccctactggcgccttctgcagttcctgccggacggcatcctcgtcacctttcaggtgacggtcttctccatcatctgctccatccccatcggcctcatcaccggtctggggaggttgtcgcgcaaccggggcatcaacctcgtggcttcaacgtatgtggaagtggtgcgcggcattccgctgctggtgcaactcttctacatctactacgcactgggacgcttcctgaaggtcccggacatgctcgccgccatcatcgccctcagcgtgtgctatggcgcgtacatgggtgaagtgttccgcgcgggtatcgaagccatccccaagggacagaccgaggccgcccgttcgctcggcttcaaccgcgtcgagacgatgttcctcgttgttctgccgcaggcgtggcgcaccatcctgccccctgtcggcaacgaattcatcgccatgctgaaagacacatcccttgtctccatcatcgccgtcgccgacatcttgcgccgtggccgcgaattcgcctccgagagcttccagtatttcgaaacctacaccatgatcgcgctcgtgtatctgctcatcaccctgcttctttccaagggcgtcagcatcatggaagcgagactgaactactatgaccgccgctaa

SEQ ID NO: 60994 - protein, 256 aa, Desulfovibrio vulgaris subsp. vulgaris str. Hildenborough
MRIEITDGASIPDPKERRLITAWSLSFLAAIGTLIYLCASQPDPYWRLLQFLPDGILVTFQVTVFSIICSIPIGLITGLGRLSRNRGINLVASTYVEVVRGIPLLVQLFYIYYALGRFLKVPDMLAAIIALSVCYGAYMGEVFRAGIEAIPKGQTEAARSLGFNRVETMFLVVLPQAWRTILPPVGNEFIAMLKDTSLVSIIAVADILRRGREFASESFQYFETYTMIALVYLLITLLLSKGVSIMEARLNYYDRR

SEQ ID NO: 60995 - DNA, 708 bp, Bartonella quintana str. Toulouse
  CDS (1)..(708): transl_table=11
atgcttcctgagtggctccatttccttttcaatcctgctctcttaaatcgttacggactaaaatttattagtgggtttcttattacttttgagctggtttttattgcttgctctcttggttttattctcggtatgcttattacatttgcacgtttattgaataataagtttttgcgttattttgcaaatacttatgtttattttttccgtggatcccctttattagcccaactcttccttttttactacggacttggttcaatggggagcttttggcaacagattggcttatggtggtttttccaaaacgcatggtattgctgtattttcatttttgcactcaattccgctgcctatcagtctgaaatctttaaaggaagttttttatcagtaacggctagacaacgtgaagcatcaaaagctttggggctaagcagctctacaacattttttagaattattcttccgcaagcaatggttctagcattacgccccctaggaaatgaatttattttaatgattaaatctagtgccattgcctcacttgtcactatttatgatttaatgggaattgctaaactcacttattcacgcacattcgatttccaagtttatgtttgggctgcccttatttatcttcttatcgttgagcttattcatcgctttatcgttgttatcgaacgtcaccttacccgatatttacgataa

SEQ ID NO: 60996 - protein, 235 aa, Bartonella quintana str. Toulouse
MLPEWLHFLFNPALLNRYGLKFISGFLITFELVFIACSLGFILGMLITFARLLNNKFLRYFANTYVYFFRGSPLLAQLFLFYYGLGSMGSFWQQIGLWWFFQNAWYCCIFIFALNSAAYQSEIFKGSFLSVTARQREASKALGLSSSTTFFRIILPQAMVLALRPLGNEFILMIKSSAIASLVTIYDLMGIAKLTYSRTFDFQVYVWAALIYLLIVELIHRFIVVIERHLTRYLR

SEQ ID NO: 60997 - DNA, 708 bp, Bartonella henselae str. Houston-1
  CDS (1)..(708): transl_table=11
atgattccagagtggctctatttccttttcaatcctgctctcttgaaccgttatggactgaaatttattgatggatttcttgttacttttgagctagtttttattgcttgctctcttggtttttttctcggtatgtttattacatttgtgcgtttatcaaataataagcttttgcggtattttgcacatgcttatgtttattttttccgtggatctcccttattagcccaacttttccttttttattatggacttggttcaatgaacagcttttggcaacaagttggtttatggtggtttttccaaaacgcatggtactgctgtattttcatttttgcacttaattccgctgcttatcaatctgaaatctttaaaggaagttttttatcagtaaaagctggacaaattgaagcatcaaaagctctagggctaagcagctctacaacattttttaaaattattcttccgcaagcaatggttgtagcgttacgtcccctaggaaatgaatttattttaatgattaaatccagtgccattgcctcacttattactatttatgatttaatggggattgctaaactcacttattcacgtacatttgattttcaagtttatatttgggttgctcttatctatcttcttgtcgttgcccttgttcatcgttttatcatcgcgattgaacgccacctcacccgatatttacgataa

SEQ ID NO: 60998 - protein, 235 aa, Bartonella henselae str. Houston-1
MIPEWLYFLFNPALLNRYGLKFIDGFLVTFELVFIACSLGFFLGMFITFVRLSNNKLLRYFAHAYVYFFRGSPLLAQLFLFYYGLGSMNSFWQQVGLWWFFQNAWYCCIFIFALNSAAYQSEIFKGSFLSVKAGQIEASKALGLSSSTTFFKIILPQAMVVALRPLGNEFILMIKSSAIASLITIYDLMGIAKLTYSRTFDFQVYIWVALIYLLVVALVHRFIIAIERHLTRYLR

SEQ ID NO: 60999 - DNA, 693 bp, Bacillus thuringiensis serovar konkukian str. 97-27
  CDS (1)..(693): transl_table=11
atgtttgaaattttcatgtctacttatcccacactcttaaaagctactattgtcacattacaattaacactaacatccctattactcggttcactaattggattgctattcgctttctttcgaatctctaataataaagttttaaatagtattgctcatgtatatatcgccattattcgtggtacacctttaattgttcaaattgccattctctattttgggattacatccgttgttgtgtttactcctttttgggcaggagccattgctttagcaatccataacggtgcatatattactgaaattttccgcggttctatccaatctgtcgatcgtggacaaatggaagctgctcgctctctagggatgccgtattctttagcaatgcgacgtattgtattaccgcaagcatttcgtcaatctattcctcctttaggaaatcaatttattattggattaaaagattcttcacttgttgcttacgtaggattgtccgaattatgggggtcaggtttatcaatcgctgcagggaacttccaacaattagatacatatataatcgttggtttatattatctcgtgctcgttctcctattcacttaccttgttaatcttttagaaaaacgattacagcgaaaagaaacaaactcagttcaagttagtgcaaagaagaaaaaagaagtctctttataa

SEQ ID NO: 61000 - protein, 230 aa, Bacillus thuringiensis serovar konkukian str. 97-27
MFEIFMSTYPTLLKATIVTLQLTLTSLLLGSLIGLLFAFFRISNNKVLNSIAHVYIAIIRGTPLIVQIAILYFGITSVVVFTPFWAGAIALAIHNGAYITEIFRGSIQSVDRGQMEAARSLGMPYSLAMRRIVLPQAFRQSIPPLGNQFIIGLKDSSLVAYVGLSELWGSGLSIAAGNFQQLDTYIIVGLYYLVLVLLFTYLVNLLEKRLQRKETNSVQVSAKKKKEVSL

SEQ ID NO: 61001 - DNA, 720 bp, Staphylococcus aureus subsp. aureus MRSA252
  CDS (1)..(720): transl_table=11
atgtttctaaatctaaatagtgaacaactacatgcacttgatgctgcaaaacaagcttttgggcctatgctcgaaggtttggtgaaatattcaattccgattaccctcgtaacatttgtattagggttaatcattgcattatttacagcattgatgcgcatttcaacgagtaaagttttaagaagtattgcacgtgtctatgtatctattattcgtgggacacctatgatagtacaattatttatcatcttttatggtattccagaattaggtagattattaaccaatgatgcagataatcaatggacattggcgcctgtggtcgctgccattattggcttgtcattaaatgtaggtgcgtatgcttcagaaattattcgcggcggtattatttctataccaaaaggacaaacggaagctgcatattctattggtatgacatatcgtcaaacgatacaacgcatcatcttaccgcaggcaattcgagtatctatacctgcactaggtaatacatttttaagtttaatcaaagatacatcattactaggatttattttagtagcagaaatgtttagaaaagctcaagaagttgcgtctacaacatatgaatatttaacaatttatgtgttagttgcgctaatgtactgggtggtatgctttattatttcaataatccaaggtatctacgaatcttatattgaaagagggtatcgctcatga

SEQ ID NO: 61002 - protein, 239 aa, Staphylococcus aureus subsp. aureus MRSA252
MFLNLNSEQLHALDAAKQAFGPMLEGLVKYSIPITLVTFVLGLIIALFTALMRISTSKVLRSIARVYVSIIRGTPMIVQLFIIFYGIPELGRLLTNDADNQWTLAPVVAAIIGLSLNVGAYASEIIRGGIISIPKGQTEAAYSIGMTYRQTIQRIILPQAIRVSIPALGNTFLSLIKDTSLLGFILVAEMFRKAQEVASTTYEYLTIYVLVALMYWVVCFIISIIQGIYESYIERGYRS

SEQ ID NO: 61003 - DNA, 720 bp, Staphylococcus aureus subsp. aureus MSSA476
  CDS (1)..(720): transl_table=11
atgtttctaaatctaaatagcgaacaacaacatgcgctagatgctgcaaaacaagctttcggacctatgctagaaggtttggtcaaatattcaattcctattacattagttacatttgttttaggattgattattgcattatttacagcattaatgcgaatttcaacgagtaaaattttaagaagtatttcacgtgtctatgtatctattattcgaggaacacctatgatagtacaactatttatcatattttatggtattccagaattaggtagattattaacaaatgacgctgacaaccaatggacattggcacctgtagtggctgctattattggtttatcattaaatgtaggtgcgtatgcttcggaaattattcgtggcggtattatttctataccgaaaggacaaacagaagctgcatattccatcggtatgacgtatggtcaaacgatacaacgtatcattttaccgcaggcaattcgagtgtcgattcctgcactaggtaatacatttttaagtttaatcaaagatacatcattattaggatttattttagtggctgaaatgtttagaaaagctcaagaagttgcgtctacaacatatgaatatttaacaatttatgtgttagttgcgctaatgtactgggtggtatgctttattatttcaattatccaaggtatctatgaatcttatattgaaagagggtatcgctcatga

SEQ ID NO: 61004 - protein, 239 aa, Staphylococcus aureus subsp. aureus MSSA476
MFLNLNSEQQHALDAAKQAFGPMLEGLVKYSIPITLVTFVLGLIIALFTALMRISTSKILRSISRVYVSIIRGTPMIVQLFIIFYGIPELGRLLTNDADNQWTLAPVVAAIIGLSLNVGAYASEIIRGGIISIPKGQTEAAYSIGMTYGQTIQRIILPQAIRVSIPALGNTFLSLIKDTSLLGFILVAEMFRKAQEVASTTYEYLTIYVLVALMYWVVCFIISIIQGIYESYIERGYRS

SEQ ID NO: 61005 - DNA, 666 bp, Erwinia carotovora subsp. atroseptica SCRI1043
  CDS (1)..(666)
atgccgccttggctacaactcatggcagactctttctggagtctgctgtctgcgggactgaaatttactgtccctctggctatcctgtctttcatctttggcctagctctcggcattctcatcgcgctggttcgcctctatggcccaaagccgctgaaatggctgggtgatttctacgtttgggtcattcgtggaacgccgttgctggtgcagcttttcctgattttttatgggctgcccagcgcaggtattactcttgatgcctttccggcggcacttattggtttcaccgtcagtgtgggggcctacagctctgagatcgtccgtggggcaatcttatctgtcccgaaaggccaatggagtgccgcctattctctcggcatgaatggcaggcaggcgattcgttgggtcatcttcccccaatccgttttcgtttcgttaccgccgctctccaatacgtttatttccttaatcaaggatacgtcgctggccgccgtcatcaccgtaccagagatgtttttatccgctcaacggatcgtttccgttacctatgaacctctgattctgtatgtcgaggctgcgctgatttatctgatgttcagcacggtgctaagccaattacaggctaagctcgaaaagtattatcagcgccacatcacacactaa

SEQ ID NO: 61006 - protein, 221 aa, Erwinia carotovora subsp. atroseptica SCRI1043
MPPWLQLMADSFWSLLSAGLKFTVPLAILSFIFGLALGILIALVRLYGPKPLKWLGDFYVWVIRGTPLLVQLFLIFYGLPSAGITLDAFPAALIGFTVSVGAYSSEIVRGAILSVPKGQWSAAYSLGMNGRQAIRWVIFPQSVFVSLPPLSNTFISLIKDTSLAAVITVPEMFLSAQRIVSVTYEPLILYVEAALIYLMFSTVLSQLQAKLEKYYQRHITH

SEQ ID NO: 61007 - DNA, 942 bp, Erwinia carotovora subsp. atroseptica SCRI1043
  CDS (1)..(942)
atgagtctcccatcaccacatcaggaactgcatatcgtcgccaaccgacactacgggcgctggctcagcgccctactggttctgttgctattgggcgctatcgcccattctgtgctgaacaacccccgctttgaatggcgggtcgttgtggacagttttacggaagactccattcttcagggcgtcatcatgacgctgaaactgaccgcaatgtcggtggtgttaggctttggcggcggaacgatactggcgctgatgcgcctatccagcaaccccgtgctggtggcagtcagttgcggctacacctggtttttccgtggcgttcccacgctggtgcagctgtttctctggtacaacattgcagcgctctacccgacgatttcactctcgctgccattcttcggcgaggttttcagcgttcctggcaatacgctcatcagcccgtttaatgccgctgtgctggcgctggttatgcatcaatctgcgtatgcagcggagattgttcgcgcaggtattcagagcgtcaaccccggtcagttggaagccgccagagcattggggtaccgtaaaccgcagatattcttctacaccgttatgccgcaggcgatgcgcgccatcctgcctccggcgggcaatgaggtcatcggccaactgaaaaccacagcggtggtttcggtgatttcacttcaggatgtgttgtactcggcacagatcatttatcagcgaacctatgaagtcatcccgctgctgctggttgccactatctggtatctgctgctgacttccgtgctgtctgtcggccaatactatattgaacgctatttcggccgttcaacgctcaaacgcaacaagccaagtaaaagccgcaaactgcgtgccgcaaggtttacccaaactcagccaacgaacaggccacagcccagcgaatcccccagcacctga

SEQ ID NO: 61008 - protein, 313 aa, Erwinia carotovora subsp. atroseptica SCRI1043
MSLPSPHQELHIVANRHYGRWLSALLVLLLLGAIAHSVLNNPRFEWRVVVDSFTEDSILQGVIMTLKLTAMSVVLGFGGGTILALMRLSSNPVLVAVSCGYTWFFRGVPTLVQLFLWYNIAALYPTISLSLPFFGEVFSVPGNTLISPFNAAVLALVMHQSAYAAEIVRAGIQSVNPGQLEAARALGYRKPQIFFYTVMPQAMRAILPPAGNEVIGQLKTTAVVSVISLQDVLYSAQIIYQRTYEVIPLLLVATIWYLLLTSVLSVGQYYIERYFGRSTLKRNKPSKSRKLRAARFTQTQPTNRPQPSESPST

SEQ ID NO: 61009 - DNA, 669 bp, Erwinia carotovora subsp. atroseptica SCRI1043
  CDS (1)..(669)
atgctcgcttatttacctgagctattaaaaggcctgcataccagtctgacgttaactgccgtctccattgtcgtcgcgctggtgttatcactgctgcttactgttgtactgacgctaaaaacgcccatcatatcaatgttggcgaaaggctacattacgctgtttaccggtacgccgctgctggtgcaaatctttctgatttactacggcccggggcaatttacctctattcagcaaatcccctggctgtggagcctgctttcacagccgtggctatgtgcgatggtggcgctagcgctcaatagcgcggcttataccacacagctgttctatggtgcggtaaaagcaattcccgccggacagtggcaatcctgcgccgctctgggaatgaatcagaagcagacattacgcattttgctgccgttcgcgtttaaacgcgcgctgtcttcttattcaaacgaagtggtgctggtatttaagagtacgtcgctggcttataccatcacgctgatggaagtcatgggctacagccaactgatgtacggccggacatatgatgtgatggtgtttggcgcggctggaattatctacctttgcgtcaatgggttactgacattattgatgcgctgggttgaacgtcgctcactggtattcgaacgccgcaactga

SEQ ID NO: 61010 - protein, 222 aa, Erwinia carotovora subsp. atroseptica SCRI1043
MLAYLPELLKGLHTSLTLTAVSIVVALVLSLLLTVVLTLKTPIISMLAKGYITLFTGTPLLVQIFLIYYGPGQFTSIQQIPWLWSLLSQPWLCAMVALALNSAAYTTQLFYGAVKAIPAGQWQSCAALGMNQKQTLRILLPFAFKRALSSYSNEVVLVFKSTSLAYTITLMEVMGYSQLMYGRTYDVMVFGAAGIIYLCVNGLLTLLMRWVERRSLVFERRN

SEQ ID NO: 61011 - DNA, 666 bp, Erwinia carotovora subsp. atroseptica SCRI1043
  CDS (1)..(666)
atgcactatcaatgggatttctcgctggtctgggacaacattccggtgttgctgaaaggccttggcgtcacgctcgaactgtggctgatagcaggcgtgctgggaactgcgctggggctggttttgggtatttttcgcgtgtttggaaagcgctggctgtcattgcccgccagattctttgtcgagatattccgcaatacgcccgtcctgatccagctgatctggttttattacgccttcccggttctggtcggtgtgcagtttagtacctttgccgccgccgtgctggctctgacgctgtatagcgccgcgtactgcaccgaaattttccgtgccggactacaatccatcgaccacggacaatgggaaggcgcaaaagcgttgggcatgcggcacacggtgatcctacggcgcgtggttctgccacaagtattgcgcaacatgctacctgccttgaccaaccggatgatcgagttggctaaagtcacctcgctggcctccatattggccgtcaacgaactgatgtaccaagggcggctgctgagcagcacctattatcgtccgctggaaatcctgacggtggtggcactgctctatttcgttttgatctggccggggagctaccttgccgcacgacttgaacgtcgtttccgttcaaccccctag

SEQ ID NO: 61012 - protein, 221 aa, Erwinia carotovora subsp. atroseptica SCRI1043
MHYQWDFSLVWDNIPVLLKGLGVTLELWLIAGVLGTALGLVLGIFRVFGKRWLSLPARFFVEIFRNTPVLIQLIWFYYAFPVLVGVQFSTFAAAVLALTLYSAAYCTEIFRAGLQSIDHGQWEGAKALGMRHTVILRRVVLPQVLRNMLPALTNRMIELAKVTSLASILAVNELMYQGRLLSSTYYRPLEILTVVALLYFVLIWPGSYLAARLERRFRSTP

SEQ ID NO: 61013 - DNA, 717 bp, Erwinia carotovora subsp. atroseptica SCRI1043
  CDS (1)..(717)
atgaatgagatcctgcaacaatattggcaaccgctactgtggagcgatggttaccgtctgacagggcttgccatgacgctctggctgctcatttcctcggtggtcatcggcgggctgatggcgctgccgctggcaattgctcgcgtgtcgccgcgacgccggttcagtctgccggtttggttatttacctacgtgttccgcggcacaccgctttatgtgcagcttctggtgttttattctggcgtatatagcctggaaatcgtacgcggcaccgatctgctgaacgccttttttcgtagtgggctgaactgcgctattttagcgctggcgctcaatacctgtgcatacaccacagagattttcgcgggggcaatccgttctgtaccccatggggaaattgaagctgccagagcatacggtttctcccgttttaagcagtatcgctgcattattttgcccagtgcgctgcgtattgcgctgccagcctacagtaatgaagtgattctgatgctgcactcgacggcgctggcttttaccgtaaccgtaccggatattttgaagattgcccgtgatattaacgcagcaacctaccagccgttttatgcgttcggtattgctgctgtcatctatctggcgatctcgtttgtgttaattgggatgttcagaaaggcggaacggcactggctacgtcatctttatacccgttcatctcattaa

SEQ ID NO: 61014 - protein, 238 aa, Erwinia carotovora subsp. atroseptica SCRI1043
MNEILQQYWQPLLWSDGYRLTGLAMTLWLLISSVVIGGLMALPLAIARVSPRRRFSLPVWLFTYVFRGTPLYVQLLVFYSGVYSLEIVRGTDLLNAFFRSGLNCAILALALNTCAYTTEIFAGAIRSVPHGEIEAARAYGFSRFKQYRCIILPSALRIALPAYSNEVILMLHSTALAFTVTVPDILKIARDINAATYQPFYAFGIAAVIYLAISFVLIGMFRKAERHWLRHLYTRSSH

SEQ ID NO: 61015 - DNA, 690 bp, Erwinia carotovora subsp. atroseptica SCRI1043
  CDS (1)..(690)
atgctctatggctattcccagctgattctggatggtgccatcatgacgctggagctggcggtgagttcgctactgctggcgttggctattggcctgattggtgcgtcggcgaagctgtcttctaatcgcctgctggcagggtgcttctcctgctataccacgttgattcgcggcatccccgatttggtgctgatgctgctgattttctatggcctgcaaattgtcttaaacggcgtgacggagtcgatcggtctggagcagattgatatcgatcctttgaccgccggggttattacgctgggctttatttacggtgcctatttcacggaaacctttcgtggcgcgtatctcgctgtgccgcgcggacaaatcgaagccgccgtcgcattcggtttctctcctatcaaggtgttccgtcgtattctatttccttccatgatgcgcttcgcactaccgggcatcggcaataactggcaggtgatcctgaaagcgacagcgttggtgtcattgcttggcctgaatgatgtgattaaggcgacgcagttggccggcaaggggacacacgaaccgttttatttcgcactggttgccggggcgatgtacttgatttttaccaccgtttctaacggcgtgttgtggtggctggaaaggcactattcgcagggagtcaagaaagtaaactatgaatga

SEQ ID NO: 61016 - protein, 229 aa, Erwinia carotovora subsp. atroseptica SCRI1043
MLYGYSQLILDGAIMTLELAVSSLLLALAIGLIGASAKLSSNRLLAGCFSCYTTLIRGIPDLVLMLLIFYGLQIVLNGVTESIGLEQIDIDPLTAGVITLGFIYGAYFTETFRGAYLAVPRGQIEAAVAFGFSPIKVFRRILFPSMMRFALPGIGNNWQVILKATALVSLLGLNDVIKATQLAGKGTHEPFYFALVAGAMYLIFTTVSNGVLWWLERHYSQGVKKVNYE

SEQ ID NO: 61017 - DNA, 765 bp, Erwinia carotovora subsp. atroseptica SCRI1043
  CDS (1)..(765)
atgacgggatttcgttgggagatcattcaggagtacgccccgctatttatggaaggcacctggatgaccatcaaatgcaccattatttgtgtcattcttggcacctgctggggattaacgctcggattaggccgcttagcgcaggcgccgcacgggccgtggaaatatatactgcactacggcattcaatggccggtgcggatctatatcagcgcctttcggggtacgccactatttgtgcaaatcatggtggtgcacttcgctctggtgccgctgttaatcaacccgcgtgacgggttgctggtgaccagcaatattatgtcggtcgattttgcccgcacattacgctcagattacggtgcgttcctctcttgcgtagtggccattacgctgaatgcgggtgcctatgtctccgagatattccgcgccggtattcaatctatcgatcgcggtcagatggaggcttcacgctctctcggcatgagctatggccgcaccatgcggaaagtgattctgccacaggcttttcgccgtatgctgccgccgctgggtaataacgccatcgccattgtgaaagattcatcgctggcttcggcaatcggattggcggatctcgcctatgccgctcgtacggtatcaggggcttacgccacgtactgggaaccctacctggcgatctctatcgtctattgggttattactttcctgctctcgctgctggtgcggcacatggaaatgaggtttggcaaaagtgattcacgttaa

SEQ ID NO: 61018 - protein, 254 aa, Erwinia carotovora subsp. atroseptica SCRI1043
MTGFRWEIIQEYAPLFMEGTWMTIKCTIICVILGTCWGLTLGLGRLAQAPHGPWKYILHYGIQWPVRIYISAFRGTPLFVQIMVVHFALVPLLINPRDGLLVTSNIMSVDFARTLRSDYGAFLSCVVAITLNAGAYVSEIFRAGIQSIDRGQMEASRSLGMSYGRTMRKVILPQAFRRMLPPLGNNAIAIVKDSSLASAIGLADLAYAARTVSGAYATYWEPYLAISIVYWVITFLLSLLVRHMEMRFGKSDSR

SEQ ID NO: 61019 - DNA, 735 bp, Erwinia carotovora subsp. atroseptica SCRI1043
  CDS (1)..(735)
atggattttccttttctgtacgaaacgtttctggaaattattcccggtattccgctgaccctgcaactggcgatcagctctgtttttctgggcttctttctagcgctaggcttagcactgatgcagttgtcatcttttgccgtactgcgctcaattgcacggacctatgtactgtttttccgcggcacaccgctgctggtgcagctgttcctgatttactacgggctggggcaattcccctgggttcgggaaagcatactttggccgttcctgcgggagccccagtggtgcgccctgctgtcgctcagcctgtgtaccggtgcctatgccagtgaaattatccgtggcggattgcagtccgttcccgtcggccagatcgaatctgcacgcgcctgcggcatgccgtcattcatgattttcaagcgtattgtttttccgctggcaatccgtcaggcgctccctgcttacggcaatgagctgatttcaatggttaaatcgacctcattggcttccatcatcacgctgatggaaatcactggtatcgccgcacgcctcattgcagaaacctaccgggcgctcgaagtctttctggtcgccggtgctatttatctgtttattaaccttattctgacacgtttactgatgtggacagaatttacgcttacacctcatctccgtgcgccgggtgcgcaaccggcagcgaaaaaaattaagaaattgggagatctgcaatga

SEQ ID NO: 61020 - protein, 244 aa, Erwinia carotovora subsp. atroseptica SCRI1043
MDFPFLYETFLEIIPGIPLTLQLAISSVFLGFFLALGLALMQLSSFAVLRSIARTYVLFFRGTPLLVQLFLIYYGLGQFPWVRESILWPFLREPQWCALLSLSLCTGAYASEIIRGGLQSVPVGQIESARACGMPSFMIFKRIVFPLAIRQALPAYGNELISMVKSTSLASIITLMEITGIAARLIAETYRALEVFLVAGAIYLFINLILTRLLMWTEFTLTPHLRAPGAQPAAKKIKKLGDLQ

SEQ ID NO: 61021 - DNA, 651 bp, Streptococcus pyogenes MGAS10394
  CDS (1)..(651): transl_table=11
atgattaatatcccattaatgaaagatagtttaggatttgtgttatcgggattaccttatacccttggtatttcgttgctcagtttttttacgggtctatttttaggtttaggcctagcccttctgggaaggtcacgtcagccgttgattcattaccttgttagagcgtacatctctattatgcgaggtgtgccgatgattgtggtgctctttgttctttatttcgggttgccttattatggtttagaattaccagccttactttgcgcttaccttggtttttctatggtcagcgctgcctacatttctgaagtttttcgctcttctatagaagctattgacaagggacagtgggaagcagctaaggctttggggttaccatattctcttatggttaagaaaattattcttcctcaagcctttcgaattgcagttcctcctctaggcaatgtcattattgatatggttaaaagttcgtcgctagctgccatgattaccgtaccagatatttttcaaaatgccaaaattatcggtggtagagagtgggattacatgtccatgtatattttagtggcctttatttattggcttattgcttttttgttagaacgttaccaagaattcttagaaaataagctagcacttgtttaa

SEQ ID NO: 61022 - protein, 216 aa, Streptococcus pyogenes MGAS10394
MINIPLMKDSLGFVLSGLPYTLGISLLSFFTGLFLGLGLALLGRSRQPLIHYLVRAYISIMRGVPMIVVLFVLYFGLPYYGLELPALLCAYLGFSMVSAAYISEVFRSSIEAIDKGQWEAAKALGLPYSLMVKKIILPQAFRIAVPPLGNVIIDMVKSSSLAAMITVPDIFQNAKIIGGREWDYMSMYILVAFIYWLIAFLLERYQEFLENKLALV

SEQ ID NO: 61023 - DNA, 687 bp, Desulfotalea psychrophila LSv54
  CDS (1)..(687): transl_table=11
ttgggagattggaaaatgttactgcaaaaattatccgttgttcttgatgccctaccgtatatccttcaaggggcaggcgtcactctcattattgttggaggcgccatgtgcttgggccttgctctgggaatcccctttgccctaggccaggtctatggcccccgccccgttcgttatttcattagtttatacgtatggttctttcgcggggtaccaattcttatcctgatgttcttgttttacttcggagtgtttgagctactgggtttaaacctttcagccctcaccaccacagccttggtgctgggaatgacaagcgccgcctaccaatcccaaattttcaaaggtgctattctctcccttccccatggccagatccgggcagcagaggcactgggcatgaatcggccccaggccatctgttccattgtcctgcctcaggctatgcgagtctccatccctgcttggtcaaatgaatattcaatcatattaaaagattcggcacttgcctatgtggttggtgccatggatatgtttacccgcacccactttgtcgcctcccgaacctatgaacatttaactctttttatttttgtcggtcttctttaccttatcatcaccgttatcggcgtaaaagtactcgccagacttgaaaagaagctacatattcctggctacacagcgtaa

SEQ ID NO: 61024 - protein, 228 aa, Desulfotalea psychrophila LSv54
MGDWKMLLQKLSVVLDALPYILQGAGVTLIIVGGAMCLGLALGIPFALGQVYGPRPVRYFISLYVWFFRGVPILILMFLFYFGVFELLGLNLSALTTTALVLGMTSAAYQSQIFKGAILSLPHGQIRAAEALGMNRPQAICSIVLPQAMRVSIPAWSNEYSIILKDSALAYVVGAMDMFTRTHFVASRTYEHLTLFIFVGLLYLIITVIGVKVLARLEKKLHIPGYTA

SEQ ID NO: 61025 - DNA, 657 bp, Symbiobacterium thermophilum IAM 14863
  CDS (1)..(657): transl_table=11
ttggccaggttcatcgaacataccctcaacatcctgcccgtcctcttcgaggggctgggcgtcacgctgaagctcacggccctcagcgccctcttcggcaccctcctggggctgctggcggccctggcgcgcatctcccgcaacccgctgttcaccgtgcccgcgaccctttacgtcaacctgtttcgcgggacgccgctgctgctgcagctgctcttcatctacaacgccctgccccagctggggctcctcatccagcccttcccggcggccgtgctggggtacagcctgaactccggcgcctacatcgcggagatcatccgggccgccatccagtccatcgaccgggggcagatggaggccgcccggtccctgggcatgtcctacgggctggcgatgcgccggatcatcctgccccagacctaccgccgcctgctgccgccgatggtcaacgagctgtccgccctgaccaaggacacctcgctggcctccaccatctccatcctggagctgatgaagtactcgtcgcagttcgtctcccgcaccaacctggcgtggcagacctacgtctggacggcggcgttttacctggtggtcaccatgaccctgagcgcgctggccagccggctggagaagaagctggaggcgaggggatag

SEQ ID NO: 61026 - protein, 218 aa, Symbiobacterium thermophilum IAM 14863
MARFIEHTLNILPVLFEGLGVTLKLTALSALFGTLLGLLAALARISRNPLFTVPATLYVNLFRGTPLLLQLLFIYNALPQLGLLIQPFPAAVLGYSLNSGAYIAEIIRAAIQSIDRGQMEAARSLGMSYGLAMRRIILPQTYRRLLPPMVNELSALTKDTSLASTISILELMKYSSQFVSRTNLAWQTYVWTAAFYLVVTMTLSALASRLEKKLEARG

SEQ ID NO: 61027 - DNA, 807 bp, Symbiobacterium thermophilum IAM 14863
  CDS (1)..(807): transl_table=11
ttgagaagtacgaggtggcgccgccgcccgaggtcaaggccgaggagtagcagccgctccgaagacgcacggggcccccaggccgccaggggaacggcggtctgggggctttttgaagggagatccgcgatgcgctgggacgtcatacccacgttcgttccgatcatctttgagggggtcaagatcaccctccagatctcggccctgggcatcctcttcggtaccctcatcggcctggtcgcagggctgctgcgcagccggaagccgtccaacctgatcctgtgggcgctctacggcctggccacgctgtacgtggaggtcgtgcgcggcacgccgttcctggtgcagctgtacctcatgtactacgggccgttcttcctgttcggcatcgacctgcccgccatgaccgcgggcaccatcgcgctgtcgctcaacagcggcgcctacgtggcagagatcttccgcggcgcgatcgagtccatcgaccgtggccagatggaggccggccggtccctggggctgacctttgcgcagacgatgcgccacatcatcctgccccaggccttccgccgcgccctgccgcccctggccaacgagttcgcatcgctcatcaaggagtcgtcggtgatctcggtcctgggcgtggccgacatcatgttcaagacgaagacggtgggcaccgcgcactttgccatgttccaggcgctgctggtggcggccgtatactacctggtgctgaccggcatcacctcgcagctggtccggctgttggagaggaggctgggcaagagtgattcgcgttcgtaa

SEQ ID NO: 61028 - protein, 268 aa, Symbiobacterium thermophilum IAM 14863
MRSTRWRRRPRSRPRSSSRSEDARGPQAARGTAVWGLFEGRSAMRWDVIPTFVPIIFEGVKITLQISALGILFGTLIGLVAGLLRSRKPSNLILWALYGLATLYVEVVRGTPFLVQLYLMYYGPFFLFGIDLPAMTAGTIALSLNSGAYVAEIFRGAIESIDRGQMEAGRSLGLTFAQTMRHIILPQAFRRALPPLANEFASLIKESSVISVLGVADIMFKTKTVGTAHFAMFQALLVAAVYYLVLTGITSQLVRLLERRLGKSDSRS

SEQ ID NO: 61029 - DNA, 699 bp, Bacillus cereus ZK
  CDS (1)..(699): transl_table=11
atgtatctaagtagtgcattgatttcagatcgattgtctacttggatagatattatgcagacttccttcatgcctatgctgaaggaagctgtttttacgacaattccattaacgcttattacatttattatcggtcttatactggcaacgttaacggcgcttgcacgtatttcaggtagtcgtattttacaatggattgctcgtatctatgtatctatcattcgcggaacgccacttcttgtacagttatttattattttctatggtctgccaactcttaatgttgaagttgagccatatacagcagcagttgttggattttcattaaatgtcggtgcgtatgcatctgaaattattcgtgcttctatcctttccattccgaaagggcagtgggaagcagcttacacaattgggatgacatatccgcaagcgttaaaacgtgttattttaccgcaagcaacgcgcgtatcaattccgccgctttcgaatacatttattagcttagtgaaagatacttcattagcatcgttaattttagtaacagaaatgttccgaaaagcgcaggaaattgcggcaatgaactatgagttcttaattgtttattttgaagcaggtcttatttattgggttatttgtttcttattatcaatcgtacaacagatgttagaaaagcgttcagaacgctatacattaaaataa

SEQ ID NO: 61030 - protein, 232 aa, Bacillus cereus ZK
MYLSSALISDRLSTWIDIMQTSFMPMLKEAVFTTIPLTLITFIIGLILATLTALARISGSRILQWIARIYVSIIRGTPLLVQLFIIFYGLPTLNVEVEPYTAAVVGFSLNVGAYASEIIRASILSIPKGQWEAAYTIGMTYPQALKRVILPQATRVSIPPLSNTFISLVKDTSLASLILVTEMFRKAQEIAAMNYEFLIVYFEAGLIYWVICFLLSIVQQMLEKRSERYTLK

SEQ ID NO: 61031 - DNA, 672 bp, Mannheimia succiniciproducens MBEL55E
  CDS (1)..(672): transl_table=11
atgttttttgaatatcttcctttaatgagtaccgcaaccctaatgactttggggttagcggtttgttcgttaatagcgggtctggttttagccatcttttttgtggtgctggaaacgaacaaatttgtgtgtgtgcgcaaaccgaccgctattttcgttaccctattacgcgggttgcccgagattttggtggtgttattgatctatttcgggtctaccgaattggtggaaaaactcaccggcgagtatattgaattcagtccgtttttatgcggggtaatcgcattggcgattatttttgccgcttacgcctcacaaaccctaagaggagcaattcaggcgattcctttaggtcagtgggaatcgggcgccgcattaggattaagccgcggctatacctttgtgaatattattctgccgcaggtgtggcgccacgcgttgccgggcttgagtaaccaatggcttgtgttattgaaagatacggcattggtttccttaatcggagtggacgatttaatgcgtcaggcaagtttagttaacacaaacacccatcaaccttttacctggtatagttttgccgcgctgctttatctgattattaccttggtcagccaatttttcatgcgtaaattggaaatgcgttttactcgttttgaaagaggggtgaaataa

SEQ ID NO: 61032 - protein, 223 aa, Mannheimia succiniciproducens MBEL55E
MFFEYLPLMSTATLMTLGLAVCSLIAGLVLAIFFVVLETNKFVCVRKPTAIFVTLLRGLPEILVVLLIYFGSTELVEKLTGEYIEFSPFLCGVIALAIIFAAYASQTLRGAIQAIPLGQWESGAALGLSRGYTFVNIILPQVWRHALPGLSNQWLVLLKDTALVSLIGVDDLMRQASLVNTNTHQPFTWYSFAALLYLIITLVSQFFMRKLEMRFTRFERGVK

SEQ ID NO: 61033 - DNA, 684 bp, Mannheimia succiniciproducens MBEL55E
  CDS (1)..(684): transl_table=11
atgttccgggaatattttatggaaattgcccgcgggattccgaccagcctgttgttaacggcggttgccttggcggttgcttttgtgctggctttatttttaacctttttgttatctatggaaaacaaacctgttaaaagggtaattaatatctttttaaccctgtttaccggcaccccgttattggtacagtttttcctgatttacagcggccccggtcagttccaatggattgtcaacagcgctctgtggccattattatctaatgcctggttttgcgccatgtttgcgttagcgttaaacagtgcggcctattctacgcaattattccatggtgcggtaaaagcgattccgaaaggtcaatgggaaagctgtgccgcattgggtttaagccgtttgcagacgttgaagattctgatcccttatgccttaaaacgcgcattgccttcttacagcaatgaaattattctagtatttaaaggcacttctttagcgtcaaccatcacaattatggatattatgggttatgcaagacagctttacggtacggaatatgacgctattacgatttatggtattgccggcgttatttatttggttattactggtttaatgaccttattgctgcgtaaattagagcataaagtccttgcgtttgaacgtttggaagtggaaaaagcataa

SEQ ID NO: 61034 - protein, 227 aa, Mannheimia succiniciproducens MBEL55E
MFREYFMEIARGIPTSLLLTAVALAVAFVLALFLTFLLSMENKPVKRVINIFLTLFTGTPLLVQFFLIYSGPGQFQWIVNSALWPLLSNAWFCAMFALALNSAAYSTQLFHGAVKAIPKGQWESCAALGLSRLQTLKILIPYALKRALPSYSNEIILVFKGTSLASTITIMDIMGYARQLYGTEYDAITIYGIAGVIYLVITGLMTLLLRKLEHKVLAFERLEVEKA

SEQ ID NO: 61035 - DNA, 684 bp, Bacillus licheniformis ATCC 14580
  CDS (1)..(684): transl_table=11
ttgggctctattcaatgggagtatatttttaatgcagaattggctgcgaaatcgtttccttatgtgatgcaaggcatatggaatacgcttttcatttcttttgcgagcatgtttgccggtttaattctcggttttttcatcgcgcttgggcgcatgtccgggctcgctttgcttcgttggccggcaagaatctatatctcgtttatgagaggcgttccgatccttgtcatactatttatcctttatttcggttttccttatatcggaatccaatttacggctttggctgctgccttaatcggcttcagcatcaacagcgccgcatacattgccgagattatccgctcggccctgtcgtccgttgacagagggcagtgggacgctgcaaaatcggtcggattctcctactggcagacgatgcgccacgtgattgtccctcaatcggttaggattgcgctcccgcctcttgcgaacgtgatgcttgatctcgttaaagcgtcttccctggccgccatgatcaccgtgcctgaattgtttcagcaggcaaaaatcgtcggcggacgggaattcgactatatgacgatgtacattttagttgccttgatttactgggccatttgctcggggatcgctttgctccaggatttcctggaaaagcggacagaggtttatatcaaaaaataa

SEQ ID NO: 61036 - protein, 227 aa, Bacillus licheniformis ATCC 14580
MGSIQWEYIFNAELAAKSFPYVMQGIWNTLFISFASMFAGLILGFFIALGRMSGLALLRWPARIYISFMRGVPILVILFILYFGFPYIGIQFTALAAALIGFSINSAAYIAEIIRSALSSVDRGQWDAAKSVGFSYWQTMRHVIVPQSVRIALPPLANVMLDLVKASSLAAMITVPELFQQAKIVGGREFDYMTMYILVALIYWAICSGIALLQDFLEKRTEVYIKK

SEQ ID NO: 61037 - DNA, 714 bp, Burkholderia mallei ATCC 23344
  CDS (1)..(714): transl_table=11
atgatcgagctgatccaagaatactggcgcaactacctgtatacggacgggtatcgcttcaccggcctcgcgatcacgatgtggctgctcgtcgtgtcgatcggcatcggcttctgtctgtccgtgccgctcgcggtcgcgcgcgtgtcgaagaagaagtggctcgcgggcgcggtctggctctacacgtacgtgttccgcggcacgccgctctacgtgcagctcctgctctgctacacgggcctttacagcctgcaggccgtgcgcggcacgccgatgctcgacgcgttctttcgcgacgggatgaactgcacgctgctcgcgttcacgctaaacacctgcgcgtatacgaccgaaatcttcgcgggcgcgatcaaggcgacgtcgtacggcgagatcgaggcggcccgcgcttacgggatgtcgaccttcacgctgtatcgccggatcgtgctgccttcggcgctgcgccgcgcgctgccgctctacagcaacgaggtgatcctgatgctgcatgcgacgacggtcgcgttcacggcgaccgtgcccgatatcctgaagatcgcgcgcgacgtcaattcggcgacctacatgtcgttccacgcgttcggcatcgccgcccttctctacctcgcgatctcgtttacgctcgtgtggctgttccgccgcgccgaacgccgctggctcgcgtatctgcgcccgcaaggcaaatga

SEQ ID NO: 61038 - protein, 237 aa, Burkholderia mallei ATCC 23344
MIELIQEYWRNYLYTDGYRFTGLAITMWLLVVSIGIGFCLSVPLAVARVSKKKWLAGAVWLYTYVFRGTPLYVQLLLCYTGLYSLQAVRGTPMLDAFFRDGMNCTLLAFTLNTCAYTTEIFAGAIKATSYGEIEAARAYGMSTFTLYRRIVLPSALRRALPLYSNEVILMLHATTVAFTATVPDILKIARDVNSATYMSFHAFGIAALLYLAISFTLVWLFRRAERRWLAYLRPQGK

SEQ ID NO: 61039 - DNA, 660 bp, Burkholderia mallei ATCC 23344
  CDS (1)..(660): transl_table=11
atgcaagcgttcgatctggtcgtgcataccctccccgtcctcgcgaaaggcgcggccctcacgatgaagttcgcggtcgcgtcgatggtgctcggattgatcgtcggcctgctcgtcgcgctcgtgcggatcggcagcaaccggctgctgtccgcgatcgcgcagggctacgtgagcctgatgcgcggcacgccgctgctcgtgcagatgttcgtcgtctactacgggttgcccgacatcggcatctcgctcgacccgacggcggccggcatcttcacgctcacgctcaacgcgggcgcgtacctgtccgagaacatgcgcggcgcgatcctcggcatcggccgcggccagtgggccgcgtcgcacagcctcggcctcacgcacgtgcagacgctgcgccacgtgatctgcccgcaggcgctgcgtctcgcggtgccgagcctcggcaacacgctgatcagcctcatcaaggacacgtcgctcgtgtccgtcatcaccgtcacggagctgctgcgctcgacgcaggaagtgatcgcgtcgacgttccagccgctgccgctgtatctggccgccgccgcgatctactgggtgctgagcacgctgctcgcgcggctgcagggccgcatcgaaacgcgctgcgcgctgccgtccgcgcactga

SEQ ID NO: 61040 - protein, 219 aa, Burkholderia mallei ATCC 23344
MQAFDLVVHTLPVLAKGAALTMKFAVASMVLGLIVGLLVALVRIGSNRLLSAIAQGYVSLMRGTPLLVQMFVVYYGLPDIGISLDPTAAGIFTLTLNAGAYLSENMRGAILGIGRGQWAASHSLGLTHVQTLRHVICPQALRLAVPSLGNTLISLIKDTSLVSVITVTELLRSTQEVIASTFQPLPLYLAAAAIYWVLSTLLARLQGRIETRCALPSAH

SEQ ID NO: 61041 - DNA, 927 bp, Nocardia farcinica IFM 10152
  CDS (1)..(927): transl_table=11
atgaccggtagcgacgaccccgcggtgtcgcgggaaccggagcccatcaaagctgttcccctgcgcaggcccggccgctggatcgcggccgggatcatcctggtgctgctcggcctgttcgtctacggcgcggccaccaacgaggcctaccagtggggcacctacggccggtacctgttcgacacccgcatcctctccggcgcgctggtgaccctcgagctcaccgtgctcgccatggccatcgccatcgtgctgggcacggtgctcgcggtgatgcggctgtcgccgaatccggtgctgcgctccaccgcgtgggtgtacctgtggatcttccgcggcacgccggtgttcgtgcagctggtgttctggggcctgttcccctcgctgtaccggcagatcgacctcggcgtgccgttcgggccgcagttcttccacctcgacgtgcagggcctacaggccgcgttcgccttcgcggtcatcggtctcggcctcaacgaggccgcctacatggccgagatcgtccgcgcggggatcaactccgtcggcgagggacagcgggaggcgtccatcgccctcggcatgtcctgggcgcagaccatgcgccggacggtgctgccgcaggcgatgcgggtgatcatcccgcccaccggcaacgagctgatcggcatgctcaagaccacctccctggtgaccgccatcccgctcagcaccgacctgtacggccgggcccgcgacatctacggggtgaacttccagccgatcccgctgctgctggtgaccgcgacctggtacctggccatcaccagcgtgctcatggtcgggcagtactacctggaacggcactactcgcgcggtgcgtcgcggcagctgaccgccaagcaactgcgtgaactggccgacgcacagaagctggatgccgcgaaatga

SEQ ID NO: 61042 - protein, 308 aa, Nocardia farcinica IFM 10152
MTGSDDPAVSREPEPIKAVPLRRPGRWIAAGIILVLLGLFVYGAATNEAYQWGTYGRYLFDTRILSGALVTLELTVLAMAIAIVLGTVLAVMRLSPNPVLRSTAWVYLWIFRGTPVFVQLVFWGLFPSLYRQIDLGVPFGPQFFHLDVQGLQAAFAFAVIGLGLNEAAYMAEIVRAGINSVGEGQREASIALGMSWAQTMRRTVLPQAMRVIIPPTGNELIGMLKTTSLVTAIPLSTDLYGRARDIYGVNFQPIPLLLVTATWYLAITSVLMVGQYYLERHYSRGASRQLTAKQLRELADAQKLDAAK

SEQ ID NO: 61043 - DNA, 948 bp, Photobacterium profundum SS9
  CDS (1)..(948): transl_table=11
atgcttaggacgtctaatcgttggctgtggcacggcatttttgtagttatcgtcgcgttgtctattgttggtatttaccaagcctcaaaacaaataaattataactggcaatgggaaagggtgacgcctttcttgtttgatacctctccaaaagaagtgattgccgctggggatggcagtgttgttattaacgatgatggctcattggttgttaatttcgattacgatgatgaaccacaagttgttactcagtacgacgagctgtttgttgctgatagcgatattgtttttgagggtgatgttcttgcccaatcagaacactgggctgttggtcctttaattttaggtttgtgggtaaccctaaaaatatccattatttctcttttctttgccgttatcattggattagtggcaggcttaatgagaatttcaaataaccctgtgacgaagaatctctcatttttatacgttgaaattattcgtggcacaccgctgttaatccaaatatttattgtctattttttcttgggcacaatatttgatttagaacgatttacggcgggtgtggtggcgctttcagtttttactggcgcctatattgccgagatcattcgatcgggtattcaatctattccccctgggcaaatggaagctgcgcgttcattagggatgaattaccccaaggcaatggcttacgttattttacctcaagcatttaagcgcacattaccgccaatggcgggtcaacttatcacgctgattaaagattcttcattagtgtctgttatttctatcactgatttaaccaaagctgggcgagaggtaattagtggcagctttgcaacgtttgaagtgtggtttgtggttgcgggtctgtatttattactgactatttcactatcatgggtagtgcaacgtattgagaagaggttagcgtctagtgactag

SEQ ID NO: 61044 - protein, 315 aa, Photobacterium profundum SS9
MLRTSNRWLWHGIFVVIVALSIVGIYQASKQINYNWQWERVTPFLFDTSPKEVIAAGDGSVVINDDGSLVVNFDYDDEPQVVTQYDELFVADSDIVFEGDVLAQSEHWAVGPLILGLWVTLKISIISLFFAVIIGLVAGLMRISNNPVTKNLSFLYVEIIRGTPLLIQIFIVYFFLGTIFDLERFTAGVVALSVFTGAYIAEIIRSGIQSIPPGQMEAARSLGMNYPKAMAYVILPQAFKRTLPPMAGQLITLIKDSSLVSVISITDLTKAGREVISGSFATFEVWFVVAGLYLLLTISLSWVVQRIEKRLASSD

SEQ ID NO: 61045 - DNA, 690 bp, Photobacterium profundum SS9
  CDS (1)..(690): transl_table=11
atggttttttcgggttactcaatgtcactcgtagaggcaagctggatgaccatccagctggcttttgccagtttattagtcggtttagttttagcggtaatttttgcaagcggtgagatgtctcgtagccgtcttgtcgcttggccgacaactgcattcgttacaattcttcgtggtttacctgaaatattagtggtgctgtttatctttttcggctcaggtcaggtgctctttatgatcacaggtgactatgtcgatatcagcccatttgtctctggagttatagccttatcactcatctttgcttcttatgccgcccaaacgatacgtggcgcattaaaagcggtgaataatggtcaacgcgaagcggcgagtgcccttggtataagcaaagcgcatagtttctttcgtattattttgccacaagcggttaggcatgccctacccggtttgactaaccagtggttagttctgctgaaagatactgctttagtgtccttaattggcgtaaccgatttacttaaacaagcacagctcacttctgctgcaacgcatgaagcctttacttggtacgccactgctgctgctatttatttggtgattacactgattacacaacgtgcggttaaagtgattgataagaaatttacggttcaaggtcttagcgcaccgcaaggagcaaccgcatga

SEQ ID NO: 61046 - protein, 229 aa, Photobacterium profundum SS9
MVFSGYSMSLVEASWMTIQLAFASLLVGLVLAVIFASGEMSRSRLVAWPTTAFVTILRGLPEILVVLFIFFGSGQVLFMITGDYVDISPFVSGVIALSLIFASYAAQTIRGALKAVNNGQREAASALGISKAHSFFRIILPQAVRHALPGLTNQWLVLLKDTALVSLIGVTDLLKQAQLTSAATHEAFTWYATAAAIYLVITLITQRAVKVIDKKFTVQGLSAPQGATA

SEQ ID NO: 61047 - DNA, 672 bp, Photobacterium profundum SS9
  CDS (1)..(672): transl_table=11
atgaatgaacaacatgtttggcaaatgctaggtggtttggcaacaagtcttgaactgacagccgtggcattattggtgggatgtacgcttgcatttttaatgacattaacactgattatgcgaacaacgggtttacattggatcagcagtggcattattactttgttcacgggcacaccgttgctggttcaaatattcttgatttattacggcccagggcaatttgaagcgatacgtgaaagctttctttggaattggttgagtcaaccttggttctgcgcgatgttagccttggcattaaacacggcagcatacagcacacagttatttaaaggtgcattcaacgccattccttctggtcaatggcaagcatgtcgcgcactaggcatggataaattcgcgacactacgtgttttattaccgtttgcaattcgtcgtgccatacctgcttattcaaatgaagttattctagtctttaaaggaacgtcgctagccagtactatcactattatggatctgatgggttacgcacaacgtattaacgcccaaacctatgacactttggtcgtgttcagtattgcaggcgcattctaccttgctgtgaatggtattttaacgttgattttccgccaagttgaaaagaaagcgttggcgtttgaagttgctcattaa

SEQ ID NO: 61048 - protein, 223 aa, Photobacterium profundum SS9
MNEQHVWQMLGGLATSLELTAVALLVGCTLAFLMTLTLIMRTTGLHWISSGIITLFTGTPLLVQIFLIYYGPGQFEAIRESFLWNWLSQPWFCAMLALALNTAAYSTQLFKGAFNAIPSGQWQACRALGMDKFATLRVLLPFAIRRAIPAYSNEVILVFKGTSLASTITIMDLMGYAQRINAQTYDTLVVFSIAGAFYLAVNGILTLIFRQVEKKALAFEVAH

SEQ ID NO: 61049 - DNA, 678 bp, Photobacterium profundum SS9
  CDS (1)..(678): transl_table=11
atggactttagtattctttttgaaagctgggaactttaccttgatggatttatcactacggtgtggatggtcgcggttgcacttgtcattggcttaattattgccatacccgtcggcattgcacgcaacagtaaaaatccgatgatttattttcctgcttgggcttatatttatttcttccgcggtacgcctttattaattcagctgtatttagtgtattacggattaagtcagcttattgaggtgcaaggtacagtgtggcaagatgcatggttttgtgcactttttgtctttattttaaatacagccgcttatacctcagagattatccgaggggcaattaatagcttacctaaaggtgaaattgaagctgcaaaagcgtatggaatgagtacaccactagcattccgccgtattattttacccagtgcgatgcgccgagcattaccagcatacagtaacgaagtgattttcatggttcatggttctgcagtggcaggtatcgtaaccattgttgatttaacgggtgcggctcgtatcgttaactcgcgttattatgcgccatttgaatcttacttatttgcaggtatgtgttatatggtgcttacatttactattatctggggctttaaaaagttagagcaacattggctacaacacttaagaccgattgtgtaa

SEQ ID NO: 61050 - protein, 225 aa, Photobacterium profundum SS9
MDFSILFESWELYLDGFITTVWMVAVALVIGLIIAIPVGIARNSKNPMIYFPAWAYIYFFRGTPLLIQLYLVYYGLSQLIEVQGTVWQDAWFCALFVFILNTAAYTSEIIRGAINSLPKGEIEAAKAYGMSTPLAFRRIILPSAMRRALPAYSNEVIFMVHGSAVAGIVTIVDLTGAARIVNSRYYAPFESYLFAGMCYMVLTFTIIWGFKKLEQHWLQHLRPIV

SEQ ID NO: 61051 - DNA, 741 bp, Photobacterium profundum SS9
  CDS (1)..(741): transl_table=11
ttgttagatttaaaaggatatgaatgggcattggcagaaggtgcttgggttacagtccaggttgcgttgttgtcactcttattcgcagtaatcttaggtatgcttggtgcgttggcgaaactatcgccataccgttgggcaagagccattgccaccatctataccacagtcatccgtggtattcctgacttaatattgatgatgctgattttcttcggtgggcaaatgctgcttaacgatagtttgtatcgtatcaatgaatggtttaatgaatattttacatccagcgatccaacccatgagtggacggcctatttacctgactatattgagataagcccttttgtggcaggtgtagtaaccattggttttatctttggtgcttatatggcagaaacgttccgtggtgcaattttatcggttgataaaggcgagctcgaagctggtaaagcgtatggcatgagtggctttaaatctttccatcgaattctattaccgcaaatgatccgacatgcgttaccgggttttggtaataactggttagtactactcaaaacaaccgcgttagtgtcgattattggtttagacgatatggtacgtaaaggctcgttggcggcaggtgcaacgcaaatgccatttaccttttatatgaccattgctgttgttttcttattgtttaccacattgtctacatcagcacttaagtgggctgagcgtcgatttagcattcatacgaggtaa

SEQ ID NO: 61052 - protein, 246 aa, Photobacterium profundum SS9
MLDLKGYEWALAEGAWVTVQVALLSLLFAVILGMLGALAKLSPYRWARAIATIYTTVIRGIPDLILMMLIFFGGQMLLNDSLYRINEWFNEYFTSSDPTHEWTAYLPDYIEISPFVAGVVTIGFIFGAYMAETFRGAILSVDKGELEAGKAYGMSGFKSFHRILLPQMIRHALPGFGNNWLVLLKTTALVSIIGLDDMVRKGSLAAGATQMPFTFYMTIAVVFLLFTTLSTSALKWAERRFSIHTR

SEQ ID NO: 61053 - DNA, 978 bp, Haloarcula marismortui ATCC 43049
  CDS (1)..(978): transl_table=11
atgagcacagctgaatccacaacatcaccgctccgggaccgcgtcgggacagtctttaccgtccgtccacttacaatcggcctgacgctgttctggatctgggttctggcccggtggactaccgatttcgttctcgcaggagtatttggactcgaccgtggcacaccgtttctcccggcggccccgttcctgacagcagcggataccgtcgcatcgctcgccgcgccgctcggtgccgccggagcgccgctggcatggttcgctgagacgctccggttcgccgccgacgcgacggcgtacctgccggcgctggcacatggcatctggacgacggtcctactgacggtcttcagtgtctgtctcgggttcgcgctggcgctcccgctcagcgtcgttcgcgtgtacggagggcggtgggcacggtggctcgccctatcctacactgaactcatccgcggaacgccgctgctcgcccagttgttcgtgctttacttcgcgacctcactcacgcaggttctcagaggcgtcccgggggtcggtgtcggattcattccagcacaggcgttctgggtcgccgttatcagcttcacgctgaacagcgccgcctaccagtccgaatatctgcgcgcgtcactggactcggtcgacggcggccagttgactgccgcacgcgcaattgggctctcaaagctcgaagggatacggtacgttgtcgttccacagggtctgcgactcgcgcttcccagttggacgaacgaactcgtgtatctcatcaagtactcctcgctggcgagtttcatcactgttcaggaactgtacggcaggacaagcaccctcgctaacgagacgtaccagtatacagaactgtttgtgctggtggcaatactgtacctggccctcgttgtgtcggcatcagcactgatggaccgcgtcgaatcgcacactgcaaccgccggtgtcggacacactagacaatga

SEQ ID NO: 61054 - protein, 325 aa, Haloarcula marismortui ATCC 43049
MSTAESTTSPLRDRVGTVFTVRPLTIGLTLFWIWVLARWTTDFVLAGVFGLDRGTPFLPAAPFLTAADTVASLAAPLGAAGAPLAWFAETLRFAADATAYLPALAHGIWTTVLLTVFSVCLGFALALPLSVVRVYGGRWARWLALSYTELIRGTPLLAQLFVLYFATSLTQVLRGVPGVGVGFIPAQAFWVAVISFTLNSAAYQSEYLRASLDSVDGGQLTAARAIGLSKLEGIRYVVVPQGLRLALPSWTNELVYLIKYSSLASFITVQELYGRTSTLANETYQYTELFVLVAILYLALVVSASALMDRVESHTATAGVGHTRQ

SEQ ID NO: 61055 - DNA, 981 bp, Haloarcula marismortui ATCC 43049
  CDS (1)..(981): transl_table=11
atggggacgccggagtccacgactgccggacgaacgctccgtgcccgtgccgccgggctgaccgaccagccgctgacgctgctgactgtcggggccttctggacgtggctcgtcgtgcgctggacgaacgacttcctgctagacggcgcgctcatcgagcgcaacacgtcgtttttcccgacggcaccgttcgaggcggccgcgtcaacgattggcggtctcgcggcgagtctcggtccggtcggggtccccgtcggctgggtcgccggcttcttcgagttcctggcggcgtcgattccgtacctgccgccactggcgaccggcgtgtgggcgaccatactgctgacgctgctgggtatcgcgctcgggttctttatcgccgtcccactcagtgtggctcgggtgtacggcgggacgctcacccgctcgcttgcactgggatacaccgaactgttccgcgggacgccgctgctcgcccagttattcgtcctctacttcgcgacgccgctgacgacgattatccgtgaactgcccacggtcggggctggattcattcccgcacaggcgttctgggtggccgtcatcgcgttcacgcttaacagcgccgcctaccagtcggagtacattcggtcagcgctgaactccgtcccggaagggcaactcaccgccgcccgttcaattgggctctcgaaagtcgatgggatacggcacgtggtcctgccgcagggcctgcgctacgcgattccgggctggtcgaacgagctggtgtacctcatcaagtactcgtcgctggcgagtttcatcaccgtccgcgaactgttcgagcgaaccgacgcgatcgctagcgagacctaccggtacacggaactgttcgtcctcgccggcctgctgtaccttgcgcttgttatctcggcgtcactggtgatggaatacgtcgaagaccgggtcgcgattcccggtctcggcacgaccagccgatga

SEQ ID NO: 61056 - protein, 326 aa, Haloarcula marismortui ATCC 43049
MGTPESTTAGRTLRARAAGLTDQPLTLLTVGAFWTWLVVRWTNDFLLDGALIERNTSFFPTAPFEAAASTIGGLAASLGPVGVPVGWVAGFFEFLAASIPYLPPLATGVWATILLTLLGIALGFFIAVPLSVARVYGGTLTRSLALGYTELFRGTPLLAQLFVLYFATPLTTIIRELPTVGAGFIPAQAFWVAVIAFTLNSAAYQSEYIRSALNSVPEGQLTAARSIGLSKVDGIRHVVLPQGLRYAIPGWSNELVYLIKYSSLASFITVRELFERTDAIASETYRYTELFVLAGLLYLALVISASLVMEYVEDRVAIPGLGTTSR

SEQ ID NO: 61057 - DNA, 684 bp, Streptococcus thermophilus LMG 18311
  CDS (1)..(684): transl_table=11
ttgatgaatttttcatttctaccacagttttggtcttactttaactatggtgtcttagtaacaattatgatttcagtctgcgtggtcttctttggaaccatccttggtgtcttggtatccttggccaaacgttctggaatcaaaccattggagtggttagtaagcctttatgtttgggttttccgtggaacacctatggttgtacagattatgattgcttttaaccttatccatatgaatcttccaactgttcagtttgggattttgaatcttgatttgtcacgtatcgttccaggtattatcgtcctttctttgaacagtggtgcttatatttctgagagtgtgcgtgcaggtattgagtctattcctaaaggtcagattgaagcagcttactcacttggtatccgaccatggaataccatgcgttatgtggtcttgcctcaagctattaaaaatatcttgcctgccttgggtaatgagtttgtcactattatcaaggatagttcactcttgcaaactatcggggttatggagttgtggaatggtgcacaaactgttgcaacgacaacctacttgactttgacaccactcttgttcgcagccttctattatttgattgtgacaacggctatgactgcacttttgaaacaaatggaaaaacgacttgggaagggacgtaaataa

SEQ ID NO: 61058 - protein, 227 aa, Streptococcus thermophilus LMG 18311
MMNFSFLPQFWSYFNYGVLVTIMISVCVVFFGTILGVLVSLAKRSGIKPLEWLVSLYVWVFRGTPMVVQIMIAFNLIHMNLPTVQFGILNLDLSRIVPGIIVLSLNSGAYISESVRAGIESIPKGQIEAAYSLGIRPWNTMRYVVLPQAIKNILPALGNEFVTIIKDSSLLQTIGVMELWNGAQTVATTTYLTLTPLLFAAFYYLIVTTAMTALLKQMEKRLGKGRK

SEQ ID NO: 61059 - DNA, 696 bp, Streptococcus thermophilus CNRZ1066
  CDS (1)..(696): transl_table=11
atgttaatgaattttagttgggaatatttttttgaattatttgtaaaattaccagcctatattccagtaactatttttatagctcttatttctatgattttagctattctaattggactatttattacatggttgcaattgtctaaaaataaggttttgatatttatctcacaagtttatatttctctctttaggggaatgccaacgcttgttcaattgttccttattttttatggtttgcctcaactatttcctgctttcaaagggatgtcggcattaactgctgctttaattggacttgggttaaaagaggctgcttacttgtcagaaatatttagggcggcaattaactctattgataagggacaaatcgaagctggggaagcattgaacattcctgcctggaaggtgtttctccatgtcattcttccccaagctaccctaaatgctcttcctgcaacaggaaatacctttattagtttgttgaaagaaacatctttggcttttacattagggataacagagctttttggtaatgctaagatgattgctggcgaatcatttcgttattttgaaacctatttagcagttggtctactatattggataatgattgtagtgtatacatgggttcaaaaacaatttgaaaaagaattagaaattccgtataggagggatttacatgactcttattag

SEQ ID NO: 61060 - protein, 231 aa, Streptococcus thermophilus CNRZ1066
MLMNFSWEYFFELFVKLPAYIPVTIFIALISMILAILIGLFITWLQLSKNKVLIFISQVYISLFRGMPTLVQLFLIFYGLPQLFPAFKGMSALTAALIGLGLKEAAYLSEIFRAAINSIDKGQIEAGEALNIPAWKVFLHVILPQATLNALPATGNTFISLLKETSLAFTLGITELFGNAKMIAGESFRYFETYLAVGLLYWIMIVVYTWVQKQFEKELEIPYRRDLHDSY

SEQ ID NO: 61061 - DNA, 657 bp, Geobacillus kaustophilus HTA426
  CDS (1)..(657): transl_table=11
atggattttcgttttgatattattgttgaatacgccccttacttttggcaagggctgctcgtaacgatcggcgtatcattagccggcatcgtgttcggcctcattctcggcctgttcatcggccttggcaaaatgtcgtccaacccgattattcgtttgccgttttcgtggtacattaactttttccgcggtacgccgcttgtcgtgcaaattttgctcgtccatttcggcgccatgccgctctttttcgcccagccaaatgccgtcgcttccctggccgtctcgctgtcgctcaactcggccgcgtatgtggccgagattttccgcgccggcatccagtcgatcgacaaagggcaaatggaagcggcccgctcgcttgggatgacgcatgcgcaggcgatgcgctacattattttgccgcaggcgttaaagcgaatgattccgccgtttgcgaacgagtttatcgtcttaattaaagattcgtcgcttgggatggtcatcgccgccccggaaatcatgtattgggggaaagcggccgcgggtgagtattaccgcgtttgggagccgtatttaacagtggcgttcatctatttgctcttaacgctttcgttaagcaaactgtcacactatcttgaaaggaagtattcgacccaatga

SEQ ID NO: 61062 - protein, 218 aa, Geobacillus kaustophilus HTA426
MDFRFDIIVEYAPYFWQGLLVTIGVSLAGIVFGLILGLFIGLGKMSSNPIIRLPFSWYINFFRGTPLVVQILLVHFGAMPLFFAQPNAVASLAVSLSLNSAAYVAEIFRAGIQSIDKGQMEAARSLGMTHAQAMRYIILPQALKRMIPPFANEFIVLIKDSSLGMVIAAPEIMYWGKAAAGEYYRVWEPYLTVAFIYLLLTLSLSKLSHYLERKYSTQ

SEQ ID NO: 61063 - DNA, 669 bp, Salmonella enterica subsp. enterica serovar Paratypi A str. ATCC
  CDS (1)..(669): transl_table=11
atgcaagaaagtatccaactggttattgaatcgctgccgtatttgcttaaaggcgccgtctttaccctgcaactgagtattggcggtatgtttttgggtctgctgctgggatttgtgctggcgctgatgcggatgtctccgctatggctggttcgctggctggcgcgcttttatatctcgatttttcgcggtacgccgcttatcgcccagttatttatgatctattacggcctgccgcaatttgggattgagctggaccctatcccggcggcgatgattggtttatcgctcaataccgcggcttacacgtccgagacgctgcgcgcggcgatctcggctatcgacaaggggcaatgggaagcggcggcgagcattggcatgacgccgtggcaaacgctacgccgcgctattttgccgcaggcggcccgcgtcgcgcttccgccgttgagcaacagctttatcagcctggtgaaagatacgtcgctcgccgcgacgattcaggtgccggagttgttccgccaggcgcagttaattacctcgcgaacgctggaggtgtttaccatgtatctggccgcgtcgttaatctactgggtaatggcgaccgtcttatcggcactgcaaaactattttgaaaaccagcttaaccgccaggagagagagccaaaatga

SEQ ID NO: 61064 - protein, 222 aa, Salmonella enterica subsp. enterica serovar Paratypi A str. ATCC
MQESIQLVIESLPYLLKGAVFTLQLSIGGMFLGLLLGFVLALMRMSPLWLVRWLARFYISIFRGTPLIAQLFMIYYGLPQFGIELDPIPAAMIGLSLNTAAYTSETLRAAISAIDKGQWEAAASIGMTPWQTLRRAILPQAARVALPPLSNSFISLVKDTSLAATIQVPELFRQAQLITSRTLEVFTMYLAASLIYWVMATVLSALQNYFENQLNRQEREPK

SEQ ID NO: 61065 - DNA, 669 bp, Salmonella enterica subsp. enterica serovar Paratypi A str. ATCC
  CDS (1)..(669): transl_table=11
atgcttgagtacttacctgaactgctaaaagagctacacaccagcctgacgctgaccgtggcttctattgccgtcgctttggtgctggcgttagtttttaccatcatcctgacgctaaaaacgccgttcgtggtgtggctggtgcgcggctatatcacgttgtttaccggtacgccgttgttggtgcaaattttcctgatctactacggacccggtcaattcccgacactgcaagagtatccgctactctggcatctactgtctgaaccgtggctgtgcgcactgatcgcgttgtcgctaaacagcgccgcttataccacgcagctattttatggcgcgattcgcgcgattccggaaggtcagtggcagtcctgcggcgcgctggggatgagtaagaaagatacgctggcgattttgttgccctatgcgtttaaacgcgccctctcctcctattctaatgaggtggtactggtcttcaaaagtacctcgctggcctataccatcaccttgatggaagtcatggggtacagtcagttgctctatggtcgtacctacgatgtggtggtatttggcgcggcaggcgtaatttacctggtcgtcaacggtctattgacgctgatgatgcggttgattgagcgtaaagccctggcgtttgagcggcgcaattaa

SEQ ID NO: 61066 - protein, 222 aa, Salmonella enterica subsp. enterica serovar Paratypi A str. ATCC
MLEYLPELLKELHTSLTLTVASIAVALVLALVFTIILTLKTPFVVWLVRGYITLFTGTPLLVQIFLIYYGPGQFPTLQEYPLLWHLLSEPWLCALIALSLNSAAYTTQLFYGAIRAIPEGQWQSCGALGMSKKDTLAILLPYAFKRALSSYSNEVVLVFKSTSLAYTITLMEVMGYSQLLYGRTYDVVVFGAAGVIYLVVNGLLTLMMRLIERKALAFERRN

SEQ ID NO: 61067 - DNA, 789 bp, Silicibacter pomeroyi DSS-3
  CDS (1)..(789): transl_table=11
atgatgcggctgatccgaccgatgctgatgccgcaccgtctggtgctgattgcgctggccgtggcgctggcgctgtggtgcgccctgacattgcgctgggactggctgccgaaatacctgccgctggcgatggaggggctgtggcgcaccgtctggctgctggcggcaagtacattcctggggttcctgctggcggttccgctgggctttgcccaggcggtggggccttggtatcttgccgttccggcgcgggtgttctgcaccctgatccgggggacgccgctgctcttgcagatatggctgctgtattatgggctggggtcggtctttccccagatcgacggtattcgcgacagcgttctgtggccctatctgcgacaggcctggccctatgcgctgctggcgctgacgctgtcctttgccgggtatgagggcgaggtgatgcgcggggccttttcgggggtcaaccgcggccagctggaggcggcgcgctcgttcgggatgccgcgctttaccctgttccgccggatctggctgccgcaggcgatcaacaacgtgctgccgacgctggggggagagaccatcctgcaacttaaggcaacgccgctggtggcgacgatcaccgtggtcgagatcttcgctgtctcgtcgcgggtgcggcaggacacattcgtgatctacgaaccgctcctgttgctggcgctggtctatatggtcattgcggggctgatcgcgctggcctttcgctggctggaaaaccgggtgcctacccggcggccgggcggctga

SEQ ID NO: 61068 - protein, 262 aa, Silicibacter pomeroyi DSS-3
MMRLIRPMLMPHRLVLIALAVALALWCALTLRWDWLPKYLPLAMEGLWRTVWLLAASTFLGFLLAVPLGFAQAVGPWYLAVPARVFCTLIRGTPLLLQIWLLYYGLGSVFPQIDGIRDSVLWPYLRQAWPYALLALTLSFAGYEGEVMRGAFSGVNRGQLEAARSFGMPRFTLFRRIWLPQAINNVLPTLGGETILQLKATPLVATITVVEIFAVSSRVRQDTFVIYEPLLLLALVYMVIAGLIALAFRWLENRVPTRRPGG

SEQ ID NO: 61069 - DNA, 810 bp, Silicibacter pomeroyi DSS-3
  CDS (1)..(810): transl_table=11
atgaaatcctgcatcgacaccatccaggattacggcctgcgttcgatcggcatcggcgagcggctgctgccccgctccgatttcaccctgtgcgagcagttcacgctgatcggttcgggcatgatctggaacatctatttcggtctgctggcgctggtctcgggttatttcctggccgtcacgctggcactgggcaaaagcgcggccaacccctgggcgcgcaaaccggcggaatggttcatcttcctgttccggggttcgccgctcttcatccagttcttctttgcctatttcttcttcctgtcgctgaagaagagctatccgatgttcgacttgctgacctcggcctgggcgggggcactgatcgtgctgttcatgaacaccgccgcctattcggccgagatcttctatggcgcgctgcgtgcgatccccaagggcgatgtcgaggccgccgacgcttatggcatgagcggctggccccgctttcgccgcatcatctggccgaccatgatgcggctggcctggcccgcctataccaacgaggcgatctttctgtttcacgccaccacgctggtcttcttttcggccttcccggcctggcaacagcgcggcgatgcgctgtactacgccagctatttcgccgacaagaccttcaacccgtttgtcccctaccctatcctggccttctatttcatcctgttgacactggccgtggtgggtatcttcggggtgattaacaccaggctcaaccgtcacctgccggcggaacggcgccccaagatgcgcttccgcctcaacctcgctcgctaa

SEQ ID NO: 61070 - protein, 269 aa, Silicibacter pomeroyi DSS-3
MKSCIDTIQDYGLRSIGIGERLLPRSDFTLCEQFTLIGSGMIWNIYFGLLALVSGYFLAVTLALGKSAANPWARKPAEWFIFLFRGSPLFIQFFFAYFFFLSLKKSYPMFDLLTSAWAGALIVLFMNTAAYSAEIFYGALRAIPKGDVEAADAYGMSGWPRFRRIIWPTMMRLAWPAYTNEAIFLFHATTLVFFSAFPAWQQRGDALYYASYFADKTFNPFVPYPILAFYFILLTLAVVGIFGVINTRLNRHLPAERRPKMRFRLNLAR

SEQ ID NO: 61071 - DNA, 666 bp, Bacillus clausii KSM-K16
  CDS (1)..(666): transl_table=11
atgcgttcatttgatctaaaccttgccattgaatcctttccgtttattttaaaaggcttgcaatatacgctttttgtggctgtaattagcatggccattgcactcgtgttcgggtttatactagcgcttggacgtatgtcaaaacaagcatatgttcgcataccgtgtatgctgtttatttctttcaaccgtggtgtgccgattttgctcttattgtttttactatatgccgctttgccggaatttgggtttcagctaagcgcagtagctgcagctattgtaggcttcagcctgaatacgtctgcgtacgtcgctgaagtgaaccgctccgccttggctgccgttgaccgtggacaacatgaagcagccgcttccctagggttgtcaaaaacaaaagccatgcagcatattattttgccacaggcggtccgtattgcattgccgccgcttagcaatatttttttaagcctggttaaaatgacgtcaatcgcgtccacgattgctttgcctgagctcatgtaccaagctcggatcgtcggcggcagggaatttaattattttaccgttctaatcgttgctgccttgatttattggggtatttgttcactgttgtctctgttgcaacgctacttagaaaaacggtttaatcgttatattgaaacttaa

SEQ ID NO: 61072 - protein, 221 aa, Bacillus clausii KSM-K16
MRSFDLNLAIESFPFILKGLQYTLFVAVISMAIALVFGFILALGRMSKQAYVRIPCMLFISFNRGVPILLLLFLLYAALPEFGFQLSAVAAAIVGFSLNTSAYVAEVNRSALAAVDRGQHEAAASLGLSKTKAMQHIILPQAVRIALPPLSNIFLSLVKMTSIASTIALPELMYQARIVGGREFNYFTVLIVAALIYWGICSLLSLLQRYLEKRFNRYIET

SEQ ID NO: 61073 - DNA, 822 bp, Dehalococcoides ethenogenes 195
  CDS (1)..(822): transl_table=11
atggcagaagacaagcttaaacaatctgaaaaaatgaatttgataccgggggctgaaccgtccagccggatggacccctggtggtggctggtagccggtgtttttgtcctgaccggcggccttatgctgtttcagcctgacccttttctggatattttcaaatacgtatgggtaggtatcggcataacggtcctggtggctgttgtatcttatttcctgatgcttatcctgggcatgttcggcgctttagggcgtttatccaaaaacaccattttgcgcggactggctacattttatgttgaaatagtacgcggcattcctttgctggtgcagctaatctggtggtatttcgccttcccggtcataattcaaagcatagggcaaggcctgaatttcgggccgatgatgaattatcaggcaaaccccattgtgatggctatctggggtatgaccttctgctacggggcatacatgagcgaaatttaccgggcgggtatccagagcatacccaaagggcaaatggaagcggcccgcagccttggtatgagccatacccaggccatgaggtatgtgatactgccgcaggcactcagggtggttctgccccctatgggcaatgaatttatcgccctgctcaaggatacttctttggtatccactgtagccgtagctgacatggtaaggctggggcgtgaatttaccgcaaccaatttcaatcctattgaagtctggactatgattggcctgctctacctgatactgacactcctgtccagccgtctgataaactacatagaaaagaaaactgcgttttcaagataa

SEQ ID NO: 61074 - protein, 273 aa, Dehalococcoides ethenogenes 195
MAEDKLKQSEKMNLIPGAEPSSRMDPWWWLVAGVFVLTGGLMLFQPDPFLDIFKYVWVGIGITVLVAVVSYFLMLILGMFGALGRLSKNTILRGLATFYVEIVRGIPLLVQLIWWYFAFPVIIQSIGQGLNFGPMMNYQANPIVMAIWGMTFCYGAYMSEIYRAGIQSIPKGQMEAARSLGMSHTQAMRYVILPQALRVVLPPMGNEFIALLKDTSLVSTVAVADMVRLGREFTATNFNPIEVWTMIGLLYLILTLLSSRLINYIEKKTAFSR

SEQ ID NO: 61075 - DNA, 660 bp, Rhodobacter sphaeroides 2.4.1
  CDS (1)..(660)
atgaacggctctcttctccaggatatcgcggcctacggaccgggctttctcaaggccgcctggctcgtcctgtggctgacgctgctcaccatcctcgtgagctgggcctgcggcctgctggccgcgctcgcccagcggtccgagctgcgtctcgtgcgcggcgccgccgccttctacatctggttcatccgcggcacgcccgccctcatccagatcttcatcatctatttcggcctgccgcagctcggcctgcgcctgtcgcccttcaccgcgggcgtcatcgcgctcggcatcaactcgggcgcctatgtggccgagatcgtccgctcgggcctctcggccatccaccgcggccagaccgagagcgcgctggcgctgggcttcagccagagccagaccatgcgtaccatcgtgctgccgcaggtcttccgcatcatcctgccctcgatcaccaacgaggcgatctcgacgctgaagaacacgtcgcttctgtccacgatcacggtggtcgagctcacgctctatgcccagaccctgatctcggcgaccttccggcccttcgacttctacatcgccgtggccgtcatctatcttgtcctcaccacggtgctcacccagatcgcgaactgggccgagcggcgctacgcaaggctgagctga

SEQ ID NO: 61076 - protein, 219 aa, Rhodobacter sphaeroides 2.4.1
MNGSLLQDIAAYGPGFLKAAWLVLWLTLLTILVSWACGLLAALAQRSELRLVRGAAAFYIWFIRGTPALIQIFIIYFGLPQLGLRLSPFTAGVIALGINSGAYVAEIVRSGLSAIHRGQTESALALGFSQSQTMRTIVLPQVFRIILPSITNEAISTLKNTSLLSTITVVELTLYAQTLISATFRPFDFYIAVAVIYLVLTTVLTQIANWAERRYARLS

SEQ ID NO: 61077 - DNA, 828 bp, Rhodobacter sphaeroides 2.4.1
  CDS (1)..(828)
atgagctgcatcgacacgatcgccgattacgggctgcgctcgctgggcctcggcgagcggctgctgccgcgcaccgatttcacgctctgccagcagttcacgctgatcggctcgggcatgatctggaacatctatttcggcgtgctggcgctggcggcgggcttcttccttgccaacgccctggccgtggccaaggccgccccctcgcctctcgtccgcaagcctgcggaatggttcatcttcctcttccgcggctcgcccctcttcatccagttcttcatcgcctatcaggcgctggtgatgctgccgcgggcgggcatcgacctctgggggatcacggtcgagaccgcctggctcacgcgggcgtgggccggcgcgctgatcgttctcttcttcaacaccgccgcctattcggccgagatcttccacggcgcgctgatggcgatccccaagggcgatctcgaggccgccgacgcctacggcctgtccggctggaagaagttccgccgcatccagtggccgacgatgctgcgcctcgcctggcccgcctataccaacgaggcgatctttctctttcatgcgacgacgctcgtcttcttctcgggctttcccgccttccagcagcgcggcgacgcgctctactatgccaactatttcgccgacaagacgttcaacccattcgtgccttaccccatcgtggccttctatttcatctgcctcacacttctcgtgatctggctcttcgggctgatgaaccggaggctgaaccgccacgttccgcaggcccaccggccgcgactgagggtcaggccgcagatcatcaggtga

SEQ ID NO: 61078 - protein, 275 aa, Rhodobacter sphaeroides 2.4.1
MSCIDTIADYGLRSLGLGERLLPRTDFTLCQQFTLIGSGMIWNIYFGVLALAAGFFLANALAVAKAAPSPLVRKPAEWFIFLFRGSPLFIQFFIAYQALVMLPRAGIDLWGITVETAWLTRAWAGALIVLFFNTAAYSAEIFHGALMAIPKGDLEAADAYGLSGWKKFRRIQWPTMLRLAWPAYTNEAIFLFHATTLVFFSGFPAFQQRGDALYYANYFADKTFNPFVPYPIVAFYFICLTLLVIWLFGLMNRRLNRHVPQAHRPRLRVRPQIIR

SEQ ID NO: 61079 - DNA, 747 bp, Leuconostoc mesenteroides subsp. mesenteroides ATCC 8293
  CDS (1)..(747)
atgaataatttttttcaaccacaccttatatgggaatatttgcctgatgtattgtcagcattaccgacaacgctgttgcttactctagtatcaacaatcattggcgtaatcgtcggcgcaggtattgcgtttgtcaaaatggaagatacaccaatctttaaacaaattgcagtagtcttcacttcttttattagagggacaccaattttgatacaaatgtttttagtttattatggactgcctatgtttctaggatatgtgggcattaacacagatgacgtcagcccattaatctatttatttattacatatgggttgaatatggcggcttttctttcagaaatcattcgtgccgcattggaaagcgtgccagcaagtcaacgtgaagcggctttaacttcaggttacacaaagcgtcagatgtattttaaaattattttccctcaggcagtaattattgcggtgcccagttttgcgacaatggtcatttcgttgctgcaagatacatcattggcattcacaatcggtgtattagatgttgttggtaaagccaaagcattgggtacggcgacatttcacacagttgaggcttacattagtgcgatgatcatatttattattttaagtttcattttagaaagattcttccgttggattgaaaagcgcagtaactttacgtcacgcaaaacaccaattttggctaataatcctgtgataccagtgattgagacaccaaaaacaacttaa

SEQ ID NO: 61080 - protein, 248 aa, Leuconostoc mesenteroides subsp. mesenteroides ATCC 8293
MNNFFQPHLIWEYLPDVLSALPTTLLLTLVSTIIGVIVGAGIAFVKMEDTPIFKQIAVVFTSFIRGTPILIQMFLVYYGLPMFLGYVGINTDDVSPLIYLFITYGLNMAAFLSEIIRAALESVPASQREAALTSGYTKRQMYFKIIFPQAVIIAVPSFATMVISLLQDTSLAFTIGVLDVVGKAKALGTATFHTVEAYISAMIIFIILSFILERFFRWIEKRSNFTSRKTPILANNPVIPVIETPKTT

SEQ ID NO: 61081 - DNA, 660 bp, Leuconostoc mesenteroides subsp. mesenteroides ATCC 8293
  CDS (1)..(660)
atgagttttagttatgaaatgattttagattacgccccatttttcatgcatggtttactatacactttgctgttttccctttgtggggtagtttttggaacgatatttggactgattattgcacttggccgtatgtcgaaaaaccccgttatttctggaatatttaaaacctatattggtttgtttcgtggcacaccattgtttgtacaaattttgattaccaactttggtgtcgtaccggcaatttttggacattccaatccatatatagccggtgccctgtccttgtccctgaatgcagcggcctacattgctgaaacatttcgttcaggtattcaatccatttctgaagggcaacgtgaggcggctagaacattgggtttgtctcaatttgatacgatgcgttttatcatagtgccgcaagccataaagatagtgataccggcattaggaaacgaatttattagtttaatcaaagattcatctttggtatcagcaatatccgcaccagaaattacgtattgggctcaagctatgaatgcacaatactatgttgtttggacgccatatctcacagttgccgtactgtatttgattttgaccttgtcagcaagtcgactaatgaaactatgggaaaggaaaatggcgcaaaatgattaa

SEQ ID NO: 61082 - protein, 219 aa, Leuconostoc mesenteroides subsp. mesenteroides ATCC 8293
MSFSYEMILDYAPFFMHGLLYTLLFSLCGVVFGTIFGLIIALGRMSKNPVISGIFKTYIGLFRGTPLFVQILITNFGVVPAIFGHSNPYIAGALSLSLNAAAYIAETFRSGIQSISEGQREAARTLGLSQFDTMRFIIVPQAIKIVIPALGNEFISLIKDSSLVSAISAPEITYWAQAMNAQYYVVWTPYLTVAVLYLILTLSASRLMKLWERKMAQND

SEQ ID NO: 61083 - DNA, 642 bp, Leuconostoc mesenteroides subsp. mesenteroides ATCC 8293
  CDS (1)..(642)
atgagttatctaactacaattcttcccagtttattggctggactaaaaacgacgctaggggtgttcttcctaacaatcattggatctgtaccattgggaattttagtatccttagggatgaaatcaccttactttacaatacgttggttgattaacggttatatctggattatgcgtggtacgccgttacttttacaattgatttttatctactatggtcttggaatgatgggtatagcatttccacgatttgaagctgctatcatagcgtttattatcaattatgcagcctatcttgctgaaattttccgtggtggactacaatcagtcccaagagggcaatatgatgctgctaaagtacttggctttagtaaaatacaaacattttttaaaataattttgccacaagtaatcaagattgttgttccttcatttggtaatgaagtgattaacttggtcaaggacacttctttagtttatgttattggcttaggtgacatcttgcgagcaggaaatattgcggctagtcgtgacgtcactttgatgccatatctattagttggattgatatatttgattatgacggcggttgtcacattattattgcgccgtagtgaaacagttttgaatacatggaggtaa

SEQ ID NO: 61084 - protein, 213 aa, Leuconostoc mesenteroides subsp. mesenteroides ATCC 8293
MSYLTTILPSLLAGLKTTLGVFFLTIIGSVPLGILVSLGMKSPYFTIRWLINGYIWIMRGTPLLLQLIFIYYGLGMMGIAFPRFEAAIIAFIINYAAYLAEIFRGGLQSVPRGQYDAAKVLGFSKIQTFFKIILPQVIKIVVPSFGNEVINLVKDTSLVYVIGLGDILRAGNIAASRDVTLMPYLLVGLIYLIMTAVVTLLLRRSETVLNTWR

SEQ ID NO: 61085 - DNA, 996 bp, Bifidobacterium longum DJO10A
  CDS (1)..(996)
atggcgaagaaagaagtcgacggtgagggagtgaacatccccaaccgcatcaaggcgctgccggtcaagcgccccggcccgattgtggccgcagtgatcgtggtgctgctcgccgcgatgctcattcaaggcttgattaccaatccgcgactggattggcccaccgtctggaagtacctgttcaacgagaacgtgcttgaaggcattcgctataccttggagctcaccgtgatctccatggtcgtggcgatcatcctgtcggtgattctcgccatcatgcgcaaatccatcaatccggtgctgcgcggcgtcagctggttcttcatctggttcttccgcggcacgcctgtgtacacgcagctcattttctggggtctgttcgccgtgctgattcccaagattagcctcggcattccgttcacctcggtggagttctggagcatcgactccaacgtggtggtcaccgcattcaacgccgcatggattggtttggctctgaacgaggccgcctacctgtccgaaatcgtgcgtgccggccttgaagccgtggaccccggccagaccgaggcggccaaggcattgggcatgaaccgcacgctcatcatgcgccgcatcgtgctgccgcaggctatgcgcatcatcatcccgcccaccggcaacgagaccatcggcatgctgaagaccacctcgctggtcaccgccgtgccgttcaccctcgaactgcagttcgccaccaacgccatcgccaaccgtatctacaagccgattccgctgcttctcgtggcctgcttctggtacctgctgatcacctccattctgatggttgtgcagtcccgccttgaggcgcacttcggcaagggcttcaacgcccgcccggtgggcaccaagggcaagcagccgccatacgatccgccgtaccccggcaagtctgacggcgagccgaaggacgatgtgaacaaaatcaatcagaccaccttcgctgggctgaatgcgtaa

SEQ ID NO: 61086 - protein, 331 aa, Bifidobacterium longum DJO10A
MAKKEVDGEGVNIPNRIKALPVKRPGPIVAAVIVVLLAAMLIQGLITNPRLDWPTVWKYLFNENVLEGIRYTLELTVISMVVAIILSVILAIMRKSINPVLRGVSWFFIWFFRGTPVYTQLIFWGLFAVLIPKISLGIPFTSVEFWSIDSNVVVTAFNAAWIGLALNEAAYLSEIVRAGLEAVDPGQTEAAKALGMNRTLIMRRIVLPQAMRIIIPPTGNETIGMLKTTSLVTAVPFTLELQFATNAIANRIYKPIPLLLVACFWYLLITSILMVVQSRLEAHFGKGFNARPVGTKGKQPPYDPPYPGKSDGEPKDDVNKINQTTFAGLNA

SEQ ID NO: 61087 - DNA, 684 bp, Haemophilus somnus 129PT
  CDS (1)..(684)
atgattaaagattattttttaacaattgcacaaggaattccaacaagcttaattcttactatagttgccttgctggtagcattttttcttgctttgacattaacttttgctctttctatggaaaaaaaatggttaagtcttccaattaatctttttctcacaatttttactggtacaccattactggtgcaatttttcttaatctatgcaggaccgggacaattttcttggattgtaaatagttttttatggcctttattatcaagtgcgtggttttgtgcaatacttacattagctttaaatagtacagcgtattcaactcagcttttttatggtgcggtaaaagcgatttctaaaggacaatgggaaagctgtgttgcactaggtttgagccgttggcaaactttgaaaattcttgttccttacgcattaaaaagagcattaccttcatatagcaatgaaataattcttgtctttaaaggcacatcgcttgcttcaattatcactattttggatattatggggtatgcaagacaactttatggtactgaatatgatgcactgacaatttatggtatcgcaggcgtaatctatctcattattacaggtattgctactttattattacgcagattggagcgtaaggtgcttgtatttgagcgtttagaaacggagcgagtgtaa

SEQ ID NO: 61088 - protein, 227 aa, Haemophilus somnus 129PT
MIKDYFLTIAQGIPTSLILTIVALLVAFFLALTLTFALSMEKKWLSLPINLFLTIFTGTPLLVQFFLIYAGPGQFSWIVNSFLWPLLSSAWFCAILTLALNSTAYSTQLFYGAVKAISKGQWESCVALGLSRWQTLKILVPYALKRALPSYSNEIILVFKGTSLASIITILDIMGYARQLYGTEYDALTIYGIAGVIYLIITGIATLLLRRLERKVLVFERLETERV

SEQ ID NO: 61089 - DNA, 630 bp, Haemophilus somnus 129PT
  CDS (1)..(630)
atgaccttagggttggcggtttgttctttattactcggattggcattatctattttctttgtagtattagaaacacacaaatgggcatgtattcgtaaaccgacagccactattgtgacattattacgagggttacctgaaattcttgtggttttcctaatttattttggcgtacctgaaatactggaatgggtaatcggagaatatgtagagtttggtgcctttggttgtggcgtggttgcactgtctattatttttgcttcttatgcttctcaatctttgcgtggagcaattcaggctatacctttaggacagtgggaatccggtgcggcattaggtttgagtcgtagttatacgtttatttttcttattatgccgcaagtttggcgacacgctttaccgggattgagtaatcaatggttagtgttattaaaagataccgcacttgtgtcgttaatcggtgtgcatgacctaatgcgtcaagctgaattaatcaataccaatactcaccaaccttttacttggtatggatttgcagcattgctttatttgttgattacgctatttagtcaatttattattcgtaaacttgagcggcgagtcacacgctttgaacgtgctacaaattaa

SEQ ID NO: 61090 - protein, 209 aa, Haemophilus somnus 129PT
MTLGLAVCSLLLGLALSIFFVVLETHKWACIRKPTATIVTLLRGLPEILVVFLIYFGVPEILEWVIGEYVEFGAFGCGVVALSIIFASYASQSLRGAIQAIPLGQWESGAALGLSRSYTFIFLIMPQVWRHALPGLSNQWLVLLKDTALVSLIGVHDLMRQAELINTNTHQPFTWYGFAALLYLLITLFSQFIIRKLERRVTRFERATN

SEQ ID NO: 61091 - DNA, 594 bp, Desulfovibrio desulfuricans G20
  CDS (1)..(594)
atgacgctgcaggtgacaacgctcggcattctgctgggctttgtgctggggctgggtacctcttttctgcgcatttccgacaaaaagattctcaacctgcccgccagggcctacatatatctcatcagaggaaccccgctgcttctgcagctgctgttcatctatttcgggctgcgcagtctggccggtctggaagcaataacctctgcagtgctggcgcttggtatccataacggcgcatacatagcggaaatattccgcggagccatcagctccatctccaccggccagatggaagccgcccgcagtctgggcatgtcctacccgcgggccatggtgcgcattattctgccgcaggcgctcaagcgggccattccgccgctgggcaaccagttcatcatcgcgcttaaagattcctcactggccagtaccatcaccatcaacgaactgctgctcaagtcgcagcaactcgcctcgtccaatttcatgatgatggaaatgcttgccatcgcggcactgttttacctgctgtataccgcggtgttcagctggctgttccacaggcttgaagcaaaactcgatactggcagttaa

SEQ ID NO: 61092 - protein, 197 aa, Desulfovibrio desulfuricans G20
MTLQVTTLGILLGFVLGLGTSFLRISDKKILNLPARAYIYLIRGTPLLLQLLFIYFGLRSLAGLEAITSAVLALGIHNGAYIAEIFRGAISSISTGQMEAARSLGMSYPRAMVRIILPQALKRAIPPLGNQFIIALKDSSLASTITINELLLKSQQLASSNFMMMEMLAIAALFYLLYTAVFSWLFHRLEAKLDTGS

SEQ ID NO: 61093 - DNA, 669 bp, Desulfovibrio desulfuricans G20
  CDS (1)..(669)
atgatgcaacaactcacaaccgtactcgaagccatgccctacatcctgcagggggggctggtctctctgctcattgtggccggcgccatgatgctggggctggccatgggcatacccatggcagtgggacaggtgtacggttcgccttttctgcgcaggctcatcggcctgtatgtatggttcttccgcggcgttcccattctggttctcatgtttcttttctatttcggcgtgtttgaactgctgggcctgaacctgagcgccatttccgccacggcgctggtgctgggcatgaccagcgccgcctaccagtcgcagattttccgcggttccatacaggcgctgcccgcagggcagcttaaagcggcacgggccatgggcatgagcgattcgcaggccatacgggccgttatactgccgcaggcgctgcgcctttccctgccgggctggtccaacgaatattccatcatactcaaagactcggctctggcctatgtggtcggcgccatggacattttcacgcgtacgcactttgtggcatcgcgcacctacgagcatctgccgctgttcatcgcggccggagcactgtatttcgtcatcaccctgaccggcgtcaaactgcttgccgcacttgagaaaaaagtccgcattccgggctacaccacataa

SEQ ID NO: 61094 - protein, 222 aa, Desulfovibrio desulfuricans G20
MMQQLTTVLEAMPYILQGGLVSLLIVAGAMMLGLAMGIPMAVGQVYGSPFLRRLIGLYVWFFRGVPILVLMFLFYFGVFELLGLNLSAISATALVLGMTSAAYQSQIFRGSIQALPAGQLKAARAMGMSDSQAIRAVILPQALRLSLPGWSNEYSIILKDSALAYVVGAMDIFTRTHFVASRTYEHLPLFIAAGALYFVITLTGVKLLAALEKKVRIPGYTT

SEQ ID NO: 61095 - DNA, 693 bp, Desulfovibrio desulfuricans G20
  CDS (1)..(693)
atgcagtggaatgttgtctgggacaatcttgattatctgcttatcggttcataccccgaagggcctctcggcggtattgcgctcagtatcgttctgtcactgggcggcatactgggtgcgttctggctggggcttgccctggggctgatgcgtctttcaaaacgctggccggtgcggttgccggcggtgctgtttattgaaattatccgcggaacgccgctgttgcttctgctgttctggttttattttcttgcacctgtggtgttggggcagacgctgcccgaagtggaatgtgcattgataacctttgtggtctttaccagtgcatatatagcggaaatagtgcgtgcaggtgtgcttgcactgccgcaagggcagatggaagcggcccgcggtacgggcctgaccaaactgcaggccatgcgttttgtcattttgccgcaggcgctgcgcaacatgataccttcatttgtgaaccagtttgtcagcctgaccaaagatacctcgctggcatacgtgataggtgtggcggagctgacccgcgccgcggtgcaggtgaacaaccgcaccctttccgcacccatggagatatactttaccatccttgtcatgtactttcttatctgttacgcgctcacttccgccagccgccggctggaaaagcagatgaagcgctatcaggcaagaggataa

SEQ ID NO: 61096 - protein, 230 aa, Desulfovibrio desulfuricans G20
MQWNVVWDNLDYLLIGSYPEGPLGGIALSIVLSLGGILGAFWLGLALGLMRLSKRWPVRLPAVLFIEIIRGTPLLLLLFWFYFLAPVVLGQTLPEVECALITFVVFTSAYIAEIVRAGVLALPQGQMEAARGTGLTKLQAMRFVILPQALRNMIPSFVNQFVSLTKDTSLAYVIGVAELTRAAVQVNNRTLSAPMEIYFTILVMYFLICYALTSASRRLEKQMKRYQARG

SEQ ID NO: 61097 - DNA, 756 bp, Desulfovibrio desulfuricans G20
  CDS (1)..(756)
atggcgcgcgccatccctatgccgtttttcatgcaccgccatgcggatgcgacacactcacccgggcgcacaacaagaggttttatggcttttcaattcaaacccgaagtgatgctggataccgcccccctgctgtgggacggcattgagctcaccatcatcatcacggtgcttggtcttgtcttcggctttattatcggcaccctggtcggcctcggacgtatatcccgcaaccgtctgtgcaacgctgtagctgtttcctatgtcgaagccatccgcggcacaccgcttatcgtacaggtcatgtttctgtacttcggcctgcctctggttctcggcatccgcattcctcccgtcactgccggcgttgtggccatagcggtaaactccggtgcctatatcgcagaaatagtgcgcggttccatccagtccatcaacaccggacaaatggaagcagggcgctccatcgggctcacacatctgcagaccatgctgtatatcatctggccgcaggcgttcaaacgcatgataccgccgctgggcaaccagttcatcatcagcctgaaggacacttcgctgctggttgtcatcggggtgggcgagctgacccgtcagggacaggaaatcatcgctgtcaacttccgggcgttcgaggtgtggcttaccgttgccatcatgtacctgtgcatgaccctgactctgtcgcaggtgctgcgcatgtacgaacgcaaactcaatgcccgcaccagccgctga

SEQ ID NO: 61098 - protein, 251 aa, Desulfovibrio desulfuricans G20
MARAIPMPFFMHRHADATHSPGRTTRGFMAFQFKPEVMLDTAPLLWDGIELTIIITVLGLVFGFIIGTLVGLGRISRNRLCNAVAVSYVEAIRGTPLIVQVMFLYFGLPLVLGIRIPPVTAGVVAIAVNSGAYIAEIVRGSIQSINTGQMEAGRSIGLTHLQTMLYIIWPQAFKRMIPPLGNQFIISLKDTSLLVVIGVGELTRQGQEIIAVNFRAFEVWLTVAIMYLCMTLTLSQVLRMYERKLNARTSR

SEQ ID NO: 61099 - DNA, 672 bp, Haemophilus somnus 2336
  CDS (1)..(672)
atgtttattgattatttacctttaatgtataccgcaaccctgatgaccttagggttggcggtttgttctttattactcggattggcattatctattttctttgtagtattagaaacacacaaatgggcatgtattcgtaaaccgacagccactattgtgacattattacgagggttacctgaaattcttgtggtttttctaatttattttggcgtacctgaaatactggaatgggtaatcggagaatatgtagagtttggtgcctttggttgtggcgtggttgcactgtctattatttttgcttcttatgcttctcaatctttgcgtggagcaattcaggctatacctttaggacagtgggaatccggtgcagcattaggtttgagtcgtagttatacgtttatttttcttattatgccgcaagtttggcgacacgctttaccgggattgagtaatcaatggttagtgttattaaaagataccgcacttgtgtcgttaatcggtgtgcatgacttaatgcgtcaagctgaattaatcaacaccaatactcaccaaccttttacttggtatggatttgcagcattgctttatttgttgattacgctatttagtcaatttattattcgtaaacttgagcggcgagtcacacgctttgaacgtgctacaaattaa

SEQ ID NO: 61100 - protein, 223 aa, Haemophilus somnus 2336
MFIDYLPLMYTATLMTLGLAVCSLLLGLALSIFFVVLETHKWACIRKPTATIVTLLRGLPEILVVFLIYFGVPEILEWVIGEYVEFGAFGCGVVALSIIFASYASQSLRGAIQAIPLGQWESGAALGLSRSYTFIFLIMPQVWRHALPGLSNQWLVLLKDTALVSLIGVHDLMRQAELINTNTHQPFTWYGFAALLYLLITLFSQFIIRKLERRVTRFERATN

SEQ ID NO: 61101 - DNA, 726 bp, Psychrobacter sp. 273-4
  CDS (1)..(726)
atggattggaattggcaggtgatttttgaccatatcccagatttactcggtggcgcggttttaaccgtacagctggtcattttctcaggggttatcgggctgttttttggtttggttttggcgctgttacggctgtctaaaaactggatggtacagatactcccttttctgtatatcttctttttccgtggcacaccgctactagtacagatatttttgatttactacggtcttgggcagtttgaagctgtacgtgagtctttcttatgggagccggtactaagtcaagcctattggtgtgccatcattgcttttaccctaaataccagtgcttatttggcggagattatccgcggtgcaatccaaaatattccggtgggtgagcttgaagctgccgatgcgattgggatgtcaaagtggcaaaaactgacgcgcattacgttaccgcgtgcctttggtatcgtgattccagtgtacagtaatgaagttatctttatgctaaaaggtagtgcgctagcgtcaaccattgctttgatggatatcactggcgttgcccgtaccattagtgcgcgtacttataccttgatggagctgttcttcgctgcaggtatcgtttatcttttattgtcgtgggtgattttattcagctttagaatgtttgaaaagcgtatgaatcgtcacgcaagctatgtgccaccagatgtgagcacgcatacggttggctaa

SEQ ID NO: 61102 - protein, 241 aa, Psychrobacter sp. 273-4
MDWNWQVIFDHIPDLLGGAVLTVQLVIFSGVIGLFFGLVLALLRLSKNWMVQILPFLYIFFFRGTPLLVQIFLIYYGLGQFEAVRESFLWEPVLSQAYWCAIIAFTLNTSAYLAEIIRGAIQNIPVGELEAADAIGMSKWQKLTRITLPRAFGIVIPVYSNEVIFMLKGSALASTIALMDITGVARTISARTYTLMELFFAAGIVYLLLSWVILFSFRMFEKRMNRHASYVPPDVSTHTVG

SEQ ID NO: 61103 - DNA, 666 bp, Haemophilus influenzae R2846
  CDS (1)..(666)
atgttttctgactttctttctttaatgtttaccgctgccctaatgactttagggcttgcggtctgttcattgatcttaggcttatttttaagccttatttttgtcgcacttgaagcaaatcgttttgttggcaagccgatgacagtatttgtggcattattacgtggcttacccgaaattattgttgtattacttgtctattttggttctactgaattagtcgaaatgctaactggcgaatacatcgaatttggggcatttggctgtggtgtgcttgcgctttctcttatttttgcagcttatgcttcacaaacattacgtggtgcaattcaagccataccaaaaggacaatgggaatcaggtgcagcgttaggcttaagcaaaagctatacgttcattcatattgttatgccacaagtatggcgtcacgccttacctggtttaagcacccaatggcttgtattgctaaaagatacggcattggtttcattaattggtgtggacgatttgatgcaccaagcggatctgattaataccaatactcatcaaccctttacttggtacggtattgctgcgttaatttatttagcggtaacattaattagccaagttggtattcgaaaattagagctgcgttttactcgttttgaaaggggcatgaaataa

SEQ ID NO: 61104 - protein, 221 aa, Haemophilus influenzae R2846
MFSDFLSLMFTAALMTLGLAVCSLILGLFLSLIFVALEANRFVGKPMTVFVALLRGLPEIIVVLLVYFGSTELVEMLTGEYIEFGAFGCGVLALSLIFAAYASQTLRGAIQAIPKGQWESGAALGLSKSYTFIHIVMPQVWRHALPGLSTQWLVLLKDTALVSLIGVDDLMHQADLINTNTHQPFTWYGIAALIYLAVTLISQVGIRKLELRFTRFERGMK

SEQ ID NO: 61105 - DNA, 669 bp, Ralstonia eutropha JMP134
  CDS (1)..(669)
atggaactggatttttctcccgtcttcagcggctggcctgacatcgtccacggtgccatcgtcaccgtggaagtgacagcctgcgcgctggtattgggctgcgtcatgggcctgctggtcggtatcggccggctcgacccgaagcgtcgcgtcatctacagcatctgtacggcctatgtgacgttcatccgcggcacgccgctgctggtacagctgttcctgctgttcttcgggctgccgcaattcaacatcatgctgccggcctttgtctgcggcgtgatcgggctgggcgtctattccggcgcctatgtatcggaaatcgtgcgaggcgcaatccagtcggtggaaaaaggccagatggaagcggcccgctcgatcggcatgtcttcgggccaggccatgcgcgcggtgatcctgccgcaggccatcgtgcggatgattccgccgctgggtaacgagttcatcgcgctgatcaagaactcggcactggtctcgctgctgaccattgccgacctgatgcacgagggccagaagatcatcagcgtgtcgtaccggtcgctggaagtctatctggcgatcgcgctggtttatctgatcctgacgagcgcggccgggctgatcctgcggcgcgcagaacaacgcctgcgcatgggaggcatggtgcaatga

SEQ ID NO: 61106 - protein, 222 aa, Ralstonia eutropha JMP134
MELDFSPVFSGWPDIVHGAIVTVEVTACALVLGCVMGLLVGIGRLDPKRRVIYSICTAYVTFIRGTPLLVQLFLLFFGLPQFNIMLPAFVCGVIGLGVYSGAYVSEIVRGAIQSVEKGQMEAARSIGMSSGQAMRAVILPQAIVRMIPPLGNEFIALIKNSALVSLLTIADLMHEGQKIISVSYRSLEVYLAIALVYLILTSAAGLILRRAEQRLRMGGMVQ

SEQ ID NO: 61107 - DNA, 672 bp, Ralstonia eutropha JMP134
  CDS (1)..(672)
atggatcgcatcatgagcccttttgatctgattattcatgcctccccggtgctcttgcagggcgccgcgatcaccgtgaagttcgccctggcctcgatgatcttcggcctgttggtcgggatcgtcgttgccatcatgggaatcagtgccagtcctgtcctcagtggcatcgcacgcgcctatgtcagcgtcatgcgggggacgccgctgcttgtgcagatgtttgtcgtctactacggtctgcccgatctcggcatcaatctcgaacccactactgccggcatccttactctcacggccaatgccggcgcttacctctcggaaagcatgcgcggcgcgatcctgggtatcagccgcgggcaatggagcgcggcgcacagtctcgggcttagtcacctgcagacactgcgttacatcgtctgcccgcaggcgctgcggctggccgtaccgagcctcggcaatacgctaatcagcctgatcaaggacacctcgctggtttccgtcatcaccgtaaccgagttgctgagatcgtcgcaggagatcattgcctcgactttccaaccgcttccgctctacctgtcagtagccgccatttactggttgctgagcacaggattgtcgtgggtgcagcggcgcatcgaggcgcggctgacactgcgcgtgacacgctga

SEQ ID NO: 61108 - protein, 223 aa, Ralstonia eutropha JMP134
MDRIMSPFDLIIHASPVLLQGAAITVKFALASMIFGLLVGIVVAIMGISASPVLSGIARAYVSVMRGTPLLVQMFVVYYGLPDLGINLEPTTAGILTLTANAGAYLSESMRGAILGISRGQWSAAHSLGLSHLQTLRYIVCPQALRLAVPSLGNTLISLIKDTSLVSVITVTELLRSSQEIIASTFQPLPLYLSVAAIYWLLSTGLSWVQRRIEARLTLRVTR

SEQ ID NO: 61109 - DNA, 660 bp, Ralstonia eutropha JMP134
  CDS (1)..(660)
atgtccgcgctccagctcatctccgattccatgcccgtgctgctgcagggcacgctactgaccatcaagttcgcgctgtggtcgatggccttcgggctggtgctgggcatggtcgtggcgctcatgggcatcagccacaaccccgtgctgaagggcatcgcacgcacgtacgtcagcatcatgcgcggcacgccgctgctggtgcagatctttgtcgtctactacggcttgcccggtatcggcgtcgcgctggagccgacgcctgcgggcgtactgacgctgagcctcaatgtgggcgcatatttgtccgagagcatgcgcggggcgattctcggcattgcgcgcgggcagtggctcgcggcctatagccttgggctgacgcccggccagacactgcgttacgtggtcggcccgcaggccctgcgtcttgcggtgccgagtctttccaacagcctgatcagcctgatcaaggacacctcgctggtgtcggtcattaccgtgacggagctgttgcgcacggcgcaggaggtcattgcggcgacttatcagccgttgccgctttatcttgcggtggcggcgatctactgggtgctcagcaccgggctgtcgggactgcagcatgtgctggagcgcaggctgtcgttgccgggccgccactga

SEQ ID NO: 61110 - protein, 219 aa, Ralstonia eutropha JMP134
MSALQLISDSMPVLLQGTLLTIKFALWSMAFGLVLGMVVALMGISHNPVLKGIARTYVSIMRGTPLLVQIFVVYYGLPGIGVALEPTPAGVLTLSLNVGAYLSESMRGAILGIARGQWLAAYSLGLTPGQTLRYVVGPQALRLAVPSLSNSLISLIKDTSLVSVITVTELLRTAQEVIAATYQPLPLYLAVAAIYWVLSTGLSGLQHVLERRLSLPGRH

SEQ ID NO: 61111 - DNA, 657 bp, Exiguobacterium sp. 255-15
  CDS (1)..(657)
atgatagactttacaaagattcaagattcaatcccatatattctgcaaggaattccagttctatttcaagttgtcatcgtcgctgcgattgccggtatgttaatcgggatcgtcgttgcggcattaaaaattacgaaaaacggatttgttcgatttattggtcatgcctatacggcagttttccgcggaacgccgctcattttacaactggcgatcattcactttgggttaccgcagttgacggggtatgtgacgacggggtatcaatccgccatcatcgccttttccttaaactccggggcttacatttcggaaatcatccgggccggcattcaagccgttgaccgcggacagtgggaagcagcagacgcccttggtattccttacatgaaacagttacggtcgatcatcttgccgcaagcgttcaaaaatatcctgccggcgatcatgaacgagctgatcacattaacaaaagaatccgctttgatttcgaccgtcggtgtcctcgacgtcatgcgccgggcgcaagtcgtcggtggagagaaggccttgtattttgaaccgttattgtttgcaggattcgtctatttcgtacttgtcatgggattgtccttgattggtcaacaagtcgaaaaagctatgagaaagagtgggtaa

SEQ ID NO: 61112 - protein, 218 aa, Exiguobacterium sp. 255-15
MIDFTKIQDSIPYILQGIPVLFQVVIVAAIAGMLIGIVVAALKITKNGFVRFIGHAYTAVFRGTPLILQLAIIHFGLPQLTGYVTTGYQSAIIAFSLNSGAYISEIIRAGIQAVDRGQWEAADALGIPYMKQLRSIILPQAFKNILPAIMNELITLTKESALISTVGVLDVMRRAQVVGGEKALYFEPLLFAGFVYFVLVMGLSLIGQQVEKAMRKSG

SEQ ID NO: 61113 - DNA, 687 bp, Exiguobacterium sp. 255-15
  CDS (1)..(687)
ttgaacagtttctctgagattgaatggcggtctgtctttaacccggaattagcaaaagaagcgtttccctacatcttaggagggctcggtcatacgctttggatttcgatactcagcatgttgattggtcttggacttggcttattgcttgctttggcacgcttatctgcatcacgtctgttacggacagtcgccactctctacatctccttcatgcgcggtgtaccgattctcgtcttattattcatgttttactttggtttaccggtcatcaacattcaactcgatgccttgaccgctgccattgccggtttcagtctgaacagtgctgcctatatggctgaaatcattcgttcgtcacttttgtccgttgatcgcgggcaacaagaagcggcacaatcgctcgggctttccagataccgtgtgttcgtcggcattatcttgccgcaggccgtccgcctggcaatccccccgttatcaaatgtccttcttgatttggtaaaagcctcttcgctcgctgccatgattacggtgccggagatttttcaacgggcaaaaatcgtcggcggacgggagtttgactacatgacagtttattttgtcatcgccttcatctactggggaatctgtgccgtcatcgccgccggacaagaaatgctcgaacggcgtttcgcccgctatctataa

SEQ ID NO: 61114 - protein, 228 aa, Exiguobacterium sp. 255-15
MNSFSEIEWRSVFNPELAKEAFPYILGGLGHTLWISILSMLIGLGLGLLLALARLSASRLLRTVATLYISFMRGVPILVLLFMFYFGLPVINIQLDALTAAIAGFSLNSAAYMAEIIRSSLLSVDRGQQEAAQSLGLSRYRVFVGIILPQAVRLAIPPLSNVLLDLVKASSLAAMITVPEIFQRAKIVGGREFDYMTVYFVIAFIYWGICAVIAAGQEMLERRFARYL

SEQ ID NO: 61115 - DNA, 645 bp, Exiguobacterium sp. 255-15
  CDS (1)..(645)
atggaagtcgcaaaaacggcgtttccgttttttctagaagggttacagatcaccctctatatctttatcatcgcggtcatcgtcggatttttaatcggcttgatcgtcgccttgatgcgtttatcaccacttaagattttaaacgggattgccatcgtctacatcgatgtcatccggggaacgccctttatcgtccaattgttcttcatttattttggactcaattcacttgagtggctgtcgatggaccggatgtatgccgggattctcactgtcgccatcaatgccggagcctatttcgccgagatcatccgggccgggattcaatcgattgataaagggcagacagaagcggcacgttctctcggtatgacggggcgtcaaacgatgacacaaatcgttttaccgcaagccttccgccgtatgctgccgacgattacgaaccaatcgatcatcagtttaaaagatacgtcgttgctatcgatcatcggtatcgcggatttgacgcaacagggacaagtgcaacaagcaacgacatttgaaccgttcatcgtctggacggtcgtcggtctgatgtacttcgtcgtcatctatctcctttcactattagggaaattcttggagcggaggtttacactgcgatga

SEQ ID NO: 61116 - protein, 214 aa, Exiguobacterium sp. 255-15
MEVAKTAFPFFLEGLQITLYIFIIAVIVGFLIGLIVALMRLSPLKILNGIAIVYIDVIRGTPFIVQLFFIYFGLNSLEWLSMDRMYAGILTVAINAGAYFAEIIRAGIQSIDKGQTEAARSLGMTGRQTMTQIVLPQAFRRMLPTITNQSIISLKDTSLLSIIGIADLTQQGQVQQATTFEPFIVWTVVGLMYFVVIYLLSLLGKFLERRFTLR

SEQ ID NO: 61117 - DNA, 729 bp, Rubrobacter xylanophilus DSM 9941
  CDS (1)..(729)
atgcccgactggtggccgccggtagagatcaacccgcaggacctctcgccggagaggctggtcggctactacctggacttcggggtggtcctggagaaccccgcccccctcctcaaggggctcgccgtgaccctctcgctggcggccctggcggaggtcgtcgggatagtgctggggctctttctggcgctgctcaagatctcgcgctccaggctcctgagcctcccggcgcaggtctacatagacgtcttccggggaaccccgctgctggtccagatcacgatcatctacttcaccacggcggcggtgggcatccggttcacgagcctcttcttcgccgggctcaccgccctctccctcaacagcgccgcctacgtggcggagatcttccgggccggcatacagtccatagacaagggccagatggaggccggaagggcctcggggctctcctacgcccagacgatgcgctacatcatcgtgccgcaggccttccggagggtcatccccccgctgaccaacgagttcgtcaccctcataaaggacacctcgctggtgagcgtgatcgggctggccgagctgctgcgggccgcccgggtgctccagtcggccacgttcaacgggacgccgctgatcgcggcggcgctcatctacctggcggtctgcctgcccctgatctacctgaccaacatcctggagcggcgcctgaaccgcaggacggcggcctag

SEQ ID NO: 61118 - protein, 242 aa, Rubrobacter xylanophilus DSM 9941
MPDWWPPVEINPQDLSPERLVGYYLDFGVVLENPAPLLKGLAVTLSLAALAEVVGIVLGLFLALLKISRSRLLSLPAQVYIDVFRGTPLLVQITIIYFTTAAVGIRFTSLFFAGLTALSLNSAAYVAEIFRAGIQSIDKGQMEAGRASGLSYAQTMRYIIVPQAFRRVIPPLTNEFVTLIKDTSLVSVIGLAELLRAARVLQSATFNGTPLIAAALIYLAVCLPLIYLTNILERRLNRRTAA

SEQ ID NO: 61119 - DNA, 642 bp, Haemophilus influenzae R2866
  CDS (1)..(642)
atgtttaccgctgctctaatgactttagggcttgcggtctgttcattgctcttaggcttatttttaagccttatttttgccgtgcttgaagcaaatcgctttgttggcaagccgatgacagtatttgtggcattattacgtggcttacccgaaattattgttgtattacttgtctattttggttctactgaattagtagaaatgctgacaggagaatacattgaatttggtgcatttggctgtggcgtgcttgcgctttctcttatttttgcagcttatgcttcgcaaacattacgcggcgcaattcaagccataccaaaaggacaatgggaatcaggtgcggcgttaggcttaagcaaaagctatacgttcattcatattgttatgccacaagtatggcgtcacgccttacctggtttaagcacccaatggcttgtattgctaaaagatacggcattggtttcattaattggtgtggacgatttgatgcaccaagcggatctgattaataccaatacacatcagccttttacttggtatggtattgctgcgttaatttatttggcagtgacattaattagccaagttggtattcgaaaattagagctgcgttttactcgttttgaaaggggcatgaaataa

SEQ ID NO: 61120 - protein, 213 aa, Haemophilus influenzae R2866
MFTAALMTLGLAVCSLLLGLFLSLIFAVLEANRFVGKPMTVFVALLRGLPEIIVVLLVYFGSTELVEMLTGEYIEFGAFGCGVLALSLIFAAYASQTLRGAIQAIPKGQWESGAALGLSKSYTFIHIVMPQVWRHALPGLSTQWLVLLKDTALVSLIGVDDLMHQADLINTNTHQPFTWYGIAALIYLAVTLISQVGIRKLELRFTRFERGMK

SEQ ID NO: 61121 - DNA, 693 bp, Burkholderia cepacia R18194
  CDS (1)..(693)
atgtcgacaacgtccctgctcgtccaatcgctgccggtgctcgcccagggcgccgttctgaccgtcaagttcgccgtgctgtcgatggtgttcggcctgcttggcgccgtcgtgctcgcgatgatgggcatccggcaaagcgaagcactcgacggcttcgaacgcatctgggtcaacgcgctcgcgtggctggcacgcgcgtacgtgagcctgatgcgcggcacgccgctgctcgtgcagatcttcgtcatctattacgggctgccgagcctcggcatctcactcgacccgacgcccgccggcgtcatcgcgctgtcggcgaacgtcgccgcctacatgtcggaaagcatgcgcggcgcgatcaacgggatcgcgcgcggccaatggctcgccgcgtatagcctcgggctgtcgtgggggcagacgctgcgctacgtgatcggcccgcaggcgctgcgcatcgcggtgccgagcctgtcgaacagcctgatcagcctgatcaaggacacctcgctcgtgtccgtgatcaccgtgaccgaactgctgcgcagcgcgcaggaagtgatcgcggcgacctatcagccgctgccgctctatctcgccgccgcggccgtgtactggatcctgtgccagatcctcgaatgggtgcagcgctggtacgaaaagcgcctgtcgctgccgtcgcggcactga

SEQ ID NO: 61122 - protein, 230 aa, Burkholderia cepacia R18194
MSTTSLLVQSLPVLAQGAVLTVKFAVLSMVFGLLGAVVLAMMGIRQSEALDGFERIWVNALAWLARAYVSLMRGTPLLVQIFVIYYGLPSLGISLDPTPAGVIALSANVAAYMSESMRGAINGIARGQWLAAYSLGLSWGQTLRYVIGPQALRIAVPSLSNSLISLIKDTSLVSVITVTELLRSAQEVIAATYQPLPLYLAAAAVYWILCQILEWVQRWYEKRLSLPSRH

SEQ ID NO: 61123 - DNA, 660 bp, Burkholderia cepacia R18194
  CDS (1)..(660)
atggaagcactccaactggtcgtacatacgctgcccgtgatggtcaagggcgccatgctcacgctgaagtttgccgtcgcgtcgatggcgctgggtctcgtcgtcgggctcgtgatcgcgatcatgcgcatcggcagcaaccggcttgccgccagcctcgcgcaaggctacgtcagcctgatgcgcggcaccccgctgctcgtgcagatgttcgtcgtctactacgggctgcccgatctcggcatcacgctcgatcccacgacggccggcatcttcacgctgacgctcaacgcaggcgcctacctgtccgagagcatgcgcggcgcgattctcggcatcggccgcgggcaatgggcggccgcacacagtctcggtctcacgcacgtgcagacgctgcgctacgtcgtctgcccgcaagcgctgcgcctcgcggtgccgagtctcggcaacacgctgatcagcctgatcaaggacacgtcgctggtctccgtaatcaccgtcaccgaattgctgcgctcgacgcaggaggtgatcgccgcgacgttccagccgctgccgctctatctcgctgccgccgcgatctactgggtcctcagcacgctgctcacgcggcttcagggtcgcgtcgagacgcgcctcgcgctgccgtccacgcattga

SEQ ID NO: 61124 - protein, 219 aa, Burkholderia cepacia R18194
MEALQLVVHTLPVMVKGAMLTLKFAVASMALGLVVGLVIAIMRIGSNRLAASLAQGYVSLMRGTPLLVQMFVVYYGLPDLGITLDPTTAGIFTLTLNAGAYLSESMRGAILGIGRGQWAAAHSLGLTHVQTLRYVVCPQALRLAVPSLGNTLISLIKDTSLVSVITVTELLRSTQEVIAATFQPLPLYLAAAAIYWVLSTLLTRLQGRVETRLALPSTH

SEQ ID NO: 61125 - DNA, 693 bp, Burkholderia cepacia R1808
  CDS (1)..(693)
atgtcgacaacgtccctgctcgtccaatcgctgccggtgctcgcccagggcgccgtgctgaccgtcaagttcgccgtgctgtcgatggtgttcggcctgttcggcgcggtcgtgctcgcgatgatgggcatccggcaaagcgaagcgctcgaaggcttcgaacggatctgggtcaacgcgctcgcatggctcgctcgcggctacgtgagcctgatgcgcggcacgccgctgctcgtgcagatcttcgtcatctattacgggctgccgagcctcggcatctcgctcgatccgacgccggccggcgtcatcgcgctgtcggcgaacgtcgcggcgtacatgtcggaaagcatgcgcggcgccatcaacgggatcgcgcgcggccagtggctggccgcctacagcctcgggctgtcgtggtcgcagacgctgcgctacgtgatcggtccgcaggcgctgcgcatcgcggtgccgagcctgtcgaacagcctgatcagcctgatcaaggacacgtcgctcgtgtcggtgatcaccgtcaccgaactcctgcgcagcgcgcaggaagtgatcgcggcgacctatcagccgctgccgttgtatctggccgccgcggccgtgtactgggtgctgtgccagatcctcgaatgggtccagcgctggtacgagaagcgcctgtcgctgcccggccggcactga

SEQ ID NO: 61126 - protein, 230 aa, Burkholderia cepacia R1808
MSTTSLLVQSLPVLAQGAVLTVKFAVLSMVFGLFGAVVLAMMGIRQSEALEGFERIWVNALAWLARGYVSLMRGTPLLVQIFVIYYGLPSLGISLDPTPAGVIALSANVAAYMSESMRGAINGIARGQWLAAYSLGLSWSQTLRYVIGPQALRIAVPSLSNSLISLIKDTSLVSVITVTELLRSAQEVIAATYQPLPLYLAAAAVYWVLCQILEWVQRWYEKRLSLPGRH

SEQ ID NO: 61127 - DNA, 714 bp, Burkholderia cepacia R1808
  CDS (1)..(714)
atgatcgagattctccaggaattcggccaggcgtttctttactgggacggccagcggttgtccggcctcgcggtgacgttgtggctgctggtcgcgtcgatttcgctcggcttcgtgtgcgcggtgccgctcgccgttgcgcgcgtgtcgaagaagcgctgggtgtcgacgccggtgcgcctttacacgtacgtgtttcgcggcacgccgctctacgtgcagttgctgctgatgtacacgggcatgtacagcctcgagttcgtccgttcgcattcgctgctcgacgcgtttttccgcagcggcttcaactgcgcgattcttgcgttcgcgctgaacacgtgtgcgtacacgacggagatcttcgccggtgcgatccgtgcgattccgcacggcgaggtcgaggctgcgcgcgcatacgggatgtcgccgttcacgatgtaccggcgcgtgatcgtaccgtcggcgctgcggcgtgcgctgccgctgtacagcaacgaggtgatcctgatgctgcacgcgaccaccgtcgcgttcaccgcgaccgtgccggacattctgaaagttgcgcgcgacgccaattccgcgacctacatggcgttccagtcgttcggcctcgccgcgctgatctatcttgcggtatcgttcgcactcgtcgcggcatttcgccgggcggagcgccactggctcgcgtatctcgcggccggacgtcattga

SEQ ID NO: 61128 - protein, 237 aa, Burkholderia cepacia R1808
MIEILQEFGQAFLYWDGQRLSGLAVTLWLLVASISLGFVCAVPLAVARVSKKRWVSTPVRLYTYVFRGTPLYVQLLLMYTGMYSLEFVRSHSLLDAFFRSGFNCAILAFALNTCAYTTEIFAGAIRAIPHGEVEAARAYGMSPFTMYRRVIVPSALRRALPLYSNEVILMLHATTVAFTATVPDILKVARDANSATYMAFQSFGLAALIYLAVSFALVAAFRRAERHWLAYLAAGRH

SEQ ID NO: 61129 - DNA, 714 bp, Burkholderia cepacia R1808
  CDS (1)..(714)
atgatcgagatcatccaagactactggaaagcctacctgtggtgcgacggctaccacatgaccggagtggccatgacggcctggctcttggtggcttccgttgccatcggtttcgtgatgtcggtgccgctgtcggtggctcgtgtgtcaagcaacccgttcgtgcgcggcccggtatggttttttacctacgtgttccgcggcaccccgctgtacatccagctgttgattttctactccggtatctacagcctgaatgtggtgcgctcacacgaattgctcgaccgcgttttccgagagggcatcaactgcaccatcttggcgcttgcgcttaatacctgcgcatataccaccgagatcttcgccggtgcgatcaaatcgatcccgtacggtgagatcgaagcggcacgtgccttcggcatgtcgccctgggtgctgtacacccgcatcatcatcccttccgcgctgcgccgcgcgctgccgtactacagtaacgaggtaatcctgatgctgcacgctaccaccttggccttcaccgccaccgtaccggatatcctgaaagtggcgcgtgacgtgaattccgctacctacgcctcgttcgaagcatttggtattgccgcagtgttgtacgcgtgcattgcctttgttctggtttggatgttccgcaagttcgagcatcgttggttagccttcctgacgccaatgggccactaa

SEQ ID NO: 61130 - protein, 237 aa, Burkholderia cepacia R1808
MIEIIQDYWKAYLWCDGYHMTGVAMTAWLLVASVAIGFVMSVPLSVARVSSNPFVRGPVWFFTYVFRGTPLYIQLLIFYSGIYSLNVVRSHELLDRVFREGINCTILALALNTCAYTTEIFAGAIKSIPYGEIEAARAFGMSPWVLYTRIIIPSALRRALPYYSNEVILMLHATTLAFTATVPDILKVARDVNSATYASFEAFGIAAVLYACIAFVLVWMFRKFEHRWLAFLTPMGH

SEQ ID NO: 61131 - DNA, 747 bp, Burkholderia cepacia R1808
  CDS (1)..(747)
atgaccttcgatttcgacttcctcgccgacacgctgcgccagttgctcgcggccgtgccgaccacgctgggcctgttcttcgcgtcgctcgtgctcggcggcctgctgtcgctcgtgatcgtcgcgatgcgcgtgtcgccgcactggctgccgaaccgcttcgcgcgcgcctacatcctcgtgtttcgcggctcgccgctgctgatccagatgtttctcgtctactacgggctcggtcagttcggcgtgatccgcgaaagcttcgtgtggccgctgctgcgcgatccctacgcatgcgcggtgctgtcgctcgcgttgtgcacggccggctatacggccgagatcgtgcgcggcgggctgatggccgtgccggtcgggcagatcgaggccggttattcgatcgggctgtcgggcttcgcgctgctgcgccgcgtgatagggccgatcgcattgcgccagtgtttgcccgcttattcgaccgaggccgtgctgctggtcaaatcgaccgcgctcgcgagcctcgtgacggtgtgggaggtcacgggcgtcgcgcagcagatcatccagcaaacctaccgcacgaccgaggtgttcgtttgtgcggccctcatctatctgggcctgaacttcatcatcgtgcgcgtgctcggcgcactcgaatggcggctctccgcgcacttgcgcgcgccgaagccgtccggcccgtccgcagcgacgacgcacaatccgcggcgcgcggcgtcctga

SEQ ID NO: 61132 - protein, 248 aa, Burkholderia cepacia R1808
MTFDFDFLADTLRQLLAAVPTTLGLFFASLVLGGLLSLVIVAMRVSPHWLPNRFARAYILVFRGSPLLIQMFLVYYGLGQFGVIRESFVWPLLRDPYACAVLSLALCTAGYTAEIVRGGLMAVPVGQIEAGYSIGLSGFALLRRVIGPIALRQCLPAYSTEAVLLVKSTALASLVTVWEVTGVAQQIIQQTYRTTEVFVCAALIYLGLNFIIVRVLGALEWRLSAHLRAPKPSGPSAATTHNPRRAAS

SEQ ID NO: 61133 - DNA, 1188 bp, Listeria monocytogenes str. 4b H7858
  CDS (1)..(1188): transl_table=11
atgaatttcgacagcttgcttggctcactaaaaactggcaagattgatatgattatttccgggatgtcacctacacccgaacgtcaaaaagaagtggatttctctgatccatacatgttcgttcagcaacgtgttgtgattagaaagacagataaagataaatttacaagtgtgaatgattttagtggcgtgaaagttggtgcccaaaaacaaacgacacaagaagaattagctcaaaatgagctagttggttcagaagtagtttcccttcaaaaagtaccggaccttattcttaaccttaaaagcaacaaagtcgatgcggttgttttagaaggtccagttgctgaagcttatattagtcaagataagacactcgctatggcggatatcaaatttgctaatggtagcaaagaaaccgccatcgcaatgccaaaaggttctacagctttacaagaaaaagtcaacgcttctattaaagatatacaagataccggcttactgaaaaaatatcaaaaagaagccaataaattaatgttccaagatggtagcttttacgagaaatatggtaattactttatcactggtacattaatcactattgcccttgccgctattggcgtattatgtggtgccattctcggctcattactagcgctcatgaaactggcgaaaacaagatggttacgctggccagcagcatgttatattgaatttgtccgtggtacgccacttctaattcaaattttcatcgtctttttcggaactcaaattatcggtatggacgtatccgcctttgtttctggttgtatcgccctatcgctaaacagtgccgcttatgttgctgaaattatccgcgcaggtatttctgctgtcaacaaaggtcaaatggaagcagctcgttcccttggtatgacacaaggcgctagcatgcgttacatcatcttaccgcaagccgtgaaaaatattcttcctgctcttgggaatgaattcgtcactgttattaaagaatcttccatcgtatccgttatcggtgtaacagaactaatgtttatgaccggcgtagtccaaggcgcaagcttcaagccatttatcccactaattatcacatcattaatttactttgtactaacatttagcttatcaagactactaggtgttgctgaaaggagaatgagaacaagtgattga

SEQ ID NO: 61134 - protein, 395 aa, Listeria monocytogenes str. 4b H7858
MNFDSLLGSLKTGKIDMIISGMSPTPERQKEVDFSDPYMFVQQRVVIRKTDKDKFTSVNDFSGVKVGAQKQTTQEELAQNELVGSEVVSLQKVPDLILNLKSNKVDAVVLEGPVAEAYISQDKTLAMADIKFANGSKETAIAMPKGSTALQEKVNASIKDIQDTGLLKKYQKEANKLMFQDGSFYEKYGNYFITGTLITIALAAIGVLCGAILGSLLALMKLAKTRWLRWPAACYIEFVRGTPLLIQIFIVFFGTQIIGMDVSAFVSGCIALSLNSAAYVAEIIRAGISAVNKGQMEAARSLGMTQGASMRYIILPQAVKNILPALGNEFVTVIKESSIVSVIGVTELMFMTGVVQGASFKPFIPLIITSLIYFVLTFSLSRLLGVAERRMRTSD

SEQ ID NO: 61135 - DNA, 681 bp, Bacillus cereus G9241
  CDS (1)..(681): transl_table=11
ttggtttcagatcgattgtctacttggatagatattatgcagtcttccttcatgcctatgctgaaggaagctgtttttacgacaattccattaacgcttattacatttattatcgggattatacttgcgacgttaacggcgcttgcacgtatttcaggtagtcgtattttacaatggattgctcgtatctatgtatctatcattcgcggaacgccacttcttgtacagttatttattattttctatggtctgccaacgcttaatgttgaggttgagccatatacagcagcagttattggattttcattaaatgtcggtgcgtatgcatctgaaattattcgtgcttctatcctttcaattccgaaagggcagtgggaagctgcttatacaattgggatgacatacccacaagcgttaaaacgtgttattttaccgcaagcaacgcgcgtatcaatcccgccgctttcgaatacatttattagcttagtgaaagatacttcattagcatcgttaattttagtaacagaaatgttccgaaaagcgcaggaaattgcggcaatgaactacgaatttttaattgtttatttcgaagcaggtcttatttattgggttatttgtttcttattatcaatcgtacaacagatgttagaaaagcgttcagaacgctatacattaaaataa

SEQ ID NO: 61136 - protein, 226 aa, Bacillus cereus G9241
MVSDRLSTWIDIMQSSFMPMLKEAVFTTIPLTLITFIIGIILATLTALARISGSRILQWIARIYVSIIRGTPLLVQLFIIFYGLPTLNVEVEPYTAAVIGFSLNVGAYASEIIRASILSIPKGQWEAAYTIGMTYPQALKRVILPQATRVSIPPLSNTFISLVKDTSLASLILVTEMFRKAQEIAAMNYEFLIVYFEAGLIYWVICFLLSIVQQMLEKRSERYTLK

SEQ ID NO: 61137 - DNA, 858 bp, Bacillus cereus G9241
  CDS (1)..(858): transl_table=11
atggtacgtatgaaaagatcagtaaaaaatggtttgggcgtaatattcttggtgaagaggaaaaaacgaagtaatttagccattcaaagtttccctaaatcatgccccactttatgtggggcatttcattctctactaaaatctatacaatatgaggtgaaacgcatgtttgaaatttttatgtctacctatcccacactcttaaaagctactattgtcacattacaattaacactaacatccctattactcggttcactaattggattactattcgctttctttcgaatctctaacaataaagttttaaatagtattgctcacgtatacatcgccattattcgtggtacacctttaattgttcaaatcgccattctctattttgggattacatccgttgttgttttcactcctttttgggcaggagccattgctttagcaatccacaacggtgcatatattactgaaattttccgaggctctatccaatctgtcgatcgtggacaaatggaagcagctcgctctctaggtatgccatatcctttagcgatgcgccgtattgtattaccgcaagcatttcgtcaatctattcctcctttaggaaatcagtttattattggattaaaggactcttccctcgttgcttacgtaggattgtccgaattatggggatcaggtttatctattgctgcaggtaacttccaacaattagaaacatacataatcgttggtttatattatctcgtgcttgttctcctattcacttaccttgttaaccttttggaaaaacgactacaacgaaaagaaactaactccgtccaagtccatacaaagaataaaaaggaagtttctttataa

SEQ ID NO: 61138 - protein, 285 aa, Bacillus cereus G9241
MVRMKRSVKNGLGVIFLVKRKKRSNLAIQSFPKSCPTLCGAFHSLLKSIQYEVKRMFEIFMSTYPTLLKATIVTLQLTLTSLLLGSLIGLLFAFFRISNNKVLNSIAHVYIAIIRGTPLIVQIAILYFGITSVVVFTPFWAGAIALAIHNGAYITEIFRGSIQSVDRGQMEAARSLGMPYPLAMRRIVLPQAFRQSIPPLGNQFIIGLKDSSLVAYVGLSELWGSGLSIAAGNFQQLETYIIVGLYYLVLVLLFTYLVNLLEKRLQRKETNSVQVHTKNKKEVSL

SEQ ID NO: 61139 - DNA, 690 bp, Rubrivivax gelatinosus PM1
  CDS (1)..(690)
atgaacttcgaggccatcgccgagagcctgccgctctacgcgagcggcctggccaccacgctgcagctgctgctgatctcgctggcaatcgggctggtggcggcactcccgctcgcggtgctgcgggtgtcggcctcgcggtggctgcacggcccggtgtggtgcttcacctacgtgatccgtggcacgccactgctggtgcagctgttcctcgtctactacggtctggcgcagttcgagtgggtgcgcgccagcatcgcctggccctggctgcagtcggcctggttctgcgcctgcctggcgttcgccgtcaacacctgcgcctacaccaccgagatcatcgcgggcagcctgaaggccacgccgcatggcgaggtcgaggcggcacgcgcactgggcctgtcgcgtgcccaggtgtggcgccgcatcctgctgccctcggcgctgcggcgtgcgctgccggcctacggcaacgaggcggtgctgatgctgcacggcacctcgctggccagcgtggtcacgctgctcgacctcaccggcgccgcgcgcgaggtcaactcgcgcttctacctgcccttcgaagccttcctgacggccgctgcggtctacttgggcctgacgctggcgctggtgggtgcgctgcacgcggccgagcgccgctggctctcccacctgcgcccgcgcgcctga

SEQ ID NO: 61140 - protein, 229 aa, Rubrivivax gelatinosus PM1
MNFEAIAESLPLYASGLATTLQLLLISLAIGLVAALPLAVLRVSASRWLHGPVWCFTYVIRGTPLLVQLFLVYYGLAQFEWVRASIAWPWLQSAWFCACLAFAVNTCAYTTEIIAGSLKATPHGEVEAARALGLSRAQVWRRILLPSALRRALPAYGNEAVLMLHGTSLASVVTLLDLTGAAREVNSRFYLPFEAFLTAAAVYLGLTLALVGALHAAERRWLSHLRPRA

SEQ ID NO: 61141 - DNA, 666 bp, Pseudomonas fluorescens PfO-1
  CDS (1)..(666)
atggaagaagctttccaactcgctctggactccgcgcccttcctgttgaagggcgcgtactacacggtaatcctcagcctcggcggcatgtttttcggcctgctgctgggctttggcctggcgttgatgcgcctgtcgcgtttcaagtcggtcagctggctggcccgcatctacgtgtcgttctttcgcggcacgccgttgctggtgcaactgttcgtgatctattacggcttgccgcaattgggcatggaactcgacccgctgccggcggcactgatcggcttctcgctgaacatggccgcctacgcctgtgaaatcctgcgtgccgcgatcggttcgatcgaacgcggccagtgggaagccgctgcgagcatcggcatgacccgtgcgcagaccctgcgccgggccatcctgccgcaggcgatgcgcacggcgttgccgccgctgggcaatagtttcatttcactggtcaaggacaccgcactggccgccaccattcaggtgccggagctgttccgtcaggcacagctgattaccgcccggactttcgaagtcttcaccatgtatcttgccgccgcgctgatctactggattctggccacggtgctgtcgcacttccagaacaagttggaagagcgggtcaatcggcacgaccaggagtcctga

SEQ ID NO: 61142 - protein, 221 aa, Pseudomonas fluorescens PfO-1
MEEAFQLALDSAPFLLKGAYYTVILSLGGMFFGLLLGFGLALMRLSRFKSVSWLARIYVSFFRGTPLLVQLFVIYYGLPQLGMELDPLPAALIGFSLNMAAYACEILRAAIGSIERGQWEAAASIGMTRAQTLRRAILPQAMRTALPPLGNSFISLVKDTALAATIQVPELFRQAQLITARTFEVFTMYLAAALIYWILATVLSHFQNKLEERVNRHDQES

SEQ ID NO: 61143 - DNA, 690 bp, Pseudomonas fluorescens PfO-1
  CDS (1)..(690)
atgttgaaaggctacggggctgtcatcctcgatggcgcttggctgacgcttcagctcgccttgtcgtccatggccctggccatcgttctcgggctgatcggcgtcgcgttgcgcctgtcgccggtgcgctggctggcgtggctgggcgatctgtattccacggtgattcgcgggattcccgacctggtgctgatcctgctgatcttctacggcggtcaggacctgctcaaccgcgttgcgcctatgctcggctatgacgactacatcgacctgaacccgctggccgccggtatcggcaccctcggcttcatcttcggtgcgtacctgtcggaaaccttccgcggcgcgttcatggcgatccccaaaggtcaggccgaagcgggcatggcgtacggcatgagcagcttccaggtgttcttccgggtgctggtgccgcagatgattcgtctggcgattccgggcttcaccaacaactggctggtgttgaccaaggccaccgcgctgatttccgtggtcggtctgcaagacatgatgttcaaggccaagcaggcggccgacgccacccgcgagcctttcaccttcttcctcgcagtggcggcgatgtacctggtgatcaccagtgtctcgttgctggcgctgcgtcaccttgagaagcgctactcggtaggcgtaagggcggctgatctatga

SEQ ID NO: 61144 - protein, 229 aa, Pseudomonas fluorescens PfO-1
MLKGYGAVILDGAWLTLQLALSSMALAIVLGLIGVALRLSPVRWLAWLGDLYSTVIRGIPDLVLILLIFYGGQDLLNRVAPMLGYDDYIDLNPLAAGIGTLGFIFGAYLSETFRGAFMAIPKGQAEAGMAYGMSSFQVFFRVLVPQMIRLAIPGFTNNWLVLTKATALISVVGLQDMMFKAKQAADATREPFTFFLAVAAMYLVITSVSLLALRHLEKRYSVGVRAADL

SEQ ID NO: 61145 - DNA, 729 bp, Pseudomonas fluorescens PfO-1
  CDS (1)..(729)
atgttcgaaaccctcttacaaaatctggggctctccgccttcagcctcaagggctttggcccgttgctgttggaaggcacctggatgaccatcaaattgtcggcgttgtcgctgctggtggccgtgttgctcggcctgctcggcgccagtgccaagctgtcaaaaatcaagctgctgcgcctgcccgcccagctctacaccacgctgattcgcggggtgccggacctggtgctgatgctgctgatcttctacagcctgcaaacctggctgacgacgctcaccgattacctggaatgggaatacatcgagatcgacccgttcagtgccggggtcctgaccctgggcttcatttatggcgcgtacttcactgaaacctttcgcggggcgattctcgccgtgccgcgcggtcaggtcgaagccgccaccgcctatggtctcaagcgcggccagcgctttcgcttcgtggtgttcccgcaaatgatgcgcttcgccctgccgggcatcggcaacaactggatggtgatgctcaaggccaccgcgctggtttcgatcatcggcctggccgatctggtcaaggccgcacaggacgccggcaagagcacctatcagctgttttacttcctggtgctcgccgcgttgatttacctgctcatcaccagtgcctcgaacttcatcctgcgctggctcgaacgccgctacgccgccggtgcaagggaggccgtacgatga

SEQ ID NO: 61146 - protein, 242 aa, Pseudomonas fluorescens PfO-1
MFETLLQNLGLSAFSLKGFGPLLLEGTWMTIKLSALSLLVAVLLGLLGASAKLSKIKLLRLPAQLYTTLIRGVPDLVLMLLIFYSLQTWLTTLTDYLEWEYIEIDPFSAGVLTLGFIYGAYFTETFRGAILAVPRGQVEAATAYGLKRGQRFRFVVFPQMMRFALPGIGNNWMVMLKATALVSIIGLADLVKAAQDAGKSTYQLFYFLVLAALIYLLITSASNFILRWLERRYAAGAREAVR

SEQ ID NO: 61147 - DNA, 663 bp, Pseudomonas fluorescens PfO-1
  CDS (1)..(663)
atgaactatcagttgaactttgccgccgtgtggcgcgatttcgacaccttgctggcggggctcggtctgggcctcgaactggcgctggtgtcgatcgccatcggctgcgtgatcggcctgctgatggcgtttgccttgctgtccaggcatcgcgccttgcgggtgctggcatcggtgtatgtgacggtgatccgtaacacgccgattctggtgttgatcctgttgatctactttgcgttgccgagcctggggatccggctggacaagatcccgtcgttcatcatcaccctgtcgctgtatgccggggcgtacctgaccgaagtgttccgcggtggcttgttgagcatccccaagggccagcgcgaagcgggactggccattggtctgggcgagtggcaggtgaaggcttatgtcaccgtgccggtgatgctgcgcaacgtgctgccggcgctgtcgaacaacttcatttcgctgttcaaggacacctcgctggccgccgcaatcgcggtgccggagctgacctattacgcgcgcaagatcaacgtcgagagctaccgggtgatcgaaacctggctggtgaccacggcgttgtatgtcgcggcctgttacctcattgccatgctgctgcgttacctcgagcagcgtctggcgatccgccgatag

SEQ ID NO: 61148 - protein, 220 aa, Pseudomonas fluorescens PfO-1
MNYQLNFAAVWRDFDTLLAGLGLGLELALVSIAIGCVIGLLMAFALLSRHRALRVLASVYVTVIRNTPILVLILLIYFALPSLGIRLDKIPSFIITLSLYAGAYLTEVFRGGLLSIPKGQREAGLAIGLGEWQVKAYVTVPVMLRNVLPALSNNFISLFKDTSLAAAIAVPELTYYARKINVESYRVIETWLVTTALYVAACYLIAMLLRYLEQRLAIRR

SEQ ID NO: 61149 - DNA, 720 bp, Rhodospirillum rubrum
  CDS (1)..(720)
atgaacctggatctggtcgccaccttcctgcccaagctgctgttcgaagggcttcccgtcaccctcaagctggtgaccctggccgtcgccatcggcgttttcatcgccatcccaacggcgttgctgcgcgttcaccccagcccgctggtccgcgccttcccttacgccttcatcttctttttccgcggcacgccgctgctgatccagatcgccctggtctattacggcctgtccaccctgccgtggatccgtgagaacgaggtgctgtggccgatcctgcgcgagccgttctggtgcgcgctgatcgctttcgccctgaataccggcgcctattcggccgagatcctgcgcggcgccatccaggccattccgcgcggcgaggtcgaggcggcgcgggcctatggcatgcgcggcctgctgatcgtgcggcggatcatcctgccgcgcgccttccagatcggcctgccggcctatggcaacgagatcatcctgatcctcaagggcagcgccctggcctcaagcatcaccttgctcgatatcaccggggtcgcccgccttctctatgcccgctattacacgccggttgaggccttcgtcaccgccggggtgatctatctgatcctggtttacctgctgacccgcggcctgcggctgatcgaacgccggctgtcgcgccacctgctcggcccgccggaaaccgagcttgccgaagaccgctag

SEQ ID NO: 61150 - protein, 239 aa, Rhodospirillum rubrum
MNLDLVATFLPKLLFEGLPVTLKLVTLAVAIGVFIAIPTALLRVHPSPLVRAFPYAFIFFFRGTPLLIQIALVYYGLSTLPWIRENEVLWPILREPFWCALIAFALNTGAYSAEILRGAIQAIPRGEVEAARAYGMRGLLIVRRIILPRAFQIGLPAYGNEIILILKGSALASSITLLDITGVARLLYARYYTPVEAFVTAGVIYLILVYLLTRGLRLIERRLSRHLLGPPETELAEDR

SEQ ID NO: 61151 - DNA, 657 bp, Rhodospirillum rubrum
  CDS (1)..(657)
atgaagtttcaggttatccttgccaatctgccgttcctgctcaagggggcgggatcgacgatcgccatctccctggtcggcatcctgcttgggcaggtcatcggcgccctggtctgcgtcggccggctttcgggaaaccggctgatcgatgcgatcggcgccctttacgtcagcttctttcgcggcgtgccgctgctcatccagttgctgctgatctattacatgctgccgctgattggcatcgatgtgccggccctgatggcggcgatcggcgccctggggctggcctcgggggcctatgtgtcggaaatctatcgcgggtcgctcaacgccattccccggggacagggcgaggcggctttggctttgggcttttccgggggctcgatctggcggcgcatcctgttgccccaggccttccggctgtcggtgccggccctggtcaatgagctgatcttgctgctcaaggcctcgtcgctgatttcggtgatcggggtggccgagctgacccgggtcagccaaaccgtatcggcgagcacctatcgggcgctggagatctatatggccgccggcgtgatctattttcttatcaatggctgtctggccattctgggcgccctggtcgagcgccacctgcggcttcaggggcggggatga

SEQ ID NO: 61152 - protein, 218 aa, Rhodospirillum rubrum
MKFQVILANLPFLLKGAGSTIAISLVGILLGQVIGALVCVGRLSGNRLIDAIGALYVSFFRGVPLLIQLLLIYYMLPLIGIDVPALMAAIGALGLASGAYVSEIYRGSLNAIPRGQGEAALALGFSGGSIWRRILLPQAFRLSVPALVNELILLLKASSLISVIGVAELTRVSQTVSASTYRALEIYMAAGVIYFLINGCLAILGALVERHLRLQGRG

SEQ ID NO: 61153 - DNA, 756 bp, Burkholderia fungorum LB400
  CDS (1)..(756)
atgcatttcgacttcgacttcctgttcgacacgctcaagcaactgctcgcggccgtgccgaccacgctcggcctgttcttctgctcgctgattctcggcggcctgctctcgctcgtgatcgtcacgatgcgtgtgtcgccgcactggctgccgaaccgcttcgcgcgcgcttatatcctcgtgtttcgcggctcgccgctgctgatccagatgttcctcgtctactacggcatgggtcagttcggcgtgatccgcgagagcttcctgtggccggtgctgcgcgagccttatatgtgcgcggtgttgtcgctcgcgctatgcacggccggctataccgccgagatcattcgcggcggcttgatggccgtgccggtcggccagatcgaggccggttattcgatcggcctgtcgggtttcgcgctgctgcgccgcgtgatcggtccgatcgcgttgcgccagtgcttacccgcgtattcgaccgaagccgtgctgctcgtcaaatccaccgcgctcgcgagtctcgtcaccgtgtgggaagtgaccggcgtcgcgcagcagatcatccagcaaacctaccgcacgacggaggttttcatctgcgccgcgctgatctatctgttcctgaatttcgtgatcgtgcgcctgctgggcctgctcgaaacgcgtctgtcgcgccacctgcgcgcggcacgcccgcaggccgcggcgagccgcccggtttccaccaccaccgaagcacgtcgcgccgcgccctaa

SEQ ID NO: 61154 - protein, 251 aa, Burkholderia fungorum LB400
MHFDFDFLFDTLKQLLAAVPTTLGLFFCSLILGGLLSLVIVTMRVSPHWLPNRFARAYILVFRGSPLLIQMFLVYYGMGQFGVIRESFLWPVLREPYMCAVLSLALCTAGYTAEIIRGGLMAVPVGQIEAGYSIGLSGFALLRRVIGPIALRQCLPAYSTEAVLLVKSTALASLVTVWEVTGVAQQIIQQTYRTTEVFICAALIYLFLNFVIVRLLGLLETRLSRHLRAARPQAAASRPVSTTTEARRAAP

SEQ ID NO: 61155 - DNA, 651 bp, Burkholderia fungorum LB400
  CDS (1)..(651)
atgttcagcacgaccgtcttcctccagggctttccgctgctgctgcacgcggcgctcgccaccatcggcatttcgctgacgggtctcctgatcggtttcttcgtggcgatcggcgtgtgcgcggcgcggctttcgccgaaccgcgcggcgcgcatgttcggcggcgcctatgtgttcttctttcgcggcgtgccgatgctggtgcaactgctgctggtgtactacctgctgccgttcgcgggcatcaacgtgtcgccggtcgtggcggcgatcagcaccgtatcgctatgttccgcgtcctatatcgccgagatcctgcgcggcggttttctcagcattccgccgggccatctggaagccgcgcgcatgctcgggctctcgccgttcgacatgctgcgccgcattctcgtgccgcaagcattccgtttgacgctgccttcgctcgtcaatgaaatggtgctgctcatcaaggcttcttcgctgatctcggtggtgggcgtggccgagctgacgcgcaccgcgcagaatatcgccgccagcacctatcggccgctggaagcgtacctcgccgccgggctgatctacttcgtgatctgcggtgcgctcacactcgtcgcgcacgccgccgaataccgcttgcagcacgcctga

SEQ ID NO: 61156 - protein, 216 aa, Burkholderia fungorum LB400
MFSTTVFLQGFPLLLHAALATIGISLTGLLIGFFVAIGVCAARLSPNRAARMFGGAYVFFFRGVPMLVQLLLVYYLLPFAGINVSPVVAAISTVSLCSASYIAEILRGGFLSIPPGHLEAARMLGLSPFDMLRRILVPQAFRLTLPSLVNEMVLLIKASSLISVVGVAELTRTAQNIAASTYRPLEAYLAAGLIYFVICGALTLVAHAAEYRLQHA

SEQ ID NO: 61157 - DNA, 666 bp, Burkholderia fungorum LB400
  CDS (1)..(666)
atgaattatcattttcactggggcatcgttggccagaacctcgggtatctgctccacggcatatggctcacactcgctgtaacggccgtctccctcgccgttgccatcgtgatcggtctcgtcattggcatcatgaggatttcctcaaaaggcgtactcaagcgagtggcaggcgtctatgtcgaggtgttccgcaacactccgacgctcgtccagctcatctgggtctattactgcttacccgtgctcacaggcatcaatctgagcccgacgagttcctgcatcttcgcgctgtcgatcaacagcgccgcgtatgtggccgaaatcttccgcgccggcatccaggctgtccccagtggtcagcttgaagcggccagaagcatcggtatgtcctattcgaaggccatgcgcaagatcattctgccgcaggccgtccgacagatgattccgccgttcgtcaacgaattcgtctcgctgctcaagtattcttcgctcgtgtcggtgctcggtgtagcggacctgacctatcaggcacagaccctcagcacgaccacgttccggccgatcgagatatttacctttatcggcgtcgtctattttcttctatgctgggccatctctgcggctgcgcacgttctcgaacagaaaatcagggtgatcgcatga

SEQ ID NO: 61158 - protein, 221 aa, Burkholderia fungorum LB400
MNYHFHWGIVGQNLGYLLHGIWLTLAVTAVSLAVAIVIGLVIGIMRISSKGVLKRVAGVYVEVFRNTPTLVQLIWVYYCLPVLTGINLSPTSSCIFALSINSAAYVAEIFRAGIQAVPSGQLEAARSIGMSYSKAMRKIILPQAVRQMIPPFVNEFVSLLKYSSLVSVLGVADLTYQAQTLSTTTFRPIEIFTFIGVVYFLLCWAISAAAHVLEQKIRVIA

SEQ ID NO: 61159 - DNA, 657 bp, Burkholderia fungorum LB400
  CDS (1)..(657)
atgcactggcacgatatagtcgactttgtaccgattctgattcagggcgcggtgatgagcattgtcatcacgctcggttgcctgctgttgagcacggtgctcggactgacctgggcgctgctgaagatgtcgcgctacccgctcgtcgttcgcggcgtgagcacgatgatcaacgtcgtgcgcggtctgccgatgatcgtgctgctgttctacatctacttcgtgctgcccgagattcacattcaggtgtcggcattgcaggcgagcattatcgggcttggtttcggctactcgacgtatgtcgcggaaattttccgcgccgggatcgaggcggttgatcccggccagtacgaagccgcgcagtccatcggcatgggccgcgtcaaaacgatggtgcgcgtgatcctgccgcaggcaatcaaggtcgcgctgccgccgtacagcaatacgctcgtgatgatgctgaaggactcgtcgctcgcctcgaccatcacggtcgccgaaatgacacgcgaagggcagttgatcgcggcgtcgacgttccagaatctgacggtttatacgctcgtcgcgattggctatctggcgatgagcctgccgctgatgagcatgacacgcacgctcgaacgacgtttcggtcggcataaggccaggtaa

SEQ ID NO: 61160 - protein, 218 aa, Burkholderia fungorum LB400
MHWHDIVDFVPILIQGAVMSIVITLGCLLLSTVLGLTWALLKMSRYPLVVRGVSTMINVVRGLPMIVLLFYIYFVLPEIHIQVSALQASIIGLGFGYSTYVAEIFRAGIEAVDPGQYEAAQSIGMGRVKTMVRVILPQAIKVALPPYSNTLVMMLKDSSLASTITVAEMTREGQLIAASTFQNLTVYTLVAIGYLAMSLPLMSMTRTLERRFGRHKAR

SEQ ID NO: 61161 - DNA, 669 bp, Burkholderia fungorum LB400
  CDS (1)..(669)
atggaacttgatttctcgccggtgattgccggctggccagacatcatgcgaggcacgttggtgacggtcgaagtgaccgccgcgtcgctcgcgctcagttgcgtgcttggcctgttgatcggcatcggccggctgacgccgaagcggcgcatggtgtacggcttctgcaccgcgtacctgaccttcttccgcggcacgccattgctggtgcaactcttcctgctgttcttcggcctcccgcaattcggcattctgctaccggcgtttgtgtgcggcatgctcgggctcggtctgtattcggcggcttatgtatcggagatcgtgcgcggcgcgattcagtcggtcgatcgcgggcagatggaagcggcgcgttcgatcggcatgtcggcggggcaggcgatgcgcgcgatcattcttccgcaggccatcgtgcggatgatcccgccgctcggcaacgaattcatcgcgctgatcaagaactcggcgctggtgtcgctgctgacaatcgacgatctgatgcatgaaggccagaagatcatcagcgtgtcgtatcgttcgctcgaagtgtatctcgctatcgcgctggtgtatctcgtgttgacgcaagcgaccaattacgcgctgcatcgcgtcgaacgtcgtttgcgtgctggaggaatggtgcaatga

SEQ ID NO: 61162 - protein, 222 aa, Burkholderia fungorum LB400
MELDFSPVIAGWPDIMRGTLVTVEVTAASLALSCVLGLLIGIGRLTPKRRMVYGFCTAYLTFFRGTPLLVQLFLLFFGLPQFGILLPAFVCGMLGLGLYSAAYVSEIVRGAIQSVDRGQMEAARSIGMSAGQAMRAIILPQAIVRMIPPLGNEFIALIKNSALVSLLTIDDLMHEGQKIISVSYRSLEVYLAIALVYLVLTQATNYALHRVERRLRAGGMVQ

SEQ ID NO: 61163 - DNA, 678 bp, Burkholderia fungorum LB400
  CDS (1)..(678)
atgccggcatggttgcatctgatggcgcagtcgctgtggcccctgctgtatgcggggctcgtgttcaccgtgccgctcacgctgatatcgtttgcgatcgggctggcgctcgcgttcctcgtcgcgctggtgcgtctgttcggaccgaagtgggccgtcgcgatcgtgcgcttctacgtgtggctgtttcgcggctcaccgttgctcgtgcaactattcgtgatcttctacggattgccgaacgtgggcatcgtgctcgatccgttgacggcggcgatcatcggcttttcgctgaatgtcggcgcgtataactccgaagtgatacgcggtgtgatcgagtcgatcccgaaaggacagtgggaagcggcgtattcgatgggtatgacgcgcgagcaggccttgcgtcgcgcgatcctgccgcaagcggcgcgcgttgcgctgccgccgttgtcgaattcgtttatcgctctggtgaaagacacctcgctcgccgcggtgctgaccgtgcctgaagtgtttcaggcggcgcagcggatcgcgtcggtgacttacgagccgctgatcctgtacaccgaggcggccctggtttatctggtcttcagttcggtgttgtcgtcggcgcaggtcaggctcgagcgcaaattcggccgccacgcacttttccatgcaggcaactga

SEQ ID NO: 61164 - protein, 225 aa, Burkholderia fungorum LB400
MPAWLHLMAQSLWPLLYAGLVFTVPLTLISFAIGLALAFLVALVRLFGPKWAVAIVRFYVWLFRGSPLLVQLFVIFYGLPNVGIVLDPLTAAIIGFSLNVGAYNSEVIRGVIESIPKGQWEAAYSMGMTREQALRRAILPQAARVALPPLSNSFIALVKDTSLAAVLTVPEVFQAAQRIASVTYEPLILYTEAALVYLVFSSVLSSAQVRLERKFGRHALFHAGN

SEQ ID NO: 61165 - DNA, 696 bp, Oenococcus oeni PSU-1
  CDS (1)..(696)
atgcaatcgataattttagacgtaaacctttggaaatttcgttccgaacttatttccggaatcgaagtcactttgctcatatccatttgtgctgttgttttaggttcgattatcggcctgtttattgcaatcatgcacatgtccaaaaaaagagtggtcaatgtaatcgctacaacctatgtcgaaattctcagagggacaccactaatagtccaactgatgtttgtctactatgctgttccattgattctccaagcgattcttagcaatttcggatcatcgattgaaatcaatatcccaacgattccagcaggaattattgccgttgccatcaactcatcggcctatgtttccgaagcaattcgggctggtttcaattcaatcgacaagggccagactgaagcggcccgctcgcttggtcttccgaaaaaattgactatgcgttacgtaattattccccaggctttaaagaatatatggccggctttaggcaatgaattcgttgccctaatcaaggagtcatcgatcgtactggttatcggaactcctgatatcatgtaccaaatcaataatattagagcagtgacctttgaaccagtcgctcctttgattctgtcagcagtaatctattttgtgctaactttcggtttgaccagaataatgaaacatttcgaagggaagatgcagcatgactaa

SEQ ID NO: 61166 - protein, 231 aa, Oenococcus oeni PSU-1
MQSIILDVNLWKFRSELISGIEVTLLISICAVVLGSIIGLFIAIMHMSKKRVVNVIATTYVEILRGTPLIVQLMFVYYAVPLILQAILSNFGSSIEINIPTIPAGIIAVAINSSAYVSEAIRAGFNSIDKGQTEAARSLGLPKKLTMRYVIIPQALKNIWPALGNEFVALIKESSIVLVIGTPDIMYQINNIRAVTFEPVAPLILSAVIYFVLTFGLTRIMKHFEGKMQHD

SEQ ID NO: 61167 - DNA, 684 bp, Haemophilus influenzae 86-028NP
  CDS (1)..(684)
atgtttcaagaatatttaagcgtgatcgtacaagggattccaacgagtttactactcacagtcgtatccttactgattgctttctttttagccttatttcttacttttttactttcaatggaaaacaaatggataaaaagtgcggtcaatttataccttactttattcactggcacgccactgttagtacagttctttttaatttatgcagggccaggccaatttcaatggattattgacagcccattatggtatgtcttatccaatgcgtggttctgtgccgtattagctttagcactaaacagcgcagcttattccacccaattatttcacggtgcagtaaaagccattcctaaaggacaatgggaaagttgcgcagcgttagggttaagccgattacagacactcaaaatcttaattccttatgccttaaaacgtgcgttgccttcttacagtaacgaaattattttggtatttaaaggaacggcattagcatccaccattacgattatggatattatgggttacgcacgccaactttatggtacagaatatgatgcaatcacaatttacggcattgcgggtggtatctatttaattatcacaggcattgcaacattattactacgtaaattagagaaaaaagtattggcatttgaacgttttgaagtaagcaaagcataa

SEQ ID NO: 61168 - protein, 227 aa, Haemophilus influenzae 86-028NP
MFQEYLSVIVQGIPTSLLLTVVSLLIAFFLALFLTFLLSMENKWIKSAVNLYLTLFTGTPLLVQFFLIYAGPGQFQWIIDSPLWYVLSNAWFCAVLALALNSAAYSTQLFHGAVKAIPKGQWESCAALGLSRLQTLKILIPYALKRALPSYSNEIILVFKGTALASTITIMDIMGYARQLYGTEYDAITIYGIAGGIYLIITGIATLLLRKLEKKVLAFERFEVSKA

SEQ ID NO: 61169 - DNA, 651 bp, Pediococcus pentosaceus ATCC 25745
  CDS (1)..(651)
atgtttaacattaattatatttcagaaatcataccatctttgttaagtggggcatcaatgacattacaggttttctgttggacaattgtggggtcattaattctaggtgtttttctagcgttggggttagtatcaaaatttaaaccattccaagcaattataagtgcgtatgtgtggttaatgcgtggtactccattacttttgcaattaatttttattttttacggattaccaactgtgggaattgtatttccacgctacgaagctgctttactagcttttatcctaaactatgcagcctattttgcagaaatttttcggggaggattacaatccgttgataaaggtcaatatgaggcgggacgggtacttcagatgacctattggcaaacaactaagaaagtaattttgcctcaggtcgctaaaattgttctcccatcaatcggaaatgaagttatcaaccttgttaaagattcgtcattagtttatgtgattggaattggtgacttactacgtgcaggaaatgtagcagcggctcgtgatgtgactttggttccatttatcttagtcggtattatgtacctaatattgacagggatatgtacattcctgttacgtaaagtcgaaaaacactattcatactttaaatag

SEQ ID NO: 61170 - protein, 216 aa, Pediococcus pentosaceus ATCC 25745
MFNINYISEIIPSLLSGASMTLQVFCWTIVGSLILGVFLALGLVSKFKPFQAIISAYVWLMRGTPLLLQLIFIFYGLPTVGIVFPRYEAALLAFILNYAAYFAEIFRGGLQSVDKGQYEAGRVLQMTYWQTTKKVILPQVAKIVLPSIGNEVINLVKDSSLVYVIGIGDLLRAGNVAAARDVTLVPFILVGIMYLILTGICTFLLRKVEKHYSYFK

SEQ ID NO: 61171 - DNA, 645 bp, Moorella thermoacetica ATCC 39073
  CDS (1)..(645)
atggccgtatccctgggctgtattctgggcctggttgctggtatgggccgcctttcccgccggcggctgaccagctttctggccacctgctatgttgatttttttcggggtactcccctgctggtccagatctttatcgtttattacggttttccccagctcctggacgaggggcagaaattcttaatggcctcgctgggtatgccacagctattacagacaacccatatccccgtctttgtggctgccacccttgccaccagtctgaatagcggcgcctatgtggccgagattttccgggccggtatccaatccatcgaaaggggtcaggtagaggccgcgcgttccctgggtatgaccgaagggcaaaccatgcgctatattgttcttccccaggccttcaaacgggttatccctcccctgggaaatgagtttattgctatgctcaaggatacctctctcctatcggttatcggttatgtcgagctaacccgccagggacagctaatcagcggtgccacctttaagcccttgcaaatctatttcggtgttgccctgatttatctaatcatgacctttaccatttcccgcctggtggattacctggaaaggaggttgaagaccggtgaccttgatcgaagttaa

SEQ ID NO: 61172 - protein, 214 aa, Moorella thermoacetica ATCC 39073
MAVSLGCILGLVAGMGRLSRRRLTSFLATCYVDFFRGTPLLVQIFIVYYGFPQLLDEGQKFLMASLGMPQLLQTTHIPVFVAATLATSLNSGAYVAEIFRAGIQSIERGQVEAARSLGMTEGQTMRYIVLPQAFKRVIPPLGNEFIAMLKDTSLLSVIGYVELTRQGQLISGATFKPLQIYFGVALIYLIMTFTISRLVDYLERRLKTGDLDRS

SEQ ID NO: 61173 - DNA, 660 bp, Streptococcus suis 89/1591
  CDS (1)..(660)
atgacagaaagagtatggcaactattgcttgattcattttcacagatacttgttccaggattgttggtgactatcccactgacaatcctgtcttttacctttggcttgctaattgctattgggacggccttggtgcaaattgctcagattcccattctcaaacaagtggctcgtttctatatttgggttgttcgagggacaccactcttggttcaactctatgtgatattctttgggctaccaagtctaggaattgtcttggatgcctttccgtcggcggttttggttttttctgtcaatacaggtgcctacgctgcggaaaccattcgggcatctatcgagtccgtgcctaaggggcagttggaggccggctattctgtcgggatgagttttgcccagaccatgcgtcggattattctcccacaggcctttcgagtggccttcccgcccttgtccaacaccttgattggattggtcaaggatacatcgctggctgccaatattaccgttttggagatgtttatggcaactcagcagattgcagcaaggacctacgaaccgtttgccctctattgtgaggtggcccttgtttatctactcttttcaaccattttgaccaagcttcaagcctatggtgagaagaagttagccgtttactag

SEQ ID NO: 61174 - protein, 219 aa, Streptococcus suis 89/1591
MTERVWQLLLDSFSQILVPGLLVTIPLTILSFTFGLLIAIGTALVQIAQIPILKQVARFYIWVVRGTPLLVQLYVIFFGLPSLGIVLDAFPSAVLVFSVNTGAYAAETIRASIESVPKGQLEAGYSVGMSFAQTMRRIILPQAFRVAFPPLSNTLIGLVKDTSLAANITVLEMFMATQQIAARTYEPFALYCEVALVYLLFSTILTKLQAYGEKKLAVY

SEQ ID NO: 61175 - DNA, 651 bp, Silicibacter sp. TM1040
  CDS (1)..(651)
atgtgggatctggtgccgatccttttgggctatgtgccgctaacgctgttcatggcagtgatcggtatggcctgcgcgctcgtgctggcctccattctggcagtcgagcgcgtgtttcagatcccggttctggacgccttcgtacgcctcttcatcagcttctttcgcggcacgccgcttctggtacagttgttcctgttctattacggcttgccgcaggtgctggggttcctcggttccattgacggcgttacggcgacgatcatggggctgacgctgcatttctcggcctatatggccgagagcatccgtgccgcaatccttggtgttgaccggagtcagtgggaggccgcccaggccgtcgggatgacgcaggggcagatgatgcgacagatcatcctgccccaggccgcccgcgtcgcagcgccgaccctggtcaactacttcattgacatgatcaaaggcacctctctcgcctttacgctaggcgtcacagagctgatgggggcaacccagaaagaagccgccgggagctttctctactttgaagccttcttggtggccgccgcgatctattggatccttgtcgaggcactgtcctttggccagcgtcacctggaaacctacctcaacaaggcgcatgcgagatga

SEQ ID NO: 61176 - protein, 216 aa, Silicibacter sp. TM1040
MWDLVPILLGYVPLTLFMAVIGMACALVLASILAVERVFQIPVLDAFVRLFISFFRGTPLLVQLFLFYYGLPQVLGFLGSIDGVTATIMGLTLHFSAYMAESIRAAILGVDRSQWEAAQAVGMTQGQMMRQIILPQAARVAAPTLVNYFIDMIKGTSLAFTLGVTELMGATQKEAAGSFLYFEAFLVAAAIYWILVEALSFGQRHLETYLNKAHAR

SEQ ID NO: 61177 - DNA, 807 bp, Silicibacter sp. TM1040
  CDS (1)..(807)
atgagctgctttgaaacctttcaggcctatgcgctgcgctcaatcgggattggcgaacggttgctgccgcgcagtgactttacgctctgcgatcaatttgtcctgatcggttccggcctgatctggaacgtctacttcggcgcgattgcgattttcaccgggttcttctttgccaatgccctcgcggtggcgaagaactcccacaagcgctggctgcgcgcaccggcaaacgggttcatctttgtgttccggggctcgccgctgttcatccagttcttctttgcctatttcgtgttcctgtcgctcaagagtgtttcaccgatctttgatccgctctcggcggcctggcttggtgcgctgatcgtgctgttcctcaatacctcggcctattcggcagagatcttctacggcgcgctgcgctcgatccccaaaggcgacctcgaagccgccgacgcctatggtctgtcgggctggagccgctttcgcagggtgatctggcccaccatgatgcggctggcctggcccgcctataccaacgaggcgatctttctgttccacgccacgacactggtctatttctcgggctttccggcgtggcgccaaaagggcgatgcgctgtattacgcgaactacttcgcggataagaccttcaacccgttcgtcccctacccgatccttgcgttctatttcatcctgctgacgctggcgatcatcgcggtgtttggaatgatcaacacgcggctcaaccggcatatgccacaggagctgcgccgcaagatccgggtgcgcccgcagctgatgcgctaa

SEQ ID NO: 61178 - protein, 268 aa, Silicibacter sp. TM1040
MSCFETFQAYALRSIGIGERLLPRSDFTLCDQFVLIGSGLIWNVYFGAIAIFTGFFFANALAVAKNSHKRWLRAPANGFIFVFRGSPLFIQFFFAYFVFLSLKSVSPIFDPLSAAWLGALIVLFLNTSAYSAEIFYGALRSIPKGDLEAADAYGLSGWSRFRRVIWPTMMRLAWPAYTNEAIFLFHATTLVYFSGFPAWRQKGDALYYANYFADKTFNPFVPYPILAFYFILLTLAIIAVFGMINTRLNRHMPQELRRKIRVRPQLMR

SEQ ID NO: 61179 - DNA, 657 bp, Rickettsia akari str. Hartford
  CDS (1)..(657)
atgtttgagtatttaataaaattttatccaaaaatcctctttattgtagaggggactctagtaactttaaaatatagcattattgccgttatattgggtttagtgatagggatgctgctcgctatttgtaaggtaaataagaatcgtgctttaaggctctgtgcaaatttctatacttctattttcagaggtactcctttattaattcaattaactattatttattttgcttcaccttatatcataggcgttaaatttagtgtgtttatggctggagctattgctttttcccttaattcgggagcatatgtttccgaagtaatcagggctggtattaatgcagttgataaagggcaatttgaagcggctgaagctcttgctattccaaagtttttaataatgaaagatatcattctgccacaagcagttaaaaatatctttccgtcattagtaaatgagcttgtaaatttgattaaagaatcagcaattatttctatgcttggagaaatggatttaatgcgtagagcacaaattgtatcaattgaaacatataattatttttttccaatgtctattgctgcttgctgttattatattttagtgatgttaatcagctttatagcgaaaataattgagaaaaaaatgattgttaattaa

SEQ ID NO: 61180 - protein, 218 aa, Rickettsia akari str. Hartford
MFEYLIKFYPKILFIVEGTLVTLKYSIIAVILGLVIGMLLAICKVNKNRALRLCANFYTSIFRGTPLLIQLTIIYFASPYIIGVKFSVFMAGAIAFSLNSGAYVSEVIRAGINAVDKGQFEAAEALAIPKFLIMKDIILPQAVKNIFPSLVNELVNLIKESAIISMLGEMDLMRRAQIVSIETYNYFFPMSIAACCYYILVMLISFIAKIIEKKMIVN

SEQ ID NO: 61181 - DNA, 684 bp, Actinobacillus pleuropneumoniae serovar 1 str. 4074
  CDS (1)..(684)
atgtttcaagattatttagccgtcattgcacaagggattccgaccagcttaagcttaaccgccgtttcattgctgattgcgtttgtattagcggtaattttgaccttcttactttcaatggaaagcaagctgattaaggcaatcgtaaacggttatttgatgctatttaccggaacaccgttattggtacagttctttttgatttatcacggaccgggtcaattccagtggattgtcgatagctttgcttggcaatttttatccgatgcgtggttttgtgcggcgttagcgttagcgttaaatagtgcggcatactcaacccaattattccacggtgcggtaaaagcgattccgaaagggcagtgggaaacctgtgcggcgcttggtttaagccgtttagatactttgaaaatcttaattccatacgccttacgccgtgcgttaccgtcgtatagcaatgagattatcttagtgttcaaaggcacatcgttagcttcaaccatcaccttattggatattatgggctatgcccgccagttatacggtacggaatacgatgcgattaccatttacggtattgccggagcgatttacttagtaattaccggtattatgacgattctgttacgtagagtggaagcgaaagtgctggcgtttgaacgtccggcagcggataaagcgtaa

SEQ ID NO: 61182 - protein, 227 aa, Actinobacillus pleuropneumoniae serovar 1 str. 4074
MFQDYLAVIAQGIPTSLSLTAVSLLIAFVLAVILTFLLSMESKLIKAIVNGYLMLFTGTPLLVQFFLIYHGPGQFQWIVDSFAWQFLSDAWFCAALALALNSAAYSTQLFHGAVKAIPKGQWETCAALGLSRLDTLKILIPYALRRALPSYSNEIILVFKGTSLASTITLLDIMGYARQLYGTEYDAITIYGIAGAIYLVITGIMTILLRRVEAKVLAFERPAADKA

SEQ ID NO: 61183 - DNA, 630 bp, Actinobacillus pleuropneumoniae serovar 1 str. 4074
  CDS (1)..(630)
atgaccttagggttggcactgacttccctgatagtcggcttattactttcaatgttgtttgtggtacttgagaccagtaaacagccttgtattagtaaaccgacttctgtttttttagccttattgcgcggtttaccggaaattttagttgttttactgattttcttcggttcaaccgaattggtagaaaaaattaccagcgaatatgtcgaattcagtgcgtttagttgcggggtattggcgctttcgttaattttttccgcttatgcttcgcaatcgttgcgcggtgcgattcaagccgtaccgaacggacaatgggaaagcggtgcggcgttagggctaagtcgtgcgcatacgtttttaagaattattatgccgcaggtttggcgtcacgctttaccgggcttaagcaaccaatggttagtgttattaaaagatacggcgttgatttccttgatcggggtggacgatttaatgcgtcaaaccgatttaattaatacgaatgagcatcaaccttttacatggtacggtttggcggcgttaatttatttagcgattaccttaatcagccaagtgataattgccggacttgaaaaacgttttactcgctttgaaagagggggtaaataa

SEQ ID NO: 61184 - protein, 209 aa, Actinobacillus pleuropneumoniae serovar 1 str. 4074
MTLGLALTSLIVGLLLSMLFVVLETSKQPCISKPTSVFLALLRGLPEILVVLLIFFGSTELVEKITSEYVEFSAFSCGVLALSLIFSAYASQSLRGAIQAVPNGQWESGAALGLSRAHTFLRIIMPQVWRHALPGLSNQWLVLLKDTALISLIGVDDLMRQTDLINTNEHQPFTWYGLAALIYLAITLISQVIIAGLEKRFTRFERGGK

SEQ ID NO: 61185 - DNA, 654 bp, Ralstonia eutropha JMP134
  CDS (1)..(654)
atggattacgtcttatcccttctgccgcccctggcgcagggtgcgaaaatcaccctcacactattttttatcacgctggccctgtctgtaccgctcggcctggcgctggcgcttgcccgcatttcgaagtggccgctgctgagcagcctcgtcaacggctatatctggctgatgcgcggtacgccgctgatgctgcagatgctgttcatctatttcgcgctgccgttcgtgccggtcattggcgtgcggctgcctgattttcctgcggcggtggtggcgttcgcgctgaactacgccgcctatttcgcggaaatcttccgtgcgggcatcaagtcggtcgaccgtggacagtacgaagccagcaaagcgctcggcatgacctatttccagaccatgcgccgcgtcgtgctgccgcagatggtcagccgcgtattgccgccggtcagcaacgagaccatcacgctgatcaaggacacgtcgctgatctacgtgctggcgctcaacgatattcttcgcaccgcgcgcggcatcgtgcagcgcgatttcacgaccacgccgttcctggtggcagcgcttttctacttgctgatgacgctgatcctgacctggttcttccagaacctcgagaaacgctatgccaaacatgatgactga

SEQ ID NO: 61186 - protein, 217 aa, Ralstonia eutropha JMP134
MDYVLSLLPPLAQGAKITLTLFFITLALSVPLGLALALARISKWPLLSSLVNGYIWLMRGTPLMLQMLFIYFALPFVPVIGVRLPDFPAAVVAFALNYAAYFAEIFRAGIKSVDRGQYEASKALGMTYFQTMRRVVLPQMVSRVLPPVSNETITLIKDTSLIYVLALNDILRTARGIVQRDFTTTPFLVAALFYLLMTLILTWFFQNLEKRYAKHDD

SEQ ID NO: 61187 - DNA, 621 bp, Polaromonas sp. JS666
  CDS (1)..(621)
atgctcaagggcgcggcatggacgctgctgctggccgtggcatcggttttttttggcgccatcatcggcacttttgtggccatcacacggttggcgaagatgcccggcctggcgcggtttgccgcgctgtatgtcagctgcatgcgcggcacgccgctgctggtgcagctgtttgtgatttacttcggcctgcccagcattggcatccagttcgacccgatcacggcgggcatcctggggctgagcctcaacgtcggcgcgtacctgtcggaaacgattcgtggggcgatcaatggcgttgaacacgggcagtggaatgccgcccgcagcctgggcctcacgcaggcgcaaacgctgcgccatgtaatcgggccgcaagccttgcgcctggccgttcccagcctgtccaacagcctgatcagcctgatcaaggacacctcgctggtctcggtgattgccgtgggtgaactgatgctggccaccaaggaagtcattgccaccaccttccagcccttcccgttgtacctggcggcggccgcgatttactgggccatgagcgcatcgtttgaaacgctgcagaaaaagctggaagtgcggctgaaccggagctatttgcgctag

SEQ ID NO: 61188 - protein, 206 aa, Polaromonas sp. JS666
MLKGAAWTLLLAVASVFFGAIIGTFVAITRLAKMPGLARFAALYVSCMRGTPLLVQLFVIYFGLPSIGIQFDPITAGILGLSLNVGAYLSETIRGAINGVEHGQWNAARSLGLTQAQTLRHVIGPQALRLAVPSLSNSLISLIKDTSLVSVIAVGELMLATKEVIATTFQPFPLYLAAAAIYWAMSASFETLQKKLEVRLNRSYLR

SEQ ID NO: 61189 - DNA, 651 bp, Polaromonas sp. JS666
  CDS (1)..(651)
atgatccagtttctgcaccatgcacgggagttcatgcccatcctgctccagggggcctggctcaccatcctcgtgacgctgggctccttgctgctgtccaccatgctgggcctggtgtgggccgtcatgcgcgtgtcgggcatcccgctgctggccaatgcaagtgccgccgtcatcaacctgctgcgcggtatcccgatcatcgtgatcttgtttttcctgtatttcgtgatgcctgatgtcggcatttcgctgtcggcgctgcaggccggcatcctcggcctgggcatcgcctattcggcctaccaggccgagaatttccgcgccggcatcgaagcggtggaccatggccaggtcgaggcggcccgtgccatgggcatgagctgggggctgatgatgcgccgcgtggtgctgccgcaggccgtcaagatcgtgctgccgccctacggcaacatcatgatcatgatgctcaaggattcgtcgcaggcctcgaccatcaccgtcgccgaactggcgctgcagggcaagatgatcgccacgtccaccttccagaacgcgaccgttttcacgctggtcgcgctgatttacctggtcatgtgcgtgccgctgattctgctggtgcgccatcttgagaagcggggcaaaaaatga

SEQ ID NO: 61190 - protein, 216 aa, Polaromonas sp. JS666
MIQFLHHAREFMPILLQGAWLTILVTLGSLLLSTMLGLVWAVMRVSGIPLLANASAAVINLLRGIPIIVILFFLYFVMPDVGISLSALQAGILGLGIAYSAYQAENFRAGIEAVDHGQVEAARAMGMSWGLMMRRVVLPQAVKIVLPPYGNIMIMMLKDSSQASTITVAELALQGKMIATSTFQNATVFTLVALIYLVMCVPLILLVRHLEKRGKK

SEQ ID NO: 61191 - DNA, 789 bp, Polaromonas sp. JS666
  CDS (1)..(789)
atgaagtttgcgtttcccgaatggcccgggcactggagccggcaacagcgcagcagtgcgaccatggtgctggccagcgtggtgctggtggtcttgctgtggctgatggccattccgctggccctggtgcccgaaccgattggcgtgaatgcgcagtcctttgccaaaggcacccgtgtcacggtgcagctcaccgtgatcgccgggctggttggcattgtcatcggtgtgctggcggccctgggcaagatatcccggctgccgccgctgcgctggatcgcttcgctctacatctgggtcgtgcgcggcacgccgctgctggtgcaggtgctgttcgtcttcctggccttgccaacgctggtgccggcgctgcagctgagcgatttctcctcggcctgtgtggcgctggccttcaacgccggggcctacaacgccgaggccatccgcagcggccttcttgcggtaccgaaggggcagatcgaggctgcccgttccctggggctgtcgagttttttcaccttcatcgacgtgacctttccgcaggctttcaagatatcgctgccgccgctggtcaacaacacggtggccctgctcaaggactcgtcgctggcctatgcgatcggcgtcgtggaactgaccaatgtgggcaatcgcatccaggccgccacgttccagccgctgcccacgctggtgaccacggcggtcatctacctggtgctcacgaccgtgctcacccagatttcgggcgcggtggagcgccgctacgacgtggaaggacgccagccatga

SEQ ID NO: 61192 - protein, 262 aa, Polaromonas sp. JS666
MKFAFPEWPGHWSRQQRSSATMVLASVVLVVLLWLMAIPLALVPEPIGVNAQSFAKGTRVTVQLTVIAGLVGIVIGVLAALGKISRLPPLRWIASLYIWVVRGTPLLVQVLFVFLALPTLVPALQLSDFSSACVALAFNAGAYNAEAIRSGLLAVPKGQIEAARSLGLSSFFTFIDVTFPQAFKISLPPLVNNTVALLKDSSLAYAIGVVELTNVGNRIQAATFQPLPTLVTTAVIYLVLTTVLTQISGAVERRYDVEGRQP

SEQ ID NO: 61193 - DNA, 669 bp, Polaromonas sp. JS666
  CDS (1)..(669)
atggaactcgatttttctcccatctggtccggctggccccagctgttgcgtggtgcgctggtgaccgtggaaatcacggcggcctcgctgctgctgggttgcgtcatggggctgctggtcggtatcggccggctcaaccccaggcggcgcattgtctatggcctgtgcacggcctatgtggcgatcatccgcggcacgccgctgctggtgcagttgttcattctgttctttggcctgccgcagttcggcatcctgctgccggcttttgtatgcggcgtgattggcctgggcatctactccggagcctatgtttcggaggtcgtgcgtggcgccatccagtccattgaccgcggccagatggaggctgcccgctccatcggcatgtcgtcggggctggcgatgcgcgccgtggtgctgccccaggccgtggtgcgcatgattccgccgctgggcaatgaattcattgccctcatcaagaactcggccctggtgtcgctgctgaccatccatgacgtcatgcacgaagggcaaaaaatcatcagcgtgtcctatcgttcactggaggtgtacctggccatcgccgtggtgtatttcgtactgaccggtgcaaccactctggtgttgcgccgcatggagttgcgcctgcgcgcaggagggatggtgcaatga

SEQ ID NO: 61194 - protein, 222 aa, Polaromonas sp. JS666
MELDFSPIWSGWPQLLRGALVTVEITAASLLLGCVMGLLVGIGRLNPRRRIVYGLCTAYVAIIRGTPLLVQLFILFFGLPQFGILLPAFVCGVIGLGIYSGAYVSEVVRGAIQSIDRGQMEAARSIGMSSGLAMRAVVLPQAVVRMIPPLGNEFIALIKNSALVSLLTIHDVMHEGQKIISVSYRSLEVYLAIAVVYFVLTGATTLVLRRMELRLRAGGMVQ

SEQ ID NO: 61195 - DNA, 687 bp, Streptococcus pyogenes M49 591
  CDS (1)..(687)
atggatttgtcgtttttgcccaaatactgggcctactttaactacggtgtacttgtcaccattatgatttcagtcagcgttgtcttttttggaacccttattggtgtcttggtaaccctgattaagcgtagtcatgtgaagccgttgacctgggtcgttaatctttacgtttggatctttcggggaacacctatggtggttcaaatcatgattgcctttgcttggatgcattttaacaatatgcctactattggttttggggttttagacttggacttttcaagactacttcctggaattattatcatttcattgaatagcggtgcttatatttcagaaattgttagagcaggtattgaggctgtaccaaaagggcaattagaagcagcttattcactaggtattcgtcctcaaaatgccatgcgttatgtgattttgcctcaggcctttaaaaatattttgccagccttaggaaatgaatttattaccattattaaggatagtgctcttttacaaaccattggagtgatggaactttggaatggtgcccaatcagtggtaacggctacttattctccaatttcccctttactggtggctgctttttactacttaatggtcacaacagtgatggcacagttattggcagtcttagaacgtcacatggcgcaaggaggtaatcattga

SEQ ID NO: 61196 - protein, 228 aa, Streptococcus pyogenes M49 591
MDLSFLPKYWAYFNYGVLVTIMISVSVVFFGTLIGVLVTLIKRSHVKPLTWVVNLYVWIFRGTPMVVQIMIAFAWMHFNNMPTIGFGVLDLDFSRLLPGIIIISLNSGAYISEIVRAGIEAVPKGQLEAAYSLGIRPQNAMRYVILPQAFKNILPALGNEFITIIKDSALLQTIGVMELWNGAQSVVTATYSPISPLLVAAFYYLMVTTVMAQLLAVLERHMAQGGNH

SEQ ID NO: 61197 - DNA, 702 bp, Lactobacillus fermentum
  CDS (1)..(702): transl_table=11
atgtgggaaattatcaagacatccttaccacaactattagcggcgggatttaaatatacgattccgttggcgataatttcatttttctttggcataatcattgcactagtaacagcattgactcgtctttcacgacagcgggggccattcatgattcttaagtggattgcgagcttttatgtatggctttttcggtccacgccactgttagttcaactgttcattgtctttttcgggcttccttatttgaggataaagggcatcttgccgcatgggattaaactagagccatttacagccggcattattacattttctcttaataccggggcctatgcttcagagacaattcgcgcggcaatcagttcagtaccaagaggacagtgggaagcaggagcagcaatcggaatgacccggttacaaattctatggcgaattattcttcctcaagccttaagagtagccttaccgccattatcgaatagtttcattagcttggtaaaggatacgtcgctggctgcttcaatcacaattatggaaatgtttgcggtcagccagcaaattgcggcggaaaattatcagccgttgcttatgtataccttagtagcgatggtttatgctgtttttacaacggtcctatcttaccttcaaggctacctggaaagaattgttgaccggcaagtaaatgcaaataataggtga

SEQ ID NO: 61198 - protein, 233 aa, Lactobacillus fermentum
MWEIIKTSLPQLLAAGFKYTIPLAIISFFFGIIIALVTALTRLSRQRGPFMILKWIASFYVWLFRSTPLLVQLFIVFFGLPYLRIKGILPHGIKLEPFTAGIITFSLNTGAYASETIRAAISSVPRGQWEAGAAIGMTRLQILWRIILPQALRVALPPLSNSFISLVKDTSLAASITIMEMFAVSQQIAAENYQPLLMYTLVAMVYAVFTTVLSYLQGYLERIVDRQVNANNR

SEQ ID NO: 61199 - DNA, 651 bp, Rhizobium sp
  CDS (1)..(651): transl_table=11
atgggtcccatcggcgaaaatgaattcttctttttgatgcagggtttgaagtggaccgtgctgctcgcgatcgtgggtttcatcggtggggggatattcggaatcctgatcgcgctgctgcgcacctccaagaagaaggtcgcccggacgatcaccgcaggatatataggcgtcttccagggcacgccccttctgatgcagctcttcgttgtatattacggcgttgcgctattgggcatcgaggtcaacgcgtggatcgcggtcgcaatcgccttcacgctccatgccagtgctttcctgggcgagatctggcgcggctccatcgaggctgtgccgaagggccagacggaagccgccaacgccctcggtctgcattatgtctcgcggatgaaagacatcatcctgccgcaggccctgaaaatctcgatgccggccaccatcggcttccttgtccagctcatcaagggcacgtcgctggcagcaatcgtcggcttcattgaactcactcgcgccggccagatcatatcaaaccagacctatcgtccgctgctcgtcttcgggatcgtcggcgcaatctacttcatcatttgctggccgctctcccatgccggaagtggcctcgaaaaacggatggcgaaagctgcccgctaa

SEQ ID NO: 61200 - protein, 216 aa, Rhizobium sp
MGPIGENEFFFLMQGLKWTVLLAIVGFIGGGIFGILIALLRTSKKKVARTITAGYIGVFQGTPLLMQLFVVYYGVALLGIEVNAWIAVAIAFTLHASAFLGEIWRGSIEAVPKGQTEAANALGLHYVSRMKDIILPQALKISMPATIGFLVQLIKGTSLAAIVGFIELTRAGQIISNQTYRPLLVFGIVGAIYFIICWPLSHAGSGLEKRMAKAAR

SEQ ID NO: 61201 - DNA, 690 bp, Rhizobium sp
  CDS (1)..(690): transl_table=11
ttggatttttcgtggatcttctcctattggccgctgcttgccgcgggcgccgtgcagaccgtgctgctgctggtgatttcggtcggctgcggcttcattctggcgatcggccttgccctggcgcaggtggtcgggccgcgctggctgaaactcttcgcacgcggctactgcacctgcctgcgcggaacgccgctgctgatccagctctggctgctctactacggcgtcggctcgctgctgccgatgatcccggggctgcgtgcgagtttcctctggccgatcctgcgcgaaggcttcttctttgcagccgtgagcttcaccctcaactatgcggcttacgaggccgaggtgctgcgcggcgcgcttctcgccgttccgaagggcgaactcgaggcgggccgctcgttcggtatgtcgtcctcgacgctcttcaggcgaatctggttgccgcgcgccatccgcatcgccttgccgacgatcgccggggaggtcgtgctgcaattgaaggcgacacctctcgccttcacggtgaccgtgatggacctctatgccgtcgcctacaaggtgagacaggacacgctgctggtctacgaaccgctgatggtcgtcaccgtcttctatgtctgcctgaccctcatcatcacccgcgccttcaagatcgtcgaagcgcaggttccggtgcggcgctag

SEQ ID NO: 61202 - protein, 229 aa, Rhizobium sp
MDFSWIFSYWPLLAAGAVQTVLLLVISVGCGFILAIGLALAQVVGPRWLKLFARGYCTCLRGTPLLIQLWLLYYGVGSLLPMIPGLRASFLWPILREGFFFAAVSFTLNYAAYEAEVLRGALLAVPKGELEAGRSFGMSSSTLFRRIWLPRAIRIALPTIAGEVVLQLKATPLAFTVTVMDLYAVAYKVRQDTLLVYEPLMVVTVFYVCLTLIITRAFKIVEAQVPVRR

SEQ ID NO: 61203 - DNA, 882 bp, Rhizobium loti
  CDS (1)..(882): transl_table=11
atgttcaacctttcgggcacagcgttcggcgaccttatgcggcctgttatcggcgacccgctgcagagcggcatttatgggcgtgtcgcaatcgccttcgtcattgcggtgatgttctgcgtcaacatcgtgctgatcgggtttgcccccttgagggtgcagatcggcattgtatgggccgagctgctgctgctgtttctcggcttcttcaacgcatttaaccttaacatgccgttcatctgggagcatctgccatacctgatcacgcagggtgtggtgaccacgatttatgtttcggcagtttcacttattttcgcatcaatcatcgcgatgatcgctgctattgcaaagctttcaagcaatggcttcgcctatgccctcgccagcttttacacctcgtttttccgcggtctgccgcttcttatccagatttacctgatttacctggggctgccgcagctgggtatcgtgatcaatgcagttccttcgggtatattggcactgtcgctttgcgtaggagcttatatgacggaaatcttccgcgcgggtatccagagcattgaccgcggccaatgggaagcatcccgttcgatcggctttggcttcggccttaccatacgcaagataatcctgccgcaggcgcttccagtcatcattccccccatgggcaacacgttcattgcaatgctgaaagacagctcgcttgtctcggtcctcggcgtatgggagttgacattccttgctcgcacgatcggccagccgacctttcatcatatggagatgctgataacagcggcgatgatctattggatcctgtccgcctgcctcgaggtgctccaatcacggcttgagcaccacttcgcaaggagtaaagtgcgatga

SEQ ID NO: 61204 - protein, 293 aa, Rhizobium loti
MFNLSGTAFGDLMRPVIGDPLQSGIYGRVAIAFVIAVMFCVNIVLIGFAPLRVQIGIVWAELLLLFLGFFNAFNLNMPFIWEHLPYLITQGVVTTIYVSAVSLIFASIIAMIAAIAKLSSNGFAYALASFYTSFFRGLPLLIQIYLIYLGLPQLGIVINAVPSGILALSLCVGAYMTEIFRAGIQSIDRGQWEASRSIGFGFGLTIRKIILPQALPVIIPPMGNTFIAMLKDSSLVSVLGVWELTFLARTIGQPTFHHMEMLITAAMIYWILSACLEVLQSRLEHHFARSKVR

SEQ ID NO: 61205 - DNA, 693 bp, Aeromonas hydrophila
  CDS (1)..(693): transl_table=11
atggatttctcaatcattctcagcgaatggcccacctactggcaaggcctctacaccacggtactgctggtggctgcctccctgatcctcgggctgatgctggcggtgccactcggcatcctgcgcaacagtcgcaactggctgatcaaggggccgatctgggcctacatctacttctttcgcggcaccccgctcttggtgcagctgttcatcatctactacggcgccgcccagtgggagtggctgaaaaacagcgtcgcctgggatctgtttgccgaagcctggttctgcgccctgctggcgttcaccctgaacaccggggcctacaccgccgaaatcgtgcgcggcgccgtgctcaacatgcccaaggggcagattgaagcggccaacgccttcggcatgacccgctggcagaccctcactcgcatcattctgcccaactcgtttcgccgggcactgccggcctacagcaacgaggtgatcttcatgctgcagggctcggcggtggcgggcatcatcaccatcgtcgatctgaccggcgccgcgcggatcatcaactcccgctactacagtccgttcgaggcgttcctgaccgccggcctgctctacatgctgctgaccttcgtcatcgtctggttgttcaagaagtgggaagcccgctggcacgcccacctgcgcccccgcaccgtgtaa

SEQ ID NO: 61206 - protein, 230 aa, Aeromonas hydrophila
MDFSIILSEWPTYWQGLYTTVLLVAASLILGLMLAVPLGILRNSRNWLIKGPIWAYIYFFRGTPLLVQLFIIYYGAAQWEWLKNSVAWDLFAEAWFCALLAFTLNTGAYTAEIVRGAVLNMPKGQIEAANAFGMTRWQTLTRIILPNSFRRALPAYSNEVIFMLQGSAVAGIITIVDLTGAARIINSRYYSPFEAFLTAGLLYMLLTFVIVWLFKKWEARWHAHLRPRTV

SEQ ID NO: 61207 - DNA, 702 bp, Lactobacillus reuteri
  CDS (1)..(702): transl_table=11
atgtgggaaattatcaagacatctttaccacaactcttagcagcgggatttaaatatacgattccgttagcgattatttcatttttatttggactgattattgcactagtaacagctttaattcgtctctctcgtcaacgtggcgcattcatgattcttaaatggattgctagtttttatgtctggctttttcggtcaacaccgctgttggttcaattatttattgtattctttggactgccatatctgagaattaagggagtcctgccgcatggaataaaattagaaccatttacagccggcattattacattttcacttaataccggtgcttatgcttccgaaacaattcgggcagcgatcagttcagttccaactgggcaatgggaagcaggtgcagctatcggaatgacgcgactgcaaatcttgtggcgaattattttaccgcaagccttaagagtagctttaccacccttatcaaacagttttataagtttggtaaaggacacgtcattagctgcttcaattacaattatggaaatgtttgctgttagtcaacaaattgcggccgaaaattatcaaccattacttatgtatactttagtagcaatggtttacgcggcctttacgacaattttatcttatttccaaggatatcttgagcgggtagtagatcggcaagtgaatgcaaataataggtga

SEQ ID NO: 61208 - protein, 233 aa, Lactobacillus reuteri
MWEIIKTSLPQLLAAGFKYTIPLAIISFLFGLIIALVTALIRLSRQRGAFMILKWIASFYVWLFRSTPLLVQLFIVFFGLPYLRIKGVLPHGIKLEPFTAGIITFSLNTGAYASETIRAAISSVPTGQWEAGAAIGMTRLQILWRIILPQALRVALPPLSNSFISLVKDTSLAASITIMEMFAVSQQIAAENYQPLLMYTLVAMVYAAFTTILSYFQGYLERVVDRQVNANNR

SEQ ID NO: 61209 - DNA, 942 bp, Streptomyces coelicolor A3
  CDS (1)..(942): transl_table=11
gtgactgttgacatcgacaagacggcgggcggcccggccggcaccccgccgaccccgcccgaggccatcaaggccatcccggtgaggcactacgggcggtacgtctccgcggtcgtcgcgatcgcgctgctggccgcggtcgtctacgccttctcccagggcaagatcaactggggcgcgatcccggactacttcttcgacgaccgtgtcctgaccggcatgggcaagacgctcctgatcaccgtcctcgcgatgctgatcggtgtcgtcggcggcatcctgctcgccgtgatgcggctgtcgaagaacccggtgacctcgtccatcgcgtggttctacatctggttcttccgcggcaccccgcagctggtggtctggttcaacctcggcctggtcttcgagtacatcaacctcggcccgttctaccgcgacgagtggtcggacttcatgacgccgttcctgacggcgctgctcggcctcggcctcaacgaggcggcgtacatggcggagatctgccgcgccggcctgctcgcggtcgacgagggccagaccgaggcggcgcacgcgctcggcatgagccacaccaagacgctgcgccggatcgtggtcccgcaggcgatgcgcgtgatcgtgccgccgacgggcaacgaggtcatcaacatgctgaagacgacctcgctggtgtcggtcgtccagtacgccgagttgttcagagtcgcccaggacatcggccagacctctggcgcaccggccgagatgctgttcctcgcggcggcctggtacctgctgctgacctccgtcttcagcgtcggccagtactacctggagcgctactacgcccgcggctccagccgcagtctgccgcccaccccgatgcagaagatcagggccaacctgttctccctgtcgaaccgctccagcacgacgggaggtgcggcatga

SEQ ID NO: 61210 - protein, 313 aa, Streptomyces coelicolor A3
MTVDIDKTAGGPAGTPPTPPEAIKAIPVRHYGRYVSAVVAIALLAAVVYAFSQGKINWGAIPDYFFDDRVLTGMGKTLLITVLAMLIGVVGGILLAVMRLSKNPVTSSIAWFYIWFFRGTPQLVVWFNLGLVFEYINLGPFYRDEWSDFMTPFLTALLGLGLNEAAYMAEICRAGLLAVDEGQTEAAHALGMSHTKTLRRIVVPQAMRVIVPPTGNEVINMLKTTSLVSVVQYAELFRVAQDIGQTSGAPAEMLFLAAAWYLLLTSVFSVGQYYLERYYARGSSRSLPPTPMQKIRANLFSLSNRSSTTGGAA

SEQ ID NO: 61211 - DNA, 669 bp, Escherichia coli
  CDS (1)..(669): transl_table=11
atgtttgagtatttacccgagctgatgaaagggctgcacaccagcctgacgctaaccgttgcctcgctgattgtggcactgattctggcattgatttttaccatcatcctgacgctgaaaacgccggtgctggtgtggctggtgcggggttatatcacgctgtttaccggtacgccgctgctggtgcagatcttcctgatttattacgggccgggccagtttccgacgttgcaggagtatccggcactgtggcatttgttgtcagaaccgtggttatgtgcgctgattgcgttatcgctgaacagtgcggcgtataccacgcagctgttttacggtgcaattcgtgcgatcccagaaggtcagtggcagtcctgtagcgccctgggaatgagcaaaaaagatacgctggcgatcctgctgccgtatgcctttaaacgctcgctctcttcttattccaacgaagtggtgctggtgttcaaaagtacctctctggcttacaccattacgctgatggaagtgatgggatacagccagttgttgtacggacgcacctacgatgtaatggtgttcggtgcggcagggattatttacctggtcgtcaacggcctgctgacgctgatgatgcgtctgatcgagcgcaaagcactggcattcgaacggcggaattaa

SEQ ID NO: 61212 - protein, 222 aa, Escherichia coli
MFEYLPELMKGLHTSLTLTVASLIVALILALIFTIILTLKTPVLVWLVRGYITLFTGTPLLVQIFLIYYGPGQFPTLQEYPALWHLLSEPWLCALIALSLNSAAYTTQLFYGAIRAIPEGQWQSCSALGMSKKDTLAILLPYAFKRSLSSYSNEVVLVFKSTSLAYTITLMEVMGYSQLLYGRTYDVMVFGAAGIIYLVVNGLLTLMMRLIERKALAFERRN

SEQ ID NO: 61213 - DNA, 684 bp, Haemophilus influenzae
  CDS (1)..(684): transl_table=11
atgtttcaagaatatttaagcgtgatcgtaaaagggattccaacgagtttgttgcttactgtcgtatccttactgattgctttctttttagccttatttcttacttttttactttcaatggaaaataaatggataaaaagtgcggtcaatttataccttactttattcacaggcacgccactgttagtacagttctttttaatttatgcaggacccggtcaattccaatggattattgacagcccattatggtatgtcttatccaatgcgtggttctgtgctgcattagctttagcactaaacagtgcagcctattccacccaattatttcacggtgcagtgaaagccattcccaaaggacaatgggaaagttgtggcgcattaggattaaaccgcatacaaactttaaaaattttaattccttatgccttaaaacgtgcgttgccttcttacagtaacgaaattattttggtatttaaaggcacggcattagcatccaccattacgattatggatattatgggttacgcacgccaactctatggtacagaatatgatgcactcacaatttacggcattgcgggtggtatctatttaattatcacaggcattgcaacattattactacgtaaattagagaaaaaagtattggcatttgaacgttttgaagtaagcaaagcataa

SEQ ID NO: 61214 - protein, 227 aa, Haemophilus influenzae
MFQEYLSVIVKGIPTSLLLTVVSLLIAFFLALFLTFLLSMENKWIKSAVNLYLTLFTGTPLLVQFFLIYAGPGQFQWIIDSPLWYVLSNAWFCAALALALNSAAYSTQLFHGAVKAIPKGQWESCGALGLNRIQTLKILIPYALKRALPSYSNEIILVFKGTALASTITIMDIMGYARQLYGTEYDALTIYGIAGGIYLIITGIATLLLRKLEKKVLAFERFEVSKA

SEQ ID NO: 61215 - DNA, 666 bp, Haemophilus influenzae
  CDS (1)..(666): transl_table=11
atgttttctgactttctttctttaatgtttaccgctgctctaatgactttagggcttgcggtctgttcattgctcttaggcttatttttaagccttatttttgccgtgcttgaagcaaatcgctttgttggcaagccgatgacagtatttgtggcattattacgtggcttacccgaaattattgttgtattacttgtctattttggttctactgaattagtagaaatgctgacaggagaatacattgaatttggggcatttggctgtggcgtgcttgcgctttctcttatttttgcagcttatgcttcacaaacattacgcggtgcaattcaagccataccaaaaggacaatgggaatcaggtgcagcgttaggcttaagcaaaagctatacgttcattcatattgttatgccacaagtatggcgtcacgccttacctggtttaagcacccaatggcttgtattgctaaaagatacggcattggtttcattaattggtgtggacgatttgatgcaccaagcggatctgattaataccaatacacatcagccttttacttggtatggtattgctgcgttaatttatttggcagtgacattaattagccaagttggtattcgaaaattagagctgcgttttactcgttttgaaaggggcgtgaaataa

SEQ ID NO: 61216 - protein, 221 aa, Haemophilus influenzae
MFSDFLSLMFTAALMTLGLAVCSLLLGLFLSLIFAVLEANRFVGKPMTVFVALLRGLPEIIVVLLVYFGSTELVEMLTGEYIEFGAFGCGVLALSLIFAAYASQTLRGAIQAIPKGQWESGAALGLSKSYTFIHIVMPQVWRHALPGLSTQWLVLLKDTALVSLIGVDDLMHQADLINTNTHQPFTWYGIAALIYLAVTLISQVGIRKLELRFTRFERGVK

SEQ ID NO: 61217 - DNA, 657 bp, Rickettsia prowazekii
  CDS (1)..(657): transl_table=11
atgttgatgtatttattaaaatattatccaaaaattctttttattatagagggaactttggtaactttaaaatatagtgttattgctgttatattaggtctagtaatagggatgcttcttgctatttgtaaggtaaataagaatcgtgttttaagactttttgcaaatttctatacttctatttttagaggtacacctttactagttcaattaagtattatttattttgctgcgccttatatcataaacattaaatttaatgtgtttatggctggggttatttcttttgcactgaattctggcgcatatgtttctgaagtaatcagggctggaattaatactgttgataaagggcaatttgaagctgctgaagctcttgcgattccaaaatttttaataatgaaagatataatcctgccgcaagctattaacaatattttcccgtcattagtaaatgagcttgtaaatttgatcaaagaatcagcaattatttctatgcttggagaaatggatttaatgcgtagagcacaaattgtatcaattgaaacatataattatttttttccaatgcttattgcagcgtgttgttattatattttagttatattaatcagctttatagcaaaaataattgagaaaaaaatgattgttaattaa

SEQ ID NO: 61218 - protein, 218 aa, Rickettsia prowazekii
MLMYLLKYYPKILFIIEGTLVTLKYSVIAVILGLVIGMLLAICKVNKNRVLRLFANFYTSIFRGTPLLVQLSIIYFAAPYIINIKFNVFMAGVISFALNSGAYVSEVIRAGINTVDKGQFEAAEALAIPKFLIMKDIILPQAINNIFPSLVNELVNLIKESAIISMLGEMDLMRRAQIVSIETYNYFFPMLIAACCYYILVILISFIAKIIEKKMIVN

SEQ ID NO: 61219 - DNA, 708 bp, Salmonella typhimurium
  CDS (1)..(708): transl_table=11
gtgattgagatcattcaggagtactggaaatccctgctttggacggatggctatcgttttaccggcgtggcgattacgctgtggctgttaatttcatcggtggtgatgggcggtcttctggcggtgattctggcggtaggccgcgtttccagtaataaattcatccgttttcccatctggctgtttacgtatatttttcgcggcacgccgctgtacgtacagctactggtgttctattcggggatgtatacgctggagatagtcaaaggcaccgatcttcttaacgcgtttttccgcagcggactaaactgtaccgtactggcgctgacgctgaatacctgcgcgtacaccacggaaattttcgccggggcgattcgctcggtaccgcacggtgaaattgaagcggcacgggcctatggcttctcgtcatttaaaatgtatcgctgcattattttgccgtcggcattacgcatcgccttgcctgcctacagcaacgaagtgattttaatgctgcactctacggcgctggcgtttaccgcgacggtgccggatttgttgaaaatcgcccgcgatattaactcagcgacttaccagccgtttaccgcgtttggcattgccgccgtgttgtatttactcatttcgtatgtcctgataagcctgttccgtcgggcggaaagacgctggttgcagcacgtgtcctctaaataa

SEQ ID NO: 61220 - protein, 235 aa, Salmonella typhimurium
MIEIIQEYWKSLLWTDGYRFTGVAITLWLLISSVVMGGLLAVILAVGRVSSNKFIRFPIWLFTYIFRGTPLYVQLLVFYSGMYTLEIVKGTDLLNAFFRSGLNCTVLALTLNTCAYTTEIFAGAIRSVPHGEIEAARAYGFSSFKMYRCIILPSALRIALPAYSNEVILMLHSTALAFTATVPDLLKIARDINSATYQPFTAFGIAAVLYLLISYVLISLFRRAERRWLQHVSSK

SEQ ID NO: 61221 - DNA, 687 bp, Escherichia coli
  CDS (1)..(687): transl_table=11
atgttgtatgggttttcaggtgttattttacagggtgcgctcgtcacgctggagctggctatcagctctgtagtgctcgctgtaatcatcggtttaattggcgctggcggtaagctctcgcaaaatcggctttcggggctgattttcgaagggtacaccacgctgattcgtggcgtgccggacttagtgttgatgctgctgattttctacggtttgcagattgcgctaaacacggtgacggaggcgatgggcgtcgggcagattgatatcgatccgatggtcgctggtattatcactctcggttttatctacggtgcttattttaccgaaacgttccgtggtgcttttatggcagtgccgaaaggacatatagaggcggcgacggcgttcggttttactcgtgggcaagtgtttcggcggatcatgtttccgtcgatgatgcgttacgccctgccaggcattggcaacaactggcaggtgatcctcaaatctaccgcactggtttcgttactcggcctggaagatgtggtcaaagccacccaactggcaggcaaaagtacctgggaaccgttctatttcgccatcgtctgtggcgtgatttacctggttttcaccactgtttccaatggtgtgctgctgttccttgagcgccgctactccgtgggtgtgaagagggctgacctgtga

SEQ ID NO: 61222 - protein, 228 aa, Escherichia coli
MLYGFSGVILQGALVTLELAISSVVLAVIIGLIGAGGKLSQNRLSGLIFEGYTTLIRGVPDLVLMLLIFYGLQIALNTVTEAMGVGQIDIDPMVAGIITLGFIYGAYFTETFRGAFMAVPKGHIEAATAFGFTRGQVFRRIMFPSMMRYALPGIGNNWQVILKSTALVSLLGLEDVVKATQLAGKSTWEPFYFAIVCGVIYLVFTTVSNGVLLFLERRYSVGVKRADL

SEQ ID NO: 61223 - DNA, 726 bp, Agrobacterium tumefaciens
  CDS (1)..(726): transl_table=11
atggatattcaactcatcatcgagtcgttcccgaaactgctcgccgccgtccccacgacgctcaccctcgcgttcatatcgctcctcatcgggtttgttgtttctgtgcctgttgcgctgatgcggctttcgaagaaccgtatcgtttcttcattggcatacggctacgtctacatcatcagatcgacgccgcttctggtgcagatgttcctgatttactacggctccgctcagttcaggggcgttctctccgaagttggcttgtggtcgtcattccgcgagccatggttctgcgcgatcctggcgctggccctcaataccgcagcctacaccagcgagatcatccggggcggcatccagtcggtttcgctcgggcagatcgaagcagcgcgtgcagtcggaatgtcgacctttcttcaattccggaggatcgtgttcccgatcgccattcggcaagcattgccggcatatggcaacgaagtgatgctcatcatcaaatcgacgtcgcttgcttcgacaatcaccattgtcgaagtgaccggtctggcgaagcagatcatctcggccacctacagcccggtcgaagtgttcatcgtcgccggtgcgatctacctgtttatcacgttcgttgtcagccgtctggtcatgctggcggagtggtggctgaatccgcacatgcgcgcccgggtgggcggaacggctccgaaggccgcggagacgcattag

SEQ ID NO: 61224 - protein, 241 aa, Agrobacterium tumefaciens
MDIQLIIESFPKLLAAVPTTLTLAFISLLIGFVVSVPVALMRLSKNRIVSSLAYGYVYIIRSTPLLVQMFLIYYGSAQFRGVLSEVGLWSSFREPWFCAILALALNTAAYTSEIIRGGIQSVSLGQIEAARAVGMSTFLQFRRIVFPIAIRQALPAYGNEVMLIIKSTSLASTITIVEVTGLAKQIISATYSPVEVFIVAGAIYLFITFVVSRLVMLAEWWLNPHMRARVGGTAPKAAETH

SEQ ID NO: 61225 - DNA, 738 bp, Agrobacterium tumefaciens
  CDS (1)..(738): transl_table=11
atgccgttcgatcccgcatttctctggcagaccttcgtcgctttgctttccggcattccgcttgcactgcaactcgctgtgttctcggtggcgctcggaacggttctcgctttcggcctggcgctgatgcgcgtgtctcgcctctggtggcttgatctgccggcacgcttctacattttcgcgtttcgtggcacgccgcttctggttcagatctacatcatttactacgggctgagccaatttcccgatgttcggcatagcttcatctggccattcctgcgcgatgcttactggtgcgcgatggcggcactggcattgaataccgctgcttacacagcagagatcatgcgtggaggtttgctttcggtgcccgcgggacagatcgaggctgcgaaagcgtgcggtatgggcagggtaaagctgtttcgccggatcgttattccgcaggcgatacgacagatgctgccgggctacagcaatgaagtaatcttgatggtcaagtcgacatcgctcgcttccaccatcaccatcatggaaattaccgggatcgcagccaaactgatctcggaaagctaccggacagtcgaagtcttctcctgtgccggggctatctaccttatcctcaacttcatcgtcgcgcgtcttttcacgttgcttgaatgggctctctggcccgaacggcgaaacaatagacttacaacagatcctgtcgaccgaaagggcgaactccatgcctaa

SEQ ID NO: 61226 - protein, 245 aa, Agrobacterium tumefaciens
MPFDPAFLWQTFVALLSGIPLALQLAVFSVALGTVLAFGLALMRVSRLWWLDLPARFYIFAFRGTPLLVQIYIIYYGLSQFPDVRHSFIWPFLRDAYWCAMAALALNTAAYTAEIMRGGLLSVPAGQIEAAKACGMGRVKLFRRIVIPQAIRQMLPGYSNEVILMVKSTSLASTITIMEITGIAAKLISESYRTVEVFSCAGAIYLILNFIVARLFTLLEWALWPERRNNRLTTDPVDRKGELHA

SEQ ID NO: 61227 - DNA, 738 bp, Rhizobium meliloti
  CDS (1)..(738): transl_table=11
atgccgttcgatccgctgtttctttgggagaccttcattgccttgcttgccggtattccgttggcgctcaaactagcggtgttctcgattgcagtcggaacagtcctcgcctttagcctggcgctgatgcgtgtatcgcgtcgctggtggctcgacttcccagctcgattttacatatttgcctttcgaggtaccccacttctggtccaaatttacatcatatactacggcctcagccagtttcctggtcttcggcacagcttgctttggccatttctgcgcgaagcatattggtgtgcactcggagcgttggcgttaaacacggctgcctatagcgcggagataatgcgagggggcctcctctccgttcctgccgggcagatcgaagctgctcgtgcgtgcggcatggcgcgggtacttctatttcgacgaattatcattccgcaggcgatccggcagatgctgcccggctacagcaacgaagtagtcttgatggtcaaatcgacctcactcgcttcgacaatcacccttatggaaatcactgggatcgcggccaaattgatttcggaaacctatcggcccgtagaggtcttcgcctgcgccggagccatctatctgacgatgaatttcatagctgcacgtctctttgcccttatcgagtggtccttgtggcctgagcggcgcaagaccaggaggccggttgatctagccgatcaaaaaggagagcttcatgtctaa

SEQ ID NO: 61228 - protein, 245 aa, Rhizobium meliloti
MPFDPLFLWETFIALLAGIPLALKLAVFSIAVGTVLAFSLALMRVSRRWWLDFPARFYIFAFRGTPLLVQIYIIYYGLSQFPGLRHSLLWPFLREAYWCALGALALNTAAYSAEIMRGGLLSVPAGQIEAARACGMARVLLFRRIIIPQAIRQMLPGYSNEVVLMVKSTSLASTITLMEITGIAAKLISETYRPVEVFACAGAIYLTMNFIAARLFALIEWSLWPERRKTRRPVDLADQKGELHV

SEQ ID NO: 61229 - DNA, 681 bp, Bacillus subtilis
  CDS (1)..(681): transl_table=11
atgatcaatagcattcagtgggaatatattttcaacacgaagctggccattgaatcgttcccttatgtcataaaaggcattggttatacactgctcatctcttttgtaagcatgtttgcgggaactgtgatcggcctgttcatatcactcgccagaatgtctaaacttgctttgttaagatggccggcgaagctctatatctcatttatgcgaggcgttccgattttggtgattttgtttatcctttatttcgggtttccttatatcggcattgaattttccgctgtcacggctgctttaatcggctttagcctaaacagcgccgcctacattgcggaaattaaccgttcagccatttcatccgtcgaaaaaggacagtgggaagccgcatcctcgctgggtctttcctattggcagacgatgaggggcatcattttgccgcaatcgatacgtattgcgctgcctccgcttgccaatgtattgctcgacttgatcaaggcgtcctctctcgctgcgatgattacagtgccggaattgctccagcatgcgaaaatcatcgggggcagagagtttgattatatgaccatgtatattctgaccgctctcatttattgggccatctgctccattgccgcggtctttcagaatatccttgagaaaaaatacgctcattatgtttaa

SEQ ID NO: 61230 - protein, 226 aa, Bacillus subtilis
MINSIQWEYIFNTKLAIESFPYVIKGIGYTLLISFVSMFAGTVIGLFISLARMSKLALLRWPAKLYISFMRGVPILVILFILYFGFPYIGIEFSAVTAALIGFSLNSAAYIAEINRSAISSVEKGQWEAASSLGLSYWQTMRGIILPQSIRIALPPLANVLLDLIKASSLAAMITVPELLQHAKIIGGREFDYMTMYILTALIYWAICSIAAVFQNILEKKYAHYV

SEQ ID NO: 61231 - DNA, 669 bp, Escherichia coli
  CDS (1)..(669): transl_table=11
atgcaagaaagtatacaactggttattgattccttgccgttcctgttgaaaggggctgggtataccctgcaactcagtatcggcggcatgttttttggcttactactcgggtttattctcgcgctgatgcgcctgtcgccaatctggcccgtgcgctggctggcgcgtttttatatctctatttttcgtggtacgccgctcatcgcacaactgtttatgatctattacggcctgccgcagtttggtatcgaattagatcccattccgtcagcaatgattggtctgtcgctgaacactgccgcctatgccgccgaaacgctgcgcgccgccatttcttctattgataaaggtcagtgggaagccgctgccagtattggtatgacgccgtggcagaccatgcgtcgcgcgattttgccacaggcggcgcgggtggcgttgccgccgctgtcgaacagctttatcagtctggtaaaagatacgtcgctggccgcgacaatccaggtgccggagctgttccgtcaggcgcagttgattacctcgcgcacgctggaggtgttcaccatgtacctggcggcttcgctcatctactggatcatggcgactgtgttatcgacgttgcagaaccattttgagaatcaacttaatcgccaggagagagaaccaaaatga

SEQ ID NO: 61232 - protein, 222 aa, Escherichia coli
MQESIQLVIDSLPFLLKGAGYTLQLSIGGMFFGLLLGFILALMRLSPIWPVRWLARFYISIFRGTPLIAQLFMIYYGLPQFGIELDPIPSAMIGLSLNTAAYAAETLRAAISSIDKGQWEAAASIGMTPWQTMRRAILPQAARVALPPLSNSFISLVKDTSLAATIQVPELFRQAQLITSRTLEVFTMYLAASLIYWIMATVLSTLQNHFENQLNRQEREPK

SEQ ID NO: 61233 - DNA, 660 bp, Bacillus subtilis
  CDS (1)..(660): transl_table=11
atgaatttggatttttcagcaacgatcccccaaattccttttatattagaaggcttggcaattacattaaaaattgttgttgtatctgctattatcggacttatactcggtattgtgctaagcttatgcaagatcagcacattccgcccgtttatctggatcgctgatttttatacatcagtgttccgaggcacgcctttagtgctgcagcttatgattgtctattttggccttcctcagctgctcggatttcaaattgaccagttttgggctgcggttgtcgcattgtctttgaattccgccgcttatgtatcggaaattatcagagccggaatcaatgccattgataaagggcaaaaagaagctgctgttgcactcggtgtcccgtatggaaaaatgatgaaggatctgctgctgccgcaggccttcaaaaatatatcacctgcaattgtgaatgaattaattacgttaacaaaagaatcggcgatcgtcaccgtcatcgggcttggtgatgtcatgagacgcgcatatcaagctggcgccgccacttacaattaccttgagccgctcattatcgcgggattgatttattatgtgcttgtcctgattttaacgtttatcggcaaggctgtagaaaggaagctgaaatccaatgattaa

SEQ ID NO: 61234 - protein, 219 aa, Bacillus subtilis
MNLDFSATIPQIPFILEGLAITLKIVVVSAIIGLILGIVLSLCKISTFRPFIWIADFYTSVFRGTPLVLQLMIVYFGLPQLLGFQIDQFWAAVVALSLNSAAYVSEIIRAGINAIDKGQKEAAVALGVPYGKMMKDLLLPQAFKNISPAIVNELITLTKESAIVTVIGLGDVMRRAYQAGAATYNYLEPLIIAGLIYYVLVLILTFIGKAVERKLKSND

SEQ ID NO: 61235 - DNA, 27 bp, Primer
atgatcgaaatcttacatgaatactgg

SEQ ID NO: 61236 - DNA, 26 bp, Primer
ttagtgcgttgaagaaggtttcacat

SEQ ID NO: 61237 - protein, 243 aa, consensus
  MISC_FEATURE (1)..(243): consensus for the disclosure of xaa see table XV
GXXXTXXXXXXXXXXXXXXXXXXXXXXXXXXXXXXXXXXXXXXXXXXXXXXXXXXXRGXPXXXXXXXXXXXXXXXXXXXXXXXXXXXXXXXXXXXXXXXXXXXXXXXXXXXXXXXXXXXXXXXXXAYXXEXXRXXXXXXXXGQXEAXXXXGXXXXXXXXXXXXXPXXXXXXXPXXXNXXXXXXKXXXLXXXXXXXXXXXXXXXXXXXXXXXXXXXXXXXXXXXXXXXYXXXXXXXXXXXXXXE

SEQ ID NO: 61238 - protein, 18 aa, consensus
  MISC_FEATURE (1)..(18): consensus for the disclosure of xaa see table XV
XXXXXXXXPXXXXXXXXX

SEQ ID NO: 61239 - protein, 76 aa, consensus
  MISC_FEATURE (1)..(76): consensus for the disclosure of xaa see table XV
XXXXXXXXXXXXXXXXXXXXXXXXXXGXXXXXXXXXXXXXXXXXXXXXPXXXXXXXXXXXXXXXXXXXXXXXXXXX

SEQ ID NO: 61240 - DNA, 1923 bp, Escherichia coli K12; identical to SEQ ID NO: 24353
  CDS (777)..(1748)

SEQ ID NO: 61241 - protein, 323 aa, Escherichia coli K12; identical to SEQ ID NO: 24354

SEQ ID NO: 61242 - DNA, 1313 bp, Capsicum annuum (pepper); identical to SEQ ID NO: 24355
  CDS (2)..(1126)

SEQ ID NO: 61243 - protein, 374 aa, Capsicum annuum (pepper); identical to SEQ ID NO: 24356

SEQ ID NO: 61244 - DNA, 1468 bp, Spinacia oleracea (spinach); identical to SEQ ID NO: 24357
  CDS (167)..(1273)

SEQ ID NO: 61245 - protein, 368 aa, Spinacia oleracea (spinach); identical to SEQ ID NO: 24358

SEQ ID NO: 61246 - DNA, 1656 bp, Homo sapiens (man); identical to SEQ ID NO: 24359
  CDS (1)..(1656)

SEQ ID NO: 61247 - protein, 551 aa, Homo sapiens (man); identical to SEQ ID NO: 24360

SEQ ID NO: 61248 - DNA, 984 bp, Aquifex aeolicus; identical to SEQ ID NO: 24361
  CDS (1)..(984)

SEQ ID NO: 61249 - protein, 327 aa, Aquifex aeolicus; identical to SEQ ID NO: 24362

SEQ ID NO: 61250 - DNA, 954 bp, Deinococcus radiodurans; identical to SEQ ID NO: 24363
  CDS (1)..(954)

SEQ ID NO: 61251 - protein, 317 aa, Deinococcus radiodurans; identical to SEQ ID NO: 24364

SEQ ID NO: 61252 - DNA, 1149 bp, Pseudomonas aeruginosa; identical to SEQ ID NO: 24365
  CDS (250)..(1149)

SEQ ID NO: 61253 - protein, 299 aa, Pseudomonas aeruginosa; identical to SEQ ID NO: 24366

SEQ ID NO: 61254 - DNA, 1210 bp, Arabidopsis thaliana (mouse-ear cress); identical to SEQ ID NO: 24367
  CDS (1)..(1179)

SEQ ID NO: 61255 - protein, 392 aa, Arabidopsis thaliana (mouse-ear cress); identical to SEQ ID NO: 24368

SEQ ID NO: 61256 - DNA, 960 bp, Nostoc sp. PCC 7120; identical to SEQ ID NO: 24369
  CDS (1)..(960)

SEQ ID NO: 61257 - protein, 319 aa, Nostoc sp. PCC 7120; identical to SEQ ID NO: 24370

SEQ ID NO: 61258 - DNA, 972 bp, Salmonella enterica subsp. enterica serovar Typhi; identical to SEQ ID NO: 24371
  CDS (1)..(972)

SEQ ID NO: 61259 - protein, 323 aa, Salmonella enterica subsp. enterica serovar Typhi; identical to SEQ ID NO: 24372

SEQ ID NO: 61260 - DNA, 1029 bp, Brucella melitensis; identical to SEQ ID NO: 24373
  CDS (1)..(1029)

SEQ ID NO: 61261 - protein, 342 aa, Brucella melitensis; identical to SEQ ID NO: 24374

SEQ ID NO: 61262 - DNA, 927 bp, Listeria innocua; identical to SEQ ID NO: 24375
  CDS (1)..(927)

SEQ ID NO: 61263 - protein, 308 aa, Listeria innocua; identical to SEQ ID NO: 24376

SEQ ID NO: 61264 - DNA, 975 bp, Nostoc sp. PCC 7120; identical to SEQ ID NO: 24377
  CDS (1)..(975)

SEQ ID NO: 61265 - protein, 324 aa, Nostoc sp. PCC 7120; identical to SEQ ID NO: 24378

SEQ ID NO: 61266 - DNA, 963 bp, Nostoc sp. PCC 7120; identical to SEQ ID NO: 24379
  CDS (1)..(963)

SEQ ID NO: 61267 - protein, 320 aa, Nostoc sp. PCC 7120; identical to SEQ ID NO: 24380

SEQ ID NO: 61268 - DNA, 1011 bp, Brucella melitensis; identical to SEQ ID NO: 24381
  CDS (1)..(1011)

SEQ ID NO: 61269 - protein, 336 aa, Brucella melitensis; identical to SEQ ID NO: 24382

SEQ ID NO: 61270 - DNA, 969 bp, Yersinia pestis; identical to SEQ ID NO: 24383
  CDS (1)..(969)

SEQ ID NO: 61271 - protein, 322 aa, Yersinia pestis; identical to SEQ ID NO: 24384

SEQ ID NO: 61272 - DNA, 942 bp, Staphylococcus aureus; identical to SEQ ID NO: 24385
  CDS (10)..(942)

SEQ ID NO: 61273 - protein, 310 aa, Staphylococcus aureus; identical to SEQ ID NO: 24386

SEQ ID NO: 61274 - DNA, 1038 bp, Agrobacterium tumefaciens; identical to SEQ ID NO: 24387
  CDS (1)..(1038)

SEQ ID NO: 61275 - protein, 345 aa, Agrobacterium tumefaciens; identical to SEQ ID NO: 24388

SEQ ID NO: 61276 - DNA, 921 bp, Helicobacter pylori; identical to SEQ ID NO: 24389
  CDS (1)..(921)

SEQ ID NO: 61277 - protein, 306 aa, Helicobacter pylori; identical to SEQ ID NO: 24390

SEQ ID NO: 61278 - DNA, 1395 bp, Mycobacterium tuberculosis; identical to SEQ ID NO: 24391
  CDS (1)..(1395)

SEQ ID NO: 61279 - protein, 464 aa, Mycobacterium tuberculosis; identical to SEQ ID NO: 24392

SEQ ID NO: 61280 - DNA, 969 bp, Vibrio cholerae; identical to SEQ ID NO: 24393
  CDS (1)..(969)

SEQ ID NO: 61281 - protein, 322 aa, Vibrio cholerae; identical to SEQ ID NO: 24394

SEQ ID NO: 61282 - DNA, 984 bp, Halobacterium sp. NRC-1; identical to SEQ ID NO: 24395
  CDS (1)..(984)

SEQ ID NO: 61283 - protein, 327 aa, Halobacterium sp. NRC-1; identical to SEQ ID NO: 24396

SEQ ID NO: 61284 - DNA, 999 bp, Caulobacter crescentus; identical to SEQ ID NO: 24397
  CDS (1)..(999)

SEQ ID NO: 61285 - protein, 332 aa, Caulobacter crescentus; identical to SEQ ID NO: 24398

SEQ ID NO: 61286 - DNA, 1014 bp, Caenorhabditis elegans; identical to SEQ ID NO: 24399
  CDS (1)..(1014)

SEQ ID NO: 61287 - protein, 337 aa, Caenorhabditis elegans; identical to SEQ ID NO: 24400

SEQ ID NO: 61288 - DNA, 972 bp, Mycobacterium tuberculosis; identical to SEQ ID NO: 24401
  CDS (1)..(972)

SEQ ID NO: 61289 - protein, 323 aa, Mycobacterium tuberculosis; identical to SEQ ID NO: 24402

SEQ ID NO: 61290 - DNA, 888 bp, Vibrio cholerae; identical to SEQ ID NO: 24403
  CDS (1)..(888)

SEQ ID NO: 61291 - protein, 295 aa, Vibrio cholerae; identical to SEQ ID NO: 24404

SEQ ID NO: 61292 - DNA, 999 bp, Xylella fastidiosa; identical to SEQ ID NO: 24405
  CDS (1)..(999)

SEQ ID NO: 61293 - protein, 332 aa, Xylella fastidiosa; identical to SEQ ID NO: 24406

SEQ ID NO: 61294 - DNA, 933 bp, Lactococcus lactis subsp. lactis; identical to SEQ ID NO: 24407
  CDS (1)..(933)

SEQ ID NO: 61295 - protein, 310 aa, Lactococcus lactis subsp. lactis; identical to SEQ ID NO: 24408

SEQ ID NO: 61296 - DNA, 921 bp, Streptococcus pneumoniae; identical to SEQ ID NO: 24409
  CDS (1)..(921)

SEQ ID NO: 61297 - protein, 306 aa, Streptococcus pneumoniae; identical to SEQ ID NO: 24410

SEQ ID NO: 61298 - DNA, 975 bp, Pseudomonas aeruginosa; identical to SEQ ID NO: 24411
  CDS (1)..(975)

SEQ ID NO: 61299 - protein, 324 aa, Pseudomonas aeruginosa; identical to SEQ ID NO: 24412

SEQ ID NO: 61300 - DNA, 1374 bp, Pseudomonas aeruginosa; identical to SEQ ID NO: 24413
  CDS (1)..(1374)

SEQ ID NO: 61301 - protein, 457 aa, Pseudomonas aeruginosa; identical to SEQ ID NO: 24414

SEQ ID NO: 61302 - DNA, 948 bp, Buchnera sp; identical to SEQ ID NO: 24415
  CDS (1)..(948)

SEQ ID NO: 61303 - protein, 315 aa, Buchnera sp; identical to SEQ ID NO: 24416

SEQ ID NO: 61304 - DNA, 906 bp, Staphylococcus aureus; identical to SEQ ID NO: 24417
  CDS (1)..(906)

SEQ ID NO: 61305 - protein, 301 aa, Staphylococcus aureus; identical to SEQ ID NO: 24418

SEQ ID NO: 61306 - DNA, 930 bp, Clostridium acetobutylicum; identical to SEQ ID NO: 24419
  CDS (1)..(930)

SEQ ID NO: 61307 - protein, 309 aa, Clostridium acetobutylicum; identical to SEQ ID NO: 24420

SEQ ID NO: 61308 - DNA, 951 bp, Haemophilus influenzae; identical to SEQ ID NO: 24421
  CDS (1)..(951)

SEQ ID NO: 61309 - protein, 316 aa, Haemophilus influenzae; identical to SEQ ID NO: 24422

SEQ ID NO: 61310 - DNA, 876 bp, Thermotoga maritima; identical to SEQ ID NO: 24423
  CDS (1)..(876)

SEQ ID NO: 61311 - protein, 291 aa, Thermotoga maritima; identical to SEQ ID NO: 24424

SEQ ID NO: 61312 - DNA, 1182 bp, Aeropyrum pernix; identical to SEQ ID NO: 24425
  CDS (1)..(1182)

SEQ ID NO: 61313 - protein, 393 aa, Aeropyrum pernix; identical to SEQ ID NO: 24426

SEQ ID NO: 61314 - DNA, 921 bp, Lactococcus lactis subsp. lactis; identical to SEQ ID NO: 24427
  CDS (1)..(921)

SEQ ID NO: 61315 - protein, 306 aa, Lactococcus lactis subsp. lactis; identical to SEQ ID NO: 24428

SEQ ID NO: 61316 - DNA, 933 bp, Mycobacterium tuberculosis; identical to SEQ ID NO: 24429
  CDS (1)..(933)

SEQ ID NO: 61317 - protein, 310 aa, Mycobacterium tuberculosis; identical to SEQ ID NO: 24430

SEQ ID NO: 61318 - DNA, 900 bp, Campylobacter jejuni; identical to SEQ ID NO: 24431
  CDS (1)..(900)

SEQ ID NO: 61319 - protein, 299 aa, Campylobacter jejuni; identical to SEQ ID NO: 24432

SEQ ID NO: 61320 - DNA, 1371 bp, Xylella fastidiosa; identical to SEQ ID NO: 24433
  CDS (1)..(1371)

SEQ ID NO: 61321 - protein, 456 aa, Xylella fastidiosa; identical to SEQ ID NO: 24434

SEQ ID NO: 61322 - DNA, 918 bp, Pseudomonas aeruginosa; identical to SEQ ID NO: 24435
  CDS (1)..(918)

SEQ ID NO: 61323 - protein, 305 aa, Pseudomonas aeruginosa; identical to SEQ ID NO: 24436

SEQ ID NO: 61324 - DNA, 939 bp, Bacillus halodurans; identical to SEQ ID NO: 24437
  CDS (1)..(939)

SEQ ID NO: 61325 - protein, 312 aa, Bacillus halodurans; identical to SEQ ID NO: 24438

SEQ ID NO: 61326 - DNA, 825 bp, Halobacterium sp. NRC-1; identical to SEQ ID NO: 24439
  CDS (1)..(825)

SEQ ID NO: 61327 - protein, 274 aa, Halobacterium sp. NRC-1; identical to SEQ ID NO: 24440

SEQ ID NO: 61328 - DNA, 987 bp, Caulobacter crescentus; identical to SEQ ID NO: 24441
  CDS (1)..(987)

SEQ ID NO: 61329 - protein, 328 aa, Caulobacter crescentus; identical to SEQ ID NO: 24442

SEQ ID NO: 61330 - DNA, 969 bp, Agrobacterium tumefaciens; identical to SEQ ID NO: 24443
  CDS (1)..(969)

SEQ ID NO: 61331 - protein, 322 aa, Agrobacterium tumefaciens; identical to SEQ ID NO: 24444

SEQ ID NO: 61332 - DNA, 924 bp, Bacillus subtilis; identical to SEQ ID NO: 24445
  CDS (1)..(924)

SEQ ID NO: 61333 - protein, 307 aa, Bacillus subtilis; identical to SEQ ID NO: 24446

SEQ ID NO: 61334 - DNA, 936 bp, Bacillus subtilis; identical to SEQ ID NO: 24447
  CDS (1)..(936)

SEQ ID NO: 61335 - protein, 311 aa, Bacillus subtilis; identical to SEQ ID NO: 24448

SEQ ID NO: 61336 - DNA, 933 bp, Neisseria meningitidis; identical to SEQ ID NO: 24449
  CDS (1)..(933)

SEQ ID NO: 61337 - protein, 310 aa, Neisseria meningitidis; identical to SEQ ID NO: 24450

SEQ ID NO: 61338 - DNA, 924 bp, Bacillus halodurans; identical to SEQ ID NO: 24451
  CDS (1)..(924)

SEQ ID NO: 61339 - protein, 307 aa, Bacillus halodurans; identical to SEQ ID NO: 24452

SEQ ID NO: 61340 - DNA, 1014 bp, Caenorhabditis elegans; identical to SEQ ID NO: 24453
  CDS (1)..(1014)

SEQ ID NO: 61341 - protein, 337 aa, Caenorhabditis elegans; identical to SEQ ID NO: 24454

SEQ ID NO: 61342 - DNA, 912 bp, Clostridium acetobutylicum; identical to SEQ ID NO: 24455
  CDS (1)..(912)

SEQ ID NO: 61343 - protein, 303 aa, Clostridium acetobutylicum; identical to SEQ ID NO: 24456

SEQ ID NO: 61344 - DNA, 1128 bp, Campylobacter jejuni; identical to SEQ ID NO: 24457
  CDS (105)..(1004)

SEQ ID NO: 61345 - protein, 299 aa, Campylobacter jejuni; identical to SEQ ID NO: 24458

SEQ ID NO: 61346 - DNA, 1371 bp, Triticum aestivum (common wheat); identical to SEQ ID NO: 24459
  CDS (72)..(1049)

SEQ ID NO: 61347 - protein, 325 aa, Triticum aestivum (common wheat); identical to SEQ ID NO: 24460

SEQ ID NO: 61348 - DNA, 1351 bp, Salmonella typhimurium; identical to SEQ ID NO: 24461
  CDS (423)..(1334)

SEQ ID NO: 61349 - protein, 303 aa, Salmonella typhimurium; identical to SEQ ID NO: 24462

SEQ ID NO: 61350 - DNA, 1432 bp, Spinacia oleracea (spinach); identical to SEQ ID NO: 24463
  CDS (54)..(1205)

SEQ ID NO: 61351 - protein, 383 aa, Spinacia oleracea (spinach); identical to SEQ ID NO: 24464

SEQ ID NO: 61352 - DNA, 1281 bp, Spinacia oleracea (spinach); identical to SEQ ID NO: 24465
  CDS (52)..(1029)

SEQ ID NO: 61353 - protein, 325 aa, Spinacia oleracea (spinach) [sequence omitted]

SEQ ID NO: 61354 - DNA, 1855 bp, Citrullus lanatus (watermelon); identical to SEQ ID NO: 24467
  CDS (564)..(1541)

SEQ ID NO: 61355 - protein, 325 aa, Citrullus lanatus (watermelon); identical to SEQ ID NO: 24468

SEQ ID NO: 61356 - DNA, 1278 bp, Arabidopsis thaliana (mouse-ear cress); identical to SEQ ID NO: 24469
  CDS (87)..(1061)

SEQ ID NO: 61357 - protein, 324 aa, Arabidopsis thaliana (mouse-ear cress); identical to SEQ ID NO: 24470

SEQ ID NO: 61358 - DNA, 1319 bp, Zea mays (maize); identical to SEQ ID NO: 24471
  CDS (73)..(1050)

SEQ ID NO: 61359 - protein, 325 aa, Zea mays (maize); identical to SEQ ID NO: 24472

SEQ ID NO: 61360 - DNA, 990 bp, Synechococcus sp; identical to SEQ ID NO: 24473
  CDS (1)..(990)

SEQ ID NO: 61361 - protein, 329 aa, Synechococcus sp; identical to SEQ ID NO: 24474

SEQ ID NO: 61362 - DNA, 1775 bp, Flavobacterium sp; identical to SEQ ID NO: 24475
  CDS (509)..(1432)

SEQ ID NO: 61363 - protein, 307 aa, Flavobacterium sp; identical to SEQ ID NO: 24476

SEQ ID NO: 61364 - DNA, 927 bp, Bacillus subtilis; identical to SEQ ID NO: 24477
  CDS (1)..(927)

SEQ ID NO: 61365 - protein, 308 aa, Bacillus subtilis; identical to SEQ ID NO: 24478

SEQ ID NO: 61366 - DNA, 978 bp, Synechocystis sp; identical to SEQ ID NO: 24479
  CDS (1)..(978)

SEQ ID NO: 61367 - protein, 325 aa, Synechocystis sp; identical to SEQ ID NO: 24480

SEQ ID NO: 61368 - DNA, 996 bp, Synechocystis sp; identical to SEQ ID NO: 24481
  CDS (1)..(996)

SEQ ID NO: 61369 - protein, 331 aa, Synechocystis sp; identical to SEQ ID NO: 24482

SEQ ID NO: 61370 - DNA, 912 bp, Escherichia coli; identical to SEQ ID NO: 24483
  CDS (1)..(912)

SEQ ID NO: 61371 - protein, 303 aa, Escherichia coli; identical to SEQ ID NO: 24484

SEQ ID NO: 61372 - DNA, 1308 bp, Solanum tuberosum (potato); identical to SEQ ID NO: 24485
  CDS (35)..(1012)

SEQ ID NO: 61373 - protein, 325 aa, Solanum tuberosum (potato); identical to SEQ ID NO: 24486

SEQ ID NO: 61374 - DNA, 1404 bp, Solanum tuberosum (potato); identical to SEQ ID NO: 24487
  CDS (21)..(1181)

SEQ ID NO: 61375 - protein, 386 aa, Solanum tuberosum (potato); identical to SEQ ID NO: 24488

SEQ ID NO: 61376 - DNA, 1492 bp, Chlamydomonas reinhardtii; identical to SEQ ID NO: 24489
  CDS (73)..(1131)

SEQ ID NO: 61377 - protein, 352 aa, Chlamydomonas reinhardtii; identical to SEQ ID NO: 24490

SEQ ID NO: 61378 - DNA, 1446 bp, chloroplast Spinacia oleracea (spinach); identical to SEQ ID NO: 24491
  CDS (43)..(1215)

SEQ ID NO: 61379 - protein, 390 aa, chloroplast Spinacia oleracea (spinach); identical to SEQ ID NO: 24492

SEQ ID NO: 61380 - DNA, 1035 bp, Caenorhabditis elegans; identical to SEQ ID NO: 24493
  CDS (1)..(1035)

SEQ ID NO: 61381 - protein, 344 aa, Caenorhabditis elegans; identical to SEQ ID NO: 24494

SEQ ID NO: 61382 - DNA, 1014 bp, Caenorhabditis elegans; identical to SEQ ID NO: 24495
  CDS (1)..(1014)

SEQ ID NO: 61383 - protein, 337 aa, Caenorhabditis elegans; identical to SEQ ID NO: 24496

SEQ ID NO: 61384 - DNA, 951 bp, Streptomyces coelicolor; identical to SEQ ID NO: 24497
  CDS (1)..(951)

SEQ ID NO: 61385 - protein, 316 aa, Streptomyces coelicolor; identical to SEQ ID NO: 24498

SEQ ID NO: 61386 - DNA, 1056 bp, Schizosaccharomyces pombe; identical to SEQ ID NO: 24499
  CDS (1)..(1056)

SEQ ID NO: 61387 - protein, 351 aa, Schizosaccharomyces pombe; identical to SEQ ID NO: 24500

SEQ ID NO: 61388 - DNA, 909 bp, Clostridium perfringens; identical to SEQ ID NO: 24501
  CDS (1)..(909)

SEQ ID NO: 61389 - protein, 302 aa, Clostridium perfringens; identical to SEQ ID NO: 24502

SEQ ID NO: 61390 - DNA, 927 bp, Methanosarcina barkeri; identical to SEQ ID NO: 24503
  CDS (1)..(927)

SEQ ID NO: 61391 - protein, 308 aa, Methanosarcina barkeri; identical to SEQ ID NO: 24504

SEQ ID NO: 61392 - DNA, 933 bp, Mycobacterium leprae; identical to SEQ ID NO: 24505
  CDS (1)..(933)

SEQ ID NO: 61393 - protein, 310 aa, Mycobacterium leprae; identical to SEQ ID NO: 24506

SEQ ID NO: 61394 - DNA, 1329 bp, Arabidopsis thaliana (mouse-ear cress); identical to SEQ ID NO: 24507
  CDS (1)..(1329)

SEQ ID NO: 61395 - protein, 442 aa, Arabidopsis thaliana (mouse-ear cress); identical to SEQ ID NO: 24508

SEQ ID NO: 61396 - DNA, 1142 bp, Arabidopsis thaliana (mouse-ear cress); identical to SEQ ID NO: 24509
  CDS (1)..(1107)

SEQ ID NO: 61397 - protein, 368 aa, Arabidopsis thaliana (mouse-ear cress); identical to SEQ ID NO: 24510

SEQ ID NO: 61398 - DNA, 1056 bp, Corynebacterium glutamicum; identical to SEQ ID NO: 24511
  CDS (101)..(1036)

SEQ ID NO: 61399 - protein, 311 aa, Corynebacterium glutamicum; identical to SEQ ID NO: 24512

SEQ ID NO: 61400 - DNA, 1035 bp, Rhodobacter sphaeroides; identical to SEQ ID NO: 24513
  CDS (1)..(1035)

SEQ ID NO: 61401 - protein, 344 aa, Rhodobacter sphaeroides; identical to SEQ ID NO: 24514

SEQ ID NO: 61402 - DNA, 1200 bp, Entamoeba histolytica; identical to SEQ ID NO: 24515
  CDS (83)..(1096)

SEQ ID NO: 61403 - protein, 337 aa, Entamoeba histolytica; identical to SEQ ID NO: 24516

SEQ ID NO: 61404 - DNA, 1524 bp, Saccharomyces cerevisiae; identical to SEQ ID NO: 24517
  CDS (1)..(1524)

SEQ ID NO: 61405 - protein, 507 aa, Saccharomyces cerevisiae; identical to SEQ ID NO: 24518

SEQ ID NO: 61406 - DNA, 894 bp, Yersinia pseudotuberculosis IP 32953; identical to SEQ ID NO: 24519
  CDS (1)..(894)

SEQ ID NO: 61407 - protein, 297 aa, Yersinia pseudotuberculosis IP 32953; identical to SEQ ID NO: 24520

SEQ ID NO: 61408 - DNA, 936 bp, Symbiobacterium thermophilum; identical to SEQ ID NO: 24521
  CDS (1)..(936)

SEQ ID NO: 61409 - protein, 311 aa, Symbiobacterium thermophilum; identical to SEQ ID NO: 24522

SEQ ID NO: 61410 - DNA, 936 bp, Propionibacterium acnes; identical to SEQ ID NO: 24523
  CDS (1)..(936)

SEQ ID NO: 61411 - protein, 311 aa, Propionibacterium acnes; identical to SEQ ID NO: 24524

SEQ ID NO: 61412 - DNA, 921 bp, Desulfotalea psychrophila; identical to SEQ ID NO: 24525
  CDS (1)..(921)

SEQ ID NO: 61413 - protein, 306 aa, Desulfotalea psychrophila; identical to SEQ ID NO: 24526

SEQ ID NO: 61414 - DNA, 1095 bp, Debaryomyces hansenii CBS767; identical to SEQ ID NO: 24527
  CDS (1)..(1095)

SEQ ID NO: 61415 - protein, 364 aa, Debaryomyces hansenii CBS767; identical to SEQ ID NO: 24528

SEQ ID NO: 61416 - DNA, 1476 bp, Debaryomyces hansenii CBS767; identical to SEQ ID NO: 24529
  CDS (1)..(1476)

SEQ ID NO: 61417 - protein, 491 aa, Debaryomyces hansenii CBS767; identical to SEQ ID NO: 24530

SEQ ID NO: 61418 - DNA, 1134 bp, Yarrowia lipolytica CLIB99; identical to SEQ ID NO: 24531
  CDS (1)..(1134)

SEQ ID NO: 61419 - protein, 377 aa, Yarrowia lipolytica CLIB99; identical to SEQ ID NO: 24532

SEQ ID NO: 61420 - DNA, 1617 bp, Yarrowia lipolytica CLIB99; identical to SEQ ID NO: 24533
  CDS (1)..(1617)

SEQ ID NO: 61421 - protein, 538 aa, Yarrowia lipolytica CLIB99; identical to SEQ ID NO: 24534

SEQ ID NO: 61422 - DNA, 1482 bp, Kluyveromyces lactis NRRL Y; identical to SEQ ID NO: 24535
  CDS (1)..(1482)

SEQ ID NO: 61423 - protein, 493 aa, Kluyveromyces lactis NRRL Y; identical to SEQ ID NO: 24536

SEQ ID NO: 61424 - DNA, 969 bp, Erwinia carotovora; identical to SEQ ID NO: 24537
  CDS (1)..(969)

SEQ ID NO: 61425 - protein, 322 aa, Erwinia carotovora; identical to SEQ ID NO: 24538

SEQ ID NO: 61426 - DNA, 2098 bp, Xenopus laevis; identical to SEQ ID NO: 24539
  CDS (30)..(1718)

SEQ ID NO: 61427 - protein, 562 aa, Xenopus laevis; identical to SEQ ID NO: 24540

SEQ ID NO: 61428 - DNA, 924 bp, Acinetobacter sp; identical to SEQ ID NO: 24541
  CDS (1)..(924)

SEQ ID NO: 61429 - protein, 307 aa, Acinetobacter sp; identical to SEQ ID NO: 24542

SEQ ID NO: 61430 - DNA, 999 bp, Acinetobacter sp; identical to SEQ ID NO: 24543
  CDS (1)..(999)

SEQ ID NO: 61431 - protein, 332 aa, Acinetobacter sp; identical to SEQ ID NO: 24544

SEQ ID NO: 61432 - DNA, 1506 bp, Candida glabrata CBS138; identical to SEQ ID NO: 24545
  CDS (1)..(1506)

SEQ ID NO: 61433 - protein, 501 aa, Candida glabrata CBS138; identical to SEQ ID NO: 24546

SEQ ID NO: 61434 - DNA, 918 bp, Bacillus thuringiensis; identical to SEQ ID NO: 24547
  CDS (1)..(918)

SEQ ID NO: 61435 - protein, 305 aa, Bacillus thuringiensis; identical to SEQ ID NO: 24548

SEQ ID NO: 61436 - DNA, 924 bp, Bacillus thuringiensis; identical to SEQ ID NO: 24549
  CDS (1)..(924)

SEQ ID NO: 61437 - protein, 307 aa, Bacillus thuringiensis; identical to SEQ ID NO: 24550

SEQ ID NO: 61438 - DNA, 951 bp, Picrophilus torridus; identical to SEQ ID NO: 24551
  CDS (1)..(951)

SEQ ID NO: 61439 - protein, 316 aa, Picrophilus torridus; identical to SEQ ID NO: 24552

SEQ ID NO: 61440 - DNA, 969 bp, Photobacterium profundum; identical to SEQ ID NO: 24553
  CDS (1)..(969)

SEQ ID NO: 61441 - protein, 322 aa, Photobacterium profundum; identical to SEQ ID NO: 24554

SEQ ID NO: 61442 - DNA, 936 bp, Corynebacterium glutamicum; identical to SEQ ID NO: 24555
  CDS (1)..(936)

SEQ ID NO: 61443 - protein, 311 aa, Corynebacterium glutamicum; identical to SEQ ID NO: 24556

SEQ ID NO: 61444 - DNA, 1047 bp, Bdellovibrio bacteriovorus; identical to SEQ ID NO: 24557
  CDS (1)..(1047)

SEQ ID NO: 61445 - protein, 348 aa, Bdellovibrio bacteriovorus; identical to SEQ ID NO: 24558

SEQ ID NO: 61446 - DNA, 990 bp, Bdellovibrio bacteriovorus; identical to SEQ ID NO: 24559
  CDS (1)..(990)

SEQ ID NO: 61447 - protein, 329 aa, Bdellovibrio bacteriovorus; identical to SEQ ID NO: 24560

SEQ ID NO: 61448 - DNA, 990 bp, Bdellovibrio bacteriovorus; identical to SEQ ID NO: 24561
  CDS (1)..(990)

SEQ ID NO: 61449 - protein, 329 aa, Bdellovibrio bacteriovorus; identical to SEQ ID NO: 24562

SEQ ID NO: 61450 - DNA, 1038 bp, Rhodopseudomonas palustris; identical to SEQ ID NO: 24563
  CDS (1)..(1038)

SEQ ID NO: 61451 - protein, 345 aa, Rhodopseudomonas palustris; identical to SEQ ID NO: 24564

SEQ ID NO: 61452 - DNA, 1398 bp, Rhodopseudomonas palustris; identical to SEQ ID NO: 24565
  CDS (1)..(1398)

SEQ ID NO: 61453 - protein, 465 aa, Rhodopseudomonas palustris; identical to SEQ ID NO: 24566

SEQ ID NO: 61454 - DNA, 999 bp, Rhodopseudomonas palustris; identical to SEQ ID NO: 24567
  CDS (1)..(999)

SEQ ID NO: 61455 - protein, 332 aa, Rhodopseudomonas palustris; identical to SEQ ID NO: 24568

SEQ ID NO: 61456 - DNA, 936 bp, Corynebacterium diphtheriae; identical to SEQ ID NO: 24569
  CDS (1)..(936)

SEQ ID NO: 61457 - protein, 311 aa, Corynebacterium diphtheriae; identical to SEQ ID NO: 24570

SEQ ID NO: 61458 - DNA, 906 bp, uncultured bacterium 561; identical to SEQ ID NO: 24571
  CDS (1)..(906)

SEQ ID NO: 61459 - protein, 301 aa, uncultured bacterium 561; identical to SEQ ID NO: 24572

SEQ ID NO: 61460 - DNA, 927 bp, Desulfovibrio vulgaris; identical to SEQ ID NO: 24573
  CDS (1)..(927)

SEQ ID NO: 61461 - protein, 308 aa, Desulfovibrio vulgaris; identical to SEQ ID NO: 24574

SEQ ID NO: 61462 - DNA, 915 bp, Thermus thermophilus; identical to SEQ ID NO: 24575
  CDS (1)..(915)

SEQ ID NO: 61463 - protein, 304 aa, Thermus thermophilus; identical to SEQ ID NO: 24576

SEQ ID NO: 61464 - DNA, 924 bp, Bacillus cereus; identical to SEQ ID NO: 24577
  CDS (1)..(924)

SEQ ID NO: 61465 - protein, 307 aa, Bacillus cereus; identical to SEQ ID NO: 24578

SEQ ID NO: 61466 - DNA, 933 bp, Mycobacterium paratuberculosis; identical to SEQ ID NO: 24579
  CDS (1)..(933)

SEQ ID NO: 61467 - protein, 310 aa, Mycobacterium paratuberculosis; identical to SEQ ID NO: 24580

SEQ ID NO: 61468 - DNA, 1407 bp, Mycobacterium paratuberculosis; identical to SEQ ID NO: 24581
  CDS (1)..(1407)

SEQ ID NO: 61469 - protein, 468 aa, Mycobacterium paratuberculosis; identical to SEQ ID NO: 24582

SEQ ID NO: 61470 - DNA, 927 bp, Geobacter sulfurreducens; identical to SEQ ID NO: 24583
  CDS (1)..(927)

SEQ ID NO: 61471 - protein, 308 aa, Geobacter sulfurreducens; identical to SEQ ID NO: 24584

SEQ ID NO: 61472 - DNA, 924 bp, Geobacter sulfurreducens; identical to SEQ ID NO: 24585
  CDS (1)..(924)

SEQ ID NO: 61473 - protein, 307 aa, Geobacter sulfurreducens; identical to SEQ ID NO: 24586

SEQ ID NO: 61474 - DNA, 1479 bp, Ashbya gossypii; identical to SEQ ID NO: 24587
  CDS (1)..(1479)

SEQ ID NO: 61475 - protein, 492 aa, Ashbya gossypii; identical to SEQ ID NO: 24588

SEQ ID NO: 61476 - DNA, 1098 bp, Spinacia oleracea; identical to SEQ ID NO: 24589
  CDS (78)..(1076)

SEQ ID NO: 61477 - protein, 332 aa, Spinacia oleracea; identical to SEQ ID NO: 24590

SEQ ID NO: 61478 - DNA, 1221 bp, Penicillium chrysogenum; identical to SEQ ID NO: 24591
  CDS (45)..(1160)

SEQ ID NO: 61479 - protein, 371 aa, Penicillium chrysogenum; identical to SEQ ID NO: 24592

SEQ ID NO: 61480 - DNA, 1206 bp, Solanum tuberosum; identical to SEQ ID NO: 24593
  CDS (35)..(1090)

SEQ ID NO: 61481 - protein, 351 aa, Solanum tuberosum; identical to SEQ ID NO: 24594

SEQ ID NO: 61482 - DNA, 999 bp, Wolinella succinogenes; identical to SEQ ID NO: 24595
  CDS (1)..(999)

SEQ ID NO: 61483 - protein, 332 aa, Wolinella succinogenes; identical to SEQ ID NO: 24596

SEQ ID NO: 61484 - DNA, 969 bp, Vibrio vulnificus; identical to SEQ ID NO: 24597
  CDS (1)..(969)

SEQ ID NO: 61485 - protein, 322 aa, Vibrio vulnificus; identical to SEQ ID NO: 24598

SEQ ID NO: 61486 - DNA, 1029 bp, Photorhabdus luminescens; identical to SEQ ID NO: 24599
  CDS (1)..(1029)

SEQ ID NO: 61487 - protein, 342 aa, Photorhabdus luminescens; identical to SEQ ID NO: 24600

SEQ ID NO: 61488 - DNA, 954 bp, Photorhabdus luminescens; identical to SEQ ID NO: 24601
  CDS (1)..(954)

SEQ ID NO: 61489 - protein, 317 aa, Photorhabdus luminescens; identical to SEQ ID NO: 24602

SEQ ID NO: 61490 - DNA, 882 bp, Photorhabdus luminescens; identical to SEQ ID NO: 24603
  CDS (1)..(882)

SEQ ID NO: 61491 - protein, 293 aa, Photorhabdus luminescens; identical to SEQ ID NO: 24604

SEQ ID NO: 61492 - DNA, 1368 bp, Photorhabdus luminescens; identical to SEQ ID NO: 24605
  CDS (1)..(1368)

SEQ ID NO: 61493 - protein, 455 aa, Photorhabdus luminescens; identical to SEQ ID NO: 24606

SEQ ID NO: 61494 - DNA, 963 bp, Gloeobacter violaceus; identical to SEQ ID NO: 24607
  CDS (1)..(963)

SEQ ID NO: 61495 - protein, 320 aa, Gloeobacter violaceus; identical to SEQ ID NO: 24608

SEQ ID NO: 61496 - DNA, 963 bp, Gloeobacter violaceus; identical to SEQ ID NO: 24609
  CDS (1)..(963)

SEQ ID NO: 61497 - protein, 320 aa, Gloeobacter violaceus; identical to SEQ ID NO: 24610

SEQ ID NO: 61498 - DNA, 933 bp, Chromobacterium violaceum; identical to SEQ ID NO: 24611
  CDS (1)..(933)

SEQ ID NO: 61499 - protein, 310 aa, Chromobacterium violaceum; identical to SEQ ID NO: 24612

SEQ ID NO: 61500 - DNA, 1371 bp, Chromobacterium violaceum; identical to SEQ ID NO: 24613
  CDS (1)..(1371)

SEQ ID NO: 61501 - protein, 456 aa, Chromobacterium violaceum; identical to SEQ ID NO: 24614

SEQ ID NO: 61502 - DNA, 891 bp, Chromobacterium violaceum; identical to SEQ ID NO: 24615
  CDS (1)..(891)

SEQ ID NO: 61503 - protein, 296 aa, Chromobacterium violaceum; identical to SEQ ID NO: 24616

SEQ ID NO: 61504 - DNA, 1131 bp, Neurospora crassa; identical to SEQ ID NO: 24617
  CDS (1)..(1131)

SEQ ID NO: 61505 - protein, 376 aa, Neurospora crassa; identical to SEQ ID NO: 24618

SEQ ID NO: 61506 - DNA, 1587 bp, Neurospora crassa; identical to SEQ ID NO: 24619
  CDS (1)..(1587)

SEQ ID NO: 61507 - protein, 528 aa, Neurospora crassa; identical to SEQ ID NO: 24620

SEQ ID NO: 61508 - DNA, 1371 bp, Neurospora crassa; identical to SEQ ID NO: 24621
  CDS (1)..(1371)

SEQ ID NO: 61509 - protein, 456 aa, Neurospora crassa; identical to SEQ ID NO: 24622

SEQ ID NO: 61510 - DNA, 969 bp, Synechococcus sp; identical to SEQ ID NO: 24623
  CDS (1)..(969)

SEQ ID NO: 61511 - protein, 322 aa, Synechococcus sp; identical to SEQ ID NO: 24624

SEQ ID NO: 61512 - DNA, 987 bp, Synechococcus sp; identical to SEQ ID NO: 24625
  CDS (1)..(987)

SEQ ID NO: 61513 - protein, 328 aa, Synechococcus sp; identical to SEQ ID NO: 24626

SEQ ID NO: 61514 - DNA, 960 bp, Rhodopirellula baltica; identical to SEQ ID NO: 24627
  CDS (1)..(960)

SEQ ID NO: 61515 - protein, 319 aa, Rhodopirellula baltica; identical to SEQ ID NO: 24628

SEQ ID NO: 61516 - DNA, 987 bp, Prochlorococcus marinus subsp; identical to SEQ ID NO: 24629
  CDS (1)..(987)

SEQ ID NO: 61517 - protein, 328 aa, Prochlorococcus marinus subsp; identical to SEQ ID NO: 24630

SEQ ID NO: 61518 - DNA, 969 bp, Prochlorococcus marinus subsp; identical to SEQ ID NO: 24631
  CDS (1)..(969)

SEQ ID NO: 61519 - protein, 322 aa, Prochlorococcus marinus subsp; identical to SEQ ID NO: 24632

SEQ ID NO: 61520 - DNA, 969 bp, Prochlorococcus marinus; identical to SEQ ID NO: 24633
  CDS (1)..(969)

SEQ ID NO: 61521 - protein, 322 aa, Prochlorococcus marinus; identical to SEQ ID NO: 24634

SEQ ID NO: 61522 - DNA, 987 bp, Prochlorococcus marinus; identical to SEQ ID NO: 24635
  CDS (1)..(987)

SEQ ID NO: 61523 - protein, 328 aa, Prochlorococcus marinus; identical to SEQ ID NO: 24636

SEQ ID NO: 61524 - DNA, 987 bp, Prochlorococcus marinus; identical to SEQ ID NO: 24637
  CDS (1)..(987)

SEQ ID NO: 61525 - protein, 328 aa, Prochlorococcus marinus; identical to SEQ ID NO: 24638

SEQ ID NO: 61526 - DNA, 969 bp, Prochlorococcus marinus; identical to SEQ ID NO: 24639
  CDS (1)..(969)

SEQ ID NO: 61527 - protein, 322 aa, Prochlorococcus marinus; identical to SEQ ID NO: 24640

SEQ ID NO: 61528 - DNA, 903 bp, Helicobacter hepaticus; identical to SEQ ID NO: 24641
  CDS (1)..(903)

SEQ ID NO: 61529 - protein, 300 aa, Helicobacter hepaticus; identical to SEQ ID NO: 24642

SEQ ID NO: 61530 - DNA, 942 bp, Helicobacter hepaticus; identical to SEQ ID NO: 24643
  CDS (1)..(942)

SEQ ID NO: 61531 - protein, 313 aa, Helicobacter hepaticus; identical to SEQ ID NO: 24644

SEQ ID NO: 61532 - DNA, 951 bp, Haemophilus ducreyi; identical to SEQ ID NO: 24645
  CDS (1)..(951)

SEQ ID NO: 61533 - protein, 316 aa, Haemophilus ducreyi; identical to SEQ ID NO: 24646

SEQ ID NO: 61534 - DNA, 945 bp, Candidatus Blochmannia floridanus; identical to SEQ ID NO: 24647
  CDS (1)..(945)

SEQ ID NO: 61535 - protein, 314 aa, Candidatus Blochmannia floridanus; identical to SEQ ID NO: 24648

SEQ ID NO: 61536 - DNA, 912 bp, Bordetella parapertussis; identical to SEQ ID NO: 24649
  CDS (1)..(912)

SEQ ID NO: 61537 - protein, 303 aa, Bordetella parapertussis; identical to SEQ ID NO: 24650

SEQ ID NO: 61538 - DNA, 969 bp, Propionibacterium freudenreichii shermanii; identical to SEQ ID NO: 24651
  CDS (1)..(969)

SEQ ID NO: 61539 - protein, 322 aa, Propionibacterium freudenreichii shermanii; identical to SEQ ID NO: 24652

SEQ ID NO: 61540 - DNA, 927 bp, Propionibacterium freudenreichii shermanii; identical to SEQ ID NO: 24653
  CDS (1)..(927)

SEQ ID NO: 61541 - protein, 308 aa, Propionibacterium freudenreichii shermanii; identical to SEQ ID NO: 24654

SEQ ID NO: 61542 - DNA, 1466 bp, Porphyra purpurea; identical to SEQ ID NO: 24655
  CDS (149)..(1282)

SEQ ID NO: 61543 - protein, 377 aa, Porphyra purpurea; identical to SEQ ID NO: 24656

SEQ ID NO: 61544 - DNA, 1436 bp, Oryza sativa; identical to SEQ ID NO: 24657
  CDS (57)..(1190)

SEQ ID NO: 61545 - protein, 377 aa, Oryza sativa; identical to SEQ ID NO: 24658

SEQ ID NO: 61546 - DNA, 1059 bp, Betula verrucosa; identical to SEQ ID NO: 24659
  CDS (1)..(1059)

SEQ ID NO: 61547 - protein, 352 aa, Betula verrucosa; identical to SEQ ID NO: 24660

SEQ ID NO: 61548 - DNA, 1990 bp, Xenopus laevis; identical to SEQ ID NO: 24661
  CDS (68)..(1765)

SEQ ID NO: 61549 - protein, 565 aa, Xenopus laevis; identical to SEQ ID NO: 24662

SEQ ID NO: 61550 - DNA, 924 bp, Bacillus cereus; identical to SEQ ID NO: 24663
  CDS (1)..(924)

SEQ ID NO: 61551 - protein, 307 aa, Bacillus cereus; identical to SEQ ID NO: 24664

SEQ ID NO: 61552 - DNA, 924 bp, Bacillus cereus; identical to SEQ ID NO: 24665
  CDS (1)..(924)

SEQ ID NO: 61553 - protein, 307 aa, Bacillus cereus; identical to SEQ ID NO: 24666

SEQ ID NO: 61554 - DNA, 951 bp, Streptomyces avermitilis; identical to SEQ ID NO: 24667
  CDS (1)..(951)

SEQ ID NO: 61555 - protein, 316 aa, Streptomyces avermitilis; identical to SEQ ID NO: 24668

SEQ ID NO: 61556 - DNA, 1395 bp, Streptomyces avermitilis; identical to SEQ ID NO: 24669
  CDS (1)..(1395)

SEQ ID NO: 61557 - protein, 464 aa, Streptomyces avermitilis; identical to SEQ ID NO: 24670

SEQ ID NO: 61558 - DNA, 888 bp, Nitrosomonas europaea; identical to SEQ ID NO: 24671
  CDS (1)..(888)

SEQ ID NO: 61559 - protein, 295 aa, Nitrosomonas europaea; identical to SEQ ID NO: 24672

SEQ ID NO: 61560 - DNA, 933 bp, Enterococcus faecalis; identical to SEQ ID NO: 24673
  CDS (1)..(933)

SEQ ID NO: 61561 - protein, 310 aa, Enterococcus faecalis; identical to SEQ ID NO: 24674

SEQ ID NO: 61562 - DNA, 918 bp, Enterococcus faecalis; identical to SEQ ID NO: 24675
  CDS (1)..(918)

SEQ ID NO: 61563 - protein, 305 aa, Enterococcus faecalis; identical to SEQ ID NO: 24676

SEQ ID NO: 61564 - DNA, 951 bp, Coxiella burnetii; identical to SEQ ID NO: 24677
  CDS (1)..(951)

SEQ ID NO: 61565 - protein, 316 aa, Coxiella burnetii; identical to SEQ ID NO: 24678

SEQ ID NO: 61566 - DNA, 990 bp, Shigella flexneri; identical to SEQ ID NO: 24679
  CDS (1)..(990)

SEQ ID NO: 61567 - protein, 329 aa, Shigella flexneri; identical to SEQ ID NO: 24680

SEQ ID NO: 61568 - DNA, 927 bp, Bacillus stearothermophilus; identical to SEQ ID NO: 24681
  CDS (1)..(927)

SEQ ID NO: 61569 - protein, 308 aa, Bacillus stearothermophilus [sequence omitted]

SEQ ID NO: 61570 - DNA, 1230 bp, Oryza sativa; identical to SEQ ID NO: 24683
  CDS (1)..(1230)

SEQ ID NO: 61571 - protein, 409 aa, Oryza sativa; identical to SEQ ID NO: 24684

SEQ ID NO: 61572 - DNA, 1371 bp, Xylella fastidiosa; identical to SEQ ID NO: 24685
  CDS (1)..(1371)

SEQ ID NO: 61573 - protein, 456 aa, Xylella fastidiosa; identical to SEQ ID NO: 24686

SEQ ID NO: 61574 - DNA, 969 bp, Vibrio parahaemolyticus; identical to SEQ ID NO: 24687
  CDS (1)..(969)

SEQ ID NO: 61575 - protein, 322 aa, Vibrio parahaemolyticus; identical to SEQ ID NO: 24688

SEQ ID NO: 61576 - DNA, 975 bp, Pseudomonas syringae; identical to SEQ ID NO: 24689
  CDS (1)..(975)

SEQ ID NO: 61577 - protein, 324 aa, Pseudomonas syringae; identical to SEQ ID NO: 24690

SEQ ID NO: 61578 - DNA, 984 bp, Pseudomonas syringae; identical to SEQ ID NO: 24691
  CDS (1)..(984)

SEQ ID NO: 61579 - protein, 327 aa, Pseudomonas syringae; identical to SEQ ID NO: 24692

SEQ ID NO: 61580 - DNA, 903 bp, Pseudomonas syringae; identical to SEQ ID NO: 24693
  CDS (1)..(903)

SEQ ID NO: 61581 - protein, 300 aa, Pseudomonas syringae; identical to SEQ ID NO: 24694

SEQ ID NO: 61582 - DNA, 975 bp, Pseudomonas putida; identical to SEQ ID NO: 24695
  CDS (1)..(975)

SEQ ID NO: 61583 - protein, 324 aa, Pseudomonas putida; identical to SEQ ID NO: 24696

SEQ ID NO: 61584 - DNA, 900 bp, Pseudomonas putida; identical to SEQ ID NO: 24697
  CDS (1)..(900)

SEQ ID NO: 61585 - protein, 299 aa, Pseudomonas putida; identical to SEQ ID NO: 24698

SEQ ID NO: 61586 - DNA, 912 bp, Lactobacillus plantarum; identical to SEQ ID NO: 24699
  CDS (1)..(912)

SEQ ID NO: 61587 - protein, 303 aa, Lactobacillus plantarum; identical to SEQ ID NO: 24700

SEQ ID NO: 61588 - DNA, 918 bp, Clostridium tetani; identical to SEQ ID NO: 24701
  CDS (1)..(918)

SEQ ID NO: 61589 - protein, 305 aa, Clostridium tetani; identical to SEQ ID NO: 24702

SEQ ID NO: 61590 - DNA, 978 bp, Bradyrhizobium japonicum; identical to SEQ ID NO: 24703
  CDS (1)..(978)

SEQ ID NO: 61591 - protein, 325 aa, Bradyrhizobium japonicum; identical to SEQ ID NO: 24704

SEQ ID NO: 61592 - DNA, 1035 bp, Bradyrhizobium japonicum; identical to SEQ ID NO: 24705
  CDS (1)..(1035)

SEQ ID NO: 61593 - protein, 344 aa, Bradyrhizobium japonicum; identical to SEQ ID NO: 24706

SEQ ID NO: 61594 - DNA, 948 bp, Bacteroides thetaiotaomicron; identical to SEQ ID NO: 24707
  CDS (1)..(948)

SEQ ID NO: 61595 - protein, 315 aa, Bacteroides thetaiotaomicron; identical to SEQ ID NO: 24708

SEQ ID NO: 61596 - DNA, 954 bp, Bacteroides thetaiotaomicron; identical to SEQ ID NO: 24709
  CDS (1)..(954)

SEQ ID NO: 61597 - protein, 317 aa, Bacteroides thetaiotaomicron; identical to SEQ ID NO: 24710

SEQ ID NO: 61598 - DNA, 909 bp, Staphylococcus epidermidis; identical to SEQ ID NO: 24711
  CDS (1)..(909)

SEQ ID NO: 61599 - protein, 302 aa, Staphylococcus epidermidis; identical to SEQ ID NO: 24712

SEQ ID NO: 61600 - DNA, 930 bp, Oceanobacillus iheyensis; identical to SEQ ID NO: 24713
  CDS (1)..(930)

SEQ ID NO: 61601 - protein, 309 aa, Oceanobacillus iheyensis; identical to SEQ ID NO: 24714

SEQ ID NO: 61602 - DNA, 1089 bp, Synechococcus elongatus; identical to SEQ ID NO: 24715
  CDS (1)..(1089)

SEQ ID NO: 61603 - protein, 362 aa, Synechococcus elongatus; identical to SEQ ID NO: 24716

SEQ ID NO: 61604 - DNA, 966 bp, Synechococcus elongatus; identical to SEQ ID NO: 24717
  CDS (1)..(966)

SEQ ID NO: 61605 - protein, 321 aa, Synechococcus elongatus; identical to SEQ ID NO: 24718

SEQ ID NO: 61606 - DNA, 927 bp, Streptococcus mutans; identical to SEQ ID NO: 24719
  CDS (1)..(927)

SEQ ID NO: 61607 - protein, 308 aa, Streptococcus mutans; identical to SEQ ID NO: 24720

SEQ ID NO: 61608 - DNA, 927 bp, Streptococcus agalactiae; identical to SEQ ID NO: 24721
  CDS (1)..(927)

SEQ ID NO: 61609 - protein, 308 aa, Streptococcus agalactiae; identical to SEQ ID NO: 24722

SEQ ID NO: 61610 - DNA, 969 bp, Shewanella oneidensis; identical to SEQ ID NO: 24723
  CDS (1)..(969)

SEQ ID NO: 61611 - protein, 322 aa, Shewanella oneidensis; identical to SEQ ID NO: 24724

SEQ ID NO: 61612 - DNA, 924 bp, Oceanobacillus iheyensis; identical to SEQ ID NO: 24725
  CDS (1)..(924)

SEQ ID NO: 61613 - protein, 307 aa, Oceanobacillus iheyensis; identical to SEQ ID NO: 24726

SEQ ID NO: 61614 - DNA, 927 bp, Oceanobacillus iheyensis; identical to SEQ ID NO: 24727
  CDS (1)..(927)

SEQ ID NO: 61615 - protein, 308 aa, Oceanobacillus iheyensis; identical to SEQ ID NO: 24728

SEQ ID NO: 61616 - DNA, 930 bp, Leptospira interrogans; identical to SEQ ID NO: 24729
  CDS (1)..(930)

SEQ ID NO: 61617 - protein, 309 aa, Leptospira interrogans; identical to SEQ ID NO: 24730

SEQ ID NO: 61618 - DNA, 936 bp, Corynebacterium efficiens; identical to SEQ ID NO: 24731
  CDS (1)..(936)

SEQ ID NO: 61619 - protein, 311 aa, Corynebacterium efficiens; identical to SEQ ID NO: 24732

SEQ ID NO: 61620 - DNA, 1227 bp, Bifidobacterium longum; identical to SEQ ID NO: 24733
  CDS (1)..(1227)

SEQ ID NO: 61621 - protein, 408 aa, Bifidobacterium longum; identical to SEQ ID NO: 24734

SEQ ID NO: 61622 - DNA, 1572 bp, Phytophthora infestans; identical to SEQ ID NO: 24735
  CDS (5)..(1474)

SEQ ID NO: 61623 - protein, 489 aa, Phytophthora infestans; identical to SEQ ID NO: 24736

SEQ ID NO: 61624 - DNA, 942 bp, Streptococcus pyogenes; identical to SEQ ID NO: 24737
  CDS (1)..(942)

SEQ ID NO: 61625 - protein, 313 aa, Streptococcus pyogenes; identical to SEQ ID NO: 24738

SEQ ID NO: 61626 - DNA, 1371 bp, Chlorobium tepidum; identical to SEQ ID NO: 24739
  CDS (1)..(1371)

SEQ ID NO: 61627 - protein, 456 aa, Chlorobium tepidum; identical to SEQ ID NO: 24740

SEQ ID NO: 61628 - DNA, 933 bp, Chlorobium tepidum; identical to SEQ ID NO: 24741
  CDS (1)..(933)

SEQ ID NO: 61629 - protein, 310 aa, Chlorobium tepidum; identical to SEQ ID NO: 24742

SEQ ID NO: 61630 - DNA, 1075 bp, Fusobacterium nucleatum; identical to SEQ ID NO: 24743
  CDS (135)..(1055)

SEQ ID NO: 61631 - protein, 306 aa, Fusobacterium nucleatum; identical to SEQ ID NO: 24744

SEQ ID NO: 61632 - DNA, 1386 bp, Rhodococcus erythropolis; identical to SEQ ID NO: 24745
  CDS (1)..(1386)

SEQ ID NO: 61633 - protein, 461 aa, Rhodococcus erythropolis; identical to SEQ ID NO: 24746

SEQ ID NO: 61634 - DNA, 1303 bp, Arabidopsis thaliana; identical to SEQ ID NO: 24747
  CDS (93)..(1067)

SEQ ID NO: 61635 - protein, 324 aa, Arabidopsis thaliana; identical to SEQ ID NO: 24748

SEQ ID NO: 61636 - DNA, 1422 bp, Arabidopsis thaliana; identical to SEQ ID NO: 24749
  CDS (239)..(1210)

SEQ ID NO: 61637 - protein, 323 aa, Arabidopsis thaliana; identical to SEQ ID NO: 24750

SEQ ID NO: 61638 - DNA, 1602 bp, Magnaporthe grisea; identical to SEQ ID NO: 24751
  CDS (1)..(1602)

SEQ ID NO: 61639 - protein, 533 aa, Magnaporthe grisea; identical to SEQ ID NO: 24752

SEQ ID NO: 61640 - DNA, 960 bp, Xanthomonas campestris; identical to SEQ ID NO: 24753
  CDS (1)..(960)

SEQ ID NO: 61641 - protein, 319 aa, Xanthomonas campestris; identical to SEQ ID NO: 24754

SEQ ID NO: 61642 - DNA, 1371 bp, Xanthomonas campestris; identical to SEQ ID NO: 24755
  CDS (1)..(1371)

SEQ ID NO: 61643 - protein, 456 aa, Xanthomonas campestris; identical to SEQ ID NO: 24756

SEQ ID NO: 61644 - DNA, 1371 bp, Xanthomonas axonopodis; identical to SEQ ID NO: 24757
  CDS (1)..(1371)

SEQ ID NO: 61645 - protein, 456 aa, Xanthomonas axonopodis; identical to SEQ ID NO: 24758

SEQ ID NO: 61646 - DNA, 960 bp, Xanthomonas axonopodis; identical to SEQ ID NO: 24759
  CDS (1)..(960)

SEQ ID NO: 61647 - protein, 319 aa, Xanthomonas axonopodis; identical to SEQ ID NO: 24760

SEQ ID NO: 61648 - DNA, 939 bp, Thermoanaerobacter tengcongensis; identical to SEQ ID NO: 24761
  CDS (1)..(939)

SEQ ID NO: 61649 - protein, 312 aa, Thermoanaerobacter tengcongensis; identical to SEQ ID NO: 24762

SEQ ID NO: 61650 - DNA, 921 bp, Thermoanaerobacter tengcongensis; identical to SEQ ID NO: 24763
  CDS (1)..(921)

SEQ ID NO: 61651 - protein, 306 aa, Thermoanaerobacter tengcongensis; identical to SEQ ID NO: 24764

SEQ ID NO: 61652 - DNA, 951 bp, Fusobacterium nucleatum; identical to SEQ ID NO: 24765
  CDS (1)..(951)

SEQ ID NO: 61653 - protein, 316 aa, Fusobacterium nucleatum; identical to SEQ ID NO: 24766

SEQ ID NO: 61654 - DNA, 927 bp, Methanosarcina acetivorans; identical to SEQ ID NO: 24767
  CDS (1)..(927)

SEQ ID NO: 61655 - protein, 308 aa, Methanosarcina acetivorans; identical to SEQ ID NO: 24768

SEQ ID NO: 61656 - DNA, 1267 bp, Glycine max; identical to SEQ ID NO: 24769
  CDS (82)..(1059)

SEQ ID NO: 61657 - protein, 325 aa, Glycine max; identical to SEQ ID NO: 24770

SEQ ID NO: 61658 - DNA, 903 bp, Clostridium perfringens; identical to SEQ ID NO: 24771
  CDS (1)..(903)

SEQ ID NO: 61659 - protein, 300 aa, Clostridium perfringens; identical to SEQ ID NO: 24772

SEQ ID NO: 61660 - DNA, 975 bp, Ralstonia solanacearum; identical to SEQ ID NO: 24773
  CDS (1)..(975)

SEQ ID NO: 61661 - protein, 324 aa, Ralstonia solanacearum; identical to SEQ ID NO: 24774

SEQ ID NO: 61662 - DNA, 903 bp, Ralstonia solanacearum; identical to SEQ ID NO: 24775
  CDS (1)..(903)

SEQ ID NO: 61663 - protein, 300 aa, Ralstonia solanacearum; identical to SEQ ID NO: 24776

SEQ ID NO: 61664 - DNA, 2433 bp, Mus musculus; identical to SEQ ID NO: 24777
  CDS (187)..(1872)

SEQ ID NO: 61665 - protein, 561 aa, Mus musculus; identical to SEQ ID NO: 24778

SEQ ID NO: 61666 - DNA, 969 bp, Rhizobium meliloti; identical to SEQ ID NO: 24779
  CDS (1)..(969)

SEQ ID NO: 61667 - protein, 322 aa, Rhizobium meliloti; identical to SEQ ID NO: 24780

SEQ ID NO: 61668 - DNA, 1601 bp, Pichia pastoris; identical to SEQ ID NO: 24781
  CDS (14)..(1519)

SEQ ID NO: 61669 - protein, 501 aa, Pichia pastoris; identical to SEQ ID NO: 24782

SEQ ID NO: 61670 - DNA, 1089 bp, Rhizobium loti; identical to SEQ ID NO: 24783
  CDS (1)..(1089)

SEQ ID NO: 61671 - protein, 362 aa, Rhizobium loti; identical to SEQ ID NO: 24784

SEQ ID NO: 61672 - DNA, 1440 bp, Rhizobium loti; identical to SEQ ID NO: 24785
  CDS (1)..(1440)

SEQ ID NO: 61673 - protein, 479 aa, Rhizobium loti; identical to SEQ ID NO: 24786

SEQ ID NO: 61674 - DNA, 1035 bp, Rhizobium loti; identical to SEQ ID NO: 24787
  CDS (1)..(1035)

SEQ ID NO: 61675 - protein, 344 aa, Rhizobium loti; identical to SEQ ID NO: 24788

SEQ ID NO: 61676 - DNA, 1370 bp, Trypanosoma cruzi; identical to SEQ ID NO: 24789
  CDS (15)..(1169)

SEQ ID NO: 61677 - protein, 384 aa, Trypanosoma cruzi; identical to SEQ ID NO: 24790

SEQ ID NO: 61678 - DNA, 1200 bp, Arabidopsis thaliana; identical to SEQ ID NO: 24791
  CDS (1)..(1200)

SEQ ID NO: 61679 - protein, 399 aa, Arabidopsis thaliana; identical to SEQ ID NO: 24792

SEQ ID NO: 61680 - DNA, 948 bp, Pasteurella multocida; identical to SEQ ID NO: 24793
  CDS (1)..(948)

SEQ ID NO: 61681 - protein, 315 aa, Pasteurella multocida; identical to SEQ ID NO: 24794

SEQ ID NO: 61682 - DNA, 1392 bp, Streptomyces venezuelae; identical to SEQ ID NO: 24795
  CDS (1)..(1392)

SEQ ID NO: 61683 - protein, 463 aa, Streptomyces venezuelae; identical to SEQ ID NO: 24796

SEQ ID NO: 61684 - DNA, 927 bp, Bacillus stearothermophilus; identical to SEQ ID NO: 24797
  CDS (1)..(927)

SEQ ID NO: 61685 - protein, 308 aa, Bacillus stearothermophilus; identical to SEQ ID NO: 24798

SEQ ID NO: 61686 - DNA, 951 bp, Selenomonas ruminantium; identical to SEQ ID NO: 24799
  CDS (19)..(951)

SEQ ID NO: 61687 - protein, 310 aa, Selenomonas ruminantium; identical to SEQ ID NO: 24800

SEQ ID NO: 61688 - DNA, 1378 bp, Solanum tuberosum; identical to SEQ ID NO: 24801
  CDS (55)..(1215)

SEQ ID NO: 61689 - protein, 386 aa, Solanum tuberosum; identical to SEQ ID NO: 24802

SEQ ID NO: 61690 - DNA, 1354 bp, Solanum tuberosum; identical to SEQ ID NO: 24803
  CDS (85)..(1062)

SEQ ID NO: 61691 - protein, 325 aa, Solanum tuberosum; identical to SEQ ID NO: 24804

SEQ ID NO: 61692 - DNA, 1250 bp, Solanum tuberosum; identical to SEQ ID NO: 24805
  CDS (96)..(1139)

SEQ ID NO: 61693 - protein, 347 aa, Solanum tuberosum; identical to SEQ ID NO: 24806

SEQ ID NO: 61694 - DNA, 1493 bp, Nicotiana tabacum; identical to SEQ ID NO: 24807
  CDS (88)..(1062)

SEQ ID NO: 61695 - protein, 324 aa, Nicotiana tabacum; identical to SEQ ID NO: 24808

SEQ ID NO: 61696 - DNA, 927 bp, Methanosarcina thermophila; identical to SEQ ID NO: 24809
  CDS (1)..(927)

SEQ ID NO: 61697 - protein, 308 aa, Methanosarcina thermophila; identical to SEQ ID NO: 24810

SEQ ID NO: 61698 - DNA, 1269 bp, Salmonella enterica subsp; identical to SEQ ID NO: 24811
  CDS (205)..(1176)

SEQ ID NO: 61699 - protein, 323 aa, Salmonella enterica subsp; identical to SEQ ID NO: 24812

SEQ ID NO: 61700 - DNA, 1386 bp, Streptomyces coelicolor; identical to SEQ ID NO: 24813
  CDS (1)..(1386)

SEQ ID NO: 61701 - protein, 461 aa, Streptomyces coelicolor; identical to SEQ ID NO: 24814

SEQ ID NO: 61702 - DNA, 915 bp, Clostridium sticklandii; identical to SEQ ID NO: 24815
  CDS (1)..(915)

SEQ ID NO: 61703 - protein, 304 aa, Clostridium sticklandii; identical to SEQ ID NO: 24816

SEQ ID NO: 61704 - DNA, 1671 bp, Allium tuberosum; identical to SEQ ID NO: 24817
  CDS (417)..(1394)

SEQ ID NO: 61705 - protein, 325 aa, Allium tuberosum; identical to SEQ ID NO: 24818

SEQ ID NO: 61706 - DNA, 1868 bp, Oryctolagus cuniculus; identical to SEQ ID NO: 24819
  CDS (71)..(1726)

SEQ ID NO: 61707 - protein, 551 aa, Oryctolagus cuniculus; identical to SEQ ID NO: 24820

SEQ ID NO: 61708 - DNA, 1077 bp, Leishmania tarentolae; identical to SEQ ID NO: 24821
  CDS (1)..(1077)

SEQ ID NO: 61709 - protein, 358 aa, Leishmania tarentolae; identical to SEQ ID NO: 24822

SEQ ID NO: 61710 - DNA, 990 bp, Synechococcus sp; identical to SEQ ID NO: 24823
  CDS (1)..(990)

SEQ ID NO: 61711 - protein, 329 aa, Synechococcus sp; identical to SEQ ID NO: 24824

SEQ ID NO: 61712 - DNA, 921 bp, Lactococcus lactis; identical to SEQ ID NO: 24825
  CDS (1)..(921)

SEQ ID NO: 61713 - protein, 306 aa, Lactococcus lactis; identical to SEQ ID NO: 24826

SEQ ID NO: 61714 - DNA, 1014 bp, Zymomonas mobilis; identical to SEQ ID NO: 24827
  CDS (1)..(1014)

SEQ ID NO: 61715 - protein, 337 aa, Zymomonas mobilis; identical to SEQ ID NO: 24828

SEQ ID NO: 61716 - DNA, 927 bp, Streptococcus suis; identical to SEQ ID NO: 24829
  CDS (1)..(927)

SEQ ID NO: 61717 - protein, 308 aa, Streptococcus suis; identical to SEQ ID NO: 24830

SEQ ID NO: 61718 - DNA, 1173 bp, Cyanidioschyzon merolae; identical to SEQ ID NO: 24831
  CDS (1)..(1173)

SEQ ID NO: 61719 - protein, 390 aa, Cyanidioschyzon merolae; identical to SEQ ID NO: 24832

SEQ ID NO: 61720 - DNA, 1170 bp, Cyanidioschyzon merolae; identical to SEQ ID NO: 24833
  CDS (1)..(1170)

SEQ ID NO: 61721 - protein, 389 aa, Cyanidioschyzon merolae; identical to SEQ ID NO: 24834

SEQ ID NO: 61722 - DNA, 972 bp, Arabidopsis thaliana; identical to SEQ ID NO: 24835
  CDS (1)..(972)

SEQ ID NO: 61723 - protein, 323 aa, Arabidopsis thaliana; identical to SEQ ID NO: 24836

SEQ ID NO: 61724 - DNA, 1068 bp, Entamoeba dispar; identical to SEQ ID NO: 24837
  CDS (26)..(1036)

SEQ ID NO: 61725 - protein, 336 aa, Entamoeba dispar; identical to SEQ ID NO: 24838

SEQ ID NO: 61726 - DNA, 1151 bp, Entamoeba dispar; identical to SEQ ID NO: 24839
  CDS (100)..(1110)

SEQ ID NO: 61727 - protein, 336 aa, Entamoeba dispar; identical to SEQ ID NO: 24840

SEQ ID NO: 61728 - DNA, 1780 bp, Drosophila melanogaster; identical to SEQ ID NO: 24841
  CDS (66)..(1634)

SEQ ID NO: 61729 - protein, 522 aa, Drosophila melanogaster; identical to SEQ ID NO: 24842

SEQ ID NO: 61730 - DNA, 1020 bp, Oryza sativa; identical to SEQ ID NO: 24843
  CDS (1)..(1020)

SEQ ID NO: 61731 - protein, 339 aa, Oryza sativa; identical to SEQ ID NO: 24844

SEQ ID NO: 61732 - DNA, 1758 bp, Fugu rubripes; identical to SEQ ID NO: 24845
  CDS (1)..(1758)

SEQ ID NO: 61733 - protein, 585 aa, Fugu rubripes; identical to SEQ ID NO: 24846

SEQ ID NO: 61734 - DNA, 1511 bp, Dictyostelium discoideum; identical to SEQ ID NO: 24847
  CDS (1)..(1494)

SEQ ID NO: 61735 - protein, 497 aa, Dictyostelium discoideum; identical to SEQ ID NO: 24848

SEQ ID NO: 61736 - DNA, 1280 bp, Brassica juncea; identical to SEQ ID NO: 24849
  CDS (74)..(1042)

SEQ ID NO: 61737 - protein, 322 aa, Brassica juncea; identical to SEQ ID NO: 24850

SEQ ID NO: 61738 - DNA, 1290 bp, Oryza sativa; identical to SEQ ID NO: 24851
  CDS (74)..(1039)

SEQ ID NO: 61739 - protein, 321 aa, Oryza sativa; identical to SEQ ID NO: 24852

SEQ ID NO: 61740 - DNA, 1238 bp, Brassica juncea; identical to SEQ ID NO: 24853
  CDS (18)..(992)

SEQ ID NO: 61741 - protein, 324 aa, Brassica juncea; identical to SEQ ID NO: 24854

SEQ ID NO: 61742 - DNA, 1363 bp, Oryza sativa; identical to SEQ ID NO: 24855
  CDS (139)..(1116)

SEQ ID NO: 61743 - protein, 325 aa, Oryza sativa; identical to SEQ ID NO: 24856

SEQ ID NO: 61744 - DNA, 969 bp, Buchnera aphidicola; identical to SEQ ID NO: 24857
  CDS (1)..(969)

SEQ ID NO: 61745 - protein, 322 aa, Buchnera aphidicola; identical to SEQ ID NO: 24858

SEQ ID NO: 61746 - DNA, 942 bp, Staphylococcus epidermidis; identical to SEQ ID NO: 24859
  CDS (10)..(942)

SEQ ID NO: 61747 - protein, 310 aa, Staphylococcus epidermidis; identical to SEQ ID NO: 24860

SEQ ID NO: 61748 - DNA, 1459 bp, Arabidopsis thaliana; identical to SEQ ID NO: 24861
  CDS (1)..(1215)

SEQ ID NO: 61749 - protein, 404 aa, Arabidopsis thaliana; identical to SEQ ID NO: 24862

SEQ ID NO: 61750 - DNA, 24 bp, Primer
atgagtaagatttttgaagataac

SEQ ID NO: 61751 - DNA, 25 bp, Primer
ttactgttgcaattctttctcagtg

SEQ ID NO: 61752 - protein, 420 aa, consensus; identical to SEQ ID NO: 25512
  MISC_FEATURE (1)..(420): consensus for the disclosure of xaa see table XV

SEQ ID NO: 61753 - protein, 56 aa, consensus; identical to SEQ ID NO: 25508
  MISC_FEATURE (1)..(56): consensus for the disclosure of xaa see table XV

SEQ ID NO: 61754 - protein, 53 aa, consensus; identical to SEQ ID NO: 25509
  MISC_FEATURE (1)..(53): consensus for the disclosure of xaa see table XV

SEQ ID NO: 61755 - protein, 74 aa, consensus; identical to SEQ ID NO: 25510
  MISC_FEATURE (1)..(74): consensus for the disclosure of xaa see table XV

SEQ ID NO: 61756 - protein, 32 aa, consensus; identical to SEQ ID NO: 25511
  MISC_FEATURE (1)..(32): consensus for the disclosure of xaa see table XV

SEQ ID NO: 61757 - DNA, 858 bp, Escherichia coli
  CDS (1)..(858)
atgtttatcctgtattttcagagggaatggagtgtaacgctctgtattaacaaggagagcattaaaatgggtaaactcacgggcaagacagcactgattacgggcgcattgcagggaattggcgaaggaattgccagaacttttgcacgtcatggcgcgaacctaatcttgctggatatctcccctgagatcgaaaagctggcggacgaactgtgtggtcgtggtcatcgctgtacggcggttgtcgccgatgtgcgtgacccggcgtcggtagccgcagctatcaaacgcgcgaaggaaaaagaagggcgcattgatatcctggtgaataacgcaggcgtttgtcgtctgggcagtttcctcgatatgagcgatgacgatcgcgatttccatattgacatcaatattaaaggcgtatggaacgtcacgaaggcggtgctgccggagatgattgcccgcaaagatggtcgcattgtgatgatgtcttcagtcactggtgatatggtggccgatcctggcgaaacggcgtacgccttaacgaaagcggcgattgttggcctgacaaaatcgctggcggtggagtacgcgcagtctggtattcgcgttaacgccatttgcccgggatacgtgcgcacaccaatggcggaaagcattgcccgccagtcgaacccggaagatccagagtcggtgctgactgaaatggcgaaagcaatcccgatgcgtcgcctcgccgatccgctggaagtcggcgaactggcggccttcctcgcatcggatgaatccagctatttaaccggtacacagaatgtgattgatggcggcagcacactgccggagacggttagcgtcggtatctga

SEQ ID NO: 61758 - protein, 285 aa, Escherichia coli
MFILYFQREWSVTLCINKESIKMGKLTGKTALITGALQGIGEGIARTFARHGANLILLDISPEIEKLADELCGRGHRCTAVVADVRDPASVAAAIKRAKEKEGRIDILVNNAGVCRLGSFLDMSDDDRDFHIDINIKGVWNVTKAVLPEMIARKDGRIVMMSSVTGDMVADPGETAYALTKAAIVGLTKSLAVEYAQSGIRVNAICPGYVRTPMAESIARQSNPEDPESVLTEMAKAIPMRRLADPLEVGELAAFLASDESSYLTGTQNVIDGGSTLPETVSVGI

SEQ ID NO: 61759 - DNA, 735 bp, Staphylococcus aureus subsp. aureus COL
  CDS (1)..(735)
atgactaagagtgctttagtaacaggtgcatcaagaggaattggacgtagtattgcgttacaattagcagaagaaggatataatgtagcagtaaactatgcaggcagcaaagagaaagctgaagcagtagtcgaagaaatcaaagctaaaggtgttgacagttttgcgattcaagcaaatgttgccgatgctgatgaagttaaagcaatgattaaagaagtagttagccaatttggttctttagatgttttagtaaataatgcaggtattactcgcgataatttattaatgcgtatgaaagaacaagagtgggatgatgttattgacacaaacttaaaaggtgtatttaactgtattcaaaaagcaacaccacaaatgttaagacaacgtagtggtgctatcattaatttatcaagtgttgttggagcagtaggtaatccgggacaagcaaactatgttgcaacaaaagcaggtgttattggtttaactaaatctgcggcgcgtgaattagcatctcgtggtatcactgtaaatgcagttgcacctggttttattgtttctgatatgacagatgctttaagtgatgagcttaaagaacaaatgttgactcaaattccgttagcacgttttggtcaagacacagatattgctaatacagtagcgttcttagcatcagacaaagcaaaatatattacaggtcaaacaatccatgtaaatggtggaatgtacatgtaa

SEQ ID NO: 61760 - protein, 244 aa, Staphylococcus aureus subsp. aureus COL
MTKSALVTGASRGIGRSIALQLAEEGYNVAVNYAGSKEKAEAVVEEIKAKGVDSFAIQANVADADEVKAMIKEVVSQFGSLDVLVNNAGITRDNLLMRMKEQEWDDVIDTNLKGVFNCIQKATPQMLRQRSGAIINLSSVVGAVGNPGQANYVATKAGVIGLTKSAARELASRGITVNAVAPGFIVSDMTDALSDELKEQMLTQIPLARFGQDTDIANTVAFLASDKAKYITGQTIHVNGGMYM

SEQ ID NO: 61761 - DNA, 741 bp, Gluconobacter oxydans 621H
  CDS (1)..(741)
atgttctctctttccggcaagactgctctcgtcacgggtgcctccggcggcattggcgctgcgattgcccgtcagcttcatgcgcagggtgcgacggtcgtgctcagcggtacgcgcgaagccgctcttcaggaactggctgacagcctgggcgagcgtgcccatatcgccgtcgccaacctgtccgacccggccgaggctgatggcctcgtcgccaaggctgaagccgttgcgggtgcgccgctggacattctggtcaacaatgccggcctgacgcgtgatacgctcgccatccgcatgaaggacagcgactggtcgcaggtcatgaccgtggatttggaaagcccgttccgtctggcccgcgctgcgctcaagggcatgctgcgtcgccgtgcggggcgcatcatttccatcgcctccgtggtaggaacgacgggcaatgccggtcaggccaactatgccgccgccaaggccggcatagtgggcatgagcaagtcgctcgcgcaggaagccggtccgcgaggcgtgacggtcaacgttgtggcccccggtttcatcgaaacgccgatgacggatgtgctgccggaaaccgtgcgcgagaagctgattggctccattccgctcggccggatggggaatactggtgacgtggcgtccgcagtagtatatctggcttccgatgaggcggcatgggtcacgggtacgaccctgcacgtcaatggtggcatggcgatggtctga

SEQ ID NO: 61762 - protein, 246 aa, Gluconobacter oxydans 621H
MFSLSGKTALVTGASGGIGAAIARQLHAQGATVVLSGTREAALQELADSLGERAHIAVANLSDPAEADGLVAKAEAVAGAPLDILVNNAGLTRDTLAIRMKDSDWSQVMTVDLESPFRLARAALKGMLRRRAGRIISIASVVGTTGNAGQANYAAAKAGIVGMSKSLAQEAGPRGVTVNVVAPGFIETPMTDVLPETVREKLIGSIPLGRMGNTGDVASAVVYLASDEAAWVTGTTLHVNGGMAMV

SEQ ID NO: 61763 - DNA, 738 bp, Vibrio fischeri ES114
  CDS (1)..(738)
atgatgaatctagagggcaaaattgccttagttactggtgcaagccgtggtatcggtcgttcaatcgctgaactacttgtatctcgtggcgcaacagtgattggtacagcgacgtctgaaggtggcgctgcagcaatcagtgaatacctaggtgagaacggtaaaggtcttgctttaaatgtaactgatgtagagtcgattgagtctgtactaaaaagcattaacgatgagtttggtgcgattgatatcttggtaaataatgcgggtattactcgtgataacctacttatgcgtatgaaagacgatgagtggacagatatcatggatactaacttaacgtctattttccgtttatcaaaagcggttcttcgtggcatgatgaagaagcgtaacggtcgtatcattaacgttggttctgttgttggtacaatgggtaacgctggtcaaactaactatgcagctgcaaaagcaggcgtaattggttttactaagtctatggctcgtgaagttgcttcacgtggcgtaacagtaaatactgttgcaccaggttttattgaaacagatatgacaaaagccttgaatgatgaccaacgagctgcaacactatcagcggtaccagctggacgtctaggtgatccaaaagaaatcgcatcagcggtggtatttttggcctctccggaagcggcatacattacgggcgaaacactgcacgtaaatggcggcatgtacatggtttaa

SEQ ID NO: 61764 - protein, 245 aa, Vibrio fischeri ES114
MMNLEGKIALVTGASRGIGRSIAELLVSRGATVIGTATSEGGAAAISEYLGENGKGLALNVTDVESIESVLKSINDEFGAIDILVNNAGITRDNLLMRMKDDEWTDIMDTNLTSIFRLSKAVLRGMMKKRNGRIINVGSVVGTMGNAGQTNYAAAKAGVIGFTKSMAREVASRGVTVNTVAPGFIETDMTKALNDDQRAATLSAVPAGRLGDPKEIASAVVFLASPEAAYITGETLHVNGGMYMV

SEQ ID NO: 61765 - DNA, 777 bp, Mesorhizobium loti MAFF303099
  CDS (1)..(777): transl_table=11
atgggccgctttgacggagcaaccgtgctgatcacaggtgccgccggggggctcggccggggtgccgcgaaaggctttgccagcgagggcgcgcggctggtgctgtcggacatcgacgaaaaggcgctcgccgatcttgccgcaacgctgccggccgaaacggcgatcctggccggcaacgtagccgacgaaaaactgtccgaggatctggtcaggctggcggtcgaaaaattcggccggctggatgtcaccgtcaacaatgccggcatcgtccagagtttcgtgcgcctgccgcaggttccttcggacgaggcgcgccgcgtgcttgagatcgacctgcttggcgtcttctatgccatgaagcaccagatcccgcagatggagcggcagttcagggctacggccaagggcggcgccatcgtcaacatcgcctcggttgccggactggtcggcgcgccgaaactctcggtttatgccgccgccaagcatggcgtcgtcgggctgaccaaatcggcggccgccgaatatgcaaccaagggtgtgcgcatcaacgccatctgtccggctcacaccaggacggcaatggtggacagtttcgtgcgcgcctccggtgcgccggaggcagaggcgttggccgaactgacacgcggtgtgccgatgaaacgcgtggcggaagtcgacgaaatcaccaccgccatcctgttcgccgccgacccggccaactccttcatgaccggccatgcgctggccgtcgacggcggcgtcggcgccatctga

SEQ ID NO: 61766 - protein, 258 aa, Mesorhizobium loti MAFF303099
MGRFDGATVLITGAAGGLGRGAAKGFASEGARLVLSDIDEKALADLAATLPAETAILAGNVADEKLSEDLVRLAVEKFGRLDVTVNNAGIVQSFVRLPQVPSDEARRVLEIDLLGVFYAMKHQIPQMERQFRATAKGGAIVNIASVAGLVGAPKLSVYAAAKHGVVGLTKSAAAEYATKGVRINAICPAHTRTAMVDSFVRASGAPEAEALAELTRGVPMKRVAEVDEITTAILFAADPANSFMTGHALAVDGGVGAI

SEQ ID NO: 61767 - DNA, 732 bp, Mesorhizobium loti MAFF303099
  CDS (1)..(732): transl_table=11
atggcggatctggcaggcaaggtcgttgtcatcacggcggcggcgcaaggcatcggcaaggcgagcgcgctggccttcgccaagactggagccaccgtccacgccaccgacatcaacgagacgcttctcgccgaactcgccaagacgccagggatcaagacccgcaagctggatgtgctcaacgacgaggccgtcaacaccaccttcgccgagatcggccgcgtcgacgtgctgttcaactgcgccggcttcgtccattccggctcgatcctggagatgaaggatggcgatctcgatttcgccttcaacctcaatgtccgcgccatgatccgcaccatcagggccgtgctgcccggcatgctggaacgaggcgacggatcgatcgtcaacatgtcttccgtcgccggcgccggcaaaggcgtgccgaaccgcttcgcctatggcgtcaccaaggccgccgtcatcggcctgaccaaggcgattgccgccgactatgtcggcaagggcatacgctgcaacgccatctgccccggcacggtcgaaagcccgtcgctgcaggaccgcatgcatgcgcaaggcgactacgaagccgcccgcgccgccttcatcgcccgccagccaatgggccggctcggcacgcctgaggaaatcgccgatctcgcggtctatctggccggcgcgacctacacgtccgggcaggcctataatatcgacggcggctggtcgatctga

SEQ ID NO: 61768 - protein, 243 aa, Mesorhizobium loti MAFF303099
MADLAGKVVVITAAAQGIGKASALAFAKTGATVHATDINETLLAELAKTPGIKTRKLDVLNDEAVNTTFAEIGRVDVLFNCAGFVHSGSILEMKDGDLDFAFNLNVRAMIRTIRAVLPGMLERGDGSIVNMSSVAGAGKGVPNRFAYGVTKAAVIGLTKAIAADYVGKGIRCNAICPGTVESPSLQDRMHAQGDYEAARAAFIARQPMGRLGTPEEIADLAVYLAGATYTSGQAYNIDGGWSI

SEQ ID NO: 61769 - DNA, 765 bp, Mesorhizobium loti MAFF303099
  CDS (1)..(765): transl_table=11
atgacccagtctttgaagggtcggtccgtcgtcgtcaccggcgggtcgaaaggcatcggcaagggcatagcgcgggtgttcgcgctgtcgggtgccaaggtcgccatcgttgcgcgccatcccgaccaggccgaagccgcggccgccgagatcggccacggcgcctttggcgtggttggcgatgtgacctcgctcgccagcatcgagagcgcgcttgcagtggtagccgcgagaaacggcagtatcgacgttttgtgcgccaatgccggcatcttcccgcaggcacggctcgaagacatgacgtcgcagcaatgggacgaggttgtcgacaccaacctcaagggcaccttccacgcggtcaaggcagcggttccctatctcaagacgtcgaaccagggccgcatcgtgctgacgtcgtcgatcaccggcccgatcactggttttcccggctggtctcactacggcgccaccaaggcgggacagctcggcttcatgcgaacggcctgcatcgaactggcgaaatacggcatcaccgtcaacgccgtcatgccgggcaacatcgtgaccgagggccttgtcggcctgggcgaggactaccagaagaccatggccgcctcgatcccgctcaagcggctcggaaccgtggaggacatcggctacgccgcgctctactttgcgtcgaaggaagccggctacgtgacgggacagacgatcatcgtcgatggcggccagatcctgccggagagcctggaggcactggcatag

SEQ ID NO: 61770 - protein, 254 aa, Mesorhizobium loti MAFF303099
MTQSLKGRSVVVTGGSKGIGKGIARVFALSGAKVAIVARHPDQAEAAAAEIGHGAFGVVGDVTSLASIESALAVVAARNGSIDVLCANAGIFPQARLEDMTSQQWDEVVDTNLKGTFHAVKAAVPYLKTSNQGRIVLTSSITGPITGFPGWSHYGATKAGQLGFMRTACIELAKYGITVNAVMPGNIVTEGLVGLGEDYQKTMAASIPLKRLGTVEDIGYAALYFASKEAGYVTGQTIIVDGGQILPESLEALA

SEQ ID NO: 61771 - DNA, 777 bp, Mesorhizobium loti MAFF303099
  CDS (1)..(777): transl_table=11
atgacaggcaggcttcaggggaagatcgcaatcgtcaccggcgccggccagggcattggtgcagccactgcccgggcctttgcgatgcagggagcaaagaccgtgattgccgagctcaatgcggcaaccggcaaggcggccgccgacgaattgcgtgccaacggcgccgacgcccttttcgtcgaaaccgatgtcaccgacacagcggcagtggccgacatggtggcgaagacgatcgcggcctatggcggcgtcaacgtgctcgtcaacaatgcaggcgccaacgtcttttacgagcccttgtctatgccggacgcggaatgggaccgttgcctcaggctcgacctccaggccgcgtggtcctgtgccaaggcggtgttgccgacgatgctggcgaacggttcgggatcgatcgtcaacatagccagctgccacgccttcaagatcattccccacacatttccctatccggtcgccaagcatgcgcttgtcggcctgacccgctcgctcggcatcgaatatgcggcgcgcggcatccgcgtgaatgcgatcgcccccggctacatcgagacgccgatcgcggaagcctattggaacacgtttccggacccggccgaggagaagcggcgggcctacgaccttcatccgcccaagcgcattggccggccggacgaagttgcaatgacggcggttttcctcgcttcggacgaagcgccgttcatcaatgccgagacgatcaccatcgatggtggacgctcggttctctaccatgactga

SEQ ID NO: 61772 - protein, 258 aa, Mesorhizobium loti MAFF303099
MTGRLQGKIAIVTGAGQGIGAATARAFAMQGAKTVIAELNAATGKAAADELRANGADALFVETDVTDTAAVADMVAKTIAAYGGVNVLVNNAGANVFYEPLSMPDAEWDRCLRLDLQAAWSCAKAVLPTMLANGSGSIVNIASCHAFKIIPHTFPYPVAKHALVGLTRSLGIEYAARGIRVNAIAPGYIETPIAEAYWNTFPDPAEEKRRAYDLHPPKRIGRPDEVAMTAVFLASDEAPFINAETITIDGGRSVLYHD

SEQ ID NO: 61773 - DNA, 738 bp, Mesorhizobium loti MAFF303099; identical to SEQ ID NO: 7296
  CDS (1)..(738): transl_table=11

SEQ ID NO: 61774 - protein, 245 aa, Mesorhizobium loti MAFF303099; identical to SEQ ID NO: 7297

SEQ ID NO: 61775 - DNA, 771 bp, Mesorhizobium loti MAFF303099
  CDS (1)..(771): transl_table=11
atgaccggacgattgaaagacaaggtggcgctgatcatcggcagcgcgcgcggcatcggcaagggcatcgcattgcgctttgccgaagaaggcgcacggctggttctggccgacagcgaggccgaggccgggcaagcgaccgcggatgagctcggtgtccctttcatcggcaccgacatctcgcaaatgcgcgacgccgaggcctcggtggcactggcgctgaagcgtcacggccggctcgacatcatcgtgcagaatgccggcatctatccctggcaattgatcgagaacaccagcaccgacgactgggatcgcgtcatggccgtcaatctgcgcggcaccttcaatgccacccgcgcagccctggtgccgatgaaggcgcagcgctccggacgcatgctctacacctcctccatcaccggaccgcatgtcacgagccccggccacggccattattcggcgacaaaggcaggcatcaacggcttcatccgggcagcggcgctggagttctccggctacggcatcaccgtcaacggtgtcgaacccggcaacatcctgaccgaagccatccagcagcatcgcggtgccgcctacatcaagaacatggaggattccatcccgctcggccggctcggcagcccgcgcgacgtcgccaatgccttccttttcctggcctcggacgacgccggctatatcaccgggacgaccattgtcgtcgacggcgggcaattgctgcccgagggcaatgattttcggatggtgccgccttga

SEQ ID NO: 61776 - protein, 256 aa, Mesorhizobium loti MAFF303099
MTGRLKDKVALIIGSARGIGKGIALRFAEEGARLVLADSEAEAGQATADELGVPFIGTDISQMRDAEASVALALKRHGRLDIIVQNAGIYPWQLIENTSTDDWDRVMAVNLRGTFNATRAALVPMKAQRSGRMLYTSSITGPHVTSPGHGHYSATKAGINGFIRAAALEFSGYGITVNGVEPGNILTEAIQQHRGAAYIKNMEDSIPLGRLGSPRDVANAFLFLASDDAGYITGTTIVVDGGQLLPEGNDFRMVPP

SEQ ID NO: 61777 - DNA, 747 bp, Chlamydia trachomatis D/UW-3/CX; identical to SEQ ID NO: 7338
  CDS (1)..(747): transl_table=11

SEQ ID NO: 61778 - protein, 248 aa, Chlamydia trachomatis D/UW-3/CX
MSGLLVNKTAIVTGGSRGIGFSIAKLFAEQGANVQIWGINGEAGQAAAQTLSEQTGRQVSFALVDVSKNDMVSAQVQNFLAEYNTIDVIVNNAGITRDALLMRMSEEEWSSVINTNLGSIYNVCSAVIRPMIKARSGAIINISSIVGLRGSPGQTNYAAAKAGIIGFSKALSKEVGSKNIRVNCIAPGFIDTDMTKSLNDNLKNEWLKGVPLGRVGMPEEIAKAALFLASDGSSYITGQVLSVDGGMA

SEQ ID NO: 61779 - DNA, 774 bp, Thermotoga maritima MSB8
  CDS (1)..(774): transl_table=11
gtgaatattcttgaaaagcttttctctttgaaaagaaaggtagctctggtgactggtggaggacagggcatcgggaaggccatcgcccaggcgctggcagcggcgggtgcagctgttttgatcatggacataaacgaagaaacagccagaagaacggtcgaagagataaaagagaaaggtggcgaagcagatttctatgttggggatgtgacgaaagaagaagattgttttggagcggtcaaaaaggcgctggataggtgggggaaactcgacataggagtcaacaacgcgggaataggagactggtgtgaagcggagaattatccggttgagaagtggaaaaaggtcatagacgtgaatctggttggggtgtttctttccgcaaaagcggagttccacgctatgaaggaaagaaaatacggaaagatcataaacatcgcgtccatgtccggacacatcgtgaacaaacctcagaagcagacagcttacaacgcttcgaaagcgggtgtgatccatctcaccagatctctggccgccgagtgggccccgtacggaatcagggtgaacagcataagccccggatacatcagaacacctctcatagaatctccaaacgtgaaagatcttgttcccctctggctcgacatgatccctcttggaagactgggagaggtggacgatctgataggagctgctatcttccttgcaagtcccgcctcagattacatgacagggcacgatcttgtgatagacggaggctacaccgtctggtga

SEQ ID NO: 61780 - protein, 257 aa, Thermotoga maritima MSB8
MNILEKLFSLKRKVALVTGGGQGIGKAIAQALAAAGAAVLIMDINEETARRTVEEIKEKGGEADFYVGDVTKEEDCFGAVKKALDRWGKLDIGVNNAGIGDWCEAENYPVEKWKKVIDVNLVGVFLSAKAEFHAMKERKYGKIINIASMSGHIVNKPQKQTAYNASKAGVIHLTRSLAAEWAPYGIRVNSISPGYIRTPLIESPNVKDLVPLWLDMIPLGRLGEVDDLIGAAIFLASPASDYMTGHDLVIDGGYTVW

SEQ ID NO: 61781 - DNA, 747 bp, Vibrio cholerae O1 biovar eltor str. N16961
  CDS (1)..(747): transl_table=11
atgagtcaattcatgaatctagagggcaaagttgctcttgtgactggcgcaagccgcggcattggtaaagcgattgctgaactcttagctgaacgtggtgccaaagtgattggtacggcaaccagcgaaagcggtgcgcaggcgatcagcgattacttgggtgacaacggcaaaggtatggcattgaatgtgaccaatcctgagtcgattgaagcggttctgaaagccattaccgacgagttcggcggcgtcgacattctggtgaacaatgctggtatcactcgcgataatctgctgatgcgcatgaaagaagaagagtggtcagacattatggagaccaatctgacgtcgattttccgtctgtctaaagccgttttgcgtggcatgatgaaaaaacgtcaaggtcgtatcatcaatgttggctctgttgttggcactatgggtaacgcaggtcaagccaactacgcggcagcaaaagcgggcgtaattggctttactaagtcaatggcgcgtgaagttgcatcgcgcggtgtgaccgtcaacacagttgcaccaggttttatcgaaactgatatgacaaaagcgctgaatgacgagcaacgtactgctacactagcgcaggttccagcaggtcgactgggggatcctcgtgaaattgcgtctgcggttgctttccttgcatcaccagaagcggcatacatcaccggcgagacactgcatgtcaacggcggtatgtacatgatctaa

SEQ ID NO: 61782 - protein, 248 aa, Vibrio cholerae O1 biovar eltor str. N16961
MSQFMNLEGKVALVTGASRGIGKAIAELLAERGAKVIGTATSESGAQAISDYLGDNGKGMALNVTNPESIEAVLKAITDEFGGVDILVNNAGITRDNLLMRMKEEEWSDIMETNLTSIFRLSKAVLRGMMKKRQGRIINVGSVVGTMGNAGQANYAAAKAGVIGFTKSMAREVASRGVTVNTVAPGFIETDMTKALNDEQRTATLAQVPAGRLGDPREIASAVAFLASPEAAYITGETLHVNGGMYMI

SEQ ID NO: 61783 - DNA, 741 bp, Bacillus halodurans C-125; identical to SEQ ID NO: 7050
  CDS (1)..(741): transl_table=11

SEQ ID NO: 61784 - protein, 246 aa, Bacillus halodurans C-125; identical to SEQ ID NO: 7051

SEQ ID NO: 61785 - DNA, 741 bp, Bacillus halodurans C-125; identical to SEQ ID NO: 7090
  CDS (1)..(741): transl_table=11

SEQ ID NO: 61786 - protein, 246 aa, Bacillus halodurans C-125; identical to SEQ ID NO: 7091

SEQ ID NO: 61787 - DNA, 729 bp, Pasteurella multocida subsp. multocida str. Pm70; identical to SEQ ID NO: 7306
  CDS (1)..(729): transl_table=11

SEQ ID NO: 61788 - protein, 242 aa, Pasteurella multocida subsp. multocida str. Pm70; identical to SEQ ID NO: 7307

SEQ ID NO: 61789 - DNA, 783 bp, Pseudomonas aeruginosa PAO1
  CDS (1)..(783): transl_table=11
atgaatgacttttcgaagtggacaggtcaggtcgcgctcatcagcggcgccggcagcgaactcggcatcggtttcgccattgcccggcggctggcccgcgaaggcgtgcgcctgctgatcaccgccagcagcgagcggattaggcaacgagcggaggaactgagcgcatgtggtcacgacgtgcgcgccgcgagcgccgacctgaccgacgaagcccaggtgcagggcctgctggactgggccgaagcccagtggggacgggtcgacatcctggtgaacaatgccggcatggcccagttggacagcgcggagcccttcagcgcagtggaagcgacctcgctgcgggattggcaactgtccctgtcgcgcaacctgaccagcgctttcctgctcacccgcggcctgctgccgggcatgcgcgagcgcggctacgggcggatcgtcaacgtcgcctccaccaccggaacccgcggcagcaacccgggcgaagccgcgtatagcgcggccaaggccggtctggtcggctggagcatgggcctcgcgctggaggtggcgaagagcggcatcacggtgaacagcgtcgcgccgggctggatcgccaccgcctcgagcaccgccgaagaacgccaggccgccctggccagccccagcggacgtgccggccggcccgaagaggtggccgccgcggtggccttcctcgcctcgcccgaagccagcttcgtcaacggcgaactgctggtggtggatggcggcaactgcctgatcgaaaacaaacggagctga

SEQ ID NO: 61790 - protein, 260 aa, Pseudomonas aeruginosa PAO1
MNDFSKWTGQVALISGAGSELGIGFAIARRLAREGVRLLITASSERIRQRAEELSACGHDVRAASADLTDEAQVQGLLDWAEAQWGRVDILVNNAGMAQLDSAEPFSAVEATSLRDWQLSLSRNLTSAFLLTRGLLPGMRERGYGRIVNVASTTGTRGSNPGEAAYSAAKAGLVGWSMGLALEVAKSGITVNSVAPGWIATASSTAEERQAALASPSGRAGRPEEVAAAVAFLASPEASFVNGELLVVDGGNCLIENKRS

SEQ ID NO: 61791 - DNA, 732 bp, Lactococcus lactis subsp. lactis Il1403; identical to SEQ ID NO: 7068
  CDS (1)..(732): transl_table=11

SEQ ID NO: 61792 - protein, 243 aa, Lactococcus lactis subsp. lactis Il1403; identical to SEQ ID NO: 7069

SEQ ID NO: 61793 - DNA, 780 bp, Streptococcus pyogenes M1 GAS
  CDS (1)..(780): transl_table=11
atgacacatactaaagaagttgcatttatcactggtgctgcaagcggaattggaaaacaaatcggggaaaccttattaaaagaaggtaaaacggttgttttttccgacattaatcaagaaaaactggatcaggttgttgctgactatactaaagaaggctatgacgcttttagtgttgtgtgcgatgtcaccaaagaagaagccatcaatgctgctattgatacggttgttgaaaaatatggtcgtattgatattttggttaacaacgcaggtcttcaacatgttgccatgattgaagattttccaactgaaaaatttgaattcatgattaaaatcatgttgacagcaccatttattgccattaaacgtgcttttcctacaatgaaagctcaaaaacacggtcgtattattaatatggcttctatcaatggtgtcattggttttgctggcaaatccgcctacaattcagctaagcacggcttgatcggtctgaccaaagtaactgccttagaagctgctgattcaggcattacggtcaatgccatttgtcctggatatgttgacacaccactggttcgtggccagtttgaagacctttccaaaacaagaggtattccccttgaaaatgttcttgaagaagtgctatacccacttgttcctcaaaaacgcctcattgacgttcaagaaattgcagactatgtgtctttccttgccagtgataaggcaaaaggtgttacaggtcaagcctgtatcttagacggtggctacactgctcaataa

SEQ ID NO: 61794 - protein, 259 aa, Streptococcus pyogenes M1 GAS
MTHTKEVAFITGAASGIGKQIGETLLKEGKTVVFSDINQEKLDQVVADYTKEGYDAFSVVCDVTKEEAINAAIDTVVEKYGRIDILVNNAGLQHVAMIEDFPTEKFEFMIKIMLTAPFIAIKRAFPTMKAQKHGRIINMASINGVIGFAGKSAYNSAKHGLIGLTKVTALEAADSGITVNAICPGYVDTPLVRGQFEDLSKTRGIPLENVLEEVLYPLVPQKRLIDVQEIADYVSFLASDKAKGVTGQACILDGGYTAQ

SEQ ID NO: 61795 - DNA, 744 bp, Xylella fastidiosa 9a5c; identical to SEQ ID NO: 7066
  CDS (1)..(744): transl_table=11

SEQ ID NO: 61796 - protein, 247 aa, Xylella fastidiosa 9a5c; identical to SEQ ID NO: 7067

SEQ ID NO: 61797 - DNA, 750 bp, Clostridium acetobutylicum ATCC 824; identical to SEQ ID NO: 7072
  CDS (1)..(750): transl_table=11

SEQ ID NO: 61798 - protein, 249 aa, Clostridium acetobutylicum ATCC 824; identical to SEQ ID NO: 7073

SEQ ID NO: 61799 - DNA, 918 bp, Agrobacterium tumefaciens str. C58
  CDS (1)..(918): transl_table=11
atgggcgcagccggatttaccacaccgccccccttccccgaagtggcgcccgaaatcacgcccgaaatcacgattgccagcccgccccctttgggcataacctgcttaaatatgtgcgaagtaatgcaaaaaggggaaagcatgcatcggacagttatcgtgacaggctccacaagcggcatcggccttggcattgcgcaaagatttgcgcgggagggcgccaatatcgtgctgaacggttttggcgacgacgacgagatcgaaaaactgcgccttctgctggaagccgaaagcggcgggcgggtgctttaccatcccgccgatatgacgaaaccggacgagatcgccgatctcatccagtcctcacacgaaaaactcggctcggtggatgtgctcatcaacaatgccggtattcagcacatcgcgcccatcgaggagttcccgacggaaaaatgggactggatcatcgccatcaatctgaccagttcttttcacaccatgcgtgccgcgataccgctgatgaaaaaggcaggcaaaggccgcatcatcaacatttcctcagcccacggccttgtcgcctcgccgttcaaatcggcctatgtggcggccaaacacggcatcatgggcttgacgaaaacggcagcgctcgaacttgcgcaaacgggcgtcaccgtcaacgccatctgtcccggttacgtgctgacgccgctggtggaaaagcagataccggaaatggccaaggtgcgcggcatcagcgaagcggcggtgaagaacgacgtgatgctggaattgcaggcgaccaaacaattcgtcaccgtcgatgacgtcgccgccgctgcgatatttctggcaagcgacgccgcaagcaacatcaccggcacccatatttccgtagacggcggctggacggcacaataa

SEQ ID NO: 61800 - protein, 305 aa, Agrobacterium tumefaciens str. C58
MGAAGFTTPPPFPEVAPEITPEITIASPPPLGITCLNMCEVMQKGESMHRTVIVTGSTSGIGLGIAQRFAREGANIVLNGFGDDDEIEKLRLLLEAESGGRVLYHPADMTKPDEIADLIQSSHEKLGSVDVLINNAGIQHIAPIEEFPTEKWDWIIAINLTSSFHTMRAAIPLMKKAGKGRIINISSAHGLVASPFKSAYVAAKHGIMGLTKTAALELAQTGVTVNAICPGYVLTPLVEKQIPEMAKVRGISEAAVKNDVMLELQATKQFVTVDDVAAAAIFLASDAASNITGTHISVDGGWTAQ

SEQ ID NO: 61801 - DNA, 819 bp, Staphylococcus aureus subsp. aureus Mu50
  CDS (1)..(819): transl_table=11
atgaaacgtttggaaaataaagttgcagtcgtaacaggagcaagtacaggtatcggacaagcttctgcaatcgctttagctcaagaaggtgcgtatgtattggcggtagacatagctgaagcggtatcggagactgtcgataaaattaaaagtaacggtgacaatgcgaaggcgtataatgtggatatttcagatgaacaacaagtggtagactttgtgtctgacataaaggaacagtttggaagaatcgatgtgttgtttaataatgccggtgtggataatgcggctggtagaattcatgagtatccaatagatgtgtatgacaagattatgaatgtagatatgcgtgggacaattttaatgacgaaaatgatgttacctttaatgatgaatcaaggtggctctattgttaatacgtcttcattttcaggacaggcagaagatttgtatcgctcaggatataatgctgcgaaaggcgcagtgattaattttacaaaatcaatcgcaattgagtatggtcgtgatggcattcgatccaatgcaattgcaccaggtacaattgaaaccccgttagtagataaactgacaggtacgagtgaggatgatgcaggtaaaacatttagagaaaatcaaaaatggatgactccgctgggacgtttaggtaaaccagaagaagttgctaaattagtagtcttcttagcatctgacgacagttcattcataactggagagacgattcgaattgatggtggtgtgatggcttacacatggcctggcgagatgttaagtgatgattcgtggaagcggacattggaataa

SEQ ID NO: 61802 - protein, 272 aa, Staphylococcus aureus subsp. aureus Mu50
MKRLENKVAVVTGASTGIGQASAIALAQEGAYVLAVDIAEAVSETVDKIKSNGDNAKAYNVDISDEQQVVDFVSDIKEQFGRIDVLFNNAGVDNAAGRIHEYPIDVYDKIMNVDMRGTILMTKMMLPLMMNQGGSIVNTSSFSGQAEDLYRSGYNAAKGAVINFTKSIAIEYGRDGIRSNAIAPGTIETPLVDKLTGTSEDDAGKTFRENQKWMTPLGRLGKPEEVAKLVVFLASDDSSFITGETIRIDGGVMAYTWPGEMLSDDSWKRTLE

SEQ ID NO: 61803 - DNA, 753 bp, Sulfolobus tokodaii str. 7; identical to SEQ ID NO: 7294
  CDS (1)..(753): transl_table=11

SEQ ID NO: 61804 - protein, 250 aa, Sulfolobus tokodaii str. 7; identical to SEQ ID NO: 7295

SEQ ID NO: 61805 - DNA, 738 bp, Sinorhizobium meliloti 1021; identical to SEQ ID NO: 7316
  CDS (1)..(738): transl_table=11

SEQ ID NO: 61806 - protein, 245 aa, Sinorhizobium meliloti 1021; identical to SEQ ID NO: 7317

SEQ ID NO: 61807 - DNA, 759 bp, Sinorhizobium meliloti 1021; identical to SEQ ID NO: 7282
  CDS (1)..(759): transl_table=11

SEQ ID NO: 61808 - protein, 252 aa, Sinorhizobium meliloti 1021; identical to SEQ ID NO: 7283

SEQ ID NO: 61809 - DNA, 741 bp, Caulobacter crescentus CB15; identical to SEQ ID NO: 7026
  CDS (1)..(741): transl_table=11

SEQ ID NO: 61810 - protein, 246 aa, Caulobacter crescentus CB15; identical to SEQ ID NO: 7027

SEQ ID NO: 61811 - DNA, 780 bp, Sinorhizobium meliloti 1021
  CDS (1)..(780): transl_table=11
atgagtgaccggcttaagggtaagcggatcatggtgaccggtgctgcgcagggtatcggccttgcgattgccgaagcgttcctgtcggagcgggcggcactcttcctcctcgaccgcgacggtcccctgcttgaaaaggaggcgaagcgcttgcagcggcaggggcagtcgctcgcctacgccgaggccgatattacggatgcggaggcgatcgaatcaacgctgtcggcagccgcttcgtcgatcggtccaatcaacgcgctcgtcaacaatgcaggggtcaacgtcttctcggagccgctggagatgagcaatgccgattggcagcgctgtttcgacatcaacctccgtggcgcctggaattgctgcaaggcggttctccccagccttatcgagcagggcggcggggcgatcctcaacatcgcctcgacgcatgcattcaccatcattccgcacacattcccctatccagtcgcaaagcacgcgctaattggtatgacgaaggcgctcggcatcgaatatgcgtcgaagggggtccgcgtgaatgcgctggcaccgggttatgtcttgacccaaaaggcgtacgactactggaacagctttcctgacccggcggcagccgaggcggcaaccctgaagcttcacccgggcggccgcattgcgacggcagaagagatcgcccgcgccgccgtcttcatgatttcggacgagtgccctttcatgaacgcgacgtgcttgacggtggatggcgggctcagcgtcctgcatcatccggcttga

SEQ ID NO: 61812 - protein, 259 aa, Sinorhizobium meliloti 1021
MSDRLKGKRIMVTGAAQGIGLAIAEAFLSERAALFLLDRDGPLLEKEAKRLQRQGQSLAYAEADITDAEAIESTLSAAASSIGPINALVNNAGVNVFSEPLEMSNADWQRCFDINLRGAWNCCKAVLPSLIEQGGGAILNIASTHAFTIIPHTFPYPVAKHALIGMTKALGIEYASKGVRVNALAPGYVLTQKAYDYWNSFPDPAAAEAATLKLHPGGRIATAEEIARAAVFMISDECPFMNATCLTVDGGLSVLHHPA

SEQ ID NO: 61813 - DNA, 735 bp, Sinorhizobium meliloti 1021
  CDS (1)..(735): transl_table=11
atgacagcgaaccttgccggaaaggtcgtcctcgtaacagctgcggcgcagggcataggacgcgcaaccgcacttgccttcgccaaggccggtgccaaggtccatgcgaccgatatcaacgcggacgccgttggtagccttgaaggtgaggcgggcatcagcacccaccggctggacgtcctcgacaccgctgcggtcgaagcgctggtcgcggagatcggggccgtggacgtgcttttcaactgcgccggtttcgtccatgcaggctcggtgctcacgatgaaggacgaggacctcgatttcgccttcgatctgaacgtgaagtcgatgatccgcaccatccgtgcggtgctgcccggcatgatcgcacgcaaggacgggtcgatcgtcaatatggcctcggtggcctccagcattaaaggcgtgccgaaccgcttcgcctatggcgtgaccaaagcagccgtcatcgggctgacgaaagccgttgcggcggattatgtaggagacggcattcgctgcaatgcgatctgcccgggaacggtcgaaagcccgtcgctcgaaagccgcatgcgggcacagggagactacgaaacggcgcgtgcggcctttatctcccgccagccgatgggccgcctcggcacgcccgaagagatcgccgaccttgccgtctatctcgccggcgccacctacacctccggccaggcctacgccatcgacggcggctggaccatttga

SEQ ID NO: 61814 - protein, 244 aa, Sinorhizobium meliloti 1021
MTANLAGKVVLVTAAAQGIGRATALAFAKAGAKVHATDINADAVGSLEGEAGISTHRLDVLDTAAVEALVAEIGAVDVLFNCAGFVHAGSVLTMKDEDLDFAFDLNVKSMIRTIRAVLPGMIARKDGSIVNMASVASSIKGVPNRFAYGVTKAAVIGLTKAVAADYVGDGIRCNAICPGTVESPSLESRMRAQGDYETARAAFISRQPMGRLGTPEEIADLAVYLAGATYTSGQAYAIDGGWTI

SEQ ID NO: 61815 - DNA, 744 bp, Listeria monocytogenes EGD-e
  CDS (1)..(744): transl_table=11
atgactttacaaggaaaagtagcagtagtaacaggtggatcacgcggaattggacgtgacattgccattaacttagccaaagaaggcgcgaatattttcttcaattacaatggtagcccagaagctgcggaagaaacagcaaaactcgttgctgaacatggtgttgaagtagaagcaatgaaagcaaacgtagccattgccgaagatgtagatgcctttttcaaacaagcaattgaacgctttggtcgtgtggatattctcgtgaataatgcgggaattacacgggataatttattaatgcgtatgaaagaagacgaatgggatgacgttattaacatcaacctaaaaggaactttcctttgtacaaaagcagtaagtcgtacaatgatgaaacaacgcgcaggtaaaattatcaacatggcatctgttgttggtttgattggtaatgcaggtcaagcaaattacgtagcaagtaaagcgggcgttatcggtttaacaaaaacaactgctcgagaacttgcgccccgtggtattaacgtaaatgctgttgctcctggtttcattacaacagatatgacagacaaattagacgaaaaaacaaaagaagcaatgttagcacaaattccgcttggtgcttacggaacaaccgaagatattgcgaatgcagttcttttcttagcaagtgatgcttcgaagtatattactggtcaaacactatccgttgatggcggaatggtgatgtaa

SEQ ID NO: 61816 - protein, 247 aa, Listeria monocytogenes EGD-e
MTLQGKVAVVTGGSRGIGRDIAINLAKEGANIFFNYNGSPEAAEETAKLVAEHGVEVEAMKANVAIAEDVDAFFKQAIERFGRVDILVNNAGITRDNLLMRMKEDEWDDVININLKGTFLCTKAVSRTMMKQRAGKIINMASVVGLIGNAGQANYVASKAGVIGLTKTTARELAPRGINVNAVAPGFITTDMTDKLDEKTKEAMLAQIPLGAYGTTEDIANAVLFLASDASKYITGQTLSVDGGMVM

SEQ ID NO: 61817 - DNA, 756 bp, Nostoc sp. PCC 7120; identical to SEQ ID NO: 7036
  CDS (1)..(756): transl_table=11

SEQ ID NO: 61818 - protein, 251 aa, Nostoc sp. PCC 7120; identical to SEQ ID NO: 7037

SEQ ID NO: 61819 - DNA, 798 bp, Ralstonia solanacearum GMI1000
  CDS (1)..(798): transl_table=11
atgacggcgcccccgacatccttcccgccgcgcctggccggcaaggtcgcgctggtgaccggcgccacgcagggcatcggcgccgccaccgcgcggctgttcgcgcggcacggcgcgcgcgtgatcgtcaatgcgctggtgcgcgacgccgccgccgaggccttcgccgcgtccatcggccacgacggcaacgtgctgctggtgcaggccgacgtgcgctatcgcgaccaggccgatgccatggtcgcggcgggcgtcgcgcgcttcggcggcatcgacgtgctggtcaacaatgccggcatcaatgtcttctccgatccgctcgcgctgtccgaggcggattgggcgcgctgcctgtcggtcgacctggaaggcgcatggcattgcgcgcgcgccgtgctgccgcacatgctggcgcgcggcgccggcagcatcgtcaacatcgcttcggtgcacgggcataagatcatcccgggggcgtttccgtatccggtggccaagcatggcctgatcgggctcacgcgggcgctgggcatcgagtacgcggcgcgcggcatccgtgtcaattcgatctcgccggggctgatcctcacgccgatcgccgaggccggctttgccgccgcgcccgaccccgaggccgaacgccgccgccaggccgacctgctgccgtgcaagcgcatcggcgagccggaggaggtggcctacaccgcgctgttcctcgcctccgacgaggcgcgcttcatcaacgccgccgacatcctgatcgatggcgctcgctcgcagctgtatcacgaatga

SEQ ID NO: 61820 - protein, 265 aa, Ralstonia solanacearum GMI1000
MTAPPTSFPPRLAGKVALVTGATQGIGAATARLFARHGARVIVNALVRDAAAEAFAASIGHDGNVLLVQADVRYRDQADAMVAAGVARFGGIDVLVNNAGINVFSDPLALSEADWARCLSVDLEGAWHCARAVLPHMLARGAGSIVNIASVHGHKIIPGAFPYPVAKHGLIGLTRALGIEYAARGIRVNSISPGLILTPIAEAGFAAAPDPEAERRRQADLLPCKRIGEPEEVAYTALFLASDEARFINAADILIDGARSQLYHE

SEQ ID NO: 61821 - DNA, 738 bp, Agrobacterium tumefaciens str. C58; identical to SEQ ID NO: 7054
  CDS (1)..(738): transl_table=11

SEQ ID NO: 61822 - protein, 245 aa, Agrobacterium tumefaciens str. C58; identical to SEQ ID NO: 7055

SEQ ID NO: 61823 - DNA, 777 bp, Agrobacterium tumefaciens str. C58
  CDS (1)..(777): transl_table=11
atgcatcggacagttatcgtgacaggctccacaagcggcatcggccttggcattgcgcaaagatttgcgcgggagggcgccaatatcgtgctgaacggttttggcgacgacgacgagatcgaaaaactgcgccttctgctggaagccgaaagcggcgggcgggtgctttaccatcccgccgatatgacgaaaccggacgagatcgccgatctcatccagtcctcacacgaaaaactcggctcggtggatgtgctcatcaacaatgccggtattcagcacatcgcgcccatcgaggagttcccgacggaaaaatgggactggatcatcgccatcaatctgaccagttcttttcacaccatgcgtgccgcgataccgctgatgaaaaaggcaggcaaaggccgcatcatcaacatttcctcagcccacggccttgtcgcctcgccgttcaaatcggcctatgtggcggccaaacacggcatcatgggcttgacgaaaacggcagcgctcgaacttgcgcaaacgggcgtcaccgtcaacgccatctgtcccggttacgtgctgacgccgctggtggaaaagcagataccggaaatggccaaggtgcgcggcatcagcgaagcggcggtgaagaacgacgtgatgctggaattgcaggcgaccaaacaattcgtcaccgtcgatgacgtcgccgccgctgcgatatttctggcaagcgacgccgcaagcaacatcaccggcacccatatttccgtagacggcggctggacggcacaataa

SEQ ID NO: 61824 - protein, 258 aa, Agrobacterium tumefaciens str. C58
MHRTVIVTGSTSGIGLGIAQRFAREGANIVLNGFGDDDEIEKLRLLLEAESGGRVLYHPADMTKPDEIADLIQSSHEKLGSVDVLINNAGIQHIAPIEEFPTEKWDWIIAINLTSSFHTMRAAIPLMKKAGKGRIINISSAHGLVASPFKSAYVAAKHGIMGLTKTAALELAQTGVTVNAICPGYVLTPLVEKQIPEMAKVRGISEAAVKNDVMLELQATKQFVTVDDVAAAAIFLASDAASNITGTHISVDGGWTAQ

SEQ ID NO: 61825 - DNA, 735 bp, Brucella melitensis 16M
  CDS (1)..(735): transl_table=11
atgacgatacgactggatggaaagaccgcgcttgtgacggccgctgggcaagggattgggcaggcaagtgcgctggcctttgtagaggcgggcgccaaggtctatgcgaccgacatcaatgccgatgcgcttgcgaaactggaaggcatagccggcattgtcacgcgcaggctggacgtgctggacgacgctgcggtcaaggcgctggtggctgaaatcgggcagatcgatatcctcttcaactgcgccggttttgtccacaacgggaccatccttgagatgaaggacgaggaactggattttgccgtcaacctgaatgtccgctccatgatccgcaccatccgcgccgtgctgccgggaatgctggagcgcaaggatggcgccatcatcaacatggcttccgtcgcatcgagcgtcaaaggggtgtcgaatcgttttgtctatggtctgaccaaggcggcggtaatcgggctcaccaaggcggtcgccgccgattatgtgagcaagggcatccgctgcaacgccatttgtcccggcacggtggaaagcccatccttgcaggaccgcctgcgggcgcagggcgattatgaggctgcccgcgctgccttcatcgcccgccagcccatcggccgcatcggccagccggaggaaatcgccgacctcgcagtctatctggcaggcgcgacctataccaccgggcaggcctataacatcgatgggggatggtcgatctaa

SEQ ID NO: 61826 - protein, 244 aa, Brucella melitensis 16M
MTIRLDGKTALVTAAGQGIGQASALAFVEAGAKVYATDINADALAKLEGIAGIVTRRLDVLDDAAVKALVAEIGQIDILFNCAGFVHNGTILEMKDEELDFAVNLNVRSMIRTIRAVLPGMLERKDGAIINMASVASSVKGVSNRFVYGLTKAAVIGLTKAVAADYVSKGIRCNAICPGTVESPSLQDRLRAQGDYEAARAAFIARQPIGRIGQPEEIADLAVYLAGATYTTGQAYNIDGGWSI

SEQ ID NO: 61827 - DNA, 741 bp, Clostridium perfringens str. 13; identical to SEQ ID NO: 7272
  CDS (1)..(741): transl_table=11

SEQ ID NO: 61828 - protein, 246 aa, Clostridium perfringens str. 13; identical to SEQ ID NO: 7273

SEQ ID NO: 61829 - DNA, 732 bp, Fusobacterium nucleatum subsp. nucleatum ATCC 25586; identical to SEQ ID NO: 7268
  CDS (1)..(732): transl_table=11

SEQ ID NO: 61830 - protein, 243 aa, Fusobacterium nucleatum subsp. nucleatum ATCC 25586; identical to SEQ ID NO: 7269

SEQ ID NO: 61831 - DNA, 780 bp, Streptococcus pyogenes MGAS8232
  CDS (1)..(780): transl_table=11
atgacacatactaaagaagttgcatttatcactggtgctgcaagcggaattggaaaacaaatcggggaaaccttattaaaagaaggtaaaacggttgttttttctgacattaatcaagaaaaactggatcaggttgttgctgattatactaaagaaggctatgacgcttttagtgttgtgtgcgatgtcaccaaagaagaagccatcaatgctgctattgatacggttgttgaaaaatatggtcgtattgatattttggttaacaacgcaggccttcaacatgttgccatgattgaagattttccaactgaaaaatttgaattcatgattaaaatcatgttgacagcaccatttattgccattaaacgtgcttttcctacaatgaaagctcaaaaacacggtcgtattattaatatggcttctatcaatggtgtcattggttttgctggcaaatccgcctacaattcagctaagcacggcttgatcggtctgaccaaagtaactgccttagaagctgctgattcaggcattacggtcaatgccatttgtcctggatatgttgacacatcactggttcgtggacagtttgaagacctttccaaaacaagaggtattccccttgaaaatgttcttgaagaagttctatacccacttgttcctcaaaaacgcctcattgacgttcaagaaattgcagactatgtgtctttccttgccagtgataaggcaaaaggtgttacaggtcaagcctgtatcttagacggtggctacactgctcaataa

SEQ ID NO: 61832 - protein, 259 aa, Streptococcus pyogenes MGAS8232
MTHTKEVAFITGAASGIGKQIGETLLKEGKTVVFSDINQEKLDQVVADYTKEGYDAFSVVCDVTKEEAINAAIDTVVEKYGRIDILVNNAGLQHVAMIEDFPTEKFEFMIKIMLTAPFIAIKRAFPTMKAQKHGRIINMASINGVIGFAGKSAYNSAKHGLIGLTKVTALEAADSGITVNAICPGYVDTSLVRGQFEDLSKTRGIPLENVLEEVLYPLVPQKRLIDVQEIADYVSFLASDKAKGVTGQACILDGGYTAQ

SEQ ID NO: 61833 - DNA, 735 bp, Streptococcus pyogenes MGAS8232
  CDS (1)..(735): transl_table=11
atggaaattaaaggaaaaaatatatttatcacaggctcaacgagaggtatcggtttagcaatggctcatcaattcgccagtttaggagctaatattgtcttaaatggtcgctctgctatctctgaggagcttgttgctagttttactgactacggcgttacagttgttaccatctctggggatgtttcagaagcatcagaagctaaacgtatggtcaatgaagctatcgaaagtttaggttcgattgatgttttagttaacaatgctggcattactaatgataaattgatgcttaaaatgacggaagaggattttgagcgcgtcttgaaaatcaatttgaccggtgcttttaacatgactcaatcagtgttaaaaccaatgatcaaggcccgccaaggagcaattattaatgtctctagtgtggttggtttaacaggcaatattgggcaagcaaactatgccgcttctaaggcaggaatgattggttttaccaagtctgttgcccgtgaagttgctgctcgtaacatttgcgtgaatgctattgctccaggatttatcgagtccgatatgacaggtgtccttcctgaaaaaatgcaagagcaaatcttaagtcaaatcccaatgaaacgtattggaaaagctcaagaagttgctcacttagcaagcttcttggtggaacaagattatattacgggacaagttatcgctattgatggcggtatgacaatgcaataa

SEQ ID NO: 61834 - protein, 244 aa, Streptococcus pyogenes MGAS8232
MEIKGKNIFITGSTRGIGLAMAHQFASLGANIVLNGRSAISEELVASFTDYGVTVVTISGDVSEASEAKRMVNEAIESLGSIDVLVNNAGITNDKLMLKMTEEDFERVLKINLTGAFNMTQSVLKPMIKARQGAIINVSSVVGLTGNIGQANYAASKAGMIGFTKSVAREVAARNICVNAIAPGFIESDMTGVLPEKMQEQILSQIPMKRIGKAQEVAHLASFLVEQDYITGQVIAIDGGMTMQ

SEQ ID NO: 61835 - DNA, 903 bp, Xanthomonas campestris pv. campestris str. ATCC 33913
  CDS (1)..(903): transl_table=11
gtggctgcagatcgcacagcagctggtacagcagtacgccgacggcaatgccgcggcggtgttcggcgacaacgcacgcacgttctatcgtctgccacggccggcggcccccacccacggaaccttatcggtatgacagtctccattcccacgacgcccaacacccgcctgcagggcaagcgctgcctgatcaccgccgccggcgccggcatcggccgcgaaagcgcactggcctgcgcacgcgccggtgcgcacgtgatcgccaccgacatcgacgccgccgcgctgcaggcgctggccgccgaatccgacgccatcaccacccagctgctggatgtcaccgacgcggcggcgatcactgcgctggtcgcggcgcacggcccgttcgatgtgctgttcaactgcgccggctacgtgcaccagggcagcattctggactgcgacgagccggcctggcgccgctcgttctcgatcaatgtcgatgcgatgtactacacctgcaaggcggtgctgccgggcatgctcgagcgcggccgcggcagcatcatcaacatgtcctcggtggcttccagcatcaagggcgtgccgaaccgcttcgtgtacggcgtgaccaaggccgcggtgatcggcctgagcaaggcgatcgccgccgattacgtggctcagggcgtgcgctgcaatgcgatctgccccggcaccatcaagacgccgtcgctgggccagcgcgtgcaagcgctcggcggcgacgagcaggcggtgtggaagagcttcaccgaccgccagccgatgggccgcctgggcgacccgcgcgagatcgcgcagctggtggtgtacctggcatcggacgagtcctcgttcactaccggccagacccacatcatcgacggcggctggtccaactga

SEQ ID NO: 61836 - protein, 300 aa, Xanthomonas campestris pv. campestris str. ATCC 33913
MAADRTAAGTAVRRRQCRGGVRRQRTHVLSSATAGGPHPRNLIGMTVSIPTTPNTRLQGKRCLITAAGAGIGRESALACARAGAHVIATDIDAAALQALAAESDAITTQLLDVTDAAAITALVAAHGPFDVLFNCAGYVHQGSILDCDEPAWRRSFSINVDAMYYTCKAVLPGMLERGRGSIINMSSVASSIKGVPNRFVYGVTKAAVIGLSKAIAADYVAQGVRCNAICPGTIKTPSLGQRVQALGGDEQAVWKSFTDRQPMGRLGDPREIAQLVVYLASDESSFTTGQTHIIDGGWSN

SEQ ID NO: 61837 - DNA, 771 bp, Xanthomonas axonopodis pv. citri str. 306
  CDS (1)..(771): transl_table=11
atgactgtctcgattcccaccactcccaataaccgcctgcagggcaagcgctgcctgatcaccgccgccggcgccggcatcgggcgcgaaagcgcgctggcctgcgcacgcgccggtgcacaggtgatcgccaccgacatcgacgccgcggccttgcaagcgctggccgccgaatccgatgccatcaccacccagctgctcgacgtcaccgacgctgcggcgatcaacgcattgatcgccgcacacggcccgttcgatgtgctgttcaactgcgccggcttcgtgcatcagggcagcattctcgactgcgacgagccggcgtggcgccgctcgttctcgatcaacgtcgatgcgatgtactacacctgcaaggcggtgttgccgggcatgctcgaacgcggccgcggcagcatcatcaacatgtcctcggtggcttccagcatcaagggcgtgccgaaccgcttcgtgtacggcgtgaccaaggccgcggtgatcggcctgagcaaggcgatcgcggccgaccacgtggcgcagggcgtacgttgcaacgcgatctgcccgggcaccatcaagacgccgtcgctgggcgagcgcgtcaaggccctgggtggcgacgaacaggcggtgtggaagagcttcaccgaccgccagccgatgggccgcctgggcgacccacgcgagattgcgcagctggtggtgtacctggcttcggacgaatcctccttcaccaccggccagacccacatcatcgatggcggctggtccaactga

SEQ ID NO: 61838 - protein, 256 aa, Xanthomonas axonopodis pv. citri str. 306
MTVSIPTTPNNRLQGKRCLITAAGAGIGRESALACARAGAQVIATDIDAAALQALAAESDAITTQLLDVTDAAAINALIAAHGPFDVLFNCAGFVHQGSILDCDEPAWRRSFSINVDAMYYTCKAVLPGMLERGRGSIINMSSVASSIKGVPNRFVYGVTKAAVIGLSKAIAADHVAQGVRCNAICPGTIKTPSLGERVKALGGDEQAVWKSFTDRQPMGRLGDPREIAQLVVYLASDESSFTTGQTHIIDGGWSN

SEQ ID NO: 61839 - DNA, 741 bp, Bacillus anthracis str. A2012
  CDS (1)..(741): n means a or g or c or t/u, r means g or a
atggagtttttaaacgggaaaacagctgttgtaacaggagctgcacaggraattggaaaagagattgcaagggtgtatgcaaaactaggggcgaaagtattaattagcgatgtaaatgaagagaagttacaaaaaacgacacgtgagttattggatgaaggatatgaagtgagcttatatcgatgtgatgtgagtaatcaaaatgaagcgaagtcgttaattgaatatgcggttcaaaaattcggtacattacatattttggtgaataacgctggaattacaagagatgccatgttacataaaatggagaagtcttcttgggaacnagtactgcaagtaaacttaaccggtgttttttattgcatgcaaccagcacttctttatatgagacaacaaggatatggaagaattattaatatttcttctataagtagagaggggaatattgggcaggcaaattatgctgcaacgaaagctggagttgtcggtttaacgaaaacggcagcgaaagaagttggaagtttcggtattacgtgtaatgcaatttgcccaggatttatggatacagatacgacaaaaacgataccagataaagtgaaagaaaagatggtcggcgcgattccagttggtagaattggaacgccagaagatattgcgaacgcagctgcctttttagcatcagaatatgcatcctatattacaggagaagtattaaatgtgagcggaggactgcaagtttaa

SEQ ID NO: 61840 - protein, 246 aa, Bacillus anthracis str. A2012
  misc_feature (17)..(17): Xaa can be Gly or Glu
  misc_feature (109)..(109): Xaa can be Arg or Gln or Leu or Pro
MEFLNGKTAVVTGAAQXIGKEIARVYAKLGAKVLISDVNEEKLQKTTRELLDEGYEVSLYRCDVSNQNEAKSLIEYAVQKFGTLHILVNNAGITRDAMLHKMEKSSWEXVLQVNLTGVFYCMQPALLYMRQQGYGRIINISSISREGNIGQANYAATKAGVVGLTKTAAKEVGSFGITCNAICPGFMDTDTTKTIPDKVKEKMVGAIPVGRIGTPEDIANAAAFLASEYASYITGEVLNVSGGLQV

SEQ ID NO: 61841 - DNA, 741 bp, Bacillus anthracis str. A2012
  CDS (1)..(741): transl_table=11
atgttaaaagggaaagtagcattagtaacgggcgcttcacgtggaattggtcgtgcgattgcgattgatttagcgaaacaaggggcaaatgtggtagtaaattatgctggtaatgagcaaaaggcaaatgaagtagttgatgaaataaagaaattaggttcggatgccattgcagtaagagcagatgttgcaaatgctgaagacgttacaaatatggtgaaacaaactgtagatgtatttggacaagttgatattcttgttaataatgcaggtgtaacaaaagataatttattaatgcgtatgaaagaagaagaatgggatacagttattaatacaaacttaaaaggtgtattcttatgtacgaaggcagtatctcgttttatgatgcgtcaacgtcatgggcgtattgttaatatcgcctctgttgttggagtaacgggtaatccaggacaagcaaactatgttgctgctaaagcaggtgtaattggattaacaaaaacatcagcaaaagagttagcgagccgcaatattactgtaaatgcaattgctcctggatttattgcgacggatatgacagacgtattagatgaaaatataaaagctgaaatgttaaaattaattcctgcagctcagtttggtgaagcgcaagatatcgcaaatgctgtaacgttttttgcttctgatcaaagcaaatatattacaggtcaaacgttaaatgttgatggcggtatggtaatgtaa

SEQ ID NO: 61842 - protein, 246 aa, Bacillus anthracis str. A2012
MLKGKVALVTGASRGIGRAIAIDLAKQGANVVVNYAGNEQKANEVVDEIKKLGSDAIAVRADVANAEDVTNMVKQTVDVFGQVDILVNNAGVTKDNLLMRMKEEEWDTVINTNLKGVFLCTKAVSRFMMRQRHGRIVNIASVVGVTGNPGQANYVAAKAGVIGLTKTSAKELASRNITVNAIAPGFIATDMTDVLDENIKAEMLKLIPAAQFGEAQDIANAVTFFASDQSKYITGQTLNVDGGMVM

SEQ ID NO: 61843 - DNA, 738 bp, Chlorobium tepidum TLS; identical to SEQ ID NO: 7248
  CDS (1)..(738): transl_table=11

SEQ ID NO: 61844 - protein, 245 aa, Chlorobium tepidum TLS; identical to SEQ ID NO: 7249

SEQ ID NO: 61845 - DNA, 741 bp, Yersinia pestis KIM
  CDS (1)..(741): transl_table=11
atgaatctgaaagggaagaaagccttggtcactgctgccgggcaggggatcggcttcaatacagccacgttgtttgcccgcaaaggcgcagaagtgatcgctagcgatatcaatatcgctgcgttgtccaacataccgggtataacggcagtgtcattggatgtgactgacacgttggctatcaatgatgtggcgcaggcaatcggcccgatagacgtgctgtttaactgtgcgggcgtggtacacagcggcgatattctcacctgtagcgagcaggagtggcagttcgcgctagacctcaacgtcaccgctatgttccatatgatccgtgcctttctacctgggatgatcgcgtgccaacagggttctatcatcaatatgtcttcggtggcttcaagtattaaaggggtaccgaatcgttttgcctatagcacttctaaagccgcggtcattggcctgacgcgttctgttgctgcggattatgtcacgcagggcatccgctgtaatgccatctgccccggaacagttgaatctccttctctgcgtcagcggattgccgtacaggcacacgccgaagggcgcagcgaagctgatgtctttcaggcattcgctgcacgtcaaccgattggccgtatcggcaaagcagaagagatagcgcaattggcactgtatctggcctcggatgccagcgcttacaccaccggcacgatacatattatcgacggaggctggagcaattaa

SEQ ID NO: 61846 - protein, 246 aa, Yersinia pestis KIM
MNLKGKKALVTAAGQGIGFNTATLFARKGAEVIASDINIAALSNIPGITAVSLDVTDTLAINDVAQAIGPIDVLFNCAGVVHSGDILTCSEQEWQFALDLNVTAMFHMIRAFLPGMIACQQGSIINMSSVASSIKGVPNRFAYSTSKAAVIGLTRSVAADYVTQGIRCNAICPGTVESPSLRQRIAVQAHAEGRSEADVFQAFAARQPIGRIGKAEEIAQLALYLASDASAYTTGTIHIIDGGWSN

SEQ ID NO: 61847 - DNA, 735 bp, Streptococcus agalactiae 2603V/R; identical to SEQ ID NO: 7232
  CDS (1)..(735): transl_table=11

SEQ ID NO: 61848 - protein, 244 aa, Streptococcus agalactiae 2603V/R; identical to SEQ ID NO: 7233

SEQ ID NO: 61849 - DNA, 765 bp, Oceanobacillus iheyensis HTE831; identical to SEQ ID NO: 7238
  CDS (1)..(765): transl_table=11

SEQ ID NO: 61850 - protein, 254 aa, Oceanobacillus iheyensis HTE831; identical to SEQ ID NO: 7239

SEQ ID NO: 61851 - DNA, 741 bp, Oceanobacillus iheyensis HTE831; identical to SEQ ID NO: 7236
  CDS (1)..(741): transl_table=11

SEQ ID NO: 61852 - protein, 246 aa, Oceanobacillus iheyensis HTE831; identical to SEQ ID NO: 7237

SEQ ID NO: 61853 - DNA, 735 bp, Brucella suis 1330
  CDS (1)..(735): transl_table=11
atgacgatacgactggatggaaagaccgcgcttgtgacggcggctgggcaagggattgggcaggcaagtgcgctggcctttgcagaggcgggcgccaaggtctatgcgaccgacatcaatgccgatgcgcttgcgaaactggaaggcatagccggcattgtcacgcgcaggctggacgtgctggacgacgctgcggtcaaggcgctggtggctgaaatcgggcagatcgatatcctcttcaactgcgccggttttgtccacaacgggaccatccttgagatgaaggacgaggaactggattttgccgtcaacctgaatgtccgctccatgatccgcaccatccgcgccgtgctgccgggaatgctggagcgcaaggatggcgccatcatcaacatggcttccgtcgcatcgagcgtcaaaggggtgtcgaatcgttttgtctatggtctgaccaaggcggcggtaatcgggctcaccaaggcggtcgccgccgattatgtgggcaagggcatccgctgcaacgccatttgtcccggcacggtggaaagcccatccttgcaggaccgcctgcgggcgcagggcgattatgaggctgcccgcgctgccttcatcgcccgccagcccatcggccgcatcggccagccggaggaaatcgccgacctcgcagtctatctggcaggcgcgacctataccaccgggcaggcctataacatcgatgggggatggtcgatctaa

SEQ ID NO: 61854 - protein, 244 aa, Brucella suis 1330
MTIRLDGKTALVTAAGQGIGQASALAFAEAGAKVYATDINADALAKLEGIAGIVTRRLDVLDDAAVKALVAEIGQIDILFNCAGFVHNGTILEMKDEELDFAVNLNVRSMIRTIRAVLPGMLERKDGAIINMASVASSVKGVSNRFVYGLTKAAVIGLTKAVAADYVGKGIRCNAICPGTVESPSLQDRLRAQGDYEAARAAFIARQPIGRIGQPEEIADLAVYLAGATYTTGQAYNIDGGWSI

SEQ ID NO: 61855 - DNA, 741 bp, Brucella suis 1330
  CDS (1)..(741): transl_table=11
atgcggttcaaggacaaggtggtcatcgtaacaggtggagcaagcggcatcggggaagccacggcgcgggcttttatccgggagggcgcaaaggtcgtgattgcggatttttccgatcatggccagcaattggcggatgaacgggctggcgcccatgaacaggcgctattcatcaagacggatgttgccgataccagggccgtgcaggcgctgattgcaaggacggtggaaaactatgggcggctcgacatcatgtttgcaaatgcaggcattgcagccgatgcccccatcgacgaactggacgaagccgcatggcagaaaaccatcgatataaacctgacgggggtttatctctgcgataaatacgccatcgaccagatgcgctcgcaaggcggtggggtgatcgtcaattgcggctccatccatagccatgtcggcaagtcgggcgttacagcttatgccgccgccaagggcggtgtgaaacttctcacgcaaacacttgccattgattacggcccccagaacattcgcgtgaacgcggtctgccccggctatatcgatacgccgcttctcaagaatatccccgacgacaaaaaacaggccctcgtggcgcttcatcccatggggcgtcttggcagggccgaggaggttgcaaacgccgtcctgttcctcgcaagcgacgaagcttccttcgtcaacggtgcatcgcttctggtcgacggcggctataccgcccaataa

SEQ ID NO: 61856 - protein, 246 aa, Brucella suis 1330
MRFKDKVVIVTGGASGIGEATARAFIREGAKVVIADFSDHGQQLADERAGAHEQALFIKTDVADTRAVQALIARTVENYGRLDIMFANAGIAADAPIDELDEAAWQKTIDINLTGVYLCDKYAIDQMRSQGGGVIVNCGSIHSHVGKSGVTAYAAAKGGVKLLTQTLAIDYGPQNIRVNAVCPGYIDTPLLKNIPDDKKQALVALHPMGRLGRAEEVANAVLFLASDEASFVNGASLLVDGGYTAQ

SEQ ID NO: 61857 - DNA, 792 bp, Shigella flexneri 2a str. 301
  CDS (1)..(792): transl_table=11
atgggtaaactcacgggcaagacagcactgattacgggcgcattgcagggaattggcgaaggaattgccagaacttttgcacgtcatggcgcgaacctaatcttgctggatatctcccctgagatcgaaaagctagcggacgaactgtgtggtcgtggtcatcgctgtacggcggttgtcgccgatgtgcgtgacccggcgtcggtagccgcagctatcaaacgcgcgaaggaaaaagaagggcgcattgatatcctggtgaataacgcaggcgtttgtcgtctgggcagtttcctcgatatgagcgatgaagatcgcgatttccatattgatatcaatattaaaggcgtatggaacgtcacgaaggcggtgctgccggagatgattgcgcgcaaagatggtcgcattgtgatgatgtcttcagtcactggtgatatggtggccgatcctggcgaaacggcgtatgccttaacgaaagcggcgattgttggcctgactaaatcgctggcggtggagtacgcgcaatccggtattcgcgttaacgccatctgcccgggatacgtccgcacgccaatggcggaaagcattgcccgccagtcgaacccggaagatccagaatcggtgctgactgaaatggcaaaagcaatcccgctgtgtcgcctcgccgatccgctggaagtcggcgaactggcggccttcctcgcatcggatgaatccagctatttaaccggtacacagaatgtgattgatggcggcagcacactgccggagacggttagcgtcggtatctga

SEQ ID NO: 61858 - protein, 263 aa, Shigella flexneri 2a str. 301
MGKLTGKTALITGALQGIGEGIARTFARHGANLILLDISPEIEKLADELCGRGHRCTAVVADVRDPASVAAAIKRAKEKEGRIDILVNNAGVCRLGSFLDMSDEDRDFHIDINIKGVWNVTKAVLPEMIARKDGRIVMMSSVTGDMVADPGETAYALTKAAIVGLTKSLAVEYAQSGIRVNAICPGYVRTPMAESIARQSNPEDPESVLTEMAKAIPLCRLADPLEVGELAAFLASDESSYLTGTQNVIDGGSTLPETVSVGI

SEQ ID NO: 61859 - DNA, 771 bp, Leptospira interrogans serovar Lai str. 56601
  CDS (1)..(771): transl_table=11
ttggagaatatcatgaaggataaagtagccattgtgaccggaggaagtactggaattggaaaagcggtcgtaaaggaatttgtctccaaaggtgttaaagttgttttttgtggtcgtagattggaagaaggaaaaaaattggaatctgaaatacgtgctgagggtggagacgtatatttcgtagtctgtgacgtaacttctggagaacaggtaaaaaaggtagtggatgccgccttggaaaaatttggaagattggatttcggaatcaacaacgctggaattatgggcctcaatcatcttttacacgaatatccggaagacgtttgggataaagtggtgaacgtaaatctcaaaggaacttggttatcgatgaagtatcaaattccagaaatgatcaaaatgggaggaggggttgtggtaaacgtttcttctatatctggaatcaacggagttgttggaatcaatccttatgcagccgcaaaacatggtgttgtaggacttacaaaaagcgctgcattggaatatgctaaaaaaaatattcgaatcaatgcaatttgtccgggagcggtaaagactgaaattttagacgaactctttcatcttgcaaaagatcctgtagaagcggaaagacaattggtaaaattacatcctatacataggattgcttctcctgaagaaatttctaaaaccgttctttggctttgtagtgaagattcttcttttattactgggactgcaattcctgtggatggtggatattctgcaaaataa

SEQ ID NO: 61860 - protein, 256 aa, Leptospira interrogans serovar Lai str. 56601
MENIMKDKVAIVTGGSTGIGKAVVKEFVSKGVKVVFCGRRLEEGKKLESEIRAEGGDVYFVVCDVTSGEQVKKVVDAALEKFGRLDFGINNAGIMGLNHLLHEYPEDVWDKVVNVNLKGTWLSMKYQIPEMIKMGGGVVVNVSSISGINGVVGINPYAAAKHGVVGLTKSAALEYAKKNIRINAICPGAVKTEILDELFHLAKDPVEAERQLVKLHPIHRIASPEEISKTVLWLCSEDSSFITGTAIPVDGGYSAK

SEQ ID NO: 61861 - DNA, 780 bp, Leptospira interrogans serovar Lai str. 56601
  CDS (1)..(780): transl_table=11
ttgagggaaatcatgtctaaacagttcgaaggaaaagtagcactcgttaccggagcggcgtctcctcgcggtctcggaagagcgatcgcaaatacaatcgctaaagaaggaggcgacatagtactagtcgaccttaacaaagaacagatagaacaagcggcggctgatgtagccaaagaatttggagtaaaaactttaggactttcttgtaacgtcactaaaccggaggactgcgattctgtcattgccggagtaaaagaaaaatttggaaaactagacttcctcgttaacaatgccggagttctcaaggataatctttttatacgtatgtccgaacaagaatttgattttgttttagacgtaaacttgaaaggcgtttttttgatgactaagtatgcttctaaacttcttcttaaagcagagtctggaaggattgtaaacatctcttccgtttccggtcttactggacaaccgggacaagcaaactattcttcctcaaaggcgggagtgattgcattgacaaaagttgcggcgagagaatttgcaggaagaaatgttctagtcaatgcagtttgtcccggttacgttcaaaccgatatgactgcatctttgccagaagaagttcaaaagaaactgaccgatcctgcttttattcctcttagaagaccggggacacaacaagagattgcaaatgccgtgaagtttttcttaagcgatcaatccaattacattaccggaacttatttaagagttgatggtggtgcagcaatcggtatgtaa

SEQ ID NO: 61862 - protein, 259 aa, Leptospira interrogans serovar Lai str. 56601; identical to SEQ ID NO: 7243

SEQ ID NO: 61863 - DNA, 765 bp, Leptospira interrogans serovar Lai str. 56601
  CDS (1)..(765): transl_table=11
atgatcgatttaaaaggaaaaaacgccgtagttaccggagccgctcgtgggatcggaaagtcaacggctttaactcttgcaaaagcaggagcaaatttagtaatcgcggacttaaacgaagaatctagtaaagcgaccgcggatgaaatttcaaaacagactggtgtaaaggcgattggaatcggaacgaatgtctcggatgtagattctgcagcaaaggcaattcaagcgtgtgtagatgaatttggatctgtagacatccttgtaaataacgcaggtattacaaaagatactcttcttatgagaatgaaaaaggagcagtgggatgctgtaattgctgtaaatctcaccgggaccttcaattgtacacaggccgctattaagtttatgatgaaaaatccaaatggaggatctattatcaatctatcatccattgctggggtaaacggaaacataggacagacaaattattctgcatctaaagcaggagtcattggttttacaaaagcggttgcattggaaatggcttctcgcaaggttcgttgtaatgcaattgcacccggctttatcgctactgaaatgacggacgcgattcctgaaaagattaggactgctatggttgcggcgattcctttaaaaagggcgggacaaccggaagatattgctaacacaatcgcatttttggcttccgatatttcttcttttatcactggtcaagtgattgaagtgaatggtggaggtttcttaccaggagcaaccgcctaa

SEQ ID NO: 61864 - protein, 254 aa, Leptospira interrogans serovar Lai str. 56601; identical to SEQ ID NO: 7241

SEQ ID NO: 61865 - DNA, 735 bp, Streptococcus mutans UA159; identical to SEQ ID NO: 7230
  CDS (1)..(735): transl_table=11

SEQ ID NO: 61866 - protein, 244 aa, Streptococcus mutans UA159; identical to SEQ ID NO: 7231

SEQ ID NO: 61867 - DNA, 750 bp, Corynebacterium efficiens YS-314; identical to SEQ ID NO: 7244
  CDS (1)..(750): transl_table=11

SEQ ID NO: 61868 - protein, 249 aa, Corynebacterium efficiens YS-314; identical to SEQ ID NO: 7245

SEQ ID NO: 61869 - DNA, 819 bp, Staphylococcus epidermidis ATCC 12228
  CDS (1)..(819): transl_table=11
atggaacgtttagaaaacaaaatcgcagtgattaccggtgcgagtactggtattggacaagcatcagccgtggcgttagcaatagaaggagcacatgtgttagcgcttgatatatcagatcaattagaagaaactgtgcagtctattaatgataatggtgggaaagcaactgcatatcgcgtagacatttcagatgataaacaagtcaaacaattctcagaaaaaatagcacaagaatttggacatgtagatgttatttttaataatgcgggtgtagataatggcgccggacgtattcatgagtatccagttgaagtgtttgataaaattatggctgttgatatgagaggaacgtttttagtaactaaatttttattacctttaatgatgaaacaaggtggttctattattaatacagcttcattctctggacaagctgccgatttataccgttcagggtataatgctgcaaagggcggtgtcattaatttcacaaaatctatcgctatagaatacggacgtgaaaatattcgtgctaatgccatagcacctggaacaatcgaaacaccacttgttgataatttagcaggtacatcagatgaagaagccggacaaacattccgagaaaatcaaaaatgggtaacaccattaggtcgactaggaacaccggatgaagtcgggaaacttgtagcatttttagcttccgatgatagttcatttataactggtgaaactattcgtatagatggtggcgttatggcttatacatggcctggagaaatgttaagtgatgaaagttggaaaaactctactaaataa

SEQ ID NO: 61870 - protein, 272 aa, Staphylococcus epidermidis ATCC 12228
MERLENKIAVITGASTGIGQASAVALAIEGAHVLALDISDQLEETVQSINDNGGKATAYRVDISDDKQVKQFSEKIAQEFGHVDVIFNNAGVDNGAGRIHEYPVEVFDKIMAVDMRGTFLVTKFLLPLMMKQGGSIINTASFSGQAADLYRSGYNAAKGGVINFTKSIAIEYGRENIRANAIAPGTIETPLVDNLAGTSDEEAGQTFRENQKWVTPLGRLGTPDEVGKLVAFLASDDSSFITGETIRIDGGVMAYTWPGEMLSDESWKNSTK

SEQ ID NO: 61871 - DNA, 807 bp, Bradyrhizobium japonicum USDA 110
  CDS (1)..(807)
atggatcggctcaagggcaaggttgcgatggtggtgggcgcgggctcgatcgggccgggctggggcaacggcaaggcgaccgcggtgaccttcgcgcgcgagggtgcgcaggtgttctgcgtcgaccgcaacggcactgctgccgaggagaccgcgaagatcatcaatgacgaaggcggcaaggcgaccgcgtttaccgccgacgtctcgcggtcagccgagatcgaggcgatggtcgcggcgtgcctgaaggcctatggccgcatcgacgtgctcgacaacaatgtcggcatcgccgagatgggcagcgtggtcgaggtaaccgaggagagctgggaccgcgtcttcagcgtcaacctcaagagcgcctatttcgccatgaagcacgtcatccccgtgatggtggagcagggcggcggctcaatcatcaacatctcttcgatcgcctcgatccgccacatgggcatctcctacgtcacctatggcacctcgaaggcggcgatgaaccagatgacgcgcaccaccgcgatcgagttcgcgcggcatcatgtgcgcgtgaatgcgatcctgcccggcctgatgaagaccccgatggtcgagcattccgccggccttgccgccagctacgccaagggcgacgtcgaggcgatgtggcgcgcgcgcgatgcccaggtgccgatgggtcacatgggcgatgcctttgacgtcgcaaatgccgcgctgttcctggcgtcggacgagtcgaaatatgtgacggggatcgagctcgtggtcgacggcgggatcacgtgcaaggcgggggcgtaa

SEQ ID NO: 61872 - protein, 268 aa, Bradyrhizobium japonicum USDA 110
MDRLKGKVAMVVGAGSIGPGWGNGKATAVTFAREGAQVFCVDRNGTAAEETAKIINDEGGKATAFTADVSRSAEIEAMVAACLKAYGRIDVLDNNVGIAEMGSVVEVTEESWDRVFSVNLKSAYFAMKHVIPVMVEQGGGSIINISSIASIRHMGISYVTYGTSKAAMNQMTRTTAIEFARHHVRVNAILPGLMKTPMVEHSAGLAASYAKGDVEAMWRARDAQVPMGHMGDAFDVANAALFLASDESKYVTGIELVVDGGITCKAGA

SEQ ID NO: 61873 - DNA, 810 bp, Bradyrhizobium japonicum USDA 110
  CDS (1)..(810)
atggcccgatggattccgggttcgcgcaaagaggcgcgccccggaatgacgacaaaaaattcaaaggagaacaagaaaatggcagaccgcctcaagggaaagcgcgccgtcatcacggctgcggcagcaggcatcgggcgcgcatgcgccatcgcattcgcgcgtgaaggcgcgaccgtgatcgccaccgacatcaacgagagcggcatcgcgggccttgccaaggaaggcatcgccgaaaccgcaaagctcgacgtgcgcaacaccgccgacgtcaatgcttttgcaaaacgcgtcggcaagatcgacatcctgctcaatgcggccggcttcgtgcaccacggcaccatcctggaatgctcggaagaggatttcgacttttcgttcgacctcaacgtcaagtcgatgcaccggaccatcagggccttcctgccggacatgctcgcgggcggcggtggcagcatcgtcaacatctcgtcctgcgccgcgctgcggccgcccgccaaccgctatgtctatagcgcgtcgaaggctgcggtgtcgctgctgacccgcgcggtcgcgctcgacttcatcaccaagggcatccgctgcaacagcatctgcccgggcaccgttgagacgccctcgatgctcgaccgcgccgccgcgcaaggaccgcagggcaaggagatgttcatctcccgccagaagatgggccggctcggcaccgccgacgagatcgcctccatggcggtctatctcggcagcgacgagagcgcgttcaccaccggcgtcgacctcgtcgtcgacggcggctacatgctctga

SEQ ID NO: 61874 - protein, 269 aa, Bradyrhizobium japonicum USDA 110
MARWIPGSRKEARPGMTTKNSKENKKMADRLKGKRAVITAAAAGIGRACAIAFAREGATVIATDINESGIAGLAKEGIAETAKLDVRNTADVNAFAKRVGKIDILLNAAGFVHHGTILECSEEDFDFSFDLNVKSMHRTIRAFLPDMLAGGGGSIVNISSCAALRPPANRYVYSASKAAVSLLTRAVALDFITKGIRCNSICPGTVETPSMLDRAAAQGPQGKEMFISRQKMGRLGTADEIASMAVYLGSDESAFTTGVDLVVDGGYML

SEQ ID NO: 61875 - DNA, 738 bp, Bradyrhizobium japonicum USDA 110; identical to SEQ ID NO: 7216
  CDS (1)..(738)

SEQ ID NO: 61876 - protein, 245 aa, Bradyrhizobium japonicum USDA 110; identical to SEQ ID NO: 7217

SEQ ID NO: 61877 - DNA, 744 bp, Xylella fastidiosa Temecula1; identical to SEQ ID NO: 7198
  CDS (1)..(744): transl_table=11

SEQ ID NO: 61878 - protein, 247 aa, Xylella fastidiosa Temecula1; identical to SEQ ID NO: 7199

SEQ ID NO: 61879 - DNA, 756 bp, Clostridium tetani E88; identical to SEQ ID NO: 7214
  CDS (1)..(756): transl_table=11

SEQ ID NO: 61880 - protein, 251 aa, Clostridium tetani E88; identical to SEQ ID NO: 7215

SEQ ID NO: 61881 - DNA, 750 bp, Clostridium tetani E88; identical to SEQ ID NO: 7212
  CDS (1)..(750): transl_table=11

SEQ ID NO: 61882 - protein, 249 aa, Clostridium tetani E88; identical to SEQ ID NO: 7213

SEQ ID NO: 61883 - DNA, 756 bp, Lactobacillus plantarum WCFS1
  CDS (1)..(756): transl_table=11
atgttcaattttacagataaagtcgttattgttacaggtgcacgcacgggaatcggcctgagtgctgccactctattcgccaaagcaggtgctcacgtcattttagctggccatcatgaacctaaagacgaagcccaacagctagtcgatcatggctactcagccgtttcattcaagtgtaacgtcgctgatcccaaaaacgtcgccggaatggtgaaattcgcagttgctcagtttgggcacctcgactatgcttataacgatgctgggattcaaagtccagtcaccgataccgccgatctatcggttgaagaatatgatcatgtcatggatactaacttaaaaggcatgtttctcagtatgaagtacgaattacgacagatgcgtgctcagggaacaccagccgcaatcgtaaactgttcttcaatgggtggtctcgttggtattgctgatcgaactgcctaccacgcttcaaagcacggcgtcttaggcctgacaaagagtagcgccttagaatacgctgaccggaatgttcggatcaacgccgtgtgtccaggaatcattgatacaccaatggttgcccgaatggatgatactgaacgacaggagatggacgacctagtccgcgaaattcccatggggcgtttagctaaaccagaagaagtcgctcaagtcgtactctttctttgcagtgatgctgccagttacatggttggtcaagccgtcgctgttgacggtggttacactattcactaa

SEQ ID NO: 61884 - protein, 251 aa, Lactobacillus plantarum WCFS1
MFNFTDKVVIVTGARTGIGLSAATLFAKAGAHVILAGHHEPKDEAQQLVDHGYSAVSFKCNVADPKNVAGMVKFAVAQFGHLDYAYNDAGIQSPVTDTADLSVEEYDHVMDTNLKGMFLSMKYELRQMRAQGTPAAIVNCSSMGGLVGIADRTAYHASKHGVLGLTKSSALEYADRNVRINAVCPGIIDTPMVARMDDTERQEMDDLVREIPMGRLAKPEEVAQVVLFLCSDAASYMVGQAVAVDGGYTIH

SEQ ID NO: 61885 - DNA, 765 bp, Pseudomonas syringae pv. tomato str. DC3000
  CDS (1)..(765): transl_table=11
atgaatcgattcacccagaaagtcgttgttgtcaccggagccggttctggaatcggcgaagcgaccgccaagcgtttcgcacatgaaggcgcgagcgtcgtgctggtcggtcgcaatcaggagaagcttgccaaagtagccgcgcaactgaaaggtgcagagcatctgatcagggctaccgatgtggcggatctgacggatgtagaggcgctgttcaaggaagtggctgaacgcttcggtcgcttggatgtactggtcaacaacgcaggtgtcgtcaagtcgggcaaggtgacggagctgggcgtggaagactggaaagcagtgatgtcagtggatctggatggtgttttttattgcacccgtaccgccatgcctgcgttgatcgccagcaaaggcaacatcatcaacgtatcgtcggtgtccggcctgggcggcgactggggcatgagcttctacaatgctgccaaaggcgcgattaccaatttcacccgcgcgctggccctggaccatggcgcagatggcgtacgaatcaatgccgtttgcccatcactgactcgcagcgaactgactgaagacatgctgggtgatgaagcattaatggcaaagttcatggaacgcatcccgctggggcgtccgggcgaagctgaagatgtcggcgatgtcatcgcttttctggccagtgaagacgcgcgcttcgtgactggcgtcaacctcccggtggatggcggattgtcagcgtccaacggccagccgccgcaggcttga

SEQ ID NO: 61886 - protein, 254 aa, Pseudomonas syringae pv. tomato str. DC3000
MNRFTQKVVVVTGAGSGIGEATAKRFAHEGASVVLVGRNQEKLAKVAAQLKGAEHLIRATDVADLTDVEALFKEVAERFGRLDVLVNNAGVVKSGKVTELGVEDWKAVMSVDLDGVFYCTRTAMPALIASKGNIINVSSVSGLGGDWGMSFYNAAKGAITNFTRALALDHGADGVRINAVCPSLTRSELTEDMLGDEALMAKFMERIPLGRPGEAEDVGDVIAFLASEDARFVTGVNLPVDGGLSASNGQPPQA

SEQ ID NO: 61887 - DNA, 735 bp, Vibrio parahaemolyticus RIMD 2210633
  CDS (1)..(735): transl_table=11
atgaatctagaaggtaaaatcgctctagtgactggcgcaagccgtggtattggtcgtgcgattgctgagcttcttgttgaacgcggtgccaccgttattggtaccgcaacgtctgaaggcggcgcggctgcgatcagcgaatacctaggcgaaaatggtaaaggtttagcgcttaacgtcactgacgttgagtctattgaagcaacactaaaagccattaacgatgagtttggtgcgatcgatattctagtgaataacgcaggtatcactcgcgataacctactaatgcgcatgaaagacgatgagtggaacgacatcatcaacacaaacctgacgcctatttaccgtatgtctaaagcggttctgcgtggcatgatgaaaaaacgcgcgggtcgtatcatcaacgtaggttctgttgtaggcactatgggtaatgcgggtcaaactaactacgcagcagcaaaagcgggcgtgattggttttactaaatcaatggctcgtgaagtggcttctcgtggcgtaacggttaacacagttgcacctggtttcatcgaaactgacatgactaaggcgctaaatgacgaccaacgtgcagcaacgttggcgaacgtgccagctggtcgcttgggtgatcctcgtgaaattgcatcagcagtagttttcctagcttcacctgaagccgcttacattactggtgaaactttgcatgtaaatggtggcatgtacatggtttaa

SEQ ID NO: 61888 - protein, 244 aa, Vibrio parahaemolyticus RIMD 2210633
MNLEGKIALVTGASRGIGRAIAELLVERGATVIGTATSEGGAAAISEYLGENGKGLALNVTDVESIEATLKAINDEFGAIDILVNNAGITRDNLLMRMKDDEWNDIINTNLTPIYRMSKAVLRGMMKKRAGRIINVGSVVGTMGNAGQTNYAAAKAGVIGFTKSMAREVASRGVTVNTVAPGFIETDMTKALNDDQRAATLANVPAGRLGDPREIASAVVFLASPEAAYITGETLHVNGGMYMV

SEQ ID NO: 61889 - DNA, 747 bp, Bacteroides thetaiotaomicron VPI-5482; identical to SEQ ID NO: 7220
  CDS (1)..(747): transl_table=11

SEQ ID NO: 61890 - protein, 248 aa, Bacteroides thetaiotaomicron VPI-5482; identical to SEQ ID NO: 7221

SEQ ID NO: 61891 - DNA, 738 bp, Enterococcus faecalis V583
  CDS (1)..(738): transl_table=11
atggaattaacaggaaaaaacgtatttattactggaagcactcgtgggattggtaaagcagttgcgttagcttttgcgaaagagggcgccaatattgtcttaaacggtcggagtgagattacgccagaacaacgacaagaaattgaagcctttggggtaaaatgtattggcctttctggagatatttccgattttgatgcggcaggtgagatgattcaagcaacagttgaccaattaggctcgattgatattctggtgaataacgctgggattacgaatgacaaattattattacgaatgacaaaagaggattttaatgcctgtttagatattaacttggtaggaacttttaacatgacccagcaagcggttaaacgtatgatgaaacaacgaagtggtcggattattaatatggctagcgtttctggtttaatgggaaatgttggtcaagcaaactacgctgcgagtaaagccggtgtcgttggttttactaaatcggtggcacgagaagttgcgccgcgcggtattacctgcaatgcgattgcaccagggtttatccaaacagaaatgacggatgttttatcggaaaaagttaaaacacaaatgaatgcgcaaattcccttacaaacgtttgggcaagtcgaagatgtcgcagctacagcgattttcttagctaaaagtccctatattactgggcaagtcgtgaatgtcgatggcggcttagtcatgcacggataa

SEQ ID NO: 61892 - protein, 245 aa, Enterococcus faecalis V583; identical to SEQ ID NO: 7185

SEQ ID NO: 61893 - DNA, 831 bp, Streptomyces avermitilis MA-4680
  CDS (1)..(831)
atgaccccgcgactgtccggcaagaccgctgtcatcacgggcgccgcccgcggtctgggacgcgccaccgcggtggcgttcgcccgcgagggtgccgacctgatgctgctcgacctggcggcggacctgccgggcgtcccctacccgctgggctccgagagccagctggcccacaccgccgagttgtgccgcgagcaaggcgtcgccgcctcgacggcccggctcgacgtgcgtgacctcgacgcggtggaggccgcgatggccaccacccgcgagcggttcggacggatcgacgtactcgtcaacaacgccgggatcgccgccccttcgggcaaggccgcccatgagatcgacgagcgtgagtggcagctgatgatcgacgtcgacctctccggagcctggcggaccatccgcgcggtaggcggtcacatggccgagcagcgctcgggcagcatcatcaacatcgcctccaccgcgggcctggtgggctaccgccacttcgccggctacgtggccgccaagcacggcctggtcggtctgaccaaggccgtcgcgctcgactacgcaccgctcaaggtgcgggtgaacgccctctgccccggctcggtccgggacgactcgcaggtcgagggccggatgctgtccgaaatcgcgcgttgcctggacgtgccggtggccgagcacgaggagaccttcgtgcaggcccagccgatgaactccctgatcgagcccgaggacatcgcgtcggcagccgtgtggctggcctccgacgagtcccgccaggtcaccggcagcgtcctcgcggtggacggcggcttcaccgcccgttag

SEQ ID NO: 61894 - protein, 276 aa, Streptomyces avermitilis MA-4680
MTPRLSGKTAVITGAARGLGRATAVAFAREGADLMLLDLAADLPGVPYPLGSESQLAHTAELCREQGVAASTARLDVRDLDAVEAAMATTRERFGRIDVLVNNAGIAAPSGKAAHEIDEREWQLMIDVDLSGAWRTIRAVGGHMAEQRSGSIINIASTAGLVGYRHFAGYVAAKHGLVGLTKAVALDYAPLKVRVNALCPGSVRDDSQVEGRMLSEIARCLDVPVAEHEETFVQAQPMNSLIEPEDIASAAVWLASDESRQVTGSVLAVDGGFTAR

SEQ ID NO: 61895 - DNA, 747 bp, Chlamydophila caviae GPIC; identical to SEQ ID NO: 7182
  CDS (1)..(747): transl_table=11

SEQ ID NO: 61896 - protein, 248 aa, Chlamydophila caviae GPIC; identical to SEQ ID NO: 7183

SEQ ID NO: 61897 - DNA, 744 bp, Bacillus cereus ATCC 14579
  CDS (1)..(744): transl_table=11
atgaaattaaaagacaaagtagcaatcataactggtggtgcaagtggaattggcgaatctactgttcgtctttttatcgaagaaggtgcaaaagtagttattgctgacttttctgaacgtggaaaagaactatcagatgaattgaatgcacatggatataatacgttatttattaaaaccgatgtaacaaaagaggcagatattaaacagctaattcatgagacagtaagtacatacggtaaattagatattatgtatgccaatgccggcgttgctgatgatgcaccggcaaacgaattatcctatgaaaagtggaaaagaactattgatattaatttgtctggggtattcctttctgataaatattcgattgaacaatttcttaaacaaggtacaggtggtgtcatcgttaacgctggttcgattcatagttttgtttcattacctacaccaacagcatactcctctgcaaaaggtggtgtgaaactattaactcaaaatttatgtactgcctacgctaaatatggaatacgtattaacgcggtgtgccctggttatattgacacccctttactaggtagtgttaatcctcaacagaaagaatatttagcttcacttcatccacaaggcagacttggaacaccagaagaagtcgctaaagctgtcttatttttagcaagtgatgatgctagttttgttaacggcacaacacttcttgttgatggaggctatactgcacgttaa

SEQ ID NO: 61898 - protein, 247 aa, Bacillus cereus ATCC 14579
MKLKDKVAIITGGASGIGESTVRLFIEEGAKVVIADFSERGKELSDELNAHGYNTLFIKTDVTKEADIKQLIHETVSTYGKLDIMYANAGVADDAPANELSYEKWKRTIDINLSGVFLSDKYSIEQFLKQGTGGVIVNAGSIHSFVSLPTPTAYSSAKGGVKLLTQNLCTAYAKYGIRINAVCPGYIDTPLLGSVNPQQKEYLASLHPQGRLGTPEEVAKAVLFLASDDASFVNGTTLLVDGGYTAR

SEQ ID NO: 61899 - DNA, 741 bp, Bacillus cereus ATCC 14579
  CDS (1)..(741): transl_table=11
atggagtttttaaatgggaaaacagctgttgtaacaggagctgcacagggaattggaaaagagattgcaagggtttatgcaaaactaggggcgaaagtattaattagcgatgtaaatgaagaaaatctacaaaaaacgacacgtgagttatcagatgaaggatatgaagtgtgctcatatcgatgtgatgtgagtaatcaaaatgaagcaaagtcgttaattgaatatgcggttcaaaaatttggtacattacatattttggtgaataatgctggaattacaagagacgcaatgttacataaaatggagaagtctgcttgggaacaagtattacaagtgaacttaactggagttttttattgtatgcaacccgcgcttctttacatgagacaacaagggtatggacgcattattaatatatcttcaattagtagagaaggaaacataggtcaagcaaattatgcggctacaaaggcaggagttgtaggattaacgaaaacagcagcgaaagaagttggaagtttcggtattacttgtaatgcgatttgtccggggtttatggatacagatatgaccaaaacgataccagataaagtgaaagaaaagatggttggcgctattccagttggtagaattggaacgccagaagatattgcgaacgcagcagcctttttagcatcagaatacgcatcttatattacaggtgaagtattaaatgtgagcggaggactgcaagtttaa

SEQ ID NO: 61900 - protein, 246 aa, Bacillus cereus ATCC 14579
MEFLNGKTAVVTGAAQGIGKEIARVYAKLGAKVLISDVNEENLQKTTRELSDEGYEVCSYRCDVSNQNEAKSLIEYAVQKFGTLHILVNNAGITRDAMLHKMEKSAWEQVLQVNLTGVFYCMQPALLYMRQQGYGRIINISSISREGNIGQANYAATKAGVVGLTKTAAKEVGSFGITCNAICPGFMDTDMTKTIPDKVKEKMVGAIPVGRIGTPEDIANAAAFLASEYASYITGEVLNVSGGLQV

SEQ ID NO: 61901 - DNA, 741 bp, Bacillus cereus ATCC 14579; identical to SEQ ID NO: 7176
  CDS (1)..(741): transl_table=11

SEQ ID NO: 61902 - protein, 246 aa, Bacillus cereus ATCC 14579; identical to SEQ ID NO: 7177

SEQ ID NO: 61903 - DNA, 753 bp, Prochlorococcus marinus subsp. marinus str. CCMP1375; identical to SEQ ID NO: 7156
  CDS (1)..(753): transl_table=11

SEQ ID NO: 61904 - protein, 250 aa, Prochlorococcus marinus subsp. marinus str. CCMP1375; identical to SEQ ID NO: 7157

SEQ ID NO: 61905 - DNA, 768 bp, Bordetella pertussis Tohama I
  CDS (1)..(768): transl_table=11
atgacgcaacgcttatccggcaggatcgccatcgtgaccggcgcgggctcgggaatcggcgaggccacggcccgcctgatggcgcgcgagggcgcggtcgtggtggtggccgacaaggccatcgaagtggccgagcgcgtcgcgcaggccatcgtggccgagggcggacgcgccgaggcgcgccaggccgacgtgggcgaggcgcaatcggtgcgcgccctggtcgacgccgtggcggcgcgctgggagcgcatcgacgtgctggtcaacaatgccggctacggtatcgccgccaccgtggtcgataccgacgaggccgactggtcggcgctgatgcgcgtcaacgtcgacggcgtgttcctgggctgcaagtacgtcatcccgatcatgcagcgccagggggccggcgtgatcgtcaatacggcgtcggcgggcgcgctggtgggcttgcgccagcgcgccgcgtattgcgcctccaagggcgcggtggcggcgctgacgcgcgccatggcgctggaccacgccaccgaggggatccgcatcaactgcgtggcgccgggcacgatcgagtcgccgtacttccgcgagatctacgcgcgcagcgacgatcccgaagccttgcgcgccagcctggcggcgcgccagcccatgaaccgcctcggccagcccgaggaagtggcgcgcgccatcgttttcctggccagcgacgacgcctcgttcgccaccggcagcacgctggtgctcgacggcggcctgacggcggcgtag

SEQ ID NO: 61906 - protein, 255 aa, Bordetella pertussis Tohama I
MTQRLSGRIAIVTGAGSGIGEATARLMAREGAVVVVADKAIEVAERVAQAIVAEGGRAEARQADVGEAQSVRALVDAVAARWERIDVLVNNAGYGIAATVVDTDEADWSALMRVNVDGVFLGCKYVIPIMQRQGAGVIVNTASAGALVGLRQRAAYCASKGAVAALTRAMALDHATEGIRINCVAPGTIESPYFREIYARSDDPEALRASLAARQPMNRLGQPEEVARAIVFLASDDASFATGSTLVLDGGLTAA

SEQ ID NO: 61907 - DNA, 753 bp, Bordetella parapertussis 12822
  CDS (1)..(753): transl_table=11
ttgttcgatttgagcggaaagaccgccctcgtcaccggggcaagccgtggcatcggccagaatgtcgcgctgtgcctggcgcaggcgggcgcgaacgtcgtgctgtggggacgcgaccaggcggaactggaacagacgcgcgtacggatcgacgaatacggcgtccagtccaccatcgacgccttcgacattaccgaggccgaatcggtgcggcgcgccacggcccaggccatcgagcgtttcggccacctggacgtgctggtcgtcaacgccggcgtcaatgtgctgcgccccttcctggactggaccccgcagcaatgggaccacatgatcggcgtgaacctggtcggcgcgatgcacacgctgcaggccgtcggccggcacatgaccgagcgcaagcagggcagcatcatcaccatgtcgtccatctacagccatgtgggcgcgcccgacaacagcttctattgcctcaccaagggcggcttgctgcaactgacgaaaagcctggcgatggaatgggcccgccacaaggtgcgcgtcaacgcgatctgcccgggctggatcgagaccgacctgaccgcgccgtacatgcaggacgcacaggtgcgcgcggccgggctgaaacagattcccttgcgccgcttcggccagcccgccgatatcggtccgatcgccgtctacctggcctcggacgaggcgcaatggacgaccggccagagtttcgtggtcgacggcgggcagatcgcccgctga

SEQ ID NO: 61908 - protein, 250 aa, Bordetella parapertussis 12822
MFDLSGKTALVTGASRGIGQNVALCLAQAGANVVLWGRDQAELEQTRVRIDEYGVQSTIDAFDITEAESVRRATAQAIERFGHLDVLVVNAGVNVLRPFLDWTPQQWDHMIGVNLVGAMHTLQAVGRHMTERKQGSIITMSSIYSHVGAPDNSFYCLTKGGLLQLTKSLAMEWARHKVRVNAICPGWIETDLTAPYMQDAQVRAAGLKQIPLRRFGQPADIGPIAVYLASDEAQWTTGQSFVVDGGQIAR

SEQ ID NO: 61909 - DNA, 738 bp, Bordetella parapertussis 12822; identical to SEQ ID NO: 7164
  CDS (1)..(738): transl_table=11

SEQ ID NO: 61910 - protein, 245 aa, Bordetella parapertussis 12822; identical to SEQ ID NO: 7165

SEQ ID NO: 61911 - DNA, 753 bp, Bordetella bronchiseptica RB50
  CDS (1)..(753): transl_table=11
ttgttcgatttgagcggaaagaccgccctcgtcaccggggcaagccgtggcatcggccagaatgtcgcgctgtgcctggcgcaggcgggcgcgaacgtcgtgctgtggggacgcgaccaggcggaactggaacagactcgcgtacggatcgacgaatacggcgtccagtccaccatcgacgccttcgacattaccgaggccgaatcggtgcggcgcgccacggcccaggccatcgagcgtttcggccacctggacgtgctggtcgtcaacgccggcgtcaatgtgctgcgccccttcctggactggaccccgcagcaatgggaccacatgatcggcgtgaacctggtcggcgcgatgcacacgctgcaggccgtcggccggcacatgaccgagcgcaagcagggcagcatcatcaccatgtcgtccatctacagccatgtgggcgcgcccgacaacagcgtctattgcctcaccaagggcggcttgctgcaactgacgaaaagcctggcgatggaatgggcccgccacaaggtgcgcgtcaacgcgatctgcccgggctggatcgagaccgacctgaccgcgccgtacatgcaggacgaacaggtgcgcgcggccgggctgaaacagattcccttgcgccgcttcggccagcccgccgatatcggtccgatcgccgtctacctggcctcggacgaggcgcaatggacgaccggccagagtttcgtggtcgacggcgggcagatcgcccgctga

SEQ ID NO: 61912 - protein, 250 aa, Bordetella bronchiseptica RB50
MFDLSGKTALVTGASRGIGQNVALCLAQAGANVVLWGRDQAELEQTRVRIDEYGVQSTIDAFDITEAESVRRATAQAIERFGHLDVLVVNAGVNVLRPFLDWTPQQWDHMIGVNLVGAMHTLQAVGRHMTERKQGSIITMSSIYSHVGAPDNSVYCLTKGGLLQLTKSLAMEWARHKVRVNAICPGWIETDLTAPYMQDEQVRAAGLKQIPLRRFGQPADIGPIAVYLASDEAQWTTGQSFVVDGGQIAR

SEQ ID NO: 61913 - DNA, 738 bp, Bordetella bronchiseptica RB50
  CDS (1)..(738): transl_table=11
atgagcggaaaattggcatatgtgacgggcggcatgggcggtatcggtaccgcgatctgccagcggttggccaaggacggcttccgggtggtggcggggtgcggccccagccgcaactatcagcagtggctcgacgagcaggcggcccagggctatacgttctacgcatcggtgggcaacgtgtccgactgggagtccaccgtcaaggctttcgagcgcgtcacggccgacctgggccaggtcgacgtgctggtcaacaacgccggcatcacgcgtgacggcctgttccgcaagatgtcggtggacgactggcgcgcggtgatcgacaccaacctgaacagcctgttcaacgtgaccaagcaggtgctcgacgggatggtggagcgccaatgggggcgcatcgtcaacatcagctcggtcaacggccagaaagggcagttcggccagaccaactactcgaccgccaaggcgggcatccatggtttcaccatggccctggcccaggaggtcgccagcaagggcattaccgtcaacaccatttcgccgggctacatcgggaccgacatggtgcgggccatccgtcccgacgtgctggagaaaatcgtcgcgacgattccggtgcgccggctgggtacgcccgaggaaatcgcgtccatgacgtcctggctggcgtcggacgagtcgggttttgccacgggcgcggatttctcgctcaatggcggcctgcacatgggttga

SEQ ID NO: 61914 - protein, 245 aa, Bordetella bronchiseptica RB50
MSGKLAYVTGGMGGIGTAICQRLAKDGFRVVAGCGPSRNYQQWLDEQAAQGYTFYASVGNVSDWESTVKAFERVTADLGQVDVLVNNAGITRDGLFRKMSVDDWRAVIDTNLNSLFNVTKQVLDGMVERQWGRIVNISSVNGQKGQFGQTNYSTAKAGIHGFTMALAQEVASKGITVNTISPGYIGTDMVRAIRPDVLEKIVATIPVRRLGTPEEIASMTSWLASDESGFATGADFSLNGGLHMG

SEQ ID NO: 61915 - DNA, 750 bp, Prochlorococcus marinus subsp. pastoris str. CCMP1986; identical to SEQ ID NO: 7152
  CDS (1)..(750): transl_table=11

SEQ ID NO: 61916 - protein, 249 aa, Prochlorococcus marinus subsp. pastoris str. CCMP1986; identical to SEQ ID NO: 7153

SEQ ID NO: 61917 - DNA, 753 bp, Prochlorococcus marinus str. MIT 9313; identical to SEQ ID NO: 7154
  CDS (1)..(753): transl_table=11

SEQ ID NO: 61918 - protein, 250 aa, Prochlorococcus marinus str. MIT 9313; identical to SEQ ID NO: 7155

SEQ ID NO: 61919 - DNA, 741 bp, Chromobacterium violaceum ATCC 12472; identical to SEQ ID NO: 7132
  CDS (1)..(741): transl_table=11

SEQ ID NO: 61920 - protein, 246 aa, Chromobacterium violaceum ATCC 12472; identical to SEQ ID NO: 7133

SEQ ID NO: 61921 - DNA, 747 bp, Porphyromonas gingivalis W83; identical to SEQ ID NO: 7128
  CDS (1)..(747): transl_table=11

SEQ ID NO: 61922 - protein, 248 aa, Porphyromonas gingivalis W83; identical to SEQ ID NO: 7129

SEQ ID NO: 61923 - DNA, 735 bp, Photorhabdus luminescens subsp. laumondii TTO1; identical to SEQ ID NO: 7138
  CDS (1)..(735): transl_table=11

SEQ ID NO: 61924 - protein, 244 aa, Photorhabdus luminescens subsp. laumondii TTO1; identical to SEQ ID NO: 7139

SEQ ID NO: 61925 - DNA, 747 bp, Vibrio vulnificus YJ016; identical to SEQ ID NO: 7224
  CDS (1)..(747): transl_table=11

SEQ ID NO: 61926 - protein, 248 aa, Vibrio vulnificus YJ016; identical to SEQ ID NO: 7225

SEQ ID NO: 61927 - DNA, 789 bp, Rhodopseudomonas palustris CGA009
  CDS (1)..(789): transl_table=11
atgcgtttcaacggcaaggtcgctgtcgtcacggcagcagcatcgggcattggcgccgccacggccgcccgtctcgcgcgggaaggcgcgtatgtctatctctcggatattgatcaggacgctctgggccgacaggccgaatctttggtcgacgtcgctgagcggatttcgacggtggtggctgatgtcaccgtacccgagcaggtctcggcgctaattgacggagccgcgcgcgagcggggccggctcgatatcctgatcaacaatgccggcatgggcgcgttcggccgcatcaccgaggtgacgccggaagcctggcaccgcgtcttcgggatctgcgtggattcgatctttcacgcaagtcgcgccgcgatcccgcatctaatcaaggcccgcggcactatcgtcaacaccgcttctatctccggtctgttcggcgactacggcttcgctgcctacaacgccgcgaagggcgcggtgatcaatctcacccgcaacatggcgctcgactacagccgcgacggccttcgcgtgaacgcggtctgccccggcctcatcgcgacgccgctgtcgctgaagctgcgcgacaacgcagcggtgatggccgagtacgaccggctgatcccgctcggccgcgccggttcgcccgaagaggtcgctggcgcgatcgctttcctcgcgtccgacgatgcgtcctacatcaccggcgtcgccttcgcggtcgatggcgggctgactgcccgaaccgggcagccgaacttcctcgggcacctggcgcccaagccctga

SEQ ID NO: 61928 - protein, 262 aa, Rhodopseudomonas palustris CGA009
MRFNGKVAVVTAAASGIGAATAARLAREGAYVYLSDIDQDALGRQAESLVDVAERISTVVADVTVPEQVSALIDGAARERGRLDILINNAGMGAFGRITEVTPEAWHRVFGICVDSIFHASRAAIPHLIKARGTIVNTASISGLFGDYGFAAYNAAKGAVINLTRNMALDYSRDGLRVNAVCPGLIATPLSLKLRDNAAVMAEYDRLIPLGRAGSPEEVAGAIAFLASDDASYITGVAFAVDGGLTARTGQPNFLGHLAPKP

SEQ ID NO: 61929 - DNA, 768 bp, Rhodopseudomonas palustris CGA009
  CDS (1)..(768): transl_table=11
atggcgcggctgcagaacaagacggcagtgatcacgggtggcggaggcggcatcggcggagcgacctgccgccggttcgcgcaggaaggcgccaagatcgcggtattcgacctcaatctcgatgctgccgagaaggtcgccggcgcgatccgcgacgcaggcggcaccgcggaagcggtccgctgcgatatcgccgaccgcacaagcgtcgatgccgcgatcgccacgaccaccaccacgctcggaccggtggacattctggtcaacaacgccggctgggacatcttcaagccgttcaccaagaccgagccgggcgaatgggaacggctgatcgccatcaatctcaccggcgcactgcacatgcatcacgcggtgctgcccggcatggtcgagcgccgccacggccggatcgtcaacatcgcctccgacgccgcccgcgtcggctcgtcgggcgaagcggtgtacgcagcctgcaagggaggcctcgtcgcgttctcgaaaacgctggcacgcgagcacgcccgccacggcatcaccgtcaacgtggtctgcccggggccgaccgacaccgcgctgctcgccgacgtgacctccggcgccgctaatccggaaaaactgatcgaagccttcaccaaggcgatcccgctcggccggctcggcaagccggacgatctcgccggcgcgatcgcgttcttcggcagcgacgacgccggcttcatcacaggccaggtgctgagcgtctccggcggcctgacgatgaacggctga

SEQ ID NO: 61930 - protein, 255 aa, Rhodopseudomonas palustris CGA009
MARLQNKTAVITGGGGGIGGATCRRFAQEGAKIAVFDLNLDAAEKVAGAIRDAGGTAEAVRCDIADRTSVDAAIATTTTTLGPVDILVNNAGWDIFKPFTKTEPGEWERLIAINLTGALHMHHAVLPGMVERRHGRIVNIASDAARVGSSGEAVYAACKGGLVAFSKTLAREHARHGITVNVVCPGPTDTALLADVTSGAANPEKLIEAFTKAIPLGRLGKPDDLAGAIAFFGSDDAGFITGQVLSVSGGLTMNG

SEQ ID NO: 61931 - DNA, 735 bp, Rhodopseudomonas palustris CGA009
  CDS (1)..(735): transl_table=11
atgtccgaccggctgacaggcaagcgcgcgttcgtcaccgcggcagcggcggggatcgggcgggcatcggcgatcgcttttgctcgcgagggcgccgaagtattcgccaccgatatcgatgaggccgggcttgcctcgctcgccgagcacggcattgcgcggaccgccaagctcgacgtccgcgacaccgccgcggtcgaagcgatcgcccgcgaggccggcaccgtcgacatcctgctcaacgctgccggcttcgtgcatcatggcacggtgctcgactgctcggatacggattgggacttttcgttcgacctcaacgtcaagtcgatgcaccgcaccatccgcgcgtttcttcctgcaatgctggaagccggccgcggctcgatcgtcaacatctcgtcggccgccggcgtgttcaaggcggcaccgaaccgctacgtctatggcgccaccaaagccgcagtggcggcgctgacccgcgcggtcgcggtggacttcatcactcgcggcatccgctgcaacgcgatctgcccggggacgatcgaaaccccgtcgatgctcggccgtgccgccgcgctcgggccgcagggccgcgagatgttcgtgtcacgccagccgatgggccgtctcggcaacgccgaggagatcgccgcgctggcggtgtacctcgcctccgacgaaagcgccttcaccaccggcgtcgcgcacatcatcgacggcggctggacgttgtaa

SEQ ID NO: 61932 - protein, 244 aa, Rhodopseudomonas palustris CGA009
MSDRLTGKRAFVTAAAAGIGRASAIAFAREGAEVFATDIDEAGLASLAEHGIARTAKLDVRDTAAVEAIAREAGTVDILLNAAGFVHHGTVLDCSDTDWDFSFDLNVKSMHRTIRAFLPAMLEAGRGSIVNISSAAGVFKAAPNRYVYGATKAAVAALTRAVAVDFITRGIRCNAICPGTIETPSMLGRAAALGPQGREMFVSRQPMGRLGNAEEIAALAVYLASDESAFTTGVAHIIDGGWTL

SEQ ID NO: 61933 - DNA, 747 bp, Rhodopseudomonas palustris CGA009
  CDS (1)..(747): transl_table=11
atgaccagacatgccatcgtcaccggagccagccgcggcatcggacgcgccatcgcgctcggccttgcccagcgcggctacgacctcgccctcaccgatatcgccgcacaggaaagcgtgctgcgtgagactgtcgaagaggtgaagcagctcggccgcaaatgcattccgatcctcgccgacgtcagcaagatcgaggattgccagcgttcggtgaccgaggcggtcgccgggctcggccacgtcgacgtgctcgtcaacaatgccgggatcctgcggctggcgatgatcgacgagaccacgcccgagcattgggatcagaccttcgcggtcaacgtccgcggcgtcttccagatgacccaggcggtggtcgtgcacatgaaggagcggcgctacggccgcatcgtcaatatcgcgtcgctggccgcgcgcaccggcggtcccggccagtcgcactacgcggcgtcgaagtccgccgtggtcggcttcacccgcgtttcttcgatggaattcggcggccacggcatcaccgtgaatgcggtttgccccggcatcatccagaccgaaatgggccgcaacaatctgcgcgatccggagcgggtcacgtatttcgagaagatcaccgacctgcatcggctcggcgagccggaagacgtcgtcggcccggtcgcgttcttcgcatcggacgattcggcgttcgtcaccggccaggcgctcaatgtcgatggcggcatcttctacagctaa

SEQ ID NO: 61934 - protein, 248 aa, Rhodopseudomonas palustris CGA009
MTRHAIVTGASRGIGRAIALGLAQRGYDLALTDIAAQESVLRETVEEVKQLGRKCIPILADVSKIEDCQRSVTEAVAGLGHVDVLVNNAGILRLAMIDETTPEHWDQTFAVNVRGVFQMTQAVVVHMKERRYGRIVNIASLAARTGGPGQSHYAASKSAVVGFTRVSSMEFGGHGITVNAVCPGIIQTEMGRNNLRDPERVTYFEKITDLHRLGEPEDVVGPVAFFASDDSAFVTGQALNVDGGIFYS

SEQ ID NO: 61935 - DNA, 741 bp, Geobacter sulfurreducens PCA; identical to SEQ ID NO: 7370
  CDS (1)..(741): transl_table=11

SEQ ID NO: 61936 - protein, 246 aa, Geobacter sulfurreducens PCA; identical to SEQ ID NO: 7371

SEQ ID NO: 61937 - DNA, 807 bp, Mycobacterium avium subsp. paratuberculosis str. k10
  CDS (1)..(807): transl_table=11
atgtcgggtctgagcggacgggtagtgctggttaccggcgccggtcgcgggatcggtcgcagccattgccagcggttcgccgaggagggcgccgacgtgatcgcggtggatgtgcccgcggcggctcccgacctcgcgcagaccgccgccgcggtgcaacagcgcggcgtgcgcgcggcgaccgctctggctgacgtcagcgacttcgccgcgttggcggccgcggtggacgaggccgtcggccgactcggtcgcctggacgtgctcgtcggcaacgcgggaatccacccggccgccgcgcccgcgtgggagatcaccccgcagaactggcagcagacgttggatgtcaacctcaccggcgtgtggcacaccgtcaaggcgggcgtcccccacatgagccggaccgcccgaggcggatcgatcgtgatcatcagctccaccagtggtattcgcggaacgcccggcgccgccccgtactccgcgagcaagcacgccgtcgtggggttggcgcgcaccctcgccaacgagctgggaccgcaaggcatccgcgtcaacaccgttcaccccggagcggtggcgaccgcgatggtgctcaacgaggccaccttccggcggctgcggcccgacctggacaacgcgacggcagacgacgccgccgaggcgctcagcgcccggcacctgctgccggttccgtgggtggagccggtcgacgtgagcaatgccgtggtgtttctggcctccgaccaggcgcgctacatcaccggcacccagatcgtggtcgacgccggattgctggccagggcttag

SEQ ID NO: 61938 - protein, 268 aa, Mycobacterium avium subsp. paratuberculosis str. k10
MSGLSGRVVLVTGAGRGIGRSHCQRFAEEGADVIAVDVPAAAPDLAQTAAAVQQRGVRAATALADVSDFAALAAAVDEAVGRLGRLDVLVGNAGIHPAAAPAWEITPQNWQQTLDVNLTGVWHTVKAGVPHMSRTARGGSIVIISSTSGIRGTPGAAPYSASKHAVVGLARTLANELGPQGIRVNTVHPGAVATAMVLNEATFRRLRPDLDNATADDAAEALSARHLLPVPWVEPVDVSNAVVFLASDQARYITGTQIVVDAGLLARA

SEQ ID NO: 61939 - DNA, 750 bp, Mycobacterium avium subsp. paratuberculosis str. k10
  CDS (1)..(750): transl_table=11
gtggtacaggtgtccttgctcagtggtcagaccgcggtcatcacaggtggcgcacaaggtttggggttcgcgatcgccgaacggttcgtcgccgaaggggcgcgggtcgtcctcggcgacgtcaatctggaggcgacgcaaaccgcggccaaacagctgggcggtgaccaggtggcgctggccgtgcgctgcgacgtcaccaagtcgtccgaggtcgaaacgctgatccagaccgccgtcgagcggttcggcggcctggacatcatggtcaacaacgccgggatcacccgggacgccaccatgcgcaagatgaccgaggagcagttcgatcaggtcatcgccgtgcacttgaagggcacctggaacggcacccgattggcggcggcgatcatgcgggaaaacaagcgcggcgccatcatcaacatgtcgtcggtgtcgggcaaggtcggcatggtcggccagaccaactactcggcggccaaggccggcatcgtgggcatgaccaaggcggccgccaaggagctggcctacctgggtgtgcgggtgaacgcgatcgcccccggtttgatccgctcggcgatgacagaggccatgccgcaacgcatttgggactccaaggtggccgaggtgtcgatgggccgggccggcgagcccagcgaggtcgccagcgtggcgctgtttttggcctccgacatgtcgtcgtacatgaccggcaccgtcatggagatcacgggcggccggcacctgtga

SEQ ID NO: 61940 - protein, 249 aa, Mycobacterium avium subsp. paratuberculosis str. k10
MVQVSLLSGQTAVITGGAQGLGFAIAERFVAEGARVVLGDVNLEATQTAAKQLGGDQVALAVRCDVTKSSEVETLIQTAVERFGGLDIMVNNAGITRDATMRKMTEEQFDQVIAVHLKGTWNGTRLAAAIMRENKRGAIINMSSVSGKVGMVGQTNYSAAKAGIVGMTKAAAKELAYLGVRVNAIAPGLIRSAMTEAMPQRIWDSKVAEVSMGRAGEPSEVASVALFLASDMSSYMTGTVMEITGGRHL

SEQ ID NO: 61941 - DNA, 795 bp, Bacillus cereus ATCC 10987
  CDS (1)..(795): transl_table=11
atggggaaattagatggtaaggttgcttttgttacaggagctgcgatggggaacggagctggaattgctcatgtatttgcagagctaggggcgaaagtattacttgttgatatttcagagacagttcatgagacagccaaaaatattgtaagtaaagggttagatgctgcaagttatgtagtcgatgtagctgatatggatgctgttaaagaagtagcgaaagatgcatatgagaagtacggaaagattgatgtgttagtaaataacgccggtgttattcgacttgcaaattttttagatatgtcagatgaaatgcgtgattttcaatttcaagtaaatattaatggggtatggaatttttctaaagcggtattgccatatatggttgagaaaaattacggaaagattgtgaatatgtcttctgtaacaggaacattggttgctgatgaaggtgaaactgcatatgcaacgacgaaagcagcaatttggggatttacaaaagcgttagcacgagaagttgcaaaacatcatattaccgtaaatgcaatttgtccaggttacattatgacaccaatggcagagcaaatagcaaatgaatctgatccaaatgagccgagtaatgtaatcgatggaattgcttcaggtgttcctttaggacgtttagggaaaattgaagaagtaggtcagttagcaggttttttagcatccgatgaatcaagctacataacaggtacacacattgtcattgatggtggtagtacattgccagaaacggtttcagtgggtgtaaagtaa

SEQ ID NO: 61942 - protein, 264 aa, Bacillus cereus ATCC 10987
MGKLDGKVAFVTGAAMGNGAGIAHVFAELGAKVLLVDISETVHETAKNIVSKGLDAASYVVDVADMDAVKEVAKDAYEKYGKIDVLVNNAGVIRLANFLDMSDEMRDFQFQVNINGVWNFSKAVLPYMVEKNYGKIVNMSSVTGTLVADEGETAYATTKAAIWGFTKALAREVAKHHITVNAICPGYIMTPMAEQIANESDPNEPSNVIDGIASGVPLGRLGKIEEVGQLAGFLASDESSYITGTHIVIDGGSTLPETVSVGVK

SEQ ID NO: 61943 - DNA, 741 bp, Bacillus cereus ATCC 10987; identical to SEQ ID NO: 7378
  CDS (1)..(741): transl_table=11

SEQ ID NO: 61944 - protein, 246 aa, Bacillus cereus ATCC 10987; identical to SEQ ID NO: 7379

SEQ ID NO: 61945 - DNA, 738 bp, Canis familiaris
  CDS (1)..(738)
atgggtcgacttgatgggaaggtcatcgtcctgacagctgctgctcaggggattggccgggcagctgccttagcttttgcaagagaaggtgccaaagtcattgccactgatatcaatgagtccaaacttcaggaactggaaaagtaccccggtattcaaactcggacccttgatgtcacaaagaagaaacaaattgatcagtttgccaatgaaattgggagacttgatgttctctttaatgttgctggttttgtccatcatggaactatcctggactgcgaggagaaagactgggacttctcaatgaatctcaatatccgcagcatgtacttgatgatcaaggcatttcttcctaagatgcttgcacagaaatctggcaacataatcaacatgtcatctgtggcttctagcatcaaaggagttgagaacagatgtgtgtacagtacaaccaaggcagctgtgattggcctcacaaagtccttggccacagacttcatccagcaggggatcaggtgcaactgcgtgtgtccagcaacggttgataccccatccctgcaagaaagaatacaagccagaccaaataccgaagaggcactgaactacttcctgaagcgacagaaaattggaagatttgcaaccgcagaagaaatagccctgctctgtgtgtatttggcttccgatgaatctgcctacataacaggtaatcctgtcatcattgatggaggctggaccttgtga

SEQ ID NO: 61946 - protein, 245 aa, Canis familiaris
MGRLDGKVIVLTAAAQGIGRAAALAFAREGAKVIATDINESKLQELEKYPGIQTRTLDVTKKKQIDQFANEIGRLDVLFNVAGFVHHGTILDCEEKDWDFSMNLNIRSMYLMIKAFLPKMLAQKSGNIINMSSVASSIKGVENRCVYSTTKAAVIGLTKSLATDFIQQGIRCNCVCPATVDTPSLQERIQARPNTEEALNYFLKRQKIGRFATAEEIALLCVYLASDESAYITGNPVIIDGGWTL

SEQ ID NO: 61947 - DNA, 744 bp, Desulfovibrio vulgaris subsp. vulgaris str. Hildenborough; identical to SEQ ID NO: 7384
  CDS (1)..(744): transl_table=11

SEQ ID NO: 61948 - protein, 247 aa, Desulfovibrio vulgaris subsp. vulgaris str. Hildenborough; identical to SEQ ID NO: 7385

SEQ ID NO: 61949 - DNA, 777 bp, Desulfovibrio vulgaris subsp. vulgaris str. Hildenborough
  CDS (1)..(777): transl_table=11
atgttttcagggatgcaagacagaagagtgatggtgaccggttctgccaaaggaatcggcaagggcatagccgaagccttcgcctctcgaggagcgcgcgtattcctcgccgacctttccgcggagcatgtcgaggccacaggcaatgcgttcagggcaaaggggtacaacgtcgcatggggcgttgccgatgtgaaggacaaggcttctgtggaacaggtcgcgagcaaggccgtggaacaactcggcgggttggatgtgctatgcgccaatgcgggcatctttcccgctgcaccgctggagaccatgaccgaagaacagtgggacacggtgctcgacgtgaacctcaagggcatgttccttacggtgcaggcctgcataccggcactgaaagagagcacgtcggggcgcattgtggtcacatcgtcaatcaccggccccgtgacaggctatccggggtggtgccactatggcgcgagcaaggcggggcagatgggcttcatccgcaccgcagccatcgaactggcgagatacggcataaccatcaacgcagtccaacccggcaacatcgccacggaagggcttcaggaacagggagaggcctatatggcctccatggcttcttccatccccctgcggcggcttggcctccctgccgacatcgcagcggcggccgtctttctcgcctctcctgacgcggggtacatcaccgggcagggcatcatcgtcgatggcgggcaaatcctcccagagacactcgaagcgcttgatgcgtaa

SEQ ID NO: 61950 - protein, 258 aa, Desulfovibrio vulgaris subsp. vulgaris str. Hildenborough
MFSGMQDRRVMVTGSAKGIGKGIAEAFASRGARVFLADLSAEHVEATGNAFRAKGYNVAWGVADVKDKASVEQVASKAVEQLGGLDVLCANAGIFPAAPLETMTEEQWDTVLDVNLKGMFLTVQACIPALKESTSGRIVVTSSITGPVTGYPGWCHYGASKAGQMGFIRTAAIELARYGITINAVQPGNIATEGLQEQGEAYMASMASSIPLRRLGLPADIAAAAVFLASPDAGYITGQGIIVDGGQILPETLEALDA

SEQ ID NO: 61951 - DNA, 738 bp, Bartonella henselae str. Houston-1
  CDS (1)..(738): transl_table=11
atgtttaaattaacaggtcgtaaagctcttgtgacgggagcaacgggaggaattggtgaggcaattgcgcgttgtttccatgcacaaggggcaattgttgggctccatggaacacgtgaagacaagctgaaagaaattgctgcagatttaggaaaagatgtttttgtgttctctgccaatctttctgaccgtaaatccattaagcaactggctgaagttgcggaaagagaaatggagggtatcgatatcttggttaacaatgctggaatcacccgagatggtctttttgttcgtatgcaggatcaagactgggatgatgtcttagcagtcaatctaacagctgcttctactttgacacgtgaattgatacattcgatgatgcgccgtcgctacggacggattattaacataacatctattgttggtgttgtcggaaatcctgggcaaacgaattattgtgctgcaaaagctggtttgataggtttttctaaagcattggcacaagaaattgcttcacgaaatatcactgtcaattgtattgctccaggattcattaaatctgcaatgacagacaaactgaatgaaaagcaaaaagaagctattatggctatgattccaatgaaacgtatgggaataggggaagaaatagcttttgctactgtttatttagcgagtgatgaagcggcatatctgacaggtcaaacacttcatatcaatggtgggatggcaatgatctga

SEQ ID NO: 61952 - protein, 245 aa, Bartonella henselae str. Houston-1
MFKLTGRKALVTGATGGIGEAIARCFHAQGAIVGLHGTREDKLKEIAADLGKDVFVFSANLSDRKSIKQLAEVAEREMEGIDILVNNAGITRDGLFVRMQDQDWDDVLAVNLTAASTLTRELIHSMMRRRYGRIINITSIVGVVGNPGQTNYCAAKAGLIGFSKALAQEIASRNITVNCIAPGFIKSAMTDKLNEKQKEAIMAMIPMKRMGIGEEIAFATVYLASDEAAYLTGQTLHINGGMAMI

SEQ ID NO: 61953 - DNA, 741 bp, Bacillus thuringiensis serovar konkukian str. 97-27
  CDS (1)..(741): transl_table=11
atggagtttttaaacgggaaaacagctgttgtaacaggagctgcacagggaattggaaaagagattgcaagggtgtatgcaaaactaggggcgaaagtattaattagcgatgtaaatgaagagaagttacaaaaaacgacacgtgagttcttggatgaaggatatgaagtgagcttatatcgatgtgatgtgagtaatcaaaatgaagcgaagtcgttaattgaatatgcggttcaaaaattcggtacattacatattttggtgaataacgctggaattacaagagatgccatgttacataaaatggagaagtcttcttgggaacaagtactgcaagtaaacttaaccggtgttttttattgcatgcaaccagcacttctttatatgagacaacaaggatatggaagaattattaatatttcttctataagtagagaggggaatattgggcaggcaaattatgctgcaacgaaagctggagttgtcggtttaacgaaaacggcagcgaaagaagttggaagtttcggtattacgtgtaatgcaatttgcccaggatttatggatacagatatgacaaaaacgataccagataaagtgaaagaaaagatggtcggcgcgattccagttggtagaattggaacgccagaagatattgcgaacgcagctgcctttttagcatcagaatatgcatcctatattacaggagaagtattaaatgtgagcggaggactgcaagtttaa

SEQ ID NO: 61954 - protein, 246 aa, Bacillus thuringiensis serovar konkukian str. 97-27
MEFLNGKTAVVTGAAQGIGKEIARVYAKLGAKVLISDVNEEKLQKTTREFLDEGYEVSLYRCDVSNQNEAKSLIEYAVQKFGTLHILVNNAGITRDAMLHKMEKSSWEQVLQVNLTGVFYCMQPALLYMRQQGYGRIINISSISREGNIGQANYAATKAGVVGLTKTAAKEVGSFGITCNAICPGFMDTDMTKTIPDKVKEKMVGAIPVGRIGTPEDIANAAAFLASEYASYITGEVLNVSGGLQV

SEQ ID NO: 61955 - DNA, 735 bp, Erwinia carotovora subsp. atroseptica SCRI1043
  CDS (1)..(735)
atgagttttgaggggaaaattgcactggttaccggtgcaagccgtggtatagggcgtgccatcgccgagacgttggttgctcgcggggcaaaagtcattggtactgcaaccagcgaaaaaggtgctgaagccattagcagctggctgggtgagaacggtaaaggttatatgctgaatgttgctgatgcagcatcagtagaaagcgtgttagcagaaattcgcgcagaattcggggaaattgatattcttatcaataacgcgggtatcacccgtgataacctgctgatgcgtatgaaagatgatgaatggcacgatattctggataccaatttgacctcggtattccgtatgtctaaagcagttatgcgtgccatgatgaagaaacgttttggccgtatcattaccatcggttccgttgtgggaacgatgggcaatgcaggacaagctaactacgcggcagcgaaggcggggctgattgggttcagcaaatccctcgcgcgtgaagtggcttctcgtggtattacggtcaacgtggtcgcgcctggttttatcgaaacagatatgactcaggcattgacagaagaacagcgagcaggcattttgacgtcggttccagctaaccgactcggtgatgctaaagaaatcgccagtgctgttgtatttttagcctctgatgaagctgcttacattactggcgaaacattgcatgtcaacggcggcatgtatatgatctaa

SEQ ID NO: 61956 - protein, 244 aa, Erwinia carotovora subsp. atroseptica SCRI1043
MSFEGKIALVTGASRGIGRAIAETLVARGAKVIGTATSEKGAEAISSWLGENGKGYMLNVADAASVESVLAEIRAEFGEIDILINNAGITRDNLLMRMKDDEWHDILDTNLTSVFRMSKAVMRAMMKKRFGRIITIGSVVGTMGNAGQANYAAAKAGLIGFSKSLAREVASRGITVNVVAPGFIETDMTQALTEEQRAGILTSVPANRLGDAKEIASAVVFLASDEAAYITGETLHVNGGMYMI

SEQ ID NO: 61957 - DNA, 762 bp, Propionibacterium acnes KPA171202
  CDS (1)..(762): transl_table=11
atgactggattgcttgctggtcgtaccgcgctggtgaccggtggaaccgctggaataggtcgcggaatcgcggaggtactcgcactccacggcgcccgtgtcgcggtgactggtgtgaccgaggaaaggtgtgctcaggcgcgcgaagacggactcgatgtgtaccaactcgacgtgcgggacaagaaagcctgcattcgcgtggtgaatgatgttgctgccgagtgtggtggcctgtccgtgctcgttgctaacgctggtgtgtatccccaggtccgtctcgccgatcttgacgatgaccaaattgacttcatctttgacgtgaatgtgaaagggatgatgcacgtcgtccaagcggcaacgccagccctgcgtgaatctggtcgcgggcgcatcgtggtcacgtcgtcgatcactggcaacatcaccggctacccggggtggtcccactacggcgccaccaaggcggcacagatgggattcatccgctcggccgcgatggagctggcaggcgacaagatcaccatcaacgccgtgatgccgggcaatattatgaccccaggtctgaaggcgctcggtgatgattacctcgccgagatggcgaagtctgtgccgctggggatgctgggcgaggcgaaggacatcggtgaggcagtggcgtatctcgcctcggatggggcgcgctatgtgaccggtcagtcgatcgtggtggatggcggacaggtcctgcctgaggggccggaggcgcttgcggaaatgtaa

SEQ ID NO: 61958 - protein, 253 aa, Propionibacterium acnes KPA171202
MTGLLAGRTALVTGGTAGIGRGIAEVLALHGARVAVTGVTEERCAQAREDGLDVYQLDVRDKKACIRVVNDVAAECGGLSVLVANAGVYPQVRLADLDDDQIDFIFDVNVKGMMHVVQAATPALRESGRGRIVVTSSITGNITGYPGWSHYGATKAAQMGFIRSAAMELAGDKITINAVMPGNIMTPGLKALGDDYLAEMAKSVPLGMLGEAKDIGEAVAYLASDGARYVTGQSIVVDGGQVLPEGPEALAEM

SEQ ID NO: 61959 - DNA, 780 bp, Streptococcus pyogenes MGAS10394
  CDS (1)..(780): transl_table=11
atgacacatactaaagaagttgcatttatcactggtgctgcaagcggaattggaaaacaaatcggggaaaccttattaaaagaaggtaaaacggttgttttttctgacattaatcaagaaaaactggatcaggttgttgctgactatactaaagaaggctatgacgcttttagtgttgtgtgcgatgtcaccaaagaagaagccatcaatgctgctattgatacggttgttgaaaaatatggtcgtattgatattttggttaacaacgcaggccttcaacatgttgccatgattgaagattttccaactgaaaaatttgaattcatgattaaaatcatgttgacagcaccatttattgccattaaacgtgcttttcctacaatgaaagctcaaaaacacggtcgtattattaatatggcttctatcaatggtgtcattggttttgctggcaaatccgcctacaattcagctaagcacggcttgatcggtctgaccaaagtaactgccttagaagctgctgattcaggcattacggtcaatgccatttgtcctggatatgttgacacaccactggttcgtggccagtttgaagacctttccaaaacaagaggtattccccttgaaaatgttcttgaagaagtgccatacccacttgttcctcaaaaacgcctcattgacgttcaagaaattgcagactatgtgtctttccttgccagtgataaggcaaaaggtgttacaggtcaagcctgtatcttagacggtggctacactgctcaataa

SEQ ID NO: 61960 - protein, 259 aa, Streptococcus pyogenes MGAS10394
MTHTKEVAFITGAASGIGKQIGETLLKEGKTVVFSDINQEKLDQVVADYTKEGYDAFSVVCDVTKEEAINAAIDTVVEKYGRIDILVNNAGLQHVAMIEDFPTEKFEFMIKIMLTAPFIAIKRAFPTMKAQKHGRIINMASINGVIGFAGKSAYNSAKHGLIGLTKVTALEAADSGITVNAICPGYVDTPLVRGQFEDLSKTRGIPLENVLEEVPYPLVPQKRLIDVQEIADYVSFLASDKAKGVTGQACILDGGYTAQ

SEQ ID NO: 61961 - DNA, 765 bp, Symbiobacterium thermophilum IAM 14863
  CDS (1)..(765): transl_table=11
atgcagctcttctcgctggaaggccgggtcgccctggtgaccggggctgggcgggggatcggccgggccctggcgctgggcctggcggacgccggggcggacgtggtttgcctggccaggaccggctccgaggtggaggccgcggcggaggaggtccgggccaggggccgccgggcgctggcggtgaccgcagacgtgacgagccaggcgcaggtgacggaggccgtcgaggcggccctggaccggttcggcaagatcgacatcctggtgaacaacgcgggcatcaacatccgcaagccggcgctggaggtggcggaggcggactgggaccgggtggtgcagaccaatctgaagggtcccttcctggtcgcccagacggtgggccggcacatgtgcgagcggggctacggccggatcatcaacgtcgcatcggtaggcggagcggtggcgctgcgcaccggggttgcctacggcgccagcaaggcggggctgatgcacatgacccgtatcctggccatggagtgggcccggtacggggtgacggtgaacggcatcggcccctggtacttccgcacgccgctgacggagaagctgctgcaggacgaacagtacgtggcggagattctggcccgcacgccgatgcggcgcatcggcgacctggcggagctggtggggccggtggtgttcctcgcgtcggacgcgtccagctacgtcaccgggcaggtgctgatggtggacgggggcatgtctgtctacgggttctga

SEQ ID NO: 61962 - protein, 254 aa, Symbiobacterium thermophilum IAM 14863
MQLFSLEGRVALVTGAGRGIGRALALGLADAGADVVCLARTGSEVEAAAEEVRARGRRALAVTADVTSQAQVTEAVEAALDRFGKIDILVNNAGINIRKPALEVAEADWDRVVQTNLKGPFLVAQTVGRHMCERGYGRIINVASVGGAVALRTGVAYGASKAGLMHMTRILAMEWARYGVTVNGIGPWYFRTPLTEKLLQDEQYVAEILARTPMRRIGDLAELVGPVVFLASDASSYVTGQVLMVDGGMSVYGF

SEQ ID NO: 61963 - DNA, 744 bp, Bacillus licheniformis ATCC 14580
  CDS (1)..(744): transl_table=11
atgctggaaaataaaacagccgttgtgacaggagcctcaagaggaatcggccgcgcgatcgccctggacctggcgaaaaacggagcaaatgtcgtcgtcaactacgcgggaaatgaagcgaaagcgaacgaagtcgtagacgaaatcaaagcgctcggccgcgatgcgtttgcttttaaagcggacgtttccaatgcggatgaggttcaggcgatgatgaaggaagcggtcggacgcttcggcacgcttgacatccttgtcaacaatgcgggcattactaaagacaatctgttcatgagaatgaaagaagatgaatgggacgacgtcattaacataaacttaaaaggtgtgttcaattgttcaaaagctgtgacaagacagatgatgaaacaaagaagcggccggatcatcaatatcacctcggttgtaggcgtcgtcggtaacgccgggcaggccaactatgtcgcggctaaatcaggcgtgatcggcttgacgaaaacgctggcaaaagaactggcgtcaagaaacatcactgtgaatgcgatcgctccgggattcatttcgacggaaatgacggacaagctgacaaaagacattcaagacgaaatgctgaagcagattccgcttgcgcggttcggcgagccgtctgacatcagcagcgccgttgttttcctcgcatctgaccatgcgagctacatgaccggccagacgctgaacatcaacggcggaatggctatggtttaa

SEQ ID NO: 61964 - protein, 247 aa, Bacillus licheniformis ATCC 14580
MLENKTAVVTGASRGIGRAIALDLAKNGANVVVNYAGNEAKANEVVDEIKALGRDAFAFKADVSNADEVQAMMKEAVGRFGTLDILVNNAGITKDNLFMRMKEDEWDDVININLKGVFNCSKAVTRQMMKQRSGRIINITSVVGVVGNAGQANYVAAKSGVIGLTKTLAKELASRNITVNAIAPGFISTEMTDKLTKDIQDEMLKQIPLARFGEPSDISSAVVFLASDHASYMTGQTLNINGGMAMV

SEQ ID NO: 61965 - DNA, 747 bp, Bacteroides fragilis YCH46
  CDS (1)..(747): transl_table=11
atgggattattagatggaaaaacagccattgtgaccggtgcggctcgtggtattggtaaagctattgctttgaaatttgcttctgaaggagcaaatattgcatttacagatcttgttatcgatgagaatgcacagaatacagcaaaagaaatcgaagcaatgggtgtgaaagccaaaggatatgcgtcgaatgctgccaattttgaagatactgcaaaagtagtggaagagattcataaagatttcggccgtatcgatattctggtaaacaatgcaggtatcactcgtgacggattgatgatgcgtatgagcgaacagcagtgggatatggttattaatgtgaacctgaaatctgcttttaactttgtgcatgcgtgtactccgatcatgatgcgccagaaagccggaagcattattaatatggcttctgtagtgggtgttcacggtaatgccggacaagctaactattcagcttcaaaagcaggtatgattggtttggctaaatctatcgctcaggagcttggctctcgtggtatccgtgccaatgccattgctccgggattcatcattactgacatgacagccggcctttcggaagaagtgaaaacagaatgggctaagaagattccattgcgtcgtggcggtactcctgaagatgtggctaacatcgctactttccttgcttctgatatgtcttcttatgtatcaggtcaggtgattcaggtagatggtggtatgaatatgtaa

SEQ ID NO: 61966 - protein, 248 aa, Bacteroides fragilis YCH46
MGLLDGKTAIVTGAARGIGKAIALKFASEGANIAFTDLVIDENAQNTAKEIEAMGVKAKGYASNAANFEDTAKVVEEIHKDFGRIDILVNNAGITRDGLMMRMSEQQWDMVINVNLKSAFNFVHACTPIMMRQKAGSIINMASVVGVHGNAGQANYSASKAGMIGLAKSIAQELGSRGIRANAIAPGFIITDMTAGLSEEVKTEWAKKIPLRRGGTPEDVANIATFLASDMSSYVSGQVIQVDGGMNM

SEQ ID NO: 61967 - DNA, 744 bp, Burkholderia mallei ATCC 23344
  CDS (1)..(744): transl_table=11
atggaagcaagactggctggcaagacggcgctcgtcacggccgccgcgcagggcatcggccgcgcgtcggccgagcggctcgcgcgcgagggtgcgcgcgtgatcgcgacggacatccgcatcgacgcgctgcgcgacggcccgttcgatgcgcgcgtgctcgacgtgcgcgacggcgcggcgatcgacgcgctcgccgatgcgatcggccccgtcgacgtgctgttcaattgcgcgggcttcgtgcacgcgggctcggtgctcgacgcgaccgaagacgaatgggacttcggcttcgatctgaacgtgaagtcgatgtaccggacgatccgcgcgttcctgcccgcaatgctcgcgcgcgagcgcggctcgatcatcaacatggcgtcggccgcctcgagcgtgaagggcgtaccgaaccggtgcgtctacggcgcgacgaaggcggccgtgatcggcttgacgaaagcggtcgcggccgatttcgtcacgcacgggattcgctgcaatgcgatttgccccggcaccgtcgaatcgccgtcgctcgatgcgcgcatcgccgagcaggcgcgcgcgcgcggcgagccgatcgacgcggtgcgcgccgcgttcgtcgcgcgccagccgatggcgcgcatcggcaggccgcaggagatcgcggcgcttgtcgcgtatctcgcgtccgacgaggcgtcgttcacgacgggggcgatccatctgatcgacggcggctggtcgaactga

SEQ ID NO: 61968 - protein, 247 aa, Burkholderia mallei ATCC 23344
MEARLAGKTALVTAAAQGIGRASAERLAREGARVIATDIRIDALRDGPFDARVLDVRDGAAIDALADAIGPVDVLFNCAGFVHAGSVLDATEDEWDFGFDLNVKSMYRTIRAFLPAMLARERGSIINMASAASSVKGVPNRCVYGATKAAVIGLTKAVAADFVTHGIRCNAICPGTVESPSLDARIAEQARARGEPIDAVRAAFVARQPMARIGRPQEIAALVAYLASDEASFTTGAIHLIDGGWSN

SEQ ID NO: 61969 - DNA, 834 bp, Burkholderia mallei ATCC 23344
  CDS (1)..(834): transl_table=11
atgaacggcgtcgattcgaggcgcgcggcaccgccgcgcggcgggctcgccgccgattttcgcggccgcaccgcgctcgtgacgggcgcggcgcagggcatcggcgcggcgatcgccgatgcgttcgccgccgccggcgcgagtgtcgcgatcgcggatgtgcagggcgacgcggcggccgcgttcgccgcgcggcttgccgcgcgaggcgccgccgatgggcagacggtgcgcgcgtaccgcgtcgacgccgcgcggcgcgacgaactgttcgggctcgtcgcgcaggcggaggcggatagcgggcggctcgacatcgtcgtgcacaacgccgcgtactttccgctgacgccgttcggcgcgatcgcgcccgacgtgcttgagcgcacgctggcggtcaatctgtccgcgctgttctggctcacgcaggcggcgctgccggcgttcgagcgcgtggggcgggggcgcgtgctggcgacgtcgtcggtgacggggccgcgcgtcgcgtacccggggcttgcgcactacgcggcgtcgaaggcgggggtgaacggcttcatccgcgcggcggcgctcgagctcgcgcgccggaacgtgaccgtcaacggtgtcgagccgggaatgatccgcacgccggccgccggcaatctcggcgatgcggcgcacggcgagcgcatcgcgcgcggcgtgccgctcggccgcctcggcgagccggaggacatcgcggccgcgatgctgtttctcgcgtccgacgcggcgggctacatcaccgggcagacgatcgtcgtcgacggcggcgcgacgctgccggagaccgccgcagcgctcggatag

SEQ ID NO: 61970 - protein, 277 aa, Burkholderia mallei ATCC 23344
MNGVDSRRAAPPRGGLAADFRGRTALVTGAAQGIGAAIADAFAAAGASVAIADVQGDAAAAFAARLAARGAADGQTVRAYRVDAARRDELFGLVAQAEADSGRLDIVVHNAAYFPLTPFGAIAPDVLERTLAVNLSALFWLTQAALPAFERVGRGRVLATSSVTGPRVAYPGLAHYAASKAGVNGFIRAAALELARRNVTVNGVEPGMIRTPAAGNLGDAAHGERIARGVPLGRLGEPEDIAAAMLFLASDAAGYITGQTIVVDGGATLPETAAALG

SEQ ID NO: 61971 - DNA, 780 bp, Burkholderia pseudomallei K96243
  CDS (1)..(780): transl_table=11
gtgaaccggctcgcgggcaaggtcgcgatcgtgacgggcgcggggcgcggcatcggcgcggcgatcgcgcgcgcgttcgtgcgcgaaggcgcggccgtcgcgatcgcggagctcgacgcggcgctcgccgaagagagcgccgacgcgatcgcgcgcgacacggccggcgcgcgggtgctcgcggtgccgacggacgtcgcgcaggccgagtcggtcgcggcggcgctcgcgcgcacggagcgcgcattcggcccgctcgacgtgctcgtgaacaacgccggcgtcaacgtgttcggcgatccgctcgcgctcaccgacgaagactggcggcgctgcttcgcgatcgatctcgacggcgtctggaacggctgccgcgcggcgctgcccggcatggtcgagcgcgggcgcggcagcatcgtgaacatcgcgtcgacgcatgcgttcaagatcattccgggctgtttcccgtacccggtcgcgaagcatggcgtgctgggcctcacgcgcgcgctcggcatcgaatacgcgccgcgcaacgtgcgcgtgaacgcgatcgcgcccggctacatcgagacgcagttgacgcatgactggtggagcgcgcagcccgatccgcaggccgcgcgccgcgagacgctcgcgctgcagccgatgaagcggatcgggcgtcccgacgaagtcgcgatgaccgcggtattcctcgcgtcggacgaagcgccgttcatcaacgcgagctgcatcacgatcgacggcggccgctcggtgctgtaccacgactga

SEQ ID NO: 61972 - protein, 259 aa, Burkholderia pseudomallei K96243
MNRLAGKVAIVTGAGRGIGAAIARAFVREGAAVAIAELDAALAEESADAIARDTAGARVLAVPTDVAQAESVAAALARTERAFGPLDVLVNNAGVNVFGDPLALTDEDWRRCFAIDLDGVWNGCRAALPGMVERGRGSIVNIASTHAFKIIPGCFPYPVAKHGVLGLTRALGIEYAPRNVRVNAIAPGYIETQLTHDWWSAQPDPQAARRETLALQPMKRIGRPDEVAMTAVFLASDEAPFINASCITIDGGRSVLYHD

SEQ ID NO: 61973 - DNA, 738 bp, Methylococcus capsulatus str. Bath
  CDS (1)..(738): transl_table=11
atgacggaccagatagccattgtcacgggggccagccgaggaatcgggcgggcgatcgcccatcgtttggcgcaggccggtcatacggtcgtaggcaccgccacctcggaagacggagccgcagcgatcggatccgcgctcaccgatgccggcctgaacggctgcgggcgggtgctggacgtgagcgatcccgcttcggtcgaggccttcgtggccgccgtcagcgatgaattcggcataccgacgatcctggtcaacaacgccggcattacccgtgacggtctgctgatgcgtatgaaagatgaagactgggatgcgatcatcgacaccaatttgtcttccgtctaccgcatgagcaaggcttgcctcaaaggcatgatgaaggcccgtaccggccgcattgtcaacatcacttcggtcgtggggttgaccggtaatgccgggcagaccaactatgcggcggccaaggccggtatcatcggtttcaccaaatccctggccaaagagattggctcgcgcggcattacggtgaattcggtggcgccgggcttcatcgataccgatatgacccgcgctcttccggaggcacacaagacggccctgctggcgtcgattcccctgggacggctgggacaggccgaggagattgcgggggccgtggcttttctgtgctccgacgacgccgcttacatcaccggagaaaccctccatgtcaatggcggtatgttcatgccctga

SEQ ID NO: 61974 - protein, 245 aa, Methylococcus capsulatus str. Bath
MTDQIAIVTGASRGIGRAIAHRLAQAGHTVVGTATSEDGAAAIGSALTDAGLNGCGRVLDVSDPASVEAFVAAVSDEFGIPTILVNNAGITRDGLLMRMKDEDWDAIIDTNLSSVYRMSKACLKGMMKARTGRIVNITSVVGLTGNAGQTNYAAAKAGIIGFTKSLAKEIGSRGITVNSVAPGFIDTDMTRALPEAHKTALLASIPLGRLGQAEEIAGAVAFLCSDDAAYITGETLHVNGGMFMP

SEQ ID NO: 61975 - DNA, 735 bp, Photobacterium profundum SS9; identical to SEQ ID NO: 7394
  CDS (1)..(735): transl_table=11

SEQ ID NO: 61976 - protein, 244 aa, Photobacterium profundum SS9; identical to SEQ ID NO: 7395

SEQ ID NO: 61977 - DNA, 807 bp, Haloarcula marismortui ATCC 43049
  CDS (1)..(807): transl_table=11
atgctggaggctaccagagcaccaagcgtacgcatgagtgtacttgacagtttctccctcgacggagagacagctatcgtcaccggtgcggcgcaggggctcggcaaacagatggcgaccggtctcaccgatatgggggccgacgtcgctatcgcggacgtgaacgttgagaaagcggagcggacggcctcggaactggacggcgagacggacgtcatcgcgacggaggtcgacgtgacggacgaaggctcggtcgaggcgatggtcgaggatgtgaccgaccgcttggggccaattgacgtcttggtcaataacgccggcatcgtcgagaactccccggcggaggagacgagcgtcgagtcctggcggcgggtcgtgtcggtcaacctcgacggcgtctttctctgtgccaaacacgtcggtcaacagatgctcaaccgcggtgagggacgcatcgtcaacatctcctcaatgtcggggttcgacgtgaacgtcccacagaaacaggccagttacaacacgacgaaagccggcgtcaggatgctgacccagtcgctggcggtcgagtggggcgatcagggcgtccgcgtcaacgctattgcgcccgggtacatgcggaccgaactcgtcgacgaggtgctcgaagagaacccggagatggaggagacctggctggagaacacgccgatgggccgtctcggtcgaccagaggagctgaaagagctcgtcgtctacctcgcgtcggacgcctcgtcgtacatgacggggtcgaccgtcgtgatggacggcggctacacctcgcggtaa

SEQ ID NO: 61978 - protein, 268 aa, Haloarcula marismortui ATCC 43049
MLEATRAPSVRMSVLDSFSLDGETAIVTGAAQGLGKQMATGLTDMGADVAIADVNVEKAERTASELDGETDVIATEVDVTDEGSVEAMVEDVTDRLGPIDVLVNNAGIVENSPAEETSVESWRRVVSVNLDGVFLCAKHVGQQMLNRGEGRIVNISSMSGFDVNVPQKQASYNTTKAGVRMLTQSLAVEWGDQGVRVNAIAPGYMRTELVDEVLEENPEMEETWLENTPMGRLGRPEELKELVVYLASDASSYMTGSTVVMDGGYTSR

SEQ ID NO: 61979 - DNA, 744 bp, Haloarcula marismortui ATCC 43049
  CDS (1)..(744): transl_table=11
atgaacctggacaatcaaacctgtgtcgtcactgggtcctcacgcggtatcggtcgcggaatcgccaaagacctcggtgctcacggggccaacgtcgtcgttaactaccggtcctcggaggcggaagcccgtgccgtcgttgaggatatccgcgaacgcggtggcaccgctatcgcggcgcaggccgacgtggcgaaactcgatgaggtccgggcgatgcgtgagaaggtggccgacgagttcggtcccgcggacgtgctcgtcaacaatgccggcatcaccatcgacaaaaagttcgagaacatgacccgcgacgactgggagacggtgatcgatgtcaacctcggcggcgtgttcaacgggacgaaggctttctatgatgatattcgtgacgccgaccacggccgactcataaacatctctagcgtcgtcggccagcagggcaacatcgggcaggccaactatgcgacgacgaaatccgggttgttcggatttacacggacgcttgcgctcgaactggcacacacgggctcgaccgcgaactgcgtcgcgccgggctttgtcaagaccgatatgctagaggaggtgcccgaacgcgtgcaggagaagattctgcgggagattccgcttgaccggttcgcacgcgtcgaagacatcgccggcatcgtgaggttcgtcgccagcgaggaatcgagctacatgacaggacaggtacttggtgttaacggcgggatggagtggtag

SEQ ID NO: 61980 - protein, 247 aa, Haloarcula marismortui ATCC 43049
MNLDNQTCVVTGSSRGIGRGIAKDLGAHGANVVVNYRSSEAEARAVVEDIRERGGTAIAAQADVAKLDEVRAMREKVADEFGPADVLVNNAGITIDKKFENMTRDDWETVIDVNLGGVFNGTKAFYDDIRDADHGRLINISSVVGQQGNIGQANYATTKSGLFGFTRTLALELAHTGSTANCVAPGFVKTDMLEEVPERVQEKILREIPLDRFARVEDIAGIVRFVASEESSYMTGQVLGVNGGMEW

SEQ ID NO: 61981 - DNA, 735 bp, Streptococcus thermophilus LMG 18311
  CDS (1)..(735): transl_table=11
atggaacttaagaataaaaatgtttttgtaacaggttcaacacgtggtattggattagctgtggcacatcaatttgctagtcttggtgccaacattgtcctaaatggacgttctgaaatttctgaggatttgcttgcacaatttgtggactatggtgtaactgttgttggtatctcaggtgatatttctaatggtgaggatgctaaacgtatggtagcagaagccattgaaaaacttggaagtgttgatgtactagttaataatgctggtatcaccaacgataaattgatgttgaagatgactgaagaagattttgaacgcgtcttgaaaatcaacttgactggtgctttcaatatgacacaggcagtcttgaaaccaatgtctaaggctcgtcaaggtgccattatcaatatgtcatctgttgtaggtcttatgggaaatgttggtcaagctaattattcggcttcaaaagctggtttgattggtttcactaaatcagtagctcgtgaagttgcagctcgtggtgttcgtgttaatgctattgctcctggtttcattgagtctgatatgactgatgcaatcccagagaaaatgaaagacgctatgattgctcaagtaccaatgaaacgtattggtcaggcaaaagaagtggcagaagttgcggctttcttagcagggcaagagtatcttacaggtcaaacaatcgctattgatggtggtatgaccatgcaataa

SEQ ID NO: 61982 - protein, 244 aa, Streptococcus thermophilus LMG 18311
MELKNKNVFVTGSTRGIGLAVAHQFASLGANIVLNGRSEISEDLLAQFVDYGVTVVGISGDISNGEDAKRMVAEAIEKLGSVDVLVNNAGITNDKLMLKMTEEDFERVLKINLTGAFNMTQAVLKPMSKARQGAIINMSSVVGLMGNVGQANYSASKAGLIGFTKSVAREVAARGVRVNAIAPGFIESDMTDAIPEKMKDAMIAQVPMKRIGQAKEVAEVAAFLAGQEYLTGQTIAIDGGMTMQ

SEQ ID NO: 61983 - DNA, 744 bp, Geobacillus kaustophilus HTA426
  CDS (1)..(744): transl_table=11
atgctcgaaggaaaaattgctcttgtgaccggggcgtcgcgcggcattggccgggcggtcgctctggagcttgcccgccaaggggcgaacgttgccgtcaattacgccggcagcgaggcgaaagcgaatgaagttgtcgaggccatccgctcgctcggccgcgaagcgatcgccgtgcaggcggacgtcgcccgcgctgaagatgttgagcgcatggtgaaaacgacgattgaccattttggccgcctcgatattttggtcaacaacgccggcattacacgcgacaatttattgatgcggatgaaagaagaagaatgggatgccgtgattaacacgaacttaaaaggagtatttctttgtacgaaggcggcaacgcgcccgatgatgaagcagcgctatgggcggatcgtcaacattgcttcggtcgtcggcgtgatcggcaatccggggcaggcgaactatgtcgccgccaaggccggcgtcatcgggctgacgaagacggcggcgcgcgaattcgccagccgcaacatcaccgttaacgccgtcgcaccaggattcattacgaccgatatgaccgaagcgctcagcccggagctgaaggcggaaatgttaaagcaaattccgctcgcccgctttggcgagccggatgatgtcgcccgcgtcgtcgctttcctcgcttccgacgccgcgagctacatgactggacagacgcttcatgttgacggcggcatggtgatgccgtaa

SEQ ID NO: 61984 - protein, 247 aa, Geobacillus kaustophilus HTA426
MLEGKIALVTGASRGIGRAVALELARQGANVAVNYAGSEAKANEVVEAIRSLGREAIAVQADVARAEDVERMVKTTIDHFGRLDILVNNAGITRDNLLMRMKEEEWDAVINTNLKGVFLCTKAATRPMMKQRYGRIVNIASVVGVIGNPGQANYVAAKAGVIGLTKTAAREFASRNITVNAVAPGFITTDMTEALSPELKAEMLKQIPLARFGEPDDVARVVAFLASDAASYMTGQTLHVDGGMVMP

SEQ ID NO: 61985 - DNA, 738 bp, Idiomarina loihiensis L2TR
  CDS (1)..(738): transl_table=11
gtgcaaaactttgaaaataaagtcgcattagttacaggcgcaagccggggaataggaaaagcaatagctgaactgcttgctagtcagggagcgaaagtcattggtacagcgacctctgataaaggtgcagctgcaatctccgaatatcttggttcaaaaggcaagggcctggcgttggatgtaaccgattctgatagtctgcagcaggttattaaagagattgaatcagagtacggttctattgatattctggtgaataacgccggcattacccgcgataacctgatgatgcgaatgaaagacgacgaatgggatgctgtcttaaacacgaacttgtcagccgtatttaaagtttgtaaggcggttgtacgcggcatgatgaagcggcgtaatggccgtattattaatatcagttcagttgttggcacaacaggaaacccggggcaggttaactattgtgcggcgaaagccggactggttggtttcagtaaggcaatggctaaagaagttgcagcgcgcggcattaccgtgaactgtgttgcgcctggctttattgatacagatatgacaaaagctctgaatgatgagcaaaaacaggctatttttgataatattccggcagcacgtttaggcgagccaaaggaaattgctgctgcggtagcatttttagcatcagaaggtgcagcttatatcactggtgaaaccattcacgttaatggtggtatggcgatggtttaa

SEQ ID NO: 61986 - protein, 245 aa, Idiomarina loihiensis L2TR
MQNFENKVALVTGASRGIGKAIAELLASQGAKVIGTATSDKGAAAISEYLGSKGKGLALDVTDSDSLQQVIKEIESEYGSIDILVNNAGITRDNLMMRMKDDEWDAVLNTNLSAVFKVCKAVVRGMMKRRNGRIINISSVVGTTGNPGQVNYCAAKAGLVGFSKAMAKEVAARGITVNCVAPGFIDTDMTKALNDEQKQAIFDNIPAARLGEPKEIAAAVAFLASEGAAYITGETIHVNGGMAMV

SEQ ID NO: 61987 - DNA, 747 bp, Azoarcus sp. EbN1
  CDS (1)..(747): transl_table=11
atgggaattcagaacagggtcgcgctggtcaccggttcggcgagcggcatgggaaaacagacggcgctgcgcttcgccgagcgcggggcggcggtcgtcatcaacgacatcgacgcggagaaggtgcgcacgacggtcgatgagttcagccggcttgggcatcgcgtgctcggcacggtcgccgacatcagcaacaaggcggccgtcgatggcatggtgcagcagacggtcgaggcgttcggccgcatcgacatcctcgtcaataacgccggcatggagcgggcgggcgcgctgcgcaagttgagcgaggccgactgggacatcaccgtcgacgttaacctgaagggcacgttcctctgcacgcaggcggtgcatgggcacatggtcgagaacaagcacgggcgcatcgtcaatatcgcgtcccgcgcgtggctcggcggcgccggccagacgccgtactcatccgcgaaggctggtgtcgtcggcatgacgcgggcgctcgccatcgagcttgggcgctcggggatcacggtcaattgtgtcgcgccggggctgatccacacgccgatgtgggaggagctgccggagaaggaccggaatttcctgctgtcgcggcaacccaccggcaagctcggcgagcccgacgacatcgccaacacgctgctcttcctcgccgacgacgacaccggcttcgttaccggccaggtgctgtacgtgtgcggcgggcggagcctgttcgcgggctga

SEQ ID NO: 61988 - protein, 248 aa, Azoarcus sp. EbN1
MGIQNRVALVTGSASGMGKQTALRFAERGAAVVINDIDAEKVRTTVDEFSRLGHRVLGTVADISNKAAVDGMVQQTVEAFGRIDILVNNAGMERAGALRKLSEADWDITVDVNLKGTFLCTQAVHGHMVENKHGRIVNIASRAWLGGAGQTPYSSAKAGVVGMTRALAIELGRSGITVNCVAPGLIHTPMWEELPEKDRNFLLSRQPTGKLGEPDDIANTLLFLADDDTGFVTGQVLYVCGGRSLFAG

SEQ ID NO: 61989 - DNA, 738 bp, Silicibacter pomeroyi DSS-3
  CDS (1)..(738): transl_table=11
atgtttgatctgaccggaaagaatgccctgatcaccggtgcctcgggtggcatcgggggcgccatcgcgcgcgcgctgcatgctgccggcgcctcggtggtgctgtcgggcacccgggtcgagccgcttcaggcgctggccgacgagctgggcgaacgcgcccatgtgctgacctgcaatctgagcgatatggcggccgtcgaggcgctgccgaaacaggccgccgacctgttgggctcggtcgatatcctggtgaacaatgccggcatcacgcgcgacaacctgttcatgcgtatgtcggatgacgaatggcaaagcgtgatcgacgtcaacctgaccgccaccatgaaactgtgcaagggcgtgctgcgcggcatgatgaaggcgcgctggggccggatcgtgaatatctcgtctgtggtgggtgccatcggcaacccggggcagggcaattatgccgcctccaaggcgggtgtcgtcggcatgtccaaggcgctggcctatgaggtcgccagccggggaatcaccgtcaacgcggtggcaccgggctttatcaccacggcaatgaccgacaagctgacggatgagcagaaatcgggcctgctgacgcaggttcccgctggccgcatgggttcgcccgaggaaatcgcggcggcggtcctgtatcttgccagtcccgaggccgcttatgtgaccggtgccaccttgcatgtgaacggcggtatggccatgttgtga

SEQ ID NO: 61990 - protein, 245 aa, Silicibacter pomeroyi DSS-3
MFDLTGKNALITGASGGIGGAIARALHAAGASVVLSGTRVEPLQALADELGERAHVLTCNLSDMAAVEALPKQAADLLGSVDILVNNAGITRDNLFMRMSDDEWQSVIDVNLTATMKLCKGVLRGMMKARWGRIVNISSVVGAIGNPGQGNYAASKAGVVGMSKALAYEVASRGITVNAVAPGFITTAMTDKLTDEQKSGLLTQVPAGRMGSPEEIAAAVLYLASPEAAYVTGATLHVNGGMAML

SEQ ID NO: 61991 - DNA, 774 bp, Bacillus clausii KSM-K16
  CDS (1)..(774): transl_table=11
ttgaccgtatctaccatatttgatttatcgacgaaacatgcagtggtaactggcggtgcccaaggccttggttttacaatcgcaaagtcattagcggccttcggttgcgacatagccattgtagacattgacgctgaagctgctgcaaaggcagcacaagaaattacaactacttattcggtcaacacacagtcgattcaagcggatgtcagcaaagaggaagaagtcagcgccatggttgatcgtgtattggaatcatttccacaaatcgatgtgctcgtcaataacgcagggattgtaaagaaaatcgatacattggacatgacatacagcgattggaagcgaacgatggatgtgaacataaacgctttattcctaacatctaagcaggttggcaaacatatggtcgctaatgggtcaggctcgattatgaacatgtcttccatgtctgcgatgattgccaatcgggaagcacagagtgcgtacaatgcctctaaaggcgcggtcagtatgctgaccaaatcactcgcttcagaatgggcgcaatatgggatacgtgtcaatgcgatagcacctggctatatggcctcgcaaatgacagggccgttattcgcgcctggcggggagctcgaacacatcctagaacacgttccgatgaaacgccttggtcgtccagatgaattaagcggcatagctgtttatttagcatctgacgcatctagttttacaactggctccatcatcgttgtggatggcggctataccacatggtaa

SEQ ID NO: 61992 - protein, 257 aa, Bacillus clausii KSM-K16
MTVSTIFDLSTKHAVVTGGAQGLGFTIAKSLAAFGCDIAIVDIDAEAAAKAAQEITTTYSVNTQSIQADVSKEEEVSAMVDRVLESFPQIDVLVNNAGIVKKIDTLDMTYSDWKRTMDVNINALFLTSKQVGKHMVANGSGSIMNMSSMSAMIANREAQSAYNASKGAVSMLTKSLASEWAQYGIRVNAIAPGYMASQMTGPLFAPGGELEHILEHVPMKRLGRPDELSGIAVYLASDASSFTTGSIIVVDGGYTTW

SEQ ID NO: 61993 - DNA, 744 bp, Dehalococcoides ethenogenes 195
  CDS (1)..(744): transl_table=11
atgctgagtttagacggcaaaacagccctgattaccggctccggcaggggcataggcaaagctatagctttacggtttgccgaagcgggggcaaaagtggtggtaaacagcctttcgcccgccggtgaagaagtggccgcccacatacgttccaatggcggtcaggccgtatttgttcaggcagatgtaagccagagcagtggggtagatgccctcttcaaagccgcccaggaagccttcggcggggtagatatactggtaaacaatgccggcataacccgtgaccagctgaccatgcgtttatccgaagaagactgggacagtgtaatccagaccaacctgaaaagtgtatttttgtgttccaaagcagccctccgccagatgctgaaaaaccgctggggacggataataaaccttagttccatagtgggtttaaagggcaaccccggtcaggccaactatgccgcagccaaagccggcattctgggattcagctgctctctagctaaagaagtggccagccgcaatataaccgtgaattccattgcccccggttttatagaaaccgatatgaccgccgctttgtctgaagagcaaagacaggccataacagagcgtatacccatgcaaaaactgggcacagtggaagatgtagccgcttgtgcattatacttggcgaaagaagatgccaaatacattaccggacaggtaatcagcctggacggcggtatgtctataatataa

SEQ ID NO: 61994 - protein, 247 aa, Dehalococcoides ethenogenes 195
MLSLDGKTALITGSGRGIGKAIALRFAEAGAKVVVNSLSPAGEEVAAHIRSNGGQAVFVQADVSQSSGVDALFKAAQEAFGGVDILVNNAGITRDQLTMRLSEEDWDSVIQTNLKSVFLCSKAALRQMLKNRWGRIINLSSIVGLKGNPGQANYAAAKAGILGFSCSLAKEVASRNITVNSIAPGFIETDMTAALSEEQRQAITERIPMQKLGTVEDVAACALYLAKEDAKYITGQVISLDGGMSII

SEQ ID NO: 61995 - DNA, 744 bp, Xylella fastidiosa Ann-1
  CDS (1)..(744)
atgaacaaacccttacagggtgaggttgcgttagtgactggtgctagccgtggcatcggtgctgcagtggctgatattttggctgatcatggggctaccgtgattggtacggcaacgtctgcttctggtgcgcagttaattggtgatcgtttggccttgctgggtggtcatggtcgcgctctggatgtgaccgatactgctgcagttggtgcattggtagaggagattgctgaacaattcggttcggtctcgattctggttaataatgctggtataacacgagacaatctgttgatgcggatgaaggatgaggattgggagtccattgtcgacactaatctgagcagtatttttcgtaccagcagggcggtggttcgcgacatgatgaaggcgcgcaagggccgtatcatcaacattgcttcggttgttggcgtgactggtaatgccggtcaggcaaactatgctgcggccaaagctggtgttattggatttaccaagtcactggctaaggaagttggcccacgtgggatcactgtcaacgtggtcgctccggggtttatcgataccgacatgactcgtgtgctgtctgagggtctacgcaatgatatccttaaccacgtcccgcttggtcatttaggtgatccggtggatattgcgcacgcggtcgcttttctggctgctccagcagcacgctacattactggtgagacattacatgtcaacggtggtatgtatatgccgtga

SEQ ID NO: 61996 - protein, 247 aa, Xylella fastidiosa Ann-1
MNKPLQGEVALVTGASRGIGAAVADILADHGATVIGTATSASGAQLIGDRLALLGGHGRALDVTDTAAVGALVEEIAEQFGSVSILVNNAGITRDNLLMRMKDEDWESIVDTNLSSIFRTSRAVVRDMMKARKGRIINIASVVGVTGNAGQANYAAAKAGVIGFTKSLAKEVGPRGITVNVVAPGFIDTDMTRVLSEGLRNDILNHVPLGHLGDPVDIAHAVAFLAAPAARYITGETLHVNGGMYMP

SEQ ID NO: 61997 - DNA, 741 bp, Magnetospirillum magnetotacticum MS-1
  CDS (1)..(741)
atgttcgacctcaccggccgcaaggctctcgtcaccggcgcgaccggcggcctcggcggcgccatcgcccgtgcgcttcatgcccagggcgcccatgtcgcgctctccggcacccgccgggccgtgctcgaggaattggcggccgaactcggcggcgagcgcgtcgccgtggtcgaggccaacctcgccgacaaggaggcggtcgaggcgctgctgccggccgccgaatcggccctgggcggcctcgacatcctcgtgaacaatgccggcatcacccgcgacaacctcttcatgcggatgaaggacgaggagtgggaggcggtgctcaacgtcaacctgaccgccgccttccggctctcccgcgccgccctcaagggcatgatgagacgccgttacggccgcatcatcgggatcggctcggtggtcggcgccacgggtaatccgggccagggcaactacgccgccgccaaggcgggcctcgtcggcatgaccaaggcgctggcggcggaggtcgcgacgcgcaacatcacggtcaactgcatcgccccgggcttcatcacctcggcgatgaccgatgccctgaacgagaagcagcgcgagacgattctcacccgcgtgccggcgggacggctcggaaccggcgccgagatcggcgcggcggcggtctatctggcctcggaggaagcgggttacgtgacggggcaaacgctccacgtcaacggcggcatggccatgtactga

SEQ ID NO: 61998 - protein, 246 aa, Magnetospirillum magnetotacticum MS-1
MFDLTGRKALVTGATGGLGGAIARALHAQGAHVALSGTRRAVLEELAAELGGERVAVVEANLADKEAVEALLPAAESALGGLDILVNNAGITRDNLFMRMKDEEWEAVLNVNLTAAFRLSRAALKGMMRRRYGRIIGIGSVVGATGNPGQGNYAAAKAGLVGMTKALAAEVATRNITVNCIAPGFITSAMTDALNEKQRETILTRVPAGRLGTGAEIGAAAVYLASEEAGYVTGQTLHVNGGMAMY

SEQ ID NO: 61999 - DNA, 774 bp, Magnetospirillum magnetotacticum MS-1
  CDS (1)..(774)
atgatttccatcgaaggagccaaggaaatgaagttcgaggataaagtcgccctgatcaccggcggtgcgtcgggcatcggctattgcaccgtgaagtccatggccgaactgggcgccgatgtgctgatcgccgatatcaacgtggaagcgggcgagaaggctgcgaccgagctgaaggccaagggcctcaaggccgaattcgtgcgcctcgacgtcaccgacaaggctaatatcgcgcgtgtcaaggagcatgttctggccacccgcggccgcctcgacatcctgtgcaacgtggcgggctgggggcatatccagcccttcgttgataacgacgacgccttcatcgccaaggtcatgagcctcaatctcaccggccccatcgagttgatccgcgccttcttccccctgatgatcgagaagaagaccggcaagatcgtcaatgtggcctccgatgccgggcgggtgggaagcttgggcgaaagcgtctattcggcggccaagggcgggctgatttccttctccaaggccctggcccgcgagggtgcccgctacaacatcaacgtcaacgccatctgccccggccccaccgacacgccgctgttgaagtccgagccggaaaagttcctggaggccttcctcaaggtcattcccatgcgccgcttcggccaaccgcaggaagtggccgattccatcgtcttcatggcatccaaccgcgccgactacatcaccggccaggttctgtcggtcaacggcggcatcaccatggtgggctaa

SEQ ID NO: 62000 - protein, 257 aa, Magnetospirillum magnetotacticum MS-1
MISIEGAKEMKFEDKVALITGGASGIGYCTVKSMAELGADVLIADINVEAGEKAATELKAKGLKAEFVRLDVTDKANIARVKEHVLATRGRLDILCNVAGWGHIQPFVDNDDAFIAKVMSLNLTGPIELIRAFFPLMIEKKTGKIVNVASDAGRVGSLGESVYSAAKGGLISFSKALAREGARYNINVNAICPGPTDTPLLKSEPEKFLEAFLKVIPMRRFGQPQEVADSIVFMASNRADYITGQVLSVNGGITMVG

SEQ ID NO: 62001 - DNA, 759 bp, Azotobacter vinelandii
  CDS (1)..(759)
atgtccaaatacttggataaggcgttcgatctgcagggacgctgcgccatcgtcaccggaggggcagccggtatcggtctggcctgcgccagactgctcaccgaatgcggcgcacgagtcgccctgctcgatcgcaacccggcagtggaaaccgttgccgccggcttgggcagcggacacctcggcgtcgccctggacgtacgccagctcgatgagatccaggcagcagtggagcgcgtggtcgccgccttcggccaaatcgactatctggtcaacagtgcgggagtcgctcggctcgacaaggcgctggatgtcgacgaagaaagctgggatatcactctcgatataaatctcaaggccagcttcttcgctgcccaagcggtcgcgcggcacatgcgcgagcgtggcgccggacgcattgtcaatctcgcatcccaggcagccgtcatcggtctcgatcgccatgccgcctattgcgccagcaaggccgcgatagtcggcctgaccaaagtcttggcgatggaatgggccgagcatggcatcaccgtcaacgccgtatcgccgaccatcgtcgaaaccgagctgggcaagcaggcttgggcgggggaagtcggagagcgggccaaacagcagatccccgtgggccgcttcgcccaacccgaagaagttgccagcctggtgctttatctactcagcgacgcagcagcgatgatcactggtgaaaatgtggtcatcgatggcggctacaccatcaagtaa

SEQ ID NO: 62002 - protein, 252 aa, Azotobacter vinelandii
MSKYLDKAFDLQGRCAIVTGGAAGIGLACARLLTECGARVALLDRNPAVETVAAGLGSGHLGVALDVRQLDEIQAAVERVVAAFGQIDYLVNSAGVARLDKALDVDEESWDITLDINLKASFFAAQAVARHMRERGAGRIVNLASQAAVIGLDRHAAYCASKAAIVGLTKVLAMEWAEHGITVNAVSPTIVETELGKQAWAGEVGERAKQQIPVGRFAQPEEVASLVLYLLSDAAAMITGENVVIDGGYTIK

SEQ ID NO: 62003 - DNA, 747 bp, Nostoc punctiforme PCC 73102
  CDS (1)..(747)
atgacattattacaaggtaaagtcgcaattgtcacaggtgcatcacgagggattggcaaagcgatcgcaattgaattagcttcacaaggagcgatcgcagttgtcaattatgctagttcgagtgctgcggctgaggcagttgttacagaaattacagcagtgggaggtcaggcgatcgctatccaagcagacgtttctaaaggcgatcaagtagatgcactagttaacgccgtcatggaaaagtttagccgtgtggatatcttagtcaataacgcagggattacccgtgacacactgcttttgcgtttaaagccagaagattggcaagctgtgatagaccttaatctaactggtgttttcttatgtacacgcgccgtcagtaaaatcatgctcaaacagcgatcgggtcgaattattaacattacctccgttgctgggcagatgggcaacccaggtcagtccaactacagcgccgccaaagcaggtgtaatcggcttcaccaaaagcgtagccaaagaactggctactcgcggtattaccgttaacgccgtcgcccctggtttcatcactaccgatatgaccagcgatctcaataaccccgaagatatcctaaaatacatccccctcggtcgcttcggtcagcccgaagaagtcgctggaatggtgcgtttcctcgccgccgatcccgcagccaactatatcaccggacaagtttttaacgtcgatggcggaatggtcatggcttaa

SEQ ID NO: 62004 - protein, 248 aa, Nostoc punctiforme PCC 73102
MTLLQGKVAIVTGASRGIGKAIAIELASQGAIAVVNYASSSAAAEAVVTEITAVGGQAIAIQADVSKGDQVDALVNAVMEKFSRVDILVNNAGITRDTLLLRLKPEDWQAVIDLNLTGVFLCTRAVSKIMLKQRSGRIINITSVAGQMGNPGQSNYSAAKAGVIGFTKSVAKELATRGITVNAVAPGFITTDMTSDLNNPEDILKYIPLGRFGQPEEVAGMVRFLAADPAANYITGQVFNVDGGMVMA

SEQ ID NO: 62005 - DNA, 726 bp, Haemophilus somnus 129PT
  CDS (1)..(726)
atgcaaggaaaaatagcattagtaacaggtgctacacgtgggattgggcgtgcaatagcagaagaattagcgagcaagggggcttttgttattggtactgcaacaagcgaaaaaggagcggaaagtatttctgcttatttaggcaaacagggtaaaggtttggtattaaatgtcgcagatcaagattcaattgatgctgtattgagtgccattaaagctgaggtgggtgatgttgagattctagtgaataatgcaggaattacccgcgatggtttattaatgcgtatgaaagatgatgattggtttgatattatgcaaactaatttaacgtctatctatcgtttatctaaagctgtattacgtccgatgatgaaaaaaggtggacgcattattaatattggttcagtagttggctcaatgggaaatcccggtcaaactaactattgtgcggcaaaagcgggtgttattggctttacaaaatcgttagcaaaagaagttgcagcaagaggagtaactgtgaatgttgtagctccaggtttcattgcaacagatatgacggatgtgttaactgacgagcaaaaagcaaatattctgacaaatgtgccggcaggtcgtttgggacagccaaaagatattgcgaaagctgttgcatttttggcatcggaggatgcgtcatatattacaggtactacattacatgttaacggtggaatgtatttaccttag

SEQ ID NO: 62006 - protein, 241 aa, Haemophilus somnus 129PT
MQGKIALVTGATRGIGRAIAEELASKGAFVIGTATSEKGAESISAYLGKQGKGLVLNVADQDSIDAVLSAIKAEVGDVEILVNNAGITRDGLLMRMKDDDWFDIMQTNLTSIYRLSKAVLRPMMKKGGRIINIGSVVGSMGNPGQTNYCAAKAGVIGFTKSLAKEVAARGVTVNVVAPGFIATDMTDVLTDEQKANILTNVPAGRLGQPKDIAKAVAFLASEDASYITGTTLHVNGGMYLP

SEQ ID NO: 62007 - DNA, 765 bp, Pseudomonas syringae pv. syringae B728a
  CDS (1)..(765)
atgaatcgtttcacccaaaaagtcatcgtcgtcacaggtgccggttccggaatcggcgaagcgaccgccaaacgttttgccgaggaaggcgcgagcgtggtgctggtcggccgcaatcacgacaagctggccaaggtggccgcgcaactgaagggcgaagggcacttggtcagagccacggatgtggccgacccgagcgacgtggaagcgctgttcaaggaagtggcgacccgtttcgggcgtctggatgtgctggtcaacaatgccggcatcgtcaagtccggcaaagtgaccgagctgggcatagaggactggaaagagctgatgtccgtggacctggacggcgtgttctattgcacccgcaccgccatgccggcactgatcgccagcaaaggcaacatcatcaatgtctcgtcggtgtccggtctgggcggcgactggggcatgagcttctataacgcggccaagggtgccatcaccaacttcacccgttcgctggccatggatcatggtgctgacggcgtgcgtgtgaatgccgtttgcccctcactgacccgcagcgagctgaccgaagacatgctcggcgacaaagcgttgatggccaaattcatggagcgcatcccattggggcgcccgggtgaagccgaagacgtcggcgacgtgattgcctttctggccagcgatgacgcgcgcttcgtgaccggcgtcaacctgccggtagacggtggcctgtcggcgtccaacgggcagccgccgcaggcctga

SEQ ID NO: 62008 - protein, 254 aa, Pseudomonas syringae pv. syringae B728a
MNRFTQKVIVVTGAGSGIGEATAKRFAEEGASVVLVGRNHDKLAKVAAQLKGEGHLVRATDVADPSDVEALFKEVATRFGRLDVLVNNAGIVKSGKVTELGIEDWKELMSVDLDGVFYCTRTAMPALIASKGNIINVSSVSGLGGDWGMSFYNAAKGAITNFTRSLAMDHGADGVRVNAVCPSLTRSELTEDMLGDKALMAKFMERIPLGRPGEAEDVGDVIAFLASDDARFVTGVNLPVDGGLSASNGQPPQA

SEQ ID NO: 62009 - DNA, 729 bp, Haemophilus somnus 2336
  CDS (1)..(729)
atgatgcaaggaaaaatagcattagtaacaggtgctacacgtgggattgggcgtgcaatagcagaagaattagcgagcaagggggcttttgttattggtactgcaacaagcgaaaaaggagcggaaagtatttctgcttatttaggcaaacagggtaaaggtttggtattaaatgtcgcagatcaagattcaatagatgctgtattgagtgccattaaagctgaagtgggtgatgttgagattctagtgaataatgcaggaattacccgtgatggtttattaatgcgtatgaaagatgatgactggtttgatattatgcaaactaatttaacgtctatctatcgtttatctaaagctgtattacgtccgatgatgaaaaaaggtggacgcattattaatattggttcagtagttggctcaatgggaaatcccggtcaaactaactattgtgcggcaaaagcgggtgttattggctttacaaaatcgttagcaaaagaagttgcagcaagaggagtaactgtgaatgttgtagctccaggtttcattgcaacagatatgacggatgtgttaactgacgagcaaaaagcaaatattctgacaaatgtgccggcaagtcgtttgggacagcccaaagatattgcgaaagctgttgcatttttggcatcggaggatgcgtcatatattacaggtactacattacatgttaacggtggaatgtatttaccttag

SEQ ID NO: 62010 - protein, 242 aa, Haemophilus somnus 2336
MMQGKIALVTGATRGIGRAIAEELASKGAFVIGTATSEKGAESISAYLGKQGKGLVLNVADQDSIDAVLSAIKAEVGDVEILVNNAGITRDGLLMRMKDDDWFDIMQTNLTSIYRLSKAVLRPMMKKGGRIINIGSVVGSMGNPGQTNYCAAKAGVIGFTKSLAKEVAARGVTVNVVAPGFIATDMTDVLTDEQKANILTNVPASRLGQPKDIAKAVAFLASEDASYITGTTLHVNGGMYLP

SEQ ID NO: 62011 - DNA, 726 bp, Actinobacillus pleuropneumoniae serovar 1 str. 4074
  CDS (1)..(726)
atgcaaggtaaaatcgcattagttacgggtgcaactcgtggtattggtaaagctatcgcagaagaattagcggcaaaaggtgcaaccgtgattggtacggcaacatcggaaaaaggtgcggaaagcatttccgcatacttaggcgaacacggtaaaggtttagtattaaacgtaacggatgcagactctattgaagcggtattagcacaaatcaaagcggatttcggcgatatcgatattttagtaaacaacgcaggtattacccgtgacggtttattaatgcgtatgaaagaagacgattggttcgatatcattcaaaccaacttaacttccgtatatcgtttatctaaagcggtactgcgtccgatgatgaaaaaaggcggccgaatcgttactatcggttcggttgtcggctcaatgggtaaccctggtcaaaccaactactgtgcggcaaaagccggtttagtcggtttttccaaatcattagccaaagaagtggcttctcgcggtattacggtaaacgtggttgctccgggctttatcgcaaccgatatgacggacgaattaaacgaagatcaaaaacaagcgatcttaagccaaattccggtcggtcagttaggctctgcacaagatattgcgaaagcggtcgcattcttagccagtgatgatgcaaaatacatcaccggcgaaactatccacgtaaacggtggtttatatatgaactaa

SEQ ID NO: 62012 - protein, 241 aa, Actinobacillus pleuropneumoniae serovar 1 str. 4074
MQGKIALVTGATRGIGKAIAEELAAKGATVIGTATSEKGAESISAYLGEHGKGLVLNVTDADSIEAVLAQIKADFGDIDILVNNAGITRDGLLMRMKEDDWFDIIQTNLTSVYRLSKAVLRPMMKKGGRIVTIGSVVGSMGNPGQTNYCAAKAGLVGFSKSLAKEVASRGITVNVVAPGFIATDMTDELNEDQKQAILSQIPVGQLGSAQDIAKAVAFLASDDAKYITGETIHVNGGLYMN

SEQ ID NO: 62013 - DNA, 783 bp, Pseudomonas aeruginosa UCBPP-PA14
  CDS (1)..(783)
atgaacgattttccgaagtggacaggccaggtcgcgctcatcagcggcgccggcagcgaactcggcatcggtttcgccattgcccggcggctggcccgcgaaggcgtgcgcctgctgatcaccgccagcagcgagcggattaggcaacgagcggaggaactgagcgcatgtggtcacgacgtgcgcgccgcgagcgccgacctgaccgacgaagcccaggtgcagggtctgctggactgggccgaagcccagtggggacgggtcgacatcctggtgaacaatgccggcatggcccagttggacagcgcggagcccttcagcgcagtggaagcgacctcgctgcgggattggcaactgtccctgtcgcgcaacctgaccagtgctttcctgctcacccgcggcctgctgccgggcatgcgcgagcgcggctacgggcggatcgtcaacgtcgcctccaccaccggaacccgcggcagcaacccgggcgaagccgcgtatagcgcggccaaggccggtctggtcggctggagcatgggcctggcgctggaggtggcgaagagcggcatcacggtgaacagcgtcgcgccgggctggatcgccaccgcctcgagcaccgccgaagaacgccaggccgccctggccagccccagcggacgtgccggccggcccgaagaggtggccgccgcggttgccttcctcgcctcgcccgaagccagcttcgtcaacggcgaactgctggtggtggacggcggcaactgcctgatcgaaaacaaacggagctga

SEQ ID NO: 62014 - protein, 260 aa, Pseudomonas aeruginosa UCBPP-PA14
MNDFPKWTGQVALISGAGSELGIGFAIARRLAREGVRLLITASSERIRQRAEELSACGHDVRAASADLTDEAQVQGLLDWAEAQWGRVDILVNNAGMAQLDSAEPFSAVEATSLRDWQLSLSRNLTSAFLLTRGLLPGMRERGYGRIVNVASTTGTRGSNPGEAAYSAAKAGLVGWSMGLALEVAKSGITVNSVAPGWIATASSTAEERQAALASPSGRAGRPEEVAAAVAFLASPEASFVNGELLVVDGGNCLIENKRS

SEQ ID NO: 62015 - DNA, 756 bp, Ralstonia eutropha JMP134
  CDS (1)..(756)
atgcgactgcaaggcaaggttgcgattctcaccggtgctgcgggcggtatcggccgcgctaccgcgcttggtttcgcgcgcgaaggcgcgagcattgtggtgaccgacatcaaccgcgacggcgcgcaggaagtcgccgacacgatcaacgcagccggcgggcgtgccatggcactggcgcacgacgtgggctgcgaaacgcagtggacgcgagttgtcgacgctgcggtcgaggcattcggcacggtcgacgttcttttcaacaatgcgggcatcttcgtgctcaagccgcttgccgaaacgacgctggacgagtggaaccgcctcatggcgatcaacgtcacgggcgtgttccttggcatgaagcacgtgatgccgctgatggcgcgcgccgggaagggctcggtcatcaacgtgtcttcggtcgccggcctggtcggctcgccgcggtccacgatgtacagcgccagcaagggtgccgtgcgtgccatgacgaagggcgcagcactggagtatgcggcgaagggcgtgagggtcaattcgatccatcccggccttatcgatacggccatggccgactacgcttcgggcacggcgggacgcagcaagcaggatctgggccaggtcatgtcgccgatgggccgactgggcacggccgatgaagtcggcggcctcgctctgttcctcgcttcggacgagtcgtcctacatgaacggcgcggagttggtgctggacggcggattcacggcggcctag

SEQ ID NO: 62016 - protein, 251 aa, Ralstonia eutropha JMP134
MRLQGKVAILTGAAGGIGRATALGFAREGASIVVTDINRDGAQEVADTINAAGGRAMALAHDVGCETQWTRVVDAAVEAFGTVDVLFNNAGIFVLKPLAETTLDEWNRLMAINVTGVFLGMKHVMPLMARAGKGSVINVSSVAGLVGSPRSTMYSASKGAVRAMTKGAALEYAAKGVRVNSIHPGLIDTAMADYASGTAGRSKQDLGQVMSPMGRLGTADEVGGLALFLASDESSYMNGAELVLDGGFTAA

SEQ ID NO: 62017 - DNA, 819 bp, Ralstonia eutropha JMP134
  CDS (1)..(819)
atgagcatggagctgaaggacaaggttgccatcattacgggtggcgggcagggtggtggggaaggcattgcgcgcgtgctggcacgtgaaggagccaggattgccgtggtggatctgaacgttgacgctgcgacacgcgttgcttcgagcattgatccggatggcaaacgtgcaatcgccatccgcgccgacatcagcaagaaggccgatacggaagccatggcacgccagacgctggaggcgttcggcaccatcgacatcctggtcaacaacgcaggcgtcggcggcgcctccgcgctggcgtgcgacgtcacggaagagaactgggaccgcgtgatgggggtgaacgccaagggcatcctgttctgctgccaggcggtcatccctgccatgaaggcgcagggcaagggcaagatcgtcaatatcgactccattgccggcattcggatggcctacttcagcagcgtggattacaccgcatccaagcacgcggtcacgggcctgacgcagcatctagcatgggagcttgcggaccagcgcatcaacgtcaatgcggtgtgccccggcggtatcctgacgcccgccatcgaagcgtatgcgagcgcggaaaagcgcgaggcgctgatccggcgcacggtgccgctgggcaggttctgcaagcccgaggaaatcggcgaagcggtatcgttccttgccagcgaccgtgcggacatgatcactggccagttgctggccgtggatggcggcacgcttaccggctatggcgaggacctgcgcgcggtgctgcgccagcggctccaggaagatcaggctcactga

SEQ ID NO: 62018 - protein, 272 aa, Ralstonia eutropha JMP134
MSMELKDKVAIITGGGQGGGEGIARVLAREGARIAVVDLNVDAATRVASSIDPDGKRAIAIRADISKKADTEAMARQTLEAFGTIDILVNNAGVGGASALACDVTEENWDRVMGVNAKGILFCCQAVIPAMKAQGKGKIVNIDSIAGIRMAYFSSVDYTASKHAVTGLTQHLAWELADQRINVNAVCPGGILTPAIEAYASAEKREALIRRTVPLGRFCKPEEIGEAVSFLASDRADMITGQLLAVDGGTLTGYGEDLRAVLRQRLQEDQAH

SEQ ID NO: 62019 - DNA, 732 bp, Exiguobacterium sp. 255-15
  CDS (1)..(732)
ttgaataaggtagcactcgtcacaggcgcctcacgtggaatcggagccgctatcgccaaacggttggcggcagacggattccggatcgtcgtgaactacgccgggaatacagcaaaagcagaagaagttgtttcggctatcgtcgatgcgggcggtgaggccatcgccgtccaggcagacgtggctgatgccgagcaagtcaaggcattgctgaaaacggcactcgatacttacggtcagttggattgtgtcgtcaacaatgccggaatcacgcgtgacggtctgttaatgcgaatgaaagaagcagatttcgatgcggttctaaacaccaatttaaaaggtgcgtttcttgtgacacaagcggcgacgcggccattattaaaaacgagcggtcgcatcatcaatattgcttccgtcgtcggcattaccggtaatcccggtcaagctaactatgtagcggcgaaagcgggactgatcggatttacgaagtcggtcgcacgtgaactggcaagtaaaggcgttacggcaaatgcgatttgtcccggtttcattgaaaccgatatgacggatgaattgacagaagcgcaacgtaatcagacgctcgatcaaattccgttaaaacgatttggtcagacggacgatatcgcatcgctcgtcagtttcatcgcatcagacaatgcccgttacatcactggtcaaactttggcagtcgatggcggcatgacaatgtaa

SEQ ID NO: 62020 - protein, 243 aa, Exiguobacterium sp. 255-15
MNKVALVTGASRGIGAAIAKRLAADGFRIVVNYAGNTAKAEEVVSAIVDAGGEAIAVQADVADAEQVKALLKTALDTYGQLDCVVNNAGITRDGLLMRMKEADFDAVLNTNLKGAFLVTQAATRPLLKTSGRIINIASVVGITGNPGQANYVAAKAGLIGFTKSVARELASKGVTANAICPGFIETDMTDELTEAQRNQTLDQIPLKRFGQTDDIASLVSFIASDNARYITGQTLAVDGGMTM

SEQ ID NO: 62021 - DNA, 783 bp, Exiguobacterium sp. 255-15
  CDS (1)..(783)
atgaaacaacttgaaggaaaagtcgcattgattaccggagcagcaagcggaatcggtctcgaaattgcggaagaatttgcacaggaaggtgcaaaagtcgtcatcgttgatttacaggagaatgcagccaaacaggcggcggaaacacttcaaagtaaaggattcgaagcctttgctgtcgcaggggacgtcacaagtgaaacggcgattcagtcaagcattgaacaaacgatgaatcactacggacggatcgatatcgtcatcaacaatgccggcatgcaacatgtttcaccaatcgaagagttctcgactgaaaaatttgatttacttcaaagcatcatgttacgggcaccgttcctctatacgaaatacgtgttcccgatcatgaaaaaacaaggattcggtcgtatcctgaacatgtcatccattaacggtttgatcggatttgccggtaaagccgcttacaacagtgcgaaacacggtgtcatcggtttgacgaaagttgccgcactagaaggggcaacgtccggtattaccgtcaatgcgatttgtccgggttatgttgatacaccgctcgtccaaaaacaattgtcttcgcttgccgaaacacggaatgtgccgctcgaccgggtacttgaagaagtcatctacccgctcgttccgcaacatcgcttactgcaagtcaaagagattgccgactacgcgatcttcctcgcaagtgacaaagcagccggtgtcaccggtcaagctgtcgttcttgacggcggatataccgctcaataa

SEQ ID NO: 62022 - protein, 260 aa, Exiguobacterium sp. 255-15
MKQLEGKVALITGAASGIGLEIAEEFAQEGAKVVIVDLQENAAKQAAETLQSKGFEAFAVAGDVTSETAIQSSIEQTMNHYGRIDIVINNAGMQHVSPIEEFSTEKFDLLQSIMLRAPFLYTKYVFPIMKKQGFGRILNMSSINGLIGFAGKAAYNSAKHGVIGLTKVAALEGATSGITVNAICPGYVDTPLVQKQLSSLAETRNVPLDRVLEEVIYPLVPQHRLLQVKEIADYAIFLASDKAAGVTGQAVVLDGGYTAQ

SEQ ID NO: 62023 - DNA, 768 bp, Rubrobacter xylanophilus DSM 9941
  CDS (1)..(768)
atgccaggacgtctcgaaggaaaggtcgccgtcatcacgggcgccgcgagcggcataggccgggagagcgcccggaggttcgccgaggagggcgccggggtgtgcgtggtggatctcgatccgagcggcggaaaggaggtggccgcatccgtcgacggcctgtacgtgcgggcggacgttacggaccccaaagacgtgcagcggatgtaccgcgaggccgcagattacttcggtcgtctggacgtgctcttcaacaacgcgggcatctctcctcccgaggacgggtccatactggagaccagcatcgacgcctggcagcgggtgcaggacgccaacctcaagtccgtctacctctgctgcaagtacggtatcccgtacctcctcgagaacgggggcggctcggtgataaacaccgcctcgttcgtggcggtgatgggcgcagcgacctctcagatctcctacaccgcctcgaagggcggcgtgctcgcgatgagccgcgagctcggggtgcagttcgcccgccagggggtgcgcgtgaacgccctctgtccggggcccgtggacacccccctcttgcaggaactcttcgccaaggatccggagaaggccaagcggcggctcgtgcaccttccgatgggccgcttcgcgaaggcggccgagatcgccaacgctgctctctttctggcctccgacgagtcctcttacgtgacggcctccaccttcctggttgacggcggcctctccggggcatacgttaccccagaatag

SEQ ID NO: 62024 - protein, 255 aa, Rubrobacter xylanophilus DSM 9941
MPGRLEGKVAVITGAASGIGRESARRFAEEGAGVCVVDLDPSGGKEVAASVDGLYVRADVTDPKDVQRMYREAADYFGRLDVLFNNAGISPPEDGSILETSIDAWQRVQDANLKSVYLCCKYGIPYLLENGGGSVINTASFVAVMGAATSQISYTASKGGVLAMSRELGVQFARQGVRVNALCPGPVDTPLLQELFAKDPEKAKRRLVHLPMGRFAKAAEIANAALFLASDESSYVTASTFLVDGGLSGAYVTPE

SEQ ID NO: 62025 - DNA, 780 bp, Rubrobacter xylanophilus DSM 9941
  CDS (1)..(780)
atgtacgaccttgccggaaagagggcgctggtgaccggcgcggggatgggcatcgggcaggccatagcggtggagctggcccgctgcggggccgacgtggccgtccactacgcccacacgccaccggacgagacggtgggggaggtggagcgggcgggccgcagggcccacccggtgcggggggacctgagccgggtgccggagtgcgagcgggtggtagaggaggccgcagaggccctcggagggctcgacgtgctggtgaacaacgccggcataacccgggcgctggactttctggacaccgacgaggagacctacgacgccatcttcgacctcaacatgaagggctacttcttctgcgcccgcagcgccgtcccgcacatgctcgaggcgggcggcggcagcatcgtcaacataacctcggtccacggcttcgccggcttcccccaccacaccgcctacgccgcgacgaagggcgccatcatcgccttcacccgccagctggccatagagctggcggggagggggatccgggtgaacgccatcggccccgggctcatcgaggtgccccgctactacgacatccccggctactccccagagcagggcagggagctggtcccctggggccgcgtgggcaaacccaaagacgtcgggcccgcagcggccttcctggcctccgacgccgccgacttcataaccggacaggtgctctacgtggacggcggcaccaccgcccgcatgggcctctggtgggagcagggcgagcagccccagtag

SEQ ID NO: 62026 - protein, 259 aa, Rubrobacter xylanophilus DSM 9941
MYDLAGKRALVTGAGMGIGQAIAVELARCGADVAVHYAHTPPDETVGEVERAGRRAHPVRGDLSRVPECERVVEEAAEALGGLDVLVNNAGITRALDFLDTDEETYDAIFDLNMKGYFFCARSAVPHMLEAGGGSIVNITSVHGFAGFPHHTAYAATKGAIIAFTRQLAIELAGRGIRVNAIGPGLIEVPRYYDIPGYSPEQGRELVPWGRVGKPKDVGPAAAFLASDAADFITGQVLYVDGGTTARMGLWWEQGEQPQ

SEQ ID NO: 62027 - DNA, 771 bp, Rubrobacter xylanophilus DSM 9941
  CDS (1)..(771)
atgaggcttgaggacagggtagcggtgatcaccggggcggcgagcgggcaggggcgggccgcggcgaagctgttcgcctccgaaggggcaaaggtcgtcgcagcggacatagacgagggcggggcgcagaggacggtcgaggagataaaggaggccggcggcgaggcgaccgccgtaaaggtggacgtgtcccgcgagcccgacgtcagggccatggtagagagtgccacagaccggtacgggcggctcgacgtcctcttcaacaacgcgggcgtgggctactcggcctcggggcgcatgaagatggccagcgtggtcgagacccccgagaaagactgggacgcgatcctcgccatcaacctcaagggcgtggcgctgggctgcaagcacgccatccccgtcatggagcggcagggctacggctcgatcatcaacaacgcctcgatcaacgccctggtggggcttcccggcgcggacgcctacacggcggcaaagggaggcgtggtcgcgttctcccgagttctggccgtagagtggggtcccagggggataagggtgaactgcatctgccccggcggcgtcgacacgccgatgatagccccggtgatctcggacgagcgggtcatgcagtccatgaggcagaacacccccctcgggcggctggcccggccggaggagatcgccagcgtagcgctgttcctcgcctcggaggaggcctcctacctcaacggcgcaatcatccccgtcgacggcggctggaccgcacactga

SEQ ID NO: 62028 - protein, 256 aa, Rubrobacter xylanophilus DSM 9941
MRLEDRVAVITGAASGQGRAAAKLFASEGAKVVAADIDEGGAQRTVEEIKEAGGEATAVKVDVSREPDVRAMVESATDRYGRLDVLFNNAGVGYSASGRMKMASVVETPEKDWDAILAINLKGVALGCKHAIPVMERQGYGSIINNASINALVGLPGADAYTAAKGGVVAFSRVLAVEWGPRGIRVNCICPGGVDTPMIAPVISDERVMQSMRQNTPLGRLARPEEIASVALFLASEEASYLNGAIIPVDGGWTAH

SEQ ID NO: 62029 - DNA, 738 bp, Mesorhizobium sp. BNC1
  CDS (1)..(738)
atgtttgatctcaatggccgcaaggctctcgtcacgggagcaaccgggggcatcggcgaggcgatcgccagggcgcttcacaagcagggcgcgattgtgggcctgcacgggacgcgggtggaaaaactcgaagcgcttgcaggcgaacttggcgaaagggcaaagatatttgccgcgaatctttcggaccgcgatgacgtgaaggctttcgccgagcgcgccgaatcagagctcgaagggatcgacattctcgtcaacaatgcagggatcacccgcgacgggcttttcgtgcgcatgagcgacgaggactgggacgcggtgatcgaaaccaatctgactgccgccttcaggctcacccgcgcgctgacgcatcccatgatgcgccgccgctggggccgcatcatcaacatttcctccgtggtgggcgtggccggcaatccagggcaggcgaattattgcgcttccaaggccggtctcatcgggttttccaagtcgctcgcccaggaggtcgccagccgcaacatcacggtcaattgcgtggcgccgggtttcattgagacggcgatgacggacaagctgaacgagaagcagcgcgaatccatcatgggcgccattcccatgaggcgcatgggctcaggagaggagattgccacggctgtggtctatcttgcctccgaggaggcggcctatgttaccggccagaccattcacgtgaatggcgggatgctgatggtctaa

SEQ ID NO: 62030 - protein, 245 aa, Mesorhizobium sp. BNC1
MFDLNGRKALVTGATGGIGEAIARALHKQGAIVGLHGTRVEKLEALAGELGERAKIFAANLSDRDDVKAFAERAESELEGIDILVNNAGITRDGLFVRMSDEDWDAVIETNLTAAFRLTRALTHPMMRRRWGRIINISSVVGVAGNPGQANYCASKAGLIGFSKSLAQEVASRNITVNCVAPGFIETAMTDKLNEKQRESIMGAIPMRRMGSGEEIATAVVYLASEEAAYVTGQTIHVNGGMLMV

SEQ ID NO: 62031 - DNA, 777 bp, Mesorhizobium sp. BNC1
  CDS (1)..(777)
atgtatttggaaaaactgaggcttgacgggcgggttgccgtaatcaccggcggcgggcagggcataggtgctgcctgcgcgcgggcgctcggcgaggccggtgccacggtgatcgtggcggacctcctggccgaacgggccgaggccaccgccaaggagctctccaccgccgggatcaaggcgcagggcattggactcgacgtcacgaaatccgccgatgtagatgccgcggcggacgaaatcgcgcgccagcacggcaggatcgatatcctcgtcaacaatgcgggcgtggccaagagcgacgtgcgggcggaagataccagcgacgaacactggcgcttccatatggacgtcaatttggacggtgtgttctggtgttgccgcgcgttcggccggcacatgctggagaaggaacgcggcgcgatcgtgaatatcggctccatgtcgggcttcatcgtcaacaagccgcagccgcagagcttctacaatgcctcgaaggcggccgtgcatcacctcacgaagtcgcttgctgccgaatggggccggcgcggcgtgcgcgtcaatgccgtggcgcccacctatatcgagacgccgctgacggccttcggcatcaaagaaagcccggagatgtacaaggtatggctcgagatgacgccgatggggcgcgttggccagccggacgagatcgcttccgtcgtgcatttcctggcatccgacgcctccagcctgatgactggctcgatcgtgctggccgacgccggctatacctgctggtga

SEQ ID NO: 62032 - protein, 258 aa, Mesorhizobium sp. BNC1
MYLEKLRLDGRVAVITGGGQGIGAACARALGEAGATVIVADLLAERAEATAKELSTAGIKAQGIGLDVTKSADVDAAADEIARQHGRIDILVNNAGVAKSDVRAEDTSDEHWRFHMDVNLDGVFWCCRAFGRHMLEKERGAIVNIGSMSGFIVNKPQPQSFYNASKAAVHHLTKSLAAEWGRRGVRVNAVAPTYIETPLTAFGIKESPEMYKVWLEMTPMGRVGQPDEIASVVHFLASDASSLMTGSIVLADAGYTCW

SEQ ID NO: 62033 - DNA, 747 bp, Rubrobacter xylanophilus DSM 9941
  CDS (1)..(747)
atgatagccgaaggaagggtggcggtggtcaccgggggagggaggggcatcgggcgcgcggtcgccgtgcggctggccggggagggggcgcaggtggcgctctcctaccgctccaacgacgccgccgcggaggagaccgcggagctggtgcgcggggccggggtccgctgcgagctcttcaggggggacgtcgcctcctccggcgacgtcaaggccctcttcgacggcgtcgccggggccttcggacgggtcgacatcctcgtcaacaacgccggcatcacccgggacaacatcatgctccgcatgaaagaggaggagttcgacgaggtgctcaggaccaacctcaagggcacctacctctgcacccgggcggcgctgcggcccatgctgcgggcgcggtggggcaggatcgtcaacatcagcagcgtggtcggtttggtgggcaacgccgggcaggccaactacgccgcctccaaggccgggatcatcggcttcaccaagagcgtggcgcgggaggtcgcccagcgcggcatcaccgtcaacgccgtggcgcccgggtacgtggagaccgagctcaccggcggcctcccggaggacataaagcggggcatcctcgcccagaccccggccgggcgcttcggggagcccggggaggtcgcggaggtcgtcgcctttctggccggggagggggccggctacgtaaccggacagaccatcgccgtcgacggcggcatgaccatgcactag

SEQ ID NO: 62034 - protein, 248 aa, Rubrobacter xylanophilus DSM 9941
MIAEGRVAVVTGGGRGIGRAVAVRLAGEGAQVALSYRSNDAAAEETAELVRGAGVRCELFRGDVASSGDVKALFDGVAGAFGRVDILVNNAGITRDNIMLRMKEEEFDEVLRTNLKGTYLCTRAALRPMLRARWGRIVNISSVVGLVGNAGQANYAASKAGIIGFTKSVAREVAQRGITVNAVAPGYVETELTGGLPEDIKRGILAQTPAGRFGEPGEVAEVVAFLAGEGAGYVTGQTIAVDGGMTMH

SEQ ID NO: 62035 - DNA, 774 bp, Burkholderia cepacia R18194
  CDS (1)..(774)
atgagccacaaccgcaccggccggctggccgggaaagtcgccgtggtgacgggcgccgcgagcggcatcggcaggagcatcgcgctgcgattcgcgaacgaaggcgccagcgtggtcgcgacgacgagccgcaacaccgcgcaactcgacgagacctgccgcctggccggcgacggggtcatcgtcgcgaggcaggccgatgccggatcggcggagcaggtcgaggcgctgatcgacttcgtggagcgccggttcggccggctcgacgtcatgtgcaacaacgcgggcgtcattcgcgaggcccggctcgtcgacaccaccgaagcggactgggatgccgtcatggacgtcaacctaaagggcgtgttcctcggctgcaagtacgcgattccggcgatgatccgcgccggcggcgggtcgatcgtcaatctcggctccacgagcagcttcgtcggcgaaccgcttcatgcggcctattgcgcatcgaagggcggggtgctgatgctgacccgctgcgtggcgatcgagcacgcgaaggatcgcatccgcgccaatgccgtctgtcctggctggatcgataccccgatgaataagccattcatcgatgcgctcggcgggcgcgacgcgatggacacgctgctcgacgcggttcagccgctcgggatgggtacgccggagcaggtcgccgacgtcgcgctgttcctggcctcgaacgaaagcagtttcgtgaccggaacgtcgatcctcgtggatggcggcttgactgcgcagtag

SEQ ID NO: 62036 - protein, 257 aa, Burkholderia cepacia R18194
MSHNRTGRLAGKVAVVTGAASGIGRSIALRFANEGASVVATTSRNTAQLDETCRLAGDGVIVARQADAGSAEQVEALIDFVERRFGRLDVMCNNAGVIREARLVDTTEADWDAVMDVNLKGVFLGCKYAIPAMIRAGGGSIVNLGSTSSFVGEPLHAAYCASKGGVLMLTRCVAIEHAKDRIRANAVCPGWIDTPMNKPFIDALGGRDAMDTLLDAVQPLGMGTPEQVADVALFLASNESSFVTGTSILVDGGLTAQ

SEQ ID NO: 62037 - DNA, 810 bp, Burkholderia cepacia R18194
  CDS (1)..(810)
atgaatgccgtgccgggcagcggccgcttgcgtgcggatttcagcgggcgcgtcgtgctcgtcacgggcgccgcgcaggggatcggcgcggcgatcgcacgccgtttcgcggaatccgacgcgttcgtcgcgcttgccgacctgaacggcgaggcggccgccgcgcaggccgatgcgctcgcgagcacggggggcgaggcgcgcgcctatcgggtggatgccgccagccgtgacgaactgggcgcgctggtcgcggcggtcgagcgtgacggtggccggctcgatgtcgtcgtccacaatgccgcgtattttccgctgacgccgttcacgcagatcgacgagccgacactcgaccggacgctgtcggtcaacctgtcggcgttgttctggctcgcgcaggccgcgctgccggcgttcgagcgcgcgggagcggggcggctgctcgtcacgtcgtcggtgacggggccgcgcgtcgtgtatccggggctggcgcattacgcggcgtcgaaggcgggcgtgaacggcttcattcgtgcggcggcgctggagctcgcgcgccgcaacgtgacggtcaacggcgtcgagccgggcatgatccgcacgccggcggctggcaatctcggcggcgcgtcggtcgcggcgcaaatcgcgcgcgacattccgctcgcgcggatgggcgagccggaagatatcgcgaacgcgatgctgttcctcgcgtcggccgatgccgcgtacatcacggggcagacgatcgtcgtcgacggcggtgcgacgttgcccgagagcggggcggtgcttggcggtgagtga

SEQ ID NO: 62038 - protein, 269 aa, Burkholderia cepacia R18194
MNAVPGSGRLRADFSGRVVLVTGAAQGIGAAIARRFAESDAFVALADLNGEAAAAQADALASTGGEARAYRVDAASRDELGALVAAVERDGGRLDVVVHNAAYFPLTPFTQIDEPTLDRTLSVNLSALFWLAQAALPAFERAGAGRLLVTSSVTGPRVVYPGLAHYAASKAGVNGFIRAAALELARRNVTVNGVEPGMIRTPAAGNLGGASVAAQIARDIPLARMGEPEDIANAMLFLASADAAYITGQTIVVDGGATLPESGAVLGGE

SEQ ID NO: 62039 - DNA, 780 bp, Burkholderia cepacia R18194
  CDS (1)..(780)
atgaatgtcaagattgacggccgactggccggcaaggtcgccgtcgtgagcggcggcgccggtggctgtggcggcgcggcgtccgaactgttcgccgcacagggcgcgaaggtcgcgatcatcgaccgcgacggcgacgccgctgaaacactcgcatcccggctgcgcgacgcgggcctgcaggcgatcggcttcggcgccgacgtgtcgaaacaggccgaagtccagcaggccgtgaacgccgcgcgggagcagtacggcaacgcggacatcctgttcaatcacgccggcacgctgatcgtcaaaccgttcctcgacatcgaggagtcggaatgggactggctgatgggcgtgaacgtgaagagcatgttcctgatgacgaaagcggtgctgccgcagatgctggagaaggggcggggcagcatcgtctgcacgtcgtcgatttccgcggtatgcgcgacgccgggcgaggtgctgtatgacgcgaccaagggcgcgtgccacatgttcgcgcgggcgattgcggtcgagtaccgcgaccgcggcattcggtgcaacgcgctcgcaccggggttcatccgcacgccgcacgggatgcgcgaactgaaggacctgcaggcgatgggtgtcgacgcgaccgaggcggcgatcgcggttcagcaaggccgcctgtgcgagccgtcggaagtcgcggcggcggcactgttcctcgcttccgacgagtcgagtttcgtcaacggcacccacctgttcgtcgacaactgcttctccgccgtctga

SEQ ID NO: 62040 - protein, 259 aa, Burkholderia cepacia R18194
MNVKIDGRLAGKVAVVSGGAGGCGGAASELFAAQGAKVAIIDRDGDAAETLASRLRDAGLQAIGFGADVSKQAEVQQAVNAAREQYGNADILFNHAGTLIVKPFLDIEESEWDWLMGVNVKSMFLMTKAVLPQMLEKGRGSIVCTSSISAVCATPGEVLYDATKGACHMFARAIAVEYRDRGIRCNALAPGFIRTPHGMRELKDLQAMGVDATEAAIAVQQGRLCEPSEVAAAALFLASDESSFVNGTHLFVDNCFSAV

SEQ ID NO: 62041 - DNA, 741 bp, Burkholderia cepacia R18194
  CDS (1)..(741)
atgaaactcaaggacaaggtggcgatcatcacgggcgccgcggcggggatcgggcaggcaacggccaggaccttcgcgagcgaaggggcgatcgtcgtgttgtgcgaccgttccgcagacgcggtgcgacacgaggcgcggcacctgaacgagcgcggccattcggcggtcgcgcatacgctcgacgtgaccgaccgggccggcatcgacgcggtaatcgcgaacgtgaaggcgcagttcggccggatcgacattctcgtcaacaacgcgggcattacgcaggatgcgcggctcgtgaacatgagcgaggaacagttcgacaaggtcatcgacgtcaacctgaagggcgtgttcaactgcacgcaggcggtcgtcgacacgatgatcgagcagaagcgcggcgtggtgctcaacgcgtcgagcgtcgtcggcatctacgggaatttcggccagacgaactacgcggccagcaaattcggcgtgatcggtttcaccaagacgtgggccagggagctcggccctaaaggcattcgcgtcaatgcggtgtgcccgggcttcatcgagacggacatcctcaagacaatgccggacaaagtgctcgacgggtttcgggacgcatgctggcagcggcggttgggtacgccgagcgaaattgcgagcgtttacgcgttcctcgcgtcggacgaagccagtttcgtgaacgggacggcgatcgaggtgtcgggcgggttgtcggtgtag

SEQ ID NO: 62042 - protein, 246 aa, Burkholderia cepacia R18194
MKLKDKVAIITGAAAGIGQATARTFASEGAIVVLCDRSADAVRHEARHLNERGHSAVAHTLDVTDRAGIDAVIANVKAQFGRIDILVNNAGITQDARLVNMSEEQFDKVIDVNLKGVFNCTQAVVDTMIEQKRGVVLNASSVVGIYGNFGQTNYAASKFGVIGFTKTWARELGPKGIRVNAVCPGFIETDILKTMPDKVLDGFRDACWQRRLGTPSEIASVYAFLASDEASFVNGTAIEVSGGLSV

SEQ ID NO: 62043 - DNA, 759 bp, Burkholderia cepacia R1808
  CDS (1)..(759)
ttgcagggcaagcgtgcgctggtgacggcggctggacagggcatcggccgcgcgaccgcgctgcggttcgcaagcgagggcgccgacgtgctggcgaccgacatcaacgacaccgcgctcgagcagctcgcagccgatgcgcaacgtgcgggcggccggctgtccacgcgccggctcgacgtgaccgctgcggccgacgtggcggcgctggcagcgcgggaacgcgcgttcgacgtgctgttcaactgcgcgggcttcgtgcatcacggctcgatcctcgactgcgacgagcgcgcgtgggcgttttcgttcgatctgaacgtcacgtcgatgtaccggctgatccgcgcgctgctgccggcgatgctggaggcgggcggcgcgtcgatcgtcaacatggcgtccgccgcgtcgagcgtgaagggcgtgccgaaccgtttcgtctacggcacgaccaaggcggccgtgatcggcctcaccaagtcggtcgccgccgatttcgtcgaacggcgcattcgctgcaacgcgatctgtcccggcacgatcgcgtcgccgtcgctcgaacagcgcatcgccgagcaggcgcgcgcacgcgaggtgtcgaccgacagcgtgcgcgcggccttcgtcgcgcgccagccgatgggccgcatcggcaccgccgacgaagtggccgcgctcgccgcgtatctcgcgtccgacgaagcgtcgttcaccaccggcacgattcacgtgatcgacggcggctggtcgaactga

SEQ ID NO: 62044 - protein, 252 aa, Burkholderia cepacia R1808
MQGKRALVTAAGQGIGRATALRFASEGADVLATDINDTALEQLAADAQRAGGRLSTRRLDVTAAADVAALAARERAFDVLFNCAGFVHHGSILDCDERAWAFSFDLNVTSMYRLIRALLPAMLEAGGASIVNMASAASSVKGVPNRFVYGTTKAAVIGLTKSVAADFVERRIRCNAICPGTIASPSLEQRIAEQARAREVSTDSVRAAFVARQPMGRIGTADEVAALAAYLASDEASFTTGTIHVIDGGWSN

SEQ ID NO: 62045 - DNA, 741 bp, Bacillus cereus G9241
  CDS (1)..(741): transl_table=11
atggagtttttaaatgggaaaacagctgttgtaacaggagctgcacagggaattggaaaagagattgcaagggtttatgcaaagctaggggcgaaagtattaattagcgatgtaaatgaagagaagctacaaaaaacgacacgtgagttatcggacgaaggacatgaagtgtgctcatatcgatgtgatgtgagtaatcaaaatgaagcgaaatcgttaattgaatatgcagttcaaaaattcggtacattacatattttggtgaataacgctgggattacaagagatgcaatgttacataaaatggagaagtctgcttgggaacaagtattacaagtgaacttaactggtgttttttattgtatgcaaccagcgcttctttacatgagacaacaagggtatggacgcattattaatatatcttcaattagtagggaaggaaacataggtcaagcaaattatgcggctacgaaggcaggcgttgtaggtttaacgaaaacggcagcgaaagaagttggaagtttcggtattacgtgtaatgcgatttgtccagggtttatggatacagatatgacaaaaacgataccagataaagtgaaagaaaagatggttggtgcgattccagttggtagaattggaaccccagaagatattgcgaacgcagcagcctttttagcatcagaatacgcatcctatattacaggagaagtattaaatgtgagcggaggactgcaagtttaa

SEQ ID NO: 62046 - protein, 246 aa, Bacillus cereus G9241
MEFLNGKTAVVTGAAQGIGKEIARVYAKLGAKVLISDVNEEKLQKTTRELSDEGHEVCSYRCDVSNQNEAKSLIEYAVQKFGTLHILVNNAGITRDAMLHKMEKSAWEQVLQVNLTGVFYCMQPALLYMRQQGYGRIINISSISREGNIGQANYAATKAGVVGLTKTAAKEVGSFGITCNAICPGFMDTDMTKTIPDKVKEKMVGAIPVGRIGTPEDIANAAAFLASEYASYITGEVLNVSGGLQV

SEQ ID NO: 62047 - DNA, 786 bp, Rubrivivax gelatinosus PM1
  CDS (1)..(786)
atgaacaccgtgaacttcgcgctttcgggccgtgtgaccgtggtcaccggcgccgctcaaggcatcggcgcggcctgtgcggagcgcttcgcgcgcgagggcgcaccggtcgcgctatgggacgtggacgacgagcgcggccagacgatggccgcgcgcctggccgccgccggcgtgcaggcgatctaccggcactgcgacgtgtcgcgcgccgatcaggtacaggccgcgcacgccgccacgctggcggccttcggccggatcgacgtgctggtcaacaacgccggcatcttcagggcggccgacttcctcgacgtcaccgaggccgactgggacgcggtgatcggcgtcaacctcaagggcgcgttcctcgtcggccaggcctgcgcccgcacgatggcgtcccagggtcgcggcgtcatcgtcaacatgagctcggtcaacggcctgatggccatccccacgatcgccagctacaacgccagcaagggcggcatcaaccagctcacccgcgcgatggccctggcgctggccgaccacggcgtgcgcgtgaatgcggtggcacccggcacgatcgccaccgagctggccacgcaggccgtgctgaccagcgacgaggcccgccagcgcatcctcggtcgcacgcccttgaagcggctgggcgagccggccgagatcgccgacgtggtggccttcctggccagcgacgcggccagctacctgaccggccagatcgtctacgccgatggcggccggcttgcgctgaactacacggttcaggcctga

SEQ ID NO: 62048 - protein, 261 aa, Rubrivivax gelatinosus PM1
MNTVNFALSGRVTVVTGAAQGIGAACAERFAREGAPVALWDVDDERGQTMAARLAAAGVQAIYRHCDVSRADQVQAAHAATLAAFGRIDVLVNNAGIFRAADFLDVTEADWDAVIGVNLKGAFLVGQACARTMASQGRGVIVNMSSVNGLMAIPTIASYNASKGGINQLTRAMALALADHGVRVNAVAPGTIATELATQAVLTSDEARQRILGRTPLKRLGEPAEIADVVAFLASDAASYLTGQIVYADGGRLALNYTVQA

SEQ ID NO: 62049 - DNA, 750 bp, Rubrivivax gelatinosus PM1
  CDS (1)..(750)
atgagcgcggacgcttcggtgacgacgcaggtggccctggtgacgggcgcgagccgcggcatcggccgcgcgatcgcgaccacgctggccgagcgcggcttcaaggtcgtcggcacggcgaccagtgaatccggcgcggcagcaatcggcgaggcgctggcccccctgggcggccgcgggttggtgctgaacgtgaacgacggcgcggcgcttgaggcggcagtcgacaccatcgtcaagcaggacggcggactgcacgtgctggtcaacaacgccggcatcacgcgtgacacgctgtcgatgcgcatgaaggacgacgactgggacgccgtgctcgacaccaacctgaaggcggtgttccgtgccagccgcgcggtgatccggccgatgatgaagcagcgctacggtcgcatcgtcaacatcacctcggtggtgggggcaagcggcaatccgggccaggccaactacgctgcggcgaaggccggcgtcgccggcatgacgcgctcgctggcccgtgaactgggcagccggggcatcacggtcaactgcgtggcgccgggtttcatcgcgaccgacatgaccgacggactgcccgaggcgcagaaggccgcgctgctggggcagatcccgctggggcgcctgggcgcgccggaggagatcgccgatgcggtggccttcctggcgtcgagacaggccggctacatcacggggaccgaactgcacgtcaacggcggcatgttcatgaattga

SEQ ID NO: 62050 - protein, 249 aa, Rubrivivax gelatinosus PM1
MSADASVTTQVALVTGASRGIGRAIATTLAERGFKVVGTATSESGAAAIGEALAPLGGRGLVLNVNDGAALEAAVDTIVKQDGGLHVLVNNAGITRDTLSMRMKDDDWDAVLDTNLKAVFRASRAVIRPMMKQRYGRIVNITSVVGASGNPGQANYAAAKAGVAGMTRSLARELGSRGITVNCVAPGFIATDMTDGLPEAQKAALLGQIPLGRLGAPEEIADAVAFLASRQAGYITGTELHVNGGMFMN

SEQ ID NO: 62051 - DNA, 819 bp, Pseudomonas fluorescens PfO-1
  CDS (1)..(819)
atggctgaacctctgtccctgccaccggtgcccgagccaccaaaaggcgagcgtctgaaaaacaaggttgtgttgctgaccggcgccgcccaaggcatcggcgaagcaatcgtcgcgaccttcgcctcccagcaggccaaactggtgatcagcgatatccaggccgaaaaggtcgagaaagtcgccgcccactggcgcgagcagggcgccgatgtgcaagcgatcaaggccgacgtatcgcgtcagcaggatctgcacgccatggccaaactggccatcgaactgcacgggcgcatcgacgtgctggtcaattgcgccggggtcaacgtgttccgtgatccgctggaaatgaccgaagaagactggaaacgctgcttcgcgatcgacctcgacggcgcctggtatggctgcaaggccgtattgccgcagatgatcgagcagggcatcggcagcatcatcaacattgcctcgacccattccacgaacatcattcccggctgcttcccgtacccggtggccaagcatggcctgctcggcctgacccgcgcgctgggcatcgagtacgcgccgaagggtattcgggtcaacgcgattgcaccgggctacatcgaaacccagctcaacgtcgattactggaacggtttcgccgacccgcacgccgaacgtcagcgcgctttcgatctgcacccaccgaaacgcatcggccaaccgatcgaagtggcaatgactgctgtattcctggccagtgatgaagcgccgttcatcaacgcctcgtgcatcactatcgatggtggtcgctcggtcatgtaccacgactga

SEQ ID NO: 62052 - protein, 272 aa, Pseudomonas fluorescens PfO-1
MAEPLSLPPVPEPPKGERLKNKVVLLTGAAQGIGEAIVATFASQQAKLVISDIQAEKVEKVAAHWREQGADVQAIKADVSRQQDLHAMAKLAIELHGRIDVLVNCAGVNVFRDPLEMTEEDWKRCFAIDLDGAWYGCKAVLPQMIEQGIGSIINIASTHSTNIIPGCFPYPVAKHGLLGLTRALGIEYAPKGIRVNAIAPGYIETQLNVDYWNGFADPHAERQRAFDLHPPKRIGQPIEVAMTAVFLASDEAPFINASCITIDGGRSVMYHD

SEQ ID NO: 62053 - DNA, 774 bp, Pseudomonas fluorescens PfO-1
  CDS (1)..(774)
atgacgactctttctggcaagaccgcactggttaccggctccaccagcggaatcgggctgggcatcgccctgacgctggccaaggctggcgccaacctgatcctaaacggctttggcgacgcctccaaggtgatcgccgaagtcgagcagttcggcggcaaggtcggccatcacccggcggacgtcagcgatcccgcccagatcgccgacatgattgcctacgccgaacgcgagttcggcggcgtggacattctggtcaacaacgccggcatccagcacgtcgcggcggtggaagaatttccggtggagcgctgggattcgatcatcgcgatcaacctgtcgtcggtgtttcacagcactcgcctgagtttgccgggcatgcgcgccaagggctgggggcgaatcgtcaacatcgcctcggtgcatggtctggtcggttccaccggcaaagccgcgtacgtggcagccaagcatggggtgatcggcttgaccaaagtggtcggcctggaaaccgccgccagcaacgtcacctgcaacgccatctgcccgggctgggtgctgacgccgctggtgcagaagcagatcgatgatcgcgcagccaagggtgtcgacccgcagcaggcgcaacacgatctgctggccgaaaagcagccgtcgctggagttcgtcacgccggcgcatctgggtgaactggtgctgttcctgtgcagcgaggccggcagccaggtgcgtggcgccgcgtggaatatcgatggcgggtggctcgcgcagtaa

SEQ ID NO: 62054 - protein, 257 aa, Pseudomonas fluorescens PfO-1
MTTLSGKTALVTGSTSGIGLGIALTLAKAGANLILNGFGDASKVIAEVEQFGGKVGHHPADVSDPAQIADMIAYAEREFGGVDILVNNAGIQHVAAVEEFPVERWDSIIAINLSSVFHSTRLSLPGMRAKGWGRIVNIASVHGLVGSTGKAAYVAAKHGVIGLTKVVGLETAASNVTCNAICPGWVLTPLVQKQIDDRAAKGVDPQQAQHDLLAEKQPSLEFVTPAHLGELVLFLCSEAGSQVRGAAWNIDGGWLAQ

SEQ ID NO: 62055 - DNA, 741 bp, Ralstonia metallidurans CH34
  CDS (1)..(741)
atgaaattgcagggacgcgtagcgatcatcaccggcgccgccgccggcatcggttttgccaccgccgaacgtttcgccgccgaaggcgcgaagctcatcatgtgcgatgtgcaggaggcccgcgtgcgcgaggccgccgagcggctggccgccaagggcgcgcaggtcgaggcgcacaaggtcgacgtcacgcgccgcgacgaggtcgatgccatggtggcagccacgctggcccgccacggtcgcatcgatgttctcgtcaacaacgccggcatcaccaaggacgcgcgcctcgccaagatgaccgaggcacagttcgatgcggtcatcgacgtcaacctgaagggcgtgttcaactgctcacaggccgtggccagcatcatgtccgagcagggcagcggcgtgatcctgaacgcatcgagcgtggttggcctgtatggcaacttcggccagaccaattacgcggcttccaagttcggcgtgatcggcttcaccaagacctgggcgcgcgaactgggtccgaagggcgtgcgcgtgaacgcggtatgcccgggctttgtcaataccgagatcctgcagaccgtgccggagaaggtgctcgacggcatgaaggaacattgctggatgcgccgcctggccgagccgtcggagatcgccgcgatctacacgttcctggccagcgacgacgccagctacgtcaacggcacgacgatcgaagccagcggcggcatgtcgctgtaa

SEQ ID NO: 62056 - protein, 246 aa, Ralstonia metallidurans CH34
MKLQGRVAIITGAAAGIGFATAERFAAEGAKLIMCDVQEARVREAAERLAAKGAQVEAHKVDVTRRDEVDAMVAATLARHGRIDVLVNNAGITKDARLAKMTEAQFDAVIDVNLKGVFNCSQAVASIMSEQGSGVILNASSVVGLYGNFGQTNYAASKFGVIGFTKTWARELGPKGVRVNAVCPGFVNTEILQTVPEKVLDGMKEHCWMRRLAEPSEIAAIYTFLASDDASYVNGTTIEASGGMSL

SEQ ID NO: 62057 - DNA, 744 bp, Burkholderia fungorum LB400
  CDS (1)..(744)
atgacacaaagactggccggcaagacggccctgatcacggcggcaggacaaggcatcggactcgccaccgccgaactcttcgcccgcgaaggcgcgcgcgtgatcgccacggacatccgcatcgacggactcgccggcaagccggtcgacgcgcgcaaactcgacgtgcgcgacaacgcggcgatcaacgcgctggccgccgaactcggcgcgatcgacgtgctgttcaactgcgcgggtttcgtgcatgcgggcaacattctcgaatgcagcgaagaagattgggactttgcgttcgacctgaacgcgaaggcgatgtaccgcacgatccgcgcgtttctgcctgccatgctggacaacggcggcgggtcgatcatcaatatgtcgtcggcggcgtcgagtgtgaagggtgtgccgaaccgctttgcctatagcgcctccaaggcggcggtgatcgggctgaccaagtccgttgctgcggacttcatcacgcgtggtgtacgctgtaacgcgatctgcccgggcacggtggcttcgccgtcgctcgaacagcggatcgtcgcgcaggctcaggcgcagggcgcgacgctcgacgccgtgcaggctgccttcgtggcgcggcagccaatgggccgcatcggcaagccggaagagatcgccgcgttggcgctgtatctcgcgtccgacgaatcgtcgttcaccacgggccatgcgcatgtgatcgacggcggctggtcgaactga

SEQ ID NO: 62058 - protein, 247 aa, Burkholderia fungorum LB400
MTQRLAGKTALITAAGQGIGLATAELFAREGARVIATDIRIDGLAGKPVDARKLDVRDNAAINALAAELGAIDVLFNCAGFVHAGNILECSEEDWDFAFDLNAKAMYRTIRAFLPAMLDNGGGSIINMSSAASSVKGVPNRFAYSASKAAVIGLTKSVAADFITRGVRCNAICPGTVASPSLEQRIVAQAQAQGATLDAVQAAFVARQPMGRIGKPEEIAALALYLASDESSFTTGHAHVIDGGWSN

SEQ ID NO: 62059 - DNA, 768 bp, Burkholderia fungorum LB400
  CDS (1)..(768)
atggtgagcggttgcggctcctcgctgccgggctggggcacgggcaaggcgatcgccgcgttgctcgcgcgccagggtgcccaggtggtgggtctcgatgtgaacgaacaggcgcttgcggacacgcgtgctgtcatcgaaggtgagggcggcaagctgaaggcgctgttatgcgacgtgaccgacccggcgagcattgaccgggtggtgcgcgagacgattgacgcgtacggccgtatcgacgtgctggtgaacaatgtcggtgtctccgcgccaggcggtgtagtcgatatgaccgaggagatatgggaccgccagttcgacatcaatctgaagagcgtattcctgatgtgcaaggcggtcttgccgctgatggacaggcaacgcggcggtaacgtcgtcaacgtgtcgtcgctttccgcgttgcgctatagcggcaaaccgcagattgcctactcggcgagcaaggcggcgctgattcaattcacccggatggcggccttgatgcacagcgaacacaatgtgcggctcaattgcgtgatcccgggcctcatcacgacgccgcttgtgcagcggctcgcgcagcagttcggcggcggcgattacgagagttatctgaagcgccgcaatgcgcaggttccgctggcgcaggagggggacgcctgggacgtcgccaatgccacggcttttctggcttccgacgaagcgcgctacatcacggcgacggaaatcctggtcgatggcgggtccgcatcgaccatgcgttag

SEQ ID NO: 62060 - protein, 255 aa, Burkholderia fungorum LB400
MVSGCGSSLPGWGTGKAIAALLARQGAQVVGLDVNEQALADTRAVIEGEGGKLKALLCDVTDPASIDRVVRETIDAYGRIDVLVNNVGVSAPGGVVDMTEEIWDRQFDINLKSVFLMCKAVLPLMDRQRGGNVVNVSSLSALRYSGKPQIAYSASKAALIQFTRMAALMHSEHNVRLNCVIPGLITTPLVQRLAQQFGGGDYESYLKRRNAQVPLAQEGDAWDVANATAFLASDEARYITATEILVDGGSASTMR

SEQ ID NO: 62061 - DNA, 804 bp, Thermobifida fusca
  CDS (1)..(804)
atggccatttcaggccgtttgacggacaagatcgcactcatcaccggagccggatcgggattcggacgcgccagcgccctgcgtttcgcagctgaaggagcctccgtggtctgcgtcgaccgcaacgccgacgctgcccacagcgccgctgacgacatcgccgccgcaggcggcaccgccctcgcactcaccgccgacgtgtcctccgctgccgacgcggaacgaatgactaccaccacgctggaacacttcggccgcatcgacatcgtcttcgccaacgcgggcatccccggctccggcgacgcccacaccaccaccgaagaagaatgggaccgggtcatcgccatcaacctcaaaggcgtctggctgacctccaaatacgcgctgccgcacatggtcgaacgccgcagcggggtcatcaccaaccaggccagcgtcggcgggctcatcggcatccccggcatcttcccctacgccgcagccaaaggcggcgtgatctccatgacccggcaaatggccgccgcctacgcaccccacaacatccgggtcaatgcgatctgcccgggcggggtctacaccccgctggtggaactgtcccgtcaaaagcgcggcctgaccgccagcagcgtcgaggaagccaacgctatcgccgcacgcaactaccccctgggccgtctcggcacagtggaggagatcgcctccctcgccctcttcctcgccagcgacgaagccgcctggatcaccgggggcatctaccccgttgacggcggacgcggcgcggtagggaccattcccaccgactga

SEQ ID NO: 62062 - protein, 267 aa, Thermobifida fusca
MAISGRLTDKIALITGAGSGFGRASALRFAAEGASVVCVDRNADAAHSAADDIAAAGGTALALTADVSSAADAERMTTTTLEHFGRIDIVFANAGIPGSGDAHTTTEEEWDRVIAINLKGVWLTSKYALPHMVERRSGVITNQASVGGLIGIPGIFPYAAAKGGVISMTRQMAAAYAPHNIRVNAICPGGVYTPLVELSRQKRGLTASSVEEANAIAARNYPLGRLGTVEEIASLALFLASDEAAWITGGIYPVDGGRGAVGTIPTD

SEQ ID NO: 62063 - DNA, 741 bp, Geobacter metallireducens GS-15
  CDS (1)..(741)
atgagtcttgaaggtaaggttgcaatcgtaacgggagcctcaaggggaatcggcagggccatcgccctaaaactcgccagggagggggccagtgtggtggtgacggccacgacactggaaagcgcccggaaaactgcggcagagattgaagcgctcgggcacaaagccctgtctctggccgtagatgttgccgactcgtctgcagtggaagccatgttcgtatcggcggtcggagcttttgggaaggttgatatccttgtgaacaacgcgggtatcacgaaggacggccttctcctcagaatgaaagatgccgattgggatgcggttatcgatgtgaacctcaagggagctttcaactgcatccgcgaggcggcaaagctcatggtcaaggctcgtagcggccgcattgtcaatatcagttccgttgttggcgagatgggtaatgcaggacagatcaactattgcgcaagcaaggcaggcatgatcgggcttacaaaatcggcagcccgcgagcttgccaagcggggaattacggtcaatgccgtaacgcccggattcattgagacgaatatgacgtcggttctttccgacaaggtgcgcgaagggctcttacaacaaattcctcttgagcgtctcggcacgtcggatgatgttgcaaatgctgtttttttccttgtctcgtcaatgggggactacataacagggcatgtcctttcagtaaatggcggcatgtacatgtga

SEQ ID NO: 62064 - protein, 246 aa, Geobacter metallireducens GS-15
MSLEGKVAIVTGASRGIGRAIALKLAREGASVVVTATTLESARKTAAEIEALGHKALSLAVDVADSSAVEAMFVSAVGAFGKVDILVNNAGITKDGLLLRMKDADWDAVIDVNLKGAFNCIREAAKLMVKARSGRIVNISSVVGEMGNAGQINYCASKAGMIGLTKSAARELAKRGITVNAVTPGFIETNMTSVLSDKVREGLLQQIPLERLGTSDDVANAVFFLVSSMGDYITGHVLSVNGGMYM

SEQ ID NO: 62065 - DNA, 768 bp, Geobacter metallireducens GS-15
  CDS (1)..(768)
atgggcttggaacgtttcagtctgaaaggtaaaaccgctatcgtcaccggtgccagtcaggggctgggtgaagccatggcactgggtctggcggaagcaggtgccaatctggtgctggcgagccgcaacgaagccagtatggccaaggtcgcttccgaggtgacctcaaaaggggtccagtgtcttacggtcaaaacggacatgctgaaggccgatgacattcaggcgatggtggataaggggatcgcccaattcggaacgatcgatatcctggtcaacaatgccggcatcaatctggtcaagccgtttgtgaatcttaccgaggaggactgggactcggtcgttgatacgaacctcaaaggatatttcctctgtagccaggttgtgggcagggaaatgatcaagaacaagaacggctgtgttatcaacaatgcctccgtcttcggtctcaggggctttcccaatattgcgtcatacatagccagcaagggtggggttgtccaactgaccaggggattggccgtggaatgggcccgtcacaatatccgggtgaactgtattgccccgggctatatcgttaccgaaatggccaagagggatattgagacaaatccgaagattctggagcagaacctgctgaagatccccatgaaaaggggcggtcagccccgggaagtcgccgatgtcgtggtgttcctggcgtcggaggcctcaagctacatgacaggacagatcgtctccatggatggcggctggtcggctttctag

SEQ ID NO: 62066 - protein, 255 aa, Geobacter metallireducens GS-15
MGLERFSLKGKTAIVTGASQGLGEAMALGLAEAGANLVLASRNEASMAKVASEVTSKGVQCLTVKTDMLKADDIQAMVDKGIAQFGTIDILVNNAGINLVKPFVNLTEEDWDSVVDTNLKGYFLCSQVVGREMIKNKNGCVINNASVFGLRGFPNIASYIASKGGVVQLTRGLAVEWARHNIRVNCIAPGYIVTEMAKRDIETNPKILEQNLLKIPMKRGGQPREVADVVVFLASEASSYMTGQIVSMDGGWSAF

SEQ ID NO: 62067 - DNA, 741 bp, Novosphingobium aromaticivorans DSM 12444
  CDS (1)..(741)
atgacgaccactttcgacctttcaggcaagcgcgcgctggttaccggcgccgggcagggcatcggccgggccagcgccgaggcgttccgcgatgcgggtgcagatgttctggcaaccgacctcaatccccatgcgcttgcctcgctggacggctgccgcagccgcgttctcgatgtgaccgatgctgcggcaatcgccgcgatggtcgccgaggaggacggcttcgatgtcgtgttcaactgcgctggcgtggtgcacaacggcacgatcctcgattgtaccgatgcggactgggcctttgcgctcgacctcaacgtgacggcgatgttccggatgacccgcgccattctgcccggcatgatcgcgcgcggcggcggatcgatcatcaacatggcttcggtcgcaagttccatcctcggcgtagccaaccgcttcgcctatggcgcgagcaaggctgcggtgatcggcctgaccaaggcggtggcggcggacttcgtgcagcagggcgtacgctgcaacgcgatctgccccggcaccgtgcattctccctcgctcgagcagcggcttgccgcaaccggcgatttcaacgccgccatggccgccttcaccgcgcgccagccgatgggacggatcggtcgcccggacgagatcgccgcgctcgcgctctatctcgccagcgatgcctcggccttcacgaccgggcagtgccatgtcatcgatggtggctggtccaacagctaa

SEQ ID NO: 62068 - protein, 246 aa, Novosphingobium aromaticivorans DSM 12444
MTTTFDLSGKRALVTGAGQGIGRASAEAFRDAGADVLATDLNPHALASLDGCRSRVLDVTDAAAIAAMVAEEDGFDVVFNCAGVVHNGTILDCTDADWAFALDLNVTAMFRMTRAILPGMIARGGGSIINMASVASSILGVANRFAYGASKAAVIGLTKAVAADFVQQGVRCNAICPGTVHSPSLEQRLAATGDFNAAMAAFTARQPMGRIGRPDEIAALALYLASDASAFTTGQCHVIDGGWSNS

SEQ ID NO: 62069 - DNA, 747 bp, Novosphingobium aromaticivorans DSM 12444
  CDS (1)..(747)
atgggacgcttgaatggcaaggtcgcgatcatcaccggcgcggcacgcgggatgggcgaatcccatgcgcgcacctttgtccgggaaggcgcccgggtcgtgctgaccgatctcagcgaggaggccggaaaggccctcgtcgcagaactgggcgacaacgcagtgttcctgaagcaggacgtcacggacccacaatcctggaatgccgtcgtcgaaaccgcagttcgagagtttgggacgatcgatatcctcgtcaacaacgcgggcatccttggccccatggcgccgacggacagcctcgacgacgaaggatatcgcaaggtctgcgcggtaaaccaggactcggtcttcttcggcatgcgcgccgtcctgcccgtgatggtaaaggcccgcaggggttccatcgtgaacatctcctcgatcgccggcatggccgcaaactacggcttcccaagcctcgcctatgttgccagcaagtttgcggtccgcggcatgaccaaggcaactgcggtcgagttcggcaagcacaacatccgcgtcaactcggtgcacccgggcttcatccagacccccatgatggtcgaggcaaccgacgaggtaggcggcgaagcgctcgcacagatccccctgggccgcatcgccgatccgtccgaggtttcgaacctcgtgctctttctggcctcggacgagtcctcctacatcaccggctcagagcatctggtcgatgccggcatgctggcccactga

SEQ ID NO: 62070 - protein, 248 aa, Novosphingobium aromaticivorans DSM 12444
MGRLNGKVAIITGAARGMGESHARTFVREGARVVLTDLSEEAGKALVAELGDNAVFLKQDVTDPQSWNAVVETAVREFGTIDILVNNAGILGPMAPTDSLDDEGYRKVCAVNQDSVFFGMRAVLPVMVKARRGSIVNISSIAGMAANYGFPSLAYVASKFAVRGMTKATAVEFGKHNIRVNSVHPGFIQTPMMVEATDEVGGEALAQIPLGRIADPSEVSNLVLFLASDESSYITGSEHLVDAGMLAH

SEQ ID NO: 62071 - DNA, 747 bp, Cytophaga hutchinsonii
  CDS (1)..(747)
atgggcttacttagtggaaaaactgctctggtaacaggagcatcaaaaggcataggaaaatcgatcgcgatgcgttacgcacaggaaggtgctaatgtggcgttcacctatctttcaagcgttgaaaaaggtcaggcattagaaaaagaattacaggcattgggtatcaaagcaaaaggataccgctcagatgcatctaaatatacagaagcagaagaattagtaacttccgtattagcagactttggacagcttgatattgttgtaaacaatgcaggtattacaaaagatggcttattaatgcgtatgacagaagaacaatgggattctgttatggaagtaaatttaaaatcggtatttaacctgacaaaagcggcattaaaaccaatgatgaaagcgaaagcaggttctattataaatatgacttctgttgtgggcatcagcggtaacgccggccagacaaactacgctgcctctaaagcaggtatcattggtttcacaaaatcagtagcgcaggaattgggttcacgcaacatccgctcaaacgcaattgccccgggttttattgaaacagaaatgacggaagtactggacccgaaagtgaaagctgaatgggaaaacggaattccgttgaaacgtgccggaaaaagtgaagatgtagcgaatgcctgtgtattccttgcatcagatctttcaacatacattaccggacaggtattacaggttgatggcggaatgctgacctag

SEQ ID NO: 62072 - protein, 248 aa, Cytophaga hutchinsonii
MGLLSGKTALVTGASKGIGKSIAMRYAQEGANVAFTYLSSVEKGQALEKELQALGIKAKGYRSDASKYTEAEELVTSVLADFGQLDIVVNNAGITKDGLLMRMTEEQWDSVMEVNLKSVFNLTKAALKPMMKAKAGSIINMTSVVGISGNAGQTNYAASKAGIIGFTKSVAQELGSRNIRSNAIAPGFIETEMTEVLDPKVKAEWENGIPLKRAGKSEDVANACVFLASDLSTYITGQVLQVDGGMLT

SEQ ID NO: 62073 - DNA, 744 bp, Clostridium thermocellum ATCC 27405
  CDS (1)..(744)
atgcaattgaagggaaaaactgcgattgtaaccggctcgagcagaggcctggggaaggctattgcgtggaaattgggaaatatgggagcaaatatcgttcttaacggttcacctgcttcaaccagccttgatgccactgcggaggaatttaaagctgccgggataaacgttgttgttgcaaaaggggatgtaaaaaaccctgaagatgttgagaacatggttaaaacggcaatggatgctttcggaagaattgacatacttgtaaataacgcaggcataaccagagatacgctcatgctgaaaatgtctgaaaaagattgggacgatgttttgaatacaaacttaaaaagtgcctatctttgtacaaaagctgtctccaaaatcatgttaaaacaaaaaagcggtaaaattataaatattacctctattgcgggtattattggtaatgcgggtcaggccaattatgcagcatcaaaagctggtttaataggttttacaaaatcaatcgcaaaggaatttgccgcaaaggggatttactgtaatgccgtggcgccgggtataataaaaaccgacatgaccgatgtgttacctgacaaagtaaaggaaatgtatttgaataacataccgcttaaaaggtttgggacgcctgaagaagtggcaaatgttgtcggtttccttgcatctgacgattcaaattatataacaggtcaggtaataaatattgacggcggattggtaatgtaa

SEQ ID NO: 62074 - protein, 247 aa, Clostridium thermocellum ATCC 27405
MQLKGKTAIVTGSSRGLGKAIAWKLGNMGANIVLNGSPASTSLDATAEEFKAAGINVVVAKGDVKNPEDVENMVKTAMDAFGRIDILVNNAGITRDTLMLKMSEKDWDDVLNTNLKSAYLCTKAVSKIMLKQKSGKIINITSIAGIIGNAGQANYAASKAGLIGFTKSIAKEFAAKGIYCNAVAPGIIKTDMTDVLPDKVKEMYLNNIPLKRFGTPEEVANVVGFLASDDSNYITGQVINIDGGLVM

SEQ ID NO: 62075 - DNA, 759 bp, Trichodesmium erythraeum IMS101
  CDS (1)..(759)
atggaagcattgccagaaacattacaacgtttaaaaggaaaagtagcaatagttacaggtgcatccagaggaattggccgagcaacagctttagcattagcaatggaaggggcaaatgtagttgttaactatgctaaatctagtgatactgctgaggaagtagtagcagaaatagttgcggcgggtggtaacggtctggcactacaagcagatgtttctcaagttgaggaagtggataacttaattaaagaagtgatggaaaagtggagtcgtgttgatatcttagttaataatgctggtattactcgcgatacattactgctgcggatgaaactagaagactggcagtcagtaatagacttaaatttgacaggagtatttctttgtactcgtgctgtgagtaaaattatgctcaaacaaaaaagtgggcgcattattaatgttgcttcagtgtccgggcaaatgggtaatcctggtcaagctaattatagcgcagcaaaagcaggagtaattggctttactaaaactgtggccaaagaacttgctaatagaggaattacagcaaatgtggttgctcctgggtttattgagactgatatgactaaagacctgaaaaattctgaggaaattattaagtttattcctctaggtcgttatggtaaaccagaagaggtagcaggtatgattaggtttttagctgctgatgatgcggcgagttatattacggctcaagtatttaatgtagatgggggtttttaa

SEQ ID NO: 62076 - protein, 252 aa, Trichodesmium erythraeum IMS101
MEALPETLQRLKGKVAIVTGASRGIGRATALALAMEGANVVVNYAKSSDTAEEVVAEIVAAGGNGLALQADVSQVEEVDNLIKEVMEKWSRVDILVNNAGITRDTLLLRMKLEDWQSVIDLNLTGVFLCTRAVSKIMLKQKSGRIINVASVSGQMGNPGQANYSAAKAGVIGFTKTVAKELANRGITANVVAPGFIETDMTKDLKNSEEIIKFIPLGRYGKPEEVAGMIRFLAADDAASYITAQVFNVDGGF

SEQ ID NO: 62077 - DNA, 735 bp, Streptococcus suis 89/1591
  CDS (1)..(735)
atggaattaacaaataaaaatgtttttgtaacaggttcaagccgaggaattggcttggccattgcccataagtttgccagtcttggtgccaatgtggtgctgaacggtcgtggtcagctaggccaggacttgctggatagctttgcagattacggtgtgaaagtcctagctatttcaggagatatttcaagcgcggaagatgccaaacgaatggtggcagaagccatcgaaacactcggtagcgtcgatattttggtcaacaatgcagggattaccaaggatggaatggctcttcgtatgacagaagaggattttgatacggttctgaaggtaaatcttactggaacttttaatatgacgcaggctgttttgaaaccaatgacaaaggctcgtgagggtgctattatcaatctatcaagcgtatctggcttgattggaaatgctggacaggccaactattctgcttctaaggcaggtgtgattggatttactaaagccattgcccgtgaggttgctgggcgaaatgttcgtgtcaatgcgattgcgccgggctttatccagtctgatatgacagatgttttatctgacaagattaaagaagctatgactgcacaaattccgatgaaacgctttggtgcgacagaagaagtagcggatgtagcagtgtttcttgccaagcaagaatatctaactggacaggtgattgcggttgacggcggcttgaccatgcagtaa

SEQ ID NO: 62078 - protein, 244 aa, Streptococcus suis 89/1591
MELTNKNVFVTGSSRGIGLAIAHKFASLGANVVLNGRGQLGQDLLDSFADYGVKVLAISGDISSAEDAKRMVAEAIETLGSVDILVNNAGITKDGMALRMTEEDFDTVLKVNLTGTFNMTQAVLKPMTKAREGAIINLSSVSGLIGNAGQANYSASKAGVIGFTKAIAREVAGRNVRVNAIAPGFIQSDMTDVLSDKIKEAMTAQIPMKRFGATEEVADVAVFLAKQEYLTGQVIAVDGGLTMQ

SEQ ID NO: 62079 - DNA, 750 bp, Silicibacter sp. TM1040
  CDS (1)..(750)
atgacacagaacacaggccggctggccgaaaaaacagctttgattactgctgcggggcaggggatcggtcgcgccagcgcggaactctttgcggctgagggcgccaaggtgatcgcctgcgacatcaatgcagagtcattggcagaactcgcggaggtcgatgggatcacggcccttgcgcttgatgtcacggatgcatccgcagttgcgcgcgcaatccaagatgcagggccattgaatgtgttgttcaactgcgcgggatatgtcgcaagtggcagcattttggactgcgatgagaacgactgggacttcagtttcgacctcaacgtcaaagccatgtatcgcctcacgaaactggttttgcccggcatgctggaaaacggcggtggctctatcatcaacatgtcgtcggtggcctcctccctgaaaggggtgccaaatcgctttgcctattgcgcgtcaaaggcggcggtgatcggcatgaccaaatccattgccgcagattttgtgacccaaggtatccgttgcaacgcgatttgccccggcacggtggacagtcccagcctgcatgatcggctgcgcgctacgggcgattatgagcaggcccgcaaggatttcatcgcacgtcagcccatggggcgcattggcaaggctgaagagattgcggcgctcgcgctctatctcgccagcgatgagagcggctttaccactggacagacccacgccatcgacggcggctgggcgatttga

SEQ ID NO: 62080 - protein, 249 aa, Silicibacter sp. TM1040
MTQNTGRLAEKTALITAAGQGIGRASAELFAAEGAKVIACDINAESLAELAEVDGITALALDVTDASAVARAIQDAGPLNVLFNCAGYVASGSILDCDENDWDFSFDLNVKAMYRLTKLVLPGMLENGGGSIINMSSVASSLKGVPNRFAYCASKAAVIGMTKSIAADFVTQGIRCNAICPGTVDSPSLHDRLRATGDYEQARKDFIARQPMGRIGKAEEIAALALYLASDESGFTTGQTHAIDGGWAI

SEQ ID NO: 62081 - DNA, 738 bp, Silicibacter sp. TM1040
  CDS (1)..(738)
atgtttgatctgacaggtaagaacgcgctgatcacaggcgcatccggtggcatcggtggcgacattgcgcgcgcgctccacgcagcgggggcgactgttgcgctctccggcacccggccagacccgctgcacgccttggccgaggagcttggcgagcgggctcatgttgtgacctgcaacctctccgacgccgaggccgtcgaggcgctgccgaaacaggccgcagaggcgatgggctctgttgacatcctggtcaacaacgccgggatcaccaaggacaacctctttatgcggatgaaggatgaagagtggcagagcgttctcgatgtgaacctcacctccaccatgcgcctgtgccgcggtgtgctgcgcggcatgatgaaggcacgctggggccggatcgtgaatatctcctccgttgtgggcgccaccggcaaccccggtcagggcaactatgcggcctccaaggcgggcatggtcggcatgtccaagtcgctggcctatgaggttgcaaaccgtggcatcaccgtgaacgccgtggcgccgggcttcatcgcgaccgccatgaccgacaaactcaacgacacccagaaagaggcgatcctcagccagatccccgcaggccgtatgggggattcgaaagaaatcgccgccgcagtgctttatctggcgtcgcaagaagccgcctatgtcaccggcaccacgctgcatgtgaatggcggcatggcgatgctctaa

SEQ ID NO: 62082 - protein, 245 aa, Silicibacter sp. TM1040
MFDLTGKNALITGASGGIGGDIARALHAAGATVALSGTRPDPLHALAEELGERAHVVTCNLSDAEAVEALPKQAAEAMGSVDILVNNAGITKDNLFMRMKDEEWQSVLDVNLTSTMRLCRGVLRGMMKARWGRIVNISSVVGATGNPGQGNYAASKAGMVGMSKSLAYEVANRGITVNAVAPGFIATAMTDKLNDTQKEAILSQIPAGRMGDSKEIAAAVLYLASQEAAYVTGTTLHVNGGMAML

SEQ ID NO: 62083 - DNA, 741 bp, Ralstonia eutropha JMP134
  CDS (1)..(741)
atgaagctgaaagacaaggtggccgtgatcacgggcgcggctgcaggcattgggcaggcgactgcgcggaagttcgcaggtgaaggcgctacggtgattctctgcgaccgagcggcagatgcagtacagcaagaggccaaaagcctgaggtcggagggctatagggtcgctgcctattcgttggacgtcaccgaccgcgcgggcgtggacgctttggccgcggatatcctggggaattttgggcgcatcgacatactggtcaacaacgcgggcatcacgctggatgcaaaggtcacccgcatgacagaagagcagtttgaccgggtgatcgatgtcaacctcaagggtgtgttcaactgcacgcaggcggtaatcggcgcaatgctcgagcagcagtccggggtcattctgaacgcgtcgagcgtggttggactctacggcaacttcggtcagtcgaattatgcggctagcaagttcggtgtcatcggatttaccaagacctgggcgagagagctcgggccgaaagggattcgcgtgaatgccgtgtgccctggctttatcgagaccgacattctgaagacgatgcctgagaaggtgcttgacggatttcgttccaattgctggcagcgacgcctcggctctccgaaagagattgcgaacgtctatgcgtttcttgcgtctgatgacgccagctttgttaacggagaagcgattgaggtttcgggagggctttcgatctga

SEQ ID NO: 62084 - protein, 246 aa, Ralstonia eutropha JMP134
MKLKDKVAVITGAAAGIGQATARKFAGEGATVILCDRAADAVQQEAKSLRSEGYRVAAYSLDVTDRAGVDALAADILGNFGRIDILVNNAGITLDAKVTRMTEEQFDRVIDVNLKGVFNCTQAVIGAMLEQQSGVILNASSVVGLYGNFGQSNYAASKFGVIGFTKTWARELGPKGIRVNAVCPGFIETDILKTMPEKVLDGFRSNCWQRRLGSPKEIANVYAFLASDDASFVNGEAIEVSGGLSI

SEQ ID NO: 62085 - DNA, 771 bp, Rubrobacter xylanophilus DSM 9941
  CDS (1)..(771)
atgggcagactcagcggtcgggttgcggttgtcacgggagcggcgcggggcataggcgctgcggaggccatccggctggcgcaggacggggcgagcgtggcggtgctggacctgtccgccgaggcgtgcggcgagacggtggaggcggtagaggccaccggcgcggaggctctcgccctggcgtgcgacgtatccgatgccgggcaggtggagggcgcgctcgaggaggtcgtggggcgcttcgggcggctggacatcctggtgaacaacgccgggatcatccgggacaacctctcgttcaagatgagcgaggaggactgggacctggtgctcgacgtccacctcaagggcagctttctgtgctcccgggcggcccagaagtacatggtggagcagaactacggcaagatagtcaacaccagctccgtggtggcgctcggcaaccgggggcaggccaactactcctcggcgaaggccgggctgcaggcgctcacccgcacgctcgcgctggagctggggcgcttcaacataaacgtcaacgcggtcgcccccggctggatcgagacggagatgaccaaggaggccgccgagcgggtggggatgaccatagaggagatgaaggagaagttcgcaaagaccatccccctcaggcgcttcgggcgggtggacgacatcgccaacgtggtggccttcctggtctccgacgaggcctcctacataagcggcgagacgatctacgtggccgggggtccggcgagcgcggtcgtctag

SEQ ID NO: 62086 - protein, 256 aa, Rubrobacter xylanophilus DSM 9941
MGRLSGRVAVVTGAARGIGAAEAIRLAQDGASVAVLDLSAEACGETVEAVEATGAEALALACDVSDAGQVEGALEEVVGRFGRLDILVNNAGIIRDNLSFKMSEEDWDLVLDVHLKGSFLCSRAAQKYMVEQNYGKIVNTSSVVALGNRGQANYSSAKAGLQALTRTLALELGRFNINVNAVAPGWIETEMTKEAAERVGMTIEEMKEKFAKTIPLRRFGRVDDIANVVAFLVSDEASYISGETIYVAGGPASAVV

SEQ ID NO: 62087 - DNA, 759 bp, Chloroflexus aurantiacus
  CDS (1)..(759)
atggagccacctttcattgggaaggttgcgctggtcaccggcgcagcagccggtattggtcgtgcttcagcactggcgtttgcccgtgagggtgccaaggttgtcgttgctgatgtgaatgtcgagggcggggaagagacgattgcgctgtgtcgggctttgaataccgatgcaatgttcgtgcgttgtgatgtttcgcaacgcgatgaagtggagcgattaattgctctggcagttgacacgttcggtcggatcgactttgcgcacaacaacgccgggattgaaggcgtgcaggcaatgctggccgattatcccgaagaggtctgggatcgggtgatcgagatcaacctcaaaggggtctggttgtgtatgaagtacgaaatccggcacatgctcaagcagggtggcggtgcgattgtgaatacctcatcggtcgccggtctggccggatcacgtggcgtttcggcgtatgtagccagcaagcacggtattgttggtattaccaaagcggcagcccttgagtatgcgcgtaacggtattcgtgtcaacgcaatctgtccaggtacgattcatactgcgatgatcgaccgctttacccagggtgatccccaactgcttgcccagttcgctgagggtgaaccgattggtcggctcggctcgcctgaagaggtcgccaatgcggtgatctggctctgctcagataaggcttcgtttgtgaccggagcgacactggcggttgatggtggccgcctggcgtaa

SEQ ID NO: 62088 - protein, 252 aa, Chloroflexus aurantiacus
MEPPFIGKVALVTGAAAGIGRASALAFAREGAKVVVADVNVEGGEETIALCRALNTDAMFVRCDVSQRDEVERLIALAVDTFGRIDFAHNNAGIEGVQAMLADYPEEVWDRVIEINLKGVWLCMKYEIRHMLKQGGGAIVNTSSVAGLAGSRGVSAYVASKHGIVGITKAAALEYARNGIRVNAICPGTIHTAMIDRFTQGDPQLLAQFAEGEPIGRLGSPEEVANAVIWLCSDKASFVTGATLAVDGGRLA

SEQ ID NO: 62089 - DNA, 753 bp, Chloroflexus aurantiacus
  CDS (1)..(753)
atgctgcttgatttgagtgggcgagtcgcaattgtcaccggtggcagtcgtgggattggccgggcgactgccgagcggttggccggcagcggcgccgccgtagtcgtcaattatcgcgggaacgcagcggctgccgaagcgacggtggccgccatcactgctgccggcggcaccgccatcgccgtgcagggtgatgtcagtcaaccggcagatgtagagcagatggtcaagaccacccttgaacggtttggtcggatcgacattctggtcaacaatgccggcatcacccgcgacacgttacttctccgcatgaaggaaagcgacttcgatgaggtgatcgccaccaatctgcgcggggtctttctctgcacccgcgccgttctccgcccgatgaccaaacagcggtttggtcggatcatcaacattacatcggtggttggcttgaccggtaacgttggtcaggctaattacgctgcggcaaaagccggtattctcggcttcaccaaatcgacagcccgcgaaatggcgagtcgggggattaccgtgaatgccattgcgccgggcttcatcgaaaccgagatgaccgaggcgctcaacgaagaggcgcgcaaggcgattctggcaactatcccgctcggtcggtttggccagccggctgaagttgcgggacttgtctgtttcctggcctctgatgccggcgcatatatcagcggtcaaacgctgactatcgacggtggaatggtgatgtcctga

SEQ ID NO: 62090 - protein, 250 aa, Chloroflexus aurantiacus
MLLDLSGRVAIVTGGSRGIGRATAERLAGSGAAVVVNYRGNAAAAEATVAAITAAGGTAIAVQGDVSQPADVEQMVKTTLERFGRIDILVNNAGITRDTLLLRMKESDFDEVIATNLRGVFLCTRAVLRPMTKQRFGRIINITSVVGLTGNVGQANYAAAKAGILGFTKSTAREMASRGITVNAIAPGFIETEMTEALNEEARKAILATIPLGRFGQPAEVAGLVCFLASDAGAYISGQTLTIDGGMVMS

SEQ ID NO: 62091 - DNA, 750 bp, Chloroflexus aurantiacus
  CDS (1)..(750)
atggaatttgaaggaaaggtcgcactcgtaacgggtgcgggtaccggaatcggagaggcaatcgcagagcgtctacttgctggcggggccttggttgtgctggttagtcgtcgccttgagccgttggaattagtttgcaggagaattgatccgaagggagcaagaactttggctcttgaggcagacgtgcgcaatccaatggcgatggaagccgcagttaagcgcaccattgagcgatttgggaagcttgatatggctgtgaataacgctggtgtaactggtccggctggcgtgccggtccaagacgtagaagcagaaatatggcgtgaggtcattgatactgatctcaccggtattttctactccatgaaatatgagatacccgcgatgctcgccaatggttctggagcgatcgtaaatatgtcgtctgccaatggcttggtcggcctggcaggtatggctgcatacaccgcagcgaaacacggggtaattggattgactcgttcggccgcactagagttggcagagtcgaatatccgcgtatgtgcagttgctccaggctatgttgcaacaccacgaataatggactccggcaaagaggtcacggactggatggcgagcttgcacccaatgaagaggcttgcaacgcgggaagaggtagcagattttgtagcttatttgctaagtgagcgtgctgccttcatgaccggaagtgtccattctatagatggcgggtatactgcacagtaa

SEQ ID NO: 62092 - protein, 249 aa, Chloroflexus aurantiacus
MEFEGKVALVTGAGTGIGEAIAERLLAGGALVVLVSRRLEPLELVCRRIDPKGARTLALEADVRNPMAMEAAVKRTIERFGKLDMAVNNAGVTGPAGVPVQDVEAEIWREVIDTDLTGIFYSMKYEIPAMLANGSGAIVNMSSANGLVGLAGMAAYTAAKHGVIGLTRSAALELAESNIRVCAVAPGYVATPRIMDSGKEVTDWMASLHPMKRLATREEVADFVAYLLSERAAFMTGSVHSIDGGYTAQ

SEQ ID NO: 62093 - DNA, 732 bp, Polaromonas sp. JS666
  CDS (1)..(732)
atgagactccagggaaaaaccgcactggtcacggccgccggacagggcatcggaaaggccaccgcgctggccatggcggccgagggcgcccaggtgtgggctaccgacgtcaatgagaaactgctcgccgattacgcgggcgtgcccaacatcaaaactgcggcgctcaatgtgctcgacaaggccgccatccagaaactggcggcagcgttgccaccgctcaacgtgctgttcaactgcgccggctttgtccacgccggctccatcctgcaggccaccgacgaagactgggactttgccttcaacctcaatgtgcgctcgcagttctggatgatccaggcggtgctgcccaagatgctggcccatggcggcggcagcatcatcaacatggccagcgtctgcggcttcaagggcctgccgaaccgctttgtctatggcgcctccaaggccgcggtgaccggcctcacgaaatgcgtggccgccgacttcgtgacgcagggtgtgcgctgcaatgccatttgccccggtacggtcgacaccccttcgctgcaggaccgcatcaatgtgtttgaagaccccgccgaggcgcggaaaaacttcgtggcgcgccagcccatggggcgacttgcacaggcccatgaaattgcgccgctggtggtgtttctggccagtgacgaatcggcctttgtgaccgggcagtcctatgccatcgacggcggcatgaccatatga

SEQ ID NO: 62094 - protein, 243 aa, Polaromonas sp. JS666
MRLQGKTALVTAAGQGIGKATALAMAAEGAQVWATDVNEKLLADYAGVPNIKTAALNVLDKAAIQKLAAALPPLNVLFNCAGFVHAGSILQATDEDWDFAFNLNVRSQFWMIQAVLPKMLAHGGGSIINMASVCGFKGLPNRFVYGASKAAVTGLTKCVAADFVTQGVRCNAICPGTVDTPSLQDRINVFEDPAEARKNFVARQPMGRLAQAHEIAPLVVFLASDESAFVTGQSYAIDGGMTI

SEQ ID NO: 62095 - DNA, 750 bp, Polaromonas sp. JS666
  CDS (1)..(750)
atggaaacaacgcgacgcatcgccgtggtgaccggcggaaccggcggtctcggtgaggcgatctgcaggcgcctggccgacgatggcttcaccgtcgtggcgctgcactcggcggggaacaagcaggtggacgactggctggttgcgcaacaggcgctgggctaccattttgcaaccgccgcggtcgacgtcacgcgcttcgcctcctgtgccgccgcggtggaggccatacgccaacagcatggtcccgtgtcggtgctggtcaacaacgccggcatcacccgcgacgcgagctttcgcaagatgtctgaggaagcgtgggacacggtgctgcgtaccaacctcgactcgatgttcaacatgaccaagcaggtcattgaagacatgctcctgctcggatggggccgtattgtgaatatctcgtctgtcaatggccaacgcggcgcttttggtcaagccaactatgcggcgtccaaagccggaatccatgggttcacgaagtcgctggccctggagtttgccagcaaaaacatcaccgtcaataccgtctcgccgggctacctgaaaacccgcatggtcgagaaggtgccgccgcaggtgctgcaggagaaaatattgccggagattcccgccggacggcttggtgacccggtcgaggtcgcggaactggtggcgtatctggtgtcgcagcgcgcggccttcaccacgggcgccaatttgtcgatcaacggtggccagcacatgtactga

SEQ ID NO: 62096 - protein, 249 aa, Polaromonas sp. JS666
METTRRIAVVTGGTGGLGEAICRRLADDGFTVVALHSAGNKQVDDWLVAQQALGYHFATAAVDVTRFASCAAAVEAIRQQHGPVSVLVNNAGITRDASFRKMSEEAWDTVLRTNLDSMFNMTKQVIEDMLLLGWGRIVNISSVNGQRGAFGQANYAASKAGIHGFTKSLALEFASKNITVNTVSPGYLKTRMVEKVPPQVLQEKILPEIPAGRLGDPVEVAELVAYLVSQRAAFTTGANLSINGGQHMY

SEQ ID NO: 62097 - DNA, 780 bp, Streptococcus pyogenes M49 591
  CDS (1)..(780)
atgacacatactaaagaagttgcatttatcactggtgctgcaagcggaattggaaaacaaatcggggaaaccttattaaaggaaggtaaaacggttgttttttctgacattaatcaagaaaaactggatcaggttgttgctgactatactaaagaaggctatgacgcttttagtgttgtgtgcgatgtcaccaaagaagaagccgtcaatgctgctattgatacggttgttgaaaaatatggtcgtattgatattttggttaacaacgcaggccttcaacatgttgccatgattgaagattttccaactgaaaaatttgaattcatgattaaaatcatgttgacagcaccatttattgccattaaacgtgcttttcctacaatgaaagctcaaaaacacggtcgtattattaatatggcttctatcaatggtgtcattggttttgctggcaaatccgcctacaattcagctaagcacggcttgatcggtctgaccaaagtaactgccttagaagctgctgattcaggcattacggtcaatgccatttgtcctggatatgttgacacaccactggttcgtggccagtttgaagacctttccaaaacaagaggtattccccttgaaaatgttcttgaagaagtgctatactcacttgttcctcaaaaacgcctcattgacgttcaagaaattgcagactatgtgtctttccttgccagtgataaggcaaaaggtgttacaggtcaagcctgtatcttagacggtggctacactgctcaataa

SEQ ID NO: 62098 - protein, 259 aa, Streptococcus pyogenes M49 591
MTHTKEVAFITGAASGIGKQIGETLLKEGKTVVFSDINQEKLDQVVADYTKEGYDAFSVVCDVTKEEAVNAAIDTVVEKYGRIDILVNNAGLQHVAMIEDFPTEKFEFMIKIMLTAPFIAIKRAFPTMKAQKHGRIINMASINGVIGFAGKSAYNSAKHGLIGLTKVTALEAADSGITVNAICPGYVDTPLVRGQFEDLSKTRGIPLENVLEEVLYSLVPQKRLIDVQEIADYVSFLASDKAKGVTGQACILDGGYTAQ

SEQ ID NO: 62099 - DNA, 774 bp, Nocardioides sp
  CDS (1)..(774): transl_table=11
atgagcacaaggttcgaaggcaaggtcgcgatcgtcactggggcaggctccgggatcggacgggcgaccgccgaactgctcgccaccgaaggcggcgccataggcgtacttgacctgcgcatcgaggccgcggaggagactgtcgcggccatcaccgccgctggaggccgtgcaattgccctcgccgccaacgtggccgacaccgctgaagtcgaagcggccgtcgccaaggtcgtggcggagtacggcggtttgcacgtgctctataacaacgccggctgcgactccaaggggtcggtcgcggacgccagcgatgccgactgggagcgcgcgatggcggtcaacgccaagggcactttcgtctgctcgcgcgcggcagtcccccacatggccgcctcgggaggcggtgccatcgtcaaccagggatcggtggccgccctcgtaggcgtgcccaacttcgccgcgtactgcgccgccaagggagctgtcgttgcgctcactcggtcgatggccgtcgacttggcgccagtcaagatccgggtcaacgtgatctgcccggggaccgtctttaccccgctgatggagccgatgcttcgggcacgaggcgatggtgatctcgaggccggtctggccaagacactcgtgaagtaccccatcggacggctgggcactcccgaggaaatcgctcgggttgcagcgttcctcgcgtccgacgattcctccttcctgaccggttccgtcatcgccgccgatggcggaatgacagcgcagtag

SEQ ID NO: 62100 - protein, 257 aa, Nocardioides sp
MSTRFEGKVAIVTGAGSGIGRATAELLATEGGAIGVLDLRIEAAEETVAAITAAGGRAIALAANVADTAEVEAAVAKVVAEYGGLHVLYNNAGCDSKGSVADASDADWERAMAVNAKGTFVCSRAAVPHMAASGGGAIVNQGSVAALVGVPNFAAYCAAKGAVVALTRSMAVDLAPVKIRVNVICPGTVFTPLMEPMLRARGDGDLEAGLAKTLVKYPIGRLGTPEEIARVAAFLASDDSSFLTGSVIAADGGMTAQ

SEQ ID NO: 62101 - DNA, 783 bp, uncultured bacterium
  CDS (1)..(783): transl_table=11
atgctgaagaacaagaccgccatcgtgaccggctcgaccagcgggatcggcctgggtatcgcccgcgcgctcggcggtgcgggcgccaacctgatgctcaacggcttcggcgaggcgcaggagatcgaacgcctgcgtgcggcgctggcggccgaattcaaagtgaacgtcgcctacagcggcgccgacatgtccaagccggcgcagattcaggacatggtgcgcatggcgacgaaggaactggggtcggtcgacattctcgtcaacaacgccggcatccagcacacggcgtcggtcgaagagtttccggacgatcgctgggatgccgtgatcgccatcaacctgtcgtccaactttcatgcgatcaaggcggtgctgccgcagatgaagagccgcaactggggccggatcgtcaacatcgcttcggtgcacggactggtcgcctcgacacacaaggccgcctacgtcgctgccaagcacggtgtggttgggttgaccaaggtagtggccctggaaatggccaggacaggcatcacctgcaacgccatctgccccggctgggtgctgacgccgctcgtgcaaaagcagatcgacgaccgggccaaggccgaaagcattgcggccgacaaggcgaaggcggaactgctggccgaaaagcagccttccggcgaattcgccacgcccgagcagatgggcgccctgtgcgtgttcctgtgctcggaggccgcggcgcagatgcgcggcgtggcgctgccggtcgacggcggctggctggcgcaatag

SEQ ID NO: 62102 - protein, 260 aa, uncultured bacterium
MLKNKTAIVTGSTSGIGLGIARALGGAGANLMLNGFGEAQEIERLRAALAAEFKVNVAYSGADMSKPAQIQDMVRMATKELGSVDILVNNAGIQHTASVEEFPDDRWDAVIAINLSSNFHAIKAVLPQMKSRNWGRIVNIASVHGLVASTHKAAYVAAKHGVVGLTKVVALEMARTGITCNAICPGWVLTPLVQKQIDDRAKAESIAADKAKAELLAEKQPSGEFATPEQMGALCVFLCSEAAAQMRGVALPVDGGWLAQ

SEQ ID NO: 62103 - DNA, 798 bp, uncultured bacterium
  CDS (1)..(798): transl_table=11
atgcggctcaaagataagattgcgttgatcaccggcgctggatcgggaattggcgaggcgaccgccaagacgtttgcgcgcgagggtgcgacggtcgtggtcgtcgatctgaatgaagatggggccgcgcgggtcgtctcggaaattcgcaaagccggcggcgcggcggagtcgcttcgggcggacgtcggcgtgcccgcggaaatcgagcgcatgatcaagttcgcgcgcgatcgtttcggacggctcgacgtgctgcacaacaacgcggtcttcacgacggtcgggcgaatcggcgagatctcgctcgagggatggcagaaaactttggacgtcggcctgaccgcgtattggtacgcgaccaaatgcgcgctcgagttgatgctgccggcgcgcaagggcgcgatcgtcaacaccgcgtcggtctcgggactcgccggcgactacacgctcggcgcctacaacgcggtgaaggcgggcgtggtgaatatcacgcgggtgacgggaatcgaatacgcgcgcaagggaatccgttgcaacgcggtatgcccggggccaatcgggacgccgccgctgctcaggatggaagattcgcggccggatatcgtcgcgcgaattcgcgaggcgattccgatgggccggcttggcgagccgcaggaaatcgcgaacgtcgtgctgttcctcgcgtccgacgaggcgtcgtttgtaaccggcgcgtttttcgtcgccgatggcggcttgtgggcgcattccggaatgccatcgctatccggccagggacccgagtggcaggggtga

SEQ ID NO: 62104 - protein, 265 aa, uncultured bacterium
MRLKDKIALITGAGSGIGEATAKTFAREGATVVVVDLNEDGAARVVSEIRKAGGAAESLRADVGVPAEIERMIKFARDRFGRLDVLHNNAVFTTVGRIGEISLEGWQKTLDVGLTAYWYATKCALELMLPARKGAIVNTASVSGLAGDYTLGAYNAVKAGVVNITRVTGIEYARKGIRCNAVCPGPIGTPPLLRMEDSRPDIVARIREAIPMGRLGEPQEIANVVLFLASDEASFVTGAFFVADGGLWAHSGMPSLSGQGPEWQG

SEQ ID NO: 62105 - DNA, 738 bp, Homo sapiens
  CDS (1)..(738)
atgggtcgacttgatgggaaagtcatcatcctgacggccgctgctcaggggattggccaagcagctgccttagcttttgcaagagaaggtgccaaagtcatagccacagacattaatgagtccaaacttcaggaactggaaaagtacccgggtattcaaactcgtgtccttgatgtcacaaagaagaaacaaattgatcagtttgccagtgaagttgagagacttgatgttctctttaatgttgctggttttgtccatcatggaactgtcctggattgtgaggagaaagactgggacttctcgatgaatctcaatgtgcgcagcatgtacctgatgatcaaggcattccttcctaaaatgcttgctcagaaatctggcaatattatcaacatgtcttctgtggcttccagcgtcaaaggagttgtgaacagatgtgtgtacagcacaaccaaggcagccgtgattggcctcacaaaatctctggctgcagatttcatccagcagggcatcaggtgcaactgtgtgtgcccaggaacagttgatacgccatctctacaagaaagaatacaagccagaggaaatcctgaagaggcacggaatgatttcctgaagagacaaaagacgggaagattcgcaactgcagaagaaatagccatgctctgcgtgtatttggcttctgatgaatctgcttatgtaactggtaaccctgtcatcattgatggaggctggagcttgtga

SEQ ID NO: 62106 - protein, 245 aa, Homo sapiens [sequence omitted]

SEQ ID NO: 62107 - DNA, 750 bp, Brachyspira pilosicoli; identical to SEQ ID NO: 7366
  CDS (1)..(750): transl_table=11

SEQ ID NO: 62108 - protein, 249 aa, Brachyspira pilosicoli; identical to SEQ ID NO: 7367

SEQ ID NO: 62109 - DNA, 777 bp, Mycobacterium smegmatis
  CDS (1)..(777): transl_table=11
atgttcgacctgcagggccgctcagtggtggtcaccggcggcaccaagggcatcggccgcggcatcgccacggtgttcgcgcgggccggcgccaatgtggcggtggcgggccgttcgaccgccgacatcgacgcgtgtgtggccgatctcgaccagttgggttccggcaaggtcatcggcgtgcagaccgatgtcagcgaccgcgcccagtgcgatgcgctcgccgggcgcgccgttgaggagttcggtggcatcgacgtcgtgtgcgccaacgcgggcgtcttccccgacgcgccgctggccaccatgacgcccgagcagctcaacgggatcttcgcggtcaacgtcaacggcacgttctacgcggtacaggcctgcctggacgcgctgatcgcgtcgggcagcgggcgcgtggtgctgacgtcgtcgatcaccggtcccatcaccgggtaccccggctggtcgcactacggcgccaccaaggccgcgcagttgggcttcatgcgcacggccgcaatcgaattggcgccgcacaagatcaccgtcaacgcgatcatgcccggcaacatcatgaccgagggtctgctggagaacggcgaggagtacatcgcgagcatggcgcgctccatccccgcgggcgcgctgggcaccccggaggacatcggccacctcgcggcgttcctggccaccaaggaggccggctacatcaccggtcaggccatcgccgtcgacggtggacaggtgctgcccgagtccctggacgcgatcgcgacgtag

SEQ ID NO: 62110 - protein, 258 aa, Mycobacterium smegmatis
MFDLQGRSVVVTGGTKGIGRGIATVFARAGANVAVAGRSTADIDACVADLDQLGSGKVIGVQTDVSDRAQCDALAGRAVEEFGGIDVVCANAGVFPDAPLATMTPEQLNGIFAVNVNGTFYAVQACLDALIASGSGRVVLTSSITGPITGYPGWSHYGATKAAQLGFMRTAAIELAPHKITVNAIMPGNIMTEGLLENGEEYIASMARSIPAGALGTPEDIGHLAAFLATKEAGYITGQAIAVDGGQVLPESLDAIAT

SEQ ID NO: 62111 - DNA, 759 bp, Terrabacter sp
  CDS (1)..(759): transl_table=11
atgtcaaactcgctcgatggcaaggtcgcactcgtcaccggtggtggcggagggatcgggcgcgagaccgcgaaggtcctcgtcgaccatggcgcacgggtcgtcgtcgccgacctgtccgaggatgccggcaacgggacgctcgagtacatcgacggcggagacgccgtggcgttcgtccgggcggacgtgaccgacctcgcgtcgatgcagcacctggtccaggccgcggtggaccgctacggccgactcgacatcgcgcacaacaacgccggcatcgaggtcaccggccccgacctcgccgacgtcacggtggagcagttcgacaaggtgatcgccgtcaacctcaccggagtgttcatcagcatgaaggccgagatcccgcagatgctggcgcagggcggcggatccatcatcaacaccgcctcgtccctcgggcaggccgccctcgcccaccagtccgcctacgtcacgtcgaagcacggcgtcatcggcctcacccgagccgccgcggtggagtactccgacaaaggcatccgcgtgaacgcagtgctgcccggggtgatccagacgccaatgatagacgcgctggaggagacctaccccggcttcaaggacgcgctgctgacgaagcacccgatcggccgactcggcacgccgcacgacatcgccgagatggtcgcgtggctcggttccgacgcggccgccttcgcgaccggctcgcagttcgccgtcgacggcgggtacctcgcgatttag

SEQ ID NO: 62112 - protein, 252 aa, Terrabacter sp
MSNSLDGKVALVTGGGGGIGRETAKVLVDHGARVVVADLSEDAGNGTLEYIDGGDAVAFVRADVTDLASMQHLVQAAVDRYGRLDIAHNNAGIEVTGPDLADVTVEQFDKVIAVNLTGVFISMKAEIPQMLAQGGGSIINTASSLGQAALAHQSAYVTSKHGVIGLTRAAAVEYSDKGIRVNAVLPGVIQTPMIDALEETYPGFKDALLTKHPIGRLGTPHDIAEMVAWLGSDAAAFATGSQFAVDGGYLAI

SEQ ID NO: 62113 - DNA, 777 bp, Sinorhizobium sp
  CDS (1)..(777): transl_table=11
atgacgaaaacagcggtcataacgggttcgacgagcggcatcggcctggcaatcgccaaggcatttgcgaagaccggggccaatatcgtgctgaatggtttcggttcggccgacgagatcaggacggtgacggacgaggtggcgggtctcggcgccggcacggtgctgcaccatccggccgacatgacgaagccggccgagatcgccgacctgatggcgaccgccgtcgcgcgcttcggcggtgccgatatcctcgtcaacaatgccggcgtacagttcgtcgaaaagatcgaggattttccggtcgagcaatgggaccggatcatcgccatcaacctctcctcctccttccacacgatccgggcggcgattcccgccatgaaacagaagggctggggccgcatcgtcaacatcgcctcggcgcatggcctcgtcgcctcacccttcaaatccgcctatgtggcggccaagcatggtatcatgggcctcacgaagaccgtggcgctcgaggtggcggaaaacggcatcaccgtgaactcgatctgccccggctatgtgctgacgccgcttgtcgaaaagcagataccggaccaggcgaggacgcgcggcatcaccgaggaacaggtgatcaacgaggtgatgctcaagggtcagccgaccaagaaattcataaccgtcgagcaggtcgcctcgctggcgctctatctcgccagcgacgaggcggcgcaaatcaccggcacgcatgtctcgatggacggcggctggacggcgcaatag

SEQ ID NO: 62114 - protein, 258 aa, Sinorhizobium sp
MTKTAVITGSTSGIGLAIAKAFAKTGANIVLNGFGSADEIRTVTDEVAGLGAGTVLHHPADMTKPAEIADLMATAVARFGGADILVNNAGVQFVEKIEDFPVEQWDRIIAINLSSSFHTIRAAIPAMKQKGWGRIVNIASAHGLVASPFKSAYVAAKHGIMGLTKTVALEVAENGITVNSICPGYVLTPLVEKQIPDQARTRGITEEQVINEVMLKGQPTKKFITVEQVASLALYLASDEAAQITGTHVSMDGGWTAQ

SEQ ID NO: 62115 - DNA, 786 bp, Azospirillum brasilense
  CDS (1)..(786): transl_table=11
atgaccttgactcagaaggtcgcggtggtcaccggctcgaccagcgggatcggcttgggcatcgcgcgggcgttggccggagccggggcggacgtggtgctgaacggtttcggcgacgcggccgccatcgaggagctgcgcgccggtctggcggcggagttcggcgtgcgcgtcggctatcacggcgccgacctgtccaagccggcggagatcgccgcgctgatcggccacgcggaggagacgttcggttcggtcgatgtgctggtgaacaacgccggcatccagcacgtcgccccggtggaggacttcccggccgaccgctgggacgcggtgatcgcgctcaacctgtccgccgtcttccacggcacccaccacgctctgccgggtatgaagcggcgcggctgggggcgcatcctcaacatcgcctccgtgcacggccatgtcgcgtcggtcaataagtcggcctacgtcgcggccaagcacggcgtggtcgggctgaccaagacggtggcgctggaaacggcgagcaccggcgtcacctgcaacgccatctgtccgggctgggtgctgaccccgctggtgcagaagcagatcgacgcgatcgcctcgaccaagaacatcccggagccgcaggcgaaggcggaactgctcggcgccaagcagccctccggcgccttcgtgacgccggacgagctgggcgggctggcggttttcctgtgctccgattcagcggcgcagatgaccggcgccagcctgctgatggacggcggctggaccgcgcagtaa

SEQ ID NO: 62116 - protein, 261 aa, Azospirillum brasilense
MTLTQKVAVVTGSTSGIGLGIARALAGAGADVVLNGFGDAAAIEELRAGLAAEFGVRVGYHGADLSKPAEIAALIGHAEETFGSVDVLVNNAGIQHVAPVEDFPADRWDAVIALNLSAVFHGTHHALPGMKRRGWGRILNIASVHGHVASVNKSAYVAAKHGVVGLTKTVALETASTGVTCNAICPGWVLTPLVQKQIDAIASTKNIPEPQAKAELLGAKQPSGAFVTPDELGGLAVFLCSDSAAQMTGASLLMDGGWTAQ

SEQ ID NO: 62117 - DNA, 747 bp, Azoarcus evansii; identical to SEQ ID NO: 7270
  CDS (1)..(747): transl_table=11

SEQ ID NO: 62118 - protein, 248 aa, Azoarcus evansii; identical to SEQ ID NO: 7271

SEQ ID NO: 62119 - DNA, 822 bp, Streptomyces antibioticus
  CDS (1)..(822): transl_table=11
gtgaatcagccctggcccgcgacccgggcagaccgaccgaacatttgcagggaaggagcacgaatgagcctcggggccgacaccgtcgcgatcgtcaccggagccggacggggcatcggcgccgccacggcgcagcggctcgccgcggagggcgcgaccgtggcagtcgtcgaccggaccgaggcggacacggccgacaccgtggcgtcgatccgggcggccggtggccgcgccctcggcatcgggtgcgacgtgacagtcaccgacctggtcgaggcggcggtcgaccgcacggtcgcggagttcggtcgtctggacgtcctcgtcaacaacgccggggtaacccgggacagcctcgtcttcatgatgggcgacgaggactgggatacggtcatcgacgtgcacctgaacggcgccgcccggaccgtccgcgcggcacggcgccagatggtgcgtcaaggttccgggcggatagtgaacttgagctcgatcgcggctctgggcaaccaggggcaggccaactacgccactgccaaggccgcgatccagggctacacccgcaccctggccgtggaacttggcccgcacggtattacggtcaatgcgatcgcgcctgggttcatcgccacgaccatgacggacgacacggctcgccggatgggctccgatccggtggcgctgcggaaggcggtggcgtcgcgggtgccgatgcgcagggttggcaggccggaggacatcgccggcctggtggccttcctggccgggcctgatgcgagctatctcacagggcagacgatctacgtcgacggcggaccgcagtga

SEQ ID NO: 62120 - protein, 273 aa, Streptomyces antibioticus; identical to SEQ ID NO: 7311

SEQ ID NO: 62121 - DNA, 768 bp, Pseudomonas sp
  CDS (1)..(768): transl_table=11
atgctcaatggaaagaccgctctgatcaccggctcgaccagcgggatcggcctcggcatcgccgaggtgctggcgcgcaacggcgccagcgtcattctcaacggtttcggcgactggcaggccgcggccgaacagctggcgcgccacgagggacgcgtcggctaccacgccgccgacctcgccgacccggcgcagatcgaggcgctgttcgactacgcccggcgcgagttcggccgcgtcgatatcctggtcaacaatgccggcatccagcatgtcgcgccgctgcaggacttcccggccgaacgctgggacgccatcctcgcgctcaacctcagcgcggtattccattgcacgcgcctggccctgccggacatgcgcgcgcaggactgggggcgcatcatcaacatcgcctcggtgcacggcagcatcggctcgctcggcaaggcggcctatgtcgcggccaagcacggcgtgctcggcctgaccaaggtggtggcgctggaaaccgccctgagcggggttacctgcaatgccatctgtcccggctgggtgctcacgcccctggtgcagcggcagatcgacgcgcgcatcgccgcaggcgaatcgcccgagcaggcgcgcacggcgctgctggcggagaagcagccatcgcaggccttcgtcaccccgcagcagctcggcgagctggcgctgtttctgtgcagttcggcggcgcagcaggtgcgtggcgcagcatggaacatcgatggtggctggctggcgcagtga

SEQ ID NO: 62122 - protein, 255 aa, Pseudomonas sp
MLNGKTALITGSTSGIGLGIAEVLARNGASVILNGFGDWQAAAEQLARHEGRVGYHAADLADPAQIEALFDYARREFGRVDILVNNAGIQHVAPLQDFPAERWDAILALNLSAVFHCTRLALPDMRAQDWGRIINIASVHGSIGSLGKAAYVAAKHGVLGLTKVVALETALSGVTCNAICPGWVLTPLVQRQIDARIAAGESPEQARTALLAEKQPSQAFVTPQQLGELALFLCSSAAQQVRGAAWNIDGGWLAQ

SEQ ID NO: 62123 - DNA, 747 bp, Thauera aromatica
  CDS (1)..(747): transl_table=11
atgggaattcagaacagggtcgcactgatcaccggttcggccagcggcatgggcaagcagacggcgctgcgcttcgccgagcagggcgcggcggtggtgatcaacgacatcgacgccgagaaggtgcgggcgacggtcgatgagttcagcgcgcgggggcatcgcgtgctgggcgcggttgccgacatcggcaacaaggcggcggtcgacggcatggtgaagcagacgatcgacgcattcggccgcatcgatattctggtcaataacgctggcatggagcgtgcgggcgcgttgcgcaagctcagcgaggcggactgggacgtcacgatcaacgtcaacctgaagggcacctttctgtgcacgcaggcggtgcatgggcacatggtcgagaacaagcacgggcgcatcgtcaacatcgcctcccgtgcctggctcggcggcgccggccagacgccgtactcgtccgccaaggcgggcgtcgtcggcatgacgcgcgcactggcgatcgagctcggccgcgccgggatcacggtgaattgtgtcgcgccgggcttgatccacaccccgatgtgggacgagctgccggagaaggatcagcagttcctgctctcgcgccagcccaccggcaagctcggcgagcccgacgacatcgctaacacgctcctcttcctcgccgacgacgacagcggtttcgtcaccggccaggtgctctatgtgtgcggcggacggagcctgttcgcgggctga

SEQ ID NO: 62124 - protein, 248 aa, Thauera aromatica
MGIQNRVALITGSASGMGKQTALRFAEQGAAVVINDIDAEKVRATVDEFSARGHRVLGAVADIGNKAAVDGMVKQTIDAFGRIDILVNNAGMERAGALRKLSEADWDVTINVNLKGTFLCTQAVHGHMVENKHGRIVNIASRAWLGGAGQTPYSSAKAGVVGMTRALAIELGRAGITVNCVAPGLIHTPMWDELPEKDQQFLLSRQPTGKLGEPDDIANTLLFLADDDSGFVTGQVLYVCGGRSLFAG

SEQ ID NO: 62125 - DNA, 738 bp, Rhizobium leguminosarum; identical to SEQ ID NO: 7318
  CDS (1)..(738): transl_table=11

SEQ ID NO: 62126 - protein, 245 aa, Rhizobium leguminosarum; identical to SEQ ID NO: 7319

SEQ ID NO: 62127 - DNA, 738 bp, Homo sapiens
  CDS (1)..(738)
atgggtcgacttgatgggaaagtcatcatcctgacggccgctgctcaggggattggccaagcagctgccttagcttttgcaagagaaggtgccaaagtcatagccacagacattaatgagtccaaacttcaggaactggaaaagtacccgggtattcaaactcgtgtccttgatgtcacaaagaagaaacaaattgatcagtttgccaatgaagttgagagacttgatgttctctttaatgttgctggttttgtccatcatggaactgtcctggattgtgaggagaaagactgggacttctcgatgaatctcaatgtgcgcagcatgtacctgatgatcaaggcattccttcctaaaatgcttgctcagaaatctggcaatattatcaacatgtcttctgtggcttccagcgtcaaaggagttgtgaacagatgtgtgtacagcacaaccaaggcagccgtgattggcctcacaaaatctgtggctgcagatttcatccagcagggcatcaggtgcaactgtgtgtgcccaggaacagttgatacgccatctctacaagaaagaatacaagccagaggaaatcctgaagaggcacggaatgatttcctgaagagacaaaagacgggaagattcgcaactgcagaagaaatagccatgctctgcgtgtatttggcttctgatgaatctgcttatgtaactggtaaccctgtcatcattgatggaggctggagcttgtga

SEQ ID NO: 62128 - protein, 245 aa, Homo sapiens
MGRLDGKVIILTAAAQGIGQAAALAFAREGAKVIATDINESKLQELEKYPGIQTRVLDVTKKKQIDQFANEVERLDVLFNVAGFVHHGTVLDCEEKDWDFSMNLNVRSMYLMIKAFLPKMLAQKSGNIINMSSVASSVKGVVNRCVYSTTKAAVIGLTKSVAADFIQQGIRCNCVCPGTVDTPSLQERIQARGNPEEARNDFLKRQKTGRFATAEEIAMLCVYLASDESAYVTGNPVIIDGGWSL

SEQ ID NO: 62129 - DNA, 744 bp, Bacillus megaterium; identical to SEQ ID NO: 7330
  CDS (1)..(744): transl_table=11

SEQ ID NO: 62130 - protein, 247 aa, Bacillus megaterium; identical to SEQ ID NO: 7331

SEQ ID NO: 62131 - DNA, 786 bp, Bacillus subtilis
  CDS (1)..(786): transl_table=11
atgaatgcaaagggtatagagggaaaaattgcttttataacaggggctgcccaaggaataggcgaagctgttgcgcggacgcttgccagtcaaggcgcacatattgcggcagttgattataatcctgaaaagctggaaaaggttgtgagcagcctcaaagcagaagcccgccatgcagaagcttttcctgcggatgtgagagacagcgcggcgattgacgagatcacggcgcgcatcgaacgtgaaatggggccgattgatattttagtgaatgtagcgggtgtccttcgcccgggactgatccattcgcttagcgatgaggaatgggaggcgacgttctcagtgaattcgactggcgtatttaacgcctcgcgttcagtcagcaaatatatgatggaccgaagatcgggttcgattgtaacagtcggatcgaatcctgccggtgtaccaagaacatctatggcggcatatgcgtcttcaaaggctgcggctgtgatgtttacgaaatgccttggccttgagcttgcagaatacaatattcgctgcaacattgtatctcccggatcaacggaaacagacatgcagtggtcattatgggccgacgagaatggagcggagcaagtcataaaaggatcacttgagacatttaaaacagggatcccgctcaaaaaactagccaagccttcggatattgcggatgcggtgctctttttggtttctggccaggcagggcatattacgatgcataatttatgcgtagatggcggggcgaccttaggcgtgtaa

SEQ ID NO: 62132 - protein, 261 aa, Bacillus subtilis
MNAKGIEGKIAFITGAAQGIGEAVARTLASQGAHIAAVDYNPEKLEKVVSSLKAEARHAEAFPADVRDSAAIDEITARIEREMGPIDILVNVAGVLRPGLIHSLSDEEWEATFSVNSTGVFNASRSVSKYMMDRRSGSIVTVGSNPAGVPRTSMAAYASSKAAAVMFTKCLGLELAEYNIRCNIVSPGSTETDMQWSLWADENGAEQVIKGSLETFKTGIPLKKLAKPSDIADAVLFLVSGQAGHITMHNLCVDGGATLGV

SEQ ID NO: 62133 - DNA, 786 bp, Streptomyces cinnamonensis
  CDS (1)..(786): transl_table=11
atgacacagtccacctcccgcgtcgcgctcgtcaccggcgccaccagcggcatcggcctggccaccgcccggctgctggccgcccagggccacctggtcttcctgggcgcgcgcaccgagagcgacgtcatcgcgaccgtcaaggccctgcgcaacgacggcctggaggccgagggccaggtgctcgatgtgcgcgacggcgcctccgtcaccgccttcgtccaggccgccgtcgaccggtacggccgcatcgacgtcctggtcaacaacgccggccgctccggcggcggcgtcaccgcggacctcaccgacgagctgtgggacgacgtgatcgacaccaacctcaacagcgtcttccgcatgacccgcgcggtgctcaccaccggcggcatgcgcacccgggagcggggccgcatcatcaacgtcgcctccaccgcgggcaagcagggcgtcgtgctcggcgccccctactccgcctccaagcacggcgtcgtcggcttcaccaaggcactcggcaacgaactggcccccaccggcatcaccgtcaacgccgtctgccccggctatgtcgagacgccgatggcccagcgggtgcgccagggctacgccgccgcctacgacaccaccgaggaggcgatcctcaccaagttccaggccaagatccccctcggccgctacagcacccccgaggaagtcgccggcctgatcggctacctggcctccgacaccgccgcctccatcacctcccaggcgctcaacgtctgcggcggcctcggcaacttctga

SEQ ID NO: 62134 - protein, 261 aa, Streptomyces cinnamonensis
MTQSTSRVALVTGATSGIGLATARLLAAQGHLVFLGARTESDVIATVKALRNDGLEAEGQVLDVRDGASVTAFVQAAVDRYGRIDVLVNNAGRSGGGVTADLTDELWDDVIDTNLNSVFRMTRAVLTTGGMRTRERGRIINVASTAGKQGVVLGAPYSASKHGVVGFTKALGNELAPTGITVNAVCPGYVETPMAQRVRQGYAAAYDTTEEAILTKFQAKIPLGRYSTPEEVAGLIGYLASDTAASITSQALNVCGGLGNF

SEQ ID NO: 62135 - DNA, 747 bp, Chlamydia muridarum; identical to SEQ ID NO: 7060
  CDS (1)..(747): transl_table=11

SEQ ID NO: 62136 - protein, 248 aa, Chlamydia muridarum; identical to SEQ ID NO: 7061

SEQ ID NO: 62137 - DNA, 747 bp, Chlamydia trachomatis; identical to SEQ ID NO: 7338
  CDS (1)..(747)

SEQ ID NO: 62138 - protein, 248 aa, Chlamydia trachomatis; identical to SEQ ID NO: 61778

SEQ ID NO: 62139 - DNA, 735 bp, Escherichia coli
  CDS (1)..(735): transl_table=11
atgaattttgaaggaaaaatcgcactggtaaccggtgcaagccgcggaattggccgcgcaattgctgaaacgctcgcagcccgtggcgcgaaagttattggcactgcgaccagtgaaaatggcgctcaggcgatcagtgattatttaggtgccaacggcaaaggtctgatgttgaatgtgaccgacccggcatctatcgaatctgttctggaaaaaattcgcgcagaatttggtgaagtggatatcctggtcaataatgccggtatcactcgtgataacctgttaatgcgaatgaaagatgaagagtggaacgatattatcgaaactaacctttcatctgttttccgtctgtcaaaagcggtaatgcgcgctatgatgaaaaagcgtcatggtcgtattatcactatcggttctgtggttggtaccatgggaaatggcggtcaggccaactacgctgcggcgaaagcgggcttgatcggcttcagtaaatcactggcgcgcgaagttgcgtcacgcggtattactgtaaacgttgttgctccgggctttattgaaacggacatgacacgtgcgctgagcgatgaccagcgtgcgggtatcctggcgcaggttcctgcgggtcgcctcggcggcgcacaggaaatcgccaacgcggttgcattcctggcatccgacgaagcagcttacatcacgggtgaaactttgcatgtgaacggcgggatgtacatggtctga

SEQ ID NO: 62140 - protein, 244 aa, Escherichia coli; identical to SEQ ID NO: 7021

SEQ ID NO: 62141 - DNA, 735 bp, Salmonella typhimurium; identical to SEQ ID NO: 7030
  CDS (1)..(735): transl_table=11

SEQ ID NO: 62142 - protein, 244 aa, Salmonella typhimurium; identical to SEQ ID NO: 7031

SEQ ID NO: 62143 - DNA, 741 bp, Staphylococcus aureus
  CDS (1)..(741): transl_table=11
atgaaaatgactaagagtgctttagtaacaggtgcatcaagaggaattggacgtagtattgcgttacaattagcagaagaaggatataatgtagcagtaaactatgcaggcagcaaagagaaagctgaagcagtagtcgaagaaatcaaagctaaaggtgttgacagttttgcgattcaagcaaatgttgccgatgctgatgaagttaaagcaatgattaaagaagtagttagccaatttggttctttagatgttttagtaaataatgcaggtattactcgcgataatttattaatgcgtatgaaagaacaagagtgggatgatgttattgacacaaacttaaaaggtgtatttaactgtatccaaaaagcaacaccacaaatgttaagacaacgtagtggtgctatcatcaatttatcaagtgttgttggagcagtaggtaatccgggacaagcaaactatgttgcaacaaaagcaggtgttattggtttaactaaatctgcggcgcgtgaattagcatctcgtggtatcactgtaaatgcagttgcacctggttttattgtttctgatatgacagatgctttaagtgatgagcttaaagaacaaatgttgactcaaattccgttagcacgttttggtcaagacacagatattgctaatacagtagcgttcttagcatcagacaaagcaaaatatattacaggtcaaacaatccatgtaaatggtggaatgtacatgtaa

SEQ ID NO: 62144 - protein, 246 aa, Staphylococcus aureus; identical to SEQ ID NO: 7043

SEQ ID NO: 62145 - DNA, 741 bp, Thermotoga maritima; identical to SEQ ID NO: 7088
  CDS (1)..(741): transl_table=11

SEQ ID NO: 62146 - protein, 246 aa, Thermotoga maritima; identical to SEQ ID NO: 7089

SEQ ID NO: 62147 - DNA, 735 bp, Vibrio cholerae; identical to SEQ ID NO: 7346
  CDS (1)..(735)

SEQ ID NO: 62148 - protein, 244 aa, Vibrio cholerae; identical to SEQ ID NO: 7347

SEQ ID NO: 62149 - DNA, 738 bp, Rhizobium meliloti; identical to SEQ ID NO: 7046
  CDS (1)..(738): transl_table=11

SEQ ID NO: 62150 - protein, 245 aa, Rhizobium meliloti; identical to SEQ ID NO: 7047

SEQ ID NO: 62151 - DNA, 738 bp, Rhizobium sp; identical to SEQ ID NO: 7348
  CDS (1)..(738): transl_table=11

SEQ ID NO: 62152 - protein, 245 aa, Rhizobium sp; identical to SEQ ID NO: 7349

SEQ ID NO: 62153 - DNA, 747 bp, Acinetobacter sp; identical to SEQ ID NO: 7352
  CDS (1)..(747): transl_table=11

SEQ ID NO: 62154 - protein, 248 aa, Acinetobacter sp; identical to SEQ ID NO: 7353

SEQ ID NO: 62155 - DNA, 792 bp, Salmonella typhimurium
  CDS (1)..(792): transl_table=11
atgggtaaactcacgggcaagacagcattgattacgggcgcatcgcagggcattggcgaagggatcgctcgcgtattcgcacgccacggcgcgaacttaatcttgctggatatctccgatgagattgaaaagctggcggatgagctgggcgggcgcgggcatcgctgtactgccgttaaagccgacgtcagagattttgcttcggtgcaggcggcggttgcgcgcgccaaagagactgaaggtagaattgatattttggtgaataacgctggcgtgtgccgtctgggcaacttcctcgatatgagtgaagaagatcgcgatttccacattgatattaatattaaaggtgtctggaacgtcaccaaagccgtcctgccggagatgatcaaacgtaaagatggccgcattgtgatgatgtcttccgtcacgggagatatggtggcggacccgggtgaaacggcctatgcgctgtcaaaagccgccattgtcggtttaaccaaatcgctggcggtagagtacgcgcagtccggtattcgtgtgaatgccatttgccccggttatgtaagaacgccgatggcggaaagcattgcccgtcagtctaaccctgacgatccggaatcggtattaacggaaatggcaaaagccattccgctacgccgtcttgccgatccgctggaagtaggggaactggcggcatttctggcttccgatgagtccagctatcttaccggaacgcaaaacgtcattgatggcggcagtaccctgcctgaaagcgtaagcgtaggcgtctga

SEQ ID NO: 62156 - protein, 263 aa, Salmonella typhimurium
MGKLTGKTALITGASQGIGEGIARVFARHGANLILLDISDEIEKLADELGGRGHRCTAVKADVRDFASVQAAVARAKETEGRIDILVNNAGVCRLGNFLDMSEEDRDFHIDINIKGVWNVTKAVLPEMIKRKDGRIVMMSSVTGDMVADPGETAYALSKAAIVGLTKSLAVEYAQSGIRVNAICPGYVRTPMAESIARQSNPDDPESVLTEMAKAIPLRRLADPLEVGELAAFLASDESSYLTGTQNVIDGGSTLPESVSVGV

SEQ ID NO: 62157 - DNA, 744 bp, Mycobacterium tuberculosis
  CDS (1)..(744): transl_table=11
atggcgtcattgctgaacgctcggactgccgtaattaccggcggtgcacaagggctggggttagctatcggccagcgattcgttgccgagggtgcacgggttgtgcttggtgatgtgaatctcgaagcgaccgaggtcgcagccaagcggctgggcggcgatgacgttgctctggcggtgcggtgcgatgtgactcaagccgacgacgtcgacatcctcatccggaccgctgtcgagcgtttcggcggtctggatgtcatggtcaacaacgccgggatcacccgcgacgcaacgatgcgcacgatgaccgaagagcagttcgatcaggtcatcgcggtgcatctgaagggaacatggaacggtacccggctggcggcggcaatcatgcgggaacgcaagcggggcgccattgtgaacatgtcttcggtgtcaggcaaggtcggtatggtcggccaaaccaactactcagcggccaaggccggcatcgtaggaatgaccaaggcggccgccaaagaacttgcacacctcggcattcgggtaaacgcaatagctccggggttgatccgttcagcgatgacagaagctatgccgcaacgcatttgggaccagaagcttgccgaagttccgatgggtcgcgccggcgagcccagcgaagtcgctagcgtggccgtgttcttggcttcggatctatcctcgtacatgaccggcaccgtgttggacgtgactggcggccggttcatatga

SEQ ID NO: 62158 - protein, 247 aa, Mycobacterium tuberculosis
MASLLNARTAVITGGAQGLGLAIGQRFVAEGARVVLGDVNLEATEVAAKRLGGDDVALAVRCDVTQADDVDILIRTAVERFGGLDVMVNNAGITRDATMRTMTEEQFDQVIAVHLKGTWNGTRLAAAIMRERKRGAIVNMSSVSGKVGMVGQTNYSAAKAGIVGMTKAAAKELAHLGIRVNAIAPGLIRSAMTEAMPQRIWDQKLAEVPMGRAGEPSEVASVAVFLASDLSSYMTGTVLDVTGGRFI

SEQ ID NO: 62159 - DNA, 756 bp, Thermotoga maritima
  CDS (1)..(756): transl_table=11
atgaatttccagggaaaagtggttttaataacaggagcaggttccggtattggaaagaaagcagccgttatgttcgcagaaagaggggcaaaagtagcgatcaacgatatctctgaagaaaaaggaaaagaaactgtggagctgataaagagcatgggaggagaagctgcgtttatcttcggagatgtagcgaaagatgcagaacagatagtgaagaaaacggtggaaacgttcggaaggctcgacatcctggtgaacaacgctggcatcgtaccttatggaaacatagaagagacttcggaggaagattttgataaaacaatggctgtgaatgtcaaagggccttttcttctctcaaaatatgccgttgagcagatgaaaaagcagggcggaggagtcattgtaaacgtttcctccgaagcaggactcataggaattccaagaaggtgtgtctacagtgtttcaaaagctgcactcctgggacttacaagatctcttgccgtcgattacgtcgattatggaatcagggtcaacgcggtgtgcccgggtaccactcagtctgagggactcatggcgagggtgaaggcttctccaaatccagaagaactcctgaaaaaaatgacctccaggatccctatgaagagactgggaaaagaggaggaaatcgccttcgcgatcctctttgcagcgtgtgacgaagccggatttatgacgggcagtatcataaacatagatggaggttctaccgctgtatga

SEQ ID NO: 62160 - protein, 251 aa, Thermotoga maritima
MNFQGKVVLITGAGSGIGKKAAVMFAERGAKVAINDISEEKGKETVELIKSMGGEAAFIFGDVAKDAEQIVKKTVETFGRLDILVNNAGIVPYGNIEETSEEDFDKTMAVNVKGPFLLSKYAVEQMKKQGGGVIVNVSSEAGLIGIPRRCVYSVSKAALLGLTRSLAVDYVDYGIRVNAVCPGTTQSEGLMARVKASPNPEELLKKMTSRIPMKRLGKEEEIAFAILFAACDEAGFMTGSIINIDGGSTAV

SEQ ID NO: 62161 - DNA, 768 bp, Bacillus subtilis
  CDS (1)..(768): transl_table=11
atgatcatgaacctcaccgataaaaccgtcctcatcacaggaggcgcatcaggcattggttatgctgcggttcaggcttttttgggccagcaggccaatgtggttgtggcggatattgatgaagcgcaaggagaagcaatggtacgaaaagaaaataatgacaggctgcactttgtgcaaacggacatcacagacgaagctgcctgccagcacgcagttgaatcggcggttcatacatttggcgggctcgatgtcttgattaataatgcaggcatcgaaatcgtggcgcctattcacgagatggagctcagcgattggaacaaggtgctgcaagtcaatttgaccggcatgtttttaatgagcaaacatgcactcaagcatatgctggccgccggcaagggcaacatcattaatacgtgctctgtcggcggactcgtggcatggcctgatattcctgcttataacgccagcaaaggcggggttttgcagctgactaaatcaatggccgttgattatgcgaaacatcaaattcgggtgaactgcgtatgcccggggatcatcgacacaccgctgaatgaaaaatcattccttgaaaataatgaaggcacacttgaagagattaaaaaagaaaaagcgaaggtaaatccgctgctgaggcttgggaaacctgaagaaatcgcaaatgtgatgctgtttttagcctcggatttatcaagctatatgaccggaagcgccatcaccgcagacggaggatacaccgcacaatag

SEQ ID NO: 62162 - protein, 255 aa, Bacillus subtilis
MIMNLTDKTVLITGGASGIGYAAVQAFLGQQANVVVADIDEAQGEAMVRKENNDRLHFVQTDITDEAACQHAVESAVHTFGGLDVLINNAGIEIVAPIHEMELSDWNKVLQVNLTGMFLMSKHALKHMLAAGKGNIINTCSVGGLVAWPDIPAYNASKGGVLQLTKSMAVDYAKHQIRVNCVCPGIIDTPLNEKSFLENNEGTLEEIKKEKAKVNPLLRLGKPEEIANVMLFLASDLSSYMTGSAITADGGYTAQ

SEQ ID NO: 62163 - DNA, 822 bp, Bacillus subtilis
  CDS (1)..(822): transl_table=11
atgggaagacttgaaaacaaaacagcagttatcacaggcgccgcgacaggcattggtcaagcgacggcggaggtttttgccaatgaaggcgcgcgtgtgatcatcggagatatcaataaagatcaaatggaagaaacagttgacgcaatcagaaaaaacggaggacaggccgaatcctttcacctcgatgtgtcagatgaaaacagtgtgaaagcatttgctgatcaaatcaaggatgcatgcggaacgattgatattctgtttaataatgccggcgttgatcaggaaggcggaaaggtgcacgaatatccggttgacctgtttgaccgcattatcgccgtcgacctgcgcggcacattcctttgcagcaaatatttgattccgctcatgctcgaaaatggaggctccatcatcaacacctcctccatgtcaggccgtgccgcggaccttgaccgctccggctacaacgccgcaaaaggcggtatcaccaacctgacaaaggcaatggcaatcgactacgcacgaaacggcatccgcgtcaattccatttcaccgggcacgatcgaaacaccgctgattgacaaattagcaggcacaaaagaacaggaaatgggcgaacaattccgcgaagccaacaaatggatcacgccgctcggacgtcttggccagcccaaagaaatggcaacagtggcactgttcctcgcatcagacgacagctcatacgtcacaggagaagacatcaccgcagacggcggcatcatggcgtacacatggcctgggaagatgctgattgaggagaaatggaaggaagaaacgaaataa

SEQ ID NO: 62164 - protein, 273 aa, Bacillus subtilis
MGRLENKTAVITGAATGIGQATAEVFANEGARVIIGDINKDQMEETVDAIRKNGGQAESFHLDVSDENSVKAFADQIKDACGTIDILFNNAGVDQEGGKVHEYPVDLFDRIIAVDLRGTFLCSKYLIPLMLENGGSIINTSSMSGRAADLDRSGYNAAKGGITNLTKAMAIDYARNGIRVNSISPGTIETPLIDKLAGTKEQEMGEQFREANKWITPLGRLGQPKEMATVALFLASDDSSYVTGEDITADGGIMAYTWPGKMLIEEKWKEETK

SEQ ID NO: 62165 - DNA, 26 bp, Primer
atgtttatcctgtattttcagaggga

SEQ ID NO: 62166 - DNA, 24 bp, Primer
ttagataccgacgctaaccgtctc

SEQ ID NO: 62167 - protein, 285 aa, consensus
  MISC_FEATURE (1)..(285): consensus for the disclosure of xaa see table XV
AXXTGXXXXXXXXGIGXXXAXXXXXXGAXXXXXXXXXXXXXXXXXXXXXXXXXXXXXXXXXXXXXXXXXXXXXXXXXXXXXXXXXXXXXXGXXXXDXLXNNAGXXXXXXXXXXXXXXXXXXXXXXXXXXXXNLXXXXXXXXXXXXXMXXXXXXXXXXGXIXNXXSXXXXXXXXXXXXXXYXXXKXXXXXXXXXXAXEXXXXXXXXNXXXPGXXXTXXXXXXXXXXXXXXXXXXXXXXXXXXXXXXXXXPXXRXGXXXXXAXXXXXLASXXXXXXXTGXXXXXXGG

SEQ ID NO: 62168 - protein, 26 aa, consensus
  MISC_FEATURE (1)..(26): consensus for the disclosure of xaa see table XV
XXXXXXXXXGXGXXXXXXXXXXGXXX

SEQ ID NO: 62169 - protein, 9 aa, consensus
  MISC_FEATURE (1)..(9): consensus for the disclosure of xaa see table XV
XXXXXXXAG

SEQ ID NO: 62170 - protein, 58 aa, consensus
  MISC_FEATURE (1)..(58): consensus for the disclosure of xaa see table XV
GXXXXXXSXXXXXXXXXXXXXXYXXXKXXXXXXXXXXXXXXXXXXXXXNXXXPGXXXX

SEQ ID NO: 62171 - protein, 37 aa, consensus
  MISC_FEATURE (1)..(37): consensus for the disclosure of xaa see table XV
XXXXXXXXXXXXXXXXXXXXXXXXXXXXXXXXXXXXG

SEQ ID NO: 62172 - DNA, 759 bp, Escherichia coli
  CDS (1)..(759)
atgagtccagtgcttacacaacatgtcagccagcccatcacgctggacgagcaaacgcaaaagatgaagcggcatttgctacaggatatccgtcgctcggcttacgtttatcgcgtcgattgcggcggctgcaacgcctgtgaaatcgaaatttttgctgccattacaccagtattcgacgcagaacgttttggcattaaggttgtttcatcaccgcgtcacgccgatattttgttatttactggcgcagtcacccgggcgatgcgtatgcctgcacttcgggcgtatgagtctgcccccgatcataaaatttgtgtttcctacggcgcgtgcggtgtcggcggcggtattttccacgatctctacagcgtctggggcggtagcgacaccattgtccccattgatgtttggatccccggctgcccgccaacaccggccgccaccattcacggtttcgccgtggcgctcggtttgctgcaacagaagattcacgctgtggattatcgcgatcccaccggggtgactatgcaaccgttgtggccgcagatcccgccatcacagcgtatcgccattgagcgagaagcgcggcggctggcgggctatcgtcaggggcgagaaatttgcgatcggctcctgcgccatttaagcgacgatcctacaggaaatcgggttaacacctggttgcgcgatgccgacgatccacgtctcaatagtatcgttcagcaactctttcgcgtactccgggggttacatgactga

SEQ ID NO: 62173 - protein, 252 aa, Escherichia coli
MSPVLTQHVSQPITLDEQTQKMKRHLLQDIRRSAYVYRVDCGGCNACEIEIFAAITPVFDAERFGIKVVSSPRHADILLFTGAVTRAMRMPALRAYESAPDHKICVSYGACGVGGGIFHDLYSVWGGSDTIVPIDVWIPGCPPTPAATIHGFAVALGLLQQKIHAVDYRDPTGVTMQPLWPQIPPSQRIAIEREARRLAGYRQGREICDRLLRHLSDDPTGNRVNTWLRDADDPRLNSIVQQLFRVLRGLHD

SEQ ID NO: 62174 - DNA, 582 bp, Thermococcus kodakaraensis
  CDS (1)..(582)
atgcagaacggtgatgtaatacactacgaactgaaggagttccagctcttcgagcccctcttcaggtgggctagaaagaagagcctctggatagtggccttctgtaccggctgtggcggtatcgagatgccgccgttagccaccgccaggtacgacttcgagcgtttcggaataatgcccaacccagcccccaggatggcagacctcttcctcatcacgggctacgtcacgccgaagacactcaagaggataatcataacctacgagatgatgcaggatccgaagtacgtactcgcccacggctcctgtccgataaacggtggcgtctactgggactcctacaacgtggttaaacagctcgacaagtacataccgattgacgttgccatagccggctgcatgccgcggccggaagctgtcatggacggaataatggagataatgcgcaagattgagaacggtgaagccgacggctggaagaggtacaaggagaactacgagtggtacaagaagaaccaggatgagctgttcggcgaaggatggcgtgagaaggatgcaaggaggtggctcgcatggatatga

SEQ ID NO: 62175 - protein, 193 aa, Thermococcus kodakaraensis
MQNGDVIHYELKEFQLFEPLFRWARKKSLWIVAFCTGCGGIEMPPLATARYDFERFGIMPNPAPRMADLFLITGYVTPKTLKRIIITYEMMQDPKYVLAHGSCPINGGVYWDSYNVVKQLDKYIPIDVAIAGCMPRPEAVMDGIMEIMRKIENGEADGWKRYKENYEWYKKNQDELFGEGWREKDARRWLAWI

SEQ ID NO: 62176 - DNA, 531 bp, Thermococcus kodakaraensis
  CDS (1)..(531)
atggcgataacagttcccgccaaccaaaacgggcagaaatcaaatccatcggagcgcgagaggctcgaaaagagaatagcccagctctgcaggttccttggaaagtcgccctgggtattccacgtaaacagcggctcgtgcaacggctgcgacatcgagataatagccgctctaacaccgcgctacgacgctgagcgctttggagtcaagctcgtcggcagcccaaggcacgcagatatactggtcgttacgggccccgtgaccaaccagagccttgagagggttaaactcgtctacgagcagacaccagacccaaagatagtcatagccgttggagcatgcccaaccggtggaagcgtcttctacgagagcccgttcacaaacgccccgctggacagggttatccccgtggacgtttatgttcccggctgcccgccgaggcctgaggccattctacacggcgtcgttcttgccctggagaagctcgccaggatgattaagggggaggttccagaggaggtgggagaatga

SEQ ID NO: 62177 - protein, 176 aa, Thermococcus kodakaraensis
MAITVPANQNGQKSNPSERERLEKRIAQLCRFLGKSPWVFHVNSGSCNGCDIEIIAALTPRYDAERFGVKLVGSPRHADILVVTGPVTNQSLERVKLVYEQTPDPKIVIAVGACPTGGSVFYESPFTNAPLDRVIPVDVYVPGCPPRPEAILHGVVLALEKLARMIKGEVPEEVGE

SEQ ID NO: 62178 - DNA, 1062 bp, Archaeoglobus fulgidus DSM 4304
  CDS (1)..(1062): transl_table=11
gtgatatcaatggatgaattcatcgaatttgttagaggaggcccgcttggccctattaagaagtggggaaccaagtggagcctgtggccggtccacctcgttacagcatgctgcggagctgaacttgctcacgctttcgcctgtggttatgacggagagaggatcggcgccctcaactacggtatcgcgaggcagacgaacctcataattgttgagggagcaatcacaagaaagatggcgaaagttttgaggataacatgggagcagatgcctgatccgaagttcgtcatcgtgatgggggcttgcggtttgcagggaggaatcttctggaatggctatcacatggtcaaaccatccgacgtagttccggttgacttcttcattcccggctgtcccccaacccctgaggccctgctcagggggataaggcagcttcagttcaagatagagaccggcgaggcaaagacctccgcaacattccccgaagtacctctggaggctggcagaaagccaagagttctgccaaaatcaccgaagaaaatatctaaggcaccggcagtcatagtgaacgctccgaaggaggttgattgggagttcggccagaagctggttgaggagattaaggcgaaagtggaggccaaatctgtgacaattaccggaaagaacagaatagctgttaaggtggaaagcgattacattccaagggctgcaatgaggctgagggagatggggttcgaccacgttaagaacgttaatgtgatagacgtaccgaatgaggacaagttcatcgtggagtaccacttctccagctacagcgtcaaagaactcatgccggtcatagtcaacgtctttgcggatattccgagagagaatccgagggtgaagagccttgcgagcatgttcccgagtgcggattacatggagagggagatgcacgacttctttggcgtaatcttcgagggcaatccgtggatgggcagaaagttccttctcgctccagacgctccggagttcccgctgagaaaggacttcaagcttgaggaggaggtttacgtgaggtga

SEQ ID NO: 62179 - protein, 353 aa, Archaeoglobus fulgidus DSM 4304
MISMDEFIEFVRGGPLGPIKKWGTKWSLWPVHLVTACCGAELAHAFACGYDGERIGALNYGIARQTNLIIVEGAITRKMAKVLRITWEQMPDPKFVIVMGACGLQGGIFWNGYHMVKPSDVVPVDFFIPGCPPTPEALLRGIRQLQFKIETGEAKTSATFPEVPLEAGRKPRVLPKSPKKISKAPAVIVNAPKEVDWEFGQKLVEEIKAKVEAKSVTITGKNRIAVKVESDYIPRAAMRLREMGFDHVKNVNVIDVPNEDKFIVEYHFSSYSVKELMPVIVNVFADIPRENPRVKSLASMFPSADYMEREMHDFFGVIFEGNPWMGRKFLLAPDAPEFPLRKDFKLEEEVYVR

SEQ ID NO: 62180 - DNA, 669 bp, Thermoplasma volcanium GSS1
  CDS (1)..(669): transl_table=11
atgagcagtatttggtttcttaatggggtgaaaaaaggaataaagacagaaagatatccttatgcagagcccgtttcagcgccacagtggccatcacgcctgtccgggcatgatgggggcaattgccctgtagatgcaataacgcctgatggatgggttatggaaaaatgcatattctgccggagatgcctgccagattataagccgacgggtgatcaacgcattttcaccatcaagaagactgaagatacgttcaggagatcgtttcatgtcttccccattgattccggggcttgtggcgcctgcaacatggaatttctaagcatattttctccacagtacgatgcaaacaggttaggaatatttatggttaatacaccgcgctatgcggacgctttaatagtaatgggggtgatgactcctggaatgaaggaggccctagacagagcctatgaggcaatgccagagccaaagcttgtcattgctatgggagcatgcgctgttacaggcggcattatgggtgagaaccctctagacagagaaaagtacaatgtggaaattgcgggatgcccgccttcgccgtacacattgattgctgcactcaacgctgcgatgaaagataagagaaaagctgattattttgaatcgaaaagacaagaggtgcactga

SEQ ID NO: 62181 - protein, 222 aa, Thermoplasma volcanium GSS1
MSSIWFLNGVKKGIKTERYPYAEPVSAPQWPSRLSGHDGGNCPVDAITPDGWVMEKCIFCRRCLPDYKPTGDQRIFTIKKTEDTFRRSFHVFPIDSGACGACNMEFLSIFSPQYDANRLGIFMVNTPRYADALIVMGVMTPGMKEALDRAYEAMPEPKLVIAMGACAVTGGIMGENPLDREKYNVEIAGCPPSPYTLIAALNAAMKDKRKADYFESKRQEVH

SEQ ID NO: 62182 - DNA, 513 bp, Pyrococcus abyssi GE5
  CDS (1)..(513): transl_table=11
atgacgataaaattgcccgctcaaacagaagagaggaaaagactggaaagaaggattgcacagttatgcagattcattgggagatctccttgggtgtttcacgttaactccggatcatgcaatggatgcgatatagagataatagcagccctcaccccaaggtacgacgctgaaagattcggagttaagctggtaggttccccaaggcatgcggacatacttctagttactggtccagtaacgaatcagagcctcgaaagggttaagctcgtttacgagcaaacaccagaaccgaagatagttattgcaattggctcctgcccaacgggaggtagcgtgttctacgagagtccgtttacgaatgcacccctagacagggttatacccgtagacgtcttcgttcctgggtgtccacctaggccagaggctatccttcatggcgttgttctagccttagagaagttagctaaaatgcttaagggagaggttccacccgaggagggagaggaatga

SEQ ID NO: 62183 - protein, 170 aa, Pyrococcus abyssi GE5
MTIKLPAQTEERKRLERRIAQLCRFIGRSPWVFHVNSGSCNGCDIEIIAALTPRYDAERFGVKLVGSPRHADILLVTGPVTNQSLERVKLVYEQTPEPKIVIAIGSCPTGGSVFYESPFTNAPLDRVIPVDVFVPGCPPRPEAILHGVVLALEKLAKMLKGEVPPEEGEE

SEQ ID NO: 62184 - DNA, 816 bp, Pyrococcus abyssi GE5
  CDS (1)..(816): transl_table=11
gtgaggaagtttaagtctctctgggtatatcacgttgatgcgggctcctgtaacggttgcgacatcgaagttcttgatgttttaacgccgtactacgatttggaaaggctcggtataaaggtggttcccaatcccaggcatgccgatgctttgcttatcacgggccccctcacgaggcagacaaggatggcaataaagaaagcgtacgaagcgatgcccccaaagcccaggatagtggttgccattggaacgtgcgcgtgtagcggtggaatcttctacaacagctatgccctctacaacacctcgcctgaaaggggaagggataggttaaggagcggtggaattgagatggttgttccagttgacatgtacattcctgggtgcccgcctagtcccgaggagatactctacggcttggctcaactgctcggtataaaggagaagaggatgaagggagagcattggaaggcccttcctcctggagaagaggggaaggctgagaacgaggtcgagttcactattcctgagaggggaatttctctaaggctttggctaaccctcagggaggagcttaggaggatcgttggatatttcgacagagaggcggtgcttaacgagttcataaaactcgtggaagaagcggagaagagcgagaatcccaaagataaactgcacgagctcgtgagtgagtacgtgcttagagagggagactcgaggattagggttgcgatgatgtttctcgagaacgaatactggaggctcaaagatgagtacgagaggaggaaggtgggtcttgctaaagctaaggtactatga

SEQ ID NO: 62185 - protein, 271 aa, Pyrococcus abyssi GE5
MRKFKSLWVYHVDAGSCNGCDIEVLDVLTPYYDLERLGIKVVPNPRHADALLITGPLTRQTRMAIKKAYEAMPPKPRIVVAIGTCACSGGIFYNSYALYNTSPERGRDRLRSGGIEMVVPVDMYIPGCPPSPEEILYGLAQLLGIKEKRMKGEHWKALPPGEEGKAENEVEFTIPERGISLRLWLTLREELRRIVGYFDREAVLNEFIKLVEEAEKSENPKDKLHELVSEYVLREGDSRIRVAMMFLENEYWRLKDEYERRKVGLAKAKVL

SEQ ID NO: 62186 - DNA, 447 bp, Methanothermobacter thermautotrophicus str. Delta H
  CDS (1)..(447): transl_table=11
atgttggatgcccttaaaagtattctgaggaaaacatcaatccatgtatgccttgtaaatacaggggggtgcaacggctgtgatatagaggtcctcgcactcctctcaccaagatatgaccttgaacagtacggtatatacgtccaccagaaccccagggaggccgatgtcatacttgtaaccggtgcagttacagagcagtggagggagaaactccagaggatctaccgcaaggcaccggagccaaagatagtggtggccctgggcaactgtccaatatccggtgacgtattcaaccaggagggtggaagcgtctatgcaccggtctccgacttcataccggtggatgcagaggtgcccggctgcccccccagaccatcagagatacttgaagcaatactggcggtggcgcccggggccatagcagagagggggaagaagagatga

SEQ ID NO: 62187 - protein, 148 aa, Methanothermobacter thermautotrophicus str. Delta H
MLDALKSILRKTSIHVCLVNTGGCNGCDIEVLALLSPRYDLEQYGIYVHQNPREADVILVTGAVTEQWREKLQRIYRKAPEPKIVVALGNCPISGDVFNQEGGSVYAPVSDFIPVDAEVPGCPPRPSEILEAILAVAPGAIAERGKKR

SEQ ID NO: 62188 - DNA, 447 bp, Methanothermobacter thermautotrophicus str. Delta H
  CDS (1)..(447): transl_table=11
atgggacttaaatcattttcaagggcaagggcagtacatgcaatgctcgtatacacagggggatgcaatggctgcgatatagagatcgtaaacgcagttttctcaccgaaatatgatgctgaacagtacaaaatattcctcacatggaacccaagggaggccgatgtcctcatagtaacgggtccggttacaaagcagaacgaggaaccactgaaggccatatacaatgcaatacccgaaccaaaggcagttatagctgcaggtgcatgcgcactcatgggcggtgtctacaagaacatacacggggacataccctctgaggagatctgcggcccagtggacaaggtcataccagttgatgccaaggtcccgggctgcgcagtaaggccagaggacgtacttgcaggtgcagtggcggcacttccaaaactgctggaggcggattga

SEQ ID NO: 62189 - protein, 148 aa, Methanothermobacter thermautotrophicus str. Delta H
MGLKSFSRARAVHAMLVYTGGCNGCDIEIVNAVFSPKYDAEQYKIFLTWNPREADVLIVTGPVTKQNEEPLKAIYNAIPEPKAVIAAGACALMGGVYKNIHGDIPSEEICGPVDKVIPVDAKVPGCAVRPEDVLAGAVAALPKLLEAD

SEQ ID NO: 62190 - DNA, 480 bp, Mycobacterium tuberculosis CDC1551
  CDS (1)..(480): transl_table=11
atgggttgggttgccaagattttccgtgttggccgggtggtcgagcccgcggcccccttaccggcggcgatagccgaaccacccgccggggtacggggttcgctgcagatccgacatgttgacgcgggttcgtgcaacgggtgtgaggtggagatttcgggcgcctttggcccggtgtatgacgcggagcggttcggggcgcggctggtcgcctcgccccgacacgccgatgcgttgttggtgaccggcgtggtcacgcacaacatggccggcccactgcgcaagaccctggaggccacgccgcgcccgcgggtggtaatcgcgtgcggggattgcgcgctgaaccggggggtgttcgccgacgcctacggcgtggtcggtgcggtcggcgaggtggtacccgtcgacgtcgagatcgccggctgcccgccgacacccgcggccatcatggcggcgctgcgatcggtgaccgggaaatga

SEQ ID NO: 62191 - protein, 159 aa, Mycobacterium tuberculosis CDC1551
MGWVAKIFRVGRVVEPAAPLPAAIAEPPAGVRGSLQIRHVDAGSCNGCEVEISGAFGPVYDAERFGARLVASPRHADALLVTGVVTHNMAGPLRKTLEATPRPRVVIACGDCALNRGVFADAYGVVGAVGEVVPVDVEIAGCPPTPAAIMAALRSVTGK

SEQ ID NO: 62192 - DNA, 606 bp, Sulfolobus solfataricus P2
  CDS (1)..(606): transl_table=11
gtgaagaattggtggtttattagaggtttaagaaaaggagtaatgacagagaaatacccgaaggaaatagcggaatggagcactgaaatacaaggagagggaactgtaaactgtccaacaaacgccataaaggatggaaagtggataaaggaaagatgcgtattttgcagaagatgctatcccaactatagaccaaatctcaatccaagaatatatacaataaacaaaacacaacccctcttcaaaaggtcattttacctttacccaatagactccggcacatgcggaggatgtaacatggaactgaagctgatctcatcaccagaatacgatatgacaagatttagcatattcttcaccaatactccaagacatgcagacgcattagtagtaatgggggtaatgacagagaaaatgaaagaagtgttaaaaaaagcttatgaagcaatgccagaacccaaagtagttatattattaggtgcttgcgctatctcaggaggaataataggcgaaggagtaccattagaagcagtagtggaaatccccggttgtccaccaaatccctttacaatactcgaagccttgatgaaggtgaagggaaaatga

SEQ ID NO: 62193 - protein, 201 aa, Sulfolobus solfataricus P2
MKNWWFIRGLRKGVMTEKYPKEIAEWSTEIQGEGTVNCPTNAIKDGKWIKERCVFCRRCYPNYRPNLNPRIYTINKTQPLFKRSFYLYPIDSGTCGGCNMELKLISSPEYDMTRFSIFFTNTPRHADALVVMGVMTEKMKEVLKKAYEAMPEPKVVILLGACAISGGIIGEGVPLEAVVEIPGCPPNPFTILEALMKVKGK

SEQ ID NO: 62194 - DNA, 489 bp, Methanopyrus kandleri AV19
  CDS (1)..(489): transl_table=11
atgagcctgaagtcagcgcttaaaaaattgaaagggtttgtgagatctaggtctattcatgtgacagtagtgaacactggtgggtgtaatggatgcgatattgaaattttagcttgctacacttatcgatacgatctagaacagtacggtatctattaccacaataatccgaggaaatctgacgttctaatagttactggaccagttacgtatcaatggcgagataagctagtcaagctgtaccacaaggtccccgagcccaaggccgtcgtcgctgtgggcacctgcgcgtgctctggcggcatcttcaaccagcgaggaggccgcgtatgtgggccggtacgcgaggtgatccccgtagacgctgaggttccaggatgtccaccacggcccgaggagatagtctccgcggtcgtcgacgtgcttcctgctttgttccgcagttgggagttccgtaggggtggggcccgtgaagcgcaggaggcgtga

SEQ ID NO: 62195 - protein, 162 aa, Methanopyrus kandleri AV19
MSLKSALKKLKGFVRSRSIHVTVVNTGGCNGCDIEILACYTYRYDLEQYGIYYHNNPRKSDVLIVTGPVTYQWRDKLVKLYHKVPEPKAVVAVGTCACSGGIFNQRGGRVCGPVREVIPVDAEVPGCPPRPEEIVSAVVDVLPALFRSWEFRRGGAREAQEA

SEQ ID NO: 62196 - DNA, 555 bp, Methanosarcina acetivorans C2A
  CDS (1)..(555): transl_table=11
atgggtgaagtgaaggagacaaaaacgaacaacacaacaggaactccggaagaagaaattcccggcgtaatcacaacaactaccaatgcgatcagcgactttctcaagaaaaccaaggctcaggacctgatcaactgggggcgaaaaaactcgctctggttcatgacccagccaatgggttgctgcggtgtggaaatgatcgctacgggctgtgcccattatgatactgaccgcttcgggattatccccaggaactccccgaggcatgcggatgtcatgatcatcagtggttatgtgacaaaaaaatacctgcctgccttaaaaaggctctgggaacagatgccggctcccaaatgggttatcgccatgggggactgttcgatcagcggcggtcccttctatgagtcttacagcacggtgcagaatatcgatgaactctttcctatcgatgtcttcattcccggatgcccgcccagacccgaagccctgatccaggggtttgtggaactgcaggaaaagattaaagccaaaaaagaccggggcacggaatactga

SEQ ID NO: 62197 - protein, 184 aa, Methanosarcina acetivorans C2A
MGEVKETKTNNTTGTPEEEIPGVITTTTNAISDFLKKTKAQDLINWGRKNSLWFMTQPMGCCGVEMIATGCAHYDTDRFGIIPRNSPRHADVMIISGYVTKKYLPALKRLWEQMPAPKWVIAMGDCSISGGPFYESYSTVQNIDELFPIDVFIPGCPPRPEALIQGFVELQEKIKAKKDRGTEY

SEQ ID NO: 62198 - DNA, 513 bp, Methanosarcina acetivorans C2A
  CDS (1)..(513): transl_table=11
atggtaaaccctctttccctctttctccgccctaaagttacggagacctttaaattccgggatgaagaactcgaagcacttggagaagaaatcaaaaaagagatcccgaaagttttcgggcacagccttgccatccgcgaactggattcaggcagtgacaactccaccgagattgagatctcaaacctcgggaaccctcattatgatgttgagaggttcgggatctcttttgtggcttccccgaggcatgctgacatcctgctagtaacaggagctgtcacccttaacatggcggaagccgtgaaaaaaacctatgaagccatgccctcccctaagtttgtggtagcagtcggagacgacgcttgtgacggcgggatttataaggattcttatgccgtactcagcggggttgacaaaatcctgcccgtggatatgaaaattcccgggaacccgccctctccgaaagagattttgaaagggattttagcccttgtaaaaaaagcctctaaataa

SEQ ID NO: 62199 - protein, 170 aa, Methanosarcina acetivorans C2A
MVNPLSLFLRPKVTETFKFRDEELEALGEEIKKEIPKVFGHSLAIRELDSGSDNSTEIEISNLGNPHYDVERFGISFVASPRHADILLVTGAVTLNMAEAVKKTYEAMPSPKFVVAVGDDACDGGIYKDSYAVLSGVDKILPVDMKIPGNPPSPKEILKGILALVKKASK

SEQ ID NO: 62200 - DNA, 744 bp, Thermoanaerobacter tengcongensis MB4
  CDS (1)..(744): transl_table=11
atggaaccagaagctaagttacaagaacttaaagcaaagttgaaaaatgtcattaaacgttctgcctacctctacagggtagactgtggcggatgtaatggatgcgagattgaaattttcgctgctatctcacctgtttatgacccagaaaggtttggcatcaaaatagtgtcctcgccgcggcatgctgatattcttctctttaccggacctatgacaagggctatgcggcttcctgctatacgggcgtataaagcagcacctgaccctaaaatcgtagtggcttacggcgcttgtggctgcagtggcggtatttttcacgactgctattgtgtatggggaggaattgacaaattctttcccgtagatgtatatatccccggctgtcctccaactccggctgctactttgtacggcttagctgtggctttggatttgctacatcagaaaattaaaggagagcagtttgtagaaacagaggttacccctgttcctgcaaaatatgagggggtttgccctgacctagctaaggatattgaaagggaagcccgacgcctgagcggttacttgcatggtaggcggatagctgcacaatatctggaatttgtgaaacaaggagacccgctgtcagtagatcgcaaaattaaagagttggtaaaacaacaaaaagatccacgattggctgaaatttttttaagtttgcacaaaatttacatggaaagggtaggtcatgatgccgggtaa

SEQ ID NO: 62201 - protein, 247 aa, Thermoanaerobacter tengcongensis MB4
MEPEAKLQELKAKLKNVIKRSAYLYRVDCGGCNGCEIEIFAAISPVYDPERFGIKIVSSPRHADILLFTGPMTRAMRLPAIRAYKAAPDPKIVVAYGACGCSGGIFHDCYCVWGGIDKFFPVDVYIPGCPPTPAATLYGLAVALDLLHQKIKGEQFVETEVTPVPAKYEGVCPDLAKDIEREARRLSGYLHGRRIAAQYLEFVKQGDPLSVDRKIKELVKQQKDPRLAEIFLSLHKIYMERVGHDAG

SEQ ID NO: 62202 - DNA, 513 bp, Methanosarcina mazei Go1
  CDS (1)..(513): transl_table=11
atggtaaaccctctttcccttttccttcgtccgaaagttacggagacatttgagttcagggacgaagaactggaagcccttggagcacaaataaaaaaagaaattcctaaagttttcgggcacagccttgcaatccgtgagctggactcgggaagcgacaattctacggagatggaaatttctaaccttggaaacccgcattatgatgttgagagattcgggatttcttttgtagcgtctcccaggcatgctgatgtccttctggttacaggggcagtcacccttaatatggctgaagccgcaaaaaagacctatgaagccatgccttaccccaagtatgtaatagcagtcggagacgacgcctgtgacggcgggatctacaagggttcttacgccgtacttgggggagttgacaaaatccttcccgtggatgtaaaaattccagggaacccgccctctccaaaagaaattcttcagggaatttttgcccttgtaaaaaaagcccgggaataa

SEQ ID NO: 62203 - protein, 170 aa, Methanosarcina mazei Go1
MVNPLSLFLRPKVTETFEFRDEELEALGAQIKKEIPKVFGHSLAIRELDSGSDNSTEMEISNLGNPHYDVERFGISFVASPRHADVLLVTGAVTLNMAEAAKKTYEAMPYPKYVIAVGDDACDGGIYKGSYAVLGGVDKILPVDVKIPGNPPSPKEILQGIFALVKKARE

SEQ ID NO: 62204 - DNA, 471 bp, Methanosarcina mazei Go1
  CDS (1)..(471): transl_table=11
atgagtttagcaaaatcaccatggatcatacatgtgaattgtaacagctgcaatggctgtgacattgaggtagtagcctgtcttacccctttatatgatgctgaaagatttggcgttttaaatatcggtactcccaagcaagctgatataatggtagttacaggctctgtaaattataaaaatgtcaatgtactcaaaaatctttacaaccagatcccggacccgaaggttgttttagctgtcggtgcctgtgcatctactggtgggatattccataactgctataatgttataggcggagtggaccagataatacccgtagatgcatatgttcccgggtgctgtccaaggcccgaagccatacttgacggcgtagtagcagcactttcaatacttgaaaataagaagaaagggaacatcaaaggaaaagaagtaccattgaaaggaaaagaggtgccatcgaatgcttaa

SEQ ID NO: 62205 - protein, 156 aa, Methanosarcina mazei Go1
MSLAKSPWIIHVNCNSCNGCDIEVVACLTPLYDAERFGVLNIGTPKQADIMVVTGSVNYKNVNVLKNLYNQIPDPKVVLAVGACASTGGIFHNCYNVIGGVDQIIPVDAYVPGCCPRPEAILDGVVAALSILENKKKGNIKGKEVPLKGKEVPSNA

SEQ ID NO: 62206 - DNA, 555 bp, Methanosarcina mazei Go1
  CDS (1)..(555): transl_table=11
atgggtgaagtgaaggagacaaaaacgaataactcaaaggaaaacccggaagaagaagtccccggagtcatcacaacaactacaagtgcaatccacaatttcctcaagaaaacaaaggctcaggacataatcaactggggacggaaaaactctctctggttcatgacccagcccatgggctgctgcggtgtggaaatgattgcaaccggctgcgcccattacgatactgaccgtttcgggattattccgaggaactccccaaggcatgcggatgtcatgatcatcagcggctacgtgacaaaaaagtatcttccggcgttaaagaggctctgggaccagatgcctgcgcccaaatgggttattgccatgggggactgtgcaatcagcggcggaccattttacgagtcctacagcactgttcagaacatcgacgaaatcttccctatcgatgtatatattccgggatgtccccccagacctgaagccctgatccaggggtttgtggaactgcaggaaaaaataaaagccagaaaggaccggggaacggaatactga

SEQ ID NO: 62207 - protein, 184 aa, Methanosarcina mazei Go1
MGEVKETKTNNSKENPEEEVPGVITTTTSAIHNFLKKTKAQDIINWGRKNSLWFMTQPMGCCGVEMIATGCAHYDTDRFGIIPRNSPRHADVMIISGYVTKKYLPALKRLWDQMPAPKWVIAMGDCAISGGPFYESYSTVQNIDEIFPIDVYIPGCPPRPEALIQGFVELQEKIKARKDRGTEY

SEQ ID NO: 62208 - DNA, 534 bp, Bradyrhizobium japonicum USDA 110
  CDS (1)..(534)
atgcgcaagctgctttttgagagcctgtttcgccggccgttcaccgagcaagcaccgtcaccggacgatgccgcggtgaccgagctcgcaactgccgtcggtcgcgcggcacgacggcgcctcggccgaagcctctcgatacgcgaggtcgatgcaggatcttgcaacggatgcgaacttgaaatccacgcgttgaacaatgcctattacgacgtcgagcgcttcggtctccggttcgttgcgtcgccgcgtcacgccgatgtgttgatggtgaccggaccggtgacgaagaacatgcgcgacgcgttggagcgcacctatcatgcgacccccgatccgaaatgggtcgtcgccgtcggagattgcgcccgggatggcggctgctttgccggcagctatgcggtggtaggaggggtctcgcaggtggttcccgtcgatcttcatattcccggctgtcctccgccgcccaccacgatcttgcgaggacttctcgccctactcgatcaggcggccaagaacaccagttccatttga

SEQ ID NO: 62209 - protein, 177 aa, Bradyrhizobium japonicum USDA 110
MRKLLFESLFRRPFTEQAPSPDDAAVTELATAVGRAARRRLGRSLSIREVDAGSCNGCELEIHALNNAYYDVERFGLRFVASPRHADVLMVTGPVTKNMRDALERTYHATPDPKWVVAVGDCARDGGCFAGSYAVVGGVSQVVPVDLHIPGCPPPPTTILRGLLALLDQAAKNTSSI

SEQ ID NO: 62210 - DNA, 768 bp, Salmonella enterica subsp. enterica serovar Typhi Ty2
  CDS (1)..(768): transl_table=11
atgagcaatttattaggcccgcgtgacgccaacggcattccggtaccgatgacggtggatgaatccatcgccagcatgaaggcgtctctactgaaaaatattaagcgttcggcatacgtttaccgcgtggactgcggcggctgtaacggctgtgaaatcgaaatctttgcgacgctttcgccgctgtttgatgccgagcgtttcggcatcaaagtagtaccgtcgccgcgtcatgccgatattctgctgtttaccggcgtggtgacccgcgccatgcgctctccggcgctgcgcgcctggcagtcggcgccggacccgaaaatttgtatctcttacggcgcctgcggcaacagcggcggcatcttccatgatctgtactgcgtctggggcggtaccgacaaaatcgtcccggtggatgtgtacattccaggctgcccgccaacgcctgccgccacgctgtatggctttgcaatggcgcttggcctgctggagcagaaaatccacgcccgcgcgccgggtgagctggacgatcagcccgcagagatcctgcatccggatatggtgcagccgctgcgcgtgaaggtggatcgcgcggcgtgccggctggcgggttatcgctatggtcgtcagatcgccgatgattacctgacacagttggggcagggcgagcagcaagtggcgcgttggctggaagcggaaaacgatccgcgtttaaccgaaattgtcatccatctcaatcatgttgttgaagaggcgcgtatccgatga

SEQ ID NO: 62211 - protein, 255 aa, Salmonella enterica subsp. enterica serovar Typhi Ty2
MSNLLGPRDANGIPVPMTVDESIASMKASLLKNIKRSAYVYRVDCGGCNGCEIEIFATLSPLFDAERFGIKVVPSPRHADILLFTGVVTRAMRSPALRAWQSAPDPKICISYGACGNSGGIFHDLYCVWGGTDKIVPVDVYIPGCPPTPAATLYGFAMALGLLEQKIHARAPGELDDQPAEILHPDMVQPLRVKVDRAACRLAGYRYGRQIADDYLTQLGQGEQQVARWLEAENDPRLTEIVIHLNHVVEEARIR

SEQ ID NO: 62212 - DNA, 831 bp, Wolinella succinogenes DSM 1740
  CDS (1)..(831): transl_table=11
atgaaaatctatgatatgcccgaagagataaaagtcgccaatgagatagagcagaagctggagctcctcaaacatattgggcggagcttcagcgtctatcgaatcgactgcgggagttgcaatggctgtgagatcgagatttttgctgcgatcacgcccttgtgggatccagagcgctttggatttaagctcgtggccaatccacgccatgcggatattctgctctgcacagggcctgtgacgaggcagatgtattatccgcttttgcgtgcctatgaggctgctccagaccccaagcttgtggtggctttaggtgcttgtggctccacgggaggaatcttttatgatgcctatagcgtcttgagtgggatcgacaaaatcatccccgtggatgtctatatccctggatgtccgcctcatcctgcgagtatcatctatgggctcacgacggctcttggtgtgatggagcagaagctgcagcgggtgagctttgaacatgatagcgagatgccccctttggtgggcgattcgcttttggggaacaccctttttgagcgagacctattggtgtacgccaagcgcctcatgagctatgtgtttgggcggacgctctatgataaatacctcgccgccctcgcgcaaagccctgaggtcaaaaatcccaaagccgccaaagccgctcttgtgctagccatgaaagaggagagtgacccgcgctatgcagagtgcatgggaatcttgcataatgaggtctattcggcgtatgttccttgcgaggaggaggagaagatcgcactcaatcaaatctcgtggggagagggcaagtggtag

SEQ ID NO: 62213 - protein, 276 aa, Wolinella succinogenes DSM 1740
MKIYDMPEEIKVANEIEQKLELLKHIGRSFSVYRIDCGSCNGCEIEIFAAITPLWDPERFGFKLVANPRHADILLCTGPVTRQMYYPLLRAYEAAPDPKLVVALGACGSTGGIFYDAYSVLSGIDKIIPVDVYIPGCPPHPASIIYGLTTALGVMEQKLQRVSFEHDSEMPPLVGDSLLGNTLFERDLLVYAKRLMSYVFGRTLYDKYLAALAQSPEVKNPKAAKAALVLAMKEESDPRYAECMGILHNEVYSAYVPCEEEEKIALNQISWGEGKW

SEQ ID NO: 62214 - DNA, 471 bp, Methanococcus maripaludis S2
  CDS (1)..(471): transl_table=11
atgattaaagattttgtaagaaaacgatcaattaacgtctgtctcgtaaacaccggcggttgcaacggttgcgatatcgaaatagtatcttgccttgccccaaggtacgatattgaacagtacggaatttatgtgcataacaatccaagagaagccgatgttttagttgtaaccggtcctgtaaccggagcttgggaaaaaagacttcttgaaatttacgaaaagacccctgaaccaaaaatagttatcgcagttggtgcatgcgcacttagcggtggaatatttaaagaaggacatattcacgggcctgttgataaagtaattcctgtggatgcaaaacttccaggatgccctccaagaccttcagaaatcatatctgcagtggtatcaattgccccagatgcacttgcggctaaagaaaaactgcttaatcaaaaattaaaagaagaaaaaaataaagtcaaagcatga

SEQ ID NO: 62215 - protein, 156 aa, Methanococcus maripaludis S2
MIKDFVRKRSINVCLVNTGGCNGCDIEIVSCLAPRYDIEQYGIYVHNNPREADVLVVTGPVTGAWEKRLLEIYEKTPEPKIVIAVGACALSGGIFKEGHIHGPVDKVIPVDAKLPGCPPRPSEIISAVVSIAPDALAAKEKLLNQKLKEEKNKVKA

SEQ ID NO: 62216 - DNA, 444 bp, Methanococcus maripaludis S2
  CDS (1)..(444): transl_table=11
atgttaaaagagctttcaagaaagaaaaatattcacgtcatgcttgtttatactggcggatgtaatggttgcgatatcgaagttgtaaactgtgttttatcacctttttatgatgcagaacagtacaacgtatttttaacgtggaatccaagagaagcggacgttttggtggtaactggctgtgttacaaaggcagtttctgcatcacttaaaaaaatatacgatgaaattcctgaaccaaaagccgtagttgctgcaggggcctgtgcattgatgggaggagtttacaataacattggtgcagatttaggcacttccacatttattgatggtcctgttgaaaatataatccctgttgatgtgaaagttccaggatgccctccaagacctgaagatgtaatcacaggaattgtaaaagcgttgccaaaaatcttgaatggatga

SEQ ID NO: 62217 - protein, 147 aa, Methanococcus maripaludis S2
MLKELSRKKNIHVMLVYTGGCNGCDIEVVNCVLSPFYDAEQYNVFLTWNPREADVLVVTGCVTKAVSASLKKIYDEIPEPKAVVAAGACALMGGVYNNIGADLGTSTFIDGPVENIIPVDVKVPGCPPRPEDVITGIVKALPKILNG

SEQ ID NO: 62218 - DNA, 822 bp, Leptospira interrogans serovar Copenhageni str. Fiocruz L1-130
  CDS (1)..(822): transl_table=11
atgaaaagtatattcgaaatattgaatattattcgtcccgcaaagacgatgaactataaaaaagtatcccctctaaatccaaatgcgagaggaattcctattccggttttatcttcaaacgaatcttgcctaacttgcaaatcctgcgaacaggtctgtccaactcattccctcaagattatatctaaagataagatgagttttgattacggtgcttgccttcaatgtggaaaatgttccgaggtatgttctaacggaaagattatagattccggttttgttcatgtatattcgaccgatcgtgaaacgttacaagtagtatatacaaacggaatgccagatgaaaaaccggaagtggaaacggaagaaataaaacaattcagaaaggttactaaaaaaaccggctttcaatttagagaagtagcggctagtggaaataatacgaccgaagcggaaattaatgcaagtttcaacgctctttttgacagtgaggcaagtaagatccgagtagtagcttctccaaaacacgcagacgcactggtatattcagggccggtagggccaaacatggaaggtcccttagacacagcctgggaaactatgccttctccaaaagcacttgtagcctgcggatcggaagccgtttcgggtggtctttttaaattaggtaaacttccaaaacaaccggatttatttattggaggtgatcctcctcgtcctgatgtaatcgtttctgcgtttcgttatctaatgggaatctgggaattttcttttagagcagaactttcaaaacacgttcaaaatttaaggaatactaaatag

SEQ ID NO: 62219 - protein, 273 aa, Leptospira interrogans serovar Copenhageni str. Fiocruz L1-130
MKSIFEILNIIRPAKTMNYKKVSPLNPNARGIPIPVLSSNESCLTCKSCEQVCPTHSLKIISKDKMSFDYGACLQCGKCSEVCSNGKIIDSGFVHVYSTDRETLQVVYTNGMPDEKPEVETEEIKQFRKVTKKTGFQFREVAASGNNTTEAEINASFNALFDSEASKIRVVASPKHADALVYSGPVGPNMEGPLDTAWETMPSPKALVACGSEAVSGGLFKLGKLPKQPDLFIGGDPPRPDVIVSAFRYLMGIWEFSFRAELSKHVQNLRNTK

SEQ ID NO: 62220 - DNA, 474 bp, Desulfovibrio vulgaris subsp. vulgaris str. Hildenborough
  CDS (1)..(474): transl_table=11
atgagtctcatcaaagactggatcaacaagggccgcctcaagtccccgtgggtcgtccacttcgactgtggttcgtgcaacggctgcgacattgaagtgctcgcctgccttacccccgtgttcgacgtcgaacgcttcggcatcatcaacgtgggcaaccccaagcacgccgacgtactgctggtgaccggcacggtcaaccatcgcaacaagaaggtgctcaagaacatctacgaccagatgcccgaccccaaggccgtcatcgccatcggggcctgcggcagttcgggcggcgtgttccgcgagtgctacaacgtcgtcggcggcgtcgaccaggtcatccccgtcgacgtctatgtgccgggctgcccggccaagcccgaggccatcatcgacggcgtggtcaccgcgcttgaggtggtcaaggccaagcttggtctcgccgagatgcccaaagtgaccgtcatcgagtag

SEQ ID NO: 62221 - protein, 157 aa, Desulfovibrio vulgaris subsp. vulgaris str. Hildenborough
MSLIKDWINKGRLKSPWVVHFDCGSCNGCDIEVLACLTPVFDVERFGIINVGNPKHADVLLVTGTVNHRNKKVLKNIYDQMPDPKAVIAIGACGSSGGVFRECYNVVGGVDQVIPVDVYVPGCPAKPEAIIDGVVTALEVVKAKLGLAEMPKVTVIE

SEQ ID NO: 62222 - DNA, 435 bp, Desulfovibrio vulgaris subsp. vulgaris str. Hildenborough
  CDS (1)..(435): transl_table=11
atgaacctggtcaagaagctcgccgtacgctccccgtggttgtaccgcatcaacgccggatcatgtaacggctgcgacgtggagcttgccaccacggcgtgcattcctcgctacgacgtggaacggctcggttgcaaatactgcggcagcccccgccatgccgacatcgtgctcatcaccgggcccctcaccgcccgcgtgaaggacaaggtgctgcgcgtgtgggacgagatacccgccccgaagatcaccgtggccgtgggcatctgccccgtcagcggcggcgtcttccgcgacggctaccccatcgaggggccgctcgaccgctacatccccatcgacatcaacgtgccggggtgtccgccccgtccgcaggccatcatcgaaggcgtcgtcaaggcgcgcgacctgtggctcgaacgcataggaggctga

SEQ ID NO: 62223 - protein, 144 aa, Desulfovibrio vulgaris subsp. vulgaris str. Hildenborough
MNLVKKLAVRSPWLYRINAGSCNGCDVELATTACIPRYDVERLGCKYCGSPRHADIVLITGPLTARVKDKVLRVWDEIPAPKITVAVGICPVSGGVFRDGYPIEGPLDRYIPIDINVPGCPPRPQAIIEGVVKARDLWLERIGG

SEQ ID NO: 62224 - DNA, 780 bp, Erwinia carotovora subsp. atroseptica SCRI1043
  CDS (1)..(780)
atgagccagccagaaatgaaaataaaccatcatgtcagccaacccattaccctcgatgagcaggctgcccagttgaaaggccgtttgctgaaagatattcagcgttcggcttacgtctatcgcgttgactgtggtggctgtaacggttgcgaaatcgaaattttcgccgcgattacgcccctctttgatgccgaacgtttcggtataaaagtggtagcctcgccgcgtcacgccgatattttactgtttactggcgcggtcacccgcgcaatgcgggttcccgccctacgagcctatgaatctgcgccggaccctaaaatttgtatctcctacggggcgtgcggctgtggcggtggcattttccacgacctgtattgcgtatggggcggcagtgaaagcattgtccctatcgatgtctggatccctggctgcccgccgacacccgccgcgacgatccacggctttgccgtagcactcggcctgttggagcaaaaactgaaagggcaagaccacattcagttgccaggagagcgtgcggaaactctgctgcccaccataccgctggcgacacgcgttatggttgagcgggaggcccgtcgactggctggatatcggaaaggccgcgaaatcagcgatcggttactgactctgctagcgggttccgacctctccactgccgccaaaaaactggatgtctggctcagcgaggaaaacgacccgcgcctgcgtgaaatcgtacagtgcctgacgcagctattgcgggaggcaccgaatgtctga

SEQ ID NO: 62225 - protein, 259 aa, Erwinia carotovora subsp. atroseptica SCRI1043
MSQPEMKINHHVSQPITLDEQAAQLKGRLLKDIQRSAYVYRVDCGGCNGCEIEIFAAITPLFDAERFGIKVVASPRHADILLFTGAVTRAMRVPALRAYESAPDPKICISYGACGCGGGIFHDLYCVWGGSESIVPIDVWIPGCPPTPAATIHGFAVALGLLEQKLKGQDHIQLPGERAETLLPTIPLATRVMVEREARRLAGYRKGREISDRLLTLLAGSDLSTAAKKLDVWLSEENDPRLREIVQCLTQLLREAPNV

SEQ ID NO: 62226 - DNA, 747 bp, Desulfotalea psychrophila LSv54
  CDS (1)..(747): transl_table=11
atgctgaaaataataaagaataaaatggagcaggggaataaaaccgccaagtatcccaaggagccgatttccctctaccaccgctaccgaggaatgcctgttatcaacaaggattgctcagcggagattgcaaggcaatgtctagatatctgtcctcaagagtgtattgatccagaggcaaaaaccattgatctggggagatgtaccttttgcggccaatgcgaaacggttgccgaggggaattttgtaaaattcagccagaactttgaattgggtgcagccaatcgagatgaattgattgttggcagcacagggcttcctgccctggcaaaacagtcaaaggcacatttcaagaagctctttggcagatccctgcaactccgtcaggtatccgctggcggctgtaactcctgtgaagctgataccaacgtactgaacaccccattttttgatctatccaggttcgggattgattttgttgcctcccctcgccacgctgatggtctccatgtgactggacccatttcccataatatgagacaggcgctcatcaccacctatgaggcagttgcctctcccaaggttgtcattgccagcggctgctgctctatctctggtggacctttttacggaagcagcgaagttgtgggcgatttgaatagcttgcttcccgtagacctctatattcccggttgccctcctcatcccctcaccaccctgcatgccctgttgaactatttcaaataa

SEQ ID NO: 62227 - protein, 248 aa, Desulfotalea psychrophila LSv54
MLKIIKNKMEQGNKTAKYPKEPISLYHRYRGMPVINKDCSAEIARQCLDICPQECIDPEAKTIDLGRCTFCGQCETVAEGNFVKFSQNFELGAANRDELIVGSTGLPALAKQSKAHFKKLFGRSLQLRQVSAGGCNSCEADTNVLNTPFFDLSRFGIDFVASPRHADGLHVTGPISHNMRQALITTYEAVASPKVVIASGCCSISGGPFYGSSEVVGDLNSLLPVDLYIPGCPPHPLTTLHALLNYFK

SEQ ID NO: 62228 - DNA, 510 bp, Methylococcus capsulatus str. Bath
  CDS (1)..(510): transl_table=11
atgaacaagctattgagcaagattgcccgtgtaggcatcgtgaccgaaaccttcaagccgctgaccgaccccgagctggaccgcctgggtgcggaactcaaggccgtgatcgacgggcgcttcgccgggagcctcgcgatccggcaagtcgacgccggttcctgcaacgcctgcgagctggagatcgccgcgctgggaaatcccttctacgacatcgagcgctacggcgtccatttcgtcgcctcaccccgacatgccgacgtgctgatggtgacaggaccggtttcccgccacatgcaggcggcgctgcaggcaacctgggaggcgacgccggagcccaaatgggtcgtcgcggtcggaagctgcgccgccgacggcggcgaattcggcgtgaactacgcaagctgtggcgcggtgggcaacgtgctccccgtggacgccgtgatccccggctgcccgccgacgccgaccgatctggttcgcggccttctgtccctgatctcgcggtag

SEQ ID NO: 62229 - protein, 169 aa, Methylococcus capsulatus str. Bath
MNKLLSKIARVGIVTETFKPLTDPELDRLGAELKAVIDGRFAGSLAIRQVDAGSCNACELEIAALGNPFYDIERYGVHFVASPRHADVLMVTGPVSRHMQAALQATWEATPEPKWVVAVGSCAADGGEFGVNYASCGAVGNVLPVDAVIPGCPPTPTDLVRGLLSLISR

SEQ ID NO: 62230 - DNA, 564 bp, Azoarcus sp. EbN1
  CDS (1)..(564): transl_table=11
atgtggcacattctcaagtacatcgcccgccatcgccgtcccggcacatcggcctctccgaccctttccccgtcgcgccaccgggcacacctgatccacgccgacattctcgcgatcctcggccgcgcgctggcgatccgacatgtcgacggcggctcgtgcaacggctgcgaactcgagatccacgcgctgaacaacccctactacaacatcgagggactcggcatcaagttcgtcgcaagcccgcgtcatgccgacatgctgctcgtcaccgggccggtgtcgcggcacatggagctcgcgctgaagcgcacctacgatgcgatcccggcgccgaagctcgtcgtcgcaatcggagactgcggctgcaccggcggcattttcggcgagagctacgcgagctgcgggcgtatatcgaatgtcatcccggtggacgtcactgttcccggctgcccccctcccccggccgacatcctcgcgggcattctcaccgccctgcggggccgcccgtcccttgccgcaggcgagggcacgacgcccgatttcacgcccggcttcaactga

SEQ ID NO: 62231 - protein, 187 aa, Azoarcus sp. EbN1
MWHILKYIARHRRPGTSASPTLSPSRHRAHLIHADILAILGRALAIRHVDGGSCNGCELEIHALNNPYYNIEGLGIKFVASPRHADMLLVTGPVSRHMELALKRTYDAIPAPKLVVAIGDCGCTGGIFGESYASCGRISNVIPVDVTVPGCPPPPADILAGILTALRGRPSLAAGEGTTPDFTPGFN

SEQ ID NO: 62232 - DNA, 468 bp, Dehalococcoides ethenogenes 195
  CDS (1)..(468): transl_table=11
gtggattttgttactaaatctcaaataaaatcaccctggctgctccattttgactgcggcagctgtaacggctgtgatattgaaatactggcctgtcttacccccctttatgatgttgaacgcttcggcattgttaacatgggtaaccccaaacactcggatgtacttctggtaaccggcccggccaataagcgtaattaccgtgttttgcaaaacttgtaccagcaaatgcctgacccgaaggtagtaatagttatcggcacctgcggctgcagcggcggtgttttccataactgcccgaatatactgggcggggtagacaaggtaataccggtggacgtatatgtgcccggttgtgccgccagaccggaggctattatagacggcgtggttatggggctgggcaagctggctgagaaaaaagccaaggccaaaactgaagccaaacgtgaggaacagcatgtgtaa

SEQ ID NO: 62233 - protein, 155 aa, Dehalococcoides ethenogenes 195
MDFVTKSQIKSPWLLHFDCGSCNGCDIEILACLTPLYDVERFGIVNMGNPKHSDVLLVTGPANKRNYRVLQNLYQQMPDPKVVIVIGTCGCSGGVFHNCPNILGGVDKVIPVDVYVPGCAARPEAIIDGVVMGLGKLAEKKAKAKTEAKREEQHV

SEQ ID NO: 62234 - DNA, 516 bp, Dehalococcoides ethenogenes 195
  CDS (1)..(516): transl_table=11
gtgaaaaacgttttaaataatatttttaaacccaaagtatgccggcagatgccaaagggtgatgcagactttgataaactgggctttgccctgaaaaccgagatacatgctgtcttcgggcggagtctggctatcagggcgctggacagcggcagtgacaactctgccgaaatagaactgaataacctttctaacccctattatgacattgaacgtttcggtctcagcttcgttgcctcaccccgccacgcagatatcttgatagtcaccggtgcggtcagccagaatatggctattgccgtcaggaaaacctttgatgccatgccctcccccaagctggtaatagccctgggtgatgatgcctgcggcagcagcattgtctgcggcggctacggggtactgggcggggttgataaaatcctgccggtagacctgaaaataccgggcaatccgcctgaaccaatccagataatcactgccctgctggggcttatgcggtctctgggcaagaaataa

SEQ ID NO: 62235 - protein, 171 aa, Dehalococcoides ethenogenes 195
MKNVLNNIFKPKVCRQMPKGDADFDKLGFALKTEIHAVFGRSLAIRALDSGSDNSAEIELNNLSNPYYDIERFGLSFVASPRHADILIVTGAVSQNMAIAVRKTFDAMPSPKLVIALGDDACGSSIVCGGYGVLGGVDKILPVDLKIPGNPPEPIQIITALLGLMRSLGKK

SEQ ID NO: 62236 - DNA, 543 bp, Magnetospirillum magnetotacticum MS-1
  CDS (1)..(543)
atgatcccgcccatcgccaaaatgctggcccgccatctgctcaagggcccacacaccatgaaggacgctccgcgtcccgatcccgacggcgtcgccgaactggccgaggcgctggggcggcgcgccagggcaagactgggtcgttccctgtccatccgcgaggttgatgcggggtcgtgcaatggctgcgagctggagattcacgccgtcaaccaccccatctacgacctggagcgtttcggcatccgctttgtcgccagcccgcgccacgccgatgtgctgctggtcaccgggccggtgacgcgcaacatggaagaggccctgcggcgcacggtcgaagccacgcccgagccccgctggatcgtcgccatgggcgattgcgggaaggacggcggctgcttcgccgggtcctatgcggtggtggggggagtctccgacgtggtgccagtggacctgcacatccccggttgcccgcccagcccgcgccaaattctggccggactgctggccctgctggatgcggcggacggcaggttagggtag

SEQ ID NO: 62237 - protein, 180 aa, Magnetospirillum magnetotacticum MS-1
MIPPIAKMLARHLLKGPHTMKDAPRPDPDGVAELAEALGRRARARLGRSLSIREVDAGSCNGCELEIHAVNHPIYDLERFGIRFVASPRHADVLLVTGPVTRNMEEALRRTVEATPEPRWIVAMGDCGKDGGCFAGSYAVVGGVSDVVPVDLHIPGCPPSPRQILAGLLALLDAADGRLG

SEQ ID NO: 62238 - DNA, 414 bp, Desulfitobacterium hafniense DCB-2
  CDS (1)..(414)
ttggagcagggcgaggcccacctccgttccctccgtcaatcctggcatattcggcacctggattgcggttcctgcaacgggtgtgattgggaaatgtctgcccttctcaaccccatctatgatttgcagcgctttgggttggattttgtggcttctccgcgccacgcggatattctgatgtgcaccggccccatgtccactcatctgattcaggctgcgctggcaacctatgaagggacccccaaccccaaaaagatcattgccgtaggggattgtgccctggatgggggaatgtttaaagaggcttatgcagcccataatggtgtgggagaagtgttacctgtggatatcaagattccgggctgccctccttcaccggatgagctgctgaaggtcctgcttcagttaaaatga

SEQ ID NO: 62239 - protein, 137 aa, Desulfitobacterium hafniense DCB-2
MEQGEAHLRSLRQSWHIRHLDCGSCNGCDWEMSALLNPIYDLQRFGLDFVASPRHADILMCTGPMSTHLIQAALATYEGTPNPKKIIAVGDCALDGGMFKEAYAAHNGVGEVLPVDIKIPGCPPSPDELLKVLLQLK

SEQ ID NO: 62240 - DNA, 522 bp, Rhodospirillum rubrum
  CDS (1)..(522)
atgtccctttatgatttcatcatgcgcaaggtcttcaagcgctcgctgtgggtctttcatgcgaacgccggagcttgcaacggctgcgacatcgaagaggtcaacgccttcaccccctattacgacgccgagcgcttcggcctgaagctggttggctcgccccgccacgccgatgtgctgctgatctcggggccggtcacccgcaccgccgaaccccgattgcgccggctttatgagcagacccccaaccccaaggtggtgatcgcctgcgggtcctgcgccgtgggcggcggcatgtggtttgacagctaccacgtgttgggcggcgccgacaaagtggtgcccgtcgacttctacatccccggctgtccgccccgccccgaagccatcctgtggggggtggcggtggccatggggttggtcgaggccaaggcccagccctacagctaccgccaggaacacgccctgccgatccccgtgcgcaagccggcggccgagcccccgcgcgaaacggccgagtag

SEQ ID NO: 62241 - protein, 173 aa, Rhodospirillum rubrum
MSLYDFIMRKVFKRSLWVFHANAGACNGCDIEEVNAFTPYYDAERFGLKLVGSPRHADVLLISGPVTRTAEPRLRRLYEQTPNPKVVIACGSCAVGGGMWFDSYHVLGGADKVVPVDFYIPGCPPRPEAILWGVAVAMGLVEAKAQPYSYRQEHALPIPVRKPAAEPPRETAE

SEQ ID NO: 62242 - DNA, 516 bp, Ralstonia metallidurans CH34
  CDS (1)..(516)
atgtggcaaatactgaagcagatcgcgcgtaccggcattctcacggagcctgcgccgcaaggtagtgccgacgacaccgcgatcgagcgtatccacaaggacctgctcgatatcctcggccgcgcactgaccatccggcaggtcgacgccggctcctgcaacggctgtgagcttgagatccacgcgctcggcaacccctactacaacatcgaaggactgggcgtcaggttcgtggctagcccgcggcatgccgacatgctgctcgtcaccgggccggtctcacgccatatggaggaagcattgcggcgtacctacgaggcaacgcccgagccaaaactggtggtcgccgtgggagattgcgggtgcaccagtggcatcttcggcgaaagctacgcgagctgcggccgtgtctccaatgtcattccagtcgatgtgagcgtcccgggttgcccaccgccacccatcgacatcctgcgaggcatccttggcgccgttctgcgcgatcgcgttggttag

SEQ ID NO: 62243 - protein, 171 aa, Ralstonia metallidurans CH34
MWQILKQIARTGILTEPAPQGSADDTAIERIHKDLLDILGRALTIRQVDAGSCNGCELEIHALGNPYYNIEGLGVRFVASPRHADMLLVTGPVSRHMEEALRRTYEATPEPKLVVAVGDCGCTSGIFGESYASCGRVSNVIPVDVSVPGCPPPPIDILRGILGAVLRDRVG

SEQ ID NO: 62244 - DNA, 528 bp, Burkholderia fungorum LB400
  CDS (1)..(528)
atgtggcaacttctcaaacagatcgcgagaaccggcactccggacccgcgcgtgccggaaagcgatgacgcatggcgtaccgaaagccagcagatccagcaggacatactcgacctgctaggccgggcgctgtgcattcgcgagatcgacgcgggctcctgcaacggctgcgaactggaaatccacgcgctcaacaatccgtactacaaccttgaaggtctgggtatcaggttcgtcgcgagtccccgccatgccgacatgctactggtcaccggcccgctgaccgtgaacatgacggaagcagtgcggctggcatacgaagcgacgcctgatccgaagctggtggttgccaccggcgagtgcgcctgcaccggtggcatgttcaaggaaagctacgccgtatgtggaccgctcgcgaaacttcttcctgtcgacgtcacgataccgggttgtccgccgccccccctcgatatcctgagaggcattctcggcgcgcttcgggtgaaacgcacgacgcgcgcgcgatga

SEQ ID NO: 62245 - protein, 175 aa, Burkholderia fungorum LB400
MWQLLKQIARTGTPDPRVPESDDAWRTESQQIQQDILDLLGRALCIREIDAGSCNGCELEIHALNNPYYNLEGLGIRFVASPRHADMLLVTGPLTVNMTEAVRLAYEATPDPKLVVATGECACTGGMFKESYAVCGPLAKLLPVDVTIPGCPPPPLDILRGILGALRVKRTTRAR

SEQ ID NO: 62246 - DNA, 534 bp, Burkholderia fungorum LB400
  CDS (1)..(534)
atgtggcaacttctcaaacagatcgcgcggaccggcacgcccaacgaacgggtgccgcaagccgacgactcgtggcatacggagagccggcagatccagcaggagatcctcgatgtgctcgggcgggccctgtgcatccgcgaaatcgacgcaggctcctgcaatggctgcgagctggaaatcaatgcgctcagcaatccctattacaacatcgaaggcctgggcatccgcttcgtcgcgagtccccgccatgcggacatgctgctcgttaccggcccgttgacgctgaacatgagggaagccgtgtggcaggcctacgaggcgacacctcatcccaaactggtggtcgccaccggtgaatgtgcgtgcacgggcggcgtgttcagggacagctatgccgtctgcgggccgctctcgacactccttccggtcgacgtgacgatccctggatgtccgccgccgcccattgatatcctgagggggattctcactgcgcttcgtgccgggcattcgaccgctccacgcagcccttaa

SEQ ID NO: 62247 - protein, 177 aa, Burkholderia fungorum LB400
MWQLLKQIARTGTPNERVPQADDSWHTESRQIQQEILDVLGRALCIREIDAGSCNGCELEINALSNPYYNIEGLGIRFVASPRHADMLLVTGPLTLNMREAVWQAYEATPHPKLVVATGECACTGGVFRDSYAVCGPLSTLLPVDVTIPGCPPPPIDILRGILTALRAGHSTAPRSP

SEQ ID NO: 62248 - DNA, 492 bp, Methanosarcina barkeri str. fusaro
  CDS (1)..(492)
atgtcgttagcaaaatctccatggattgtacatgtgaattgtaacagttgtaatggctgtgatattgaagtaatagcttgtcttactcccctatatgacgctgaaagatttggtgtgttaaacatcggtacccctaagcaagcagatataatggtggttacaggcgcagtgaattacaaaaatgttaatgtgcttataaatatatataaccagattcctgatccaaaagttgttatagcagttggcgcctgtgcatccacaggtgggattttccatagctgctataatgtaataggcggagtggatcaggttatacccgtagacatatatgttccaggctgctgcccacgacctgaagccatacttgatggaatcattgcggctcttccgattctagaagataagaagaaaaggaatattaaaggaaaagaggtaaaactcaaaagaaatgagggcccggcaccttgtgattccctggacacaccaagctga

SEQ ID NO: 62249 - protein, 163 aa, Methanosarcina barkeri str. fusaro
MSLAKSPWIVHVNCNSCNGCDIEVIACLTPLYDAERFGVLNIGTPKQADIMVVTGAVNYKNVNVLINIYNQIPDPKVVIAVGACASTGGIFHSCYNVIGGVDQVIPVDIYVPGCCPRPEAILDGIIAALPILEDKKKRNIKGKEVKLKRNEGPAPCDSLDTPS

SEQ ID NO: 62250 - DNA, 735 bp, Geobacter metallireducens GS-15
  CDS (1)..(735)
atgttccgagcaatcgcttcccgaatcaagcagggccatcgcaccaccccctatcccgctgcgccgctgcagatgcctgagcggttccgcggctatccgcttgtcagcccggcaaacgaggcttccgaggccacgtgcccctacggtgcttactcaaaggagagcggcgggtgtctcgacatgggcaaatgtcttttctgtgccgaatgcccggtagggaccatccagtttaccacggactatcaactggccgttacgaaccgtgaccatctgctggttcatcccggatcggaacatcaccacgcccggccgctccctcccgacctgcggcgtctgttcgggcgctcccttaaattccgggaggtcagcgccggcgggtgtaacgcctgcgaagccgataccaatgtcctttcgaccatcggctgggatctcggccggttcgggatccagttcgtggcgtcgccgcgccacgcggatggcctgtgggtaaccggtccggttaccgaacacatggccaaggcacttctgaccacctatgaggcgattcctgacccgaagatcgttgtcgcctgcggcgcctgcgccatcaacggcggaccttacatcgacaccccccaggtctgcaatggcgtggacagcattgttcccgttgatctgtacatccccggttgcccaccccatccggctaccatccttgatggcctgctgcgcattctgaataaaataaagggataa

SEQ ID NO: 62251 - protein, 244 aa, Geobacter metallireducens GS-15
MFRAIASRIKQGHRTTPYPAAPLQMPERFRGYPLVSPANEASEATCPYGAYSKESGGCLDMGKCLFCAECPVGTIQFTTDYQLAVTNRDHLLVHPGSEHHHARPLPPDLRRLFGRSLKFREVSAGGCNACEADTNVLSTIGWDLGRFGIQFVASPRHADGLWVTGPVTEHMAKALLTTYEAIPDPKIVVACGACAINGGPYIDTPQVCNGVDSIVPVDLYIPGCPPHPATILDGLLRILNKIKG

SEQ ID NO: 62252 - DNA, 600 bp, Ferroplasma acidarmanus
  CDS (1)..(600)
atgaactggttcctcaagggggtaaaaaatagaataaagacggaagagcttgagggctatagggttgaacagccatcgttccttgatgggaagagcgattatgattgccctacagatgccctggagaatgggaaatgggacatgaacagatgtatattctgcagggaatgtgatctaaaacccacaggaaaacagacaactttcacagttaatagggaaacaccacacatatttgaaaaatccctgtatttatatcctatagattccggtacatgtggagcctgcaatgttgagtttacaacattattttccccgcagtatgatacaaacagatttaagatttttatgtcaaatacaccgaggcatgctgatgcacttgttgttatgggagtgtacacagatggcatggaagccgttttaaaggaggcttatgatgctatgccttcccctaaaatagtcataggaataggggcatgtgcactctccggaggaattattggcagcagggcaatggataaatatgatatagaagttgcaggatgcccacccacacctgcttctataataaacgcgataataaaggcgaggggtaaaagatga

SEQ ID NO: 62253 - protein, 199 aa, Ferroplasma acidarmanus
MNWFLKGVKNRIKTEELEGYRVEQPSFLDGKSDYDCPTDALENGKWDMNRCIFCRECDLKPTGKQTTFTVNRETPHIFEKSLYLYPIDSGTCGACNVEFTTLFSPQYDTNRFKIFMSNTPRHADALVVMGVYTDGMEAVLKEAYDAMPSPKIVIGIGACALSGGIIGSRAMDKYDIEVAGCPPTPASIINAIIKARGKR

SEQ ID NO: 62254 - DNA, 438 bp, Clostridium thermocellum ATCC 27405
  CDS (1)..(438)
atgaattttagcaaaaaatccccatggattctgcattatgacggttccagctgcaacggctgtgacatagaggtattggcctgccttactccattgtatgacatagagcgctttggagtaataaacacgggcaatcccaaacatgcggacattttgctcataaccggcagtatcaacgaacagaataaatcagtggtaaagcagctttacgaacaaatggcggacccaaaggttgttgtggccgttggaatatgcgcggcaactggaggcattttttctgaatgttataatgtgtcgggaggggtcgacaaaatcattccggtggatgtttatgtaccgggctgtgcggcgcgtcccgaagcaataattgacggggttgtaaaagctctcggcatattggaggaaaggcagaaatacgcaagaaaaaaagataaataa

SEQ ID NO: 62255 - protein, 145 aa, Clostridium thermocellum ATCC 27405
MNFSKKSPWILHYDGSSCNGCDIEVLACLTPLYDIERFGVINTGNPKHADILLITGSINEQNKSVVKQLYEQMADPKVVVAVGICAATGGIFSECYNVSGGVDKIIPVDVYVPGCAARPEAIIDGVVKALGILEERQKYARKKDK

SEQ ID NO: 62256 - DNA, 759 bp, Moorella thermoacetica ATCC 39073
  CDS (1)..(759)
atggaacaggaagtaaagctggccgagctgaaggcgaagctaaaaaatgtcattaaacgctccgtctacgtgtaccgggtggattgtggcggttgcaacgggtgcgagattgaaattttcgccactatctcacctgtttatgacccggaaaggctggggttcaaggtagtagcctccccacggcatgccgatatcctcctttttaccggccccatgaccagggccatgcgtttgccggccattcgggcgtatcaggcggcacctgatcccaagatagtagtggcttacggaacgtgtggctgcagcggcggtatctttcacgattgttactctgtatggggtgggaccgggagtatctttcctgtggatgtatatatccccggctgtcctccaactcccggggcaacgatctacggtttgggcctggccctggatctacttcaacaaaaaatgaagggtgaacaatacacagaaaaggaggtggcccggatcacgtcgcaatatgcgggagtttctcccgacctggccagagatatcgagagggaggcccgtcgtttaagcggttacctccatggccggcgtataaccgagaaatacctccagttcgtacgcgaggatcccctggcggtcgaccagaaaattaaagagctggtaaagcaggagaaggattcacggctggctgaagtttatttgagcctgcataaaatttatctggactatttaggtaagacggagaaggcgggccatcatgccgggtag

SEQ ID NO: 62257 - protein, 252 aa, Moorella thermoacetica ATCC 39073
MEQEVKLAELKAKLKNVIKRSVYVYRVDCGGCNGCEIEIFATISPVYDPERLGFKVVASPRHADILLFTGPMTRAMRLPAIRAYQAAPDPKIVVAYGTCGCSGGIFHDCYSVWGGTGSIFPVDVYIPGCPPTPGATIYGLGLALDLLQQKMKGEQYTEKEVARITSQYAGVSPDLARDIEREARRLSGYLHGRRITEKYLQFVREDPLAVDQKIKELVKQEKDSRLAEVYLSLHKIYLDYLGKTEKAGHHAG

SEQ ID NO: 62258 - DNA, 546 bp, Polaromonas sp. JS666
  CDS (1)..(546)
atgtggcacatcctcaaacagatcgcccgcaccggcatcatcaccgaaccggctccgggtattgacgacgcccaacgtaccgcgatcgagcgcatccaccgcgatattttgctgatcctcggtcaggcgctgaccatccgcgcggtcgatgccggctcgtgcaatggttgcgagctggaaatccacgcgctcaacaacccctactacaacatcgaagggctgggcatcaagttcgtcgccagcccacgccacgctgacatgctgctggtgaccggcccggtatcgcgccacatggacgaggcgttgcggcgcacctatgacgcgacgcccgagccgaaactcgtggtcgctgtgggggactgcggctgcaccggtggtattttcggcgacagctacgcgagctgtggccgcgttgccaacgtgattcctgtggatgtcaccgtgcctggctgcccgccgccgcccatagaaattctgcggggaatactgaccgcggtgcggcagcgccgacccggcacggcgggagataaccctgcaggcagctga

SEQ ID NO: 62259 - protein, 181 aa, Polaromonas sp. JS666
MWHILKQIARTGIITEPAPGIDDAQRTAIERIHRDILLILGQALTIRAVDAGSCNGCELEIHALNNPYYNIEGLGIKFVASPRHADMLLVTGPVSRHMDEALRRTYDATPEPKLVVAVGDCGCTGGIFGDSYASCGRVANVIPVDVTVPGCPPPPIEILRGILTAVRQRRPGTAGDNPAGS

SEQ ID NO: 62260 - DNA, 444 bp, Methanococcus maripaludis
  CDS (1)..(444): transl_table=11
atgttaaaagagctttcaagaaagaaaaatattcacgtcatgcttgtttatactggcggatgtaatggttgcgatattgaagttgtaaactgtgttttatctccattttatgatgcagagcagtacaacgtatttttaacgtggaatccaagagaagcagatgttttggtagtaactggctgtgttacaaaggcagtttctgcatcacttaaaaaaatatatgatgaaattcctgaaccaaaagccgtagttgctgcaggggcctgtgcgttgatgggcggtgtttacaataatattggtgcagatttgggaacttccacatttattgatggtcctgttgaaaatataatccctgttgacataaaagttccaggatgcccaccaagacctgaggacgttatcacgggaattgtaaaagcgttgccaaaaatcttgaatggatga

SEQ ID NO: 62261 - protein, 147 aa, Methanococcus maripaludis
MLKELSRKKNIHVMLVYTGGCNGCDIEVVNCVLSPFYDAEQYNVFLTWNPREADVLVVTGCVTKAVSASLKKIYDEIPEPKAVVAAGACALMGGVYNNIGADLGTSTFIDGPVENIIPVDIKVPGCPPRPEDVITGIVKALPKILNG

SEQ ID NO: 62262 - DNA, 429 bp, Rhodospirillum rubrum
  CDS (1)..(429): transl_table=11
atgaattttctttcgcgtatgtccaagaagtcgccctggctttaccgcatcaacgccggatcgtgtaacggctgcgatgtcgagctggcgaccaccgcctgcattccgcgctatgacgtcgaacgccttggctgtcagtactgcggcagccccaagcacgccgatatcgtgctggtcaccggccctttgaccgcccgggtcaaggacaaggtgctgcgggtctatgaggaaatccccgatcccaaggtcaccgtagccatcggggtttgcccgatctcgggcggggtgttccgggaaagctacagcatcgtcggcccgatcgaccgttatctgcccgtcgatgtcaacgtgccgggctgtccgccgcgcccccaggcgatcatcgaggggatcgccaaagccatcgaaatttgggccggtcggatctag

SEQ ID NO: 62263 - protein, 142 aa, Rhodospirillum rubrum
MNFLSRMSKKSPWLYRINAGSCNGCDVELATTACIPRYDVERLGCQYCGSPKHADIVLVTGPLTARVKDKVLRVYEEIPDPKVTVAIGVCPISGGVFRESYSIVGPIDRYLPVDVNVPGCPPRPQAIIEGIAKAIEIWAGRI

SEQ ID NO: 62264 - DNA, 528 bp, uncultured archaeon GZfos37B2
  CDS (1)..(528)
atgccaaaagacattagaacaccaatgcaggttataaccaccacgacgggtgcgattcatgagtttctcaagaaatcgccggcgcaggacgtcataaactggggcaggaagaattcgctctggttcatgacccagccgatgggatgctgtggcgtcgagatgattgccgcgggatgttcccactacgacaccgatcgattcggaatcattccgagatgttcaccgcgacatgcggacgtgatggtgatcagtggatatatcgtccgtaagtacttcccggcgctgaaacgattgtacgaacagatgccttcaccaaaatgggtcatctgtatgggcaactgctcaataagtggtggaccgttctacagatcgtacaatacgttgcagaacatcgacgagatatttccggttgatgtctatatcaccggatgcccgccaagacccgaggcactgatccaggggttcatagaactccagaagaagatcaaggcgaagaccgacaagggaacaatgtacggggtgaaatga

SEQ ID NO: 62265 - protein, 175 aa, uncultured archaeon GZfos37B2
MPKDIRTPMQVITTTTGAIHEFLKKSPAQDVINWGRKNSLWFMTQPMGCCGVEMIAAGCSHYDTDRFGIIPRCSPRHADVMVISGYIVRKYFPALKRLYEQMPSPKWVICMGNCSISGGPFYRSYNTLQNIDEIFPVDVYITGCPPRPEALIQGFIELQKKIKAKTDKGTMYGVK

SEQ ID NO: 62266 - DNA, 444 bp, Desulfovibrio gigas
  CDS (1)..(444): transl_table=11
atgcaagccattctcgacttcatcaaatcctcacggatcaaatccccctggctgatgcactttgactgcgggttctgcaacggctgcgacattgaaaccctggcctgccttgacccccatctacgacgtggaacgttcggcatcgtcaacgtgggcaaccccaagcatgcggatatcctcatcgtcagcggcacggtgaaccaccgcaacaagaaggtgctggccaacctgtatgaacaaatgccccaccccaaagtggtggtggccatcggcgcatgcggcctctccggcggcgtgttccgcgaggcccccaatgtggtgggcggcatcgacaaggtcatcccggtggatgcgtacgtccccggttgtccgcccaagcccgaagccatcattgacggcgtggtgctcggtttgcagaaattcgccgaaaaatcccttgcctaa

SEQ ID NO: 62267 - protein, 147 aa, Desulfovibrio gigas
MQAILDFIKSSRIKSPWLMHFDCGFCNGCDIETLACLDPHLRRGTFGIVNVGNPKHADILIVSGTVNHRNKKVLANLYEQMPHPKVVVAIGACGLSGGVFREAPNVVGGIDKVIPVDAYVPGCPPKPEAIIDGVVLGLQKFAEKSLA

SEQ ID NO: 62268 - DNA, 447 bp, Methanobacterium thermoformicicum
  CDS (1)..(447): transl_table=11
atgggtcttaaatcattttcaagggcaagagctgtacatgcaatgctcgtatacaccgggggatgcaacggctgcgacatagagatagtgaacgcagttctctcaccaaaatatgacgccgaacagtacaagatcttcctgacatggaaccccagggaggccgatgtactcatagtaaccggtccggtcacaaaacagaacgaggggccacttaaggagatatacaatgcaataccagaacccaaggcggttatagctgcaggggcctgcgctctgatgggcggggtctacaagaatatacatggggacatcccctcagaggaaatctgcggcccagtggataaggtcatacctgtggatgcaaaggtccctggatgcgcggtaagacctgaagatgtccttgcaggggcagtcgcagcactgccaaaacttctggaggcagattga

SEQ ID NO: 62269 - protein, 148 aa, Methanobacterium thermoformicicum
MGLKSFSRARAVHAMLVYTGGCNGCDIEIVNAVLSPKYDAEQYKIFLTWNPREADVLIVTGPVTKQNEGPLKEIYNAIPEPKAVIAAGACALMGGVYKNIHGDIPSEEICGPVDKVIPVDAKVPGCAVRPEDVLAGAVAALPKLLEAD

SEQ ID NO: 62270 - DNA, 768 bp, Escherichia coli
  CDS (1)..(768): transl_table=11
atgagcaatttattaggcccccgtgacgccaacggcattccggtccccatgacggtggatgaatccatcgccagcatgaaggcgtcgttactgaaaaaaatcaaacgttctgcctatgtttaccgcgtggactgcggcggctgcaacggttgcgaaatcgaaattttcgccacgctttcgccgctgtttgatgcagaacgcttcggcattaaagtcgttccttcaccgcgtcatgcggatattttactgtttaccggcgcggtcacccgtgcaatgcgatcccctgcgctgcgtgcgtggcagtccgcgccggacccgaaaatttgtatctcctacggtgcctgcggtaacagtggcgggatcttccacgatctctactgcgtgtggggcggtacggataaaattgtccctgtggatgtttatatccctggctgcccgccaacgcctgccgccacgctgtacggctttgcaatggcgctcggcctgctggagcagaaaattcacgcccgtgggccgggtgaactggatgaacaaccggcggagatcctgcatggtgatatggtgcagccgctgcgcgtgaaagtggatcgcgaagcacgtcgcctggcgggttatcgttacggtcgtcagattgccgatgattaccttacacagttagggcagggcgaagaacaggttgcacgctggctggaagcggaaaacgatccgcgtctgaacgagattgtcagccatctgaatcatgttgttgaagaggcgcgtatccgatga

SEQ ID NO: 62271 - protein, 255 aa, Escherichia coli
MSNLLGPRDANGIPVPMTVDESIASMKASLLKKIKRSAYVYRVDCGGCNGCEIEIFATLSPLFDAERFGIKVVPSPRHADILLFTGAVTRAMRSPALRAWQSAPDPKICISYGACGNSGGIFHDLYCVWGGTDKIVPVDVYIPGCPPTPAATLYGFAMALGLLEQKIHARGPGELDEQPAEILHGDMVQPLRVKVDREARRLAGYRYGRQIADDYLTQLGQGEEQVARWLEAENDPRLNEIVSHLNHVVEEARIR

SEQ ID NO: 62272 - DNA, 24 bp, Primer
atgagtccagtgcttacacaacat

SEQ ID NO: 62273 - DNA, 24 bp, Primer
ttagtcatgtaacccccggagtac

SEQ ID NO: 62274 - protein, 119 aa, consensus
  MISC_FEATURE (1)..(119): consensus for the disclosure of xaa see table XV
GXCNXCXXEXXXXXXXPXYDXEXXGXXXXXXPRXADXLXXTGXXXXXXXXXXXXXXXXXPXXPKXVXAXGXCXXXGGXXXXXXXXXXXXXXXXXXXXXXXXXXXXXPVDXXXPGCPPXP

SEQ ID NO: 62275 - protein, 76 aa, consensus
  MISC_FEATURE (1)..(76): consensus for the disclosure of xaa see table XV
XXXXXXXXXXXXXXXXXXXXXXXXXXXXXPXXXDXXXXXGXXXXXXXXXXXXXXXXXXXPXXXXXXGXXXXXXXXX

SEQ ID NO: 62276 - protein, 19 aa, consensus
  MISC_FEATURE (1)..(19): consensus for the disclosure of xaa see table XV
XXDXXXXGXXXXPXXXXXX

SEQ ID NO: 62277 - DNA, 339 bp, Escherichia coli
  CDS (1)..(339)
atgaaaaagattgatgcgattattaaacccttcaagctggacgatgtccgcgaagcactggctgaagtcggcattaccggcatgacggtcactgaggtgaaaggttttggccgccagaaaggccataccgagctgtaccgcggcgcggagtatatggtggattttctgccgaaagtgaaaattgagattgtcgtaccggacgacattgtcgatacctgtgtcgataccattattcgcacggcgcaaaccggcaaaatcggtgacggtaaaatcttcgtctttgacgtggcacgggtcattcgcatccgtaccggtgaagaggacgacgcggcaatttaa

SEQ ID NO: 62278 - protein, 112 aa, Escherichia coli
MKKIDAIIKPFKLDDVREALAEVGITGMTVTEVKGFGRQKGHTELYRGAEYMVDFLPKVKIEIVVPDDIVDTCVDTIIRTAQTGKIGDGKIFVFDVARVIRIRTGEEDDAAI

SEQ ID NO: 62279 - DNA, 348 bp, Gluconobacter oxydans 621H
  CDS (1)..(348)
atgccgttcgtgaagctcgttactgccatcatcaaaccgttcaagcttgatgacgtccgcgaagccctgaccccgcttggggtgcagggcctcactgttaccgaggtcaagggttttggccgccagaaaggccagacggagatctatcgcggcgccgaatatcacgtcagcttcctgcccaagctcaagatcgaggtcgccgtttccgacacgatcgccgaggacgtgattgaggccatcatgaccgcagcccgcaccggcaagatcggtgacggcaagatcatggtctccagcctcgaccagctcatccgcatccgtacgggagaaaccggcgagggcgctctctga

SEQ ID NO: 62280 - protein, 115 aa, Gluconobacter oxydans 621H
MPFVKLVTAIIKPFKLDDVREALTPLGVQGLTVTEVKGFGRQKGQTEIYRGAEYHVSFLPKLKIEVAVSDTIAEDVIEAIMTAARTGKIGDGKIMVSSLDQLIRIRTGETGEGAL

SEQ ID NO: 62281 - DNA, 363 bp, Archaeoglobus fulgidus DSM 4304
  CDS (1)..(363): transl_table=11
atgaggaggttgcctacacgtgaggtggtggagatgaagatggttgtcgctgtaataaggcccgagaagcttgagtgcgttaagaaagctttggaagagagagggtttgtcggaatgaccgttacagaggtgaagggcaggggggagcagaagggtataaggcttcagttcaggggaagagaggtggaggttgatttgctccagaagacgaaggtggaggttgtggtgagcgacgatgctgttgatgaggttgtggaggcgatagtgagttcggcaagaactgggaagttcggtgatgggaggatattcgttattccagtggagaagtcagtcaagataaggacgggtgaggaggaagtttaa

SEQ ID NO: 62282 - protein, 120 aa, Archaeoglobus fulgidus DSM 4304
MRRLPTREVVEMKMVVAVIRPEKLECVKKALEERGFVGMTVTEVKGRGEQKGIRLQFRGREVEVDLLQKTKVEVVVSDDAVDEVVEAIVSSARTGKFGDGRIFVIPVEKSVKIRTGEEEV

SEQ ID NO: 62283 - DNA, 339 bp, Archaeoglobus fulgidus DSM 4304
  CDS (1)..(339): transl_table=11
atgaagaagatagaggcaatagtcagagctgaaaaattcccagaagttaaggctgcccttgaggagagagggttctacggtatgactgtgacggatgttaaggggaggggacagcagggtggcatgcaaattcagttcagaggcagaacgatggaggttaccctgcttcccaaggtaaagctagaaatcgtggtaaaggatgatgctgtggaggaggtaatagggttgatcgtgaactccgcattcaccggtagcccaggtgatggaaagatcttcataatcccagtggaggatgtcgttagaatcaggacaggggagaggggagacgactccctttaa

SEQ ID NO: 62284 - protein, 112 aa, Archaeoglobus fulgidus DSM 4304
MKKIEAIVRAEKFPEVKAALEERGFYGMTVTDVKGRGQQGGMQIQFRGRTMEVTLLPKVKLEIVVKDDAVEEVIGLIVNSAFTGSPGDGKIFIIPVEDVVRIRTGERGDDSL

SEQ ID NO: 62285 - DNA, 339 bp, Mesorhizobium loti MAFF303099
  CDS (1)..(339): transl_table=11
atgaaaatcgtgatggcaatcatcaagccgttcaagctggacgaggtacgcgaagcgcttaccgccgtcggcatccagggcctgaccgtcaccgaagtcaaaggctacgggcgtcagaagggacatacggaaatctatcgcggagcggaatacgcggtcagtttcctgccgaagatcaagatcgaggtcgctgtcagtgccgatacggtcgacaaggccgtcgaagccatcaccgccgcggccaagaccggccagatcggcgacggcaagatcttcgttttcggcatcgatcaggcggtgcgcatccgcaccggcgaaacagacaccgacgcgctctga

SEQ ID NO: 62286 - protein, 112 aa, Mesorhizobium loti MAFF303099
MKIVMAIIKPFKLDEVREALTAVGIQGLTVTEVKGYGRQKGHTEIYRGAEYAVSFLPKIKIEVAVSADTVDKAVEAITAAAKTGQIGDGKIFVFGIDQAVRIRTGETDTDAL

SEQ ID NO: 62287 - DNA, 591 bp, Arabidopsis thaliana
  CDS (1)..(591)
atggcggcgtcaatgacgaaacccatctcaataacttctctcggtttctattctgatcgaaagaacattgctttctctgattgcatttcgatttgttctggattcagacattcccgaccatcttgcctcgatttggtcacaaagtcaccgagtaataacagtcgtgttttacctgtcgttagtgcccaaatatcttctgattatattccagactcgaaattttacaaggtggaagcaattgtcagaccatggagaatccagcaagtttcatcggctttactgaaaatcgggattcgaggtgttactgtttctgatgtgagagggtttggtgcacaaggaggttctaccgagagacacggtggctctgagttctcggaagacaaatttgttgctaaagttaagatggaaatcgttgttaagaaagaccaagtggaatctgtaatcaacacaataattgaaggagcaaggacaggagagattggtgatggcaagatttttgttttgcctgtgtcagatgtcataagagttaggacaggtgagcgtggggagaaagcagagaagatgactggtgatatgctttcaccgtcttag

SEQ ID NO: 62288 - protein, 196 aa, Arabidopsis thaliana
MAASMTKPISITSLGFYSDRKNIAFSDCISICSGFRHSRPSCLDLVTKSPSNNSRVLPVVSAQISSDYIPDSKFYKVEAIVRPWRIQQVSSALLKIGIRGVTVSDVRGFGAQGGSTERHGGSEFSEDKFVAKVKMEIVVKKDQVESVINTIIEGARTGEIGDGKIFVLPVSDVIRVRTGERGEKAEKMTGDMLSPS

SEQ ID NO: 62289 - DNA, 618 bp, Aquifex aeolicus VF5
  CDS (1)..(618): transl_table=11
atggaagagctcttggcaattgtcaggaaggaaaagtcttacgatgtgatgaaatccttatctgaggctgagataccttacgtttcctggactgtgaaggggagggggaaggaggggggactcagatataaaggtcttattaaagaaaaggtcctcatgcctttcctgccaaaaagggctttcttggtctttcccgaggagggcaaagtaaatgaggctgtgaaccttatcgttgaaagtgctcacacgggtgcttacggagatgggaaggtctttttgataaaccaggaggtaggcgttatgaaacttgtaaaggctgttataagacctgagaaagtctacgaagtaattaaggctctcgagagcgaaggatttaaagctatgaccatgtgggatgtggtaggaagaggaaaggagggggggatcttggtgggagggactccttacgacgagctcgctaagacgctcatcatggtcgcggtaaaggatgaggacgttgacaaggttatacagagcataacgaaagctgcgcacacgggtgcttacggagatgggaaggtgttcgtttgcagcatttcaaaagtttggaccataaggactaaggaggaggagctatga

SEQ ID NO: 62290 - protein, 205 aa, Aquifex aeolicus VF5
MEELLAIVRKEKSYDVMKSLSEAEIPYVSWTVKGRGKEGGLRYKGLIKEKVLMPFLPKRAFLVFPEEGKVNEAVNLIVESAHTGAYGDGKVFLINQEVGVMKLVKAVIRPEKVYEVIKALESEGFKAMTMWDVVGRGKEGGILVGGTPYDELAKTLIMVAVKDEDVDKVIQSITKAAHTGAYGDGKVFVCSISKVWTIRTKEEEL

SEQ ID NO: 62291 - DNA, 342 bp, Thermotoga maritima MSB8
  CDS (1)..(342): transl_table=11
atgaaactgatcatagctgttatacaaccccacaagttaccggatgtgaaaaaggcacttttcgatgcacaggtttacaagatgactgtcatgaacgttcttggatgtggtcaacagaagggatacacagaaacgtatcgaggtgaagtagaagaggtgaatcttctcaaaaaggtgatgcttctcatagcggtcaatgaagaattcgttgaaccaactatcgaggcgattcaaaaaggggcaaggacaggaaacataggagatgggaaaatttttgtgctggatctgctggattgcattaggatcagaacgggagaaagaggacgggaggccataggataa

SEQ ID NO: 62292 - protein, 113 aa, Thermotoga maritima MSB8
MKLIIAVIQPHKLPDVKKALFDAQVYKMTVMNVLGCGQQKGYTETYRGEVEEVNLLKKVMLLIAVNEEFVEPTIEAIQKGARTGNIGDGKIFVLDLLDCIRIRTGERGREAIG

SEQ ID NO: 62293 - DNA, 345 bp, Vibrio cholerae O1 biovar eltor str. N16961
  CDS (1)..(345): transl_table=11
atgaacatgaaaaaaatcgaagccatcatcaagccgtttaaactcgacgatgtccgcgaggcgttggccgaagtcggcatcacaggtatgacagtgtctgaagtcaaaggatttggccgtcagaaaggacacactgaactgtaccgcggtgctgagtatatggtcgatttcctgcctaaagtgaagctagaaattgtggtcaccgatgatgtggcggatcgctgtgtcgacaccatcattgaaacggctcaaaccggtaagattggcgatggtaaaatcttcatcaccaacgttgagcgtgtggtacgtattcgtaccggtgaagaggatgaagatgcaatttaa

SEQ ID NO: 62294 - protein, 114 aa, Vibrio cholerae O1 biovar eltor str. N16961
MNMKKIEAIIKPFKLDDVREALAEVGITGMTVSEVKGFGRQKGHTELYRGAEYMVDFLPKVKLEIVVTDDVADRCVDTIIETAQTGKIGDGKIFITNVERVVRIRTGEEDEDAI

SEQ ID NO: 62295 - DNA, 339 bp, Pseudomonas aeruginosa PAO1
  CDS (1)..(339): transl_table=11
atgaagctagtcactgccatcatcaagccgttcaagttggacgacgtccgcgagtcgttgtccgagatcggtgtgcagggcatcacggtgaccgaggtcaagggtttcggccggcaaaagggccacaccgagctgtatcgcggcgccgagtacgtcgtcgacttcctgcccaaggtgaagatcgacgtggcgatcgccgacgaccagctggaccgcgtcatcgaggcgatcaccaaggcggccaataccggcaagatcggtgacggcaagatcttcgtggtgaacctggaacaggccatccgcatccgtaccggcgaaaccgataccgacgcgatctaa

SEQ ID NO: 62296 - protein, 112 aa, Pseudomonas aeruginosa PAO1
MKLVTAIIKPFKLDDVRESLSEIGVQGITVTEVKGFGRQKGHTELYRGAEYVVDFLPKVKIDVAIADDQLDRVIEAITKAANTGKIGDGKIFVVNLEQAIRIRTGETDTDAI

SEQ ID NO: 62297 - DNA, 342 bp, Lactococcus lactis subsp. lactis Il1403
  CDS (1)..(342): transl_table=11
atgaaaaaaattgaagcgattattcggacagataaattagaagatttgaaagcagccctatcagataatggcttggtgcatgggatgacagtttctcaagttttgggttatggtgaacaaaaaggatttacagaatatgttcgtggtcaacgaattgaaactactttactttcaaagttaaagatagaaattgtatcaatcgatgaaaaagttgatgatattgttaatgtgattattaaagcagttcaaacgggcgaagtgggagatggtaaaatcttcattcaacctgttgagcgtgtaattcgaattagaacctcagaagaagatgctcaagcgctctaa

SEQ ID NO: 62298 - protein, 113 aa, Lactococcus lactis subsp. lactis Il1403
MKKIEAIIRTDKLEDLKAALSDNGLVHGMTVSQVLGYGEQKGFTEYVRGQRIETTLLSKLKIEIVSIDEKVDDIVNVIIKAVQTGEVGDGKIFIQPVERVIRIRTSEEDAQAL

SEQ ID NO: 62299 - DNA, 339 bp, Neisseria meningitidis MC58
  CDS (1)..(339): transl_table=11
atgaaaaaaatcgaggcgattgtcaaaccgttcaaactcgacgacgtgcgcgaggcgttgacggaaatcggcattacgggcatgaccgtcagcgaggtcaaagggttcggcaggcagaaggggcatacggaaatctatcgcggcgcggaatacgccgtcgatttcctgcccaaaatcaaaatcgagctggtgttggcggatgatgctgtggaacgcgcgattgacgtgattgtcgaggtggcgcgttcgggaaaaatcggcgacggcaagatttttgtgctgccggttgaggaggcaatccgtatccgcacgggcgaacgttcggacgcggcagtctga

SEQ ID NO: 62300 - protein, 112 aa, Neisseria meningitidis MC58
MKKIEAIVKPFKLDDVREALTEIGITGMTVSEVKGFGRQKGHTEIYRGAEYAVDFLPKIKIELVLADDAVERAIDVIVEVARSGKIGDGKIFVLPVEEAIRIRTGERSDAAV

SEQ ID NO: 62301 - DNA, 327 bp, Methanothermobacter thermautotrophicus str. Delta H
  CDS (1)..(327): transl_table=11
gtgttaaagatgaagatgataagggccataataagaccagagaagtctgaagaggtgattgatgccctcgataaagctggatttccagccctaacaaaaatggatgttgcagggagaggtaaacagagggggatacgccttgatgagatctactatgaggagttaccaaagaccatgctcctcatagttgtggatgacagtgatgcagagaaggtcataaacaccgtccatgaaacagcattcacaggtaacattggggatggtaaaatctttgtaagtcccgtggaaagtgcatataccatcaggacaagggaagagggtctttag

SEQ ID NO: 62302 - protein, 108 aa, Methanothermobacter thermautotrophicus str. Delta H
MLKMKMIRAIIRPEKSEEVIDALDKAGFPALTKMDVAGRGKQRGIRLDEIYYEELPKTMLLIVVDDSDAEKVINTVHETAFTGNIGDGKIFVSPVESAYTIRTREEGL

SEQ ID NO: 62303 - DNA, 369 bp, Methanothermobacter thermautotrophicus str. Delta H
  CDS (1)..(369): transl_table=11
atgaaggagataatagccataataaggtcaaacaaaatgaaaaagaccagggatgtccttgaagtcctcgggtttcccgccatgaacgccagaagagtcctgggaagggggcatcagagggccataattgacgatgttaacatcccctttcctccagagggtattgaagagtcgagaggtacaatgaggtatattcctaagaggatgatcagcatcatggttgaagacagggacgtggagctggttgtggaggccataatgaaggtaaaccacacaggcaatattggggatggtaaaatctttgtatgcccagtggatgatgctgtaaggataagaaccggcgagaatggggatgtggcacttcaatag

SEQ ID NO: 62304 - protein, 122 aa, Methanothermobacter thermautotrophicus str. Delta H
MKEIIAIIRSNKMKKTRDVLEVLGFPAMNARRVLGRGHQRAIIDDVNIPFPPEGIEESRGTMRYIPKRMISIMVEDRDVELVVEAIMKVNHTGNIGDGKIFVCPVDDAVRIRTGENGDVALQ

SEQ ID NO: 62305 - DNA, 339 bp, Neisseria meningitidis Z2491
  CDS (1)..(339): transl_table=11
atgaaaaaaatcgaggcgattgtcaaaccgttcaaactcgacgacgtgcgcgaggcgttgacggaaatcggcattacggggatgaccgtcagcgaggtcaaagggttcggcaggcagaaggggcatacggaaatctatcgcggtgcggaatacgccgtcgatttcctgcccaaggtcaaaatcgagcttgtgttggcggatgatgctgtggaacgcgcgattgacgtgattgtcgaggtggcgcgttcgggaaaaatcggcgacggcaagatttttgtgctgccggtcgaggaggcaatccgtatccgcacgggcgaacgtgcggacgcggcggtttga

SEQ ID NO: 62306 - protein, 112 aa, Neisseria meningitidis Z2491
MKKIEAIVKPFKLDDVREALTEIGITGMTVSEVKGFGRQKGHTEIYRGAEYAVDFLPKVKIELVLADDAVERAIDVIVEVARSGKIGDGKIFVLPVEEAIRIRTGERADAAV

SEQ ID NO: 62307 - DNA, 414 bp, Deinococcus radiodurans R1
  CDS (1)..(414): transl_table=11
gtgcgccgcgcgaggcaaagggaggacaggatgaaactgattacggcagtggtccggcccgaacgggtgcagcaggtcaaggaagcgctgtttcaggcgggcatcagcgggctgacgctcagccgggtcagcgggcacggcggcgaacaggaactcgtcgagcactaccggggcaaccgggtgatgatcgagttccgcgacaaggtcgaatttcgcatggcggtcagcgagccgttcgtgcagcccgccatcgacgccatctgccggggtgcccgcaccggcgaggtgggcgacggcaaaattttcgtgcaaccgctggaacgggtgattcgcatccgcaccggcgaggaagacagcttggccctgacgcccgtgactgaaacccggctcgcgcccctcggaggtcactcgtga

SEQ ID NO: 62308 - protein, 137 aa, Deinococcus radiodurans R1
MRRARQREDRMKLITAVVRPERVQQVKEALFQAGISGLTLSRVSGHGGEQELVEHYRGNRVMIEFRDKVEFRMAVSEPFVQPAIDAICRGARTGEVGDGKIFVQPLERVIRIRTGEEDSLALTPVTETRLAPLGGHS

SEQ ID NO: 62309 - DNA, 366 bp, Clostridium acetobutylicum ATCC 824
  CDS (1)..(366): transl_table=11
atggattacaagatgagcaaagttgacatagttacaagaccagaaaaattcgatgaacttaaaagtgagcttaacaaaattggagttacaggtatgacagttacaaacgtactcggatgtggtcttcaaaagggtactcttgagtactatagaggaaatcctgttgaaataaccctaaatcctaaaataaaagttgaaatagtcgtatgctcagttcctgttgaaaaggtggtagagacagccaaaaatgttctaaacacaggaaaaattggagacggaaaaatttttgtatacgacgttagtaaagtagttaaaataagaactggtgaagaagattacgatgcacttcaagatgataaagaataa

SEQ ID NO: 62310 - protein, 121 aa, Clostridium acetobutylicum ATCC 824
MDYKMSKVDIVTRPEKFDELKSELNKIGVTGMTVTNVLGCGLQKGTLEYYRGNPVEITLNPKIKVEIVVCSVPVEKVVETAKNVLNTGKIGDGKIFVYDVSKVVKIRTGEEDYDALQDDKE

SEQ ID NO: 62311 - DNA, 474 bp, Agrobacterium tumefaciens str. C58
  CDS (1)..(474): transl_table=11
atgcattttgtgccagaaagccgggcgagcgaagttttttcttcacgcccgcttccgatctggcacaatacgtgcattcttgtggcagagcgggaattacctgctttaacgggagaagcggagagatattttctcatgaaaaagatcgaagcgatcattaagcccttcaagctcgatgaagtgaaggaagcccttcaggaagtcggacttcagggcatcacggtcacggaagcaaaaggctttggtcgtcagaagggccacacggaactctaccgcggagcagagtacgttgtggactttctgccgaaagtgaaagtcgaagtcgtcttggcggacgagaacgcggaagccgtcatcgaggcgatccgtaatgcggcgcagaccggacgtatcggcgacggaaagattttcgtttccaatatcgaggaagtcatccgcatccgtaccggtgaaacaggcgtggacgccatataa

SEQ ID NO: 62312 - protein, 157 aa, Agrobacterium tumefaciens str. C58
MHFVPESRASEVFSSRPLPIWHNTCILVAERELPALTGEAERYFLMKKIEAIIKPFKLDEVKEALQEVGLQGITVTEAKGFGRQKGHTELYRGAEYVVDFLPKVKVEVVLADENAEAVIEAIRNAAQTGRIGDGKIFVSNIEEVIRIRTGETGVDAI

SEQ ID NO: 62313 - DNA, 339 bp, Sinorhizobium meliloti 1021
  CDS (1)..(339): transl_table=11
atgaaaattgtgatggccattatcaagccgttcaagctcgatgaggttcgcgaagccctcactgccgttggcatccagggtttgaccgtgaccgaagtgaagggctacggccgccaaaagggacacaccgagatttaccgcggcaccgaatatgccgtgagctttctgcctaagctgaaggtcgagatcgcggtcgcgacggagatcgtcgacagggccgtcgaagccatcgcttcggccgccaagaccggccagatcggcgacggcaagatcttcgtctactcgattgaccatgccgtgcgcatccgcaccggcgagaccgactcagaagcgttgtaa

SEQ ID NO: 62314 - protein, 112 aa, Sinorhizobium meliloti 1021
MKIVMAIIKPFKLDEVREALTAVGIQGLTVTEVKGYGRQKGHTEIYRGTEYAVSFLPKLKVEIAVATEIVDRAVEAIASAAKTGQIGDGKIFVYSIDHAVRIRTGETDSEAL

SEQ ID NO: 62315 - DNA, 345 bp, Caulobacter crescentus CB15
  CDS (1)..(345): transl_table=11
atgaagatgatcgtcgccgtgattaagccgagccgcctggatgcggtgctcgaagcggtcaccgaggcgggggcgtctggcctgaccgtcaccgaggtgcgcggctatggccgtcagaagggcaagaccgaggtctatcggggcgccgaatacgaggtgaagctgctgcccaaggtgaagctggagatcgccgttccaaccgacgtgctcgagccggtgatcgaggctctgcagcgcaccgccaacaccggcaagatcggtgacggcaaggtcttcgtcatggacctggaacaggccctgcgcatccgaaccggcgagcgcgacgccgcggcgatcgccggctga

SEQ ID NO: 62316 - protein, 114 aa, Caulobacter crescentus CB15
MKMIVAVIKPSRLDAVLEAVTEAGASGLTVTEVRGYGRQKGKTEVYRGAEYEVKLLPKVKLEIAVPTDVLEPVIEALQRTANTGKIGDGKVFVMDLEQALRIRTGERDAAAIAG

SEQ ID NO: 62317 - DNA, 339 bp, Caulobacter crescentus CB15
  CDS (1)..(339): transl_table=11
atgaaactgatcatagcggtcgtcaaacccttcaagctggacgaggtgcgcgaagcgctcgtcgcggccggcgttgaaggcctgacggtgtctgaagtgaagggctacggccgccagaagggccagaccgagatttaccggggcgccgagtaccaggtgaatttcgtgccgaaggtgaagctggaggccgttgtcgacgacgcctcggccgccaaggccgtcgaagccatcaagggcgcggccgccaccggcaagatcggcgacggcaaggtcttcgtcctcaatgtcgaagaagccgtccgcatccgcaccggcgaaaccggctcggccgctctgtaa

SEQ ID NO: 62318 - protein, 112 aa, Caulobacter crescentus CB15
MKLIIAVVKPFKLDEVREALVAAGVEGLTVSEVKGYGRQKGQTEIYRGAEYQVNFVPKVKLEAVVDDASAAKAVEAIKGAAATGKIGDGKVFVLNVEEAVRIRTGETGSAAL

SEQ ID NO: 62319 - DNA, 339 bp, Caulobacter crescentus CB15
  CDS (1)..(339): transl_table=11
atgaagaagatcgaagccgtcatcaagccgttcaagctggatgaggtgaaggaggccctgcaggacatgggcgtccaaggcatgaccgtgctcgaggccaagggctacggccgtcagaaaggccacaccgagctttatcgcggcgccgagtacgtcgtggacttcctccccaagatcaaggtggaggtcgtcgtcgaggacagccagctcgagcccgcgctggaagccatcacccgcgccgcccgcacgggccgcatcggcgacggcaagattttcgtctcggagatcgcggaagtgatccgcatccgaaccggagaaaacggtccggccgccgtctag

SEQ ID NO: 62320 - protein, 112 aa, Caulobacter crescentus CB15
MKKIEAVIKPFKLDEVKEALQDMGVQGMTVLEAKGYGRQKGHTELYRGAEYVVDFLPKIKVEVVVEDSQLEPALEAITRAARTGRIGDGKIFVSEIAEVIRIRTGENGPAAV

SEQ ID NO: 62321 - DNA, 339 bp, Salmonella typhimurium LT2
  CDS (1)..(339): transl_table=11
atgaagctggttaccgtgattatcaaaccgttcaagctggaggacgtgcgggaggcgctttcttccattggcattcagggactgaccgtcaccgaagtgaaagggtttggccgtcagaaaggacacgccgaactgtatcgcggcgcggagtacagcgtgaatttcctgccgaaggtcaaaattgatgtggctatcgccgacgaccaactggaagaggtgatcgatatcatcagtaaagcggcttacaccggaaaaattggcgacggcaaaattttcgtcgcggagctcatgcgcgttattcggattcgtaccggcgaagctgacgaagcagcgctgtaa

SEQ ID NO: 62322 - protein, 112 aa, Salmonella typhimurium LT2
MKLVTVIIKPFKLEDVREALSSIGIQGLTVTEVKGFGRQKGHAELYRGAEYSVNFLPKVKIDVAIADDQLEEVIDIISKAAYTGKIGDGKIFVAELMRVIRIRTGEADEAAL

SEQ ID NO: 62323 - DNA, 366 bp, Listeria innocua Clip11262
  CDS (1)..(366): transl_table=11
atgtcaggattaactaaaatcgaaattattacacgtccaaaccgcttccatttatttcaaaaagaacttgcaaaaattggcgtaagtggactaactgttacaaaagcacttgggactggcttagaaaaaggatttattgaattataccgcggtactaaaaaagaaagtaatgttcacgaacgaatgaaaattgaaattgttgtttctactgttccggttgaagatgtccttcgcgtcgttaaagaaactcttcgaactggcgaacctggtgatggaaaagtatttatttatccccttgccgaggtcgttaaaatcagcacaggtgaaaccggcatcgatgctttacaagataaaccagcaaaatga

SEQ ID NO: 62324 - protein, 121 aa, Listeria innocua Clip11262
MSGLTKIEIITRPNRFHLFQKELAKIGVSGLTVTKALGTGLEKGFIELYRGTKKESNVHERMKIEIVVSTVPVEDVLRVVKETLRTGEPGDGKVFIYPLAEVVKISTGETGIDALQDKPAK

SEQ ID NO: 62325 - DNA, 339 bp, Nostoc sp. PCC 7120
  CDS (1)..(339): transl_table=11
atgaaaaaagtagaagctattatccgcccatttaagctagatgaagtgaaaatcgctttagtcaacgcgggtattgtgggtatgactgtttctgaagtccggggttttggacggcagaaaggacagacagaacgctatcgcggctctgagtacactgtggagtttctgcaaaaactgaaggtggagattgtagttgaagataaccaagttgatatggttgttgacaaaatcattgctgctgctcgtacaggcgaaatcggtgatggtaaaatctttatctcacctgtagaacaagtaattcggattcgtactggagagaagaatacagaagccgtgtaa

SEQ ID NO: 62326 - protein, 112 aa, Nostoc sp. PCC 7120
MKKVEAIIRPFKLDEVKIALVNAGIVGMTVSEVRGFGRQKGQTERYRGSEYTVEFLQKLKVEIVVEDNQVDMVVDKIIAAARTGEIGDGKIFISPVEQVIRIRTGEKNTEAV

SEQ ID NO: 62327 - DNA, 351 bp, Agrobacterium tumefaciens str. C58
  CDS (1)..(351): transl_table=11
atgggaaaccagatgaaaattgtgatggccattatcaagccgttcaagctggatgaggtgcgcgaagcactcaccggcgtcggcatccagggcctgaccgtgaccgaggtgaagggttacggacgtcagaaggggcataccgagatctatcgcggcacggaatacgcggtgagcttccttcccaagctgaagatcgagatcgcagttccatccgacgtcgtcgacaaggccgtcgaggcgatcgcgtctgcggcaaagaccgggcagatcggtgacggcaagatctttgtctactctatcgaacaggccgtgcgcattcgtaccggcgaaaccaacacagaagcgctttaa

SEQ ID NO: 62328 - protein, 116 aa, Agrobacterium tumefaciens str. C58
MGNQMKIVMAIIKPFKLDEVREALTGVGIQGLTVTEVKGYGRQKGHTEIYRGTEYAVSFLPKLKIEIAVPSDVVDKAVEAIASAAKTGQIGDGKIFVYSIEQAVRIRTGETNTEAL

SEQ ID NO: 62329 - DNA, 339 bp, Corynebacterium glutamicum ATCC 13032
  CDS (1)..(339): transl_table=11
atgaaactcatcaccgcaattgtcaagccgtttaccctcaccgacattaaagatgctctcgagcaggcaggtgtgcagggcatgactgtcaccgaaacccaaggctttggccagcagaaaggccacaccgaggtgtaccgtggtgctgaatacgctgtcgattttgtgcctaaggtcaagattgaagttattatctccgatgctcaggctgaggaagtcatcaacattatcgtcgagaccgcacgcaccggcaaagtcggcgacggcaaagtgtggatgactaacatcgaagagctggttcgtgttcgtaccggtgagcgcggcgaagcagccctttaa

SEQ ID NO: 62330 - protein, 112 aa, Corynebacterium glutamicum ATCC 13032
MKLITAIVKPFTLTDIKDALEQAGVQGMTVTETQGFGQQKGHTEVYRGAEYAVDFVPKVKIEVIISDAQAEEVINIIVETARTGKVGDGKVWMTNIEELVRVRTGERGEAAL

SEQ ID NO: 62331 - DNA, 354 bp, Methanopyrus kandleri AV19
  CDS (1)..(354): transl_table=11
atgtacatgatcgaagccgtcatcaggccggagaagttggacgatgtgaaagaggcgctggacgaggccggctatcctggtatgaccgtgattcacgtgaagggccgtggtcggcagcggggaatcgtacaccggtaccgtgacgaggagtaccggaccgatctcctcgacaagatcctgctgaaggtcgccgttcccaccgaggatgacgtcgagaaggtcatcgacgtcatctgtgagcacgcgaagacgggcaggcccggcgacggtatgatcttcgtcatcccgctcgaggacgccgtccgcgcgcgcaccggagagcgtggggacgacgcactgtccaccgaggagtga

SEQ ID NO: 62332 - protein, 117 aa, Methanopyrus kandleri AV19
MYMIEAVIRPEKLDDVKEALDEAGYPGMTVIHVKGRGRQRGIVHRYRDEEYRTDLLDKILLKVAVPTEDDVEKVIDVICEHAKTGRPGDGMIFVIPLEDAVRARTGERGDDALSTEE

SEQ ID NO: 62333 - DNA, 372 bp, Methanosarcina acetivorans C2A
  CDS (1)..(372): transl_table=11
atgaaagaagttactgcagttgtcagacccaataaaatgtctaccacaaaagatgcactggataaaatcggctttcctgctatgacagcaattccggtattagggaaaggcaagcaaagaggcatctctggggaacttaacttttacatacaaccaaggctgcttgcaaaaaggtacagtacaggtatgaaatacatacccaaaaggcttctgagcatagtcgtaaatgacgaagatgtggatctggtggtaaaaaccattatcgaagtcaatcaaactgcccagataggggatggaaggattttcgttgagccgattgatgatgtcatcaggatcaggactggcgaaaaaggagaactatctttgaaataa

SEQ ID NO: 62334 - protein, 123 aa, Methanosarcina acetivorans C2A
MKEVTAVVRPNKMSTTKDALDKIGFPAMTAIPVLGKGKQRGISGELNFYIQPRLLAKRYSTGMKYIPKRLLSIVVNDEDVDLVVKTIIEVNQTAQIGDGRIFVEPIDDVIRIRTGEKGELSLK

SEQ ID NO: 62335 - DNA, 339 bp, Methanosarcina acetivorans C2A
  CDS (1)..(339): transl_table=11
atgtgcaaagtagaagcaataataaaacccctgaaactgcatcaggtaaaggatgccctggaagaatccggctttccaagcctgacagttaccgacgttaaaggtcgtggtcagcaaaaagggattgtgcagcaatggagaggtaagaaatactgtgtggatctccttccaaaaaccaaagtagaagtggttgtaccggaagaggaggtcgaaaaaattatacaggtgatccagagcacggcctatactggggaaataggagacggaaagatcttcgttatcccaattgaaaccgtagtaaggatcagaaccggagaaaggaatggagatgccctttaa

SEQ ID NO: 62336 - protein, 112 aa, Methanosarcina acetivorans C2A
MCKVEAIIKPLKLHQVKDALEESGFPSLTVTDVKGRGQQKGIVQQWRGKKYCVDLLPKTKVEVVVPEEEVEKIIQVIQSTAYTGEIGDGKIFVIPIETVVRIRTGERNGDAL

SEQ ID NO: 62337 - DNA, 354 bp, Methanosarcina mazei Go1
  CDS (1)..(354): transl_table=11
gtggtcgcgatgaaatacgtaattgcaatgataaggcctgaaaggcttgatgcagtcaaaagagagcttcagaaaatcgaagtgagcaggttgactgtatcatccgtttccggctatggcgctcaaaaaggatatatggaaatctacagagcgatggaatatgatgcaaacctgcttgaaaaaatcaagatcgaaatcgctgtaaatgacgaattccttgagccaacaattgaggcaataaaaactggagcaaaaggcagtgacggttacgttggaagcggaaagatcttcgtgctgccacttgaaaacgtgataaggatccgcacgaacgaaaccggacctgaggcaatttga

SEQ ID NO: 62338 - protein, 117 aa, Methanosarcina mazei Go1
MVAMKYVIAMIRPERLDAVKRELQKIEVSRLTVSSVSGYGAQKGYMEIYRAMEYDANLLEKIKIEIAVNDEFLEPTIEAIKTGAKGSDGYVGSGKIFVLPLENVIRIRTNETGPEAI

SEQ ID NO: 62339 - DNA, 345 bp, Xanthomonas campestris pv. campestris str. ATCC 33913
  CDS (1)..(345): transl_table=11
atgcgcatgaaattgatcaccgccatcatccggccgttcaagctcgacgaggtccgcgaggccctgtccgcagctggcgtgtcgggtatcaccgttaccgaggtcaaaggcttcggccggcagaagggccataccgagttgtaccgcggcgccgagtacgtcgtggatttcctgcccaagatcaaaatcgagacggtggtgaccgacgaccggctggatgcggtggtcgaggccatccagaacgccgccggcaccggcaagatcggcgacggcaagatcttcgtgaccgcgatcgagcaagtcgtgcgtatccgcaccggcgagatcggcgccgatgcgctctga

SEQ ID NO: 62340 - protein, 114 aa, Xanthomonas campestris pv. campestris str. ATCC 33913
MRMKLITAIIRPFKLDEVREALSAAGVSGITVTEVKGFGRQKGHTELYRGAEYVVDFLPKIKIETVVTDDRLDAVVEAIQNAAGTGKIGDGKIFVTAIEQVVRIRTGEIGADAL

SEQ ID NO: 62341 - DNA, 339 bp, Xanthomonas campestris pv. campestris str. ATCC 33913
  CDS (1)..(339): transl_table=11
atgaaaatgatcatggccatcgtcaaaccgttcaagctggacgatgtgcgcgaagcactcgccggctgcggcgtcgcgggcatcacggtgaccgaggtcaagggattcgggcgccagaagggccacaccgagctgtatcgcggcgccgaatacgtggtcgacttcctgcccaaggtgaaactcgaagtggcggtgaccgacgaccaggccgagcaggtggtggaagccatcgtcaaggcggccggcaccggcaagatcggcgacggcaaggtgttcgtctacgacctgggcagcgtggtgcgcatccgcaccggcgaactggacggcgacgcgctgtaa

SEQ ID NO: 62342 - protein, 112 aa, Xanthomonas campestris pv. campestris str. ATCC 33913
MKMIMAIVKPFKLDDVREALAGCGVAGITVTEVKGFGRQKGHTELYRGAEYVVDFLPKVKLEVAVTDDQAEQVVEAIVKAAGTGKIGDGKVFVYDLGSVVRIRTGELDGDAL

SEQ ID NO: 62343 - DNA, 339 bp, Xanthomonas axonopodis pv. citri str. 306
  CDS (1)..(339): transl_table=11
atgaaaatgatcatggccatcgtcaaaccgttcaagctcgacgatgtgcgcgaagcactcgccggctgcggggtggcgggcatcacggtgaccgaggtcaaaggcttcggccggcagaaaggccacaccgagctgtatcgcggcgccgaatacgtggtcgatttcctgcccaaggtgaagatcgaagtggcggtgaccgacgaccaggccgagcgcgtggtcgaggcgatcgtcggagcggccggtaccggcaagatcggcgacggcaaggtgttcgtatacgacctgggcacggtggtacgcatccgtaccggcgagctggatagcgacgcgttgtag

SEQ ID NO: 62344 - protein, 112 aa, Xanthomonas axonopodis pv. citri str. 306
MKMIMAIVKPFKLDDVREALAGCGVAGITVTEVKGFGRQKGHTELYRGAEYVVDFLPKVKIEVAVTDDQAERVVEAIVGAAGTGKIGDGKVFVYDLGTVVRIRTGELDSDAL

SEQ ID NO: 62345 - DNA, 354 bp, Chlorobium tepidum TLS
  CDS (1)..(354): transl_table=11
atgaaaaaaatagaagccatcattcgcacaagccagtacgaagcggtcaaaaaagccctgcatgagatcgacatcgatttcttcacctggtgggacgtgactgggcagggcaacgacaagaagcaccgcaccgagatctaccggggcaccgtcagggacacctcgtacatctcgcgccgctacctgtcgattgtcgttcgcgacgtcaatctccagaaaacggtcgattgcctgatcaaaaacgcccggacgggtgaggtgggagacggaaaaattttcgtttcggacatcgagcagtcctaccggatccgaacgggagagagcggcgacgaatcgctgtacaacaaggactag

SEQ ID NO: 62346 - protein, 117 aa, Chlorobium tepidum TLS
MKKIEAIIRTSQYEAVKKALHEIDIDFFTWWDVTGQGNDKKHRTEIYRGTVRDTSYISRRYLSIVVRDVNLQKTVDCLIKNARTGEVGDGKIFVSDIEQSYRIRTGESGDESLYNKD

SEQ ID NO: 62347 - DNA, 342 bp, Chlorobium tepidum TLS
  CDS (1)..(342): transl_table=11
atgaaatacatcgtagcaatgatacagccccacaagctgccggacgtcaagaaaagccttgccgcagcggggatacgcaagatgaccgtaaccaatgctctcggatgcggcgcgcagggcggatacaccgaaatgtatcgcggcataccgagcgaggtgaaccttctcaaaaaggtcaagcttgaaatcgccgtcaacgaggagttcgctgacgccacggtcaaggcgatcatcaagggcgcgaaaaccggcgagataggagatgggaaaatttttatcttcgacctccccgagtgcatccgaatcagaaccgaggaaaagggacacgccgccatcggctga

SEQ ID NO: 62348 - protein, 113 aa, Chlorobium tepidum TLS
MKYIVAMIQPHKLPDVKKSLAAAGIRKMTVTNALGCGAQGGYTEMYRGIPSEVNLLKKVKLEIAVNEEFADATVKAIIKGAKTGEIGDGKIFIFDLPECIRIRTEEKGHAAIG

SEQ ID NO: 62349 - DNA, 339 bp, Yersinia pestis KIM
  CDS (1)..(339): transl_table=11
atgaagctggttaccgtggtgataaaaccatttaagctggaagatgtgcgagaagccttatcttctgtaggtattcaggggctgaccgtaaccgaagtcaaagggtttggtcgccagaaagggcatgcagagctttatcgaggagctgaatacagcgtcaatttcttacccaaagtaaaaattgatatcgccatcgccgatgatcaattagacgaagtgattgatgtgatcagtaaagcggcctataccggaaaaattggtgatggcaaaattttcgttgctgaattgcaacgtgttattcgcatccgtactggcgaaacagacgaagcagcgctgtaa

SEQ ID NO: 62350 - protein, 112 aa, Yersinia pestis KIM
MKLVTVVIKPFKLEDVREALSSVGIQGLTVTEVKGFGRQKGHAELYRGAEYSVNFLPKVKIDIAIADDQLDEVIDVISKAAYTGKIGDGKIFVAELQRVIRIRTGETDEAAL

SEQ ID NO: 62351 - DNA, 339 bp, Yersinia pestis KIM
  CDS (1)..(339): transl_table=11
atgaaaaaaattgacgcgattattaaaccattcaaactggatgacgtacgtgaagcgctggctgaagtcggtattaccgggatgacagtgacagaagtaaaaggttttggccgccagaaggggcatactgaactctaccgtggcgctgagtatatggtggattttctgccaaaggtaaaaattgagattgttgttgcggatgacatcgtcgatacctgcgtagaagccattatgcaaaccgcccatacgggtaaaattggcgatggtaaaatctttgtttttgatgtctcccgtgttgtgcgtattcgtaccggtgagcaggatgaagaagcgatttaa

SEQ ID NO: 62352 - protein, 112 aa, Yersinia pestis KIM
MKKIDAIIKPFKLDDVREALAEVGITGMTVTEVKGFGRQKGHTELYRGAEYMVDFLPKVKIEIVVADDIVDTCVEAIMQTAHTGKIGDGKIFVFDVSRVVRIRTGEQDEEAI

SEQ ID NO: 62353 - DNA, 339 bp, Thermosynechococcus elongatus BP-1
  CDS (1)..(339): transl_table=11
ttgaaaaaggtagaagccattattcgtcccttcaaactcgatgaagttaagatcgcccttgtcaatgcaggtattgtcggcatgaccgtctccgaagtgcgcggctttgggcggcaaaaggggcaaacggaacggtatcgtggctcggaatacacggtggagtttttacaaaagttaaaagttgagattgttgtcgaagacaatcaagtggacatggtcgtggcgaaaattattgaagctgcccgcacaggcgaaattggcgacggtaagattttcgtcacccccgtagagcaggtcattcgcattcgtaccagtgaaaaagatcacgaggcggtctag

SEQ ID NO: 62354 - protein, 112 aa, Thermosynechococcus elongatus BP-1
MKKVEAIIRPFKLDEVKIALVNAGIVGMTVSEVRGFGRQKGQTERYRGSEYTVEFLQKLKVEIVVEDNQVDMVVAKIIEAARTGEIGDGKIFVTPVEQVIRIRTSEKDHEAV

SEQ ID NO: 62355 - DNA, 342 bp, Oceanobacillus iheyensis HTE831
  CDS (1)..(342): transl_table=11
atgaaaaaattggaagcaattatacgtccagaaaaattccagtctcttcgtgatgagttatcttcaattggaattggtggtttaactgttactgaagtagcaggtacaggaaagcaaaaaggccaaacaggggtttatcgctcgacagagtttcaaattcaattattatccaaattgaaagtagagatggtgattgaagaaagtcaattagaagaaattgttgatattatcattaaaagctgtaagacaggtaatataggagacggtaaaatttttgtctctcctgtagaagaagttattcgaattcgtactggcgaacgtggtatggaagctgttttataa

SEQ ID NO: 62356 - protein, 113 aa, Oceanobacillus iheyensis HTE831
MKKLEAIIRPEKFQSLRDELSSIGIGGLTVTEVAGTGKQKGQTGVYRSTEFQIQLLSKLKVEMVIEESQLEEIVDIIIKSCKTGNIGDGKIFVSPVEEVIRIRTGERGMEAVL

SEQ ID NO: 62357 - DNA, 339 bp, Bifidobacterium longum NCC2705
  CDS (1)..(339): transl_table=11
atgaagctgatcaccgctatcattcagccccataagctcgacgatgtcaaggaggccctcgcggccgccggcgtgcacggtctgaccgtgtccgaggccaacggctacggccgccagcgcggccacaccgaggtctaccgtggcgctgaatacactgtggacctgattccgaagattcgcgttgaagtgctgtccgatgacgcggatgccgagacgctggtcggtgtgatcatcaagtccgccggcaccggcaccatcggtgacggcaaggtgtgggtcgctccgctggactccgtggcccgcgtgcgtaccggtgagaccggttccgccgcgatctga

SEQ ID NO: 62358 - protein, 112 aa, Bifidobacterium longum NCC2705
MKLITAIIQPHKLDDVKEALAAAGVHGLTVSEANGYGRQRGHTEVYRGAEYTVDLIPKIRVEVLSDDADAETLVGVIIKSAGTGTIGDGKVWVAPLDSVARVRTGETGSAAI

SEQ ID NO: 62359 - DNA, 339 bp, Brucella suis 1330
  CDS (1)..(339): transl_table=11
atgaaaaagatcgaagccattattaagcccttcaagctggatgaagtgaaggaagcccttcaggaagtcggcttgcagggaattactgtcattgaagccaagggtttcggtcggcagaaggggcataccgagctttaccgcggcgccgaatatgtcgtcgattttcttcccaaggtgaaagtcgaagtcattgtcgcagacgaaaccgtggacagcgccatcgaggccatccgcaaggccgcccagaccggacgtatcggcgacggcaagattttcgtctccaacatcgaagaagtcatccgtatccgcaccggcgaatccggcgtggatgccatttaa

SEQ ID NO: 62360 - protein, 112 aa, Brucella suis 1330
MKKIEAIIKPFKLDEVKEALQEVGLQGITVIEAKGFGRQKGHTELYRGAEYVVDFLPKVKVEVIVADETVDSAIEAIRKAAQTGRIGDGKIFVSNIEEVIRIRTGESGVDAI

SEQ ID NO: 62361 - DNA, 339 bp, Shewanella oneidensis MR-1
  CDS (1)..(339): transl_table=11
atgaaactagtcagcgctatcatcaagccatttaaattggatgatgtccgtgaagctatcgccggaattggtattgaggggatgacggtgaccgaggttaaaggttttggccgtcaaaaggggcacaccgagctgtaccgtggcgccgagtatcaggtggattttttgccaaaagtaaaactagaaattgccaccaaagcagaaaatctcgacatgctgattgaggcgattaccactgcggctcatacgggaaaaattggtgacggaaagattttcgttatcgacttagaacatgccatccgtattcgtacgggtgaactcgatactgaagcgctatag

SEQ ID NO: 62362 - protein, 112 aa, Shewanella oneidensis MR-1
MKLVSAIIKPFKLDDVREAIAGIGIEGMTVTEVKGFGRQKGHTELYRGAEYQVDFLPKVKLEIATKAENLDMLIEAITTAAHTGKIGDGKIFVIDLEHAIRIRTGELDTEAL

SEQ ID NO: 62363 - DNA, 339 bp, Shewanella oneidensis MR-1
  CDS (1)..(339): transl_table=11
atgaagaaagttgaagccattattaagccttttaaattagatgatgtgcgcgagtcacttgctgagatagggatcacggggatgacggtgctggaagttaagggctttggccgtcagaaagggcacacagagctttatcgtggtgctgagtatatggttgattttttacccaaagttaagattgagctcgtcatccaagatgatttagtagaccaagcgatagatgttattgttgaaactgcccgcacaggtaaaattggcgatggtaaaatttttgtgacagatgttgagcgggttatccggattcgaactggtgaagaaaacgaagaagcggtttaa

SEQ ID NO: 62364 - protein, 112 aa, Shewanella oneidensis MR-1
MKKVEAIIKPFKLDDVRESLAEIGITGMTVLEVKGFGRQKGHTELYRGAEYMVDFLPKVKIELVIQDDLVDQAIDVIVETARTGKIGDGKIFVTDVERVIRIRTGEENEEAV

SEQ ID NO: 62365 - DNA, 339 bp, Shewanella oneidensis MR-1
  CDS (1)..(339): transl_table=11
ttgaaactcatcactgcaattattaaacccttcaaaattgatgatgttcgtgaagcgctaactcaactggggatccacggcatgacagtcacagaagttcgtggctttggtcgtcaaaagggccacacagagctctatcgcggcgccgaatatgctgtcgactttctccccaaaatgaagcttgaaatcgcgatccactccgaacttgaagaagcagtcatcgaagccatcatccaagccgcccacacaggtaaagtcggtgacgggaagatttttgtcaccccactcgaacaagtgatccgcgtccgcaccgcagaagaaggggttgatgccatatga

SEQ ID NO: 62366 - protein, 112 aa, Shewanella oneidensis MR-1
MKLITAIIKPFKIDDVREALTQLGIHGMTVTEVRGFGRQKGHTELYRGAEYAVDFLPKMKLEIAIHSELEEAVIEAIIQAAHTGKVGDGKIFVTPLEQVIRVRTAEEGVDAI

SEQ ID NO: 62367 - DNA, 342 bp, Streptococcus mutans UA159
  CDS (1)..(342): transl_table=11
atgaaaaaaatagaagctattattcgctctgataaattagaagatttaaaagcagccttggttcagtcaggttttatcaaaggaatgactattagccaagttctaggatttgggaatcaacgaggttatacagaatatgtccgtggtcaaaagatcactccaacgctcttagccaaagtgaaagttgaaattgttgctcatgatgcagcagtcgaagaaatgattacgaccatcagccaagcagtaaagacaggagaagttggtgatggtaagatatttgtcagtccagttgatgaaattgttagaattcgtacaggagaacgtgatggtgatgccatttaa

SEQ ID NO: 62368 - protein, 113 aa, Streptococcus mutans UA159
MKKIEAIIRSDKLEDLKAALVQSGFIKGMTISQVLGFGNQRGYTEYVRGQKITPTLLAKVKVEIVAHDAAVEEMITTISQAVKTGEVGDGKIFVSPVDEIVRIRTGERDGDAI

SEQ ID NO: 62369 - DNA, 339 bp, Streptomyces coelicolor A3(2)
  CDS (1)..(339)
atgaagctcatcaccgccgtcgtcaagccgcaccggctcgacgagatcaaggaggccctccaggccttcggggtccacggcctgaccgtcaccgaggccagcggctacggccgccagcgcggacacaccgaggtctaccggggggccgagtacaccgtcgacctggtgcccaagatccgcatcgaggtcctggtcgaggacgacgacgccgagcagctgatcgacgtcgtcgtcaaggcggcccgcaccggcaagatcggcgacggcaaggtctgggcggtcccggtcgacacggccgtacgggtgaggaccggcgagcgcggacccgacgcgctctga

SEQ ID NO: 62370 - protein, 112 aa, Streptomyces coelicolor A3(2)
MKLITAVVKPHRLDEIKEALQAFGVHGLTVTEASGYGRQRGHTEVYRGAEYTVDLVPKIRIEVLVEDDDAEQLIDVVVKAARTGKIGDGKVWAVPVDTAVRVRTGERGPDAL

SEQ ID NO: 62371 - DNA, 339 bp, Corynebacterium efficiens YS-314
  CDS (1)..(339): transl_table=11
atgaaactcatcaccgccattgtcaagcctttcaccctgaccgatgtcaaggaagccctcgagcaggtgggcgtgcagggcatgaccgtcaccgagacccagggcttcggccagcagaagggacacaccgaggtctaccgcggagcggaatacgccgttgatttcgtcccgaagatcaagatcgaggtcgtggtctccgacgcgcagttggatgaggtggtcgaggcgatcgtcaccaccgcccgcaccggcaagatgggcgacggcaaggtctgggtcacccacgtcgaggagctcatccgcgtgcgcaccggcgagcgtggcgacgaagccctgtaa

SEQ ID NO: 62372 - protein, 112 aa, Corynebacterium efficiens YS-314
MKLITAIVKPFTLTDVKEALEQVGVQGMTVTETQGFGQQKGHTEVYRGAEYAVDFVPKIKIEVVVSDAQLDEVVEAIVTTARTGKMGDGKVWVTHVEELIRVRTGERGDEAL

SEQ ID NO: 62373 - DNA, 339 bp, Pseudomonas putida KT2440
  CDS (1)..(339): transl_table=11
atgaagctagtcacagccatcatcaagccgttcaagctggacgacgtgcgcgagtcgctgtcggaaatcggcgtgcagggcatcaccgtcaccgaagtcaaaggtttcggtcggcagaagggccacaccgagctgtatcgcggtgctgaatatgtggtcgatttcctgcccaaggtgaagatcgatgtcgccatcgatgacaaagaccttgatcgggtaatcgaagccatcaccaaggcagccaacaccggcaagatcggtgacggcaagattttcgtggtgaatctggagcaggcgatccgcatccgtaccggcgaaaccgataccgacgcgatctaa

SEQ ID NO: 62374 - protein, 112 aa, Pseudomonas putida KT2440
MKLVTAIIKPFKLDDVRESLSEIGVQGITVTEVKGFGRQKGHTELYRGAEYVVDFLPKVKIDVAIDDKDLDRVIEAITKAANTGKIGDGKIFVVNLEQAIRIRTGETDTDAI

SEQ ID NO: 62375 - DNA, 339 bp, Bradyrhizobium japonicum USDA 110
  CDS (1)..(339)
atgaaactcgtcgtcgcgatcatcaaacccttcaagctcgatgaggtccgccaggccctgacggcgatcggcgtccacggcatgaccgtgaccgaggtaaagggttatggccgccagaagggccacaccgagatctatcgcggcgcggaatatgtcgtgaacttcctgccgaagctgcgcatcgagatcgcggtcgcctccgacgtcgccgacaaggcggtcgccgtgatcaccgccacggcgcgcaccgggcagatcggcgacggcaagatcttcgtcacgccgatcgaccacgcgctgcgcatccgcaccggcgaaaccgacagcgacgcgctctaa

SEQ ID NO: 62376 - protein, 112 aa, Bradyrhizobium japonicum USDA 110
MKLVVAIIKPFKLDEVRQALTAIGVHGMTVTEVKGYGRQKGHTEIYRGAEYVVNFLPKLRIEIAVASDVADKAVAVITATARTGQIGDGKIFVTPIDHALRIRTGETDSDAL

SEQ ID NO: 62377 - DNA, 339 bp, Vibrio parahaemolyticus RIMD 2210633
  CDS (1)..(339): transl_table=11
atgaaaataatcaacgccattattaagccgtttaagttagacgatgttcgcgaagcattggctgatgtcggtatcgaagggatgacagtatcagaggtgaaaggctttggtcgccagaagggtcacactgagttgtaccgcggtgcggagtaccaagtggactttctaccgaaggtcaaaatagaaattgcgacacatgcagacaatgttgatcgcgtcgtagaggcgatcacaaaagcggcgcagaccggaaaaattggcgacggtaagatttttgtgtacgacctgaaccaagcggtgcgcatccgtacgggtgaaatggacgcagaagcactttaa

SEQ ID NO: 62378 - protein, 112 aa, Vibrio parahaemolyticus RIMD 2210633
MKIINAIIKPFKLDDVREALADVGIEGMTVSEVKGFGRQKGHTELYRGAEYQVDFLPKVKIEIATHADNVDRVVEAITKAAQTGKIGDGKIFVYDLNQAVRIRTGEMDAEAL

SEQ ID NO: 62379 - DNA, 357 bp, Bacteroides thetaiotaomicron VPI-5482
  CDS (1)..(357): transl_table=11
atgaaaaagattgaagctatcatccgtaaaaccaaattcgaggacgtgaaagacgctctgctcgaagcggacattgaatggttctcttactacgatgtaagagggatcggtaaagcacggcaaggacgtatctatcgtggagtggtatatgataccagcaccatcgaacgtattctggtttctattgtagtacgcgacaaaaatgcagaaaagaccgtacaggctatcatcaaagccgcacaaaccggagagatcggtgacggacgcattttcgtcattcctatcgaggacgccatccgcatccgcaccgccgaacgtggcgacatcgctctctataacgccgaacaggaacgataa

SEQ ID NO: 62380 - protein, 118 aa, Bacteroides thetaiotaomicron VPI-5482
MKKIEAIIRKTKFEDVKDALLEADIEWFSYYDVRGIGKARQGRIYRGVVYDTSTIERILVSIVVRDKNAEKTVQAIIKAAQTGEIGDGRIFVIPIEDAIRIRTAERGDIALYNAEQER

SEQ ID NO: 62381 - DNA, 339 bp, Streptomyces avermitilis MA-4680
  CDS (1)..(339)
atgaagctcatcaccgcgatcgtcaagccgtaccgcctcgacgaggtcaagacggccctccaggaactcggcgtgcacggcctgaccgtgaccgaggcgagcgggtacgggcgccagcgcggccacaccgaggtgtaccgcggcgccgagtaccgggtcgacctcgtccccaaggtccgtatcgaggtcgtcgtcgaggacgcggactcggacgcggtcatcgacgcgatcgtgaaggccgcgcagacggggaagatcggggacgggaaggtgtggtcggttccggtggagacggtggtacgggtccggacgggcgagcgcggccccgacgcgctctga

SEQ ID NO: 62382 - protein, 112 aa, Streptomyces avermitilis MA-4680
MKLITAIVKPYRLDEVKTALQELGVHGLTVTEASGYGRQRGHTEVYRGAEYRVDLVPKVRIEVVVEDADSDAVIDAIVKAAQTGKIGDGKVWSVPVETVVRVRTGERGPDAL

SEQ ID NO: 62383 - DNA, 402 bp, Rhodopirellula baltica SH 1
  CDS (1)..(402): transl_table=11
atgacgtggcgagtgtacaatgttctgaaattctctgttcgcatgtttgtcggagccgctcctgtgaaaaaagtcgaagccattgttcgtcacttcaaactcgaagacgtcaagaatgcgttgaccgagcaggggattcacggaatgaccgtcagcgaagttcgcggatttggtcgccaaaaaggtcacaccgaaatctatcgcggcaccgagtacgccatcgatttcgtccccaaggtcaaaatcgaagtggtttgcaccagtgacaacctgcaaacggtgatcgacaccattctgcaaactgcccaaaccggacaaattggcgacggaaagatcttcgtcaccaacctcgaagaatcggttcgcatccgcaccggcgagcgtggcgaagaagcgctataa

SEQ ID NO: 62384 - protein, 133 aa, Rhodopirellula baltica SH 1
MTWRVYNVLKFSVRMFVGAAPVKKVEAIVRHFKLEDVKNALTEQGIHGMTVSEVRGFGRQKGHTEIYRGTEYAIDFVPKVKIEVVCTSDNLQTVIDTILQTAQTGQIGDGKIFVTNLEESVRIRTGERGEEAL

SEQ ID NO: 62385 - DNA, 477 bp, Rhodopirellula baltica SH 1
  CDS (1)..(477): transl_table=11
ttggcgatcgatgccatcagctttcggtcagcgatcaggagcggacctgattgccgaaagggcaccttctttgcccgttcgattggcttgctcgaatcgcccgcacgcgacttctggtttgtaccgtccatgaaattgatcattgccatcgttcagccttccaaattggacgccatcaaagaggcgttgactcgcgtggaggtgcaccgactaaccgtcgtggattgccaagggtttggacgtcaacgcggccaaaccggatccatgcgaggccgcgattatggcgtcagcctgctacgcaaagtgcaattgcaaatcggggtcaacgaagagtttgttcaaccgaccattgatgcaatcttggaaggcggacgtagcggagagagcggcgaaattggcgacggaaaaatcttcgttctgccgatggacgactgcgtccggatccgaaccggcgaacgcggcggagaagcaatctag

SEQ ID NO: 62386 - protein, 158 aa, Rhodopirellula baltica SH 1
MAIDAISFRSAIRSGPDCRKGTFFARSIGLLESPARDFWFVPSMKLIIAIVQPSKLDAIKEALTRVEVHRLTVVDCQGFGRQRGQTGSMRGRDYGVSLLRKVQLQIGVNEEFVQPTIDAILEGGRSGESGEIGDGKIFVLPMDDCVRIRTGERGGEAI

SEQ ID NO: 62387 - DNA, 318 bp, Rhodopirellula baltica SH 1
  CDS (1)..(318): transl_table=11
atgccggatgcgatcatgaaacaagtcgtcaccgtcgtttcaccgcatctggccgagaacgttctcgccgccttgcgtcgagctccgctggaagggttgagtgtcatggaggtcaaaggttatggccgccaaaaaagctacctcgatcagtaccaagacaccgagtactcagaagcctttgtgccgaaggtcgagatcacgctctgggtcgatgacctgcgtcttgaagaggtcctcgacaagatcgtcgcggtcactcgcaccggccgcatcggcgacggcaagatcctggtcatgccggtcgcgtcgttcatctga

SEQ ID NO: 62388 - protein, 105 aa, Rhodopirellula baltica SH 1
MPDAIMKQVVTVVSPHLAENVLAALRRAPLEGLSVMEVKGYGRQKSYLDQYQDTEYSEAFVPKVEITLWVDDLRLEEVLDKIVAVTRTGRIGDGKILVMPVASFI

SEQ ID NO: 62389 - DNA, 339 bp, Prochlorococcus marinus subsp. marinus str. CCMP1375
  CDS (1)..(339): transl_table=11
atgaaaaagatagaagcaattatcaggccttttaagcttgaagatgtaaaaatagcccttgtcaatcttggcatagttggcatgacggtcagtgaggttaggggttttgggcgacaaaaaggacaagtagagcgttacagaggatctgaatttacggttgaatttcttcagaaactaaagatagaagttgttgttgctgatgaaagtgttgatggagttattaaagcaattgcagaagctgcaaaaacaggagaaattggtgacgggaaaattttcgtttcttctattgaaactgttctaagaattcggacaggcgaatctgacgattcagctctttaa

SEQ ID NO: 62390 - protein, 112 aa, Prochlorococcus marinus subsp. marinus str. CCMP1375
MKKIEAIIRPFKLEDVKIALVNLGIVGMTVSEVRGFGRQKGQVERYRGSEFTVEFLQKLKIEVVVADESVDGVIKAIAEAAKTGEIGDGKIFVSSIETVLRIRTGESDDSAL

SEQ ID NO: 62391 - DNA, 339 bp, Bordetella bronchiseptica RB50
  CDS (1)..(339): transl_table=11
atgaaactcgtcatcgccatcatcaagcccttcaagctggacgaagtgcggatggccctgtccgatatcggcgtccagggcctgaccgtcaccgaggtgaagggcttcggacgccagaaaggccataccgagctttaccgcggcgccgaatacgccgtcgacttcctgcccaagctgcgggtcgaggcggccgtgccggatcacctggtggaccaggtgatcgaggcgatcgaacagtcggcccgcaccggcaagatcggggacggcaagatattcaccgccccgctcgaggaagtcatccgcatccgcaccggcgagtccggtgaggccgccctgtaa

SEQ ID NO: 62392 - protein, 112 aa, Bordetella bronchiseptica RB50
MKLVIAIIKPFKLDEVRMALSDIGVQGLTVTEVKGFGRQKGHTELYRGAEYAVDFLPKLRVEAAVPDHLVDQVIEAIEQSARTGKIGDGKIFTAPLEEVIRIRTGESGEAAL

SEQ ID NO: 62393 - DNA, 339 bp, Bordetella bronchiseptica RB50
  CDS (1)..(339): transl_table=11
gtgaaacaagtaaccgccatcatcaaacccttcaagctggacgaagtccgcgaagcgctggccgaggtcggcgtcagcggcctgaccgtcaccgaggtcaaggggttcggccgccagaagggccataccgagctgtatcgcggcgccgagtatgtggtggatttcctgcccaagatccgcgtcgaggtcgtgctggccgacgacatggtcgatccggccatcgaggccatcgtcaaggccgcgcgcaccggcaagatcggcgacggcaagatcttcgtgaccccggtcgaacaggccatccgcatccgcaccggcgagagcgacgaagaggcgctgtag

SEQ ID NO: 62394 - protein, 112 aa, Bordetella bronchiseptica RB50
MKQVTAIIKPFKLDEVREALAEVGVSGLTVTEVKGFGRQKGHTELYRGAEYVVDFLPKIRVEVVLADDMVDPAIEAIVKAARTGKIGDGKIFVTPVEQAIRIRTGESDEEAL

SEQ ID NO: 62395 - DNA, 339 bp, Prochlorococcus marinus subsp. pastoris str. CCMP1986
  CDS (1)..(339): transl_table=11
atgaagaaaattgaggcaatcatacgtccatttaaactagaagatgtaaaaattgcattagtaaattctggaattgttggaatgactgtaagtgaagtcaggggatttggaagacaaaaaggtcaggtagaaaggtatagaggttcagaatttacagttgaatttcttcagaaacttaaagttgaagttgtagtagaaaatgaaaaagtaagttcagtaatagatgcaattgccgaagctgcaaaaacaggcgaaattggagatggaaaaatatttatatcatctattgattctgttgtaagaattagaactggagataccgatgaagaagctctttga

SEQ ID NO: 62396 - protein, 112 aa, Prochlorococcus marinus subsp. pastoris str. CCMP1986
MKKIEAIIRPFKLEDVKIALVNSGIVGMTVSEVRGFGRQKGQVERYRGSEFTVEFLQKLKVEVVVENEKVSSVIDAIAEAAKTGEIGDGKIFISSIDSVVRIRTGDTDEEAL

SEQ ID NO: 62397 - DNA, 339 bp, Synechococcus sp. WH 8102
  CDS (1)..(339): transl_table=11
atgaaaaaagttgaagccatcatccgcccgttcaagttagaagacgtcaaggtcgccctcgttgaagccggcatcatcggcatgactgtcagcgaggtccgcggttttggccgccagaagggtcaggtagagcgctatcgcggttcagaattcaccgttgagttcctgcaaaagctcaagatcgacgtggtcgttgacgacgaacgggtggatgacgttgtcaaagccattgcagatgcggctcgaaccggcgaaatcggtgacggcaagatcttcatcagctctgtagattccgtcgtacggattcggaccggcgaccgggacagctcagccctttga

SEQ ID NO: 62398 - protein, 112 aa, Synechococcus sp. WH 8102
MKKVEAIIRPFKLEDVKVALVEAGIIGMTVSEVRGFGRQKGQVERYRGSEFTVEFLQKLKIDVVVDDERVDDVVKAIADAARTGEIGDGKIFISSVDSVVRIRTGDRDSSAL

SEQ ID NO: 62399 - DNA, 339 bp, Chromobacterium violaceum ATCC 12472
  CDS (1)..(339): transl_table=11
atgaaaaaggtcgaagccatcatcaagccgttcaagctggacgaggtgcgcgaggccttgtcggagatcggcatcaacggcctcaccgtgtccgaggtcaagggcttcggccgccagaaaggccacaccgagctgtaccgcggcgccgagtacgtggtggatttcctgcccaaggtgaagatagaggtggtgctgccggacgacctggtcgagcgcgcgatcgaaaccatcgtcgagaccgcccgcaccggcaagatcggcgacggcaagatcttcgtggtgccggtggaacaggtggtgcgcatccgcaccggcgaaaccaacgagcaggcgatctga

SEQ ID NO: 62400 - protein, 112 aa, Chromobacterium violaceum ATCC 12472
MKKVEAIIKPFKLDEVREALSEIGINGLTVSEVKGFGRQKGHTELYRGAEYVVDFLPKVKIEVVLPDDLVERAIETIVETARTGKIGDGKIFVVPVEQVVRIRTGETNEQAI

SEQ ID NO: 62401 - DNA, 339 bp, Chromobacterium violaceum ATCC 12472
  CDS (1)..(339): transl_table=11
atgaaactcgttaccgcagtgatcaagccgttcaagcttgacgaagtccgcgaagcgctgtccgccatcggcgtacagggcatcaccgtctccgaggtcaagggcttcggccgccagaaaggccataccgagctgtatcgcggcgccgagtacgtcgtcgacttcctgcccaaggtgaagctggagatcgccatcgacgacgcgctgctggaccaggtggtggaggcgattgagaaatccgcccgcaccggcaagatcggcgacggcaagatatttgtctacgacctggagcaggtgatccgcatccgcaccggcgagaccggcgccgacgcggtctga

SEQ ID NO: 62402 - protein, 112 aa, Chromobacterium violaceum ATCC 12472
MKLVTAVIKPFKLDEVREALSAIGVQGITVSEVKGFGRQKGHTELYRGAEYVVDFLPKVKLEIAIDDALLDQVVEAIEKSARTGKIGDGKIFVYDLEQVIRIRTGETGADAV

SEQ ID NO: 62403 - DNA, 339 bp, Wolinella succinogenes DSM 1740
  CDS (1)..(339): transl_table=11
atgaaaaaaatcgaagccatcatcaagcctttcaagcttgatgatgtaaaaaacgcactcacagagctaggagtgacaggaatgaccgtcactgaagtcaaaggatatggccgccaacaaggccacacagagctctatcgaggggcagagtatgtggtggatttcatccctaagatcaaaatcgagattgtcgtaggggatggcgaggccgacaaaatcgtcgatacaattgtcgccaccgccaaaacaggcaaaatcggtgatggaaaaatcttcgtcacggatgtctctaaagtggttcgtgtccgaacaggcgaaactgacgaagaggcgatctaa

SEQ ID NO: 62404 - protein, 112 aa, Wolinella succinogenes DSM 1740
MKKIEAIIKPFKLDDVKNALTELGVTGMTVTEVKGYGRQQGHTELYRGAEYVVDFIPKIKIEIVVGDGEADKIVDTIVATAKTGKIGDGKIFVTDVSKVVRVRTGETDEEAI

SEQ ID NO: 62405 - DNA, 339 bp, Wolinella succinogenes DSM 1740
  CDS (1)..(339): transl_table=11
atgaagaaaatcgaagcagtcatcaaacccttcaaacttgaagaggtcaaaagcgctctagtggagcgaggaattagcgggatgacggtgagcgaagtgaaaggttatggtcgccaaaaagggcatacagagctctatagaggcgctgaatatgtggtggatttcatccccaagatcaagctggagatcgtcgtgagggatgaggaggtcgaaggaatcatcgaggcgattatcaagagcgccaaaacgggaaaaattggcgatggaaagatttttgtcacgcccgtagagcgcgcgattcgtatccgcacccaagagagcgatgaagaggcgatttga

SEQ ID NO: 62406 - protein, 112 aa, Wolinella succinogenes DSM 1740
MKKIEAVIKPFKLEEVKSALVERGISGMTVSEVKGYGRQKGHTELYRGAEYVVDFIPKIKLEIVVRDEEVEGIIEAIIKSAKTGKIGDGKIFVTPVERAIRIRTQESDEEAI

SEQ ID NO: 62407 - DNA, 339 bp, Gloeobacter violaceus PCC 7421
  CDS (1)..(339): transl_table=11
ttgaaaaagatagaagcaattatcaggcctttcaagctcgatgaggtcaagattgccctggtcaacgcgggcatcatcggcatgaccgtcagcgaagtgcgcggtttcggccgccagaaaggtcagaccgagcgctaccgaggctcggagtacacggtggaatttttgcagaaactcaaaatcgaagtggtggtcgacgatgggctggtcgatctggtgatggacaagattatggtggctgcccgcaccggcgagatcggcgacggcaaaatctttgtctcggatgtcgatcgggtggtgcgcattcgaaccggtgagcgcgacgacgaagcgctttga

SEQ ID NO: 62408 - protein, 112 aa, Gloeobacter violaceus PCC 7421
MKKIEAIIRPFKLDEVKIALVNAGIIGMTVSEVRGFGRQKGQTERYRGSEYTVEFLQKLKIEVVVDDGLVDLVMDKIMVAARTGEIGDGKIFVSDVDRVVRIRTGERDDEAL

SEQ ID NO: 62409 - DNA, 369 bp, Gloeobacter violaceus PCC 7421
  CDS (1)..(369): transl_table=11
atgaacaaaatcgaagcgatcatccaaccttccaggctcgacgccgtcgagcaggccctggcggccatcggtgtgcagggcatgaccgtcagccgggttgaaggcttcggccggcagcgcggccattcggtgatctttcggggattcgggagcgccgcgcagtttcttgccaagctcaaactcgaaatcgtcgtacctgacgaattcaccgagacggttgtcgagcgaatcgtacaggcggcacgcaccggcagcgtcggcgacggcaaaatctttgtgctgcctgtcacccaggcggtgcgggtgcgcaccggcgagtgcgacctggaggcggtccgcttcgagagtccggcagtcctgattcactga

SEQ ID NO: 62410 - protein, 122 aa, Gloeobacter violaceus PCC 7421
MNKIEAIIQPSRLDAVEQALAAIGVQGMTVSRVEGFGRQRGHSVIFRGFGSAAQFLAKLKLEIVVPDEFTETVVERIVQAARTGSVGDGKIFVLPVTQAVRVRTGECDLEAVRFESPAVLIH

SEQ ID NO: 62411 - DNA, 339 bp, Photorhabdus luminescens subsp. laumondii TTO1
  CDS (1)..(339): transl_table=11
atgaaaaagattgatgcgattatcaaacctttcaaattagatgatgtgcgtgaagctctggcggaagtgggtatcaccggaatgacagtaacagaggtgaaaggttttgggcgccaaaaaggtcatacagagctgtatcgcggtgcagaatatatggtggattttctgccaaaagtgaaaatagaaattgtcgtgccagatgatattgtcgatacctgtgttgaaaccattatgcagacggcacagaccgggaaaatcggtgatggtaaaatatttgtatttgatgtagcacgtgttgtgcgtatccgcaccggtgagcaggatgaagaggcgatttaa

SEQ ID NO: 62412 - protein, 112 aa, Photorhabdus luminescens subsp. laumondii TTO1
MKKIDAIIKPFKLDDVREALAEVGITGMTVTEVKGFGRQKGHTELYRGAEYMVDFLPKVKIEIVVPDDIVDTCVETIMQTAQTGKIGDGKIFVFDVARVVRIRTGEQDEEAI

SEQ ID NO: 62413 - DNA, 339 bp, Photorhabdus luminescens subsp. laumondii TTO1
  CDS (1)..(339): transl_table=11
atgaagctcattacgacaattataaaaccattcaaattggaggatattcgggaagttctttctggtcttggtgttcaggggttgaccataacagaggtaaaaggatttgggcgtcagagaggacatgcggagctgtatcgtggagctgaatatagtgtcaattttttacctaaaataaagatagatattgctgtagcagatgaattggttgaggaggtcattcatgctattcagcaatcagcttttactggaaaagttggcgacggtaaaatctttgtcattgaattacaacaggctattcgtattagaacaggagaaactaacgatgcggcactgtaa

SEQ ID NO: 62414 - protein, 112 aa, Photorhabdus luminescens subsp. laumondii TTO1
MKLITTIIKPFKLEDIREVLSGLGVQGLTITEVKGFGRQRGHAELYRGAEYSVNFLPKIKIDIAVADELVEEVIHAIQQSAFTGKVGDGKIFVIELQQAIRIRTGETNDAAL

SEQ ID NO: 62415 - DNA, 339 bp, Corynebacterium diphtheriae NCTC 13129
  CDS (1)..(339): transl_table=11
atgaagctggtgacggctatcgtcaaacctttcaccttgacggatattaaagattccctagagcaagtgggcgttcatggcatgacagtcaccgaatctcaaggttttggccagcaaaaaggtcacactgaggtttaccgtggtgcagagtatgcagttgatttcgtaccaaagatcaaaattgaaatagtgatcaatgatgacttgctagacgacgttgttaaagcaatcgttgattccgcacacaccggaaagattggcgacggaaaagtgtgggttactacggtcgatgacttgatccgtgtgcgcaccggcgagcgcggcgacagcgcggtctag

SEQ ID NO: 62416 - protein, 112 aa, Corynebacterium diphtheriae NCTC 13129
MKLVTAIVKPFTLTDIKDSLEQVGVHGMTVTESQGFGQQKGHTEVYRGAEYAVDFVPKIKIEIVINDDLLDDVVKAIVDSAHTGKIGDGKVWVTTVDDLIRVRTGERGDSAV

SEQ ID NO: 62417 - DNA, 339 bp, Rhodopseudomonas palustris CGA009
  CDS (1)..(339): transl_table=11
atgaaactggtcgtcgccatcatcaaacctttcaagctggacgaggtccgccaggcgctgaccgagatcggcgttcacggcatgaccgtcaccgaggtcaagggctacggccgccagcgcggccataccgagatctatcgtggcgccgagtacatcgtgaatttcctgcccaagctgcggatcgagattgcggtcgattccgcgctcgccgacaaggcggtcgaagtgatcacccgcggcgcccgcaccggccagatcggtgacggcaagatcttcgtcacgccgatcgaccgcgccttgcggatccgcaccggcgagaccgacgtcgacgcgctgtaa

SEQ ID NO: 62418 - protein, 112 aa, Rhodopseudomonas palustris CGA009
MKLVVAIIKPFKLDEVRQALTEIGVHGMTVTEVKGYGRQRGHTEIYRGAEYIVNFLPKLRIEIAVDSALADKAVEVITRGARTGQIGDGKIFVTPIDRALRIRTGETDVDAL

SEQ ID NO: 62419 - DNA, 339 bp, Rhodopseudomonas palustris CGA009
  CDS (1)..(339): transl_table=11
atgaaaattgttatggcgatcattaagccattcaaactcgaagaagtccgtgacgccctgaccgccatcggcgttcacggtttgacggtgacggaagtgaagggatacggccgccagaaaggccacacggaaatctaccgcggcgctgaatacgcggtgagcttcctgcccaagatcaagatcgaggtcgcgatcgccaacgagcaggtcgagaagaccatcgaggcgatcaccagcgccgccaagaccggccagatcggcgacggcaagatcttcgtcatcggcctcgaccacgcggtgcgcatccgcaccggcgaggccgacgcggccgccctctga

SEQ ID NO: 62420 - protein, 112 aa, Rhodopseudomonas palustris CGA009
MKIVMAIIKPFKLEEVRDALTAIGVHGLTVTEVKGYGRQKGHTEIYRGAEYAVSFLPKIKIEVAIANEQVEKTIEAITSAAKTGQIGDGKIFVIGLDHAVRIRTGEADAAAL

SEQ ID NO: 62421 - DNA, 339 bp, Rhodopseudomonas palustris CGA009
  CDS (1)..(339): transl_table=11
gtgaagaagatcgaagccatcatcaagccgttcaagctcgacgaggtcaaagaagcgctgcaggaagtcggattgcaggggatcacggtcacggaagccaagggcttcggccggcagaagggccacgccgagttgtatcgcggcgctgaatacatcgtcgacttcctgcccaaggtgaaaatcgagatcgtgatcgccgacgacctggtcgagaaagcgatcgacgccatccggcgcgccgcccagaccggccgcatcggcgacggcaagattttcgtctccaacatcgaagaagccatccgcatcaggacgggcgaatccggactggacgccatctaa

SEQ ID NO: 62422 - protein, 112 aa, Rhodopseudomonas palustris CGA009
MKKIEAIIKPFKLDEVKEALQEVGLQGITVTEAKGFGRQKGHAELYRGAEYIVDFLPKVKIEIVIADDLVEKAIDAIRRAAQTGRIGDGKIFVSNIEEAIRIRTGESGLDAI

SEQ ID NO: 62423 - DNA, 339 bp, Geobacter sulfurreducens PCA
  CDS (1)..(339): transl_table=11
ttgaaaaaagtcgaagcgattatcaaaccgttcaagctggatgaagtgaaggaagcgctcaacgaaatcggcatccagggaatcacggttggggaagtcaaggggttcggtcgtcagaaggggcacacggagctctatcgcggcgctgaatatgtcgtggattttatccccaagatcaagatggagatcattgtcgccgacgatatcgtttccaaggtggtcgataccatcgagcaggccgccaagacggggcgcatcggcgacggtaaaattttcgtgactccggttgaagaggttatccgcatacggaccggcgagcgcggcgaagacgcactgtag

SEQ ID NO: 62424 - protein, 112 aa, Geobacter sulfurreducens PCA
MKKVEAIIKPFKLDEVKEALNEIGIQGITVGEVKGFGRQKGHTELYRGAEYVVDFIPKIKMEIIVADDIVSKVVDTIEQAAKTGRIGDGKIFVTPVEEVIRIRTGERGEDAL

SEQ ID NO: 62425 - DNA, 339 bp, Mycobacterium avium subsp. paratuberculosis str. k10
  CDS (1)..(339): transl_table=11
atgaagttgatcaccgcgatcgtaaagccgttcacgctcgatgacgtgaagaccagcctcgaggacgcgggcgtcctgggcatgacggtcagcgaaatccagggctacggacggcagaagggtcacaccgaggtctaccgcggtgccgagtactcggtcgacttcgtgcccaaggtgcgcatcgaggtcgtcgtcgacgactcgatcgtcgacaaggtggtggacagcatcgtccgggcggcgcgcaccggcaagatcggtgacggcaaagtgtgggtgagtccggtggaaaccatcgtgcgggtgcgcaccggcgagcgcggaaccgatgcgctgtga

SEQ ID NO: 62426 - protein, 112 aa, Mycobacterium avium subsp. paratuberculosis str. k10
MKLITAIVKPFTLDDVKTSLEDAGVLGMTVSEIQGYGRQKGHTEVYRGAEYSVDFVPKVRIEVVVDDSIVDKVVDSIVRAARTGKIGDGKVWVSPVETIVRVRTGERGTDAL

SEQ ID NO: 62427 - DNA, 339 bp, Bdellovibrio bacteriovorus HD100
  CDS (1)..(339): transl_table=11
atgaaaaaaattgaggcaatcataaaacccttcaagcttgatgatgtggtcgatgctctctcagaggtcggcgttgaagggatcactgtctcagaagttcgtggtttcggtcgacaaaaagggcgcactgaggtttacaaaggcgccgaatacgttgtcgactttctcccaaagataaaaattgaagtggttcttccgacagctctggtcgacagcgctgtcgaggccattcgcaaaacagctcacacaggcaagattggtgacggcaaaatcttcgtgcttcctgtggactcagcccttcgcatccgcaccggtgagaaggacgagcaggctctttag

SEQ ID NO: 62428 - protein, 112 aa, Bdellovibrio bacteriovorus HD100
MKKIEAIIKPFKLDDVVDALSEVGVEGITVSEVRGFGRQKGRTEVYKGAEYVVDFLPKIKIEVVLPTALVDSAVEAIRKTAHTGKIGDGKIFVLPVDSALRIRTGEKDEQAL

SEQ ID NO: 62429 - DNA, 339 bp, Methanococcus maripaludis S2
  CDS (1)..(339): transl_table=11
atgaaaaaaattgaagctataatcagaatagaaagattggatatcgtaaaaggcattctttctgagaatggctttttaagtttgacaatttctgaagtaaaaggaagaggagttcagggtggaataactgaacgatacagaggaacagaatacgtagttgaccttcttccgaaagttaaacttgaaatggtcgtcgatgataaggatattgacgaagtaatcacaataattcgtgaaaatgcagaaactggaaaacccggagatggaaaaatctttattattccagtagaagacgcagtaagaattagaacaggcgaatcaggcataaaagctatttaa

SEQ ID NO: 62430 - protein, 112 aa, Methanococcus maripaludis S2
MKKIEAIIRIERLDIVKGILSENGFLSLTISEVKGRGVQGGITERYRGTEYVVDLLPKVKLEMVVDDKDIDEVITIIRENAETGKPGDGKIFIIPVEDAVRIRTGESGIKAI

SEQ ID NO: 62431 - DNA, 339 bp, Methanococcus maripaludis S2
  CDS (1)..(339): transl_table=11
atgagaaaaatagaagcgatattcaggcctgaaagacttttagcagttaaaaatgctctttttgaagaaggatttattagtttaacgcttacagaagtaaaaggaagaggagttcagggcggaatcattgaaagataccgtggaaacgagtatttagtagatttacttcctaaagttaaaattgagattgtttctaatgacagcgatgttgaaaaaatagttaaacttatttctgaaaacgcagttactggaaaacctggagacggaaaaatcttcgtaattcctgttgaagatgtaattagaatcagaacaaatgaaacaggaaaagacgctatttaa

SEQ ID NO: 62432 - protein, 112 aa, Methanococcus maripaludis S2
MRKIEAIFRPERLLAVKNALFEEGFISLTLTEVKGRGVQGGIIERYRGNEYLVDLLPKVKIEIVSNDSDVEKIVKLISENAVTGKPGDGKIFVIPVEDVIRIRTNETGKDAI

SEQ ID NO: 62433 - DNA, 339 bp, Methanococcus maripaludis S2
  CDS (1)..(339): transl_table=11
atgaagaaactagaagcaataataagaatggaaagagtaggactcgttaaaaatgctctttacaaaagcgggcatgctagtttaacgttaacagaagtaaagggaagaggagttcagggcgggattgttgaaagatatcgcggaacagaacatgtggtagacctacttccaaaagtcaaaatagagctcgtagtcaatgaaaaagacgtagactctgtaataaaaataattgcagaaaatgcatatactggaaaaccgggagatggaaaaatcttcgtaattccggtcgaagacgtatgtcgtgtaagaactggtgaaatgggtccagatgctatataa

SEQ ID NO: 62434 - protein, 112 aa, Methanococcus maripaludis S2
MKKLEAIIRMERVGLVKNALYKSGHASLTLTEVKGRGVQGGIVERYRGTEHVVDLLPKVKIELVVNEKDVDSVIKIIAENAYTGKPGDGKIFVIPVEDVCRVRTGEMGPDAI

SEQ ID NO: 62435 - DNA, 351 bp, Thermus thermophilus HB27
  CDS (1)..(351): transl_table=11
atgaagctcatcgtggccatcgtccgtccggagaagctcaacgaggtgctggaggcccttttccaggcggaggtccgcgggctcaccctaagccgcgtccagggccacggcggcgagacggagcgggtggagacctaccggggcaccacggtgaagatggagctccacgagaaggtgcgcctggagatcggggtctcggagcccttcgtgaagcccacggtggaggccatcctgaaggcggcccgcaccggggaggtgggggacgggaagatcttcgtcctcccggtggagaaggtctaccggatccgcaccggagaggaggacgaggccgcggtgaccccggtacaataa

SEQ ID NO: 62436 - protein, 116 aa, Thermus thermophilus HB27
MKLIVAIVRPEKLNEVLEALFQAEVRGLTLSRVQGHGGETERVETYRGTTVKMELHEKVRLEIGVSEPFVKPTVEAILKAARTGEVGDGKIFVLPVEKVYRIRTGEEDEAAVTPVQ

SEQ ID NO: 62437 - DNA, 396 bp, Desulfovibrio vulgaris subsp. vulgaris str. Hildenborough
  CDS (1)..(396): transl_table=11
atgaaggaagtcatcgccatcatccgccccaacagaatcaacgccaccaagaaggcgatggtcgaggccgggctgcccgccttcaccggggcgcgctgcatgggccgcgggcgcaagccggtcgagttcgagttgctgaagcaccttgagggcagcggcgaagatacggcagacgtgctgcccgccctcgcacaggggggcaggctcatccagaagcgcatgctcaccatcgtcgtgccggacgaacgcgtcagtgccgtggtcgacgtgctcatgaaggccaaccgcaccgggcagccgggcgacggcaagatattcgtcaggcccgtcatcgacgtggcccgcatccgcaccggagagaccggggccaccgccatcgacgagatgaaaggctag

SEQ ID NO: 62438 - protein, 131 aa, Desulfovibrio vulgaris subsp. vulgaris str. Hildenborough
MKEVIAIIRPNRINATKKAMVEAGLPAFTGARCMGRGRKPVEFELLKHLEGSGEDTADVLPALAQGGRLIQKRMLTIVVPDERVSAVVDVLMKANRTGQPGDGKIFVRPVIDVARIRTGETGATAIDEMKG

SEQ ID NO: 62439 - DNA, 339 bp, Desulfovibrio vulgaris subsp. vulgaris str. Hildenborough
  CDS (1)..(339): transl_table=11
atgaagaagctcgagattatcatcaggccgttcaagctggacgaggtgaaggaagtccttgcatccatggatgtgaaggggatgaccgtgaccgaggtgaaaggcttcggacgtcagcgtggacacaaggaagtataccgcggggccgagtatcaggtcgatttcatgcccaaggtcaagatagaggtggtgctcgaagacgcccaggtcaaagctgtcgtggatgcggtctgcaaggccgcacgcacaggcaaggtgggggacggcaagatattcgtgctgcccgtcgacgacgccatacgcatacgcaccggcgagtccggcgccgaagccatctag

SEQ ID NO: 62440 - protein, 112 aa, Desulfovibrio vulgaris subsp. vulgaris str. Hildenborough
MKKLEIIIRPFKLDEVKEVLASMDVKGMTVTEVKGFGRQRGHKEVYRGAEYQVDFMPKVKIEVVLEDAQVKAVVDAVCKAARTGKVGDGKIFVLPVDDAIRIRTGESGAEAI

SEQ ID NO: 62441 - DNA, 339 bp, Bartonella quintana str. Toulouse
  CDS (1)..(339): transl_table=11
atgaaaaagattgaagccattataaaacctttcaaacttgatgaagtgaaagaagcacttcaaaaaattggattacatggtattacagtaacagaagcaaagggttttggtcgtcaaaaagggcatacagaactttatcgcggtgctaaatatgttgttgattttctacctaaagtaaaaattgaaattgttgttgccgatgaaaagctggatcaagctattgatgcaatacgtaacgcagctcaaacaaagcatattggagatggaaaaatatttgttttttccattgataatgccattcgtattggtactggcaaatcgggaatcgaagctctttaa

SEQ ID NO: 62442 - protein, 112 aa, Bartonella quintana str. Toulouse
MKKIEAIIKPFKLDEVKEALQKIGLHGITVTEAKGFGRQKGHTELYRGAKYVVDFLPKVKIEIVVADEKLDQAIDAIRNAAQTKHIGDGKIFVFSIDNAIRIGTGKSGIEAL

SEQ ID NO: 62443 - DNA, 339 bp, Bartonella henselae str. Houston-1
  CDS (1)..(339): transl_table=11
atgaaaaagattgaagccatcataaaacctttcaaacttgatgaagtgaaagaagcgcttcaaaaaattggattacatagtattacagtaacagaagcaaaggggtttggttgtcaaaaagggcatacagaactttatcgtggtgctaaatatgttattgattttctacctaaagtaaaaattgaaattgttattgccgatgaaaaactagaacaagccattgacacaatacgtaaagcagcgcaaacaaagcatattggagatggaaaaatatttgtttcttccattgatcatgccattcgtatcggcacaggtaaatccggaatcgatgcgctttaa

SEQ ID NO: 62444 - protein, 112 aa, Bartonella henselae str. Houston-1
MKKIEAIIKPFKLDEVKEALQKIGLHSITVTEAKGFGCQKGHTELYRGAKYVIDFLPKVKIEIVIADEKLEQAIDTIRKAAQTKHIGDGKIFVSSIDHAIRIGTGKSGIDAL

SEQ ID NO: 62445 - DNA, 339 bp, Acinetobacter sp. ADP1
  CDS (1)..(339): transl_table=11
atgaagctcgtaactgcaattgtaaaaccattcaaactggatgatgtgcgtgaagccctttcagagatcggtgttcaggggattactgtcactgaagtaaaaggttttggacgtcaaaaaggccatactgaactctaccgtggtgctgaatatgtagttgattttctaccaaaagtaaaaattgaaattgcaatcagcgatgagatggtcgatgcggtgattgaatctattacacgtgttgcaagcacaggcaaaatcggtgatggaaaaatctttgtaacgaaccttgaacaagtgatccgtattcgtactggtgaaactggtgcagatgctgtttaa

SEQ ID NO: 62446 - protein, 112 aa, Acinetobacter sp. ADP1
MKLVTAIVKPFKLDDVREALSEIGVQGITVTEVKGFGRQKGHTELYRGAEYVVDFLPKVKIEIAISDEMVDAVIESITRVASTGKIGDGKIFVTNLEQVIRIRTGETGADAV

SEQ ID NO: 62447 - DNA, 339 bp, Erwinia carotovora subsp. atroseptica SCRI1043
  CDS (1)..(339)
atgaagaaaattgatgcgattattaagccgttcaaactggacgatgtgcgtgaagcgttagctgaagtgggcatcacagggatgacggtaacggaagtgaaaggctttggtcgtcagaaaggccacacagagctgtatcgtggcgcagaatacatggtcgattttctgccgaaagtaaaaatcgaaattgttgtatcagatgatatcgtcgatacctgtgttgaaaccatcacgcagaccgcgcagacgggtaaaatcggcgacggcaaaatctttgtctttgatgtggcacgcgttgtccgtattcgtaccggtgaagaggacgaggaagcgatttaa

SEQ ID NO: 62448 - protein, 112 aa, Erwinia carotovora subsp. atroseptica SCRI1043
MKKIDAIIKPFKLDDVREALAEVGITGMTVTEVKGFGRQKGHTELYRGAEYMVDFLPKVKIEIVVSDDIVDTCVETITQTAQTGKIGDGKIFVFDVARVVRIRTGEEDEEAI

SEQ ID NO: 62449 - DNA, 345 bp, Desulfotalea psychrophila LSv54
  CDS (1)..(345): transl_table=11
gtgttgatgaaaaagatagaggcaataataaaaccattcaaacttgatgacgtgaaatctgccctgtctgaggttggcattacggggatgactatttctgaggtgaggggctatggtcgccagaagggacactcggaaatgtatcgtggggcagagtatgtcgtggagttcgtgcctaagataaagctggaaattgtggtttcagccgatagggctaccgaggttgtggcaaaaattcgtgagcatgcctacacgggaaaaattggtgatggtaaaatttttgtttcacccattgagtatgcagtgcgagtacgtaccggtgaagaaaataaggaagctgtgtaa

SEQ ID NO: 62450 - protein, 114 aa, Desulfotalea psychrophila LSv54
MLMKKIEAIIKPFKLDDVKSALSEVGITGMTISEVRGYGRQKGHSEMYRGAEYVVEFVPKIKLEIVVSADRATEVVAKIREHAYTGKIGDGKIFVSPIEYAVRVRTGEENKEAV

SEQ ID NO: 62451 - DNA, 339 bp, Mannheimia succiniciproducens MBEL55E
  CDS (1)..(339): transl_table=11
atgaaaaaaattgaagcaataattaaaccttttaaattggatgatgtgcgagaatccttatcggatatcggtattaccgggatgacggttaccgaagtgcgcggtttcgggcgccaaaaagggcacacggagctttatcgcggcgccgaatatatggtggattttttgcctaaagtaaagcttgaaatcattattcccgacgaattattggatcaatgtattgaagccattatggaaacggcgcaaactggcaaaatcggcgatggtaaaatttttgtttataatgtggaacgtgtcattcgtattcgtaccggcgaagaaaacgaagacgctctttaa

SEQ ID NO: 62452 - protein, 112 aa, Mannheimia succiniciproducens MBEL55E
MKKIEAIIKPFKLDDVRESLSDIGITGMTVTEVRGFGRQKGHTELYRGAEYMVDFLPKVKLEIIIPDELLDQCIEAIMETAQTGKIGDGKIFVYNVERVIRIRTGEENEDAL

SEQ ID NO: 62453 - DNA, 351 bp, Bacillus licheniformis ATCC 14580
  CDS (1)..(351): transl_table=11
atgagcggtcaaatgtataaagtggaaattgtaacccgtcctacaaactttgaaaagctgaaaacggagctggccaaaatcggggtaacgtccattacgttttacaatgtacacggatgcggcctgcaaaaagggcatactgagctttaccgcggggtcaaacgcgaaagcaatgtgtatgaaaggttaaaagtcgaaatcgtcgtcagcaaagtgcctgtcgaaaaggtggccgagacggcgcaaaacgtcctgaaaaccggggaacccggtgacggcaagatcttcatatacgaaattaaaaacaccatcaacatccgcacaggcgaggaaggtcctgacgctttataa

SEQ ID NO: 62454 - protein, 116 aa, Bacillus licheniformis ATCC 14580
MSGQMYKVEIVTRPTNFEKLKTELAKIGVTSITFYNVHGCGLQKGHTELYRGVKRESNVYERLKVEIVVSKVPVEKVAETAQNVLKTGEPGDGKIFIYEIKNTINIRTGEEGPDAL

SEQ ID NO: 62455 - DNA, 339 bp, Burkholderia mallei ATCC 23344
  CDS (1)..(339): transl_table=11
atgaaacgcatcaccgccatcatcaagccgttcaagctggacgaagtgcgcgaagcgctcgccgaagtcggcctgaccgggctcaccgtgacggaagtgaagggcttcggccgccagaaggggcacacggagctctatcgcggcgccgagtacgtggtcgatttcctgccgaagatgaagatcgaagtggtggtggcgaacaatctcgtcgatcaggtgatcgacgcggtgatcggcgccgcgcgcaccggcaagatcggcgacggcaagatcttcgtgtcggatgtcgagcgcgtgatccggatccgcacgggcgaggaaaacgaagcggccgtctga

SEQ ID NO: 62456 - protein, 112 aa, Burkholderia mallei ATCC 23344
MKRITAIIKPFKLDEVREALAEVGLTGLTVTEVKGFGRQKGHTELYRGAEYVVDFLPKMKIEVVVANNLVDQVIDAVIGAARTGKIGDGKIFVSDVERVIRIRTGEENEAAV

SEQ ID NO: 62457 - DNA, 339 bp, Burkholderia mallei ATCC 23344
  CDS (1)..(339): transl_table=11
atgaaactgattaccgcaatcatcaagccgttcaagctcgatgagacgcgcgaggcgctctcggcgctcggcgtctcgggcatcacggtgacggaggtcaaggggttcggccgccagaaggggcacaccgagctgtatcgcggtgccgaatacgtcgtcgatttccttcctaagatgaagatcgaggccgcggtgtcggacgatctcgtcgaccaggccgtcgaggcgatcgagcgcgcggcacgcacgggcaagatcggcgacggcaagatcttcgtcacgtcgatcgagcaggtgattcggattcgtaccggggagacgggcgctgacgccctgtaa

SEQ ID NO: 62458 - protein, 112 aa, Burkholderia mallei ATCC 23344
MKLITAIIKPFKLDETREALSALGVSGITVTEVKGFGRQKGHTELYRGAEYVVDFLPKMKIEAAVSDDLVDQAVEAIERAARTGKIGDGKIFVTSIEQVIRIRTGETGADAL

SEQ ID NO: 62459 - DNA, 339 bp, Methylococcus capsulatus str. Bath
  CDS (1)..(339): transl_table=11
atgaaactcatcactgcaatcatcaaacccttcaagctcgacgacgtgcgcgaagcgctttccgatatcggcgtgagtggactgacggtcaccgaagtcaaggggttcggccggcaaaaaggccacaccgaactttaccgcggggccgaatacgtcgtggatttcctcccgaaggtgaaactggaaatcgcagtggccgacacgctggtcgatgcggcagtcgatgccatcgtcaaggcagccaacacgggaaagatcggcgatggcaaaatcttcatcacttccatcgaccaggcgatccgcatccgcaccggcgagacgggcgaccaggcgctgtaa

SEQ ID NO: 62460 - protein, 112 aa, Methylococcus capsulatus str. Bath
MKLITAIIKPFKLDDVREALSDIGVSGLTVTEVKGFGRQKGHTELYRGAEYVVDFLPKVKLEIAVADTLVDAAVDAIVKAANTGKIGDGKIFITSIDQAIRIRTGETGDQAL

SEQ ID NO: 62461 - DNA, 339 bp, Nocardia farcinica IFM 10152
  CDS (1)..(339): transl_table=11
atgaaactgatcaccgcaatcgtcaaaccgttcacgctcgaggacgtcaagaccggtctggaacaggcgggcgtgttcggcatgaccgtcagcgaggtgcagggctacggcaggcagaagggccacaccgaggtctaccgcggcgccgagtactcggtggacttcgtgccaaaggtccgggtcgaggtcgtcgtcgacgatgcctccgtcgacaaggtcgtggacgtgatcgtcgaggcgtcgcgcaccggcaagatcggcgacggcaaggtatgggtcacccccgtcgagtcgatcatccgcgtgcgcaccggcgagcgcggcaccgacgcgctgtag

SEQ ID NO: 62462 - protein, 112 aa, Nocardia farcinica IFM 10152
MKLITAIVKPFTLEDVKTGLEQAGVFGMTVSEVQGYGRQKGHTEVYRGAEYSVDFVPKVRVEVVVDDASVDKVVDVIVEASRTGKIGDGKVWVTPVESIIRVRTGERGTDAL

SEQ ID NO: 62463 - DNA, 339 bp, Legionella pneumophila str. Lens
  CDS (1)..(339): transl_table=11
atgaaaatgatcacggcgattatcaaaccatttaaactggatgatgtacatgaagctttaatggaaataggggtgccaggaattaccatatctgaaactcgaggatttgggcgtcaaaaaggccataccgaattatatcgaggtgcggagtacgtggtagatttcctccctaaaattaaaattgaactggcattgccagataatatggttgaagcagccatagaagctatttgcaagtccgcctacactggtaaaattggtgatggcaagatttttgtttatgctttggaacaggtagtgagggttagaaccggggaagtcggtacagacgctctatag

SEQ ID NO: 62464 - protein, 112 aa, Legionella pneumophila str. Lens
MKMITAIIKPFKLDDVHEALMEIGVPGITISETRGFGRQKGHTELYRGAEYVVDFLPKIKIELALPDNMVEAAIEAICKSAYTGKIGDGKIFVYALEQVVRVRTGEVGTDAL

SEQ ID NO: 62465 - DNA, 339 bp, Photobacterium profundum SS9
  CDS (1)..(339): transl_table=11
atgaaaaagattgaagccgttattaagccttttaagcttgatgatgttcgcgaagcattagctgaagtgggtatcacaggcatgactgtttctgaagttaaaggatttggacgtcagaaaggtcataccgaattgtaccgtggtgcagaatacatggtcgattttctgccaaaagtgaaattagaaattgttgtaaccgatgaagtagcagagcaatgtattgaaacgattatcgaaaccgcgcaaacgggtaaaatcggtgatggtaaaatcttcatgttcgatgtcgagcgtgttgttcgaatcagaacgggcgaagaagacgaagatgcaatttaa

SEQ ID NO: 62466 - protein, 112 aa, Photobacterium profundum SS9
MKKIEAVIKPFKLDDVREALAEVGITGMTVSEVKGFGRQKGHTELYRGAEYMVDFLPKVKLEIVVTDEVAEQCIETIIETAQTGKIGDGKIFMFDVERVVRIRTGEEDEDAI

SEQ ID NO: 62467 - DNA, 339 bp, Photobacterium profundum SS9
  CDS (1)..(339): transl_table=11
atgaaattgattagtgcaattattaaacctttcaaacttgatgatgtgcgtgaagcattagccgatgttggcgttgaaggtatgacggtttctgaggtcaaaggatttggccgtcaaaaagggcataccgaactataccgcggcgctgaataccaagttgattttttgccgaaggttaaaatcgaaatcgcaacacaggctgataactttgaagcgattgttgatgccatttctaaggctgcgcaaactggcaaaattggtgatggcaaaatcttcgtttacgacctcgaccatgcggtacgtatccgtacaggcgagacagatctcgaagcgctgtaa

SEQ ID NO: 62468 - protein, 112 aa, Photobacterium profundum SS9
MKLISAIIKPFKLDDVREALADVGVEGMTVSEVKGFGRQKGHTELYRGAEYQVDFLPKVKIEIATQADNFEAIVDAISKAAQTGKIGDGKIFVYDLDHAVRIRTGETDLEAL

SEQ ID NO: 62469 - DNA, 366 bp, Haloarcula marismortui ATCC 43049
  CDS (1)..(366): transl_table=11
atgactgacgaaaccgacgactctgaaatcaagatggtggtcgcaatggttcgaccggacaagctcggcgacgtgaagaaggcgctggcggaagtcggcgcgccgtcgctgacagtgacgaacgtctccggccgcggctcacagcccgcaaagaaggggcagtggcgcggcgaggagtacgtcgtcgacctgcaccagaaagtcaaagtcgagacagtggtcgcagacatccccgcagaggatgtcgtcgacgctatcgccgacggtgcccacaccggcgagaaaggtgacggcaagatattcgtccttcccgtggacaacgcctatcaggtccgaaccggtaaagaaggtccagaggcagtctga

SEQ ID NO: 62470 - protein, 121 aa, Haloarcula marismortui ATCC 43049
MTDETDDSEIKMVVAMVRPDKLGDVKKALAEVGAPSLTVTNVSGRGSQPAKKGQWRGEEYVVDLHQKVKVETVVADIPAEDVVDAIADGAHTGEKGDGKIFVLPVDNAYQVRTGKEGPEAV

SEQ ID NO: 62471 - DNA, 339 bp, Idiomarina loihiensis L2TR
  CDS (1)..(339): transl_table=11
atgaaaaaagttgaagccattattaagccgtttaagttggacgacgtgcgcgaagcgctgtctgaagtcggcattgccggtatgactgtgtcagaggtaaaaggctttggtcgtcagaaaggccataccgaactttatcgtggcgcggagtacatggtcgattttctaccaaaagtaaaactggaagttgtggttgcggatagtgaagttgagcgttgtattgaagccattatggaaaccgctcaaaccggaaaaattggtgatgggaaaatttttatcactgagattgaacgtgttattcgtattcgtaccggagaggaaaacgaagacgcggtataa

SEQ ID NO: 62472 - protein, 112 aa, Idiomarina loihiensis L2TR
MKKVEAIIKPFKLDDVREALSEVGIAGMTVSEVKGFGRQKGHTELYRGAEYMVDFLPKVKLEVVVADSEVERCIEAIMETAQTGKIGDGKIFITEIERVIRIRTGEENEDAV

SEQ ID NO: 62473 - DNA, 339 bp, Idiomarina loihiensis L2TR
  CDS (1)..(339): transl_table=11
atgaaaatgctcgttgcgttaatcaaacccttcaagctggaggatgtgaagcaagcgctgtttgaaattggctgcaaaggcctgacagtaaccgaagtccggggagtaggacgtcaaaaggggcataccgaactgtaccggggcgccgaatatcaagtcgacttcctgcccaaaatgaaaattgaactggcggttcccgacgaaaccgtcgaacgagctctggaagtagtcattgccgcggctcataccggcaatatcggcgacggaaaaatattcgttatgccgctggagcaatgcgttcgcatacgcactggcgaaaccgaccaagacgccctttaa

SEQ ID NO: 62474 - protein, 112 aa, Idiomarina loihiensis L2TR
MKMLVALIKPFKLEDVKQALFEIGCKGLTVTEVRGVGRQKGHTELYRGAEYQVDFLPKMKIELAVPDETVERALEVVIAAAHTGNIGDGKIFVMPLEQCVRIRTGETDQDAL

SEQ ID NO: 62475 - DNA, 339 bp, Azoarcus sp. EbN1
  CDS (1)..(339): transl_table=11
atgaaattcgtcactgccatcatcaagccgttcaagctcgacgaagtgcgtgaagcgctctcggcgatcggcgtgcagggtatcaccgtcaccgaagtcaagggtttcggccgccagaaaggccacaccgagctgtatcgcggcgcggagtacgtcgtcgattttctgcctaaagtgaagatcgaggccgcgatccgccccgatctgctcgatcaggcgatcgaggcgatcgaaaaatcggccgcgaccggcaagatcggggacggcaagatcttcgttttcgatctcgaacaggccatccgcatccgcaccggcgaaaccggtcccgacgcgctgtaa

SEQ ID NO: 62476 - protein, 112 aa, Azoarcus sp. EbN1
MKFVTAIIKPFKLDEVREALSAIGVQGITVTEVKGFGRQKGHTELYRGAEYVVDFLPKVKIEAAIRPDLLDQAIEAIEKSAATGKIGDGKIFVFDLEQAIRIRTGETGPDAL

SEQ ID NO: 62477 - DNA, 339 bp, Azoarcus sp. EbN1
  CDS (1)..(339): transl_table=11
atgaagaaaatcgaagccgtcatcaagccgttcaagctcgacgaggtccgtgaagcgctgtccgaagtcggcatcgctggtctgaccgtgtcggaggtcaagggcttcggccgccagaaaggccacaccgagttgtatcgcggcgccgagtacgtcgttgatttcctgccgaaaatcaaggtcgaaatcgtcctcggcgacgacctcgtggaccaggcggtcgaagcgatcatcaaggctgcgcgcaccggcaagatcggcgacggcaagatcttcgtcacggctgtcgagcaggtcgtgcgcatccgcaccggcgaaacggacgaagccgcaatctga

SEQ ID NO: 62478 - protein, 112 aa, Azoarcus sp. EbN1
MKKIEAVIKPFKLDEVREALSEVGIAGLTVSEVKGFGRQKGHTELYRGAEYVVDFLPKIKVEIVLGDDLVDQAVEAIIKAARTGKIGDGKIFVTAVEQVVRIRTGETDEAAI

SEQ ID NO: 62479 - DNA, 363 bp, Zymomonas mobilis subsp. mobilis ZM4
  CDS (1)..(363): transl_table=11
atgcgcgggatagaggaagcgcttgtgaaaaaaattgaagtcgtcatcaagccttttaaactggaagacgttaaggccgctctgacggatgccggtatatccggtattaccgttacagagacacgtggatacggccgtcagaaagggcataccgagttatatcggggcgctgaatatgtcgtcgactttctgcccaaggtaaaactggaaacagtggtgccggacgaattggtagaaaatgtggtcgaggctgtcacagtggctgccagaacaggccgtatcggggacggaaagatttttataagcgatgtgttggacgctatccgtattcgtaccggagagagaggtatcgaagcgatttaa

SEQ ID NO: 62480 - protein, 120 aa, Zymomonas mobilis subsp. mobilis ZM4
MRGIEEALVKKIEVVIKPFKLEDVKAALTDAGISGITVTETRGYGRQKGHTELYRGAEYVVDFLPKVKLETVVPDELVENVVEAVTVAARTGRIGDGKIFISDVLDAIRIRTGERGIEAI

SEQ ID NO: 62481 - DNA, 339 bp, Dehalococcoides ethenogenes 195
  CDS (1)..(339): transl_table=11
atgaaaaagatagaagccattatccgcgaagaaagattggaaccggttagaaaagcattggaactggcaggttttgccgggttgactgtcaccgaagtcagcggacgcggaaagcaaaagggtgttccgcttcagtggagagtaggtgaataccgggtagagtttctgccgaagctgaaactggagatgatttgccacgatgatgattgccaggttgcagttgatgccatcgtcaaggctgcccggacaggacgtatcggagatggtaaaatattcataatgccagttgagcaggtggtgcggattcgtacaggtgaaacaggcagcgaggctgtctaa

SEQ ID NO: 62482 - protein, 112 aa, Dehalococcoides ethenogenes 195
MKKIEAIIREERLEPVRKALELAGFAGLTVTEVSGRGKQKGVPLQWRVGEYRVEFLPKLKLEMICHDDDCQVAVDAIVKAARTGRIGDGKIFIMPVEQVVRIRTGETGSEAV

SEQ ID NO: 62483 - DNA, 393 bp, Dehalococcoides ethenogenes 195
  CDS (1)..(393): transl_table=11
atgaaagaggttatggctattatcaggtttaacaagataaatattactaagcgcgccctggtggatgctggctttgcttccattacgatgctgaagaccatgggccggggtaaaggtaatgtggattatctgctgctggcgggagccgaaggcggccatgaagaagccatttcccagcttgggccgtctctcaagctggtacccaagcggctgattaccctggtggtgccggatgatcaggtgaaaacagtggttaatacagttatagaagtaaaccggacagaaaatcacggtgacggcaaaatctttgtcatgccggtactggaagcggtacggttacgtacaggtgaacggggcgaggacgccatagactctgtggtcaatgtcttgtaa

SEQ ID NO: 62484 - protein, 130 aa, Dehalococcoides ethenogenes 195
MKEVMAIIRFNKINITKRALVDAGFASITMLKTMGRGKGNVDYLLLAGAEGGHEEAISQLGPSLKLVPKRLITLVVPDDQVKTVVNTVIEVNRTENHGDGKIFVMPVLEAVRLRTGERGEDAIDSVVNVL

SEQ ID NO: 62485 - DNA, 339 bp, Magnetospirillum magnetotacticum MS-1
  CDS (1)..(339)
atgaagaagatcgaggcgatcatcaagccgttcaagctcgacgaggtgaaggaggcgctccaggaggtcggcctccagggcatcaccgtgatcgaggcgaagggcttcggccggcagaagggccataccgagctgtaccgcggcgccgagtacgtcgtggactttcttcccaaggtgaagctggagatcgtgctctccgacgccttggtcgagggcgccgtcgaggcgatccgcaaatcggcccagacgggccggatcggcgacggcaagatcttcgtctcgacgatcgaggaagcgatccgcatccgcaccggcgagaccggctccgacgcgatctga

SEQ ID NO: 62486 - protein, 112 aa, Magnetospirillum magnetotacticum MS-1
MKKIEAIIKPFKLDEVKEALQEVGLQGITVIEAKGFGRQKGHTELYRGAEYVVDFLPKVKLEIVLSDALVEGAVEAIRKSAQTGRIGDGKIFVSTIEEAIRIRTGETGSDAI

SEQ ID NO: 62487 - DNA, 339 bp, Magnetospirillum magnetotacticum MS-1
  CDS (1)..(339)
atgaagctgatcatggccatcatcaagcccttcaagctcgacgaggttcgcgaggccctgacgccgttgggcgtccaaggcctgaccgtgagcgaagtcaagggcttcggccgccagaagggacaaaccgaaatctatcgcggcgccgaatacgtggtgaacttcctgcccaaggtgaagatcgaggtcgccgtcaacgacgatctggtcgaccgcgtggtggaagccatccagaccgctgcccgcaccggcaagatcggtgacggcaaggtgttcgtcaccgagatccagcaggcctaccgcatccgcaccggcgaaagcaacgcggaagcgctctga

SEQ ID NO: 62488 - protein, 112 aa, Magnetospirillum magnetotacticum MS-1
MKLIMAIIKPFKLDEVREALTPLGVQGLTVSEVKGFGRQKGQTEIYRGAEYVVNFLPKVKIEVAVNDDLVDRVVEAIQTAARTGKIGDGKVFVTEIQQAYRIRTGESNAEAL

SEQ ID NO: 62489 - DNA, 339 bp, Magnetospirillum magnetotacticum MS-1
  CDS (1)..(339)
atgaagaagatcgaagccatcatcaagcccttcaagctggacgaggtgaaggaagcccttcacgaagttggtctgcagggccttaccgttaccgaagcgaagggtttcggccggcagaaggggcataccgagctctatcgcggcgccgagtatgtggtggacttcctgcccaaggtgaaaatcgaactggtcatcgaggataatctggtggagcgtgccgtcgaggccatccagcaggccgcccatacggggcgcatcggcgacggcaagattttcatctccacggtggaagaagccatccgcatccgtaccggcgagcgcggcagcgacgccatctga

SEQ ID NO: 62490 - protein, 112 aa, Magnetospirillum magnetotacticum MS-1
MKKIEAIIKPFKLDEVKEALHEVGLQGLTVTEAKGFGRQKGHTELYRGAEYVVDFLPKVKIELVIEDNLVERAVEAIQQAAHTGRIGDGKIFISTVEEAIRIRTGERGSDAI

SEQ ID NO: 62491 - DNA, 339 bp, Desulfitobacterium hafniense DCB-2
  CDS (1)..(339)
atgaaaaagattgaagcgattatccgaccgagcaaactggatgaagtacaaagtgctctggatcgttttggggtaagcgggctgactgtgactcatgtcattggctgcggtaagcaaaagggccatacccaggtttacagaggggtagagtataaagtttttcttctccccaaagtaaagattgaagttgtagttaacgatcaggcggtggatgaagtggtcagaatcatttccgatgaggcccgcagcggcgaagtgggagatgggaaaatctttatttaccccgttgaaggagctatccgtatccgcaccggtgagataggagaaactgttttataa

SEQ ID NO: 62492 - protein, 112 aa, Desulfitobacterium hafniense DCB-2
MKKIEAIIRPSKLDEVQSALDRFGVSGLTVTHVIGCGKQKGHTQVYRGVEYKVFLLPKVKIEVVVNDQAVDEVVRIISDEARSGEVGDGKIFIYPVEGAIRIRTGEIGETVL

SEQ ID NO: 62493 - DNA, 312 bp, Desulfitobacterium hafniense DCB-2
  CDS (1)..(312)
atgatacgctcgattatccgaccggaaaaggctgaagttgtcgccgaagctttggcagacgcaggcctgacatctttaaccaaaatgcatgtttttggacggggccgtaccaaaggcatccgcatcggtgatgtggtttatgatgaattcccgaaaaccttgcttctgatggttgtgccaaatgagaacttagaaaaagccatccagatcatcctggaaaagtccaagaccgggaccatgggggatgggaaaatctttattaccgaagtggaagaggcttataccataagctcaggaaccaaaggcttataa

SEQ ID NO: 62494 - protein, 103 aa, Desulfitobacterium hafniense DCB-2
MIRSIIRPEKAEVVAEALADAGLTSLTKMHVFGRGRTKGIRIGDVVYDEFPKTLLLMVVPNENLEKAIQIILEKSKTGTMGDGKIFITEVEEAYTISSGTKGL

SEQ ID NO: 62495 - DNA, 342 bp, Haemophilus somnus 129PT
  CDS (1)..(342)
atgatgaaaaaaattgaagcaattattaaaccttttaaattagatgatgtacgtgaaagtttagctgatatcggtattaccggaatgacggtaacggaagtgcgtggttttggtcgtcagaagggacatacagagttataccgtggtgccgaatacatggtagactttttaccaaaagtcaaaatggagattattgtgcctgatgaaattgtcgaacaatgtattgaggcaatcattgaaaccgcacaaaccggtaaaattggtgacggcaaaatttttgtgtatgatgtaaatcgtgtcattcgtattcgtacgagagaggaaaatgaggaagcactttga

SEQ ID NO: 62496 - protein, 113 aa, Haemophilus somnus 129PT
MMKKIEAIIKPFKLDDVRESLADIGITGMTVTEVRGFGRQKGHTELYRGAEYMVDFLPKVKMEIIVPDEIVEQCIEAIIETAQTGKIGDGKIFVYDVNRVIRIRTREENEEAL

SEQ ID NO: 62497 - DNA, 327 bp, Desulfovibrio desulfuricans G20
  CDS (1)..(327)
atgaaattgcttatcgcctatatacgccctgaaaagctctcgacggtgaaaaaggctctttatgccagaggcatatacgccatgtccgtgaccaacgcattgggcagcggacagcagaaaggctttaccgaaacctatcgcggcattgtgacggaagtgaatctgctgaaaaaggtccgcatagaggtgggggtacccgcggacaaagcggaagacgctctggcggcgctgcagacaggtgcccacaccggacgtgagggagacggcataatctttgtgcaggacgtggccagaacagtacgggtacggaccggcgaagccccctga

SEQ ID NO: 62498 - protein, 108 aa, Desulfovibrio desulfuricans G20
MKLLIAYIRPEKLSTVKKALYARGIYAMSVTNALGSGQQKGFTETYRGIVTEVNLLKKVRIEVGVPADKAEDALAALQTGAHTGREGDGIIFVQDVARTVRVRTGEAP

SEQ ID NO: 62499 - DNA, 339 bp, Actinobacillus pleuropneumoniae serovar 1 str. 4074
  CDS (1)..(339)
atgaaaaaaatcgaagcgattattaagccgttcaaactggatgatgtgcgtgaagcattaaccgacgccggcattaccggtatgaccgtcaccgaagcgaaaggattcggtcgtcaaaaaggtcataccgagctttatcgcggtgcggaatatgcgattgattttttaccgaaaattaaactggaaatcgtagtagcggatgaccaagtggacgcctgtatcgaagcaattatcgataccgcacagaccggtaaaatcggcgacggcaaaatctttatctatgatgtcgaacgagtgattcgtatccgtaccggcgaagaaaacgaagacgcactttaa

SEQ ID NO: 62500 - protein, 112 aa, Actinobacillus pleuropneumoniae serovar 1 str. 4074
MKKIEAIIKPFKLDDVREALTDAGITGMTVTEAKGFGRQKGHTELYRGAEYAIDFLPKIKLEIVVADDQVDACIEAIIDTAQTGKIGDGKIFIYDVERVIRIRTGEENEDAL

SEQ ID NO: 62501 - DNA, 339 bp, Psychrobacter sp. 273-4
  CDS (1)..(339)
atgaagctaatcactgcgatcttaaaaccgtttaagctcgatgatgtgcgtgaagcgctttctgacattggtgttaaaggtgttaccgtcactgaggtcaaaggtttcggtcgccaaaaaggtcataccgagctctatcgcggcgccgagtacgtggtggattttttgcctaaagtaaaagtggaagtggccgtgatcgacgagatggtcgagcctgctattgaagccattacgcgtatcgctagtaccggtaaaatcggtgacggtaaaatatttgtgaccaatcttgagcaagtcattcgtattcgtacgggtgagacaggtcctgacgctatctaa

SEQ ID NO: 62502 - protein, 112 aa, Psychrobacter sp. 273-4
MKLITAILKPFKLDDVREALSDIGVKGVTVTEVKGFGRQKGHTELYRGAEYVVDFLPKVKVEVAVIDEMVEPAIEAITRIASTGKIGDGKIFVTNLEQVIRIRTGETGPDAI

SEQ ID NO: 62503 - DNA, 333 bp, Methanococcoides burtonii DSM 6242
  CDS (1)..(333)
atgaagaaaataacagccattataagaccgggtaaactggaaacggtaaaggaggagcttgttactgcaggattaaacgcaatgactatctttgacgttaaaggcagaggtgaacagaaagggatctgcctccagttcagaggcaaacggaaccttatcgacatgatacccaagatacagatcgatatcgttgtaaagaatgatgaagtcgtaactgtgatacagaccattaaacatgctgtacgtaccggaaagatcggggacggcaaaatatttggtccccctgtggaaatgatgataggaataaggacgggagaatgtattacagaatga

SEQ ID NO: 62504 - protein, 110 aa, Methanococcoides burtonii DSM 6242
MKKITAIIRPGKLETVKEELVTAGLNAMTIFDVKGRGEQKGICLQFRGKRNLIDMIPKIQIDIVVKNDEVVTVIQTIKHAVRTGKIGDGKIFGPPVEMMIGIRTGECITE

SEQ ID NO: 62505 - DNA, 339 bp, Dechloromonas aromatica RCB
  CDS (1)..(339)
atgaagaaaatcgaagccatcatcaagcctttcaagctcgacgaagtgcgtgaagccttgtcggaaatcggcatcagcggcttgacggtgaccgaagtcaaaggctttggccgtcagaaaggtcataccgaactgtaccgtggtgcggaatatgtcgtcgattttctgcccaagatcaagatcgagattgttgtgaactcgaacaatgtcgagccggcgatcgacgccatcatcaaggcggcccgcactggcaagattggcgacggcaagattttcgtgatgccggttgagcaggtggtgcgcatccgtacgggcgaaaccgacgaagcggctgtctga

SEQ ID NO: 62506 - protein, 112 aa, Dechloromonas aromatica RCB
MKKIEAIIKPFKLDEVREALSEIGISGLTVTEVKGFGRQKGHTELYRGAEYVVDFLPKIKIEIVVNSNNVEPAIDAIIKAARTGKIGDGKIFVMPVEQVVRIRTGETDEAAV

SEQ ID NO: 62507 - DNA, 339 bp, Dechloromonas aromatica RCB
  CDS (1)..(339)
atgaaattcgttaccgccatcatcaagccgttcaagcttgacgaagtgcgtgaagcgttgtccgccatcggcgtgcaaggcatcacggtcactgaagtgaagggtttcggccggcagaaagggcataccgagctgtatcggggcgccgaatatgtcgtcgatttcctgcccaaggtcaagatcgaagccgctgtcagggacgatcagctcgatcaggtcatcgaagccatcgaaaagtcggcatccaccggcaagatcggcgacggcaagatcttcgtgttcgatgtcgaacaagtcattcgtatccggaccggtgaaaccggtaccgatgccctctaa

SEQ ID NO: 62508 - protein, 112 aa, Dechloromonas aromatica RCB
MKFVTAIIKPFKLDEVREALSAIGVQGITVTEVKGFGRQKGHTELYRGAEYVVDFLPKVKIEAAVRDDQLDQVIEAIEKSASTGKIGDGKIFVFDVEQVIRIRTGETGTDAL

SEQ ID NO: 62509 - DNA, 339 bp, Dechloromonas aromatica RCB
  CDS (1)..(339)
atgaaagaaatcaaggcgatcattcgccccaacaaactgccgcttttgcgcgatgcgctggtcgccttgccggactttccagggatgacggtctccaaggttgaggggtgcagcgccccgtcgcgccatgtgccggcgcggaccaaaatcaaggatgaactgaccgattacacgtccaaggtacgcatcgaaatcgtcgcgcccgacgaagtcgccgagaccatcttcctacgcattaccgaagtggcgcagaccgggcattacggagatggtctggtctggatcaccgacatcgaaaaggtggccttcgtttttaaaacgacccccgggccggattaa

SEQ ID NO: 62510 - protein, 112 aa, Dechloromonas aromatica RCB
MKEIKAIIRPNKLPLLRDALVALPDFPGMTVSKVEGCSAPSRHVPARTKIKDELTDYTSKVRIEIVAPDEVAETIFLRITEVAQTGHYGDGLVWITDIEKVAFVFKTTPGPD

SEQ ID NO: 62511 - DNA, 339 bp, Ralstonia eutropha JMP134
  CDS (1)..(339)
atgaagcagattaccgccatcatcaaaccgttcaaactcgacgaagtgcgcgaatcgctcgcggatgtcggcgtgacggggctgacggtgaccgaagtgaagggatttggccgccagaaggggcataccgagctgtaccgcggcgccgagtatgtggtcgacttcctgccgaagatcaagatcgaggtcgtggtcgccgagaaccagctcgacacggtgctggacgccgtcgtcaaggccgcgcacaccggcaagatcggcgacggcaagatcttcgtcacggagatcgagcgcgtgatccgcatccgcaccggcgagcaggacgaagccgcggtctga

SEQ ID NO: 62512 - protein, 112 aa, Ralstonia eutropha JMP134
MKQITAIIKPFKLDEVRESLADVGVTGLTVTEVKGFGRQKGHTELYRGAEYVVDFLPKIKIEVVVAENQLDTVLDAVVKAAHTGKIGDGKIFVTEIERVIRIRTGEQDEAAV

SEQ ID NO: 62513 - DNA, 339 bp, Methylobacillus flagellatus KT
  CDS (1)..(339)
atgaaattcatatccgctatcatcaagccgttcaagcttgacgaagtgcgggaagctctttccgctattggcgtgcaggggatcaccgtcactgaggtgaagggattcgggcgacaaaaggggcataccgagctttaccgcggcgctgaatatgtggtggattttcttcccaaagtgaaactggaggtcgccatagaggacagcttgctcgaccaagtgattgacgcaatcgagcaatctgccagcaccgggaagatcggggatggcaagatttttgtctttgatcttgaacaggcttatcgcattcgcaccggtgaaaccggtggcgatgcgctttga

SEQ ID NO: 62514 - protein, 112 aa, Methylobacillus flagellatus KT
MKFISAIIKPFKLDEVREALSAIGVQGITVTEVKGFGRQKGHTELYRGAEYVVDFLPKVKLEVAIEDSLLDQVIDAIEQSASTGKIGDGKIFVFDLEQAYRIRTGETGGDAL

SEQ ID NO: 62515 - DNA, 339 bp, Methylobacillus flagellatus KT
  CDS (1)..(339)
atgaaactcgtatccgctatcatcaagcccttcaagcttgacgaggtgcgtgaagccctttcctccattggagttcagggtatcaccgtcactgaagtcaaaggctttggtcgtcaaaaaggccacaccgagctttaccgtggtgcagaatacgttgtcgattttttgcccaagatcaagctggaagtcgcagtcgccgatgaattacttgaccaagtagtggaagttatcgaaaaatctgcctccactggcaaaatcggcgatggcaagattttcgtcttcgacttggaacaagtctaccgcattcgtactggcgaaaccggcgctgatgcgctttaa

SEQ ID NO: 62516 - protein, 112 aa, Methylobacillus flagellatus KT
MKLVSAIIKPFKLDEVREALSSIGVQGITVTEVKGFGRQKGHTELYRGAEYVVDFLPKIKLEVAVADELLDQVVEVIEKSASTGKIGDGKIFVFDLEQVYRIRTGETGADAL

SEQ ID NO: 62517 - DNA, 339 bp, Crocosphaera watsonii WH 8501
  CDS (1)..(339)
ttgaaaaaggtagaagcgattatccgcccctttaaattagacgaagtaaagatcgctttagtcaatgcgggaattgttggtatgacagtttctgaggttcgggggtttggacgacaaaaaggacaaaccgaacgttatcgcggttcggaatatacggtagaatttctacaaaaattgaagctggaaattgtggttgagaatgatcaggtagcaatggttattgacaagctgagaggggctgcacgtacaggggaaattggagatggcaagatttttgtttctcctgtcgaccaggttattcgcattcgcactggagaaagcgatctcgaagcgatttaa

SEQ ID NO: 62518 - protein, 112 aa, Crocosphaera watsonii WH 8501
MKKVEAIIRPFKLDEVKIALVNAGIVGMTVSEVRGFGRQKGQTERYRGSEYTVEFLQKLKLEIVVENDQVAMVIDKLRGAARTGEIGDGKIFVSPVDQVIRIRTGESDLEAI

SEQ ID NO: 62519 - DNA, 339 bp, Mesorhizobium sp. BNC1
  CDS (1)..(339)
atgaaattcgtgatggcaatcataaagccgttcaagctcgaggcggttcgcgaagcgctgacggagctcggcattcaggggctgaccgtcaccgaggtgaaggggtatgggcggcaaaaggggcacactgaaatctatcgtggcgctgaatatgcggtgagtttcctgcccaaagtgaagatcgaggtggccgtggattcggacatcgccgaccaggcggtgcaagcgatcgcaggggcggccaaaaccggccagatcggcgatggcaagatcttcgtctacagcatcgaaaaggcagtgcgtatccgcacaggcgagaccgacgccgatgcgctgtga

SEQ ID NO: 62520 - protein, 112 aa, Mesorhizobium sp. BNC1
MKFVMAIIKPFKLEAVREALTELGIQGLTVTEVKGYGRQKGHTEIYRGAEYAVSFLPKVKIEVAVDSDIADQAVQAIAGAAKTGQIGDGKIFVYSIEKAVRIRTGETDADAL

SEQ ID NO: 62521 - DNA, 339 bp, Mesorhizobium sp. BNC1
  CDS (1)..(339)
atgaagaagatcgaggcgatcatcaaacctttcaagctcgacgaagtgaaggaagctcttcaggaagtcgggttgcaaggcatcaccgtcaccgaggccaagggtttcggacgtcaaaaggggcataccgagctctatcgcggggcggagtatgtcgtggacttcctacccaaggtgaagatcgaggtggtgctgatcgacgaaatggtagacgcggccatcgaggccattcgcaaggccgcacagacggggcgcatcggcgacggaaagatctttgtctccaatgtggaggaagtcatccgcatccgcaccggcgaaaccgggcctgatgcggtctga

SEQ ID NO: 62522 - protein, 112 aa, Mesorhizobium sp. BNC1
MKKIEAIIKPFKLDEVKEALQEVGLQGITVTEAKGFGRQKGHTELYRGAEYVVDFLPKVKIEVVLIDEMVDAAIEAIRKAAQTGRIGDGKIFVSNVEEVIRIRTGETGPDAV

SEQ ID NO: 62523 - DNA, 339 bp, Burkholderia cepacia R18194
  CDS (1)..(339)
atgaaactcattaccgcaatcatcaagccgttcaagctcgatgagacgcgcgaagcgctgtcggcgcttggcgtctcgggcatcacggtgacggaggtgaaagggttcggacgccagaaggggcacaccgagctgtaccgcggcgccgaatacgtggtcgatttcctgccgaagatgaagatcgaggcagccgtgtccgacgatctcgtcgaccaggcggtcgaggcgatcgagcgggccgcgcgcacgggcaagatcggcgacggcaagatcttcgtcacggcgatcgaacaggtaatccggattcgcaccggggagaccggcgcagacgcgctgtaa

SEQ ID NO: 62524 - protein, 112 aa, Burkholderia cepacia R18194
MKLITAIIKPFKLDETREALSALGVSGITVTEVKGFGRQKGHTELYRGAEYVVDFLPKMKIEAAVSDDLVDQAVEAIERAARTGKIGDGKIFVTAIEQVIRIRTGETGADAL

SEQ ID NO: 62525 - DNA, 339 bp, Rubrivivax gelatinosus PM1
  CDS (1)..(339)
atgaagatggtgactgccattgtcaagcccttcaagcttgacgaagttcgtgaggccttgagcgctatcggcgttcagggcatcacggtgaccgaagtcaaaggcttcggccgccaaaagggccacaccgagctgtatcgcggtgcggagtacgttgtcgacttcctgcccaaggtcaagatcgaggcagccgtcgatgacgccatcgtcgaccgcgtgatcgaagcgatcgaagcctcggcccgcaccggcaagatcggtgacggcaaggtcttcgtcaccaacctcgagcaggtgatccgcatccgcaccggcgaaaccggcaaggacgcgctctga

SEQ ID NO: 62526 - protein, 112 aa, Rubrivivax gelatinosus PM1
MKMVTAIVKPFKLDEVREALSAIGVQGITVTEVKGFGRQKGHTELYRGAEYVVDFLPKVKIEAAVDDAIVDRVIEAIEASARTGKIGDGKVFVTNLEQVIRIRTGETGKDAL

SEQ ID NO: 62527 - DNA, 339 bp, Rubrivivax gelatinosus PM1
  CDS (1)..(339)
atgaaacagatcaccgccgtcatcaagcccttcaagctcgaggaagtgcgcgaggcgcttgccgaggtgggtgtgtccggtctgaccgtgaccgaggtcaagggcttcggccgccagaagggccacaccgagctgtaccgtggtgccgagtacgtggtcgacttcctgccgaaggtcaagctcgaggtggtggtgaaggacgtcgacgtcgatcgttgcctggaagccatcgtcaaggcggccaagaccggcaagatcggtgacggcaagatcttcgtcagctcggtcgagcaggtcgttcgcatccgcaccggcgaaacggacgaagcggcggtctga

SEQ ID NO: 62528 - protein, 112 aa, Rubrivivax gelatinosus PM1
MKQITAVIKPFKLEEVREALAEVGVSGLTVTEVKGFGRQKGHTELYRGAEYVVDFLPKVKLEVVVKDVDVDRCLEAIVKAAKTGKIGDGKIFVSSVEQVVRIRTGETDEAAV

SEQ ID NO: 62529 - DNA, 339 bp, Rhodospirillum rubrum
  CDS (1)..(339)
atgaagctgatcatggccatcatcaagcctttcaagctcgacgaagtttgcgaggcactgacatcgcttgacgtccacggactgaccgtttccgaagtgaagggattcggccgccagaagggccagacggaaatctaccggggcgccgaatatcaggtgaacttcctgcccaaggtgaagatcgaggtggcggtgagcgacggacttgccgacctcgcggtcgaagccatctgcaacgccgcccggaccgacagaatcggcgatggcaaggtcttcgtctacgacctggacaagatcgtgcgcatccgcaccggcgaaatcgacgccgacgctctctga

SEQ ID NO: 62530 - protein, 112 aa, Rhodospirillum rubrum
MKLIMAIIKPFKLDEVCEALTSLDVHGLTVSEVKGFGRQKGQTEIYRGAEYQVNFLPKVKIEVAVSDGLADLAVEAICNAARTDRIGDGKVFVYDLDKIVRIRTGEIDADAL

SEQ ID NO: 62531 - DNA, 339 bp, Rhodospirillum rubrum
  CDS (1)..(339)
atgaaattcgttattgcgataaccaagcccttcaaactcgacgaggtccgcgaagccctcggcgccctggggatccaggggatgaccgttaccgaggtgaaggggttcggccggcagaagggccagaccgaggtttaccgcggagctgaatacgtggtgaatttcctgcccaaggtgaagatcgaactggccgttcccgataatcttctcgatcaggtggtcgagaccatccaatccacggcgcaaaccggcaagatcggcgacggcaagatcttcgtcttcgatctgggcgaagccgtaaggatccgcaccggcgagcgcggcgaggaagccctctag

SEQ ID NO: 62532 - protein, 112 aa, Rhodospirillum rubrum
MKFVIAITKPFKLDEVREALGALGIQGMTVTEVKGFGRQKGQTEVYRGAEYVVNFLPKVKIELAVPDNLLDQVVETIQSTAQTGKIGDGKIFVFDLGEAVRIRTGERGEEAL

SEQ ID NO: 62533 - DNA, 339 bp, Ralstonia metallidurans CH34
  CDS (1)..(339)
atgaagcagattaccgccatcatcaaaccgttcaagctcgacgaagtgcgtgaggcaatggccgacgtcggcgtgacggggttgacggtgaccgaagtcaagggttttggccgtcagaagggccacaccgagctctatcgcggagccgagtatgtggtcgacttccttccgaagatcaagatcgaagtggtcgtggctgagaaccagctcgacacggtgctcgacgccatcgtcaaggccgcccacaccggcaagatcggtgacggcaagatcttcgtgaccgagatcgaacgcgtgatccgcattcgtaccggcgagcaggacgaagcggcagtctga

SEQ ID NO: 62534 - protein, 112 aa, Ralstonia metallidurans CH34
MKQITAIIKPFKLDEVREAMADVGVTGLTVTEVKGFGRQKGHTELYRGAEYVVDFLPKIKIEVVVAENQLDTVLDAIVKAAHTGKIGDGKIFVTEIERVIRIRTGEQDEAAV

SEQ ID NO: 62535 - DNA, 339 bp, Burkholderia fungorum LB400
  CDS (1)..(339)
atgaaactcattaccgcaatcatcaagccgttcaagctcgatgaggcgcgcgaagccttgtcggccatcggcgtctcgggcatcacggtgactgaagtgaaaggcttcggtcgtcagaaggggcacacggagctgtaccgcggcgccgaatacgtcgtcgatttcctgccgaaggtgaagatcgaggcggctgtctcggacgacatcgtcgaccaggcgatcgaggcgctggaacgcgcagcgcgcaccggcaagatcggcgacggcaagatcttcgtcacgccgatcgagcaggtgatccggattcgcaccggggagaccggcgcggacgctctgtaa

SEQ ID NO: 62536 - protein, 112 aa, Burkholderia fungorum LB400
MKLITAIIKPFKLDEAREALSAIGVSGITVTEVKGFGRQKGHTELYRGAEYVVDFLPKVKIEAAVSDDIVDQAIEALERAARTGKIGDGKIFVTPIEQVIRIRTGETGADAL

SEQ ID NO: 62537 - DNA, 339 bp, Magnetococcus sp. MC-1
  CDS (1)..(339)
atgaaatggatcgtagccattattaaacccttcaagttggatgaggtacgggaagcactcacctctgtgggtatctccggtatcacggtttccgaagtgcgcggttttggtcgccaaaagggccataccgaactctatcgtggtgccgagtatcgtgtggatttcctgcccaagctcaaagtggagctggccgtggatgacagcatccttgagcaagccgtcgaggcgattcaaaaaggcgccaaaacctccaaaattggtgacggtaaaatctttgtgtatgacctggagagtgctgtacgcattcgtaccggcgaatctggccccagcgcgctataa

SEQ ID NO: 62538 - protein, 112 aa, Magnetococcus sp. MC-1
MKWIVAIIKPFKLDEVREALTSVGISGITVSEVRGFGRQKGHTELYRGAEYRVDFLPKLKVELAVDDSILEQAVEAIQKGAKTSKIGDGKIFVYDLESAVRIRTGESGPSAL

SEQ ID NO: 62539 - DNA, 339 bp, Magnetococcus sp. MC-1
  CDS (1)..(339)
atgaagaaggtggaagcaatcattaagccctttaagttggatgacgttaaagaagcgctggctgaggtaggcattcaagggattaccgtttcggaagtgcgcggatttggccgtcaaaagggccataccgagctgtatcgtggtgctgagtatgtggtggacttcctgcctaaacttaaggtcgaagtggtgcttaccgatgatcatgtggagcgcgctgtagaagccattgaaaacgccgctcgcaccggtcgtattggtgatggtaagatctttgtctctcccgtggatacggccattcgtattcggaccggtgagcgtgacagcgacgcggtgtaa

SEQ ID NO: 62540 - protein, 112 aa, Magnetococcus sp. MC-1
MKKVEAIIKPFKLDDVKEALAEVGIQGITVSEVRGFGRQKGHTELYRGAEYVVDFLPKLKVEVVLTDDHVERAVEAIENAARTGRIGDGKIFVSPVDTAIRIRTGERDSDAV

SEQ ID NO: 62541 - DNA, 339 bp, Geobacter metallireducens GS-15
  CDS (1)..(339)
atgaagctcatcgaagcgataatcaaaccgttcaagctggacgaggtaaaggatgcgctcaccgaaatcggcgtggaaggaataactgtgagcgaagtaaagggattcggtcgccagaaggggcataccgaactctaccgcggtgccgagtatgttgtcgatttcattccaaaggttaagattgagattgcggttgccgatgaggtggtggccaaggtggtggaaaccatagaaaataccgccaagaccggcagaatcggcgacggcaagatattcatccttcccctcgacgaggcggtcaggatcaggaccggcgaaaagggtgccgaggccatctga

SEQ ID NO: 62542 - protein, 112 aa, Geobacter metallireducens GS-15
MKLIEAIIKPFKLDEVKDALTEIGVEGITVSEVKGFGRQKGHTELYRGAEYVVDFIPKVKIEIAVADEVVAKVVETIENTAKTGRIGDGKIFILPLDEAVRIRTGEKGAEAI

SEQ ID NO: 62543 - DNA, 339 bp, Novosphingobium aromaticivorans DSM 12444
  CDS (1)..(339)
atgaaattcatcatcgccatcatcaagccgttcaagctcgacgaagtgcgtgaagcgctgtcgggtctgggcgttgctgggatgacggtgtcggaggtgaagggcttcggtcggcagaaaggccagaccgagatctaccgaggcgccgaatattcgaccaacatgctgccgaaggtgaagatcgagatcgccgccagcgacgatctcgcgccgcagatcgtcgagacgatccagcaggccgccagcaccgaggcgattggcgacggcaaggtgttcgtcctcgatctcgcgtccgcgacccgtatccgcaccggcgaaaccggggacaccgcgctttga

SEQ ID NO: 62544 - protein, 112 aa, Novosphingobium aromaticivorans DSM 12444
MKFIIAIIKPFKLDEVREALSGLGVAGMTVSEVKGFGRQKGQTEIYRGAEYSTNMLPKVKIEIAASDDLAPQIVETIQQAASTEAIGDGKVFVLDLASATRIRTGETGDTAL

SEQ ID NO: 62545 - DNA, 339 bp, Novosphingobium aromaticivorans DSM 12444
  CDS (1)..(339)
atgaaaaaggtcgaagcgatcatcaagccgttcaagctcgatgaagtgaaggaagcgctgcacgaaatcggcgtctccggcatcaccgtcaccgaagccaagggcttcggtcgccagaagggccataccgagctctatcgcggcgccgaatacgtcgtcgacttcctgccgaaggtgaagctcgaggtcgtggtttccgacgccctggtcgatcgcgtggtcgaagctgtcgccgccgccgcccagacgggccgcatcggtgacggcaagatcttcgtgatccccgtcgaaagcgcactgcgcatccgcaccggcgaacgcgacgacgacgcgatctga

SEQ ID NO: 62546 - protein, 112 aa, Novosphingobium aromaticivorans DSM 12444
MKKVEAIIKPFKLDEVKEALHEIGVSGITVTEAKGFGRQKGHTELYRGAEYVVDFLPKVKLEVVVSDALVDRVVEAVAAAAQTGRIGDGKIFVIPVESALRIRTGERDDDAI

SEQ ID NO: 62547 - DNA, 342 bp, Cytophaga hutchinsonii
  CDS (1)..(342)
atgaaaaaaattgaagcaattgtaaaaccttcaaaactgaaggcaatacaggcaggtttaattaaaataggtattccgtgtatgactgttgtgcctgtaaagggcgttggcttgcagcagggctttccggaaatatacagaggtacagaaaagtcgattgtactcttatcaaaagtcatgatcatttgtgtggtgagtgatgagaatcttgaaaagtgtatcgatgtaattattgaaacaggctccgaaggaaaagtcggtgacggaaaaatatttgtctacgatgtactcgatgcaattcgcatgcgtacgaggacaagaggtgatgatgcgataaggtaa

SEQ ID NO: 62548 - protein, 113 aa, Cytophaga hutchinsonii
MKKIEAIVKPSKLKAIQAGLIKIGIPCMTVVPVKGVGLQQGFPEIYRGTEKSIVLLSKVMIICVVSDENLEKCIDVIIETGSEGKVGDGKIFVYDVLDAIRMRTRTRGDDAIR

SEQ ID NO: 62549 - DNA, 339 bp, Cytophaga hutchinsonii
  CDS (1)..(339)
atgaaaaaaattgaagccgttattcgaacgtctaaatttctggagttaaaagaagcccttaataaaatggggattcagttcttcacgtatgcagatgttaaaggtgttggacatcaagcgactgaaaaagcagtttacagaggtgttcaatatgaccttggttatatagcaagaacaaagcttgatattattgtaagcgaaaaagttgaagaagtaattaaatgcattgttgatacctgtaaaaccggggaacttggagatgggaaaatctttgtttccaatatagaggaatgtgtgcgtatccgtacaggcgaaagaggcgttcccgcgctgcaataa

SEQ ID NO: 62550 - protein, 112 aa, Cytophaga hutchinsonii
MKKIEAVIRTSKFLELKEALNKMGIQFFTYADVKGVGHQATEKAVYRGVQYDLGYIARTKLDIIVSEKVEEVIKCIVDTCKTGELGDGKIFVSNIEECVRIRTGERGVPALQ

SEQ ID NO: 62551 - DNA, 339 bp, Microbulbifer degradans 2-40
  CDS (1)..(339)
atgaaactgattacagctgtaattaagccgttcaaactagacgacgtgcgcaacgcgctgtctgaaattggcgtgcaaggcatgaccgtaaccgaagttaagggttttggtcgtcagaagggtcacacagagctttatagaggggccgagtacgttatcgactttttgcctaaggtaaaattagagctagtattgggtgatgagcttattgatcaagccgtagaagccatttctaaagcggcgcaaaccggcaaaattggcgatggcaaaatctttattacgccgtgcgaagaggtgattcgcattcgcaccggcgaaactggcccagaggcggtttaa

SEQ ID NO: 62552 - protein, 112 aa, Microbulbifer degradans 2-40
MKLITAVIKPFKLDDVRNALSEIGVQGMTVTEVKGFGRQKGHTELYRGAEYVIDFLPKVKLELVLGDELIDQAVEAISKAAQTGKIGDGKIFITPCEEVIRIRTGETGPEAV

SEQ ID NO: 62553 - DNA, 339 bp, Microbulbifer degradans 2-40
  CDS (1)..(339)
atgaaattaattactgccgtaattaagccttttaaattggatgcagtacgcgaagcattatcagaaattggtgtgcaaggtattacagtaactgaagtaaaaggtttcggccgtcaaaaaggtcatacagagctataccgtggtgcagagtacgtagtggactttctgccaaaaactaaattggaagtagcggtagcagataatcaggtggattctgttgtagaaaccatcagcaaagcagcgcacagcggcaagattggagacggaaaaatattcgtttcagctcttgaacaagttatccgcattcgcaccggcgagtccggcgaagacgcactttaa

SEQ ID NO: 62554 - protein, 112 aa, Microbulbifer degradans 2-40
MKLITAVIKPFKLDAVREALSEIGVQGITVTEVKGFGRQKGHTELYRGAEYVVDFLPKTKLEVAVADNQVDSVVETISKAAHSGKIGDGKIFVSALEQVIRIRTGESGEDAL

SEQ ID NO: 62555 - DNA, 348 bp, Trichodesmium erythraeum IMS101
  CDS (1)..(348)
atgaataacttgaaaaaagtagaagctattattcggccttttaaattagaccaggtgaaaattgctctcgttaatgctggtatcgtaggtatgactgtttctgaagtcagagggttcgggcgtcagaagggtcaaactgaaagatatcggggttctgagtatacagttgagtttttgcaaaagcttaaacttgaagttgtagttgaggatgatcaggtacaaacggttattgataagattattaatgcttcccgtacaggtgagatcggtgatggtaagattttcgtttctccagtagataaaattgtccgaattcggactggggaagataatacagacgcaatttag

SEQ ID NO: 62556 - protein, 115 aa, Trichodesmium erythraeum IMS101
MNNLKKVEAIIRPFKLDQVKIALVNAGIVGMTVSEVRGFGRQKGQTERYRGSEYTVEFLQKLKLEVVVEDDQVQTVIDKIINASRTGEIGDGKIFVSPVDKIVRIRTGEDNTDAI

SEQ ID NO: 62557 - DNA, 339 bp, Moorella thermoacetica ATCC 39073
  CDS (1)..(339)
atgaaaaaaatcgaagccatcatccgctcgtcgcgcctggaggccgtcaaagaagccctgggtaagtacaacatccacggcctgacggtcacccacgtcctgggatgcggcctccagcggggccagacggaatattatcgcggcaacctgtataccgttaacctgttacccaaggtaaaactggagattatcgccctggacaatcgggtaccggagatagtggagataatctcccgggaagcccgaaccggcgaaatcggggacggtaaaatctttatctaccccgtggaaaccgccattcgcatccgtaccggtgaacagggcgaagacgccatctaa

SEQ ID NO: 62558 - protein, 112 aa, Moorella thermoacetica ATCC 39073
MKKIEAIIRSSRLEAVKEALGKYNIHGLTVTHVLGCGLQRGQTEYYRGNLYTVNLLPKVKLEIIALDNRVPEIVEIISREARTGEIGDGKIFIYPVETAIRIRTGEQGEDAI

SEQ ID NO: 62559 - DNA, 339 bp, Moorella thermoacetica ATCC 39073
  CDS (1)..(339)
atgtataaaatcgaggccatcatccggccggaaaaattcgaggccgtcaaggaagccctgggtcgctacggcgtccacggcatgactgtaacccacaccctgggctgcggccagcagaagggcaaaaccgaggtctaccggggcacggcttataccatcgccctcttgcccaaggtcaaggtagagatagtcctggaagatagatacgttgacgatgtggtggctattatcgcccgcgaggcccgtaccggcaacatcggcgacggcaaaatttttatctgccccgtacaagatgccatcagaatccgcaccggtgagcggggtgcagaagcgatttaa

SEQ ID NO: 62560 - protein, 112 aa, Moorella thermoacetica ATCC 39073
MYKIEAIIRPEKFEAVKEALGRYGVHGMTVTHTLGCGQQKGKTEVYRGTAYTIALLPKVKVEIVLEDRYVDDVVAIIAREARTGNIGDGKIFICPVQDAIRIRTGERGAEAI

SEQ ID NO: 62561 - DNA, 339 bp, Thiobacillus denitrificans ATCC 25259
  CDS (1)..(339)
atgaaaaaaatagaagcgatcatcaagccgttcaaactcgacgaagtgcgcgaagcgctgtccgaaatcggcgtcaccgggctgaccgtgaccgaagtcaagggcttcggccggcagaagggccataccgagctgtaccgcggcgccgaatacgtggtggatttcctgcccaaggtgaagctcgaagtcgtcgtcgccgacaatctggtcgagcgcgtcaccgaggcggtcgtcaacgccgcgcgcaccggcaagatcggcgacggcaagatcttcgtgaccgcggtcgagcaggtggtgcgcatccgcaccggggaatcgggcgaagcggcggtgtga

SEQ ID NO: 62562 - protein, 112 aa, Thiobacillus denitrificans ATCC 25259
MKKIEAIIKPFKLDEVREALSEIGVTGLTVTEVKGFGRQKGHTELYRGAEYVVDFLPKVKLEVVVADNLVERVTEAVVNAARTGKIGDGKIFVTAVEQVVRIRTGESGEAAV

SEQ ID NO: 62563 - DNA, 339 bp, Thiobacillus denitrificans ATCC 25259
  CDS (1)..(339)
atgaaattcgtaacggccatcatcaagccgttcaagctggacgaagtgcgcgaggccttgtcggccatcggcgtcaccggcctgacggtcacggaagtaaaggggttcgggcggcagaagggacacaccgagctgtatcgcggtgcggaatacgtcgtcgacttcctgcccaaggtcaagctcgaagtcgcgatcaaggccgatctgctcgagcgcgtcatcgaggcgatcgagcacgcggcgaacaccggcaagatcggcgacggcaagatcttcgtcagcagcctggaacaggtcgtgcgcatccgtaccggcgagtccggcccggacgcactgtga

SEQ ID NO: 62564 - protein, 112 aa, Thiobacillus denitrificans ATCC 25259
MKFVTAIIKPFKLDEVREALSAIGVTGLTVTEVKGFGRQKGHTELYRGAEYVVDFLPKVKLEVAIKADLLERVIEAIEHAANTGKIGDGKIFVSSLEQVVRIRTGESGPDAL

SEQ ID NO: 62565 - DNA, 339 bp, Silicibacter sp. TM1040
  CDS (1)..(339)
atgaaattgatcatagcagccatcaaacccttcaagctcgaagaggtgcgtgaagcactgaccaagcttggggtgtccggtttgatggtaaccgaaatcaaaggctttggcgcgcaagccggtcacaccgaaatctaccgtggagccgagtacgaagtgaacttcgttcccaaggtgaaactggaaatcgtcgtgccgtccgacctcgctgaccaggtcgtcgagaccattacccaggcatcccgcaccggcaaaatcggagatggcaagatcttcgtgctggatgtggcgcaggccgtgcgcgtgcgcaccggggaaaccaatcaagacgcgctctaa

SEQ ID NO: 62566 - protein, 112 aa, Silicibacter sp. TM1040
MKLIIAAIKPFKLEEVREALTKLGVSGLMVTEIKGFGAQAGHTEIYRGAEYEVNFVPKVKLEIVVPSDLADQVVETITQASRTGKIGDGKIFVLDVAQAVRVRTGETNQDAL

SEQ ID NO: 62567 - DNA, 339 bp, Silicibacter sp. TM1040
  CDS (1)..(339)
atgaaaaagatcgaagccatcatcaagccgttcaagctcgacgaggtgaaagaagcgctgcaggacgtcggcgttcagggtctctctgtcatcgaggttaagggctttggtcgtcaaaaaggccataccgagctttatcgcggagcagaatatgtcgtggactttctgcccaaggtaaaaatcgaagtggtgctcgacgacgatcaggtggacgccgccatcgaggcgatcgtggcagcggccaagaccgacaagatcggcgatggcaagatttttgtcagcccggttgaacaggccatccgcattcggaccggtgaagccggctctgacgccctttaa

SEQ ID NO: 62568 - protein, 112 aa, Silicibacter sp. TM1040
MKKIEAIIKPFKLDEVKEALQDVGVQGLSVIEVKGFGRQKGHTELYRGAEYVVDFLPKVKIEVVLDDDQVDAAIEAIVAAAKTDKIGDGKIFVSPVEQAIRIRTGEAGSDAL

SEQ ID NO: 62569 - DNA, 339 bp, Methylobacillus flagellatus KT
  CDS (1)..(339)
atgaaaaaaattgaagcagtaatcaagccattcaagctcgacgaggtgcgcgaagcgctatccgagatcggggcaaacgggttgacggtgaccgaggtgaagggattcggccgccagaaagggcataccgaactctaccgcggtgcggagtatgtggtggacttcctgcccaagatcaaggtcgagctggtggtgaccgacgatgtcgtggatgcagcagtggagtccatcatcaaggcagcacgtaccggcaagattggcgacggcaagattttcgtgactcccgtggagcagattatccgtatccgtaccggggagaccgatgaggcagccatctaa

SEQ ID NO: 62570 - protein, 112 aa, Methylobacillus flagellatus KT
MKKIEAVIKPFKLDEVREALSEIGANGLTVTEVKGFGRQKGHTELYRGAEYVVDFLPKIKVELVVTDDVVDAAVESIIKAARTGKIGDGKIFVTPVEQIIRIRTGETDEAAI

SEQ ID NO: 62571 - DNA, 339 bp, Xylella fastidiosa Dixon
  CDS (1)..(339)
atgaaactgattactgccatcattcggccgttcaagcttgatgaggtgcgagaagcactatcacaagttggcgtgtcaggtattaccgtgaccgaggtcaagggctttggacagcaaaagggtcatactgaattatatcgagggactgagtacgtcattgattttttgccaaaaatcaagatcgaaatggtggttaccgatgagcgcttggatgcggtcattgaagtgatccggatcgccgctgttaccggaaaaatcggtgacggtaaaatttttgtcactaaaatcgaacaggttgtaagaatccgtactggcgagatcgacattgatgcactctaa

SEQ ID NO: 62572 - protein, 112 aa, Xylella fastidiosa Dixon
MKLITAIIRPFKLDEVREALSQVGVSGITVTEVKGFGQQKGHTELYRGTEYVIDFLPKIKIEMVVTDERLDAVIEVIRIAAVTGKIGDGKIFVTKIEQVVRIRTGEIDIDAL

SEQ ID NO: 62573 - DNA, 339 bp, Polaromonas sp. JS666
  CDS (1)..(339)
atgaaacaaattaccgcgatcctcaagcccttcaaactggaagaagtccgggaggccctggccgaatgcggggtcacgggcctcaccgtgaccgaagtcaaaggttttggtcgccagaaaggccacacagaactctaccgcggcgccgagtatgtggtcgacttcctgcccaaggtgaaggtggaagtggttgtgaaaaccgacgacgtggaacgctgtgtggacgccatcgtgcgcgcggcacgcaccggaaaaatcggtgacggcaagattttcatcaccgccgtcgagcgcacagtgcgcatccgtaccggtgaagaggacgaagcggccgtctaa

SEQ ID NO: 62574 - protein, 112 aa, Polaromonas sp. JS666
MKQITAILKPFKLEEVREALAECGVTGLTVTEVKGFGRQKGHTELYRGAEYVVDFLPKVKVEVVVKTDDVERCVDAIVRAARTGKIGDGKIFITAVERTVRIRTGEEDEAAV

SEQ ID NO: 62575 - DNA, 339 bp, Azospirillum brasilense
  CDS (1)..(339): transl_table=11
atgaaactggttatggccatcatcaagccgttcaagctcgacgaagtgcgcgaggcgctgacgtcgctcgggattcagggcctgacggtgagcgaggtgaagggcttcggacgccagaagggtcagaccgagatctaccgcggcgccgagtattccgtgagcttcctgcccaaggtgaaggtcgaggtcgcggtgtccgacgaccagtacgagcaggtggtcgaggcgatccagaaggccgccaacaccggccgcatcggcgacggcaagatcttcgtgctggacatcgcccaggccgtgcgcatccgcaccggcgaaaccaacaccgaagctctctga

SEQ ID NO: 62576 - protein, 112 aa, Azospirillum brasilense
MKLVMAIIKPFKLDEVREALTSLGIQGLTVSEVKGFGRQKGQTEIYRGAEYSVSFLPKVKVEVAVSDDQYEQVVEAIQKAANTGRIGDGKIFVLDIAQAVRIRTGETNTEAL

SEQ ID NO: 62577 - DNA, 339 bp, Azorhizobium caulinodans
  CDS (1)..(339): transl_table=11
atgaagaagatcgaggcgatcatcaagcccttcaagctcgatgaagtgaaggaggcccttcaggaagtcggcctgcaaggtatcacggtcaccgaggcaaaggggttcggtcgccagaagggccataccgagctttatcgcggcgccgaatatgtggtggacttcctgcccaaggtgaaaatcgaggtggtgctcgccgacgacatggtcgagaaggcggtggaagccctgctccgcgccgctcagaccggacgcatcggcgacggcaagatcttcgtgtccagcatcgaggaagccatccgcatccgcaccggcgagaccgggctcgacgccatctga

SEQ ID NO: 62578 - protein, 112 aa, Azorhizobium caulinodans
MKKIEAIIKPFKLDEVKEALQEVGLQGITVTEAKGFGRQKGHTELYRGAEYVVDFLPKVKIEVVLADDMVEKAVEALLRAAQTGRIGDGKIFVSSIEEAIRIRTGETGLDAI

SEQ ID NO: 62579 - DNA, 339 bp, Herbaspirillum seropedicae
  CDS (1)..(339): transl_table=11
atgaaacaagtgaccgccatcatcaaaccgttcaagctggacgaggtgcgtgaatccctcgccgaagtcggcgtcacgggcctgacggtcaccgaagtgaaaggcttcgggcgccagaagggccataccgaactctatcgcggtgctgaatacgtggtcgacttcctgcccaaggtcaagatcgaagtcgtggtggacgacaaggtggtcgagcaggctgtggacgccatcatcaaggccgcccgcaccggcaagatcggcgacggcaagatcttcgtgcaggaagtggagcaggtgatccgtatccgtaccggcgaaaccgggccggatgccgtctga

SEQ ID NO: 62580 - protein, 112 aa, Herbaspirillum seropedicae
MKQVTAIIKPFKLDEVRESLAEVGVTGLTVTEVKGFGRQKGHTELYRGAEYVVDFLPKVKIEVVVDDKVVEQAVDAIIKAARTGKIGDGKIFVQEVEQVIRIRTGETGPDAV

SEQ ID NO: 62581 - DNA, 339 bp, Clostridium longisporum
  CDS (1)..(339): transl_table=11
atgaagaaaattgaagctgtaatacgtccggaaaaacttgaagaattaaaggatgctttaaaaaaaggcaatataaacggaattactgtagatcaagtaatgggatgtggtcagcaacatggatggactgaacattatagaggaagcgaaatcatggtgaactttttacctaaggttgaagtaaaggttatagttgatgactcaaaggtgcaagaggtcataaatttaattattgatacagtaaaaacaggggaagttggagacggaaaaatatttgttagtgatgttagtgaatgcataagaataaggacaggagaaaaaggattagatgcattataa

SEQ ID NO: 62582 - protein, 112 aa, Clostridium longisporum
MKKIEAVIRPEKLEELKDALKKGNINGITVDQVMGCGQQHGWTEHYRGSEIMVNFLPKVEVKVIVDDSKVQEVINLIIDTVKTGEVGDGKIFVSDVSECIRIRTGEKGLDAL

SEQ ID NO: 62583 - DNA, 639 bp, Oryza sativa
  CDS (1)..(639)
atgtcgtcgccggcgaccgccgccgccgccgccgcgtcctgtggcgtcctccgccaccaccatcctccggcttccccgcggcctcctcccaccaccaccaccaccacctcccgcctcctcctcgcctcgcgctcgcggggcctccagcggccactccgagtcaaccacgcgccccctcgtcgcctcccgcccacggccgcgcgcgcccagagtgccgccgcagcagggtaccagccggagtcggagttctacaaggtggaggcaatcctgaggccatggagggtgccttatgtgtcatcgggtttgctgcaaatggggatcagaggcgtgacggtgtccgacgtgcggggtttcggcgcacagggcgggtcaactgagaggcatgaagggtcagaatttgcagaagatacatttattgataaagttaagatggaaatagtggtgtccaaggatcaggttgaagctgttgttgacaagataattgaaaaggcaagaacaggagaaattggtgatggaaaaatatttttgatacccgtgtcggacgtgatcagaatacgcaccggcgaacgaggggagcgagcggagaggatggccggagggctggcggacaagctgtcctcagcaatgccgatctcatga

SEQ ID NO: 62584 - protein, 212 aa, Oryza sativa
MSSPATAAAAAASCGVLRHHHPPASPRPPPTTTTTTSRLLLASRSRGLQRPLRVNHAPPRRLPPTAARAQSAAAAGYQPESEFYKVEAILRPWRVPYVSSGLLQMGIRGVTVSDVRGFGAQGGSTERHEGSEFAEDTFIDKVKMEIVVSKDQVEAVVDKIIEKARTGEIGDGKIFLIPVSDVIRIRTGERGERAERMAGGLADKLSSAMPIS

SEQ ID NO: 62585 - DNA, 600 bp, Lycopersicon esculentum
  CDS (1)..(600)
atggcttctccctcactttcaaaatccaatttctcccttcactccttctcttcttctccatccttgtcacagttccctcatttcacttccatcaccgttgttcaacccaaattcttcccttcgcagctcaccttcaaacgctgtcaaaatgctccttctttcccgattatcagagcccaaaactctccagatttcgtccctgatgcgaagttttacaaagttgaagcaattctaagaccttggagaattcaacaggtttcttcggcactactgaaaatgggcattcgtggtgtcactgtttcggatgttcgtggttttggcgcccaaggtggcttgactgagaggcaagctggctctgaattctctgaagacacgtttgttgcaaaagttaaaatggaaattgttgtcagcaaagaccaggttgaaggagtcattgccaagataattgaagaggcaagaactggtgaaataggtgatggaaagatattcttgactcccatctccgatgttataagagttcgcactggtgaacggggagaaaaggcagagaggatgatgggagggcatgctgatatgtcctctgcattatcaacttcttga

SEQ ID NO: 62586 - protein, 199 aa, Lycopersicon esculentum
MASPSLSKSNFSLHSFSSSPSLSQFPHFTSITVVQPKFFPSQLTFKRCQNAPSFPIIRAQNSPDFVPDAKFYKVEAILRPWRIQQVSSALLKMGIRGVTVSDVRGFGAQGGLTERQAGSEFSEDTFVAKVKMEIVVSKDQVEGVIAKIIEEARTGEIGDGKIFLTPISDVIRVRTGERGEKAERMMGGHADMSSALSTS

SEQ ID NO: 62587 - DNA, 348 bp, uncultured crenarchaeote
  CDS (1)..(348): transl_table=11
atgaaacgtatagaagctattatcgctagcgaaaagatatctgaattaaacgctgctttgaaacaaatgggagtgggtggatgtactatactagatgccaaaggaagaggaaaaggagaaaaacccatggtggaagcccagagaggcactgcccgattcgctgcggaattttctgttagggcaaatgttgtaactgtagtcgaagattcccaattagaaaaggttatcaaaaccatattagacactataagcacaggttcagccggggatggtaaaatctttgtatcaacggtaattgatgcaattgacattggaactaaggcacgtggagaagaggcaataggttag

SEQ ID NO: 62588 - protein, 115 aa, uncultured crenarchaeote
MKRIEAIIASEKISELNAALKQMGVGGCTILDAKGRGKGEKPMVEAQRGTARFAAEFSVRANVVTVVEDSQLEKVIKTILDTISTGSAGDGKIFVSTVIDAIDIGTKARGEEAIG

SEQ ID NO: 62589 - DNA, 732 bp, Pinus pinaster
  CDS (1)..(732)
atggctgcccatctgcctctatttgtcaaaggatctatattttctctaccatcatcgacatcgacgtcttcttcctgtacgtattcgagcatatcgcatacagcggcatctcctggatttcactcatctccagcagcagccaataaatctgtaaaattgggaacgatgcagaggatggatggtgtcaggtcggtgaagcaccgaatgacaagtctgcatgcaaagatggagaagagacaacaaattaaggcatcggcccaggcaccaaatgggaccaacactcatccagattatgtcccagaagccaacttttacaaagtagaagcaatattgaggccatggcgcatctcccatgtgactacgggtctattgaaaatggggattcgtggcgtaactgtctctgatgttagaggttttggagttcaggctggatctgcagaacggcaagcaggctccgagttttctaaagacaattttgtgtcaaaagtaaagatggagattgtggtatctaaagatcaggtagaagcagtaattgatgcaatcattgatgaggcaagaactggagaaattggagatggcaaaatatttgtggttccagttgcagatgtcattcgtgtgagaacaggtgagcgggacttgaagccagagagaatggctggtggcgatcagagatacttacaggtgtacatcaagaggttacagacagcaactaaatcacttttagcactataa

SEQ ID NO: 62590 - protein, 243 aa, Pinus pinaster
MAAHLPLFVKGSIFSLPSSTSTSSSCTYSSISHTAASPGFHSSPAAANKSVKLGTMQRMDGVRSVKHRMTSLHAKMEKRQQIKASAQAPNGTNTHPDYVPEANFYKVEAILRPWRISHVTTGLLKMGIRGVTVSDVRGFGVQAGSAERQAGSEFSKDNFVSKVKMEIVVSKDQVEAVIDAIIDEARTGEIGDGKIFVVPVADVIRVRTGERDLKPERMAGGDQRYLQVYIKRLQTATKSLLAL

SEQ ID NO: 62591 - DNA, 339 bp, Leptospirillum ferrooxidans
  CDS (1)..(339): transl_table=11
atgaaaaaagtggaagccatcatcaagccgttcaagcttgatgcagtcaaggaagcggtgaccgccctcggcgtgtatggcatgaccgtcaccgaagtcaagggatacggacagcagaaaggccatacggaacagtaccgtggggcagaatatgtcgtggagtttatcaccaagatcaaagttgaaatcgttgttgccgatgccaaggtttctcctgttctggaagcgatccgccggacagcaatgtcaaactctatcggagatggcaaggtgtttgtctcgcctgtggaaacagcgttgcgaattcgaaccggtgaaacaggagacgctgcgctttag

SEQ ID NO: 62592 - protein, 112 aa, Leptospirillum ferrooxidans
MKKVEAIIKPFKLDAVKEAVTALGVYGMTVTEVKGYGQQKGHTEQYRGAEYVVEFITKIKVEIVVADAKVSPVLEAIRRTAMSNSIGDGKVFVSPVETALRIRTGETGDAAL

SEQ ID NO: 62593 - DNA, 339 bp, Acetobacter diazotrophicus
  CDS (1)..(339): transl_table=11
atgaaattcattatagccattatcaagccattcaaactcgacgatgtccgcgaagccctgggcaccatcggcatccagggactgaccgttaccgaagtcaaaggatatggccgccagaagggacagaccgagatctatcgcggcgcggaatatcagatccagttcgtggcaaaagtgaaaatcgaagtcgcggtggccgattcgatgctggatcaggcgctcgataccattcgtgccgccgcccataccggcacgatcggggacggcaagatgtttgttcttgaactgcaacaggccattcgtatccgtacgaatgaaaccggggagattgccttgtga

SEQ ID NO: 62594 - protein, 112 aa, Acetobacter diazotrophicus
MKFIIAIIKPFKLDDVREALGTIGIQGLTVTEVKGYGRQKGQTEIYRGAEYQIQFVAKVKIEVAVADSMLDQALDTIRAAAHTGTIGDGKMFVLELQQAIRIRTNETGEIAL

SEQ ID NO: 62595 - DNA, 339 bp, Acetobacter diazotrophicus
  CDS (1)..(339): transl_table=11
atgaagcttgtcacagccatcatcaagcccttcaaactcgacgacgttcgggaatccctgaccccgctgggcatccaggggctgaccgtgtcggaagtgaagggtttcggtcgtcagaagggccagaccgaaatctatcgcggcgcggaataccatgtcagcttcctgccaaaggtgaagatcgaggtcgcggtgtcggacgacatcgtggaccaggtcgtggacgtgattctgcagtccgcccacacgggcaagatcggcgacggcaagatcttcgtatccagcctggacagcgtcatccgcatccggacgcgcgagacgggagaagacgcgctgtga

SEQ ID NO: 62596 - protein, 112 aa, Acetobacter diazotrophicus
MKLVTAIIKPFKLDDVRESLTPLGIQGLTVSEVKGFGRQKGQTEIYRGAEYHVSFLPKVKIEVAVSDDIVDQVVDVILQSAHTGKIGDGKIFVSSLDSVIRIRTRETGEDAL

SEQ ID NO: 62597 - DNA, 339 bp, Acetobacter diazotrophicus
  CDS (1)..(339): transl_table=11
atgaaaaagatcgaggccatcatcaagcccttcaagctggacgaggtgaaggacgcccttcacgagatcggcctgatgggcatcacggtgaccgaggccaagggattcggccgccagaaaggccacaccgaactgtatcgcggcgccgaatacatcgtcgatttcctgccgaaggtgaagctggagatcgtctgcgccgacaacttggtggaccgcgccgtcgagacgatcatggccgccgcgcgcaccgggcgcatcggtgacggcaagatcttcatcctgccggtggaagacgtcatccgcatccgcaccggagagcacggcgaggaggccatctga

SEQ ID NO: 62598 - protein, 112 aa, Acetobacter diazotrophicus
MKKIEAIIKPFKLDEVKDALHEIGLMGITVTEAKGFGRQKGHTELYRGAEYIVDFLPKVKLEIVCADNLVDRAVETIMAAARTGRIGDGKIFILPVEDVIRIRTGEHGEEAI

SEQ ID NO: 62599 - DNA, 378 bp, Methanosarcina mazei
  CDS (1)..(378): transl_table=11
gtgaaagagattacggcaataatcaggatgaacagagtccagaaaaccaaggatgtcctccttgaatgcggctttccctcctttaccgtgagaagggtgatgggccgcggaaaacagaaaggactctgctttgaatttaacccacctctgccagaacctgaaaaggaagcagagacctgtattcacttcattccaaaacgcatgttcaccattgtggtggatgatgaaaatgtaaacgaagtggttcggaaaattatagaggtaaaccagaccggacatccgggagacggaaaaatattcgtatcaagtatcagcgaagcataccgcataaggaccggagaaagcggagaagcaaccgtgaataaggagatggtgtga

SEQ ID NO: 62600 - protein, 125 aa, Methanosarcina mazei
MKEITAIIRMNRVQKTKDVLLECGFPSFTVRRVMGRGKQKGLCFEFNPPLPEPEKEAETCIHFIPKRMFTIVVDDENVNEVVRKIIEVNQTGHPGDGKIFVSSISEAYRIRTGESGEATVNKEMV

SEQ ID NO: 62601 - DNA, 339 bp, Azospirillum brasilense
  CDS (1)..(339): transl_table=11
atgaagaagatcgaagccatcattaagccgttcaaactcgacgaagtgaaggaagcccttcacgaagtcggcatcaagggcatcaccgtcaccgaggccaagggcttcggccgtcagaaggggcacaccgagctgtaccgcggcgcggagtatgtggtcgacttcctgccgaaggtgaagatcgaggtggtgatggaggactccctggtggagcgggcgatcgaggcgatccagcaggccgcccacaccggccgcatcggcgacggcaagatcttcgtcacccccgtggaaagaattgtccgcatccggaccggcgagaagggaggcgacgcgatctga

SEQ ID NO: 62602 - protein, 112 aa, Azospirillum brasilense
MKKIEAIIKPFKLDEVKEALHEVGIKGITVTEAKGFGRQKGHTELYRGAEYVVDFLPKVKIEVVMEDSLVERAIEAIQQAAHTGRIGDGKIFVTPVERIVRIRTGEKGGDAI

SEQ ID NO: 62603 - DNA, 585 bp, Medicago sativa
  CDS (1)..(585)
atgactttgattgcgaaaccgaacgtgttcaacggtttgaattttaatatcaatgaaactcaaattcctttttcaagcttcagcgtcattcgcaagcgtttcggagattcttctcatcgcaatgtggtcctaagaagcaacggaaatgcttcggttcttcccaaaattagagctcaaaaccttcctgactatgttcctgaatccaagttttacaaagttgaagccattctcaggccatggagaatccctcaggtttcttcgggtttgttgaaaatgggaattcgtggtgtcactgtatctgatgtcaaggggtttggtgctcagggtggctcaaaagagaggcagggaggctctgaattttctgaagacaattttgttgccaaagttaaaatggaaatagtggtgagaaaagaccaggttgaggcagtgataaacaaaattatggagacggcaagaactggggagattggtgatggcaaaattttcttgatccctgtatctgatgtaataagaatccgcacaggtgagcgtggggagcaggctgagaggatggctgggggactaactgacgcgttgtatgtttga

SEQ ID NO: 62604 - protein, 194 aa, Medicago sativa
MTLIAKPNVFNGLNFNINETQIPFSSFSVIRKRFGDSSHRNVVLRSNGNASVLPKIRAQNLPDYVPESKFYKVEAILRPWRIPQVSSGLLKMGIRGVTVSDVKGFGAQGGSKERQGGSEFSEDNFVAKVKMEIVVRKDQVEAVINKIMETARTGEIGDGKIFLIPVSDVIRIRTGERGEQAERMAGGLTDALYV

SEQ ID NO: 62605 - DNA, 405 bp, Methanosarcina barkeri
  CDS (1)..(405): transl_table=11
atgaaagagattactgcgataattaggatgaacaaagcccagagaactaaagatgtcctgcttgaatgcggctttccttcatttaccataagaagggttatgggccgcgggaaacaaagagggctttgccatgaatttaatccccctctgccagatccggaaaaagaagctgagacctgtattcgcttcatcccaaaacgaatgttcacaatcgttgtggatgacgaaaatgtaagtgaagtggtccagaaaatcatagaagttaaccagaccggaaatgcaggagatggaaagattttcgtttcagacgttactgaagcaatccgtatccggactggagaaagcggagaggcgacagtaaataagagctggtataatgggagcagaaatagattcaagaattga

SEQ ID NO: 62606 - protein, 134 aa, Methanosarcina barkeri
MKEITAIIRMNKAQRTKDVLLECGFPSFTIRRVMGRGKQRGLCHEFNPPLPDPEKEAETCIRFIPKRMFTIVVDDENVSEVVQKIIEVNQTGNAGDGKIFVSDVTEAIRIRTGESGEATVNKSWYNGSRNRFKN

SEQ ID NO: 62607 - DNA, 339 bp, Azoarcus sp
  CDS (1)..(339): transl_table=11
atgaagaagatcgaagccatcatcaagccgttcaagctggacgaagtacgtgaagcgctctccgaggtcggtatcgccggcctcaccgtcaccgaggtcaagggtttcgggcgccagaaagggcacaccgaactctatcgcggcgccgaatacgtcgtggatttcctgcccaagatcaaggtcgaggtcgtggttgccgacgacatggtcgagcagaccatggacgccgtcatcaaggccgcccagaccggcaagatcggcgacggcaagatcttcgtcacgccagtggagcaggtggtgcgcatccgcaccggcgaaaccaacgaagccgcaatctga

SEQ ID NO: 62608 - protein, 112 aa, Azoarcus sp
MKKIEAIIKPFKLDEVREALSEVGIAGLTVTEVKGFGRQKGHTELYRGAEYVVDFLPKIKVEVVVADDMVEQTMDAVIKAAQTGKIGDGKIFVTPVEQVVRIRTGETNEAAI

SEQ ID NO: 62609 - DNA, 339 bp, Azoarcus sp
  CDS (1)..(339): transl_table=11
atgaagttcatcacagcgatcatcaagccgttcaagctcgacgaagtgcgggaagccctttccgcgatcggcgtgcagggcatcaccgtcaccgaggtcaagggcttcggccgccagaagggccacaccgagctgtaccgcggcgccgagtacgtcgtcgacttcctgcccaaggtgaagatcgaggcggcgatccgcgacgaactgctcgatcaggccatcgaggcgatcgagaagtccgcctccaccggcaagatcggtgacggcaagatctttgtcttcgacctggagcaggcgatccgcatccgcaccggagaaaccggggccgacgccctgtaa

SEQ ID NO: 62610 - protein, 112 aa, Azoarcus sp
MKFITAIIKPFKLDEVREALSAIGVQGITVTEVKGFGRQKGHTELYRGAEYVVDFLPKVKIEAAIRDELLDQAIEAIEKSASTGKIGDGKIFVFDLEQAIRIRTGETGADAL

SEQ ID NO: 62611 - DNA, 342 bp, Streptococcus thermophilus
  CDS (1)..(342): transl_table=11
atgaaaaaaatcgaagcgattattcgttcggataaattggaagatttgaaaaataccttgactggtagtggtttgactaagggaatgactgtgagtcaggtcttgggtcatgggacccaacgtggctttgcggagtttgtccgtggtcaacggattgttccgaccttattggctaaggttaaggtggaaatagtagtcaaggatctggcagttgatgaggttgtggatactatccgtagcgctgtggcgacaggcgaagtcggtgatgggaagatttttattgttcctattgatgatgtcattcgtattcgtactggcgaacggggcggagacgctatttaa

SEQ ID NO: 62612 - protein, 113 aa, Streptococcus thermophilus
MKKIEAIIRSDKLEDLKNTLTGSGLTKGMTVSQVLGHGTQRGFAEFVRGQRIVPTLLAKVKVEIVVKDLAVDEVVDTIRSAVATGEVGDGKIFIVPIDDVIRIRTGERGGDAI

SEQ ID NO: 62613 - DNA, 339 bp, Synechococcus sp
  CDS (1)..(339): transl_table=11
atgaaaaaagtagaagccattattcgccccttcaaactcgatgaagtcaaaatcgccctcgtcaatgcaggcatcgtcggcatgaccgtttctgaagttcgcggtttcggtcgccaaaaaggacaaacagaaagatatcgcggttctgagtacaccgttgaattcctccaaaagctcaagattgagattgtcatcgatgatgatcaagtagatgcagtcgttgacaaaattgttgcggcggcccggactggggaaatcggcgacgggaaaatctttatttctcctgtggatcaaattgtgcggatccggactggcgaaaaagacctcgaagctgtctaa

SEQ ID NO: 62614 - protein, 112 aa, Synechococcus sp
MKKVEAIIRPFKLDEVKIALVNAGIVGMTVSEVRGFGRQKGQTERYRGSEYTVEFLQKLKIEIVIDDDQVDAVVDKIVAAARTGEIGDGKIFISPVDQIVRIRTGEKDLEAV

SEQ ID NO: 62615 - DNA, 318 bp, nitrogen fixing bacterium ANFK33
  CDS (1)..(318): transl_table=11
atgaaaatgatacgagcaattgtccgccccgagatggcggacatggtaagcgaaggactggcagaatccggcttttattccatgacgaaaatggcggttttcgggcggggaaaacaaaaaggactcactgccggaaatctccactatgatgaacttcccaaaacactcatcatcattgtcgtagaagacagttcggtggacgaggtgataaaaatcatccagtacaaggcttatacgggcaacgaaggcgacggtaagatatttacatcgccggtcgaaaaagtattcacggtacgcacagggtcgaatgaactttaa

SEQ ID NO: 62616 - protein, 105 aa, nitrogen fixing bacterium ANFK33
MKMIRAIVRPEMADMVSEGLAESGFYSMTKMAVFGRGKQKGLTAGNLHYDELPKTLIIIVVEDSSVDEVIKIIQYKAYTGNEGDGKIFTSPVEKVFTVRTGSNEL

SEQ ID NO: 62617 - DNA, 339 bp, Klebsiella pneumoniae
  CDS (1)..(339): transl_table=11
atgaagctggttaccgtggtaatcaaaccattcaaactggaagatgtgcgtgaacgattatcttcaatgggtattcagggcctgacggtcactgaagttaaagggttcggccgtcagaaaggccacgcggagctctatcgcggcgccgaatacagcgtcaattttctaccgaaagtgaagattgatgtcgcgattgccgacgatcagctggacgaagtcgtcgatgtcatcagtaaagcggcgtacaccggaaagattggcgacggcaaaatctttgtcgccgagctgcagcgcgtgattcgcatccgtaccggcgaatctgacgaagccgcactgtaa

SEQ ID NO: 62618 - protein, 112 aa, Klebsiella pneumoniae
MKLVTVVIKPFKLEDVRERLSSMGIQGLTVTEVKGFGRQKGHAELYRGAEYSVNFLPKVKIDVAIADDQLDEVVDVISKAAYTGKIGDGKIFVAELQRVIRIRTGESDEAAL

SEQ ID NO: 62619 - DNA, 318 bp, Methanococcus maripaludis
  CDS (1)..(318): transl_table=11
atgaaaatgattagagcagtagtcagaccaagtaaagcagaagaagttgtagatgcactcgctgaatccggatgcgtagctttgacaaaaatggacgttattggaagaggaaaacaaaaaggaattaagattgaccagatttactacgatgaacttccaaaaacaatgctcatgctcgtagttgaagacgatgcagcagaaaatgtaattgaattgattacaaaaactgcatacacgggaagctttggtgacggtaagatattcgtaagtcctgtagatgaagcatacacagttagaacaagatcatgcggattataa

SEQ ID NO: 62620 - protein, 105 aa, Methanococcus maripaludis
MKMIRAVVRPSKAEEVVDALAESGCVALTKMDVIGRGKQKGIKIDQIYYDELPKTMLMLVVEDDAAENVIELITKTAYTGSFGDGKIFVSPVDEAYTVRTRSCGL

SEQ ID NO: 62621 - DNA, 318 bp, Methanococcus thermolithotrophicus
  CDS (1)..(318): transl_table=11
atgaagatgataaaggcaattgttaggccagataaagttgatgatattgtagattccttagaaaacgctggttatccagcatttacaaaaataaacagtgtgggaagaggtaagcaaggaggattgaaggttggtgaaatattctacgatgaattgccaaaaaccatattattaattgctgtaaatgacgacgaagtagatgaagttgtgggattgataaaatcttcagccagtactggaaactttggagatggtaaaatcttcatccaacctattactgaggcatatacaattagaaccggagaaacaggaatttaa

SEQ ID NO: 62622 - protein, 105 aa, Methanococcus thermolithotrophicus
MKMIKAIVRPDKVDDIVDSLENAGYPAFTKINSVGRGKQGGLKVGEIFYDELPKTILLIAVNDDEVDEVVGLIKSSASTGNFGDGKIFIQPITEAYTIRTGETGI

SEQ ID NO: 62623 - DNA, 372 bp, Methanosarcina barkeri
  CDS (1)..(372): transl_table=11
atgaaagaagttactgcagtcgttagacctaacaagatgtcggttacgaaagacgcactggataaaattggttatcgtcgtatgacggcaattccggtattaggaaagggtaaacaaagagggatctcaggagagcttaacttctacatacaaccaaagctgctcgcgaaaaggtacagcacaggtatgaagtacatacccaaaagacttctgagcatagttgtaaatgacgaagatgtggatcaggtgattaaaaccattattggagtcaatcaaactgcccagattggtgatggaaagatttttgtcgagtccattgacgaggttattcggatcaggactggcgaaaaaggagaactagctttaaaataa

SEQ ID NO: 62624 - protein, 123 aa, Methanosarcina barkeri
MKEVTAVVRPNKMSVTKDALDKIGYRRMTAIPVLGKGKQRGISGELNFYIQPKLLAKRYSTGMKYIPKRLLSIVVNDEDVDQVIKTIIGVNQTAQIGDGKIFVESIDEVIRIRTGEKGELALK

SEQ ID NO: 62625 - DNA, 369 bp, Methanobacterium ivanovii
  CDS (1)..(369): transl_table=11
atgaaagaaataatagcaattattcggcctaataaaatcaacaggacaaaggaggttctcgatgctttaggattttcatctatgactgcaaatgcagtttttggaaggggaagacagaaagcaatcgtgggggaagtgacctttgctatccagaataaagatcttcgtgaagaagaaggaagcatgcgttatattcctaaaaggatgatatcgctggttgtccctgatgaagatgcctctttggtggttgaatctataatgaaagtaaataaaacgggtcaaattggagacggtaaaatatttgtttgtcccatagaagacgcagttagagttagaacaaaagaatcaggagaagacgcaattttgtaa

SEQ ID NO: 62626 - protein, 122 aa, Methanobacterium ivanovii
MKEIIAIIRPNKINRTKEVLDALGFSSMTANAVFGRGRQKAIVGEVTFAIQNKDLREEEGSMRYIPKRMISLVVPDEDASLVVESIMKVNKTGQIGDGKIFVCPIEDAVRVRTKESGEDAIL

SEQ ID NO: 62627 - DNA, 348 bp, Methanobacterium thermoautotrophicum
  CDS (1)..(348): transl_table=11
gtgattttcatgaaggaaatagtggccataataagacctgaaaaactggaggaagttaaaaacgcccttgaagctgcagggtgccacggtatgactgtgacagaggtcagaggacgggggagacagctcggtataacagaaagttaccgtgggagggactacaggatagacctcctccccaagacaaagatcgagatagtggtgaatgatgaggacgtggacaccgtggttgaaacaatagttaaaagcgcccagaccggagacataggggacggaaaaatattcatatcaggggtagatgaggttgtgagaataagaaccggtgaaagtggaaaaaaagctgtttaa

SEQ ID NO: 62628 - protein, 115 aa, Methanobacterium thermoautotrophicum
MIFMKEIVAIIRPEKLEEVKNALEAAGCHGMTVTEVRGRGRQLGITESYRGRDYRIDLLPKTKIEIVVNDEDVDTVVETIVKSAQTGDIGDGKIFISGVDEVVRIRTGESGKKAV

SEQ ID NO: 62629 - DNA, 339 bp, Aquifex aeolicus
  CDS (1)..(339): transl_table=11
atgaaaaagatcgaggcgattattaaaccttttaagctcgacgaagtgaaggacgccctcgttgagataggcataggcggtatgaccgtaaccgaggtaaagggttttggtcagcagaagggccacacggagatttacaggggaactgagtacgtaattgactttctgccaaaggtaaagattgaagttgtcgtgagagacgaagacgtggaaaaggtggtggaaaccattgtgaaaactgcccagacgggaagggtaggggacggaaagatattcataattcctgttgaggatgtcataaggatcaggaccggtgaaagaggtgaacaagccatttaa

SEQ ID NO: 62630 - protein, 112 aa, Aquifex aeolicus
MKKIEAIIKPFKLDEVKDALVEIGIGGMTVTEVKGFGQQKGHTEIYRGTEYVIDFLPKVKIEVVVRDEDVEKVVETIVKTAQTGRVGDGKIFIIPVEDVIRIRTGERGEQAI

SEQ ID NO: 62631 - DNA, 339 bp, Azospirillum brasilense
  CDS (1)..(339): transl_table=11
atgaagaagatcgaagccatcattaagccgttcaaactcgacgaagtgaaggaagcccttcacgaagtcggcatcaagggcatcaccgtcaccgaggccaagggcttcggccgtcagaaggggcacaccgagctgtaccgcggcgcggagtatgtggtcgacttcctgccgaaggtgaagatcgaggtggtgatggaggactccctggtggagcgggcgatcgaggcgatccagcaggccgcccacaccggccgcatcggcgacggcaagatcttcgtcacccccgtggaagaagttgtccgcatccggaccggcgagaagggaggcgacgcgatctga

SEQ ID NO: 62632 - protein, 112 aa, Azospirillum brasilense
MKKIEAIIKPFKLDEVKEALHEVGIKGITVTEAKGFGRQKGHTELYRGAEYVVDFLPKVKIEVVMEDSLVERAIEAIQQAAHTGRIGDGKIFVTPVEEVVRIRTGEKGGDAI

SEQ ID NO: 62633 - DNA, 339 bp, Bradyrhizobium japonicum
  CDS (1)..(339)
atgaagaaaatcgaagccatcatcaagccgttcaagctcgacgaggtgaaggaagcgcttcaggaagtcggccttcagggcatcaccgtcaccgaggccaagggctttggccggcagaagggacacgccgagctttaccgcggcgcagaatacatcgtcgacttcctgcccaaggtgaagatcgagatcgtgatcggcgacgatctggtcgagcgcgccatcgacgcgatccgccgcgctgcgcagaccggtcgcatcggtgacggcaagattttcgtctccaacatcgaagaggcgatccgcatccgaaccggcgaatccgggctggacgctatctga

SEQ ID NO: 62634 - protein, 112 aa, Bradyrhizobium japonicum
MKKIEAIIKPFKLDEVKEALQEVGLQGITVTEAKGFGRQKGHAELYRGAEYIVDFLPKVKIEIVIGDDLVERAIDAIRRAAQTGRIGDGKIFVSNIEEAIRIRTGESGLDAI

SEQ ID NO: 62635 - DNA, 342 bp, Cyanidium caldarium
  CDS (1)..(342): transl_table=11
atgtttagcaaacttgaagcaattattaggccatttaaattagaagaggttaaagttagattaatgacttttggtgttccaggcatcactgttacaaatgtgatggggtgcggtaaacaaataggaggaatagaaagatcaaagggggtagaatatgattctgaattgatagagaaagtgaaaattgaaatagttgttatgaatgaacacatcgatgagttaatcgagataattatcaatgctgtatggactggtgaaattggggatggaaaaatattcgtcagccctgtttctagtgttattagaattagaactcaagataaagatttggatgctatttaa

SEQ ID NO: 62636 - protein, 113 aa, Cyanidium caldarium
MFSKLEAIIRPFKLEEVKVRLMTFGVPGITVTNVMGCGKQIGGIERSKGVEYDSELIEKVKIEIVVMNEHIDELIEIIINAVWTGEIGDGKIFVSPVSSVIRIRTQDKDLDAI

SEQ ID NO: 62637 - DNA, 339 bp, Fremyella diplosiphon
  CDS (1)..(339): transl_table=11
atgaaaaaagtagaagcgattatccgcccatttaagcttgatgaagtcaaaattgccttggttaatgcagggattgtcggtatgaccgtttctgaagttcgaggcttcggtagacaaaaaggtcaaactgaacgctatcgtggttcggagtacaccgttgaatttctgcaaaaactcaaagtagaaatcgtcgttgaagacaaccaagttgatatggtagtagataaaattattgctgctgcccgcactggtgaaattggtgatggtaagattttcatctctcctgtagagcaagttgtgcggattcgtactggagaaaaaaataccgaagccgtctaa

SEQ ID NO: 62638 - protein, 112 aa, Fremyella diplosiphon
MKKVEAIIRPFKLDEVKIALVNAGIVGMTVSEVRGFGRQKGQTERYRGSEYTVEFLQKLKVEIVVEDNQVDMVVDKIIAAARTGEIGDGKIFISPVEQVVRIRTGEKNTEAV

SEQ ID NO: 62639 - DNA, 339 bp, Haemophilus influenzae
  CDS (1)..(339): transl_table=11
atgaaaaaaatcgaagcaatgattaaaccctttaaattagacgatgtgcgagaaagtctttcagatattggtatttcaggtatgacaatcacagaagtacgcggatttggtcgtcaaaaaggtcatacagaactttatcgtggtgcggaatatatggtggattttctgccgaaagtgaaattggaagtggtagttcctgatgagcttgtggatcaatgtattgaagcgattattgaaacggcacaaacaggtaaaatcggtgacggcaaaatttttgtttatcacgttgagagagccatccgcattcgcacgggcgaagaaaacgaggatgcgatttag

SEQ ID NO: 62640 - protein, 112 aa, Haemophilus influenzae
MKKIEAMIKPFKLDDVRESLSDIGISGMTITEVRGFGRQKGHTELYRGAEYMVDFLPKVKLEVVVPDELVDQCIEAIIETAQTGKIGDGKIFVYHVERAIRIRTGEENEDAI

SEQ ID NO: 62641 - DNA, 339 bp, Mycobacterium bovis
  CDS (1)..(339): transl_table=11
atgaagctgatcactgcgatcgtgaagccgttcacgctcgacgacgtcaagacgagcctcgaggacgcgggagtgctggggatgacggtcagtgaaatccagggatacggacggcagaagggccacacggaggtttaccgcggggccgaatactcggtggatttcgtaccgaaggttcggatcgaggtcgttgttgacgattccattgtcgataaggtcgtggacagcattgtccgggcggcgcgcaccggcaagatcggcgacggcaaggtgtgggtgagtccggtagacaccatcgtgcgggtgcgcaccggtgaacgcggacacgacgcgttatga

SEQ ID NO: 62642 - protein, 112 aa, Mycobacterium bovis
MKLITAIVKPFTLDDVKTSLEDAGVLGMTVSEIQGYGRQKGHTEVYRGAEYSVDFVPKVRIEVVVDDSIVDKVVDSIVRAARTGKIGDGKVWVSPVDTIVRVRTGERGHDAL

SEQ ID NO: 62643 - DNA, 339 bp, Pasteurella multocida
  CDS (1)..(339): transl_table=11
atgaaaaagattgaagcaatcattaaacctttcaaattagatgacgtacgtgaaagtttatctgatgtgggtattaccgggatgacggttacagaagtgcgtggatttggacgtcaaaaaggacatactgaactttatcgtggtgccgaatatatggtggattttctgccgaaagtcaaaatggaaattgtcgtgactgatgagcaagtggatcaatgtattgaagccattatggaaaccgcacaaactgggaaaattggtgacggcaagatttttgtgtatgacgttgaacgtgtcatccgaatccgtactggggaagaaaacgaggacgcaatctaa

SEQ ID NO: 62644 - protein, 112 aa, Pasteurella multocida
MKKIEAIIKPFKLDDVRESLSDVGITGMTVTEVRGFGRQKGHTELYRGAEYMVDFLPKVKMEIVVTDEQVDQCIEAIMETAQTGKIGDGKIFVYDVERVIRIRTGEENEDAI

SEQ ID NO: 62645 - DNA, 339 bp, Porphyra purpurea
  CDS (1)..(339)
atgaaaaaaattgaagctatcatcagacctttcaagttgaatgaagtaaaacttgcattagtaaaaggaggtattggaggtatgaccgttgttaaagtatccggatttgggcgacagaagggtcaaaccgagaggtataaaggttccgaatattctatagatataatagataaaatcaaaattgaaataattgtaagtgatgacaaagtaaatagcattacagaaataatcattaaaacagcaaaaaccggagaaattggagatggtaaaatttttattagtgatgttgaacaagttataagaattaggacaaacgacttaaattctgcagctttgtaa

SEQ ID NO: 62646 - protein, 112 aa, Porphyra purpurea
MKKIEAIIRPFKLNEVKLALVKGGIGGMTVVKVSGFGRQKGQTERYKGSEYSIDIIDKIKIEIIVSDDKVNSITEIIIKTAKTGEIGDGKIFISDVEQVIRIRTNDLNSAAL

SEQ ID NO: 62647 - DNA, 339 bp, Rhizobium meliloti
  CDS (1)..(339): transl_table=11
atgaaaaagatcgaagcgatcattaagcctttcaagctcgacgaagtgaaggaagcccttcaggaggtcggcctgcaggggatcaccgtcacggaagccaagggcttcgggcggcagaagggacatacggagctctaccgcggcgcagaatacgtcgtcgacttcctgccgaaggtgaaggtcgaagtggtgctggcggacgaaaatgcggaggccgtgatcgaagccatccgcaatgccgcgcaaaccggccgcatcggcgatggcaagattttcgtatctaatgtggaagaagtgatccgcatccgtaccggcgaaaccggcctcgacgccatctga

SEQ ID NO: 62648 - protein, 112 aa, Rhizobium meliloti
MKKIEAIIKPFKLDEVKEALQEVGLQGITVTEAKGFGRQKGHTELYRGAEYVVDFLPKVKVEVVLADENAEAVIEAIRNAAQTGRIGDGKIFVSNVEEVIRIRTGETGLDAI

SEQ ID NO: 62649 - DNA, 339 bp, Rhodobacter capsulatus
  CDS (1)..(339): transl_table=11
atgaagaaggtcgaggcgatcatcaagccgttcaagctcgatgaagtgaaggaagcgcttcaggaagcggggattcaagggctgagcgtgatcgaggtgaaaggcttcgggcggcaaaagggccataccgagctgtatcgcggggccgaatatgtcgtcgacttcctgcccaaggtgaagatcgagatggttctgcccgacgagatggtcgatatcgccatcgaggccatcgtcggcgccgcccgcaccgaaaagatcggcgacgggaagatcttcgtctcctccatcgaacaggcgatccgcatccgcaccggcgagaccggcgaggacgcggtctga

SEQ ID NO: 62650 - protein, 112 aa, Rhodobacter capsulatus
MKKVEAIIKPFKLDEVKEALQEAGIQGLSVIEVKGFGRQKGHTELYRGAEYVVDFLPKVKIEMVLPDEMVDIAIEAIVGAARTEKIGDGKIFVSSIEQAIRIRTGETGEDAV

SEQ ID NO: 62651 - DNA, 339 bp, Rhodobacter sphaeroides
  CDS (1)..(339): transl_table=11
gtgaagaagatcgaggcgatcatcaagccgttcaagctcgacgaagtgaaagaggcgctgcaggccgccggcgtgcagggactttcggtgaccgaggtcaagggcttcggacgccagaagggccacaccgagctttaccgcggggcggcatatgtcgtggacttcctcccgaaggtgaagatcgaggtcgtcctcgcggacgatatggtcgaggccgcggtcgaagcgatcgtctccgcctcgcgcaccgacaagatcggcgacggcaagatcttcattagccccgtcgagcaggcgatccgcatccgcaccggcgagaccggcgaagacgcggtctga

SEQ ID NO: 62652 - protein, 112 aa, Rhodobacter sphaeroides
MKKIEAIIKPFKLDEVKEALQAAGVQGLSVTEVKGFGRQKGHTELYRGAAYVVDFLPKVKIEVVLADDMVEAAVEAIVSASRTDKIGDGKIFISPVEQAIRIRTGETGEDAV

SEQ ID NO: 62653 - DNA, 339 bp, Escherichia coli
  CDS (1)..(339): transl_table=11
atgaagctggtgaccgtgataatcaaaccattcaagctggaagacgttcgtgaagcgttatcttccattggtattcagggcctgaccgtcaccgaagtgaaaggtttcgggcgtcagaaagggcatgccgagctgtaccggggggcggaatacagcgtcaatttcctgccaaaagtaaaaattgatgtggcgattgctgatgaccaactcgatgaagtgatcgatatcgtcagtaaggcggcttacaccggaaaaattggcgacggcaaaatcttcgtcgctgaattgcaacgcgtcattcgtattcgtaccggcgaagccgacgaagcggcgctgtaa

SEQ ID NO: 62654 - protein, 112 aa, Escherichia coli
MKLVTVIIKPFKLEDVREALSSIGIQGLTVTEVKGFGRQKGHAELYRGAEYSVNFLPKVKIDVAIADDQLDEVIDIVSKAAYTGKIGDGKIFVAELQRVIRIRTGEADEAAL

SEQ ID NO: 62655 - DNA, 351 bp, Bacillus subtilis
  CDS (1)..(351): transl_table=11
atgagcggtcaaatgttcaaggtagaaattgtaacgcgtccggcaaattttgaaaagctgaagcaggaactcggaaaaatcggagtgacctctctgactttctccaatgtacacggctgcggccttcaaaaagcacatacggagctctatcgaggggtaaaaatagaaagcaatgtatacgagcgtttaaaaatagaaattgtggtcagcaaggttcctgttgatcaagtgacagagaccgctaaaagggtgctgaaaacgggatcaccaggtgacggtaaaatatttgtctatgaaatcagcaatacgatcaacatccgcacaggcgaagaaggacctgaagcactttaa

SEQ ID NO: 62656 - protein, 116 aa, Bacillus subtilis
MSGQMFKVEIVTRPANFEKLKQELGKIGVTSLTFSNVHGCGLQKAHTELYRGVKIESNVYERLKIEIVVSKVPVDQVTETAKRVLKTGSPGDGKIFVYEISNTINIRTGEEGPEAL

SEQ ID NO: 62657 - DNA, 339 bp, Methanococcus jannaschii
  CDS (1)..(339): transl_table=11
atgaaaaaagttgaagcaatcataagaccggagaagttggagattgttaaaaaggctttgtctgatgctgggtatgttggaatgactgttagtgaggttaagggtaggggagttcaaggtggaatagttgagaggtatagggggagagagtatattgttgatttaattccaaaggttaagattgagttggttgtaaaagaggaagatgttgataatgttattgatatcatatgcgagaatgcaagaacaggaaacccaggagatggaaaaatcttcgtcataccagtagaaagagtcgtaagagtaagaacaaaagaagaaggaaaagaggcattataa

SEQ ID NO: 62658 - protein, 112 aa, Methanococcus jannaschii
MKKVEAIIRPEKLEIVKKALSDAGYVGMTVSEVKGRGVQGGIVERYRGREYIVDLIPKVKIELVVKEEDVDNVIDIICENARTGNPGDGKIFVIPVERVVRVRTKEEGKEAL

SEQ ID NO: 62659 - DNA, 26 bp, Primer
atgaaaaagattgatgcgattataaa

SEQ ID NO: 62660 - DNA, 23 bp, Primer
ttaaattgccgcgtcgtcctctt

SEQ ID NO: 62661 - protein, 130 aa, consensus
  MISC_FEATURE (1)..(130): consensus for the disclosure of xaa see table XV
MKXXXAIXXPXKLXXVXXALXXXGXXXGXTVXXXXGXGXQXGXXXEXYRGXXXXXXXXXXXXXXXXXXXXXXKXKXEXXXXXXXXXXXXXXXIXXXAXXXXTGXXGDGKIFXXXXXXXXRIRTGEXXXXA

SEQ ID NO: 62662 - protein, 42 aa, consensus
  MISC_FEATURE (1)..(42): consensus for the disclosure of xaa see table XV
XXXXXXXXXXXXXXXXXXXLXXXXXXXXXXXXXXXGXGXXXX

SEQ ID NO: 62663 - protein, 24 aa, consensus
  MISC_FEATURE (1)..(24): consensus for the disclosure of xaa see table XV
XXXXGDGXXXXXXXXXXXXXXTXX

SEQ ID NO: 62664 - DNA, 681 bp, Escherichia coli K12; identical to SEQ ID NO: 30948
  CDS (1)..(681)

SEQ ID NO: 62665 - protein, 226 aa, Escherichia coli K12; identical to SEQ ID NO: 30949

SEQ ID NO: 62666 - DNA, 738 bp, Pseudomonas sp; identical to SEQ ID NO: 30950
  CDS (1)..(738)

SEQ ID NO: 62667 - protein, 245 aa, Pseudomonas sp; identical to SEQ ID NO: 30951

SEQ ID NO: 62668 - DNA, 678 bp, Salmonella enterica subsp. enterica serovar Typhi; identical to SEQ ID NO: 30952
  CDS (1)..(678)

SEQ ID NO: 62669 - protein, 225 aa, Salmonella enterica subsp. enterica serovar Typhi; identical to SEQ ID NO: 30953

SEQ ID NO: 62670 - DNA, 675 bp, Sinorhizobium meliloti; identical to SEQ ID NO: 30954
  CDS (1)..(675)

SEQ ID NO: 62671 - protein, 224 aa, Sinorhizobium meliloti; identical to SEQ ID NO: 30955

SEQ ID NO: 62672 - DNA, 923 bp, Pseudomonas pseudoalcaligenes; identical to SEQ ID NO: 30956
  CDS (95)..(832)

SEQ ID NO: 62673 - protein, 245 aa, Pseudomonas pseudoalcaligenes; identical to SEQ ID NO: 30957

SEQ ID NO: 62674 - DNA, 681 bp, Bacillus licheniformis DSM 13; identical to SEQ ID NO: 30958
  CDS (1)..(681)

SEQ ID NO: 62675 - protein, 226 aa, Bacillus licheniformis DSM 13; identical to SEQ ID NO: 30959

SEQ ID NO: 62676 - DNA, 654 bp, Photobacterium profundum; identical to SEQ ID NO: 30960
  CDS (1)..(654)

SEQ ID NO: 62677 - protein, 217 aa, Photobacterium profundum; identical to SEQ ID NO: 30961

SEQ ID NO: 62678 - DNA, 732 bp, Rhodopseudomonas palustris; identical to SEQ ID NO: 30962
  CDS (1)..(732)

SEQ ID NO: 62679 - protein, 243 aa, Rhodopseudomonas palustris; identical to SEQ ID NO: 30963

SEQ ID NO: 62680 - DNA, 711 bp, Rhodopseudomonas palustris; identical to SEQ ID NO: 30964
  CDS (1)..(711)

SEQ ID NO: 62681 - protein, 236 aa, Rhodopseudomonas palustris; identical to SEQ ID NO: 30965

SEQ ID NO: 62682 - DNA, 666 bp, Rhodopseudomonas palustris; identical to SEQ ID NO: 30966
  CDS (1)..(666)

SEQ ID NO: 62683 - protein, 221 aa, Rhodopseudomonas palustris; identical to SEQ ID NO: 30967

SEQ ID NO: 62684 - DNA, 738 bp, Rhizobium sp; identical to SEQ ID NO: 30968
  CDS (1)..(738)

SEQ ID NO: 62685 - protein, 245 aa, Rhizobium sp; identical to SEQ ID NO: 30969

SEQ ID NO: 62686 - DNA, 720 bp, Rhizobium sp; identical to SEQ ID NO: 30970
  CDS (1)..(720)

SEQ ID NO: 62687 - protein, 239 aa, Rhizobium sp; identical to SEQ ID NO: 30971

SEQ ID NO: 62688 - DNA, 675 bp, Chromobacterium violaceum; identical to SEQ ID NO: 30972
  CDS (1)..(675)

SEQ ID NO: 62689 - protein, 224 aa, Chromobacterium violaceum; identical to SEQ ID NO: 30973

SEQ ID NO: 62690 - DNA, 663 bp, Bordetella parapertussis; identical to SEQ ID NO: 30974
  CDS (1)..(663)

SEQ ID NO: 62691 - protein, 220 aa, Bordetella parapertussis; identical to SEQ ID NO: 30975

SEQ ID NO: 62692 - DNA, 711 bp, Bordetella parapertussis; identical to SEQ ID NO: 30976
  CDS (1)..(711)

SEQ ID NO: 62693 - protein, 236 aa, Bordetella parapertussis; identical to SEQ ID NO: 30977

SEQ ID NO: 62694 - DNA, 741 bp, Bordetella parapertussis; identical to SEQ ID NO: 30978
  CDS (1)..(741)

SEQ ID NO: 62695 - protein, 246 aa, Bordetella parapertussis; identical to SEQ ID NO: 30979

SEQ ID NO: 62696 - DNA, 657 bp, Bordetella bronchiseptica; identical to SEQ ID NO: 30980
  CDS (1)..(657)

SEQ ID NO: 62697 - protein, 218 aa, Bordetella bronchiseptica; identical to SEQ ID NO: 30981

SEQ ID NO: 62698 - DNA, 945 bp, Wautersia oxalatica; identical to SEQ ID NO: 30982
  CDS (1)..(945)

SEQ ID NO: 62699 - protein, 314 aa, Wautersia oxalatica; identical to SEQ ID NO: 30983

SEQ ID NO: 62700 - DNA, 699 bp, Ralstonia sp; identical to SEQ ID NO: 30984
  CDS (1)..(699)

SEQ ID NO: 62701 - protein, 232 aa, Ralstonia sp; identical to SEQ ID NO: 30985

SEQ ID NO: 62702 - DNA, 675 bp, Vibrio parahaemolyticus; identical to SEQ ID NO: 30986
  CDS (1)..(675)

SEQ ID NO: 62703 - protein, 224 aa, Vibrio parahaemolyticus; identical to SEQ ID NO: 30987

SEQ ID NO: 62704 - DNA, 669 bp, Vibrio parahaemolyticus; identical to SEQ ID NO: 30988
  CDS (1)..(669)

SEQ ID NO: 62705 - protein, 222 aa, Vibrio parahaemolyticus; identical to SEQ ID NO: 30989

SEQ ID NO: 62706 - DNA, 729 bp, Pseudomonas syringae; identical to SEQ ID NO: 30990
  CDS (31)..(729)

SEQ ID NO: 62707 - protein, 232 aa, Pseudomonas syringae; identical to SEQ ID NO: 30991

SEQ ID NO: 62708 - DNA, 696 bp, Pseudomonas putida; identical to SEQ ID NO: 30992
  CDS (1)..(696)

SEQ ID NO: 62709 - protein, 231 aa, Pseudomonas putida; identical to SEQ ID NO: 30993

SEQ ID NO: 62710 - DNA, 717 bp, Pseudomonas putida; identical to SEQ ID NO: 30994
  CDS (1)..(717)

SEQ ID NO: 62711 - protein, 238 aa, Pseudomonas putida; identical to SEQ ID NO: 30995

SEQ ID NO: 62712 - DNA, 774 bp, Bradyrhizobium japonicum; identical to SEQ ID NO: 30996
  CDS (1)..(774)

SEQ ID NO: 62713 - protein, 257 aa, Bradyrhizobium japonicum; identical to SEQ ID NO: 30997

SEQ ID NO: 62714 - DNA, 693 bp, Bradyrhizobium japonicum; identical to SEQ ID NO: 30998
  CDS (1)..(693)

SEQ ID NO: 62715 - protein, 230 aa, Bradyrhizobium japonicum; identical to SEQ ID NO: 30999

SEQ ID NO: 62716 - DNA, 924 bp, Bradyrhizobium japonicum; identical to SEQ ID NO: 31000
  CDS (1)..(924)

SEQ ID NO: 62717 - protein, 307 aa, Bradyrhizobium japonicum; identical to SEQ ID NO: 31001

SEQ ID NO: 62718 - DNA, 720 bp, Bradyrhizobium japonicum; identical to SEQ ID NO: 31002
  CDS (1)..(720)

SEQ ID NO: 62719 - protein, 239 aa, Bradyrhizobium japonicum; identical to SEQ ID NO: 31003

SEQ ID NO: 62720 - DNA, 627 bp, Vibrio vulnificus; identical to SEQ ID NO: 31004
  CDS (1)..(627)

SEQ ID NO: 62721 - protein, 208 aa, Vibrio vulnificus; identical to SEQ ID NO: 31005

SEQ ID NO: 62722 - DNA, 672 bp, Shewanella oneidensis; identical to SEQ ID NO: 31006
  CDS (1)..(672)

SEQ ID NO: 62723 - protein, 223 aa, Shewanella oneidensis; identical to SEQ ID NO: 31007

SEQ ID NO: 62724 - DNA, 675 bp, Xanthomonas campestris; identical to SEQ ID NO: 31008
  CDS (1)..(675)

SEQ ID NO: 62725 - protein, 224 aa, Xanthomonas campestris; identical to SEQ ID NO: 31009

SEQ ID NO: 62726 - DNA, 675 bp, Xanthomonas axonopodis; identical to SEQ ID NO: 31010
  CDS (1)..(675)

SEQ ID NO: 62727 - protein, 224 aa, Xanthomonas axonopodis; identical to SEQ ID NO: 31011

SEQ ID NO: 62728 - DNA, 765 bp, Pseudomonas sp; identical to SEQ ID NO: 31012
  CDS (1)..(765)

SEQ ID NO: 62729 - protein, 254 aa, Pseudomonas sp; identical to SEQ ID NO: 31013

SEQ ID NO: 62730 - DNA, 762 bp, Rhizobium loti; identical to SEQ ID NO: 31014
  CDS (1)..(762)

SEQ ID NO: 62731 - protein, 253 aa, Rhizobium loti; identical to SEQ ID NO: 31015

SEQ ID NO: 62732 - DNA, 663 bp, Rhizobium loti; identical to SEQ ID NO: 31016
  CDS (1)..(663)

SEQ ID NO: 62733 - protein, 220 aa, Rhizobium loti; identical to SEQ ID NO: 31017

SEQ ID NO: 62734 - DNA, 744 bp, Rhizobium loti; identical to SEQ ID NO: 31018
  CDS (1)..(744)

SEQ ID NO: 62735 - protein, 247 aa, Rhizobium loti; identical to SEQ ID NO: 31019

SEQ ID NO: 62736 - DNA, 780 bp, Rhizobium loti; identical to SEQ ID NO: 31020
  CDS (1)..(780)

SEQ ID NO: 62737 - protein, 259 aa, Rhizobium loti; identical to SEQ ID NO: 31021

SEQ ID NO: 62738 - DNA, 693 bp, Streptomyces coelicolor; identical to SEQ ID NO: 31022
  CDS (1)..(693)

SEQ ID NO: 62739 - protein, 230 aa, Streptomyces coelicolor; identical to SEQ ID NO: 31023

SEQ ID NO: 62740 - DNA, 732 bp, Alcaligenes eutrophus; identical to SEQ ID NO: 31024
  CDS (1)..(732)

SEQ ID NO: 62741 - protein, 243 aa, Alcaligenes eutrophus; identical to SEQ ID NO: 31025

SEQ ID NO: 62742 - DNA, 741 bp, Rhodococcus sp; identical to SEQ ID NO: 31026
  CDS (1)..(741)

SEQ ID NO: 62743 - protein, 246 aa, Rhodococcus sp; identical to SEQ ID NO: 31027

SEQ ID NO: 62744 - DNA, 780 bp, Comamonas testosteroni; identical to SEQ ID NO: 31028
  CDS (25)..(744)

SEQ ID NO: 62745 - protein, 239 aa, Comamonas testosteroni; identical to SEQ ID NO: 31029

SEQ ID NO: 62746 - DNA, 666 bp, Photobacterium leiognathi; identical to SEQ ID NO: 31030
  CDS (1)..(666)

SEQ ID NO: 62747 - protein, 221 aa, Photobacterium leiognathi; identical to SEQ ID NO: 31031

SEQ ID NO: 62748 - DNA, 22 bp, Primer
atgatcaggagtcacaccatga

SEQ ID NO: 62749 - DNA, 21 bp, Primer
ttaattgccagccatcgcctg

SEQ ID NO: 62750 - protein, 178 aa, consensus; identical to SEQ ID NO: 31034
  MISC_FEATURE (1)..(178): consensus for the disclosure of xaa see table XV

SEQ ID NO: 62751 - protein, 81 aa, consensus; identical to SEQ ID NO: 31035
  MISC_FEATURE (1)..(81): consensus for the disclosure of xaa see table XV

SEQ ID NO: 62752 - protein, 12 aa, consensus
  MISC_FEATURE (1)..(12): consensus for the disclosure of xaa see table XV
XXXXXXXXXXXX

SEQ ID NO: 62753 - DNA, 1440 bp, Escherichia coli; identical to SEQ ID NO: 45264
  CDS (1)..(1440)

SEQ ID NO: 62754 - protein, 479 aa, Escherichia coli; identical to SEQ ID NO: 45265

SEQ ID NO: 62755 - DNA, 1230 bp, Thermococcus kodakaraensis; identical to SEQ ID NO: 45266
  CDS (1)..(1230)

SEQ ID NO: 62756 - protein, 409 aa, Thermococcus kodakaraensis; identical to SEQ ID NO: 45267

SEQ ID NO: 62757 - DNA, 1491 bp, Vibrio fischeri ES114; identical to SEQ ID NO: 45268
  CDS (1)..(1491)

SEQ ID NO: 62758 - protein, 496 aa, Vibrio fischeri ES114; identical to SEQ ID NO: 45269

SEQ ID NO: 62759 - DNA, 1011 bp, Archaeoglobus fulgidus DSM 4304; identical to SEQ ID NO: 45270
  CDS (1)..(1011): transl_table=11

SEQ ID NO: 62760 - protein, 336 aa, Archaeoglobus fulgidus DSM 4304; identical to SEQ ID NO: 45271

SEQ ID NO: 62761 - DNA, 1467 bp, Archaeoglobus fulgidus DSM 4304; identical to SEQ ID NO: 45272
  CDS (1)..(1467): transl_table=11

SEQ ID NO: 62762 - protein, 488 aa, Archaeoglobus fulgidus DSM 4304; identical to SEQ ID NO: 45273

SEQ ID NO: 62763 - DNA, 1230 bp, Pyrococcus abyssi GE5; identical to SEQ ID NO: 45274
  CDS (1)..(1230): transl_table=11

SEQ ID NO: 62764 - protein, 409 aa, Pyrococcus abyssi GE5; identical to SEQ ID NO: 45275

SEQ ID NO: 62765 - DNA, 1236 bp, Pyrococcus horikoshii OT3; identical to SEQ ID NO: 45276
  CDS (1)..(1236): transl_table=11

SEQ ID NO: 62766 - protein, 411 aa, Pyrococcus horikoshii OT3; identical to SEQ ID NO: 45277

SEQ ID NO: 62767 - DNA, 1197 bp, Thermotoga maritima MSB8; identical to SEQ ID NO: 45278
  CDS (1)..(1197): transl_table=11

SEQ ID NO: 62768 - protein, 398 aa, Thermotoga maritima MSB8; identical to SEQ ID NO: 45279

SEQ ID NO: 62769 - DNA, 1158 bp, Methanothermobacter thermautotrophicus str. Delta H; identical to SEQ ID NO: 45280
  CDS (1)..(1158): transl_table=11

SEQ ID NO: 62770 - protein, 385 aa, Methanothermobacter thermautotrophicus str. Delta H; identical to SEQ ID NO: 45281

SEQ ID NO: 62771 - DNA, 1233 bp, Methanothermobacter thermautotrophicus str. Delta H; identical to SEQ ID NO: 45282
  CDS (1)..(1233): transl_table=11

SEQ ID NO: 62772 - protein, 410 aa, Methanothermobacter thermautotrophicus str. Delta H; identical to SEQ ID NO: 45283

SEQ ID NO: 62773 - DNA, 1230 bp, Methanothermobacter thermautotrophicus str. Delta H; identical to SEQ ID NO: 45284
  CDS (1)..(1230): transl_table=11

SEQ ID NO: 62774 - protein, 409 aa, Methanothermobacter thermautotrophicus str. Delta H; identical to SEQ ID NO: 45285

SEQ ID NO: 62775 - DNA, 1179 bp, Clostridium acetobutylicum ATCC 824; identical to SEQ ID NO: 45286
  CDS (1)..(1179): transl_table=11

SEQ ID NO: 62776 - protein, 392 aa, Clostridium acetobutylicum ATCC 824; identical to SEQ ID NO: 45287

SEQ ID NO: 62777 - DNA, 1203 bp, Clostridium acetobutylicum ATCC 824; identical to SEQ ID NO: 45288
  CDS (1)..(1203): transl_table=11

SEQ ID NO: 62778 - protein, 400 aa, Clostridium acetobutylicum ATCC 824; identical to SEQ ID NO: 45289

SEQ ID NO: 62779 - DNA, 1122 bp, Clostridium perfringens str. 13; identical to SEQ ID NO: 45290
  CDS (1)..(1122): transl_table=11

SEQ ID NO: 62780 - protein, 373 aa, Clostridium perfringens str. 13; identical to SEQ ID NO: 45291

SEQ ID NO: 62781 - DNA, 1221 bp, Clostridium perfringens str. 13; identical to SEQ ID NO: 45292
  CDS (1)..(1221): transl_table=11

SEQ ID NO: 62782 - protein, 406 aa, Clostridium perfringens str. 13; identical to SEQ ID NO: 45293

SEQ ID NO: 62783 - DNA, 2637 bp, Clostridium perfringens str. 13; identical to SEQ ID NO: 45294
  CDS (1)..(2637): transl_table=11

SEQ ID NO: 62784 - protein, 878 aa, Clostridium perfringens str. 13; identical to SEQ ID NO: 45295

SEQ ID NO: 62785 - DNA, 1176 bp, Pyrococcus furiosus DSM 3638; identical to SEQ ID NO: 45296
  CDS (1)..(1176): transl_table=11

SEQ ID NO: 62786 - protein, 391 aa, Pyrococcus furiosus DSM 3638; identical to SEQ ID NO: 45297

SEQ ID NO: 62787 - DNA, 1245 bp, Pyrococcus furiosus DSM 3638; identical to SEQ ID NO: 45298
  CDS (1)..(1245): transl_table=11

SEQ ID NO: 62788 - protein, 414 aa, Pyrococcus furiosus DSM 3638; identical to SEQ ID NO: 45299

SEQ ID NO: 62789 - DNA, 1212 bp, Fusobacterium nucleatum subsp. nucleatum ATCC 25586; identical to SEQ ID NO: 45300
  CDS (1)..(1212): transl_table=11

SEQ ID NO: 62790 - protein, 403 aa, Fusobacterium nucleatum subsp. nucleatum ATCC 25586; identical to SEQ ID NO: 45301

SEQ ID NO: 62791 - DNA, 1218 bp, Fusobacterium nucleatum subsp. nucleatum ATCC 25586; identical to SEQ ID NO: 45302
  CDS (1)..(1218): transl_table=11

SEQ ID NO: 62792 - protein, 405 aa, Fusobacterium nucleatum subsp. nucleatum ATCC 25586; identical to SEQ ID NO: 45303

SEQ ID NO: 62793 - DNA, 1248 bp, Methanosarcina acetivorans C2A; identical to SEQ ID NO: 45304
  CDS (1)..(1248): transl_table=11

SEQ ID NO: 62794 - protein, 415 aa, Methanosarcina acetivorans C2A; identical to SEQ ID NO: 45305

SEQ ID NO: 62795 - DNA, 1218 bp, Methanosarcina acetivorans C2A; identical to SEQ ID NO: 45306
  CDS (1)..(1218): transl_table=11

SEQ ID NO: 62796 - protein, 405 aa, Methanosarcina acetivorans C2A; identical to SEQ ID NO: 45307

SEQ ID NO: 62797 - DNA, 1179 bp, Thermoanaerobacter tengcongensis MB4; identical to SEQ ID NO: 45308
  CDS (1)..(1179): transl_table=11

SEQ ID NO: 62798 - protein, 392 aa, Thermoanaerobacter tengcongensis MB4; identical to SEQ ID NO: 45309

SEQ ID NO: 62799 - DNA, 1197 bp, Methanosarcina mazei Go1; identical to SEQ ID NO: 45310
  CDS (1)..(1197): transl_table=11

SEQ ID NO: 62800 - protein, 398 aa, Methanosarcina mazei Go1; identical to SEQ ID NO: 45311

SEQ ID NO: 62801 - DNA, 1227 bp, Chlorobium tepidum TLS; identical to SEQ ID NO: 45312
  CDS (1)..(1227): transl_table=11

SEQ ID NO: 62802 - protein, 408 aa, Chlorobium tepidum TLS; identical to SEQ ID NO: 45313

SEQ ID NO: 62803 - DNA, 1200 bp, Clostridium tetani E88; identical to SEQ ID NO: 45314
  CDS (1)..(1200): transl_table=11

SEQ ID NO: 62804 - protein, 399 aa, Clostridium tetani E88; identical to SEQ ID NO: 45315

SEQ ID NO: 62805 - DNA, 1188 bp, Clostridium tetani E88; identical to SEQ ID NO: 45316
  CDS (1)..(1188): transl_table=11

SEQ ID NO: 62806 - protein, 395 aa, Clostridium tetani E88; identical to SEQ ID NO: 45317

SEQ ID NO: 62807 - DNA, 1248 bp, Clostridium tetani E88; identical to SEQ ID NO: 45318
  CDS (1)..(1248): transl_table=11

SEQ ID NO: 62808 - protein, 415 aa, Clostridium tetani E88; identical to SEQ ID NO: 45319

SEQ ID NO: 62809 - DNA, 1197 bp, Bacteroides thetaiotaomicron VPI-5482; identical to SEQ ID NO: 45320
  CDS (1)..(1197): transl_table=11

SEQ ID NO: 62810 - protein, 398 aa, Bacteroides thetaiotaomicron VPI-5482; identical to SEQ ID NO: 45321

SEQ ID NO: 62811 - DNA, 1845 bp, Prochlorococcus marinus subsp. marinus str. CCMP1375; identical to SEQ ID NO: 45322
  CDS (1)..(1845): transl_table=11

SEQ ID NO: 62812 - protein, 614 aa, Prochlorococcus marinus subsp. marinus str. CCMP1375; identical to SEQ ID NO: 45323

SEQ ID NO: 62813 - DNA, 1773 bp, Prochlorococcus marinus subsp. marinus str. CCMP1375; identical to SEQ ID NO: 45324
  CDS (1)..(1773): transl_table=11

SEQ ID NO: 62814 - protein, 590 aa, Prochlorococcus marinus subsp. marinus str. CCMP1375; identical to SEQ ID NO: 45325

SEQ ID NO: 62815 - DNA, 1776 bp, Prochlorococcus marinus subsp. pastoris str. CCMP1986; identical to SEQ ID NO: 45326
  CDS (1)..(1776): transl_table=11

SEQ ID NO: 62816 - protein, 591 aa, Prochlorococcus marinus subsp. pastoris str. CCMP1986; identical to SEQ ID NO: 45327

SEQ ID NO: 62817 - DNA, 1776 bp, Prochlorococcus marinus str. MIT 9313; identical to SEQ ID NO: 45328
  CDS (1)..(1776): transl_table=11

SEQ ID NO: 62818 - protein, 591 aa, Prochlorococcus marinus str. MIT 9313; identical to SEQ ID NO: 45329

SEQ ID NO: 62819 - DNA, 1848 bp, Prochlorococcus marinus str. MIT 9313; identical to SEQ ID NO: 45330
  CDS (1)..(1848): transl_table=11

SEQ ID NO: 62820 - protein, 615 aa, Prochlorococcus marinus str. MIT 9313; identical to SEQ ID NO: 45331

SEQ ID NO: 62821 - DNA, 1749 bp, Synechococcus sp. WH 8102; identical to SEQ ID NO: 45332
  CDS (1)..(1749): transl_table=11

SEQ ID NO: 62822 - protein, 582 aa, Synechococcus sp. WH 8102; identical to SEQ ID NO: 45333

SEQ ID NO: 62823 - DNA, 1803 bp, Synechococcus sp. WH 8102; identical to SEQ ID NO: 45334
  CDS (1)..(1803): transl_table=11

SEQ ID NO: 62824 - protein, 600 aa, Synechococcus sp. WH 8102; identical to SEQ ID NO: 45335

SEQ ID NO: 62825 - DNA, 1209 bp, Porphyromonas gingivalis W83; identical to SEQ ID NO: 45336
  CDS (1)..(1209): transl_table=11

SEQ ID NO: 62826 - protein, 402 aa, Porphyromonas gingivalis W83; identical to SEQ ID NO: 45337

SEQ ID NO: 62827 - DNA, 1212 bp, Wolinella succinogenes DSM 1740; identical to SEQ ID NO: 45338
  CDS (1)..(1212): transl_table=11

SEQ ID NO: 62828 - protein, 403 aa, Wolinella succinogenes DSM 1740; identical to SEQ ID NO: 45339

SEQ ID NO: 62829 - DNA, 1755 bp, Gloeobacter violaceus PCC 7421; identical to SEQ ID NO: 45340
  CDS (1)..(1755): transl_table=11

SEQ ID NO: 62830 - protein, 584 aa, Gloeobacter violaceus PCC 7421; identical to SEQ ID NO: 45341

SEQ ID NO: 62831 - DNA, 1740 bp, Gloeobacter violaceus PCC 7421; identical to SEQ ID NO: 45342
  CDS (1)..(1740): transl_table=11

SEQ ID NO: 62832 - protein, 579 aa, Gloeobacter violaceus PCC 7421; identical to SEQ ID NO: 45343

SEQ ID NO: 62833 - DNA, 1215 bp, Geobacter sulfurreducens PCA; identical to SEQ ID NO: 45344
  CDS (1)..(1215): transl_table=11

SEQ ID NO: 62834 - protein, 404 aa, Geobacter sulfurreducens PCA; identical to SEQ ID NO: 45345

SEQ ID NO: 62835 - DNA, 1227 bp, Treponema denticola ATCC 35405; identical to SEQ ID NO: 45346
  CDS (1)..(1227): transl_table=11

SEQ ID NO: 62836 - protein, 408 aa, Treponema denticola ATCC 35405; identical to SEQ ID NO: 45347

SEQ ID NO: 62837 - DNA, 1224 bp, Methanococcus maripaludis S2; identical to SEQ ID NO: 45348
  CDS (1)..(1224): transl_table=11

SEQ ID NO: 62838 - protein, 407 aa, Methanococcus maripaludis S2; identical to SEQ ID NO: 45349

SEQ ID NO: 62839 - DNA, 1221 bp, Methanococcus maripaludis S2; identical to SEQ ID NO: 45350
  CDS (1)..(1221): transl_table=11

SEQ ID NO: 62840 - protein, 406 aa, Methanococcus maripaludis S2; identical to SEQ ID NO: 45351

SEQ ID NO: 62841 - DNA, 1164 bp, Methanococcus maripaludis S2; identical to SEQ ID NO: 45352
  CDS (1)..(1164): transl_table=11

SEQ ID NO: 62842 - protein, 387 aa, Methanococcus maripaludis S2; identical to SEQ ID NO: 45353

SEQ ID NO: 62843 - DNA, 1155 bp, Anopheles gambiae str. PEST; identical to SEQ ID NO: 45354
  CDS (1)..(1155)

SEQ ID NO: 62844 - protein, 384 aa, Anopheles gambiae str. PEST; identical to SEQ ID NO: 45355

SEQ ID NO: 62845 - DNA, 1176 bp, Desulfovibrio vulgaris subsp. vulgaris str. Hildenborough; identical to SEQ ID NO: 45356
  CDS (1)..(1176): transl_table=11

SEQ ID NO: 62846 - protein, 391 aa, Desulfovibrio vulgaris subsp. vulgaris str. Hildenborough; identical to SEQ ID NO: 45357

SEQ ID NO: 62847 - DNA, 1209 bp, Desulfovibrio vulgaris subsp. vulgaris str. Hildenborough; identical to SEQ ID NO: 45358
  CDS (1)..(1209): transl_table=11

SEQ ID NO: 62848 - protein, 402 aa, Desulfovibrio vulgaris subsp. vulgaris str. Hildenborough; identical to SEQ ID NO: 45359

SEQ ID NO: 62849 - DNA, 1530 bp, Erwinia carotovora subsp. atroseptica SCRI1043; identical to SEQ ID NO: 45360
  CDS (1)..(1530)

SEQ ID NO: 62850 - protein, 509 aa, Erwinia carotovora subsp. atroseptica SCRI1043; identical to SEQ ID NO: 45361

SEQ ID NO: 62851 - DNA, 1203 bp, Desulfotalea psychrophila LSv54; identical to SEQ ID NO: 45362
  CDS (1)..(1203): transl_table=11

SEQ ID NO: 62852 - protein, 400 aa, Desulfotalea psychrophila LSv54; identical to SEQ ID NO: 45363

SEQ ID NO: 62853 - DNA, 1275 bp, Desulfotalea psychrophila LSv54; identical to SEQ ID NO: 45364
  CDS (1)..(1275): transl_table=11

SEQ ID NO: 62854 - protein, 424 aa, Desulfotalea psychrophila LSv54; identical to SEQ ID NO: 45365

SEQ ID NO: 62855 - DNA, 1200 bp, Bacteroides fragilis YCH46; identical to SEQ ID NO: 45366
  CDS (1)..(1200): transl_table=11

SEQ ID NO: 62856 - protein, 399 aa, Bacteroides fragilis YCH46; identical to SEQ ID NO: 45367

SEQ ID NO: 62857 - DNA, 1545 bp, Photobacterium profundum SS9; identical to SEQ ID NO: 45368
  CDS (1)..(1545): transl_table=11

SEQ ID NO: 62858 - protein, 514 aa, Photobacterium profundum SS9; identical to SEQ ID NO: 45369

SEQ ID NO: 62859 - DNA, 2664 bp, Azoarcus sp. EbN1; identical to SEQ ID NO: 45370
  CDS (1)..(2664): transl_table=11

SEQ ID NO: 62860 - protein, 887 aa, Azoarcus sp. EbN1; identical to SEQ ID NO: 45371

SEQ ID NO: 62861 - DNA, 1266 bp, Rhodobacter sphaeroides 2.4.1; identical to SEQ ID NO: 45372
  CDS (1)..(1266)

SEQ ID NO: 62862 - protein, 421 aa, Rhodobacter sphaeroides 2.4.1; identical to SEQ ID NO: 45373

SEQ ID NO: 62863 - DNA, 1725 bp, Nostoc punctiforme PCC 73102; identical to SEQ ID NO: 45374
  CDS (1)..(1725)

SEQ ID NO: 62864 - protein, 574 aa, Nostoc punctiforme PCC 73102; identical to SEQ ID NO: 45375

SEQ ID NO: 62865 - DNA, 1737 bp, Nostoc punctiforme PCC 73102; identical to SEQ ID NO: 45376
  CDS (1)..(1737)

SEQ ID NO: 62866 - protein, 578 aa, Nostoc punctiforme PCC 73102; identical to SEQ ID NO: 45377

SEQ ID NO: 62867 - DNA, 1488 bp, Nostoc punctiforme PCC 73102; identical to SEQ ID NO: 45378
  CDS (1)..(1488)

SEQ ID NO: 62868 - protein, 495 aa, Nostoc punctiforme PCC 73102; identical to SEQ ID NO: 45379

SEQ ID NO: 62869 - DNA, 1374 bp, Nostoc punctiforme PCC 73102; identical to SEQ ID NO: 45380
  CDS (1)..(1374): n means a or g or c or t/u

SEQ ID NO: 62870 - protein, 457 aa, Nostoc punctiforme PCC 73102; identical to SEQ ID NO: 45381
  misc_feature (11)..(11): Xaa can be Ile or Met
  misc_feature (13)..(13): Xaa can be Ala or Glu or Gly or Val

SEQ ID NO: 62871 - DNA, 1713 bp, Nostoc punctiforme PCC 73102; identical to SEQ ID NO: 45382
  CDS (1)..(1713)

SEQ ID NO: 62872 - protein, 570 aa, Nostoc punctiforme PCC 73102; identical to SEQ ID NO: 45383

SEQ ID NO: 62873 - DNA, 1719 bp, Nostoc punctiforme PCC 73102; identical to SEQ ID NO: 45384
  CDS (1)..(1719)

SEQ ID NO: 62874 - protein, 572 aa, Nostoc punctiforme PCC 73102; identical to SEQ ID NO: 45385

SEQ ID NO: 62875 - DNA, 1257 bp, Desulfovibrio desulfuricans G20; identical to SEQ ID NO: 45386
  CDS (1)..(1257)

SEQ ID NO: 62876 - protein, 418 aa, Desulfovibrio desulfuricans G20; identical to SEQ ID NO: 45387

SEQ ID NO: 62877 - DNA, 1218 bp, Fusobacterium nucleatum subsp. vincentii ATCC 49256; identical to SEQ ID NO: 45388
  CDS (1)..(1218): transl_table=11

SEQ ID NO: 62878 - protein, 405 aa, Fusobacterium nucleatum subsp. vincentii ATCC 49256; identical to SEQ ID NO: 45389

SEQ ID NO: 62879 - DNA, 1215 bp, Methanococcoides burtonii DSM 6242; identical to SEQ ID NO: 45390
  CDS (1)..(1215)

SEQ ID NO: 62880 - protein, 404 aa, Methanococcoides burtonii DSM 6242; identical to SEQ ID NO: 45391

SEQ ID NO: 62881 - DNA, 1272 bp, Dechloromonas aromatica RCB; identical to SEQ ID NO: 45392
  CDS (1)..(1272)

SEQ ID NO: 62882 - protein, 423 aa, Dechloromonas aromatica RCB; identical to SEQ ID NO: 45393

SEQ ID NO: 62883 - DNA, 1713 bp, Anabaena variabilis ATCC 29413; identical to SEQ ID NO: 45394
  CDS (1)..(1713)

SEQ ID NO: 62884 - protein, 570 aa, Anabaena variabilis ATCC 29413; identical to SEQ ID NO: 45395

SEQ ID NO: 62885 - DNA, 1725 bp, Anabaena variabilis ATCC 29413; identical to SEQ ID NO: 45396
  CDS (1)..(1725)

SEQ ID NO: 62886 - protein, 574 aa, Anabaena variabilis ATCC 29413; identical to SEQ ID NO: 45397

SEQ ID NO: 62887 - DNA, 1794 bp, Anabaena variabilis ATCC 29413; identical to SEQ ID NO: 45398
  CDS (1)..(1794)

SEQ ID NO: 62888 - protein, 597 aa, Anabaena variabilis ATCC 29413; identical to SEQ ID NO: 45399

SEQ ID NO: 62889 - DNA, 1740 bp, Anabaena variabilis ATCC 29413; identical to SEQ ID NO: 45400
  CDS (1)..(1740)

SEQ ID NO: 62890 - protein, 579 aa, Anabaena variabilis ATCC 29413; identical to SEQ ID NO: 45401

SEQ ID NO: 62891 - DNA, 1731 bp, Anabaena variabilis ATCC 29413; identical to SEQ ID NO: 45402
  CDS (1)..(1731)

SEQ ID NO: 62892 - protein, 576 aa, Anabaena variabilis ATCC 29413; identical to SEQ ID NO: 45403

SEQ ID NO: 62893 - DNA, 1716 bp, Synechococcus elongatus PCC 7942; identical to SEQ ID NO: 45404
  CDS (1)..(1716)

SEQ ID NO: 62894 - protein, 571 aa, Synechococcus elongatus PCC 7942; identical to SEQ ID NO: 45405

SEQ ID NO: 62895 - DNA, 1755 bp, Synechococcus elongatus PCC 7942; identical to SEQ ID NO: 45406
  CDS (1)..(1755)

SEQ ID NO: 62896 - protein, 584 aa, Synechococcus elongatus PCC 7942; identical to SEQ ID NO: 45407

SEQ ID NO: 62897 - DNA, 1728 bp, Crocosphaera watsonii WH 8501; identical to SEQ ID NO: 45408
  CDS (1)..(1728)

SEQ ID NO: 62898 - protein, 575 aa, Crocosphaera watsonii WH 8501; identical to SEQ ID NO: 45409

SEQ ID NO: 62899 - DNA, 1725 bp, Crocosphaera watsonii WH 8501; identical to SEQ ID NO: 45410
  CDS (1)..(1725)

SEQ ID NO: 62900 - protein, 574 aa, Crocosphaera watsonii WH 8501; identical to SEQ ID NO: 45411

SEQ ID NO: 62901 - DNA, 1182 bp, Methanosarcina barkeri str. fusaro; identical to SEQ ID NO: 45412
  CDS (1)..(1182)

SEQ ID NO: 62902 - protein, 393 aa, Methanosarcina barkeri str. fusaro; identical to SEQ ID NO: 45413

SEQ ID NO: 62903 - DNA, 1137 bp, Clostridium thermocellum ATCC 27405; identical to SEQ ID NO: 45414
  CDS (1)..(1137)

SEQ ID NO: 62904 - protein, 378 aa, Clostridium thermocellum ATCC 27405; identical to SEQ ID NO: 45415

SEQ ID NO: 62905 - DNA, 1254 bp, Clostridium thermocellum ATCC 27405; identical to SEQ ID NO: 45416
  CDS (1)..(1254)

SEQ ID NO: 62906 - protein, 417 aa, Clostridium thermocellum ATCC 27405; identical to SEQ ID NO: 45417

SEQ ID NO: 62907 - DNA, 1725 bp, Trichodesmium erythraeum IMS101; identical to SEQ ID NO: 45418
  CDS (1)..(1725)

SEQ ID NO: 62908 - protein, 574 aa, Trichodesmium erythraeum IMS101; identical to SEQ ID NO: 45419

SEQ ID NO: 62909 - DNA, 1728 bp, Trichodesmium erythraeum IMS101; identical to SEQ ID NO: 45420
  CDS (1)..(1728)

SEQ ID NO: 62910 - protein, 575 aa, Trichodesmium erythraeum IMS101; identical to SEQ ID NO: 45421

SEQ ID NO: 62911 - DNA, 1254 bp, Trichomonas vaginalis; identical to SEQ ID NO: 45422
  CDS (1)..(1254)

SEQ ID NO: 62912 - protein, 417 aa, Trichomonas vaginalis; identical to SEQ ID NO: 45423

SEQ ID NO: 62913 - DNA, 1394 bp, Giardia lamblia ATCC 50803; identical to SEQ ID NO: 45424
  CDS (81)..(1325)

SEQ ID NO: 62914 - protein, 414 aa, Giardia lamblia ATCC 50803; identical to SEQ ID NO: 45425

SEQ ID NO: 62915 - DNA, 1716 bp, Synechococcus elongatus; identical to SEQ ID NO: 45426
  CDS (1)..(1716)

SEQ ID NO: 62916 - protein, 571 aa, Synechococcus elongatus; identical to SEQ ID NO: 45427

SEQ ID NO: 62917 - DNA, 1722 bp, Synechocystis sp; identical to SEQ ID NO: 45428
  CDS (1)..(1722)

SEQ ID NO: 62918 - protein, 573 aa, Synechocystis sp; identical to SEQ ID NO: 45429

SEQ ID NO: 62919 - DNA, 1737 bp, Synechococcus elongatus; identical to SEQ ID NO: 45430
  CDS (1)..(1737)

SEQ ID NO: 62920 - protein, 578 aa, Synechococcus elongatus; identical to SEQ ID NO: 45431

SEQ ID NO: 62921 - DNA, 1737 bp, Synechocystis sp; identical to SEQ ID NO: 45432
  CDS (1)..(1737)

SEQ ID NO: 62922 - protein, 578 aa, Synechocystis sp; identical to SEQ ID NO: 45433

SEQ ID NO: 62923 - DNA, 1794 bp, Synechocystis sp; identical to SEQ ID NO: 45434
  CDS (1)..(1794)

SEQ ID NO: 62924 - protein, 597 aa, Synechocystis sp; identical to SEQ ID NO: 45435

SEQ ID NO: 62925 - DNA, 1785 bp, Synechocystis sp; identical to SEQ ID NO: 45436
  CDS (1)..(1785)

SEQ ID NO: 62926 - protein, 594 aa, Synechocystis sp; identical to SEQ ID NO: 45437

SEQ ID NO: 62927 - DNA, 1251 bp, Methanococcus jannaschii; identical to SEQ ID NO: 45438
  CDS (1)..(1251): transl_table=11

SEQ ID NO: 62928 - protein, 416 aa, Methanococcus jannaschii; identical to SEQ ID NO: 45439

SEQ ID NO: 62929 - DNA, 1215 bp, Methanobacterium thermoautotrophicum; identical to SEQ ID NO: 45440
  CDS (1)..(1215): transl_table=11

SEQ ID NO: 62930 - protein, 404 aa, Methanobacterium thermoautotrophicum; identical to SEQ ID NO: 45441

SEQ ID NO: 62931 - DNA, 1200 bp, Moorella thermoacetica; identical to SEQ ID NO: 45442
  CDS (1)..(1200): transl_table=11

SEQ ID NO: 62932 - protein, 399 aa, Moorella thermoacetica; identical to SEQ ID NO: 45443

SEQ ID NO: 62933 - DNA, 1308 bp, Rhodobacter capsulatus; identical to SEQ ID NO: 45444
  CDS (1)..(1308): transl_table=11

SEQ ID NO: 62934 - protein, 435 aa, Rhodobacter capsulatus; identical to SEQ ID NO: 45445

SEQ ID NO: 62935 - DNA, 1440 bp, Salmonella typhi; identical to SEQ ID NO: 45446
  CDS (1)..(1440): transl_table=11

SEQ ID NO: 62936 - protein, 479 aa, Salmonella typhi; identical to SEQ ID NO: 45447

SEQ ID NO: 62937 - DNA, 1209 bp, Desulfovibrio gigas; identical to SEQ ID NO: 45448
  CDS (1)..(1209): transl_table=11

SEQ ID NO: 62938 - protein, 402 aa, Desulfovibrio gigas; identical to SEQ ID NO: 45449

SEQ ID NO: 62939 - DNA, 1176 bp, Methanococcus jannaschii; identical to SEQ ID NO: 45450
  CDS (1)..(1176): transl_table=11

SEQ ID NO: 62940 - protein, 391 aa, Methanococcus jannaschii; identical to SEQ ID NO: 45451

SEQ ID NO: 62941 - DNA, 1182 bp, Methanococcus jannaschii; identical to SEQ ID NO: 45452
  CDS (1)..(1182): transl_table=11

SEQ ID NO: 62942 - protein, 393 aa, Methanococcus jannaschii; identical to SEQ ID NO: 45453

SEQ ID NO: 62943 - DNA, 27 bp, Primer
atgtctattgtggtgaaaaataacatt

SEQ ID NO: 62944 - DNA, 25 bp, Primer
ttattttgcctccgatgccagttct

SEQ ID NO: 62945 - protein, 428 aa, consensus; identical to SEQ ID NO: 45456
  MISC_FEATURE (1)..(428): consensus for the disclosure of xaa see table XV

SEQ ID NO: 62946 - protein, 9 aa, consensus
  MISC_FEATURE (1)..(9): consensus for the disclosure of xaa see table XV
GXXXNXXXX

SEQ ID NO: 62947 - protein, 16 aa, consensus
  MISC_FEATURE (1)..(16): consensus for the disclosure of xaa see table XV
XXXXXXXXXXXXXXXX

SEQ ID NO: 62948 - DNA, 1575 bp, Escherichia coli K12
  CDS (244)..(1575)
ggatcctgacatgcctctcccgagcaaaagaaatctaagctgtgtaacaagtaaacgactaatttgaccggtttcaaaagcgaaagacgcataatctgtcatctaataaacggtaaacattctttttatattcacggcattactgataaaaaagtcgctctcgcataaaatttacacttgcaccctgcgaaaaaacagaataaaaatacactaatttcgaataatcatgcaaagaggtgtgccatggtaaaggaacgtaaaaccgagttggtcgagggattccgccattcggttccctatatcaatacccaccggggaaaaacgtttgtcatcatgctcggcggtgaagccattgagcatgagaatttctccagtatcgttaatgatatcgggttgttgcacagcctcggcatccgtctggtggtggtctatggcgcacgtccgcagatcgacgcaaatctggctgcgcatcaccacgaaccgctgtatcacaagaatatacgtgtgaccgacgccaaaacactggaactggtgaagcaggctgcgggaacattgcaactggatattactgctcgcctgtcgatgagtctcaataacacgccgctgcagggcgcgcatatcaacgtcgtcagtggcaattttattattgcccagccgctgggcgtcgatgacggcgtggattactgccatagcgggcgtatccggcggattgatgaagacgcgatccatcgtcaactggacagcggtgcaatagtgctaatggggccggtcgctgtttcagtcactggcgagagctttaacctgacctcggaagagattgccactcaactggccatcaaactgaaagctgaaaagatgattggtttttgctcttcccagggcgtcactaatgacgacggtgatattgtctccgaacttttccctaacgaagcgcaagcgcgggtagaagcccaggaagagaaaggcgattacaactccggtacggtgcgctttttgcgtggcgcagtgaaagcctgccgcagcggcgtgcgtcgctgtcatttaatcagttatcaggaagatggcgcgctgttgcaagagttgttctcacgcgacggtatcggtacgcagattgtgatggaaagcgccgagcagattcgtcgcgcaacaatcaacgatattggcggtattctggagttgattcgcccactggagcagcaaggtattctggtacgccgttctcgcgagcagctggagatggaaatcgacaaattcaccattattcagcgcgataacacgactattgcctgcgccgcgctctatccgttcccggaagagaagattggggaaatggcctgtgtggcagttcacccggattaccgcagttcatcaaggggtgaagttctgctggaacgcattgccgctcaggctaagcagagcggcttaagcaaattgtttgtgctgaccacgcgcagtattcactggttccaggaacgtggatttaccccagtggatattgatttactgcccgagagcaaaaagcagttgtacaactaccagcgtaaatccaaagtgttgatggcggatttagggtaa

SEQ ID NO: 62949 - protein, 443 aa, Escherichia coli K12
MVKERKTELVEGFRHSVPYINTHRGKTFVIMLGGEAIEHENFSSIVNDIGLLHSLGIRLVVVYGARPQIDANLAAHHHEPLYHKNIRVTDAKTLELVKQAAGTLQLDITARLSMSLNNTPLQGAHINVVSGNFIIAQPLGVDDGVDYCHSGRIRRIDEDAIHRQLDSGAIVLMGPVAVSVTGESFNLTSEEIATQLAIKLKAEKMIGFCSSQGVTNDDGDIVSELFPNEAQARVEAQEEKGDYNSGTVRFLRGAVKACRSGVRRCHLISYQEDGALLQELFSRDGIGTQIVMESAEQIRRATINDIGGILELIRPLEQQGILVRRSREQLEMEIDKFTIIQRDNTTIACAALYPFPEEKIGEMACVAVHPDYRSSSRGEVLLERIAAQAKQSGLSKLFVLTTRSIHWFQERGFTPVDIDLLPESKKQLYNYQRKSKVLMADLG

SEQ ID NO: 62950 - DNA, 1326 bp, Yersinia pestis
  CDS (1)..(1326)
atgaaggaacgtagtactgaactggttcaaggatttcgccactcagttccctatatcaatgcgcaccgcggcaagacatttgttgtcatgctaggtggcgaagcgattgaacatgaaaacttctctagtatcgtcaacgatataggcttattacatagccttgggatcagattagtcgtggtatacggtgcccgaccacagattgacagtaatctggcagatcataactacgaacctatttatcataaacatacccgagtgactgacgcccggactctggagatggtcaagcaagcggccggtttattacaactggatatcacggccaggctttcaatgagtttgaacaacaccccactgcaaggtgctcatatcaacgtagttagcggtaactttatcattgctcaaccgctaggtgtggatgatggtgttgattattgccatagcgggcgtatccggcgcattgatgaagaagctattcatcgccaattggataatggcgctatcgttttgctggggccagttgcggtatcggtcacaggtgaaagctttaacctcacatcagaggaagttgcaactcagttagccatcaaactgaaagcggagaaaatgattggattctgctcatcacaaggggtgactgatagcgaaggtaatattatttcagaattgttcccaaacgatgcgcaaaagcggattgaagacctggaacaggatggggattacaattcgggcacagtacgtttcttgcgtggtgccgttaaagcctgccgcagcggtgtgcgccgtagccatttactcagctatcaggaagatggcgctctgattcaagaactcttctcccgtgacggtatcggtacccagattgtcatggaaagtgcggagcaagtccgccgagccaccatcaacgatatcggcggtatcttggaactgattcgcccattggaacaacaagggatcttggtgcgccgttcacgtgaacaattagagatggagatagataagtttactattattgaacgggataatttaactatcgcttgcgccgccctctatccgttccctgatgaacatattggtgaaatggcttgtgtcgcggtccatccagattatcgcagctcctcccggggagaaatgctgctgaataggataaccaatcaggcgcgacaaatgggccttaaaaagctgtttgtgctgaccacacgcagcattcactggttccaggaacgcggttttacacctgcagaggtagatgttttacctattcaaaaacaggaactgtataactatcagcgccgttcgaagatcttactggccgatctatag

SEQ ID NO: 62951 - protein, 441 aa, Yersinia pestis
MKERSTELVQGFRHSVPYINAHRGKTFVVMLGGEAIEHENFSSIVNDIGLLHSLGIRLVVVYGARPQIDSNLADHNYEPIYHKHTRVTDARTLEMVKQAAGLLQLDITARLSMSLNNTPLQGAHINVVSGNFIIAQPLGVDDGVDYCHSGRIRRIDEEAIHRQLDNGAIVLLGPVAVSVTGESFNLTSEEVATQLAIKLKAEKMIGFCSSQGVTDSEGNIISELFPNDAQKRIEDLEQDGDYNSGTVRFLRGAVKACRSGVRRSHLLSYQEDGALIQELFSRDGIGTQIVMESAEQVRRATINDIGGILELIRPLEQQGILVRRSREQLEMEIDKFTIIERDNLTIACAALYPFPDEHIGEMACVAVHPDYRSSSRGEMLLNRITNQARQMGLKKLFVLTTRSIHWFQERGFTPAEVDVLPIQKQELYNYQRRSKILLADL

SEQ ID NO: 62952 - DNA, 1332 bp, Salmonella enterica subsp. enterica serovar Typhi
  CDS (1)..(1332)
atgataaaggaacgtaaaaccgaactggtagaagggtttcgccattcagttccctatatcaatacccatcgcggaaaaacctttgtcattatgctcggcggcgaagccattgagcatgacaatttttccagcatcgttagcgatatcgggctactgcatagcctcggtattcgccttgtcgtggtgtatggcgcgcgaccgcaaatcgacgccaatctggccgcgcatcatcatgaaccgatttaccacaaaaacacacgggtgacggacgccaaaacactggagctggtgaaacaggccgccggtttactccagcttgatattaccgcccgtctgtcgatgagtctgaacaatacgccgttgcagggcgcgcacattaatgtcgtcagcggcaatttcaccattgcgcagccgctgggcgttgatgatggcgtggactactgtcatagcggccgtatccggcgcattgatgaagatgcgatcaaccgccagttggataacggcgcgatcgttctgatggggccggtcgccgtctcagtgaccggcgaaagttttaatctgacctcagaagagattgccactcaactcgccgttaaactgaaagcggaaaaaatgatcggtttctgttcttctcagggcgttaccaatagcgagggcggcatcatttctgaactcttcccgaatgaagcgcaggcgcgggtggaagagttggaagcgcagggcgattacaactccggaaccgtacgttttttgcgcggcgcggtaaaagcctgtcgtagcggcgttcgtcgttgccatctgatcagctatcaggaagatggctcgctattacaggaattgttctcgcgtgatggtatcggtacgcagatcgtcatggagagcgccgagcagatccgccgcgctaccatcaacgatattggcggtattctggagcttatccgcccactggaacagcagggcattctggtacgccgttcccgtgaacaactggagatggagatcgataaatttaccattattcagcgcgataatatgactatcgcttgcgcggcgctgtatccttttgtggaagagaaaataggcgaaatggcctgcgtagcggtacatccggattatcgcagctcatcgcgtggagaagtgcttctggagcgggttgccgcccaggcacggcaaatggggctgcgtaaattgtttgtgttgacgacgcgcagtattcactggttccaggagcgcggttttacgcctgtcgatattgagttactgcctgagagcaagaaaaaaatgtataactatcagcgacgttcaaaggtgctgatggcagatttaggataa

SEQ ID NO: 62953 - protein, 443 aa, Salmonella enterica subsp. enterica serovar Typhi
MIKERKTELVEGFRHSVPYINTHRGKTFVIMLGGEAIEHDNFSSIVSDIGLLHSLGIRLVVVYGARPQIDANLAAHHHEPIYHKNTRVTDAKTLELVKQAAGLLQLDITARLSMSLNNTPLQGAHINVVSGNFTIAQPLGVDDGVDYCHSGRIRRIDEDAINRQLDNGAIVLMGPVAVSVTGESFNLTSEEIATQLAVKLKAEKMIGFCSSQGVTNSEGGIISELFPNEAQARVEELEAQGDYNSGTVRFLRGAVKACRSGVRRCHLISYQEDGSLLQELFSRDGIGTQIVMESAEQIRRATINDIGGILELIRPLEQQGILVRRSREQLEMEIDKFTIIQRDNMTIACAALYPFVEEKIGEMACVAVHPDYRSSSRGEVLLERVAAQARQMGLRKLFVLTTRSIHWFQERGFTPVDIELLPESKKKMYNYQRRSKVLMADLG

SEQ ID NO: 62954 - DNA, 1311 bp, Neisseria meningitidis
  CDS (1)..(1311)
atgagcgcgcccgacctctttgtcgcccacttccgcgaagccgtcccctacatccgccaaatgcgcggcaaaacgctggtcgccggcatagacgaccgcctgctcgaaggtgataccttaaacaagctcgccgccgacatcgggctgttgtcgcaactgggcatcaggctcgtcctcatccacggcgcgcgccacttcctcgaccgccacgccgccgctcaaggccgcacgccgcattattgccggggcttgcgcgttaccgacgaaacctcgctcgaacaggcgcagcagtttgccggcaccgtccgcagccgttttgaagccgcattgtgcggcagcgtttccgggttcgcgcgcgcgccttccgtcccgctcgtatcgggcaacttcctgaccgcccgtccgataggtgtgattgacggaaccgatatggaatacgcgggcgttatccgcaaaaccgacaccgccgccctccgtttccaactcgacgcgggcaatatcgtctggctgccgccgctcggacattcctacagcggcaagaccttctatctcgatatgcttcaaaccgccgcctccgccgccgtctcgcttcaggccgaaaaactcgtttacctgaccctttcagacggcatttcccgccccgacggcacgctcgccgaaaccctctcggcacaggaagcgcaatcgctggcggaacacgccggcggcgaaacgcgacggctgatttcgtccgccgttgccgcgctcgaaggcggcgtgcatcgcgtccaaatcctcaacggagccgccgacggcagcctgctgcaagaactcttcacccgcaacggcatcggcacgtccattgccaaagaagccttcgtctccatccggcaggcgcacagcggcgacatcccgcacatcgccgccctcatccgcccgctggaagaacagggcatcctgctgcaccgcagccgcgaatacctcgaaaaccacatttccgaattttccatcctcgaacacgacggcaacctgtacggttgcgccgccctgaaaacctttgccgaagccgattgcggcgaaatcgcctgccttgccgtctcgccgcaggcacaggacggcggctacggcgaacgcctgcttgcccacattatcgataaggcgcgcggcataggcataagcaggctgttcgcactgtccacaaataccggcgaatggtttgccgaacgcggctttcagacggcatcggaagacgagttgcccgaaacgcggcgcaaagactaccgcagcaacggacggaactcgcatattctggtacgtcgcctgcaccgctga

SEQ ID NO: 62955 - protein, 436 aa, Neisseria meningitidis
MSAPDLFVAHFREAVPYIRQMRGKTLVAGIDDRLLEGDTLNKLAADIGLLSQLGIRLVLIHGARHFLDRHAAAQGRTPHYCRGLRVTDETSLEQAQQFAGTVRSRFEAALCGSVSGFARAPSVPLVSGNFLTARPIGVIDGTDMEYAGVIRKTDTAALRFQLDAGNIVWLPPLGHSYSGKTFYLDMLQTAASAAVSLQAEKLVYLTLSDGISRPDGTLAETLSAQEAQSLAEHAGGETRRLISSAVAALEGGVHRVQILNGAADGSLLQELFTRNGIGTSIAKEAFVSIRQAHSGDIPHIAALIRPLEEQGILLHRSREYLENHISEFSILEHDGNLYGCAALKTFAEADCGEIACLAVSPQAQDGGYGERLLAHIIDKARGIGISRLFALSTNTGEWFAERGFQTASEDELPETRRKDYRSNGRNSHILVRRLHR

SEQ ID NO: 62956 - DNA, 1863 bp, Arabidopsis thaliana (mouse-ear cress)
  CDS (1)..(1863)
atggcaaattgcagaactccacgaccgtgcgttggcaagctcagccgcggcgtggtttgggaaaactccgattttcggtctgaacctccaggttcttggggatgtccgaagcaaatgagacacaatcacgtgtcttcttcgacaacggagcatcaacgacgaagctggaccaacgctaacggtaaagaaacaaagagccattccaattttgcagactctggtgggattgttgcggtggaggaagcggagttagtggcagtgttgagggaggctcatccgtacgtgaatttacatagagacagtaaatttgtcgttatgttgtcggctgagctacttgactccggattccaaagtgaaatcattataacatgtgtgcaggacatagcatttcttcatcatctgggcattaagtttgttctagttcctggaactcaagtgcaaatcgaccagcttctagctgagagaggacgcgagcctacatatgtaggtcgttacagagtcacagactcagcatctcttcaggctgctaaggaagctgcgggagcaatatctgtaatgattgaggccaaactatctcccggaccttctatttacaatatacgccgacatggtgatagtagtcgtttgcatgaaacaggcgttagggtcgatactggtaacttctttgcagcaaagagaagaggtgttgttgatggtgttgattttggagcaactggtttagtgaagaagatagatgtagatcgaatccgtgagaggcttgatagtggttctgtagttttattgaggaacttgggccattccagcaccggagaagtcttaaattgcaatacctatgaggttgctacagcatgtgctttagctataggagcagataagcttatttgcataatggatggtccagttcttgatgagaatggacatcttgttcggttcttgactcttcaggaagcagatacattagtcagaaaacgggcacagcaaagcgagatcgctgccaattacgtgaaggctgttggggatggaggcataagtagttttcctgaacctcttggttacaatggtatggtgacgactcccaacaatcatattgggagaccgatttgggaaaaactcagtccgacctttcagaatggtgttggatttgacaacggaaatgggttgtggtctggggagcaaggttttgctattggcggtgaggagagaattagccgtttgaatggatatctctctgaactggctgcagcagcgttcgtttgcagaggtggtgtcaaaagagttcacttattggatggtactataagtggagtgctattgttggagcttttcaaaagagatggaatggggactatggtggcaagtgatgtatatgaaggaaaccgggaggcgaaagtggaagatcttgctggaataagacaaataatcaaacccctggaagaatctggggctttagttcgtagaactgatgaggagcttctgcgagctttggattcgtttgtggttgtggaaagggaaggacatattatcgcttgcgcggctttgttccctttctttgaagaaaaatgtggagaagttgcagctatcgcagttgcatcagattgccgtggacaaggccagggagataaattgctcgattacattgagaagaaagcgtcagctcttggacttgagatgctatttctgctgacaacgagaaccgcggactggtttgtgagacgcgggtttcaggaatgtccaatcgagatgataccagaggcaagacgggaaagaatcaatctttcgaggagatcaaagtattacatgaagaagctgttgccagacaggagtggaatttctgttgttcgaacatttcagtatgattcttga

SEQ ID NO: 62957 - protein, 620 aa, Arabidopsis thaliana (mouse-ear cress)
MANCRTPRPCVGKLSRGVVWENSDFRSEPPGSWGCPKQMRHNHVSSSTTEHQRRSWTNANGKETKSHSNFADSGGIVAVEEAELVAVLREAHPYVNLHRDSKFVVMLSAELLDSGFQSEIIITCVQDIAFLHHLGIKFVLVPGTQVQIDQLLAERGREPTYVGRYRVTDSASLQAAKEAAGAISVMIEAKLSPGPSIYNIRRHGDSSRLHETGVRVDTGNFFAAKRRGVVDGVDFGATGLVKKIDVDRIRERLDSGSVVLLRNLGHSSTGEVLNCNTYEVATACALAIGADKLICIMDGPVLDENGHLVRFLTLQEADTLVRKRAQQSEIAANYVKAVGDGGISSFPEPLGYNGMVTTPNNHIGRPIWEKLSPTFQNGVGFDNGNGLWSGEQGFAIGGEERISRLNGYLSELAAAAFVCRGGVKRVHLLDGTISGVLLLELFKRDGMGTMVASDVYEGNREAKVEDLAGIRQIIKPLEESGALVRRTDEELLRALDSFVVVEREGHIIACAALFPFFEEKCGEVAAIAVASDCRGQGQGDKLLDYIEKKASALGLEMLFLLTTRTADWFVRRGFQECPIEMIPEARRERINLSRRSKYYMKKLLPDRSGISVVRTFQYDS

SEQ ID NO: 62958 - DNA, 1371 bp, Vibrio cholerae
  CDS (1)..(1371)
atgcgcatatttaaacaccaaggatgttcagccgtgaaaattcgcagtaccgctctcgtcaaaggatttcgccagtcagcgccctacgttaatgcccaccgtgggaaaaccatggtcgttatgctgggaggagaagcgattgccgataaaaattttcctaacatcatcagcgatatcgctctgctgcacagccttggcgttaaagtggtactcgtgcacggagctcggccacaaatcaatcaaatccttgaaaaaaatcaacgtgatacgccataccacaaaggggtgcggatcactgatgaatcctcactcggcttagtgatgcaagccgccggacaactacaacacgcgatcactgcgcgtctttcgatgagcctcaacaatacgccaatggcgggcactcaactcaacgttgtgagcggcaatttcatcatctctcaaccactaggtatagatgaaggtgtcgattactgccacagcgggcgcattcgccggattgatgtggaaggcatcaaccgtatgctggatttaggttcgattgtgctgcttggcccgattgctagctctgtcactggtgagtgtttcaatctgctttctgaggaagtggcgacccaagtggcgataaaacttaaagccgataagctgatcggtttttgcccacagcaagggatcatagataccaaaggcaacgcgattgccgaactcttcccaagcgatgtagagcgcctcgtcaaaagcatggagcaagagtgcgcaccagatgatgaagagtgtttcagcaccatgcgttttttgcgcgccgctttaaaagcctgccgcgcgggtgtgccacgcagccacttggtgagttacaaagaagatggtgcattaatccaagagctgttctcgtttgatggtatcggcacccagatcgtaatggcgagtgcggagcagatccgccaagccacgattgatgatatcggcggtatttttgatttgattcgtcctctggaagagcaaggcattctggtacgccgctctcgtgaacagttggagcaagagatccataaattcaccatcatcgacaaagatggcttagtgattggctgctcggcactctacccttatccagaagaacgcatggctgagatggcttgtgtcgcgattcatcctgaatatcgtgatggtcaccgcggattgcatttattggtccacagcaagcatcaagccaagcaaatgggcattcgtcacctgtttgtgctaaccactcacagcacacactggttccgtgaacaaggtttcaatgaagtcgatgtcgaagcgttaccgatggcgaaaaagagcttatacaactaccaacgccgctcaaaaattttgatgctgcagctttaa

SEQ ID NO: 62959 - protein, 456 aa, Vibrio cholerae
MRIFKHQGCSAVKIRSTALVKGFRQSAPYVNAHRGKTMVVMLGGEAIADKNFPNIISDIALLHSLGVKVVLVHGARPQINQILEKNQRDTPYHKGVRITDESSLGLVMQAAGQLQHAITARLSMSLNNTPMAGTQLNVVSGNFIISQPLGIDEGVDYCHSGRIRRIDVEGINRMLDLGSIVLLGPIASSVTGECFNLLSEEVATQVAIKLKADKLIGFCPQQGIIDTKGNAIAELFPSDVERLVKSMEQECAPDDEECFSTMRFLRAALKACRAGVPRSHLVSYKEDGALIQELFSFDGIGTQIVMASAEQIRQATIDDIGGIFDLIRPLEEQGILVRRSREQLEQEIHKFTIIDKDGLVIGCSALYPYPEERMAEMACVAIHPEYRDGHRGLHLLVHSKHQAKQMGIRHLFVLTTHSTHWFREQGFNEVDVEALPMAKKSLYNYQRRSKILMLQL

SEQ ID NO: 62960 - DNA, 1299 bp, Pseudomonas aeruginosa
  CDS (1)..(1299)
atgcccgactacgtcaactggttacgtcacgcttcgccctacatcaactcgcaccgggaccgcaccttcgtggtcatgctccccggcgaaggggtggagcatcccaatttcggcaatatcgtccacgacctagtccttctccacagcctcggtgcgcgcctggtgctggtgcacggttcgcgtccgcagatcgaggcgcgcctggccgcgcgcggcctggctccgcgctatcaccgcgacctgcgagtgaccgatgcaccgaccctggagtgcgtcatcgacgccgtgggtagcctgcgcatcgccatcgaggcgcggctgtcgatggacatggccgcctcgccgatgcagggcgcgcgcctgcgggtcgctggcggcaacctggtcaccgcgcggccgatcggcgtggtcgagggtgtcgactatcaccataccggtgaggtccgtcgcatcgaccgcaagggtattggccgccttctcgacgagcgcagcatcgttctgctctcgccgctgggctactcgccgaccggggaaatcttcaacctggcctgtgaagacgtggccatgcgcgccgccatcgacctggaagcggaaaagctgattctctacggcgccgaacagggcttgctggacgcatccggcaaactggtccgcgaactgcgcccgcagcaggtgcccgcgcacctgcaacggctgggcaacagctaccaggccgagctgctggacgccgcggcgcaggcctgccgggccggggtcaagcgcagccatatcgtcagctacaccgaggacggcgcgctgctcagcgagctattcacccgcaccggcaacggcaccctggtcgcccaggagcagttcgagcagttgcgcgaggcgggcatcgaggacgttggcgggctgatcgagctgatccgcccgctggaagagcagggcatcctggtacgccgttcccgcgaggtgctggaacgcgagatcgaacagttcagcatcgtcgagcgcgaagggctgatcatcgcctgcgccgcgctctacccgatcgccgattccgaggcgggcgagctggcctgtctggcggtcaacccggagtaccgccacggcgggcgtggcgacgaactgctggagcggatcgaggagcgcgcgcgcggactcggcctgaagaccctgttcgtgctcaccacgcggaccgcgcactggttccgcgagcgcggcttccagcctagcagcgtcgaacggctaccggcggcgcgggcctcgctgtacaacttccagcgcaattcgcaggtattcgagaagagcctgtga

SEQ ID NO: 62961 - protein, 432 aa, Pseudomonas aeruginosa
MPDYVNWLRHASPYINSHRDRTFVVMLPGEGVEHPNFGNIVHDLVLLHSLGARLVLVHGSRPQIEARLAARGLAPRYHRDLRVTDAPTLECVIDAVGSLRIAIEARLSMDMAASPMQGARLRVAGGNLVTARPIGVVEGVDYHHTGEVRRIDRKGIGRLLDERSIVLLSPLGYSPTGEIFNLACEDVAMRAAIDLEAEKLILYGAEQGLLDASGKLVRELRPQQVPAHLQRLGNSYQAELLDAAAQACRAGVKRSHIVSYTEDGALLSELFTRTGNGTLVAQEQFEQLREAGIEDVGGLIELIRPLEEQGILVRRSREVLEREIEQFSIVEREGLIIACAALYPIADSEAGELACLAVNPEYRHGGRGDELLERIEERARGLGLKTLFVLTTRTAHWFRERGFQPSSVERLPAARASLYNFQRNSQVFEKSL

SEQ ID NO: 62962 - DNA, 1259 bp, Pseudomonas aeruginosa
  CDS (45)..(1238)
gctcacgctttgctctcgctcacgaaacgaaggctttccccaccatgcccgactacgtcaactggttacgtcacgcttcgccctacatcaactcgcaccgggaccgcaccttcgtggtcatgctcccggcgaagggtggagcatcccaatttcggcaatatcgtccacgacctagtccttctcaagcgcctcggtgcgcgatacctggtgctggtgcaggttcgcgtccgcagatcgtggcgcgctggcgcgcggcctgtcgcgtatcaccagcgacctgcgcagtgaccgatgcaccgaccctggagtgcgtcatcgcggtgggtagcctgcgatcgcgatcggcgggctgtcgatggacatggccgctcgccgatgcaggggcgcgctggcgtcgtgggccaacctggtcaccgcgcggccgatcgcgtggtcgagggtgtcgactatcaccataccgtgaggtccgtcgcatcgaccgcaaggtattggccgcttctcgaacgagcgcacagtcgttctgctctcgccgctgggcgtactcgccgaccggggccctcttcaacctggcctgtgaagacgtggccatgcgcgccgccatcgacctggaagcggaaaagctgattctctacggcgccgaacagggcttgctggacgcatccggcaaactggtccgcgaactgcgcccgcgacaggtgcccgcgccacatgacaggctgggcaacagctaccaggccggctgctggacgccgccggaggctgccgggcgagagtcaagcgcacgcatatcgtcagctacacgaggacggccgctgctcagcgagctattcacccgcaccggcaacggcacctggtcgcccaggagcagttcgagcagttgcgcgaggtgggcatcgagagacgttggcgggctgatcgagctgatccgcccgctggaagagcagggcatcctggtacgccgttcccgcgagtggctggaacgcgagatcgcaagtccagttgcatcagcatcgtcgcagcgccgaagggctgatcatcgcctgcgccgcgctctacccgatcgccgattccgcggccggcgagcgtcgccgtgtctggcggtcaacccggagtaccgccacggcgcgtggcacgaactgctggagcggatcgaggagcgcgcgcgactcggcctgaagaccctgttcgtgctcaccacgcggaccgcactggttccgccgagcgcgcttccagcctagcagcgtcgaagctggctaccg

SEQ ID NO: 62963 - protein, 397 aa, Pseudomonas aeruginosa
MPDYVNWLRHASPYINSHRDRTFVVMLPAKGGASQFRQYRPRPSPSQAPRCAIPGAGAGSRPQIVARWRAACRVSPATCAVTDAPTLECVIAVGSLRSRSAGCRWTWPLADAGARWRRGPTWSPRGRSRGRGCRLSPYREVRRIDRKVLAASRTSAQSFCSRRWAYSPTGALFNLACEDVAMRAAIDLEAEKLILYGAEQGLLDASGKLVRELRPRQVPAPHDRLGNSYQAGCWTPPEAAGRESSARISSATRGRPLLSELFTRTGNGTWSPRSSSSSCARWASRDVGGLIELIRPLEEQGILVRRSREWLEREIASPVASASSQRRRADHRLRRALPDRRFRGRRASPCLAVNPEYRHGAWHELLERIEERARLGLKTLFVLTTRTALVPPSALPA

SEQ ID NO: 62964 - DNA, 1716 bp, Arabidopsis thaliana (mouse-ear cress)
  CDS (1)..(1716)
atggagcgaggagctttagtgggttcttcttctacttctagctactatgttccttaccactttcgccaatcaaagtcgaatttttcgtcattcaaaccaaaaaataagctaaaccctactcaattccggtttaactgttcatggtttaagccggttagttctataacggcggcgaaatgcaatatgtttgactacgcggtgactgcagccggcgatgtggaggctgagcatccagttgacgacaaacagtttgtgcgttggttccgtgaagcatggccttatctttgggctcaccgtggctgcacattcgtcgttattatctccggcgagatcatcgccggctcttcttgtgatgccattttgaaggacatagcgtttcttcatcatctaggaataaggtttgttttagttcctggaactcaggagcaaatcgaccagcttctggctgagagaggacgcgaggctacgtatgtgggacgttacagagtaacggatgcagcatctttgcaggctgctaaagaagctgcaggagcaatatcagtgatgcttgaggccaaattatctcctggaccttctatttgcaatatccgtagacatggtgatcgtagtcgtttacatgatataggtgttagggttgataccggtaacttctttgcagcaaaaagaagaggtgttgttgatggtgttgattttggagcgactggtgaggtaaagaagatagatgtagatcggatttgtgagaggcttgacggtggttctgtagttttgttgaggaacttgggccactcgagctccggagaagtcttaaattgcaatacctatgaggttgctacagcttgtgctttagctataggagcagataagcttatttgcataatggacggcccaattcttgatgagagtggacatcttattcatttcttgacacttcaagaagcagatatgttagttcgaaaacgggcacaacaaagcgacatagctgcaaattacgtaaaagccgttggagatggaagcatggcttatcccgaacctcctaacaacaccaatggtaatattacttctgctcaaaacgggagagccgtttcattttggggaaacggaaaccacactccgatctttcagaacggtgttggatttgacaacggaaacggattgtggccttgtgagcaaggttttgctattggtggtgaagaaagattaagccgcttaaacggttatctttctgaattggctgctgcggcgttcgtctgcagaggtggagtcaaaagagttcacttgttggatggtactataagtggagttctattgttggagcttttcaaaagagatggaatgggaactatggttgctaggtacattcattcttttcgtcttcactcgcatatactcctggctttttcgtgttcttacaattctatattgcctgttacgtgcagtgatgtttacgaaggaacccgtgatgccagagtggaagatctagcaggaattagacatataatcaaacccttggaggaatcagggattttagttcgcagaactgatgaggagttactgcgagctttggattcatttgtggttgtggaaagggaaggacagatcatcgcttgtgcggctttgtttccgttcttcaaagacaaatgcggagaagttgctgcaatcgcggttgcatcagattgtcgcggtcaaggccaaggcgataaattgctcggtgaataa

SEQ ID NO: 62965 - protein, 571 aa, Arabidopsis thaliana (mouse-ear cress)
MERGALVGSSSTSSYYVPYHFRQSKSNFSSFKPKNKLNPTQFRFNCSWFKPVSSITAAKCNMFDYAVTAAGDVEAEHPVDDKQFVRWFREAWPYLWAHRGCTFVVIISGEIIAGSSCDAILKDIAFLHHLGIRFVLVPGTQEQIDQLLAERGREATYVGRYRVTDAASLQAAKEAAGAISVMLEAKLSPGPSICNIRRHGDRSRLHDIGVRVDTGNFFAAKRRGVVDGVDFGATGEVKKIDVDRICERLDGGSVVLLRNLGHSSSGEVLNCNTYEVATACALAIGADKLICIMDGPILDESGHLIHFLTLQEADMLVRKRAQQSDIAANYVKAVGDGSMAYPEPPNNTNGNITSAQNGRAVSFWGNGNHTPIFQNGVGFDNGNGLWPCEQGFAIGGEERLSRLNGYLSELAAAAFVCRGGVKRVHLLDGTISGVLLLELFKRDGMGTMVARYIHSFRLHSHILLAFSCSYNSILPVTCSDVYEGTRDARVEDLAGIRHIIKPLEESGILVRRTDEELLRALDSFVVVEREGQIIACAALFPFFKDKCGEVAAIAVASDCRGQGQGDKLLGE

SEQ ID NO: 62966 - DNA, 1326 bp, Erwinia carotovora
  CDS (1)..(1326)
atgaaggaacgtagtacagagctggttcagggcttccgccattcagttccctatatcaatgcccaccgtggcaaaacgtttgtcatcatgttaggtggcgaggccattgaacatgcaaacttctctagcatcgtaaatgatattgggctgttacacagtctggggatcaagctggtcgtcgtttatggtgcccgcccccagattgatgccaacctgacaacgcaccactacgagccccactatcataaaaatacccgtatcaccgacagcgccacgctggagctggtcaaacaggctgcgggtatgctgcaactggacatcaccgctcggctgtcgatgagcctgaacaacacgccgctacaaggtgcccacattaatgtcgtcagcggtaattttattatcgcgcagccgcttggcgttgatgacggtgtggactactgccacagtggccgtattcgtcgtattgatgaagaagcggttcaccgccagttgaatagcggcgcgattgtgctgctcggcccagttgctgtttcagtcaccggtgaaagtttcaatttaacctcagaagaggttgcaacccagctcgccattaagctgaaagcagagaagatgatcggcttctgctcgtcacagggtgtgaccaacgaagaaggccgcatcatctccgagctgttccctgacgatgcgcagcagcgtattgatgtactggaacaagctggcgattaccactctggtacggtcagattcctgcgcggtgcagtcaaagcctgtcgtagcggcgtgcgccgtagccacctgatcagctatcaggacgacggcgcgctattgcaggaactgttctcacgcgacggaatcggtacgcagatcgtgatggaaagcgccgagcaggttcgccgtgcgaccatcaatgacatcggcggtattctggaattgatccgtccgctggaagaacaaggcattctggttagacgctcgcgtgaacagctggaaatggagatcgacaaattcaccgtcgtggtacgtgataacctgaccatcgcctgtgccgcgctttatccgttcccggaagaaagcatcggtgaaatggcctgcgtcgcggttcacccggattaccgcagttcatcacgtggcgatatgctgttaatgcgcgttgccgctcaggcgcgccagcagggtctacaaaagctgttcgtgctgaccacacacagcatccactggtttcaggagcgcggctttttacccgccgaagtggaaatgctgccgaagaaaaaacaggcgctgtacaactaccagcgtcgctcgaagattctggtgctggacctctga

SEQ ID NO: 62967 - protein, 441 aa, Erwinia carotovora
MKERSTELVQGFRHSVPYINAHRGKTFVIMLGGEAIEHANFSSIVNDIGLLHSLGIKLVVVYGARPQIDANLTTHHYEPHYHKNTRITDSATLELVKQAAGMLQLDITARLSMSLNNTPLQGAHINVVSGNFIIAQPLGVDDGVDYCHSGRIRRIDEEAVHRQLNSGAIVLLGPVAVSVTGESFNLTSEEVATQLAIKLKAEKMIGFCSSQGVTNEEGRIISELFPDDAQQRIDVLEQAGDYHSGTVRFLRGAVKACRSGVRRSHLISYQDDGALLQELFSRDGIGTQIVMESAEQVRRATINDIGGILELIRPLEEQGILVRRSREQLEMEIDKFTVVVRDNLTIACAALYPFPEESIGEMACVAVHPDYRSSSRGDMLLMRVAAQARQQGLQKLFVLTTHSIHWFQERGFLPAEVEMLPKKKQALYNYQRRSKILVLDL

SEQ ID NO: 62968 - DNA, 1356 bp, Acinetobacter sp
  CDS (1)..(1356)
atgcagcgttatgaaaccacttctgttcagaacataacacaacaatatgtccactggtttcgtcactcagcaccctatattaatgctcatcgaaataaaaccctggtgttaatgtttggtggtgaagcagttcagcatccaaattttcagcatattattcatgatattgcactgttacattctctcggaatccgtctgattctggttcatggcgcacgtccacaaatcaatcaaaatctgcaagaaaagcagattgagacacccattcatttacatcgtcgagtcacaacacgtgaatctctggcttgcgttatgaatgctgtgggttccattcgacttgaaattgaagcactcctttcgatggggcttgccaattcacctatgtttggtgcgcggattgatgtcgtttcaggtaactttgtcacggccaaaccttacgggatacgtgatggtgtcgattttcagcttacgggtgaagttcgcgctattgatactgacgccattcagcggcatttagataatcataatattgtggtgttgggtcccacaggttattccaccacgggtgaagtgtttaaccttttggcagaagaagttgcaacaaaaaccgccactgcactgcatgcagataaattgatttttttaggcaagaagcaaggcttactcagtgatcaaggtaaactattacgtgaactcacccctcaacagcttgagccgtatatcaaacatttccagcaacttgatcatgagatggcactacatttacaaggcgcacaaacagcgtctttgtctggtgtacatcgcgttcatctgatttcttatgcttatgacggcgccctgattgaagagttatttactcgtgatggcattggtaccatgattaccgatgcccactatgaagacgttcgtacagcgactattcaagatgtaggaggtctgattaatctactacgccctctcgaagaagaaggcattctggtttaccgttcacgtgaacgtctggaaagtgagattagtcagtttgcggtgatcgaacgcgatggcatgattctggcctgtgccgcgctctatccaattccgacagcaaaaaatgaaattcgttctgctgaaatcgcctgtgttgccgttgatcctgcctatcgtaaatcgaatcggggtagtcaaattctgcattttttagaagagaaagcacgtcaagaagggattttgcaactctttgttctcaccacccgtactgcacactggtttctggaacacggtttccaaacagcaagtgtcgatgatctccctagtgcccgacaagagctgtataactaccaacgtaactcactcgtttttaaaaaaatactgatgtaa

SEQ ID NO: 62969 - protein, 451 aa, Acinetobacter sp
MQRYETTSVQNITQQYVHWFRHSAPYINAHRNKTLVLMFGGEAVQHPNFQHIIHDIALLHSLGIRLILVHGARPQINQNLQEKQIETPIHLHRRVTTRESLACVMNAVGSIRLEIEALLSMGLANSPMFGARIDVVSGNFVTAKPYGIRDGVDFQLTGEVRAIDTDAIQRHLDNHNIVVLGPTGYSTTGEVFNLLAEEVATKTATALHADKLIFLGKKQGLLSDQGKLLRELTPQQLEPYIKHFQQLDHEMALHLQGAQTASLSGVHRVHLISYAYDGALIEELFTRDGIGTMITDAHYEDVRTATIQDVGGLINLLRPLEEEGILVYRSRERLESEISQFAVIERDGMILACAALYPIPTAKNEIRSAEIACVAVDPAYRKSNRGSQILHFLEEKARQEGILQLFVLTTRTAHWFLEHGFQTASVDDLPSARQELYNYQRNSLVFKKILM

SEQ ID NO: 62970 - DNA, 1326 bp, Photobacterium profundum
  CDS (1)..(1326)
atgaaacttcgtagtactgccctcgtaaaaggctttaggcaatcagccccctacgtgaatgcacactcaggtaaaacggttgtcattatgttaggcggcgaagccattgctgatcctaactttgcaaatattgttaacgatatcgcgctgttaaacagccttgggttacagattgttgtggtatatggcgctcgcccgcaaatatcacacttattaacctcacagggctacacaacgccttaccataaaggcattcgggttaccgacgcacgcgcgctagagttagtaaaacaagcggcggggcaattacagctcgatattacggcacgattttcgatggggctcaacaacacaccaatggcaggggcgcagataaatgtcatcagtggcaatttcattatcgcccagccacttggtatcgatgacggtatcgattattaccatactggccgtattcgccgtattgatatcgatggtattcagcgtcaacttaatcaacattcaattgtattgctcggcccagtggccagctcagtcaccggcgaatgctttaaccttacctcagaagaagtcgcaactcagctagccataagattaaaggccgataagttaattggtttttgctcggaacaaggggttattgaccttgatggtgaagtggcatcagagatgctgcccaacgaagcagaaacggctctacagcgtttaatcgaagcacaagaagatgattgtggtaccgctcgtttcttacgaggggccgttagtgcatgtcgtgctggcgtaccacgaagccatctgattagctataaagaagacggggctttaatccaagagctcttctcgcttgatggtattggtacccaaatcgtgatggcaagtgctgaaaaagtgcgtggtgcaggcattgatgacattggtggtattctcgaccttatctaccctctcgaacaagaaggcattttagtacgtcgctctcgtgaacaactcgaacaagaaatcgaacagttcaccattattgaacgcgatgggctcattattgcttgcgctgcactgtatccatttcctgatgaaaaaattgccgagatggcatgtgttgctgttcaccctgattttagagacggggatcgtggtgtcatactgcttaatcgccttcgtcagcaagccaaagaacagcgcttaaaacacgtttttgtcttaaccactcgcagcgtacattggttcctagagcaaggttttatcgagtccgatgtagaacaattaccgatggctaaaaaagcgttatataacttccaacgtcgatccaagattttagtattggctgtttag

SEQ ID NO: 62971 - protein, 441 aa, Photobacterium profundum
MKLRSTALVKGFRQSAPYVNAHSGKTVVIMLGGEAIADPNFANIVNDIALLNSLGLQIVVVYGARPQISHLLTSQGYTTPYHKGIRVTDARALELVKQAAGQLQLDITARFSMGLNNTPMAGAQINVISGNFIIAQPLGIDDGIDYYHTGRIRRIDIDGIQRQLNQHSIVLLGPVASSVTGECFNLTSEEVATQLAIRLKADKLIGFCSEQGVIDLDGEVASEMLPNEAETALQRLIEAQEDDCGTARFLRGAVSACRAGVPRSHLISYKEDGALIQELFSLDGIGTQIVMASAEKVRGAGIDDIGGILDLIYPLEQEGILVRRSREQLEQEIEQFTIIERDGLIIACAALYPFPDEKIAEMACVAVHPDFRDGDRGVILLNRLRQQAKEQRLKHVFVLTTRSVHWFLEQGFIESDVEQLPMAKKALYNFQRRSKILVLAV

SEQ ID NO: 62972 - DNA, 1872 bp, Oryza sativa
  CDS (1)..(1731)
atgccgatgcggcggcagtgcgccaggggcgtcgtcgtgcggtgcgcaggggcgggggcggggcggtcgttcggtggggcctcctgcgggggcgggggcgggggcgggggcggggcggaggatcaggaggaggaggggacgaggttcgtggggtggtttcgggaggcctggccctacgtccgtggccaccgggggagcaccttcgtcgtcgtcgtctccggtgaggtcgtcgccgggccccacctcgacggcattctccaggatatttcacttcttcatggtcttgggatcaaatttgttcttgttcctggaacacatgttcagattgataagctcctatctgagagagggaagaaggccaagtatgctggtcgttaccgtattactgattctgattcattagaggctgcaatggaggcagcaggcagaatacgcttaactatagaagcaaaactatcccctggtcccccaatgttgaatcttcgtcggcatggtgttaatggtcgttggcatgaaatatgtgataatgttgcaagtggaaactttcttggcgctaagagacggggggttgttggtggcattgattatggattcactggtgaagttaagaaaatagatgtttcacggataaaagaaagacttgatagagatagcatagttgttgtgagcaatatgggatattccagctctggcgaggtgttgaattgcaacacatatgaagtcgctacagcttgtgctttagctatcgaggcagacaagcttatctgcattgttgatggtcaaatatttgatgaacatggtcgagtcaatcgtttcatgtctattgaagaagcggacatgttgatcagaacacgtgctaagcagagtgagattgctgcaaattatgtcgaagttgtaggtgaggaggatattagttatgctcgcaatcttcctatcaaagaggagaaagaattaggattgattggaagggacttcgttgatgggtatactgcatctttccggaatggtgtgggtttcaataacggaaatggtctgtctggtgagcaagggtttgcaattggtggggaagagcggttgagtaggtcaaatggttacctttcagagttagcagcagcagcatatgtatgcaatggaggcgttcaaagggttcacattatagatggcactgttggcggatcattgttgttggaattattcacaagagatggtgttggaacgatgatagctagagacatgtatgaaggaacaaggatggctagagaagaagatctttctggtattagaaagatcatccgacccttagaagaatctggtgtcctagtgcggcgaacagataaagagcttctagaagcattgaagtcatttatcgtcgtggaaagagatggttcaatcattgcatgtgctgctctctttccatttcttgaggataaatctggggaagttgccgctattgctgtatctgaagaatgtcgaggacagggtcaaggggataagttacttgattacgtcgagaagaaggcattatcgcttggtcttgagaaaatattcttgctcaccacacgaacagcagactggtttgttcggcgtggcttcaaggagtgttcgattgagtccctgcctgcgcagaggagaaaacgaatcgatctttcacgtggatcaaaatattacatcaagcggctccgggcagcagagattgggcagatggctgttaacaattttgctgtcagatgagatactgcacgcaatcccggtgttgctcatgaggtttctaactttctatgataacctcaaaagcgattgtacattgtataaattgtgtatggtatatatgtgagtaatcgatcaccaatgtggttttgtttctttagtaga

SEQ ID NO: 62973 - protein, 576 aa, Oryza sativa
MPMRRQCARGVVVRCAGAGAGRSFGGASCGGGGGGGGGAEDQEEEGTRFVGWFREAWPYVRGHRGSTFVVVVSGEVVAGPHLDGILQDISLLHGLGIKFVLVPGTHVQIDKLLSERGKKAKYAGRYRITDSDSLEAAMEAAGRIRLTIEAKLSPGPPMLNLRRHGVNGRWHEICDNVASGNFLGAKRRGVVGGIDYGFTGEVKKIDVSRIKERLDRDSIVVVSNMGYSSSGEVLNCNTYEVATACALAIEADKLICIVDGQIFDEHGRVNRFMSIEEADMLIRTRAKQSEIAANYVEVVGEEDISYARNLPIKEEKELGLIGRDFVDGYTASFRNGVGFNNGNGLSGEQGFAIGGEERLSRSNGYLSELAAAAYVCNGGVQRVHIIDGTVGGSLLLELFTRDGVGTMIARDMYEGTRMAREEDLSGIRKIIRPLEESGVLVRRTDKELLEALKSFIVVERDGSIIACAALFPFLEDKSGEVAAIAVSEECRGQGQGDKLLDYVEKKALSLGLEKIFLLTTRTADWFVRRGFKECSIESLPAQRRKRIDLSRGSKYYIKRLRAAEIGQMAVNNFAVR

SEQ ID NO: 62974 - DNA, 1308 bp, Chromobacterium violaceum
  CDS (1)..(1308)
atgctgacccgcgagttcgtccacaccttccgcgaagccgccccctacatcaacgcctaccgcggcaagaccttcgtgctggccatgggcggcgagagcctgctggacggcgacttttccagcatggcccaggacatcaacctgctggtcagcctgggcgtgcgcatcgtgctggtgcacggcatccgcccgcagatcgaaaccctgctcaagcgccacggcatcgcccgcctgttccaccgcgatcgccgcgtcaccgacgccgctaccatggacatcgtcaagcaggcggccggcgccacccgccatgacgtcgaggcccggctgtcgatgggcatgccgcactcgccgatgcacggcgcccacctgcgcgtggccggcggcaacttcgtcaccgcccagccgctcggcgtgctggacggcgtggacatgcagtacaccggccaggtgcggcgcgtggacgccgcggcgatccgccagcgcctggacgccggggaactggtgctgctgaccccggtcggctattcgctgaccggcgagagcttcaacctgaccatggaagagctggccacccacgccgccatcgcgctgaaggcggagaagctgatcttcgtcgtagaaggccgcggcgcggtggagcaggacagcgagctgatcagcacgctgaccgcccagcaagccgagcagctgctgcaggcgggcagcctgcaggacgacgtcgccgcctgcctgccctattgcatacgcgccacccgcgaaggcattccccgcgcccacctggtcagccgccatcaggacggcgcgctgctgctggagcacttcacccgcggcggcaacggcaccatgatcgcccgcgacccgctggtcaaggtccgccacgccagcatagaggacgtaggcgacatcatggggctgatccgcccgctggaggaacagggcattctggtgcgccgcagccgcgagcggctggaggtggagataggcgaatactcggtgctggagcacgacggcaagatctacggctgcgtggcgatgcacccgttcccggaagcggagacggccgaactggcctgcctcgccgtgtcgcaggaaaaacgcgacggcggcttcggcgagatgctgctcaagcacgtggaataccaggcgcgcacccagggcctgcgatcgctgttcgtgctgaccacccagacctcgcactggttcgtcgagcgtggtttcgccgaggccgacaagagctcgctgccgctggcgcgccagcagttttacaattaccagcgccgctcgaaggtgttcgtaaagaagctgtaa

SEQ ID NO: 62975 - protein, 435 aa, Chromobacterium violaceum
MLTREFVHTFREAAPYINAYRGKTFVLAMGGESLLDGDFSSMAQDINLLVSLGVRIVLVHGIRPQIETLLKRHGIARLFHRDRRVTDAATMDIVKQAAGATRHDVEARLSMGMPHSPMHGAHLRVAGGNFVTAQPLGVLDGVDMQYTGQVRRVDAAAIRQRLDAGELVLLTPVGYSLTGESFNLTMEELATHAAIALKAEKLIFVVEGRGAVEQDSELISTLTAQQAEQLLQAGSLQDDVAACLPYCIRATREGIPRAHLVSRHQDGALLLEHFTRGGNGTMIARDPLVKVRHASIEDVGDIMGLIRPLEEQGILVRRSRERLEVEIGEYSVLEHDGKIYGCVAMHPFPEAETAELACLAVSQEKRDGGFGEMLLKHVEYQARTQGLRSLFVLTTQTSHWFVERGFAEADKSSLPLARQQFYNYQRRSKVFVKKL

SEQ ID NO: 62976 - DNA, 1404 bp, Bordetella parapertussis
  CDS (1)..(1404)
atgcaagaccgctgcccgcaccaagaccacaggagtattccgaccatcatgcccgatctggaaccagacaccgtctccgcgctcgaagcccccgaattcgcccccgcgcaattcgtccgatggttccgcgaagtggcgccctacgtgcatgcgttccgaggcaagaccttcgtggtggcgttcggcggcgagctggtgcaggccggcgccctcaatgtcctggtgcaggacctctccctgctgtcggccctgggcatccacctggtgctggtgcacggctcgcgcccgcaggtcaatgaacagctgcgcctgaagggctacacccagcagttcggccggggcctggcgcccaccgacccggccgcgctggaatgcgccaaggaggcggccggcgagatccgcctggacatcgaggccgccttcagccagggcctgcccaacacgccgatgtcgcattcgcacatccgcgtcctgtcgggcaacttcgtcaccgcccggcccaccggcgtggtggacggcatcgactacaagcacaccggccaggtgcgcaagatcgatgtcgacgcgctcaagttcgccatcgagcagggctcggtggtgctgctctcgccgctgggcttctcgcccaccggcgacgccttcaacctggccatggaagacctggccaccagcgtggcggtggccctgcgcgccgagaaactgatcttcctgtccggcgagcccggcgtgctcgacggcaacggcgccgtcgacaccgagctggcgcgcgtggatgccgacgccctgctggcgcgcggggaactggacgaggacaccacctacttcctgcagcatgcctcgctggccgtcaagcgcggcgtggcgcgcgcccacctggtgccctacgcgctggacggcagcgtgctgctggagatcttcacccacgacggcgtgggcaccatggtggtcgaggacacgctggacgacctgcgcgcagccacgctcgacgacgtgggcgccatcctcagcctgatcgaaccgctggaaaccgacggcaccctggtgccgcgcccgcgcagcgccatcgagcgcgacgtggaacgcttcaccgtgctcgagcacgatggcgtgatctacggctgtgccgcgctgtatccgttccccgaggaccagatggccgagatggcctgcctgatcgtgcaccccgaatggcagggctccggcgaaggcgagatcctgctgcgccacatggagtcgcgcgcccgcgccagcggcgcgcgccgcctgttcgtgctgaccacccgcacttcgcactggttcatgaaacgcggcttcgtacgcggcggcgtcgccgacctgccgcgcgacaagcagaacaattacaaccgctcgcgcaacagcctggttttcatcaagaaactgtaa

SEQ ID NO: 62977 - protein, 467 aa, Bordetella parapertussis
MQDRCPHQDHRSIPTIMPDLEPDTVSALEAPEFAPAQFVRWFREVAPYVHAFRGKTFVVAFGGELVQAGALNVLVQDLSLLSALGIHLVLVHGSRPQVNEQLRLKGYTQQFGRGLAPTDPAALECAKEAAGEIRLDIEAAFSQGLPNTPMSHSHIRVLSGNFVTARPTGVVDGIDYKHTGQVRKIDVDALKFAIEQGSVVLLSPLGFSPTGDAFNLAMEDLATSVAVALRAEKLIFLSGEPGVLDGNGAVDTELARVDADALLARGELDEDTTYFLQHASLAVKRGVARAHLVPYALDGSVLLEIFTHDGVGTMVVEDTLDDLRAATLDDVGAILSLIEPLETDGTLVPRPRSAIERDVERFTVLEHDGVIYGCAALYPFPEDQMAEMACLIVHPEWQGSGEGEILLRHMESRARASGARRLFVLTTRTSHWFMKRGFVRGGVADLPRDKQNNYNRSRNSLVFIKKL

SEQ ID NO: 62978 - DNA, 1335 bp, Nitrosomonas europaea
  CDS (1)..(1335)
atgaaatcggataccgaatttgtcacctggtttcgttccgtcaccccccatatccatgccagccatggaaaagtcttcgtcatcgctttcgggggtgaagtcgttgagaacggaaaatttgttgagctggtgcaggatttcaatctgcttgccagcctcggcatccaactggtgctggtacatggtgcacgcccgcaaattgaatcccggcttcgggcaaatcagcaggaaatgagctatgtgcagggcatgcgtgttactgatgctgcaaccctgcaatgtgtgaaagaagccgtcggcaaagtacgggtcgagatcgaagccctgctgtcgatgggcttacccaacacacccatggccaatgccgccatacgggtagccagcggtaacttcgtaaccgcccggccggtcggtgtgttggaaggcgtggatctgcaatacacgggagaagtacgtcgtatcaatatcacggcaattctcgatcagctcgaacaagggacggtagtactgctctcccctctgggttattcgccgacaggggaaattttcaacctgacgctggaaaatattgccgctgaagtagctgccgctctccaggccgataaattaatttttctggtggatacaccaggaatccggcagcaaactgaatcaggcgccgtattactgccggaactcactgtcaggcagggtaaaacactacttgcaacaatggaaacagcaacagatcagccggatgaggatacccggctctacctgccatgggcgttacatgcatgtgaaaagggagtgaagcgcgttcatctcgtcagccgccatatcgatggcgcactgctgctcgaactgttcactcatagcggtattggcagcatgatcacacgtgacccgttgcaaatcatccgccaagctgaaatcgaagacatcggtgctattctccaattgatcgaaccattagagaatgcaggtatcctggtacggcgcaaccgggaattgctggaaatggaaattgagcgcttcacagtgatcgaacacgacaacatgatcatcgcttgtgcggcactctaccctttcccggatgacaaagcatgcgaactggcctgcctcgcagtacaccccgaatatcgcaaggcaggtatcggccggatactgatcgatcatcttgaagatcaggccagggaacaaggttaccgccgcctgttcgcacttaccacccgtaccactcactggttcgtagaacgcggcttttcggaaaccacccctgaccagcttcctcgactgaaacagaatttttacaactaccagcggcgttccaaggtattcgtcaaattgatctga

SEQ ID NO: 62979 - protein, 444 aa, Nitrosomonas europaea
MKSDTEFVTWFRSVTPHIHASHGKVFVIAFGGEVVENGKFVELVQDFNLLASLGIQLVLVHGARPQIESRLRANQQEMSYVQGMRVTDAATLQCVKEAVGKVRVEIEALLSMGLPNTPMANAAIRVASGNFVTARPVGVLEGVDLQYTGEVRRINITAILDQLEQGTVVLLSPLGYSPTGEIFNLTLENIAAEVAAALQADKLIFLVDTPGIRQQTESGAVLLPELTVRQGKTLLATMETATDQPDEDTRLYLPWALHACEKGVKRVHLVSRHIDGALLLELFTHSGIGSMITRDPLQIIRQAEIEDIGAILQLIEPLENAGILVRRNRELLEMEIERFTVIEHDNMIIACAALYPFPDDKACELACLAVHPEYRKAGIGRILIDHLEDQAREQGYRRLFALTTRTTHWFVERGFSETTPDQLPRLKQNFYNYQRRSKVFVKLI

SEQ ID NO: 62980 - DNA, 2075 bp, Arabidopsis thaliana
  CDS (120)..(1949)
tccttcgtccgaatacttttcttcttcctccaccgatcatccgccattgttacccaattttgctctgaattctattaaatctcatcggaattattcaaattccttccataaatttcgaaatgacagagcgtggagctatggtggtatcgtcttctacctgttacgttccttttcgatgtcctcaagcaagaaaagattttgctttcgtcgagccgagtaagaagctaaaccctaatcgtgtattgataaagcctccggtttacacgtattctccggcactgacggcggcgaaatgtaacatttttgattacgcggaaactggtgagaatttggtcggcgataagcaatttgtgcggtggtttcgtgaagcttggccttatttgtgggctcatcgtagctgtaccttcgtcgttactatctccggcgatgtcttagacggcccttattgtgatctcgttttaaaggacatagcatttcttcatcatctgggcattaagtttgttctagttcctggaactcaagtgcaaatcgaccagcttctagctgagagaggacgcgagcctacatatgtaggtcgttacagagtcacagactcagcatctcttcaggctgctaaggaagctgcgggagcaatatctgtaatgattgaggccaaactatctcccggaccttctatttacaatatacgccgacatggtgatagtagtcgtttgcatgaaacaggcgttagggtcgatactggtaacttctttgcagcaaagagaagaggtgttgttgatggtgttgattttggagcaactggtttagtgaagaagatagatgtagatcgaatccgtgagaggcttgatagtggttctgtagttttattgaggaacttgggccattccagcaccggagaagtcttaaattgcaatacctatgaggttgctacagcatgtgctttagctataggagcagataagcttatttgcataatggatggtccagttcttgatgagaatggacatcttgttcggttcttgactcttcaggaagcagatacattagtcagaaaacgggcacagcaaagcgagatcgctgccaattacgtgaaggctgttggggatggaggcataagtagttttcctgaacctcttggttacaatggtatggtgacgactcccaacaatcatattgggagaccgatttgggaaaaactcagtccgacctttcagaatggtgttggatttgacaacggaaatgggttgtggtctggggagcaaggttttgctattggcggtgaggagagaattagccgtttgaatggatatctctctgaactggctgcagcagcgttcgtttgcagaggtggtgtcaaaagagttcacttattggatggtactataagtggagtgctattgttggagcttttcaaaagagatggaatggggactatggtggcaagtgatgtatatgaaggaaaccgggaggcgaaagtggaagatcttgctggaataagacaaataatcaaacccctggaagaatctggggctttagttcgtagaactgatgaggagcttctgcgagctttggattcgtttgtggttgtggaaagggaaggacatattatcgcttgcgcggctttgttccctttctttgaagaaaaatgtggagaagttgcagctatcgcagttgcatcagattgccgtggacaaggccagggagataaattgctcgattacattgagaagaaagcgtcagctcttggacttgagatgctatttctgctgacaacgagaaccgcggactggtttgtgagacgcgggtttcaggaatgtccaatcgagatgataccagaggcaagacgggaaagaatcaatctttcgaggagatcaaagtattacatgaagaagctgttgccagacaggagtggaatttctgttgttcgaacatttcagtatgattcttgagagtgtccagaagcagaaaattcaaacatagagcaaataaaatgtaattgacacagaaacatttagctgaatctctaagattctgctgagttttgaatcaatattttcaggaaaaaaaaaaaaaaa

SEQ ID NO: 62981 - protein, 609 aa, Arabidopsis thaliana
MTERGAMVVSSSTCYVPFRCPQARKDFAFVEPSKKLNPNRVLIKPPVYTYSPALTAAKCNIFDYAETGENLVGDKQFVRWFREAWPYLWAHRSCTFVVTISGDVLDGPYCDLVLKDIAFLHHLGIKFVLVPGTQVQIDQLLAERGREPTYVGRYRVTDSASLQAAKEAAGAISVMIEAKLSPGPSIYNIRRHGDSSRLHETGVRVDTGNFFAAKRRGVVDGVDFGATGLVKKIDVDRIRERLDSGSVVLLRNLGHSSTGEVLNCNTYEVATACALAIGADKLICIMDGPVLDENGHLVRFLTLQEADTLVRKRAQQSEIAANYVKAVGDGGISSFPEPLGYNGMVTTPNNHIGRPIWEKLSPTFQNGVGFDNGNGLWSGEQGFAIGGEERISRLNGYLSELAAAAFVCRGGVKRVHLLDGTISGVLLLELFKRDGMGTMVASDVYEGNREAKVEDLAGIRQIIKPLEESGALVRRTDEELLRALDSFVVVEREGHIIACAALFPFFEEKCGEVAAIAVASDCRGQGQGDKLLDYIEKKASALGLEMLFLLTTRTADWFVRRGFQECPIEMIPEARRERINLSRRSKYYMKKLLPDRSGISVVRTFQYDS

SEQ ID NO: 62982 - DNA, 1728 bp, Oryza sativa
  CDS (1)..(1728)
atggcctcgccgtcgtcggtcgcctccgctcgcgccgccgccgaaggagcggcgacggtggctgctcggggtggcgccgagcccgcccgggccctgcggctgcctccggcgaacggggcgcggcgcggtgtccggtgctgctgcggggccgcgaatcccggcggcggtagcggtggcggtggcggcgcggtcgcgcgggaggagttcgtcgggttcttcagggaggcgtggccgtacatccggggccacagggggagcaccttcgtggtcgtcatctccagcgaggtcgtgtcagggccgcacttcgacggcattctgcaggatatttcacttcttcatggtttggggattcaatttgttcttgttcctggaacacatgtccaaattgataagctcttgtcagaaagaaggatggctaagtatgttggccagtaccgagttactgattctgattcattagaggctgcaatggaggcagctggaagaatacgattaactattgaggccaagctttctcctggtcctccaatgttgaatcttcgtagacatggtgttattggacgttggcatggtcttgtggataatgttgcaagtggcaacttccttggtgctaagagaagaggagtagttagtggtattgattatgggttcaccggcgaggttaagaaaattgatgtttcacgaataaaagaaaggcttgatagtgatagcatagttgttgtgagcaatatgggatactcgagctcaggagaagtgctaaactgcacttatgaagtagctactgcgtgtgctttagccattgaggcggataagctgatctgcattgtagatggccagatatttgatgagcatggacgtgtcattcctttcatgtctcttgaggaagcagatatgttgatcagaaagcgtgctaagcaaagtgatatcgcagcaaattatgtcaaggttgtggacgaggagggtatcagtcatttgcatgaggatgtcaaaccatttttgaacggaagcggtcctcttggtgcatatgctgcttctttccataatggcttgggtttcaacaatggaaatggtattttatctggtgagcaaggatttgctattggtggtgaagagcggttaagtagatcaaatgcctatctttctgagttggcagcagcagcatttgtatgccatggtggtgttcaaagagttcatatcatagatggaacagttgatggatcactgctattagaattgtttacaagagatggtacaggaacaatgatagctgatgtgtatgaaggaacaaggatagctagagaggaggatcttcttgggataagaaaaattcttcgaccactagaagaatctggtgttttggtgaagagaactgataaggagcttcttgaagcactggagtcgttctatgttgttgaaagggatggttcaatcattggatgtgctgctctgttcccatttcccgaagataaatctggagaagttgctgcgattgctgtatctgaagaatgccgaggaagaggtcaaggggacaagttgcttattatgatgatgcttcagactatattgagaaggcagcaatgtcccttggtctggagaaattattcttgctcacgacacggacagctgattggtttgtgcggcgtggcttcttggagtgttcgattgaatccattcctgagcaaaggagaaaacgcatcaatttatcacgaggatcaaagtattatataa

SEQ ID NO: 62983 - protein, 575 aa, Oryza sativa
MASPSSVASARAAAEGAATVAARGGAEPARALRLPPANGARRGVRCCCGAANPGGGSGGGGGAVAREEFVGFFREAWPYIRGHRGSTFVVVISSEVVSGPHFDGILQDISLLHGLGIQFVLVPGTHVQIDKLLSERRMAKYVGQYRVTDSDSLEAAMEAAGRIRLTIEAKLSPGPPMLNLRRHGVIGRWHGLVDNVASGNFLGAKRRGVVSGIDYGFTGEVKKIDVSRIKERLDSDSIVVVSNMGYSSSGEVLNCTYEVATACALAIEADKLICIVDGQIFDEHGRVIPFMSLEEADMLIRKRAKQSDIAANYVKVVDEEGISHLHEDVKPFLNGSGPLGAYAASFHNGLGFNNGNGILSGEQGFAIGGEERLSRSNAYLSELAAAAFVCHGGVQRVHIIDGTVDGSLLLELFTRDGTGTMIADVYEGTRIAREEDLLGIRKILRPLEESGVLVKRTDKELLEALESFYVVERDGSIIGCAALFPFPEDKSGEVAAIAVSEECRGRGQGDKLLIMMMLQTILRRQQCPLVWRNYSCSRHGQLIGLCGVASWSVRLNPFLSKGENASIYHEDQSII

SEQ ID NO: 62984 - DNA, 1329 bp, Buchnera aphidicola
  CDS (1)..(1329)
atgagagagcgtactactgaattagttcagggttttcgccacagtgtaccctatattaatgctcatcgaggtaaaaaatttgtaataatgctaagtggtgaagccattaaatatggaaatttttctggtattattaatgatataggattactgcatagtttaggtattcgtttaattgtagtgtatggatcttgtcctcaaattaatgctaatttaaaggaaaaaaatattaaaataacttatcataagtatatacgcgtcactgacttattatctttagaacaagtaaaacaagcagcaggaagattacagcttgacataacagcacgtctttctatgagtttaagtaacacccccttacaaggagctaatattaatgttgttagcggtaattttattattgctcagcctttaggtgtagacgatggtatagattattgtcacagcggtcgtattagaagaattgataaaaaagctattaattgtcaattagaaaatggagccatagttttaattggacctgtagctgtttctgttacaggagaaagttttaatttaacttctgaagaaattgcaactcaagttagtattaagttaaaagcagaaaaaatgataggtttttgcagtaaacaaggtgtaattgatagtcaaggaaaaactatttctgaattacttcctaataatatacaaaatgaaattaaaaaattagaagggaaaggtgattatatttcttcaacaatacgatttttaagaggatcaattaaagcttgtaaaagcggagtcaatcgtagtcatttaattagctatcataaaaatggagcattactacaagaattattttcgcgtgatggaattggaacgcagatggttatggaatctgcagaaaaaatcagacaagcaaatattaatgatattggaggtattttagaattaattcgtcctttagaaaaaaaaggtattttagtacgcagatctagagaacaattagagatggaagtagataaattcactattattgaacgtgataatttaactattgcttgtgctgcattataccctttttttaaggaaaaaataggtgaaatggcatgtgtagctgttcatcctgattaccgaaattcttcaaggggagatttattattgcaaacaatgaagttaaatgctaaaaagctaaatttaaaaaaaatttttgtccttactactcaaagtattcattggtttcaagaaagaggcttcattttagtagatgttgaaatattgcctgaaagtaaaaagaaaatgtataattatcaacgttgttcgaaaattttaatgattgatttattttag

SEQ ID NO: 62985 - protein, 442 aa, Buchnera aphidicola
MRERTTELVQGFRHSVPYINAHRGKKFVIMLSGEAIKYGNFSGIINDIGLLHSLGIRLIVVYGSCPQINANLKEKNIKITYHKYIRVTDLLSLEQVKQAAGRLQLDITARLSMSLSNTPLQGANINVVSGNFIIAQPLGVDDGIDYCHSGRIRRIDKKAINCQLENGAIVLIGPVAVSVTGESFNLTSEEIATQVSIKLKAEKMIGFCSKQGVIDSQGKTISELLPNNIQNEIKKLEGKGDYISSTIRFLRGSIKACKSGVNRSHLISYHKNGALLQELFSRDGIGTQMVMESAEKIRQANINDIGGILELIRPLEKKGILVRRSREQLEMEVDKFTIIERDNLTIACAALYPFFKEKIGEMACVAVHPDYRNSSRGDLLLQTMKLNAKKLNLKKIFVLTTQSIHWFQERGFILVDVEILPESKKKMYNYQRCSKILMIDLF

SEQ ID NO: 62986 - DNA, 1314 bp, Haemophilus ducreyi
  CDS (1)..(1314)
atgcgtaatacagaattaattgaatggttcaggcaatcagcgccatacgttaatatgcacagacataaaacttttgtcattatgcttgatggtaacgcaattgcacatccaaattttattaatattaccaacgatattagtttattacatagtttagggattaaattagtaattgtgtttggggcccgttgtcaaattgaaaacttgttaaagcaaaataatatttcttcaagttatcatcataatattcgtgttacagacagcaatatgcttgaaatcattaaacaagctgtgggtggcttacattatgatattttctcccgcttatcgcttaggttaccccattcaccggtgctgaatgtagtcagcagtaatgctattcttgcccaaccgcttggtgtgattgacggcgtagattatggcttgagtggtaaaattagacggattaatattgaggccattcaacagcaattagcgcaaaatgcaattgtcgtgattggtccaatagcgccatcagtaaccggaaaaatgtttaatttggcgtttgaagaaattgcgactcaattagccatcaaacttaaagtggataaattaatagccttttgcgaccgccaaggattactagacgaacagggtaaggtcatttcagatattcacccgcgtgaagccaaacaacatttaaaaaaatttattcagcaaggtgattatcaccattctgccgcgcgttttttacaagcggcgatagatgtttgccatgcaggcattaaacgctcacatttaatcagttatcaaacggatggttctttgttgcaagagttattttcacgtgatggcgttggtactcagctatccgaagcaagctcagaatgtattcgacttgccacatcatttgatattgctggtttattgaatttaattcgcccgttagaggatcaaggtcttttagtcaaacgttcacgtgaacaattagaaatggaaattagccaatatacgattattgaacgtgatggtattgtaattgcttgcgcagctttgatacattatcccgctgagaaaatggcagaaatggcttgtgttgccgtacatcctgattatcgtgattctgcgagaggcgatattttactagaagcgattaaacgacgcgcctataaattaaatattgaaaaattatttgtattaactacccaaacaatacaatggtttcaagaacgaggttttgtgcaaatacaaccaacggatttacccgttgaaaaacaacgccattataattatcaacgtatgtcaaaagtattaatgttggcattggataattag

SEQ ID NO: 62987 - protein, 437 aa, Haemophilus ducreyi
MRNTELIEWFRQSAPYVNMHRHKTFVIMLDGNAIAHPNFINITNDISLLHSLGIKLVIVFGARCQIENLLKQNNISSSYHHNIRVTDSNMLEIIKQAVGGLHYDIFSRLSLRLPHSPVLNVVSSNAILAQPLGVIDGVDYGLSGKIRRINIEAIQQQLAQNAIVVIGPIAPSVTGKMFNLAFEEIATQLAIKLKVDKLIAFCDRQGLLDEQGKVISDIHPREAKQHLKKFIQQGDYHHSAARFLQAAIDVCHAGIKRSHLISYQTDGSLLQELFSRDGVGTQLSEASSECIRLATSFDIAGLLNLIRPLEDQGLLVKRSREQLEMEISQYTIIERDGIVIACAALIHYPAEKMAEMACVAVHPDYRDSARGDILLEAIKRRAYKLNIEKLFVLTTQTIQWFQERGFVQIQPTDLPVEKQRHYNYQRMSKVLMLALDN

SEQ ID NO: 62988 - DNA, 1323 bp, Pasteurella multocida
  CDS (1)..(1323)
atgcgcagtacagaattagttcattggtttagacaatcaaccccttatgtcaatatgcatagaggcaaaacttttgtcattatgcttgatggggacactattgcttgtccaaattttgttaatattatcaatgatatcagcctgctacatagtttaggcattaagttagttttagtgtttggtgcacgttatcaaatcaatgagctgttacagcaacatcagattgaatcggtctatcataaaaatattcgtattactgacttaacaagtttagaactggtgaaacaagctgtgggtaagctcaattacgatattgcttcacgcttgtcactacgtctccctcattctcctttaattgatgtggtcagcggtaacttcgtattagcccaacctattggcgtagatgacggcatcgattatcaattaagtggcaaaattcgccgtattaatacagaaagtatccagcaacaattagatcgtgatgcgattgtcttaattggaccaattgcaccttctgttactggagaaagctttaatttgcctttcgaagaaattgcttcacagcttgccattaagttaaaagctgaaaaattgataggcttttccgcaacacaaggcatcttagatgaaaacaaccaaacaatcagtgatctgttgccgcaagatgccgagctttacttagctaaactgatacaacaaaaccaatatcacagctctcaagctcgctttttacaagcagctattgaggcttgccgatttggcataaagcgttcacatttgatcagttatgaagaagatggctcactgttgcaggaattatttacgcgtgacggggttggtactcagctatccatggaacattccgaaaccattcgcttagcgacggtcagtgatattcccgcgttactcgaattgattcgtccacttgaacagcaaggaattttagtcaaacgctcacgcgaacaattagaaatggaaattaaccaatatacgattatcgatcgcgatggtgtgattattgcttgtgctgccttaaattgctatgccgatgagaaaatggcagaaatggcttgtgtggcggttcacccagattaccgtaattcttcgcgtggcgatattttattagaagctatccaaaaacgcgctaaacaactgggaattgaaaagctgtttgttctcacaacgcgtacagtacattggttccaagaaagaggttttcaactcgcagagatcgcagatttaccagacaaaaaacgtcaacactataattatcaacgtcgttccaaaatcttgattcaagcgctacaaaataaaaaaggctaa

SEQ ID NO: 62989 - protein, 440 aa, Pasteurella multocida
MRSTELVHWFRQSTPYVNMHRGKTFVIMLDGDTIACPNFVNIINDISLLHSLGIKLVLVFGARYQINELLQQHQIESVYHKNIRITDLTSLELVKQAVGKLNYDIASRLSLRLPHSPLIDVVSGNFVLAQPIGVDDGIDYQLSGKIRRINTESIQQQLDRDAIVLIGPIAPSVTGESFNLPFEEIASQLAIKLKAEKLIGFSATQGILDENNQTISDLLPQDAELYLAKLIQQNQYHSSQARFLQAAIEACRFGIKRSHLISYEEDGSLLQELFTRDGVGTQLSMEHSETIRLATVSDIPALLELIRPLEQQGILVKRSREQLEMEINQYTIIDRDGVIIACAALNCYADEKMAEMACVAVHPDYRNSSRGDILLEAIQKRAKQLGIEKLFVLTTRTVHWFQERGFQLAEIADLPDKKRQHYNYQRRSKILIQALQNKKG

SEQ ID NO: 62990 - DNA, 1347 bp, Photorhabdus luminescens
  CDS (1)..(1347)
atgaaagaacgaagcaccgagttagttgaaggatttcgtcattctgttccgtacatcaatgcacaccgtggtaaaacttttgttatcatgcttggtggagaggctattgctcacgaaaattttaccaatattatcaacgatataggattactgcatagtttaggcatccgcctggtcgtcgtttatggtgccagacctcaaattgagcaaaaccttgcagaccatcattacgaaccggtttaccacaaacacacccgtgttaccgataataaaacattagaattagtcaaacaatctgctggcttgctgcaactggatatcactgcacgcctttctatgaatttgaataataccccgttacaaggtgccaacattaatgttgtcagtggtaacttcattattgctcaacctcttggcgttgatgatggtgtggattattgccacagcggaaaaattcgccgtatcgatgagcatgccataaatcgtcaattagacaatggcgcaatcgtgctaattggccctgtcgcagtttctgtcaccggagagagttttaatctggcatttgaagatgttgctactcaattagctatcaaactacaggctgaaaaactgattggattctgttctactcaaggtgtacaagacaaagacggaaaaattctatcggaagtttttcttaatcaagcaccggaactgattaaagagctagaagttaaaggtgactactattcaggcacagtctgttttttgcggagtgcaataaaagcttgccgtcgtggcgttcgtcgcagccatttattaagttatcaggcagatggttctctacttcaagaattattctcccgagatggtattggcactcaaatagtgatggaaagtgcggaacaaatacgccgagctaatatcaatgatattggtggtattctcgaacttattcgcccactggaacaacagggtattctggttcgccgttcaagagaacaacttgagagagaaattgataaattcatcattatcgaacgcgataacctaactatcgcctgtgccgcgctctacccttatcctgaagagaaaattggcgaaatggcttgtttagcggtgaatcctaaataccgcagctctttaagaggtgaagtattactgaatcgcattgcggaacacgccaaacagctcggactggaaaaactgtttgttctgactacccgcagcattcattggttccaagagcgaggttttgagcccgcagaactctcaatgctaccgattcagaaacaagtgttatataactatcagcgccgttctaaaattcttatgctgaatttggaaccacagcctggattcacataa

SEQ ID NO: 62991 - protein, 448 aa, Photorhabdus luminescens
MKERSTELVEGFRHSVPYINAHRGKTFVIMLGGEAIAHENFTNIINDIGLLHSLGIRLVVVYGARPQIEQNLADHHYEPVYHKHTRVTDNKTLELVKQSAGLLQLDITARLSMNLNNTPLQGANINVVSGNFIIAQPLGVDDGVDYCHSGKIRRIDEHAINRQLDNGAIVLIGPVAVSVTGESFNLAFEDVATQLAIKLQAEKLIGFCSTQGVQDKDGKILSEVFLNQAPELIKELEVKGDYYSGTVCFLRSAIKACRRGVRRSHLLSYQADGSLLQELFSRDGIGTQIVMESAEQIRRANINDIGGILELIRPLEQQGILVRRSREQLEREIDKFIIIERDNLTIACAALYPYPEEKIGEMACLAVNPKYRSSLRGEVLLNRIAEHAKQLGLEKLFVLTTRSIHWFQERGFEPAELSMLPIQKQVLYNYQRRSKILMLNLEPQPGFT

SEQ ID NO: 62992 - DNA, 1299 bp, Pseudomonas putida
  CDS (1)..(1299)
atgcccgattacgtcaactggctgcgtcatgcatccccctatatcaatgcccatcgcgactgcaccttcgtggtcatgctccctggcgatggggtggaacaccctaatttcggcaatatcgtccacgacctggtgctgctgcacagcctcggcgtgcggctggtgctggtgcatggctcgcgcccgcagatcgaaagccggctggccgatcgcggcctgaccccgcactaccaccggggcatgcgtattactgatgcggccaccctggactgcgtgatcgatgccgtcggcgccctgcgcctggccattgaagcgcggctgtcgatggacatcgccgcttcgccgatgcagggctcgcgcctgcgcgtggcctccggcaacctggtcaccgcgcggccgatcggcgtgctcgaaggcgtggactaccaccacactggcgaagtgcgccgggtcgaccgcaagggcatcagccgcctgctcgacgagcgttccatcgtgctgttgtcgcccttgggctactcgcctaccggggaaattttcaacctggcctgcgaagacgtggctacccgtgcggccatcgaactgggcgccgacaagttgctgctgttcggcgccgagccgggcctgttggacgctgacggtaggctggtgcgcgaactgcgcccgcagcaggttgctccgcatctgcagcgtctaggcagcgattaccagggcgaactgctggatgctgcggccgaggcttgcaaaggcggtgtggcgcgcagccatatcgtcagctatgccgaggacggcgcgctgctcaccgagctgttcacacggggcggtggcggtacgctggtgtcgcaggagcagttcgaagtggtgcgcgaggcgaccatcgaggacgtcggtggcctgctggaattgatcagcccgctggaagagcagggcatcctggtgcgccgctcgcgcgaagtgctggagcgagagatcgagcagttcagcgtggtcgagcgcgagggcatgatcatcgcctgtgcggcgctgtacccgattgccgattccgaagcaggggagctggcttgcctggctgtgaacccggagtaccgccatggcgggcgtggcgatgagctgctggaacgcatcgaaagccgggcacggcagatgggcttgagtactttgttcgtgctgactacgcgcactgcgcactggttccgcgagcgcggctttgcgccgagtggcgtggagcggctgccggcggcgcgggcttcgctgtacaactaccagcgcaattcgaagattttcgagaagcccctgtaa

SEQ ID NO: 62993 - protein, 432 aa, Pseudomonas putida
MPDYVNWLRHASPYINAHRDCTFVVMLPGDGVEHPNFGNIVHDLVLLHSLGVRLVLVHGSRPQIESRLADRGLTPHYHRGMRITDAATLDCVIDAVGALRLAIEARLSMDIAASPMQGSRLRVASGNLVTARPIGVLEGVDYHHTGEVRRVDRKGISRLLDERSIVLLSPLGYSPTGEIFNLACEDVATRAAIELGADKLLLFGAEPGLLDADGRLVRELRPQQVAPHLQRLGSDYQGELLDAAAEACKGGVARSHIVSYAEDGALLTELFTRGGGGTLVSQEQFEVVREATIEDVGGLLELISPLEEQGILVRRSREVLEREIEQFSVVEREGMIIACAALYPIADSEAGELACLAVNPEYRHGGRGDELLERIESRARQMGLSTLFVLTTRTAHWFRERGFAPSGVERLPAARASLYNYQRNSKIFEKPL

SEQ ID NO: 62994 - DNA, 1299 bp, Pseudomonas syringae
  CDS (1)..(1299)
atgcccgaatacgtcaactggcttcgccatgcgtctccctacatcaatgcccaccgcgattgcaccttcgtcgtcatgcttcccggcgacggcgttgcgcatcccaacttcggcaatatcgtccacgatctggtgctgctgcacagcctgggcgtgcggcttgtgctggtgcacggctcgcgtccacagattgaaagccgtctggcccagcgcggcattacaccgcgctaccatcgcgacatgcgtattaccgataccgagacgctggagtgcgtgatcgacgccgttggccagttgcgcatctcgatagaagcgcgcctgtcgatggacatggcagcctcgccgatgcagggctcgcggctgcgggtgaccagcggcaatgtggtcactgcccggcctatcggggtgctggaaggtattgattatcagcacaccggtgaggtgcgcagggtagaccgcaagggtatcaatcgcctgctggacgagcgtcatatcgtgctgctgtcgccgttgggttattcaccgaccggcgagattttcaatctggcctgcgaagacgtcgccacgcgcgctgcgattgatctggctgccgacaaactgctgttgttcggtgccgaaaccgggttgctggacgagcagggccgactggtgcgcgaactgcgcccgcaacaggtgcctgcgcatttgcagcggctgggtggcaactatcaggccgaattgctcgatgcagcggccgaggcctgccgcggtggtgtggctcgcagccatatcgtcagttatgccgaagacggcgcgctgctgaccgagctgtttacccgcgacggtggtggcacgctggtggcgcaggagcagtttgaactggttcgcgaggcggccatcgaggacgtcggcggtttgatggacctgatcaccccgctggaagagcagggcattctggtacgccgttctcgtgaggtgctggaacgcgagatcacccagttcagtgtggtcgagcgggaagggctgatcatcgcctgcgcggcgctgtacccgattgccgactcggagtctggtgagcttgcgtgtctggccgtcaacccggaataccgacacggcgggcgtggcgacgagctgctggagcgtatcgaaaaccgcgcgcgggcgctgggcatcaaaaccctgttcgtcctcaccacccgtaccgcacactggttccgcgagcgcggcttcgagcccagcagcgtcgaccgcctgccaagcgcccgtgcgtcgctgtacaacttccagcgtaattcgaagatctttgaaaaagcgatttaa

SEQ ID NO: 62995 - protein, 432 aa, Pseudomonas syringae
MPEYVNWLRHASPYINAHRDCTFVVMLPGDGVAHPNFGNIVHDLVLLHSLGVRLVLVHGSRPQIESRLAQRGITPRYHRDMRITDTETLECVIDAVGQLRISIEARLSMDMAASPMQGSRLRVTSGNVVTARPIGVLEGIDYQHTGEVRRVDRKGINRLLDERHIVLLSPLGYSPTGEIFNLACEDVATRAAIDLAADKLLLFGAETGLLDEQGRLVRELRPQQVPAHLQRLGGNYQAELLDAAAEACRGGVARSHIVSYAEDGALLTELFTRDGGGTLVAQEQFELVREAAIEDVGGLMDLITPLEEQGILVRRSREVLEREITQFSVVEREGLIIACAALYPIADSESGELACLAVNPEYRHGGRGDELLERIENRARALGIKTLFVLTTRTAHWFRERGFEPSSVDRLPSARASLYNFQRNSKIFEKAI

SEQ ID NO: 62996 - DNA, 1356 bp, Ralstonia solanacearum
  CDS (1)..(1356)
atggcgcacacgcccgccaccgccgacgtcgctccgatcccgcccacgcccgagcagcagcagttcgtggactggctgcgcgcggtggcgccctatatccacgccttccgcgacaagaccttcgtgatcggcttcggcggcgagctggtcaaggccggcatgctcggggcgctggtcaacgacatcgcgctgctgcacgccatgggcatgcacatcgtgctggtgcacggctcgcggccgcaggtggaagaacagctggcgctgcgccacgtgcagacccagttcgtcgacggcatccgcgtgaccgacaacgccgcgctggaatcggccaaggaggcctcgggcgaactgcggctcgacatcgaggccaccttcagccaggcgctgcccaatacgccgatggcgggggcccgcatttcggtggtgtcgggcaacttcgtgacggcgcggccggtgggcatcgtcaacggcgtcgatttccagcacacggggctggtgcgcaagatcgacgcggaatcgatccagcactcgctgtccaaccgcaagatcgtgctgctgtcgccgctgggcttctcgcccacggggcaggcgttcaacctgtcgatggaagacgtggccaccaacacggcgaccgcgctcaaggccgacaagctgatcttcatcaccgaggtgccgggcatcatggaccgggtcggcaagctacagcaggagctgtcgatggaatcggccatcgagcgcctgcgcgaagggcggctctccgccgacaccgcgtactacctgcagcacatcgtcaaggccatgcgcggcggcgtgcgccgggcgcacctgatcccgttcgcgctggacggcagcatcctgctggagctgttcctgcacgacggcgtcggcaccatggtctcgcacaccgacctggaatacctgcgcgaggccacgctggacgacgtgggcggcatcgtccagctgatcgagccgctggaagccgacggcacgctggtgccacgcgagcgccggctgctggagcgcgacatcgccaacttctccgtgatcgagcacgacggcatcatcttcggctgcgcggcgctctacccctacccgaaggaaggcgtgggcgagatggcctgcctgacggtggcgcccgatacccagggcaccggcgacggcgaacgcctgctcaagcacgtcgaggcccgcgcccgcgccgtggggctcaagcgcctgttcgtgctcaccacgcgcaccgagcactggttcctcaagcgcggcttcgtgcacgccaccgtggacgacctgccggaagaccgccgcaagctgtacaactggcagcggcggtcgatggtgctgatgaagaagctgtaa

SEQ ID NO: 62997 - protein, 451 aa, Ralstonia solanacearum
MAHTPATADVAPIPPTPEQQQFVDWLRAVAPYIHAFRDKTFVIGFGGELVKAGMLGALVNDIALLHAMGMHIVLVHGSRPQVEEQLALRHVQTQFVDGIRVTDNAALESAKEASGELRLDIEATFSQALPNTPMAGARISVVSGNFVTARPVGIVNGVDFQHTGLVRKIDAESIQHSLSNRKIVLLSPLGFSPTGQAFNLSMEDVATNTATALKADKLIFITEVPGIMDRVGKLQQELSMESAIERLREGRLSADTAYYLQHIVKAMRGGVRRAHLIPFALDGSILLELFLHDGVGTMVSHTDLEYLREATLDDVGGIVQLIEPLEADGTLVPRERRLLERDIANFSVIEHDGIIFGCAALYPYPKEGVGEMACLTVAPDTQGTGDGERLLKHVEARARAVGLKRLFVLTTRTEHWFLKRGFVHATVDDLPEDRRKLYNWQRRSMVLMKKL

SEQ ID NO: 62998 - DNA, 1338 bp, Shewanella oneidensis
  CDS (1)..(1338)
atgaggtgtaaacaacgcgtgcgtaccactgaactggttgatggatttcgtcattccgccccttacgtcaatgcccatagagggaaaacctttgtggtgatgctgggtggagaagctttggcacaaaatcaatttcgcggcattctgaatgacgtggcgttgttgcacagtttaggcattaaagtggtgttggtgtatggtgcgaggccgcaaatcgatgcagcgttagccgctaatgggattgaacccgcctaccatgatggtgtacgtatcaccgatgaagactcgctaaaagtgattaagcaagtggcgggtgcattgcagtttgatattacggcgcgtttatccatgagcttaagcaatacgcccatgcaaggcgcacaaatcaacttagtcagcggtaactttgtcattgcccagcccttaggggtcgataatggcgtggatttttgtttaagcggcaaggtgcgccggattgatgcgcaggggcttaagcgtcagctcgataatcactgtatcgtattgatggggccgattgcggcatccgttactggtgaaagttttaatcttaccgctgaagaaattgctactcaggtagcgataaaacttaaagcagacaagatgattggttttagttcgcaaaatggcattctcgatcgcaatggagatgtgattgccgagttaatgccaaatgatgcgcaaaagattcttaataagctcgcagagcagggttcagcctgtattggcactatggccttcctcaaggccagtattgatgcttgccgcaatggcgtgccccgctgccatttggttagctatctcgacgacggcgctttgctgcaggaactgttttcccgcgaggggattggtacgcagatcgtgaccgagagtgctgaacgtttacgccgtgcatcgattagcgatattggcggtattctcaatctgatccgtccgttagaggagcagggcattttggtgcgccgtagtcgtgagcagctcgagatcgaaattgagcagtttatgctgattgagcgtgatggcttagtgattggctgtgcggctttgtatccgttcgaagaagataatgccggggagtttgcttgccttgtggtgcatccagattatcgcgatgccgacagggggagcttgctgctgaagaatattattggtcaggcccgcagccgtggttattcacggttgtttgcattaacaacccgcagcattcactggtttttagagcatggctttgtgattgaagatgtggatgcattgccgcagaagaaaaagcagctgtataactatcagcgccgctccaaaattctcgcccttgatctataa

SEQ ID NO: 62999 - protein, 445 aa, Shewanella oneidensis
MRCKQRVRTTELVDGFRHSAPYVNAHRGKTFVVMLGGEALAQNQFRGILNDVALLHSLGIKVVLVYGARPQIDAALAANGIEPAYHDGVRITDEDSLKVIKQVAGALQFDITARLSMSLSNTPMQGAQINLVSGNFVIAQPLGVDNGVDFCLSGKVRRIDAQGLKRQLDNHCIVLMGPIAASVTGESFNLTAEEIATQVAIKLKADKMIGFSSQNGILDRNGDVIAELMPNDAQKILNKLAEQGSACIGTMAFLKASIDACRNGVPRCHLVSYLDDGALLQELFSREGIGTQIVTESAERLRRASISDIGGILNLIRPLEEQGILVRRSREQLEIEIEQFMLIERDGLVIGCAALYPFEEDNAGEFACLVVHPDYRDADRGSLLLKNIIGQARSRGYSRLFALTTRSIHWFLEHGFVIEDVDALPQKKKQLYNYQRRSKILALDL

SEQ ID NO: 63000 - DNA, 1338 bp, Vibrio parahaemolyticus
  CDS (1)..(1338)
atgaaaattcgtagtaccgctctcgtaaaaggattccgccaatcaaccccttacgtcaacgctcaccgtgggaaaaccatggtgatcatgctgggaggtgaagcggtcgcccataataattttggcaatataatcaatgatattgctttgatgcacagtttaggcatcaaagtcgttgtcgtttatggcgctcgtccacaaatcaatcaattacttgaaaaacaagaccttactacgccataccacaaaaacatccgaattaccgacgaagcggcactatcggtagttatgcaagctgctgggcagcttcaactagccattaccgcacgcctttcaatgagcttaaacaacaccccaatggctggcacacaactgaatgttgtcagtggtaactttgtcattgcacagccacttggcgtagatgacggtgtcgattactgccacagtggacgcattcgccgcattgacaccgacgcgattaatcgcacgctcgaccaaggctctattgtgctacttggccccattgcgagctccgtgactggtgagtgttttaacttactttctgaagaagtcgcgacgcaactggcgatcaaattaggcgcagacaaactgattggtttctgctcagaacaaggcgtgattgacgacaatggcaatgccgtcgcagagttgctgcctatcgaggcagagcacgttatcaaaacgctttcagaaaaccacgcttcagattccgattacaacacgggcactttgcgtttcctcaaaggttccatcgccgcttgtcgcgctggcgtcccacgtagccatctcatcagctacaaagtagatggggctttgattcaggagttgttctcgtttgacggtatcggaactcaagtcgtcatggcgagcgcagagcaagttcgtcaagctggtattgatgacatcggcggtattttggaattgattcatccattagaagaacaaggcattttggtcaggcgttcgagagaacagcttgagcaagagattggtaaattcaccatcattgaaaaagatggcttaatcatcggatgcgcggctttatacccatattctgaagaacgaaaagctgaaatggcctgtgttgccattcacccagactatcgggatggcaaccgaggtttgttgctgctgaattacatgaagcatcgttcaaaatcagaaaacatcaaccagatttttgtccttacaacccacagtctgcattggtttagagagcaaggattctacgaagttggagtcgattacttgccaggagccaaacaagggttgtacaactttcagcgtaagtccaaaatcttagcgttagacttataa

SEQ ID NO: 63001 - protein, 445 aa, Vibrio parahaemolyticus
MKIRSTALVKGFRQSTPYVNAHRGKTMVIMLGGEAVAHNNFGNIINDIALMHSLGIKVVVVYGARPQINQLLEKQDLTTPYHKNIRITDEAALSVVMQAAGQLQLAITARLSMSLNNTPMAGTQLNVVSGNFVIAQPLGVDDGVDYCHSGRIRRIDTDAINRTLDQGSIVLLGPIASSVTGECFNLLSEEVATQLAIKLGADKLIGFCSEQGVIDDNGNAVAELLPIEAEHVIKTLSENHASDSDYNTGTLRFLKGSIAACRAGVPRSHLISYKVDGALIQELFSFDGIGTQVVMASAEQVRQAGIDDIGGILELIHPLEEQGILVRRSREQLEQEIGKFTIIEKDGLIIGCAALYPYSEERKAEMACVAIHPDYRDGNRGLLLLNYMKHRSKSENINQIFVLTTHSLHWFREQGFYEVGVDYLPGAKQGLYNFQRKSKILALDL

SEQ ID NO: 63002 - DNA, 25 bp, Primer
atggtaaaggaacgtaaaaccgagt

SEQ ID NO: 63003 - DNA, 24 bp, Primer
ttaccctaaatccgccatcaacac

SEQ ID NO: 63004 - protein, 528 aa, consensus
  MISC_FEATURE (1)..(528): consensus for the disclosure of xaa see table XV
VXXFRXXXPYXXXHRXXTFVXXXXGXXXXXXXXXXXXXXXXXDXXLLHXLGXXXVXVXGXRXQIXXXLXXXXXXXXYXXXXRXTDXXXLXXXXXAXGXXXXXIXAXLSXXXXXXXXXXXXXXXPXXXXXXXVXSGNFXXAXPXGVXXGXDXXXXGXXRXIDXXXIXXXLXXXXIVLXXPXXXSXTGEXFNLXXEXXATXXAXXLXAXKXIXXXXXXGXXXXXGXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXXAXXACXXGVXRXHXXXXXXDGXLLXELFXXXGXGTXXXXXXXXEXXRXAXXXDXXGXXXLIXPLEXXGXLVXRXREXLEXXXXXFXXXEXDXXXIXCAALXPXXXXXXXXXXXEXACXAVXPXXRXXXXGXXLLXXXXXXAXXXGXXXLFXLTTXXXXWFXXXGFXXXXXXXLPXXXXXXYNXXXRXSXXXXXXL

SEQ ID NO: 63005 - protein, 108 aa, consensus
  MISC_FEATURE (1)..(108): consensus for the disclosure of xaa see table XV
XXXXRXXXPXXXXXXXXXXVXXXXXXXXXXXXXXXXXXXXXXDXXXXXXXGXXXXXXXGXXXXXXXXXXXXXXXXXXXXXXXXTXXXXXXXXXXXXGXXXXXXXXXXX

SEQ ID NO: 63006 - protein, 79 aa, consensus
  MISC_FEATURE (1)..(79): consensus for the disclosure of xaa see table XV
XXXXNXXXXXXXGXXXGXDXXXXGXXXXXXXXXXXXXXXXXXXVXXXXXXXSXXGXXXXXXXXXXAXXXXXXXXXXKXX

SEQ ID NO: 63007 - protein, 103 aa, consensus
  MISC_FEATURE (1)..(103): consensus for the disclosure of xaa see table XV
XXXXXXXXXXGXXRXXXXXXXXXGXXXXEXFXXXGXGXXXXXXXXXXXXRXAXXXDXXXXXXXXXPLEXXGXLXXRXXXXXXXXXXXXXXXXXXXXXXXCXAX

SEQ ID NO: 63008 - protein, 76 aa, consensus
  MISC_FEATURE (1)..(76): consensus for the disclosure of xaa see table XV
XEXAXXXXXXXXXXXXXGXXXXXXXXXXXXXXXXXXXFXLXTXXXXWFXXXGFXXXXXXXXPXXXXXXXXXXXRXX

SEQ ID NO: 63009 - DNA, 1014 bp, Escherichia coli; identical to SEQ ID NO: 45566
  CDS (1)..(1014)

SEQ ID NO: 63010 - protein, 337 aa, Escherichia coli; identical to SEQ ID NO: 45567

SEQ ID NO: 63011 - DNA, 978 bp, Thermococcus kodakaraensis; identical to SEQ ID NO: 45568
  CDS (1)..(978)

SEQ ID NO: 63012 - protein, 325 aa, Thermococcus kodakaraensis; identical to SEQ ID NO: 45569

SEQ ID NO: 63013 - DNA, 1026 bp, Staphylococcus aureus subsp. aureus COL; identical to SEQ ID NO: 45570
  CDS (1)..(1026)

SEQ ID NO: 63014 - protein, 341 aa, Staphylococcus aureus subsp. aureus COL; identical to SEQ ID NO: 45571

SEQ ID NO: 63015 - DNA, 1167 bp, Gluconobacter oxydans 621H; identical to SEQ ID NO: 45572
  CDS (1)..(1167)

SEQ ID NO: 63016 - protein, 388 aa, Gluconobacter oxydans 621H; identical to SEQ ID NO: 45573

SEQ ID NO: 63017 - DNA, 1215 bp, Danio rerio; identical to SEQ ID NO: 45574
  CDS (1)..(1215)

SEQ ID NO: 63018 - protein, 404 aa, Danio rerio; identical to SEQ ID NO: 45575

SEQ ID NO: 63019 - DNA, 1161 bp, Saccharomyces cerevisiae; identical to SEQ ID NO: 45576
  CDS (1)..(1161)

SEQ ID NO: 63020 - protein, 386 aa, Saccharomyces cerevisiae; identical to SEQ ID NO: 45577

SEQ ID NO: 63021 - DNA, 972 bp, Archaeoglobus fulgidus DSM 4304; identical to SEQ ID NO: 45578
  CDS (1)..(972): transl_table=11

SEQ ID NO: 63022 - protein, 323 aa, Archaeoglobus fulgidus DSM 4304; identical to SEQ ID NO: 45579

SEQ ID NO: 63023 - DNA, 963 bp, Ureaplasma parvum serovar 3 str. ATCC 700970; identical to SEQ ID NO: 45580
  CDS (1)..(963): transl_table=4

SEQ ID NO: 63024 - protein, 320 aa, Ureaplasma parvum serovar 3 str. ATCC 700970; identical to SEQ ID NO: 45581

SEQ ID NO: 63025 - DNA, 1245 bp, Mus musculus; identical to SEQ ID NO: 45582
  CDS (1)..(1245)

SEQ ID NO: 63026 - protein, 414 aa, Mus musculus; identical to SEQ ID NO: 45583

SEQ ID NO: 63027 - DNA, 1089 bp, Mesorhizobium loti MAFF303099; identical to SEQ ID NO: 45584
  CDS (1)..(1089): transl_table=11

SEQ ID NO: 63028 - protein, 362 aa, Mesorhizobium loti MAFF303099; identical to SEQ ID NO: 45585

SEQ ID NO: 63029 - DNA, 1584 bp, Thermoplasma volcanium GSS1; identical to SEQ ID NO: 45586
  CDS (1)..(1584): transl_table=11

SEQ ID NO: 63030 - protein, 527 aa, Thermoplasma volcanium GSS1; identical to SEQ ID NO: 45587

SEQ ID NO: 63031 - DNA, 1050 bp, Aeropyrum pernix K1; identical to SEQ ID NO: 45588
  CDS (1)..(1050): transl_table=11

SEQ ID NO: 63032 - protein, 349 aa, Aeropyrum pernix K1; identical to SEQ ID NO: 45589

SEQ ID NO: 63033 - DNA, 1062 bp, Arabidopsis thaliana; identical to SEQ ID NO: 45590
  CDS (1)..(1062)

SEQ ID NO: 63034 - protein, 353 aa, Arabidopsis thaliana; identical to SEQ ID NO: 45591

SEQ ID NO: 63035 - DNA, 984 bp, Thermotoga maritima MSB8; identical to SEQ ID NO: 45592
  CDS (1)..(984): transl_table=11

SEQ ID NO: 63036 - protein, 327 aa, Thermotoga maritima MSB8; identical to SEQ ID NO: 45593

SEQ ID NO: 63037 - DNA, 1032 bp, Bacillus halodurans C-125; identical to SEQ ID NO: 45594
  CDS (1)..(1032): transl_table=11

SEQ ID NO: 63038 - protein, 343 aa, Bacillus halodurans C-125; identical to SEQ ID NO: 45595

SEQ ID NO: 63039 - DNA, 1032 bp, Pasteurella multocida subsp. multocida str. Pm70; identical to SEQ ID NO: 45596
  CDS (1)..(1032): transl_table=11

SEQ ID NO: 63040 - protein, 343 aa, Pasteurella multocida subsp. multocida str. Pm70; identical to SEQ ID NO: 45597

SEQ ID NO: 63041 - DNA, 1452 bp, Halobacterium salinarum NRC-1; identical to SEQ ID NO: 45598
  CDS (1)..(1452): transl_table=11

SEQ ID NO: 63042 - protein, 483 aa, Halobacterium salinarum NRC-1; identical to SEQ ID NO: 45599

SEQ ID NO: 63043 - DNA, 1008 bp, Campylobacter jejuni subsp. jejuni NCTC 11168; identical to SEQ ID NO: 45600
  CDS (1)..(1008): transl_table=11

SEQ ID NO: 63044 - protein, 335 aa, Campylobacter jejuni subsp. jejuni NCTC 11168; identical to SEQ ID NO: 45601

SEQ ID NO: 63045 - DNA, 1065 bp, Neisseria meningitidis Z2491; identical to SEQ ID NO: 45602
  CDS (1)..(1065): transl_table=11

SEQ ID NO: 63046 - protein, 354 aa, Neisseria meningitidis Z2491; identical to SEQ ID NO: 45603

SEQ ID NO: 63047 - DNA, 1038 bp, Deinococcus radiodurans R1; identical to SEQ ID NO: 45604
  CDS (1)..(1038): transl_table=11

SEQ ID NO: 63048 - protein, 345 aa, Deinococcus radiodurans R1; identical to SEQ ID NO: 45605

SEQ ID NO: 63049 - DNA, 1047 bp, Xylella fastidiosa 9a5c; identical to SEQ ID NO: 45606
  CDS (1)..(1047): transl_table=11

SEQ ID NO: 63050 - protein, 348 aa, Xylella fastidiosa 9a5c; identical to SEQ ID NO: 45607

SEQ ID NO: 63051 - DNA, 1023 bp, Clostridium acetobutylicum ATCC 824; identical to SEQ ID NO: 45608
  CDS (1)..(1023): transl_table=11

SEQ ID NO: 63052 - protein, 340 aa, Clostridium acetobutylicum ATCC 824; identical to SEQ ID NO: 45609

SEQ ID NO: 63053 - DNA, 1101 bp, Agrobacterium tumefaciens str. C58; identical to SEQ ID NO: 45610
  CDS (1)..(1101): transl_table=11

SEQ ID NO: 63054 - protein, 366 aa, Agrobacterium tumefaciens str. C58; identical to SEQ ID NO: 45611

SEQ ID NO: 63055 - DNA, 1011 bp, Streptococcus pneumoniae R6; identical to SEQ ID NO: 45612
  CDS (1)..(1011): transl_table=11

SEQ ID NO: 63056 - protein, 336 aa, Streptococcus pneumoniae R6; identical to SEQ ID NO: 45613

SEQ ID NO: 63057 - DNA, 1011 bp, Sulfolobus tokodaii str. 7; identical to SEQ ID NO: 45614
  CDS (1)..(1011): transl_table=11

SEQ ID NO: 63058 - protein, 336 aa, Sulfolobus tokodaii str. 7; identical to SEQ ID NO: 45615

SEQ ID NO: 63059 - DNA, 1083 bp, Sinorhizobium meliloti 1021; identical to SEQ ID NO: 45616
  CDS (1)..(1083): transl_table=11

SEQ ID NO: 63060 - protein, 360 aa, Sinorhizobium meliloti 1021; identical to SEQ ID NO: 45617

SEQ ID NO: 63061 - DNA, 1590 bp, Thermoplasma acidophilum DSM 1728; identical to SEQ ID NO: 45618
  CDS (1)..(1590): transl_table=11

SEQ ID NO: 63062 - protein, 529 aa, Thermoplasma acidophilum DSM 1728; identical to SEQ ID NO: 45619

SEQ ID NO: 63063 - DNA, 1014 bp, Yersinia pestis CO92; identical to SEQ ID NO: 45620
  CDS (1)..(1014)

SEQ ID NO: 63064 - protein, 337 aa, Yersinia pestis CO92; identical to SEQ ID NO: 45621

SEQ ID NO: 63065 - DNA, 1104 bp, Caulobacter crescentus CB15; identical to SEQ ID NO: 45622
  CDS (1)..(1104): transl_table=11

SEQ ID NO: 63066 - protein, 367 aa, Caulobacter crescentus CB15; identical to SEQ ID NO: 45623

SEQ ID NO: 63067 - DNA, 1035 bp, Chlamydophila pneumoniae AR39; identical to SEQ ID NO: 45624
  CDS (1)..(1035): transl_table=11

SEQ ID NO: 63068 - protein, 344 aa, Chlamydophila pneumoniae AR39; identical to SEQ ID NO: 45625

SEQ ID NO: 63069 - DNA, 1035 bp, Listeria innocua Clip11262; identical to SEQ ID NO: 45626
  CDS (1)..(1035): transl_table=11

SEQ ID NO: 63070 - protein, 344 aa, Listeria innocua Clip11262; identical to SEQ ID NO: 45627

SEQ ID NO: 63071 - DNA, 1041 bp, Nostoc sp. PCC 7120; identical to SEQ ID NO: 45628
  CDS (1)..(1041): transl_table=11

SEQ ID NO: 63072 - protein, 346 aa, Nostoc sp. PCC 7120; identical to SEQ ID NO: 45629

SEQ ID NO: 63073 - DNA, 1176 bp, Caenorhabditis elegans; identical to SEQ ID NO: 45630
  CDS (1)..(1176)

SEQ ID NO: 63074 - protein, 391 aa, Caenorhabditis elegans; identical to SEQ ID NO: 45631

SEQ ID NO: 63075 - DNA, 1266 bp, Caenorhabditis elegans; identical to SEQ ID NO: 45632
  CDS (1)..(1266)

SEQ ID NO: 63076 - protein, 421 aa, Caenorhabditis elegans; identical to SEQ ID NO: 45633

SEQ ID NO: 63077 - DNA, 1032 bp, Pyrobaculum aerophilum str. IM2; identical to SEQ ID NO: 45634
  CDS (1)..(1032): transl_table=11

SEQ ID NO: 63078 - protein, 343 aa, Pyrobaculum aerophilum str. IM2; identical to SEQ ID NO: 45635

SEQ ID NO: 63079 - DNA, 1020 bp, Clostridium perfringens str. 13; identical to SEQ ID NO: 45636
  CDS (1)..(1020): transl_table=11

SEQ ID NO: 63080 - protein, 339 aa, Clostridium perfringens str. 13; identical to SEQ ID NO: 45637

SEQ ID NO: 63081 - DNA, 1443 bp, Arabidopsis thaliana; identical to SEQ ID NO: 45638
  CDS (1)..(1443)

SEQ ID NO: 63082 - protein, 480 aa, Arabidopsis thaliana; identical to SEQ ID NO: 45639

SEQ ID NO: 63083 - DNA, 975 bp, Pyrococcus furiosus DSM 3638; identical to SEQ ID NO: 45640
  CDS (1)..(975): transl_table=11

SEQ ID NO: 63084 - protein, 324 aa, Pyrococcus furiosus DSM 3638; identical to SEQ ID NO: 45641

SEQ ID NO: 63085 - DNA, 1239 bp, Schizosaccharomyces pombe; identical to SEQ ID NO: 45642
  CDS (1)..(1239)

SEQ ID NO: 63086 - protein, 412 aa, Schizosaccharomyces pombe; identical to SEQ ID NO: 45643

SEQ ID NO: 63087 - DNA, 1041 bp, Schizosaccharomyces pombe; identical to SEQ ID NO: 45644
  CDS (1)..(1041)

SEQ ID NO: 63088 - protein, 346 aa, Schizosaccharomyces pombe; identical to SEQ ID NO: 45645

SEQ ID NO: 63089 - DNA, 996 bp, Encephalitozoon cuniculi; identical to SEQ ID NO: 45646
  CDS (1)..(996)

SEQ ID NO: 63090 - protein, 331 aa, Encephalitozoon cuniculi; identical to SEQ ID NO: 45647

SEQ ID NO: 63091 - DNA, 1035 bp, Corynebacterium glutamicum ATCC 13032; identical to SEQ ID NO: 45648
  CDS (1)..(1035): transl_table=11

SEQ ID NO: 63092 - protein, 344 aa, Corynebacterium glutamicum ATCC 13032; identical to SEQ ID NO: 45649

SEQ ID NO: 63093 - DNA, 1026 bp, Fusobacterium nucleatum subsp. nucleatum ATCC 25586; identical to SEQ ID NO: 45650
  CDS (1)..(1026): transl_table=11

SEQ ID NO: 63094 - protein, 341 aa, Fusobacterium nucleatum subsp. nucleatum ATCC 25586; identical to SEQ ID NO: 45651

SEQ ID NO: 63095 - DNA, 1230 bp, Drosophila melanogaster; identical to SEQ ID NO: 45652
  CDS (1)..(1230)

SEQ ID NO: 63096 - protein, 409 aa, Drosophila melanogaster; identical to SEQ ID NO: 45653

SEQ ID NO: 63097 - DNA, 1041 bp, Methanopyrus kandleri AV19; identical to SEQ ID NO: 45654
  CDS (1)..(1041): transl_table=11

SEQ ID NO: 63098 - protein, 346 aa, Methanopyrus kandleri AV19; identical to SEQ ID NO: 45655

SEQ ID NO: 63099 - DNA, 1644 bp, Methanosarcina acetivorans C2A; identical to SEQ ID NO: 45656
  CDS (1)..(1644): transl_table=11

SEQ ID NO: 63100 - protein, 547 aa, Methanosarcina acetivorans C2A; identical to SEQ ID NO: 45657

SEQ ID NO: 63101 - DNA, 1689 bp, Methanosarcina mazei Go1; identical to SEQ ID NO: 45658
  CDS (1)..(1689): transl_table=11

SEQ ID NO: 63102 - protein, 562 aa, Methanosarcina mazei Go1; identical to SEQ ID NO: 45659

SEQ ID NO: 63103 - DNA, 1065 bp, Xanthomonas campestris pv. campestris str. ATCC 33913; identical to SEQ ID NO: 45660
  CDS (1)..(1065): transl_table=11

SEQ ID NO: 63104 - protein, 354 aa, Xanthomonas campestris pv. campestris str. ATCC 33913; identical to SEQ ID NO: 45661

SEQ ID NO: 63105 - DNA, 1059 bp, Xanthomonas axonopodis pv. citri str. 306; identical to SEQ ID NO: 45662
  CDS (1)..(1059): transl_table=11

SEQ ID NO: 63106 - protein, 352 aa, Xanthomonas axonopodis pv. citri str. 306; identical to SEQ ID NO: 45663

SEQ ID NO: 63107 - DNA, 1044 bp, Drosophila melanogaster; identical to SEQ ID NO: 45664
  CDS (1)..(1044)

SEQ ID NO: 63108 - protein, 347 aa, Drosophila melanogaster; identical to SEQ ID NO: 45665

SEQ ID NO: 63109 - DNA, 1062 bp, Chlorobium tepidum TLS; identical to SEQ ID NO: 45666
  CDS (1)..(1062): transl_table=11

SEQ ID NO: 63110 - protein, 353 aa, Chlorobium tepidum TLS; identical to SEQ ID NO: 45667

SEQ ID NO: 63111 - DNA, 1062 bp, Thermosynechococcus elongatus BP-1; identical to SEQ ID NO: 45668
  CDS (1)..(1062): transl_table=11

SEQ ID NO: 63112 - protein, 353 aa, Thermosynechococcus elongatus BP-1; identical to SEQ ID NO: 45669

SEQ ID NO: 63113 - DNA, 1026 bp, Oceanobacillus iheyensis HTE831; identical to SEQ ID NO: 45670
  CDS (1)..(1026): transl_table=11

SEQ ID NO: 63114 - protein, 341 aa, Oceanobacillus iheyensis HTE831; identical to SEQ ID NO: 45671

SEQ ID NO: 63115 - DNA, 1080 bp, Brucella suis 1330; identical to SEQ ID NO: 45672
  CDS (1)..(1080): transl_table=11

SEQ ID NO: 63116 - protein, 359 aa, Brucella suis 1330; identical to SEQ ID NO: 45673

SEQ ID NO: 63117 - DNA, 1017 bp, Leptospira interrogans serovar Lai str. 56601; identical to SEQ ID NO: 45674
  CDS (1)..(1017): transl_table=11

SEQ ID NO: 63118 - protein, 338 aa, Leptospira interrogans serovar Lai str. 56601; identical to SEQ ID NO: 45675

SEQ ID NO: 63119 - DNA, 1017 bp, Shewanella oneidensis MR-1; identical to SEQ ID NO: 45676
  CDS (1)..(1017): transl_table=11

SEQ ID NO: 63120 - protein, 338 aa, Shewanella oneidensis MR-1; identical to SEQ ID NO: 45677

SEQ ID NO: 63121 - DNA, 1011 bp, Streptococcus mutans UA159; identical to SEQ ID NO: 45678
  CDS (1)..(1011): transl_table=11

SEQ ID NO: 63122 - protein, 336 aa, Streptococcus mutans UA159; identical to SEQ ID NO: 45679

SEQ ID NO: 63123 - DNA, 1035 bp, Corynebacterium efficiens YS-314; identical to SEQ ID NO: 45680
  CDS (1)..(1035): transl_table=11

SEQ ID NO: 63124 - protein, 344 aa, Corynebacterium efficiens YS-314; identical to SEQ ID NO: 45681

SEQ ID NO: 63125 - DNA, 1026 bp, Pseudomonas putida KT2440; identical to SEQ ID NO: 45682
  CDS (1)..(1026): transl_table=11

SEQ ID NO: 63126 - protein, 341 aa, Pseudomonas putida KT2440; identical to SEQ ID NO: 45683

SEQ ID NO: 63127 - DNA, 1023 bp, Staphylococcus epidermidis ATCC 12228; identical to SEQ ID NO: 45684
  CDS (1)..(1023): transl_table=11

SEQ ID NO: 63128 - protein, 340 aa, Staphylococcus epidermidis ATCC 12228; identical to SEQ ID NO: 45685

SEQ ID NO: 63129 - DNA, 1074 bp, Bradyrhizobium japonicum USDA 110; identical to SEQ ID NO: 45686
  CDS (1)..(1074)

SEQ ID NO: 63130 - protein, 357 aa, Bradyrhizobium japonicum USDA 110; identical to SEQ ID NO: 45687

SEQ ID NO: 63131 - DNA, 1023 bp, Clostridium tetani E88; identical to SEQ ID NO: 45688
  CDS (1)..(1023): transl_table=11

SEQ ID NO: 63132 - protein, 340 aa, Clostridium tetani E88; identical to SEQ ID NO: 45689

SEQ ID NO: 63133 - DNA, 1047 bp, Lactobacillus plantarum WCFS1; identical to SEQ ID NO: 45690
  CDS (1)..(1047): transl_table=11

SEQ ID NO: 63134 - protein, 348 aa, Lactobacillus plantarum WCFS1; identical to SEQ ID NO: 45691

SEQ ID NO: 63135 - DNA, 1206 bp, Tropheryma whipplei str. Twist; identical to SEQ ID NO: 45692
  CDS (1)..(1206): transl_table=11

SEQ ID NO: 63136 - protein, 401 aa, Tropheryma whipplei str. Twist; identical to SEQ ID NO: 45693

SEQ ID NO: 63137 - DNA, 1020 bp, Bacteroides thetaiotaomicron VPI-5482; identical to SEQ ID NO: 45694
  CDS (1)..(1020): transl_table=11

SEQ ID NO: 63138 - protein, 339 aa, Bacteroides thetaiotaomicron VPI-5482; identical to SEQ ID NO: 45695

SEQ ID NO: 63139 - DNA, 1047 bp, Enterococcus faecalis V583; identical to SEQ ID NO: 45696
  CDS (1)..(1047): transl_table=11

SEQ ID NO: 63140 - protein, 348 aa, Enterococcus faecalis V583; identical to SEQ ID NO: 45697

SEQ ID NO: 63141 - DNA, 1020 bp, Coxiella burnetii RSA 493; identical to SEQ ID NO: 45698
  CDS (1)..(1020): transl_table=11

SEQ ID NO: 63142 - protein, 339 aa, Coxiella burnetii RSA 493; identical to SEQ ID NO: 45699

SEQ ID NO: 63143 - DNA, 1125 bp, Streptomyces avermitilis MA-4680; identical to SEQ ID NO: 45700
  CDS (1)..(1125)

SEQ ID NO: 63144 - protein, 374 aa, Streptomyces avermitilis MA-4680; identical to SEQ ID NO: 45701

SEQ ID NO: 63145 - DNA, 1035 bp, Chlamydophila caviae GPIC; identical to SEQ ID NO: 45702
  CDS (1)..(1035): transl_table=11

SEQ ID NO: 63146 - protein, 344 aa, Chlamydophila caviae GPIC; identical to SEQ ID NO: 45703

SEQ ID NO: 63147 - DNA, 1014 bp, Nitrosomonas europaea ATCC 19718; identical to SEQ ID NO: 45704
  CDS (1)..(1014): transl_table=11

SEQ ID NO: 63148 - protein, 337 aa, Nitrosomonas europaea ATCC 19718; identical to SEQ ID NO: 45705

SEQ ID NO: 63149 - DNA, 1077 bp, Helicobacter hepaticus ATCC 51449; identical to SEQ ID NO: 45706
  CDS (1)..(1077): transl_table=11

SEQ ID NO: 63150 - protein, 358 aa, Helicobacter hepaticus ATCC 51449; identical to SEQ ID NO: 45707

SEQ ID NO: 63151 - DNA, 1077 bp, Rhodopirellula baltica SH 1; identical to SEQ ID NO: 45708
  CDS (1)..(1077): transl_table=11

SEQ ID NO: 63152 - protein, 358 aa, Rhodopirellula baltica SH 1; identical to SEQ ID NO: 45709

SEQ ID NO: 63153 - DNA, 1023 bp, Wigglesworthia glossinidia endosymbiont of Glossina brevipalpis; identical to SEQ ID NO: 45710
  CDS (1)..(1023): transl_table=11

SEQ ID NO: 63154 - protein, 340 aa, Wigglesworthia glossinidia endosymbiont of Glossina brevipalpis; identical to SEQ ID NO: 45711

SEQ ID NO: 63155 - DNA, 1047 bp, Haemophilus ducreyi 35000HP; identical to SEQ ID NO: 45712
  CDS (1)..(1047): transl_table=11

SEQ ID NO: 63156 - protein, 348 aa, Haemophilus ducreyi 35000HP; identical to SEQ ID NO: 45713

SEQ ID NO: 63157 - DNA, 1062 bp, Candidatus Blochmannia floridanus; identical to SEQ ID NO: 45714
  CDS (1)..(1062): transl_table=11

SEQ ID NO: 63158 - protein, 353 aa, Candidatus Blochmannia floridanus; identical to SEQ ID NO: 45715

SEQ ID NO: 63159 - DNA, 1041 bp, Bordetella pertussis Tohama I; identical to SEQ ID NO: 45716
  CDS (1)..(1041): transl_table=11

SEQ ID NO: 63160 - protein, 346 aa, Bordetella pertussis Tohama I; identical to SEQ ID NO: 45717

SEQ ID NO: 63161 - DNA, 1041 bp, Bordetella parapertussis 12822; identical to SEQ ID NO: 45718
  CDS (1)..(1041): transl_table=11

SEQ ID NO: 63162 - protein, 346 aa, Bordetella parapertussis 12822; identical to SEQ ID NO: 45719

SEQ ID NO: 63163 - DNA, 1071 bp, Prochlorococcus marinus subsp. pastoris str. CCMP1986; identical to SEQ ID NO: 45720
  CDS (1)..(1071): transl_table=11

SEQ ID NO: 63164 - protein, 356 aa, Prochlorococcus marinus subsp. pastoris str. CCMP1986; identical to SEQ ID NO: 45721

SEQ ID NO: 63165 - DNA, 1071 bp, Prochlorococcus marinus str. MIT 9313; identical to SEQ ID NO: 45722
  CDS (1)..(1071): transl_table=11

SEQ ID NO: 63166 - protein, 356 aa, Prochlorococcus marinus str. MIT 9313; identical to SEQ ID NO: 45723

SEQ ID NO: 63167 - DNA, 1065 bp, Synechococcus sp. WH 8102; identical to SEQ ID NO: 45724
  CDS (1)..(1065): transl_table=11

SEQ ID NO: 63168 - protein, 354 aa, Synechococcus sp. WH 8102; identical to SEQ ID NO: 45725

SEQ ID NO: 63169 - DNA, 1026 bp, Chromobacterium violaceum ATCC 12472; identical to SEQ ID NO: 45726
  CDS (1)..(1026): transl_table=11

SEQ ID NO: 63170 - protein, 341 aa, Chromobacterium violaceum ATCC 12472; identical to SEQ ID NO: 45727

SEQ ID NO: 63171 - DNA, 1026 bp, Porphyromonas gingivalis W83; identical to SEQ ID NO: 45728
  CDS (1)..(1026): transl_table=11

SEQ ID NO: 63172 - protein, 341 aa, Porphyromonas gingivalis W83; identical to SEQ ID NO: 45729

SEQ ID NO: 63173 - DNA, 996 bp, Wolinella succinogenes DSM 1740; identical to SEQ ID NO: 45730
  CDS (1)..(996): transl_table=11

SEQ ID NO: 63174 - protein, 331 aa, Wolinella succinogenes DSM 1740; identical to SEQ ID NO: 45731

SEQ ID NO: 63175 - DNA, 1029 bp, Gloeobacter violaceus PCC 7421; identical to SEQ ID NO: 45732
  CDS (1)..(1029): transl_table=11

SEQ ID NO: 63176 - protein, 342 aa, Gloeobacter violaceus PCC 7421; identical to SEQ ID NO: 45733

SEQ ID NO: 63177 - DNA, 1014 bp, Photorhabdus luminescens subsp. laumondii TTO1; identical to SEQ ID NO: 45734
  CDS (1)..(1014): transl_table=11

SEQ ID NO: 63178 - protein, 337 aa, Photorhabdus luminescens subsp. laumondii TTO1; identical to SEQ ID NO: 45735

SEQ ID NO: 63179 - DNA, 1020 bp, Vibrio vulnificus YJ016; identical to SEQ ID NO: 45736
  CDS (1)..(1020): transl_table=11

SEQ ID NO: 63180 - protein, 339 aa, Vibrio vulnificus YJ016; identical to SEQ ID NO: 45737

SEQ ID NO: 63181 - DNA, 1053 bp, Corynebacterium diphtheriae NCTC 13129; identical to SEQ ID NO: 45738
  CDS (1)..(1053): transl_table=11

SEQ ID NO: 63182 - protein, 350 aa, Corynebacterium diphtheriae NCTC 13129; identical to SEQ ID NO: 45739

SEQ ID NO: 63183 - DNA, 1170 bp, Rhodopseudomonas palustris CGA009; identical to SEQ ID NO: 45740
  CDS (1)..(1170): transl_table=11

SEQ ID NO: 63184 - protein, 389 aa, Rhodopseudomonas palustris CGA009; identical to SEQ ID NO: 45741

SEQ ID NO: 63185 - DNA, 1026 bp, Mycobacterium avium subsp. paratuberculosis str. k10; identical to SEQ ID NO: 45742
  CDS (1)..(1026): transl_table=11

SEQ ID NO: 63186 - protein, 341 aa, Mycobacterium avium subsp. paratuberculosis str. k10; identical to SEQ ID NO: 45743

SEQ ID NO: 63187 - DNA, 945 bp, Nanoarchaeum equitans Kin4-M; identical to SEQ ID NO: 45744
  CDS (1)..(945): transl_table=11

SEQ ID NO: 63188 - protein, 314 aa, Nanoarchaeum equitans Kin4-M; identical to SEQ ID NO: 45745

SEQ ID NO: 63189 - DNA, 1008 bp, Wolbachia endosymbiont of Drosophila melanogaster; identical to SEQ ID NO: 45746
  CDS (1)..(1008): transl_table=11

SEQ ID NO: 63190 - protein, 335 aa, Wolbachia endosymbiont of Drosophila melanogaster; identical to SEQ ID NO: 45747

SEQ ID NO: 63191 - DNA, 1038 bp, Bdellovibrio bacteriovorus HD100; identical to SEQ ID NO: 45748
  CDS (1)..(1038): transl_table=11

SEQ ID NO: 63192 - protein, 345 aa, Bdellovibrio bacteriovorus HD100; identical to SEQ ID NO: 45749

SEQ ID NO: 63193 - DNA, 1017 bp, Treponema denticola ATCC 35405; identical to SEQ ID NO: 45750
  CDS (1)..(1017): transl_table=11

SEQ ID NO: 63194 - protein, 338 aa, Treponema denticola ATCC 35405; identical to SEQ ID NO: 45751

SEQ ID NO: 63195 - DNA, 960 bp, Mycoplasma mycoides subsp. mycoides SC str. PG1; identical to SEQ ID NO: 45752
  CDS (1)..(960): transl_table=4

SEQ ID NO: 63196 - protein, 319 aa, Mycoplasma mycoides subsp. mycoides SC str. PG1; identical to SEQ ID NO: 45753

SEQ ID NO: 63197 - DNA, 1017 bp, Bacillus cereus ATCC 10987; identical to SEQ ID NO: 45754
  CDS (1)..(1017): transl_table=11

SEQ ID NO: 63198 - protein, 338 aa, Bacillus cereus ATCC 10987; identical to SEQ ID NO: 45755

SEQ ID NO: 63199 - DNA, 1158 bp, Eremothecium gossypii; identical to SEQ ID NO: 45756
  CDS (1)..(1158)

SEQ ID NO: 63200 - protein, 385 aa, Eremothecium gossypii; identical to SEQ ID NO: 45757

SEQ ID NO: 63201 - DNA, 1155 bp, Eremothecium gossypii; identical to SEQ ID NO: 45758
  CDS (1)..(1155)

SEQ ID NO: 63202 - protein, 384 aa, Eremothecium gossypii; identical to SEQ ID NO: 45759

SEQ ID NO: 63203 - DNA, 1647 bp, Methanococcus maripaludis S2; identical to SEQ ID NO: 45760
  CDS (1)..(1647): transl_table=11

SEQ ID NO: 63204 - protein, 548 aa, Methanococcus maripaludis S2; identical to SEQ ID NO: 45761

SEQ ID NO: 63205 - DNA, 1053 bp, Anopheles gambiae str. PEST; identical to SEQ ID NO: 45762
  CDS (1)..(1053)

SEQ ID NO: 63206 - protein, 350 aa, Anopheles gambiae str. PEST; identical to SEQ ID NO: 45763

SEQ ID NO: 63207 - DNA, 1209 bp, Anopheles gambiae str. PEST; identical to SEQ ID NO: 45764
  CDS (1)..(1209)

SEQ ID NO: 63208 - protein, 402 aa, Anopheles gambiae str. PEST; identical to SEQ ID NO: 45765

SEQ ID NO: 63209 - DNA, 1065 bp, Neurospora crassa; identical to SEQ ID NO: 45766
  CDS (1)..(1065)

SEQ ID NO: 63210 - protein, 354 aa, Neurospora crassa; identical to SEQ ID NO: 45767

SEQ ID NO: 63211 - DNA, 1065 bp, Magnaporthe grisea 70-15; identical to SEQ ID NO: 45768
  CDS (1)..(1065)

SEQ ID NO: 63212 - protein, 354 aa, Magnaporthe grisea 70-15; identical to SEQ ID NO: 45769

SEQ ID NO: 63213 - DNA, 1092 bp, Gibberella zeae PH-1; identical to SEQ ID NO: 45770
  CDS (1)..(1092)

SEQ ID NO: 63214 - protein, 363 aa, Gibberella zeae PH-1; identical to SEQ ID NO: 45771

SEQ ID NO: 63215 - DNA, 1008 bp, Apis mellifera; identical to SEQ ID NO: 45772
  CDS (1)..(1008)

SEQ ID NO: 63216 - protein, 335 aa, Apis mellifera; identical to SEQ ID NO: 45773

SEQ ID NO: 63217 - DNA, 1149 bp, Apis mellifera; identical to SEQ ID NO: 45774
  CDS (1)..(1149)

SEQ ID NO: 63218 - protein, 382 aa, Apis mellifera; identical to SEQ ID NO: 45775

SEQ ID NO: 63219 - DNA, 1245 bp, Ustilago maydis 521; identical to SEQ ID NO: 45776
  CDS (1)..(1245)

SEQ ID NO: 63220 - protein, 414 aa, Ustilago maydis 521; identical to SEQ ID NO: 45777

SEQ ID NO: 63221 - DNA, 1092 bp, Aspergillus nidulans FGSC A4; identical to SEQ ID NO: 45778
  CDS (1)..(1092)

SEQ ID NO: 63222 - protein, 363 aa, Aspergillus nidulans FGSC A4; identical to SEQ ID NO: 45779

SEQ ID NO: 63223 - DNA, 1494 bp, Aspergillus nidulans FGSC A4; identical to SEQ ID NO: 45780
  CDS (1)..(1494)

SEQ ID NO: 63224 - protein, 497 aa, Aspergillus nidulans FGSC A4; identical to SEQ ID NO: 45781

SEQ ID NO: 63225 - DNA, 1122 bp, Candida glabrata CBS138; identical to SEQ ID NO: 45782
  CDS (1)..(1122)

SEQ ID NO: 63226 - protein, 373 aa, Candida glabrata CBS138; identical to SEQ ID NO: 45783

SEQ ID NO: 63227 - DNA, 1188 bp, Candida glabrata CBS138; identical to SEQ ID NO: 45784
  CDS (1)..(1188)

SEQ ID NO: 63228 - protein, 395 aa, Candida glabrata CBS138; identical to SEQ ID NO: 45785

SEQ ID NO: 63229 - DNA, 1173 bp, Kluyveromyces lactis NRRL Y-1140; identical to SEQ ID NO: 45786
  CDS (1)..(1173)

SEQ ID NO: 63230 - protein, 390 aa, Kluyveromyces lactis NRRL Y-1140; identical to SEQ ID NO: 45787

SEQ ID NO: 63231 - DNA, 1158 bp, Kluyveromyces lactis NRRL Y-1140; identical to SEQ ID NO: 45788
  CDS (1)..(1158)

SEQ ID NO: 63232 - protein, 385 aa, Kluyveromyces lactis NRRL Y-1140; identical to SEQ ID NO: 45789

SEQ ID NO: 63233 - DNA, 1122 bp, Debaryomyces hansenii CBS767; identical to SEQ ID NO: 45790
  CDS (1)..(1122)

SEQ ID NO: 63234 - protein, 373 aa, Debaryomyces hansenii CBS767; identical to SEQ ID NO: 45791

SEQ ID NO: 63235 - DNA, 1329 bp, Debaryomyces hansenii CBS767; identical to SEQ ID NO: 45792
  CDS (1)..(1329)

SEQ ID NO: 63236 - protein, 442 aa, Debaryomyces hansenii CBS767; identical to SEQ ID NO: 45793

SEQ ID NO: 63237 - DNA, 1071 bp, Yarrowia lipolytica CLIB99; identical to SEQ ID NO: 45794
  CDS (1)..(1071)

SEQ ID NO: 63238 - protein, 356 aa, Yarrowia lipolytica CLIB99; identical to SEQ ID NO: 45795

SEQ ID NO: 63239 - DNA, 1131 bp, Yarrowia lipolytica CLIB99; identical to SEQ ID NO: 45796
  CDS (1)..(1131)

SEQ ID NO: 63240 - protein, 376 aa, Yarrowia lipolytica CLIB99; identical to SEQ ID NO: 45797

SEQ ID NO: 63241 - DNA, 1737 bp, Pan troglodytes; identical to SEQ ID NO: 45798
  CDS (1)..(1737)

SEQ ID NO: 63242 - protein, 578 aa, Pan troglodytes; identical to SEQ ID NO: 45799

SEQ ID NO: 63243 - DNA, 972 bp, Thermus thermophilus HB27; identical to SEQ ID NO: 45800
  CDS (1)..(972): transl_table=11

SEQ ID NO: 63244 - protein, 323 aa, Thermus thermophilus HB27; identical to SEQ ID NO: 45801

SEQ ID NO: 63245 - DNA, 1032 bp, Parachlamydia sp. UWE25; identical to SEQ ID NO: 45802
  CDS (1)..(1032): transl_table=11

SEQ ID NO: 63246 - protein, 343 aa, Parachlamydia sp. UWE25; identical to SEQ ID NO: 45803

SEQ ID NO: 63247 - DNA, 1086 bp, Desulfovibrio vulgaris subsp. vulgaris str. Hildenborough; identical to SEQ ID NO: 45804
  CDS (1)..(1086): transl_table=11

SEQ ID NO: 63248 - protein, 361 aa, Desulfovibrio vulgaris subsp. vulgaris str. Hildenborough; identical to SEQ ID NO: 45805

SEQ ID NO: 63249 - DNA, 1023 bp, Listeria monocytogenes str. 4b F2365; identical to SEQ ID NO: 45806
  CDS (1)..(1023): transl_table=11

SEQ ID NO: 63250 - protein, 340 aa, Listeria monocytogenes str. 4b F2365; identical to SEQ ID NO: 45807

SEQ ID NO: 63251 - DNA, 918 bp, Mycoplasma mobile 163K; identical to SEQ ID NO: 45808
  CDS (1)..(918): transl_table=4

SEQ ID NO: 63252 - protein, 305 aa, Mycoplasma mobile 163K; identical to SEQ ID NO: 45809

SEQ ID NO: 63253 - DNA, 1590 bp, Picrophilus torridus DSM 9790; identical to SEQ ID NO: 45810
  CDS (1)..(1590): transl_table=11

SEQ ID NO: 63254 - protein, 529 aa, Picrophilus torridus DSM 9790; identical to SEQ ID NO: 45811

SEQ ID NO: 63255 - DNA, 1095 bp, Bartonella quintana str. Toulouse; identical to SEQ ID NO: 45812
  CDS (1)..(1095): transl_table=11

SEQ ID NO: 63256 - protein, 364 aa, Bartonella quintana str. Toulouse; identical to SEQ ID NO: 45813

SEQ ID NO: 63257 - DNA, 1095 bp, Bartonella henselae str. Houston-1; identical to SEQ ID NO: 45814
  CDS (1)..(1095): transl_table=11

SEQ ID NO: 63258 - protein, 364 aa, Bartonella henselae str. Houston-1; identical to SEQ ID NO: 45815

SEQ ID NO: 63259 - DNA, 1023 bp, Acinetobacter sp. ADP1; identical to SEQ ID NO: 45816
  CDS (1)..(1023): transl_table=11

SEQ ID NO: 63260 - protein, 340 aa, Acinetobacter sp. ADP1; identical to SEQ ID NO: 45817

SEQ ID NO: 63261 - DNA, 1014 bp, Erwinia carotovora subsp. atroseptica SCRI1043; identical to SEQ ID NO: 45818
  CDS (1)..(1014)

SEQ ID NO: 63262 - protein, 337 aa, Erwinia carotovora subsp. atroseptica SCRI1043; identical to SEQ ID NO: 45819

SEQ ID NO: 63263 - DNA, 954 bp, Mesoplasma florum L1; identical to SEQ ID NO: 45820
  CDS (1)..(954): transl_table=4

SEQ ID NO: 63264 - protein, 317 aa, Mesoplasma florum L1; identical to SEQ ID NO: 45821

SEQ ID NO: 63265 - DNA, 1044 bp, Propionibacterium acnes KPA171202; identical to SEQ ID NO: 45822
  CDS (1)..(1044): transl_table=11

SEQ ID NO: 63266 - protein, 347 aa, Propionibacterium acnes KPA171202; identical to SEQ ID NO: 45823

SEQ ID NO: 63267 - DNA, 1083 bp, Leifsonia xyli subsp. xyli str. CTCB07; identical to SEQ ID NO: 45824
  CDS (1)..(1083): transl_table=11

SEQ ID NO: 63268 - protein, 360 aa, Leifsonia xyli subsp. xyli str. CTCB07; identical to SEQ ID NO: 45825

SEQ ID NO: 63269 - DNA, 1035 bp, Desulfotalea psychrophila LSv54; identical to SEQ ID NO: 45826
  CDS (1)..(1035): transl_table=11

SEQ ID NO: 63270 - protein, 344 aa, Desulfotalea psychrophila LSv54; identical to SEQ ID NO: 45827

SEQ ID NO: 63271 - DNA, 1017 bp, Borrelia garinii PBi; identical to SEQ ID NO: 45828
  CDS (1)..(1017): transl_table=11

SEQ ID NO: 63272 - protein, 338 aa, Borrelia garinii PBi; identical to SEQ ID NO: 45829

SEQ ID NO: 63273 - DNA, 963 bp, Symbiobacterium thermophilum IAM 14863; identical to SEQ ID NO: 45830
  CDS (1)..(963): transl_table=11

SEQ ID NO: 63274 - protein, 320 aa, Symbiobacterium thermophilum IAM 14863; identical to SEQ ID NO: 45831

SEQ ID NO: 63275 - DNA, 1026 bp, Symbiobacterium thermophilum IAM 14863; identical to SEQ ID NO: 45832
  CDS (1)..(1026): transl_table=11

SEQ ID NO: 63276 - protein, 341 aa, Symbiobacterium thermophilum IAM 14863; identical to SEQ ID NO: 45833

SEQ ID NO: 63277 - DNA, 1035 bp, Mannheimia succiniciproducens MBEL55E; identical to SEQ ID NO: 45834
  CDS (1)..(1035): transl_table=11

SEQ ID NO: 63278 - protein, 344 aa, Mannheimia succiniciproducens MBEL55E; identical to SEQ ID NO: 45835

SEQ ID NO: 63279 - DNA, 1020 bp, Bacteroides fragilis YCH46; identical to SEQ ID NO: 45836
  CDS (1)..(1020): transl_table=11

SEQ ID NO: 63280 - protein, 339 aa, Bacteroides fragilis YCH46; identical to SEQ ID NO: 45837

SEQ ID NO: 63281 - DNA, 1014 bp, Methylococcus capsulatus str. Bath; identical to SEQ ID NO: 45838
  CDS (1)..(1014): transl_table=11

SEQ ID NO: 63282 - protein, 337 aa, Methylococcus capsulatus str. Bath; identical to SEQ ID NO: 45839

SEQ ID NO: 63283 - DNA, 1035 bp, Nocardia farcinica IFM 10152; identical to SEQ ID NO: 45840
  CDS (1)..(1035): transl_table=11

SEQ ID NO: 63284 - protein, 344 aa, Nocardia farcinica IFM 10152; identical to SEQ ID NO: 45841

SEQ ID NO: 63285 - DNA, 1002 bp, Legionella pneumophila str. Paris; identical to SEQ ID NO: 45842
  CDS (1)..(1002): transl_table=11

SEQ ID NO: 63286 - protein, 333 aa, Legionella pneumophila str. Paris; identical to SEQ ID NO: 45843

SEQ ID NO: 63287 - DNA, 1020 bp, Photobacterium profundum SS9; identical to SEQ ID NO: 45844
  CDS (1)..(1020): transl_table=11

SEQ ID NO: 63288 - protein, 339 aa, Photobacterium profundum SS9; identical to SEQ ID NO: 45845

SEQ ID NO: 63289 - DNA, 1029 bp, Geobacillus kaustophilus HTA426; identical to SEQ ID NO: 45846
  CDS (1)..(1029): transl_table=11

SEQ ID NO: 63290 - protein, 342 aa, Geobacillus kaustophilus HTA426; identical to SEQ ID NO: 45847

SEQ ID NO: 63291 - DNA, 1026 bp, Anaplasma marginale str. St. Maries; identical to SEQ ID NO: 45848
  CDS (1)..(1026): transl_table=11

SEQ ID NO: 63292 - protein, 341 aa, Anaplasma marginale str. St. Maries; identical to SEQ ID NO: 45849

SEQ ID NO: 63293 - DNA, 1035 bp, Idiomarina loihiensis L2TR; identical to SEQ ID NO: 45850
  CDS (1)..(1035): transl_table=11

SEQ ID NO: 63294 - protein, 344 aa, Idiomarina loihiensis L2TR; identical to SEQ ID NO: 45851

SEQ ID NO: 63295 - DNA, 1029 bp, Azoarcus sp. EbN1; identical to SEQ ID NO: 45852
  CDS (1)..(1029): transl_table=11

SEQ ID NO: 63296 - protein, 342 aa, Azoarcus sp. EbN1; identical to SEQ ID NO: 45853

SEQ ID NO: 63297 - DNA, 1092 bp, Zymomonas mobilis subsp. mobilis ZM4; identical to SEQ ID NO: 45854
  CDS (1)..(1092): transl_table=11

SEQ ID NO: 63298 - protein, 363 aa, Zymomonas mobilis subsp. mobilis ZM4; identical to SEQ ID NO: 45855

SEQ ID NO: 63299 - DNA, 1098 bp, Silicibacter pomeroyi DSS-3; identical to SEQ ID NO: 45856
  CDS (1)..(1098): transl_table=11

SEQ ID NO: 63300 - protein, 365 aa, Silicibacter pomeroyi DSS-3; identical to SEQ ID NO: 45857

SEQ ID NO: 63301 - DNA, 1011 bp, Francisella tularensis subsp. tularensis Schu 4; identical to SEQ ID NO: 45858
  CDS (1)..(1011): transl_table=11

SEQ ID NO: 63302 - protein, 336 aa, Francisella tularensis subsp. tularensis Schu 4; identical to SEQ ID NO: 45859

SEQ ID NO: 63303 - DNA, 1050 bp, Synechococcus elongatus PCC 6301; identical to SEQ ID NO: 45860
  CDS (1)..(1050): transl_table=11

SEQ ID NO: 63304 - protein, 349 aa, Synechococcus elongatus PCC 6301; identical to SEQ ID NO: 45861

SEQ ID NO: 63305 - DNA, 1047 bp, Ehrlichia ruminantium str. Welgevonden; identical to SEQ ID NO: 45862
  CDS (1)..(1047): transl_table=11

SEQ ID NO: 63306 - protein, 348 aa, Ehrlichia ruminantium str. Welgevonden; identical to SEQ ID NO: 45863

SEQ ID NO: 63307 - DNA, 981 bp, Dehalococcoides ethenogenes 195; identical to SEQ ID NO: 45864
  CDS (1)..(981): transl_table=11

SEQ ID NO: 63308 - protein, 326 aa, Dehalococcoides ethenogenes 195; identical to SEQ ID NO: 45865

SEQ ID NO: 63309 - DNA, 1026 bp, Azotobacter vinelandii; identical to SEQ ID NO: 45866
  CDS (1)..(1026)

SEQ ID NO: 63310 - protein, 341 aa, Azotobacter vinelandii; identical to SEQ ID NO: 45867

SEQ ID NO: 63311 - DNA, 909 bp, Desulfitobacterium hafniense DCB-2; identical to SEQ ID NO: 45868
  CDS (1)..(909)

SEQ ID NO: 63312 - protein, 302 aa, Desulfitobacterium hafniense DCB-2; identical to SEQ ID NO: 45869

SEQ ID NO: 63313 - DNA, 1044 bp, Bifidobacterium longum DJO10A; identical to SEQ ID NO: 45870
  CDS (1)..(1044)

SEQ ID NO: 63314 - protein, 347 aa, Bifidobacterium longum DJO10A; identical to SEQ ID NO: 45871

SEQ ID NO: 63315 - DNA, 1053 bp, Desulfovibrio desulfuricans G20; identical to SEQ ID NO: 45872
  CDS (1)..(1053)

SEQ ID NO: 63316 - protein, 350 aa, Desulfovibrio desulfuricans G20; identical to SEQ ID NO: 45873

SEQ ID NO: 63317 - DNA, 1044 bp, Actinobacillus pleuropneumoniae serovar 1 str. 4074; identical to SEQ ID NO: 45874
  CDS (1)..(1044)

SEQ ID NO: 63318 - protein, 347 aa, Actinobacillus pleuropneumoniae serovar 1 str. 4074; identical to SEQ ID NO: 45875

SEQ ID NO: 63319 - DNA, 1026 bp, Fusobacterium nucleatum subsp. vincentii ATCC 49256; identical to SEQ ID NO: 45876
  CDS (1)..(1026): transl_table=11

SEQ ID NO: 63320 - protein, 341 aa, Fusobacterium nucleatum subsp. vincentii ATCC 49256; identical to SEQ ID NO: 45877

SEQ ID NO: 63321 - DNA, 1050 bp, Psychrobacter sp. 273-4; identical to SEQ ID NO: 45878
  CDS (1)..(1050)

SEQ ID NO: 63322 - protein, 349 aa, Psychrobacter sp. 273-4; identical to SEQ ID NO: 45879

SEQ ID NO: 63323 - DNA, 1044 bp, Dechloromonas aromatica RCB; identical to SEQ ID NO: 45880
  CDS (1)..(1044)

SEQ ID NO: 63324 - protein, 347 aa, Dechloromonas aromatica RCB; identical to SEQ ID NO: 45881

SEQ ID NO: 63325 - DNA, 1035 bp, Rickettsia rickettsii; identical to SEQ ID NO: 45882
  CDS (1)..(1035)

SEQ ID NO: 63326 - protein, 344 aa, Rickettsia rickettsii; identical to SEQ ID NO: 45883

SEQ ID NO: 63327 - DNA, 1029 bp, Haemophilus influenzae R2846; identical to SEQ ID NO: 45884
  CDS (1)..(1029)

SEQ ID NO: 63328 - protein, 342 aa, Haemophilus influenzae R2846; identical to SEQ ID NO: 45885

SEQ ID NO: 63329 - DNA, 1041 bp, Anabaena variabilis ATCC 29413; identical to SEQ ID NO: 45886
  CDS (1)..(1041)

SEQ ID NO: 63330 - protein, 346 aa, Anabaena variabilis ATCC 29413; identical to SEQ ID NO: 45887

SEQ ID NO: 63331 - DNA, 1035 bp, Ralstonia eutropha JMP134; identical to SEQ ID NO: 45888
  CDS (1)..(1035)

SEQ ID NO: 63332 - protein, 344 aa, Ralstonia eutropha JMP134; identical to SEQ ID NO: 45889

SEQ ID NO: 63333 - DNA, 1047 bp, Crocosphaera watsonii WH 8501; identical to SEQ ID NO: 45890
  CDS (1)..(1047)

SEQ ID NO: 63334 - protein, 348 aa, Crocosphaera watsonii WH 8501; identical to SEQ ID NO: 45891

SEQ ID NO: 63335 - DNA, 990 bp, Rubrobacter xylanophilus DSM 9941; identical to SEQ ID NO: 45892
  CDS (1)..(990)

SEQ ID NO: 63336 - protein, 329 aa, Rubrobacter xylanophilus DSM 9941; identical to SEQ ID NO: 45893

SEQ ID NO: 63337 - DNA, 1008 bp, Methanococcoides burtonii DSM 6242; identical to SEQ ID NO: 45894
  CDS (1)..(1008)

SEQ ID NO: 63338 - protein, 335 aa, Methanococcoides burtonii DSM 6242; identical to SEQ ID NO: 45895

SEQ ID NO: 63339 - DNA, 1095 bp, Rhodobacter sphaeroides 2.4.1; identical to SEQ ID NO: 45896
  CDS (1)..(1095)

SEQ ID NO: 63340 - protein, 364 aa, Rhodobacter sphaeroides 2.4.1; identical to SEQ ID NO: 45897

SEQ ID NO: 63341 - DNA, 1035 bp, Magnetospirillum magnetotacticum MS-1; identical to SEQ ID NO: 45898
  CDS (1)..(1035)

SEQ ID NO: 63342 - protein, 344 aa, Magnetospirillum magnetotacticum MS-1; identical to SEQ ID NO: 45899

SEQ ID NO: 63343 - DNA, 1053 bp, Ehrlichia canis str. Jake; identical to SEQ ID NO: 45900
  CDS (1)..(1053)

SEQ ID NO: 63344 - protein, 350 aa, Ehrlichia canis str. Jake; identical to SEQ ID NO: 45901

SEQ ID NO: 63345 - DNA, 1047 bp, Rubrivivax gelatinosus PM1; identical to SEQ ID NO: 45902
  CDS (1)..(1047)

SEQ ID NO: 63346 - protein, 348 aa, Rubrivivax gelatinosus PM1; identical to SEQ ID NO: 45903

SEQ ID NO: 63347 - DNA, 1089 bp, Rhodospirillum rubrum; identical to SEQ ID NO: 45904
  CDS (1)..(1089)

SEQ ID NO: 63348 - protein, 362 aa, Rhodospirillum rubrum; identical to SEQ ID NO: 45905

SEQ ID NO: 63349 - DNA, 1068 bp, Burkholderia fungorum LB400; identical to SEQ ID NO: 45906
  CDS (1)..(1068)

SEQ ID NO: 63350 - protein, 355 aa, Burkholderia fungorum LB400; identical to SEQ ID NO: 45907

SEQ ID NO: 63351 - DNA, 1017 bp, Enterococcus faecium; identical to SEQ ID NO: 45908
  CDS (1)..(1017)

SEQ ID NO: 63352 - protein, 338 aa, Enterococcus faecium; identical to SEQ ID NO: 45909

SEQ ID NO: 63353 - DNA, 1062 bp, Magnetococcus sp. MC-1; identical to SEQ ID NO: 45910
  CDS (1)..(1062)

SEQ ID NO: 63354 - protein, 353 aa, Magnetococcus sp. MC-1; identical to SEQ ID NO: 45911

SEQ ID NO: 63355 - DNA, 1044 bp, Thermobifida fusca; identical to SEQ ID NO: 45912
  CDS (1)..(1044)

SEQ ID NO: 63356 - protein, 347 aa, Thermobifida fusca; identical to SEQ ID NO: 45913

SEQ ID NO: 63357 - DNA, 1638 bp, Methanosarcina barkeri str. fusaro; identical to SEQ ID NO: 45914
  CDS (1)..(1638)

SEQ ID NO: 63358 - protein, 545 aa, Methanosarcina barkeri str. fusaro; identical to SEQ ID NO: 45915

SEQ ID NO: 63359 - DNA, 1026 bp, Geobacter metallireducens GS-15; identical to SEQ ID NO: 45916
  CDS (1)..(1026)

SEQ ID NO: 63360 - protein, 341 aa, Geobacter metallireducens GS-15; identical to SEQ ID NO: 45917

SEQ ID NO: 63361 - DNA, 1053 bp, Novosphingobium aromaticivorans DSM 12444; identical to SEQ ID NO: 45918
  CDS (1)..(1053)

SEQ ID NO: 63362 - protein, 350 aa, Novosphingobium aromaticivorans DSM 12444; identical to SEQ ID NO: 45919

SEQ ID NO: 63363 - DNA, 1596 bp, Ferroplasma acidarmanus; identical to SEQ ID NO: 45920
  CDS (1)..(1596)

SEQ ID NO: 63364 - protein, 531 aa, Ferroplasma acidarmanus; identical to SEQ ID NO: 45921

SEQ ID NO: 63365 - DNA, 1017 bp, Cytophaga hutchinsonii; identical to SEQ ID NO: 45922
  CDS (1)..(1017)

SEQ ID NO: 63366 - protein, 338 aa, Cytophaga hutchinsonii; identical to SEQ ID NO: 45923

SEQ ID NO: 63367 - DNA, 1020 bp, Clostridium thermocellum ATCC 27405; identical to SEQ ID NO: 45924
  CDS (1)..(1020)

SEQ ID NO: 63368 - protein, 339 aa, Clostridium thermocellum ATCC 27405; identical to SEQ ID NO: 45925

SEQ ID NO: 63369 - DNA, 1026 bp, Microbulbifer degradans 2-40; identical to SEQ ID NO: 45926
  CDS (1)..(1026)

SEQ ID NO: 63370 - protein, 341 aa, Microbulbifer degradans 2-40; identical to SEQ ID NO: 45927

SEQ ID NO: 63371 - DNA, 1026 bp, Oenococcus oeni PSU-1; identical to SEQ ID NO: 45928
  CDS (1)..(1026)

SEQ ID NO: 63372 - protein, 341 aa, Oenococcus oeni PSU-1; identical to SEQ ID NO: 45929

SEQ ID NO: 63373 - DNA, 1038 bp, Pediococcus pentosaceus ATCC 25745; identical to SEQ ID NO: 45930
  CDS (1)..(1038)

SEQ ID NO: 63374 - protein, 345 aa, Pediococcus pentosaceus ATCC 25745; identical to SEQ ID NO: 45931

SEQ ID NO: 63375 - DNA, 978 bp, Trichodesmium erythraeum IMS101; identical to SEQ ID NO: 45932
  CDS (1)..(978)

SEQ ID NO: 63376 - protein, 325 aa, Trichodesmium erythraeum IMS101; identical to SEQ ID NO: 45933

SEQ ID NO: 63377 - DNA, 1029 bp, Moorella thermoacetica ATCC 39073; identical to SEQ ID NO: 45934
  CDS (1)..(1029)

SEQ ID NO: 63378 - protein, 342 aa, Moorella thermoacetica ATCC 39073; identical to SEQ ID NO: 45935

SEQ ID NO: 63379 - DNA, 1020 bp, Thiobacillus denitrificans ATCC 25259; identical to SEQ ID NO: 45936
  CDS (1)..(1020)

SEQ ID NO: 63380 - protein, 339 aa, Thiobacillus denitrificans ATCC 25259; identical to SEQ ID NO: 45937

SEQ ID NO: 63381 - DNA, 1098 bp, Silicibacter sp. TM1040; identical to SEQ ID NO: 45938
  CDS (1)..(1098)

SEQ ID NO: 63382 - protein, 365 aa, Silicibacter sp. TM1040; identical to SEQ ID NO: 45939

SEQ ID NO: 63383 - DNA, 1047 bp, Lactobacillus gasseri; identical to SEQ ID NO: 45940
  CDS (1)..(1047)

SEQ ID NO: 63384 - protein, 348 aa, Lactobacillus gasseri; identical to SEQ ID NO: 45941

SEQ ID NO: 63385 - DNA, 1017 bp, Leuconostoc mesenteroides subsp. mesenteroides ATCC 8293; identical to SEQ ID NO: 45942
  CDS (1)..(1017)

SEQ ID NO: 63386 - protein, 338 aa, Leuconostoc mesenteroides subsp. mesenteroides ATCC 8293; identical to SEQ ID NO: 45943

SEQ ID NO: 63387 - DNA, 1008 bp, Exiguobacterium sp. 255-15; identical to SEQ ID NO: 45944
  CDS (1)..(1008)

SEQ ID NO: 63388 - protein, 335 aa, Exiguobacterium sp. 255-15; identical to SEQ ID NO: 45945

SEQ ID NO: 63389 - DNA, 1074 bp, Chloroflexus aurantiacus; identical to SEQ ID NO: 45946
  CDS (1)..(1074)

SEQ ID NO: 63390 - protein, 357 aa, Chloroflexus aurantiacus; identical to SEQ ID NO: 45947

SEQ ID NO: 63391 - DNA, 1002 bp, Polaromonas sp. JS666; identical to SEQ ID NO: 45948
  CDS (1)..(1002)

SEQ ID NO: 63392 - protein, 333 aa, Polaromonas sp. JS666; identical to SEQ ID NO: 45949

SEQ ID NO: 63393 - DNA, 1008 bp, Campylobacter lari RM2100; identical to SEQ ID NO: 45950
  CDS (1)..(1008): transl_table=11

SEQ ID NO: 63394 - protein, 335 aa, Campylobacter lari RM2100; identical to SEQ ID NO: 45951

SEQ ID NO: 63395 - DNA, 1008 bp, Brachydanio rerio; identical to SEQ ID NO: 45952
  CDS (1)..(1008)

SEQ ID NO: 63396 - protein, 335 aa, Brachydanio rerio; identical to SEQ ID NO: 45953

SEQ ID NO: 63397 - DNA, 1143 bp, Oryza sativa; identical to SEQ ID NO: 45954
  CDS (1)..(1143)

SEQ ID NO: 63398 - protein, 380 aa, Oryza sativa; identical to SEQ ID NO: 45955

SEQ ID NO: 63399 - DNA, 1245 bp, Mus musculus; identical to SEQ ID NO: 45956
  CDS (1)..(1245)

SEQ ID NO: 63400 - protein, 414 aa, Mus musculus; identical to SEQ ID NO: 45957

SEQ ID NO: 63401 - DNA, 1023 bp, uncultured bacterium 578; identical to SEQ ID NO: 45958
  CDS (1)..(1023): transl_table=11

SEQ ID NO: 63402 - protein, 340 aa, uncultured bacterium 578; identical to SEQ ID NO: 45959

SEQ ID NO: 63403 - DNA, 957 bp, Spiroplasma kunkelii; identical to SEQ ID NO: 45960
  CDS (1)..(957): transl_table=4

SEQ ID NO: 63404 - protein, 318 aa, Spiroplasma kunkelii; identical to SEQ ID NO: 45961

SEQ ID NO: 63405 - DNA, 1053 bp, Cryptosporidium parvum; identical to SEQ ID NO: 45962
  CDS (1)..(1053)

SEQ ID NO: 63406 - protein, 350 aa, Cryptosporidium parvum; identical to SEQ ID NO: 45963

SEQ ID NO: 63407 - DNA, 972 bp, Drosophila melanogaster; identical to SEQ ID NO: 45964
  CDS (1)..(972)

SEQ ID NO: 63408 - protein, 323 aa, Drosophila melanogaster; identical to SEQ ID NO: 45965

SEQ ID NO: 63409 - DNA, 1245 bp, Homo sapiens; identical to SEQ ID NO: 45966
  CDS (1)..(1245)

SEQ ID NO: 63410 - protein, 414 aa, Homo sapiens; identical to SEQ ID NO: 45967

SEQ ID NO: 63411 - DNA, 1095 bp, Homo sapiens; identical to SEQ ID NO: 45968
  CDS (1)..(1095)

SEQ ID NO: 63412 - protein, 364 aa, Homo sapiens [sequence omitted]

SEQ ID NO: 63413 - DNA, 1014 bp, Caenorhabditis elegans; identical to SEQ ID NO: 45970
  CDS (1)..(1014)

SEQ ID NO: 63414 - protein, 337 aa, Caenorhabditis elegans; identical to SEQ ID NO: 45971

SEQ ID NO: 63415 - DNA, 1026 bp, Riemerella anatipestifer; identical to SEQ ID NO: 45972
  CDS (1)..(1026): transl_table=11

SEQ ID NO: 63416 - protein, 341 aa, Riemerella anatipestifer; identical to SEQ ID NO: 45973

SEQ ID NO: 63417 - DNA, 1008 bp, Aquifex aeolicus; identical to SEQ ID NO: 45974
  CDS (1)..(1008): transl_table=11

SEQ ID NO: 63418 - protein, 335 aa, Aquifex aeolicus; identical to SEQ ID NO: 45975

SEQ ID NO: 63419 - DNA, 1041 bp, Borrelia burgdorferi; identical to SEQ ID NO: 45976
  CDS (1)..(1041): transl_table=11

SEQ ID NO: 63420 - protein, 346 aa, Borrelia burgdorferi; identical to SEQ ID NO: 45977

SEQ ID NO: 63421 - DNA, 1014 bp, Buchnera aphidicola; identical to SEQ ID NO: 45978
  CDS (1)..(1014): transl_table=11

SEQ ID NO: 63422 - protein, 337 aa, Buchnera aphidicola; identical to SEQ ID NO: 45979

SEQ ID NO: 63423 - DNA, 1647 bp, Haloarcula marismortui; identical to SEQ ID NO: 45980
  CDS (1)..(1647): transl_table=11

SEQ ID NO: 63424 - protein, 548 aa, Haloarcula marismortui; identical to SEQ ID NO: 45981

SEQ ID NO: 63425 - DNA, 1023 bp, Helicobacter pylori J99; identical to SEQ ID NO: 45982
  CDS (1)..(1023): transl_table=11

SEQ ID NO: 63426 - protein, 340 aa, Helicobacter pylori J99; identical to SEQ ID NO: 45983

SEQ ID NO: 63427 - DNA, 1608 bp, Methanococcus jannaschii; identical to SEQ ID NO: 45984
  CDS (1)..(1608): transl_table=11

SEQ ID NO: 63428 - protein, 535 aa, Methanococcus jannaschii; identical to SEQ ID NO: 45985

SEQ ID NO: 63429 - DNA, 1605 bp, Methanobacterium thermoautotrophicum; identical to SEQ ID NO: 45986
  CDS (1)..(1605): transl_table=11

SEQ ID NO: 63430 - protein, 534 aa, Methanobacterium thermoautotrophicum; identical to SEQ ID NO: 45987

SEQ ID NO: 63431 - DNA, 1008 bp, Mus musculus; identical to SEQ ID NO: 45988
  CDS (1)..(1008)

SEQ ID NO: 63432 - protein, 335 aa, Mus musculus; identical to SEQ ID NO: 45989

SEQ ID NO: 63433 - DNA, 978 bp, Pasteurella haemolytica; identical to SEQ ID NO: 45990
  CDS (1)..(978): transl_table=11

SEQ ID NO: 63434 - protein, 325 aa, Pasteurella haemolytica; identical to SEQ ID NO: 45991

SEQ ID NO: 63435 - DNA, 975 bp, Pyrococcus abyssi; identical to SEQ ID NO: 45992
  CDS (1)..(975): transl_table=11

SEQ ID NO: 63436 - protein, 324 aa, Pyrococcus abyssi; identical to SEQ ID NO: 45993

SEQ ID NO: 63437 - DNA, 975 bp, Pyrococcus horikoshii; identical to SEQ ID NO: 45994
  CDS (1)..(975)

SEQ ID NO: 63438 - protein, 324 aa, Pyrococcus horikoshii; identical to SEQ ID NO: 45995

SEQ ID NO: 63439 - DNA, 1014 bp, Salmonella typhimurium; identical to SEQ ID NO: 45996
  CDS (1)..(1014): transl_table=11

SEQ ID NO: 63440 - protein, 337 aa, Salmonella typhimurium; identical to SEQ ID NO: 45997

SEQ ID NO: 63441 - DNA, 1047 bp, Synechocystis sp; identical to SEQ ID NO: 45998
  CDS (1)..(1047)

SEQ ID NO: 63442 - protein, 348 aa, Synechocystis sp; identical to SEQ ID NO: 45999

SEQ ID NO: 63443 - DNA, 1059 bp, Treponema pallidum; identical to SEQ ID NO: 46000
  CDS (1)..(1059): transl_table=11

SEQ ID NO: 63444 - protein, 352 aa, Treponema pallidum; identical to SEQ ID NO: 46001

SEQ ID NO: 63445 - DNA, 1008 bp, Xenopus laevis; identical to SEQ ID NO: 46002
  CDS (1)..(1008)

SEQ ID NO: 63446 - protein, 335 aa, Xenopus laevis; identical to SEQ ID NO: 46003

SEQ ID NO: 63447 - DNA, 1224 bp, Saccharomyces cerevisiae; identical to SEQ ID NO: 46004
  CDS (1)..(1224)

SEQ ID NO: 63448 - protein, 407 aa, Saccharomyces cerevisiae; identical to SEQ ID NO: 46005

SEQ ID NO: 63449 - DNA, 23 bp, Primer
atgcgtgtactgggtattgaaac

SEQ ID NO: 63450 - DNA, 21 bp, Primer
ttacgcagccggtaactccgc

SEQ ID NO: 63451 - protein, 510 aa, consensus; identical to SEQ ID NO: 46008
  MISC_FEATURE (1)..(510): consensus for the disclosure of xaa see table XV

SEQ ID NO: 63452 - protein, 43 aa, consensus; identical to SEQ ID NO: 46009
  MISC_FEATURE (1)..(43): consensus for the disclosure of xaa see table XV

SEQ ID NO: 63453 - protein, 120 aa, consensus; identical to SEQ ID NO: 46010
  MISC_FEATURE (1)..(120): consensus for the disclosure of xaa see table XV

SEQ ID NO: 63454 - protein, 59 aa, consensus; identical to SEQ ID NO: 46011
  MISC_FEATURE (1)..(59): consensus for the disclosure of xaa see table XV

SEQ ID NO: 63455 - DNA, 333 bp, Escherichia coli K12; identical to SEQ ID NO: 24865
  CDS (1)..(333)

SEQ ID NO: 63456 - protein, 110 aa, Escherichia coli K12; identical to SEQ ID NO: 24866

SEQ ID NO: 63457 - DNA, 1068 bp, Mus musculus (house mouse); identical to SEQ ID NO: 24867
  CDS (64)..(996)

SEQ ID NO: 63458 - protein, 310 aa, Mus musculus (house mouse); identical to SEQ ID NO: 24868

SEQ ID NO: 63459 - DNA, 1953 bp, Helicobacter pylori; identical to SEQ ID NO: 24869
  CDS (1)..(1953)

SEQ ID NO: 63460 - protein, 650 aa, Helicobacter pylori; identical to SEQ ID NO: 24870

SEQ ID NO: 63461 - DNA, 336 bp, Pseudomonas aeruginosa; identical to SEQ ID NO: 24871
  CDS (1)..(336)

SEQ ID NO: 63462 - protein, 111 aa, Pseudomonas aeruginosa; identical to SEQ ID NO: 24872

SEQ ID NO: 63463 - DNA, 489 bp, Sulfolobus solfataricus; identical to SEQ ID NO: 24873
  CDS (1)..(489)

SEQ ID NO: 63464 - protein, 162 aa, Sulfolobus solfataricus; identical to SEQ ID NO: 24874

SEQ ID NO: 63465 - DNA, 1935 bp, Clostridium acetobutylicum; identical to SEQ ID NO: 24875
  CDS (1)..(1935)

SEQ ID NO: 63466 - protein, 644 aa, Clostridium acetobutylicum; identical to SEQ ID NO: 24876

SEQ ID NO: 63467 - DNA, 2028 bp, Yersinia pestis; identical to SEQ ID NO: 24877
  CDS (1)..(2028)

SEQ ID NO: 63468 - protein, 675 aa, Yersinia pestis; identical to SEQ ID NO: 24878

SEQ ID NO: 63469 - DNA, 1995 bp, Listeria innocua; identical to SEQ ID NO: 24879
  CDS (1)..(1995)

SEQ ID NO: 63470 - protein, 664 aa, Listeria innocua; identical to SEQ ID NO: 24880

SEQ ID NO: 63471 - DNA, 2205 bp, Borrelia burgdorferi (Lyme disease spirochete); identical to SEQ ID NO: 24881
  CDS (1)..(2205)

SEQ ID NO: 63472 - protein, 734 aa, Borrelia burgdorferi (Lyme disease spirochete); identical to SEQ ID NO: 24882

SEQ ID NO: 63473 - DNA, 2169 bp, Pyrococcus abyssi; identical to SEQ ID NO: 24883
  CDS (1)..(2169)

SEQ ID NO: 63474 - protein, 722 aa, Pyrococcus abyssi; identical to SEQ ID NO: 24884

SEQ ID NO: 63475 - DNA, 2046 bp, Deinococcus radiodurans; identical to SEQ ID NO: 24885
  CDS (1)..(2046)

SEQ ID NO: 63476 - protein, 681 aa, Deinococcus radiodurans; identical to SEQ ID NO: 24886

SEQ ID NO: 63477 - DNA, 2109 bp, Xylella fastidiosa; identical to SEQ ID NO: 24887
  CDS (1)..(2109)

SEQ ID NO: 63478 - protein, 702 aa, Xylella fastidiosa; identical to SEQ ID NO: 24888

SEQ ID NO: 63479 - DNA, 2070 bp, Halobacterium sp. NRC-1; identical to SEQ ID NO: 24889
  CDS (1)..(2070)

SEQ ID NO: 63480 - protein, 689 aa, Halobacterium sp. NRC-1; identical to SEQ ID NO: 24890

SEQ ID NO: 63481 - DNA, 1323 bp, Arabidopsis thaliana (mouse-ear cress); identical to SEQ ID NO: 24891
  CDS (1)..(1323)

SEQ ID NO: 63482 - protein, 440 aa, Arabidopsis thaliana (mouse-ear cress); identical to SEQ ID NO: 24892

SEQ ID NO: 63483 - DNA, 1974 bp, Staphylococcus aureus; identical to SEQ ID NO: 24893
  CDS (1)..(1974)

SEQ ID NO: 63484 - protein, 657 aa, Staphylococcus aureus; identical to SEQ ID NO: 24894

SEQ ID NO: 63485 - DNA, 1977 bp, Archaeoglobus fulgidus; identical to SEQ ID NO: 24895
  CDS (1)..(1977)

SEQ ID NO: 63486 - protein, 658 aa, Archaeoglobus fulgidus; identical to SEQ ID NO: 24896

SEQ ID NO: 63487 - DNA, 2172 bp, Pyrococcus horikoshii; identical to SEQ ID NO: 24897
  CDS (1)..(2172)

SEQ ID NO: 63488 - protein, 723 aa, Pyrococcus horikoshii; identical to SEQ ID NO: 24898

SEQ ID NO: 63489 - DNA, 1998 bp, Streptococcus pneumoniae; identical to SEQ ID NO: 24899
  CDS (1)..(1998)

SEQ ID NO: 63490 - protein, 665 aa, Streptococcus pneumoniae; identical to SEQ ID NO: 24900

SEQ ID NO: 63491 - DNA, 2436 bp, Treponema pallidum subsp. pallidum (syphilis spirochete); identical to SEQ ID NO: 24901
  CDS (1)..(2436)

SEQ ID NO: 63492 - protein, 811 aa, Treponema pallidum subsp. pallidum (syphilis spirochete); identical to SEQ ID NO: 24902

SEQ ID NO: 63493 - DNA, 1890 bp, Thermotoga maritima; identical to SEQ ID NO: 24903
  CDS (1)..(1890)

SEQ ID NO: 63494 - protein, 629 aa, Thermotoga maritima; identical to SEQ ID NO: 24904

SEQ ID NO: 63495 - DNA, 1983 bp, Bacillus halodurans; identical to SEQ ID NO: 24905
  CDS (1)..(1983)

SEQ ID NO: 63496 - protein, 660 aa, Bacillus halodurans; identical to SEQ ID NO: 24906

SEQ ID NO: 63497 - DNA, 1956 bp, Methanococcus jannaschii; identical to SEQ ID NO: 24907
  CDS (1)..(1956)

SEQ ID NO: 63498 - protein, 651 aa, Methanococcus jannaschii; identical to SEQ ID NO: 24908

SEQ ID NO: 63499 - DNA, 336 bp, Aquifex aeolicus; identical to SEQ ID NO: 24909
  CDS (1)..(336)

SEQ ID NO: 63500 - protein, 111 aa, Aquifex aeolicus; identical to SEQ ID NO: 24910

SEQ ID NO: 63501 - DNA, 339 bp, Pyrococcus horikoshii; identical to SEQ ID NO: 24911
  CDS (1)..(339)

SEQ ID NO: 63502 - protein, 112 aa, Pyrococcus horikoshii; identical to SEQ ID NO: 24912

SEQ ID NO: 63503 - DNA, 1887 bp, Campylobacter jejuni; identical to SEQ ID NO: 24913
  CDS (1)..(1887)

SEQ ID NO: 63504 - protein, 628 aa, Campylobacter jejuni; identical to SEQ ID NO: 24914

SEQ ID NO: 63505 - DNA, 345 bp, Vibrio cholerae; identical to SEQ ID NO: 24915
  CDS (1)..(345)

SEQ ID NO: 63506 - protein, 114 aa, Vibrio cholerae; identical to SEQ ID NO: 24916

SEQ ID NO: 63507 - DNA, 1956 bp, Methanobacterium thermoautotrophicum; identical to SEQ ID NO: 24917
  CDS (1)..(1956)

SEQ ID NO: 63508 - protein, 651 aa, Methanobacterium thermoautotrophicum; identical to SEQ ID NO: 24918

SEQ ID NO: 63509 - DNA, 1971 bp, Helicobacter pylori; identical to SEQ ID NO: 24919
  CDS (1)..(1971)

SEQ ID NO: 63510 - protein, 656 aa, Helicobacter pylori; identical to SEQ ID NO: 24920

SEQ ID NO: 63511 - DNA, 354 bp, Aeropyrum pernix; identical to SEQ ID NO: 24921
  CDS (1)..(354)

SEQ ID NO: 63512 - protein, 117 aa, Aeropyrum pernix; identical to SEQ ID NO: 24922

SEQ ID NO: 63513 - DNA, 330 bp, Pyrococcus abyssi; identical to SEQ ID NO: 24923
  CDS (1)..(330)

SEQ ID NO: 63514 - protein, 109 aa, Pyrococcus abyssi; identical to SEQ ID NO: 24924

SEQ ID NO: 63515 - DNA, 1989 bp, Lactococcus lactis subsp. lactis; identical to SEQ ID NO: 24925
  CDS (1)..(1989)

SEQ ID NO: 63516 - protein, 662 aa, Lactococcus lactis subsp. lactis; identical to SEQ ID NO: 24926

SEQ ID NO: 63517 - DNA, 2049 bp, Haemophilus influenzae; identical to SEQ ID NO: 24927
  CDS (1)..(2049)

SEQ ID NO: 63518 - protein, 682 aa, Haemophilus influenzae; identical to SEQ ID NO: 24928

SEQ ID NO: 63519 - DNA, 2879 bp, Bacillus stearothermophilus; identical to SEQ ID NO: 24929
  CDS (646)..(2595)

SEQ ID NO: 63520 - protein, 649 aa, Bacillus stearothermophilus; identical to SEQ ID NO: 24930

SEQ ID NO: 63521 - DNA, 1131 bp, Saccharomyces cerevisiae; identical to SEQ ID NO: 24931
  CDS (1)..(1131)

SEQ ID NO: 63522 - protein, 376 aa, Saccharomyces cerevisiae; identical to SEQ ID NO: 24932

SEQ ID NO: 63523 - DNA, 1995 bp, Bacillus subtilis; identical to SEQ ID NO: 24933
  CDS (1)..(1995)

SEQ ID NO: 63524 - protein, 664 aa, Bacillus subtilis; identical to SEQ ID NO: 24934

SEQ ID NO: 63525 - DNA, 2544 bp, Thermus aquaticus; identical to SEQ ID NO: 24935
  CDS (361)..(2211)

SEQ ID NO: 63526 - protein, 616 aa, Thermus aquaticus; identical to SEQ ID NO: 24936

SEQ ID NO: 63527 - DNA, 2394 bp, Arabidopsis thaliana (mouse-ear cress); identical to SEQ ID NO: 24937
  CDS (1)..(2394)

SEQ ID NO: 63528 - protein, 797 aa, Arabidopsis thaliana (mouse-ear cress); identical to SEQ ID NO: 24938

SEQ ID NO: 63529 - DNA, 853 bp, Arabidopsis thaliana (mouse-ear cress); identical to SEQ ID NO: 24939
  CDS (1)..(822)

SEQ ID NO: 63530 - protein, 273 aa, Arabidopsis thaliana (mouse-ear cress); identical to SEQ ID NO: 24940

SEQ ID NO: 63531 - DNA, 582 bp, Geodia cydonium; identical to SEQ ID NO: 24941
  CDS (62)..(511)

SEQ ID NO: 63532 - protein, 149 aa, Geodia cydonium; identical to SEQ ID NO: 24942

SEQ ID NO: 63533 - DNA, 2175 bp, Borrelia garinii PBi; identical to SEQ ID NO: 24943
  CDS (1)..(2175)

SEQ ID NO: 63534 - protein, 724 aa, Borrelia garinii PBi; identical to SEQ ID NO: 24944

SEQ ID NO: 63535 - DNA, 1956 bp, Symbiobacterium thermophilum; identical to SEQ ID NO: 24945
  CDS (1)..(1956)

SEQ ID NO: 63536 - protein, 651 aa, Symbiobacterium thermophilum; identical to SEQ ID NO: 24946

SEQ ID NO: 63537 - DNA, 1938 bp, Desulfotalea psychrophila; identical to SEQ ID NO: 24947
  CDS (1)..(1938)

SEQ ID NO: 63538 - protein, 645 aa, Desulfotalea psychrophila; identical to SEQ ID NO: 24948

SEQ ID NO: 63539 - DNA, 1119 bp, Kluyveromyces lactis NRRL Y; identical to SEQ ID NO: 24949
  CDS (1)..(1119)

SEQ ID NO: 63540 - protein, 372 aa, Kluyveromyces lactis NRRL Y; identical to SEQ ID NO: 24950

SEQ ID NO: 63541 - DNA, 624 bp, Kluyveromyces lactis NRRL Y; identical to SEQ ID NO: 24951
  CDS (1)..(624)

SEQ ID NO: 63542 - protein, 207 aa, Kluyveromyces lactis NRRL Y; identical to SEQ ID NO: 24952

SEQ ID NO: 63543 - DNA, 2031 bp, Erwinia carotovora; identical to SEQ ID NO: 24953
  CDS (1)..(2031)

SEQ ID NO: 63544 - protein, 676 aa, Erwinia carotovora; identical to SEQ ID NO: 24954

SEQ ID NO: 63545 - DNA, 1928 bp, Xenopus tropicalis; identical to SEQ ID NO: 24955
  CDS (128)..(1714)

SEQ ID NO: 63546 - protein, 528 aa, Xenopus tropicalis; identical to SEQ ID NO: 24956

SEQ ID NO: 63547 - DNA, 2058 bp, Acinetobacter sp; identical to SEQ ID NO: 24957
  CDS (1)..(2058)

SEQ ID NO: 63548 - protein, 685 aa, Acinetobacter sp; identical to SEQ ID NO: 24958

SEQ ID NO: 63549 - DNA, 1131 bp, Candida glabrata CBS138; identical to SEQ ID NO: 24959
  CDS (1)..(1131)

SEQ ID NO: 63550 - protein, 376 aa, Candida glabrata CBS138; identical to SEQ ID NO: 24960

SEQ ID NO: 63551 - DNA, 327 bp, Picrophilus torridus; identical to SEQ ID NO: 24961
  CDS (1)..(327)

SEQ ID NO: 63552 - protein, 108 aa, Picrophilus torridus; identical to SEQ ID NO: 24962

SEQ ID NO: 63553 - DNA, 354 bp, Photobacterium profundum; identical to SEQ ID NO: 24963
  CDS (1)..(354)

SEQ ID NO: 63554 - protein, 117 aa, Photobacterium profundum; identical to SEQ ID NO: 24964

SEQ ID NO: 63555 - DNA, 2043 bp, Photobacterium profundum; identical to SEQ ID NO: 24965
  CDS (1)..(2043)

SEQ ID NO: 63556 - protein, 680 aa, Photobacterium profundum; identical to SEQ ID NO: 24966

SEQ ID NO: 63557 - DNA, 1992 bp, Methanococcus maripaludis; identical to SEQ ID NO: 24967
  CDS (1)..(1992)

SEQ ID NO: 63558 - protein, 663 aa, Methanococcus maripaludis; identical to SEQ ID NO: 24968

SEQ ID NO: 63559 - DNA, 2097 bp, Parachlamydia sp; identical to SEQ ID NO: 24969
  CDS (1)..(2097)

SEQ ID NO: 63560 - protein, 698 aa, Parachlamydia sp; identical to SEQ ID NO: 24970

SEQ ID NO: 63561 - DNA, 2064 bp, Bdellovibrio bacteriovorus; identical to SEQ ID NO: 24971
  CDS (1)..(2064)

SEQ ID NO: 63562 - protein, 687 aa, Bdellovibrio bacteriovorus; identical to SEQ ID NO: 24972

SEQ ID NO: 63563 - DNA, 2217 bp, Brachydanio rerio; identical to SEQ ID NO: 24973
  CDS (65)..(1654)

SEQ ID NO: 63564 - protein, 529 aa, Brachydanio rerio; identical to SEQ ID NO: 24974

SEQ ID NO: 63565 - DNA, 2106 bp, uncultured bacterium; identical to SEQ ID NO: 24975
  CDS (1)..(2106)

SEQ ID NO: 63566 - protein, 701 aa, uncultured bacterium; identical to SEQ ID NO: 24976

SEQ ID NO: 63567 - DNA, 1998 bp, Listeria monocytogenes; identical to SEQ ID NO: 24977
  CDS (1)..(1998)

SEQ ID NO: 63568 - protein, 665 aa, Listeria monocytogenes; identical to SEQ ID NO: 24978

SEQ ID NO: 63569 - DNA, 1992 bp, Desulfovibrio vulgaris; identical to SEQ ID NO: 24979
  CDS (1)..(1992)

SEQ ID NO: 63570 - protein, 663 aa, Desulfovibrio vulgaris; identical to SEQ ID NO: 24980

SEQ ID NO: 63571 - DNA, 330 bp, Thermus thermophilus; identical to SEQ ID NO: 24981
  CDS (1)..(330)

SEQ ID NO: 63572 - protein, 109 aa, Thermus thermophilus; identical to SEQ ID NO: 24982

SEQ ID NO: 63573 - DNA, 2382 bp, Treponema denticola; identical to SEQ ID NO: 24983
  CDS (1)..(2382)

SEQ ID NO: 63574 - protein, 793 aa, Treponema denticola; identical to SEQ ID NO: 24984

SEQ ID NO: 63575 - DNA, 2331 bp, Nanoarchaeum equitans; identical to SEQ ID NO: 24985
  CDS (1)..(2331)

SEQ ID NO: 63576 - protein, 776 aa, Nanoarchaeum equitans; identical to SEQ ID NO: 24986

SEQ ID NO: 63577 - DNA, 615 bp, Ashbya gossypii; identical to SEQ ID NO: 24987
  CDS (1)..(615)

SEQ ID NO: 63578 - protein, 204 aa, Ashbya gossypii; identical to SEQ ID NO: 24988

SEQ ID NO: 63579 - DNA, 1116 bp, Ashbya gossypii; identical to SEQ ID NO: 24989
  CDS (1)..(1116)

SEQ ID NO: 63580 - protein, 371 aa, Ashbya gossypii; identical to SEQ ID NO: 24990

SEQ ID NO: 63581 - DNA, 1950 bp, Wolinella succinogenes; identical to SEQ ID NO: 24991
  CDS (1)..(1950)

SEQ ID NO: 63582 - protein, 649 aa, Wolinella succinogenes; identical to SEQ ID NO: 24992

SEQ ID NO: 63583 - DNA, 2043 bp, Porphyromonas gingivalis; identical to SEQ ID NO: 24993
  CDS (1)..(2043)

SEQ ID NO: 63584 - protein, 680 aa, Porphyromonas gingivalis; identical to SEQ ID NO: 24994

SEQ ID NO: 63585 - DNA, 336 bp, Photorhabdus luminescens; identical to SEQ ID NO: 24995
  CDS (1)..(336)

SEQ ID NO: 63586 - protein, 111 aa, Photorhabdus luminescens; identical to SEQ ID NO: 24996

SEQ ID NO: 63587 - DNA, 2028 bp, Photorhabdus luminescens; identical to SEQ ID NO: 24997
  CDS (1)..(2028)

SEQ ID NO: 63588 - protein, 675 aa, Photorhabdus luminescens; identical to SEQ ID NO: 24998

SEQ ID NO: 63589 - DNA, 2070 bp, Chromobacterium violaceum; identical to SEQ ID NO: 24999
  CDS (1)..(2070)

SEQ ID NO: 63590 - protein, 689 aa, Chromobacterium violaceum; identical to SEQ ID NO: 25000

SEQ ID NO: 63591 - DNA, 1629 bp, Anopheles gambiae str; identical to SEQ ID NO: 25001
  CDS (1)..(1629)

SEQ ID NO: 63592 - protein, 542 aa, Anopheles gambiae str; identical to SEQ ID NO: 25002

SEQ ID NO: 63593 - DNA, 339 bp, Rhodopirellula baltica; identical to SEQ ID NO: 25003
  CDS (1)..(339)

SEQ ID NO: 63594 - protein, 112 aa, Rhodopirellula baltica; identical to SEQ ID NO: 25004

SEQ ID NO: 63595 - DNA, 1932 bp, Helicobacter hepaticus; identical to SEQ ID NO: 25005
  CDS (1)..(1932)

SEQ ID NO: 63596 - protein, 643 aa, Helicobacter hepaticus; identical to SEQ ID NO: 25006

SEQ ID NO: 63597 - DNA, 2055 bp, Haemophilus ducreyi; identical to SEQ ID NO: 25007
  CDS (1)..(2055)

SEQ ID NO: 63598 - protein, 684 aa, Haemophilus ducreyi; identical to SEQ ID NO: 25008

SEQ ID NO: 63599 - DNA, 339 bp, Bordetella parapertussis; identical to SEQ ID NO: 25009
  CDS (1)..(339)

SEQ ID NO: 63600 - protein, 112 aa, Bordetella parapertussis; identical to SEQ ID NO: 25010

SEQ ID NO: 63601 - DNA, 342 bp, Bordetella bronchiseptica; identical to SEQ ID NO: 25011
  CDS (1)..(342)

SEQ ID NO: 63602 - protein, 113 aa, Bordetella bronchiseptica; identical to SEQ ID NO: 25012

SEQ ID NO: 63603 - DNA, 2079 bp, Bordetella bronchiseptica; identical to SEQ ID NO: 25013
  CDS (1)..(2079)

SEQ ID NO: 63604 - protein, 692 aa, Bordetella bronchiseptica; identical to SEQ ID NO: 25014

SEQ ID NO: 63605 - DNA, 759 bp, Oryza sativa; identical to SEQ ID NO: 25015
  CDS (1)..(759)

SEQ ID NO: 63606 - protein, 252 aa, Oryza sativa; identical to SEQ ID NO: 25016

SEQ ID NO: 63607 - DNA, 2053 bp, Xenopus laevis; identical to SEQ ID NO: 25017
  CDS (259)..(1845)

SEQ ID NO: 63608 - protein, 528 aa, Xenopus laevis; identical to SEQ ID NO: 25018

SEQ ID NO: 63609 - DNA, 2121 bp, Nitrosomonas europaea; identical to SEQ ID NO: 25019
  CDS (1)..(2121)

SEQ ID NO: 63610 - protein, 706 aa, Nitrosomonas europaea; identical to SEQ ID NO: 25020

SEQ ID NO: 63611 - DNA, 2043 bp, Shigella flexneri; identical to SEQ ID NO: 25021
  CDS (1)..(2043)

SEQ ID NO: 63612 - protein, 680 aa, Shigella flexneri; identical to SEQ ID NO: 25022

SEQ ID NO: 63613 - DNA, 333 bp, Vibrio vulnificus; identical to SEQ ID NO: 25023
  CDS (1)..(333)

SEQ ID NO: 63614 - protein, 110 aa, Vibrio vulnificus; identical to SEQ ID NO: 25024

SEQ ID NO: 63615 - DNA, 333 bp, Vibrio parahaemolyticus; identical to SEQ ID NO: 25025
  CDS (1)..(333)

SEQ ID NO: 63616 - protein, 110 aa, Vibrio parahaemolyticus; identical to SEQ ID NO: 25026

SEQ ID NO: 63617 - DNA, 2040 bp, Bacteroides thetaiotaomicron; identical to SEQ ID NO: 25027
  CDS (1)..(2040)

SEQ ID NO: 63618 - protein, 679 aa, Bacteroides thetaiotaomicron; identical to SEQ ID NO: 25028

SEQ ID NO: 63619 - DNA, 1983 bp, Vibrio vulnificus; identical to SEQ ID NO: 25029
  CDS (1)..(1983)

SEQ ID NO: 63620 - protein, 660 aa, Vibrio vulnificus; identical to SEQ ID NO: 25030

SEQ ID NO: 63621 - DNA, 333 bp, Vibrio vulnificus; identical to SEQ ID NO: 25031
  CDS (1)..(333)

SEQ ID NO: 63622 - protein, 110 aa, Vibrio vulnificus; identical to SEQ ID NO: 25032

SEQ ID NO: 63623 - DNA, 2010 bp, Streptococcus mutans; identical to SEQ ID NO: 25033
  CDS (1)..(2010)

SEQ ID NO: 63624 - protein, 669 aa, Streptococcus mutans; identical to SEQ ID NO: 25034

SEQ ID NO: 63625 - DNA, 1998 bp, Streptococcus agalactiae; identical to SEQ ID NO: 25035
  CDS (1)..(1998)

SEQ ID NO: 63626 - protein, 665 aa, Streptococcus agalactiae; identical to SEQ ID NO: 25036

SEQ ID NO: 63627 - DNA, 2031 bp, Shewanella oneidensis; identical to SEQ ID NO: 25037
  CDS (1)..(2031)

SEQ ID NO: 63628 - protein, 676 aa, Shewanella oneidensis; identical to SEQ ID NO: 25038

SEQ ID NO: 63629 - DNA, 2148 bp, Leptospira interrogans; identical to SEQ ID NO: 25039
  CDS (1)..(2148)

SEQ ID NO: 63630 - protein, 715 aa, Leptospira interrogans; identical to SEQ ID NO: 25040

SEQ ID NO: 63631 - DNA, 1209 bp, Plasmodium falciparum; identical to SEQ ID NO: 25041
  CDS (1)..(1209)

SEQ ID NO: 63632 - protein, 402 aa, Plasmodium falciparum; identical to SEQ ID NO: 25042

SEQ ID NO: 63633 - DNA, 330 bp, Thermoanaerobacter tengcongensis; identical to SEQ ID NO: 25043
  CDS (1)..(330)

SEQ ID NO: 63634 - protein, 109 aa, Thermoanaerobacter tengcongensis; identical to SEQ ID NO: 25044

SEQ ID NO: 63635 - DNA, 1230 bp, Oryza sativa; identical to SEQ ID NO: 25045
  CDS (1)..(1230)

SEQ ID NO: 63636 - protein, 409 aa, Oryza sativa; identical to SEQ ID NO: 25046

SEQ ID NO: 63637 - DNA, 858 bp, Encephalitozoon cuniculi GB; identical to SEQ ID NO: 25047
  CDS (1)..(858)

SEQ ID NO: 63638 - protein, 285 aa, Encephalitozoon cuniculi GB; identical to SEQ ID NO: 25048

SEQ ID NO: 63639 - DNA, 330 bp, Pyrococcus furiosus; identical to SEQ ID NO: 25049
  CDS (1)..(330)

SEQ ID NO: 63640 - protein, 109 aa, Pyrococcus furiosus; identical to SEQ ID NO: 25050

SEQ ID NO: 63641 - DNA, 327 bp, Pyrobaculum aerophilum; identical to SEQ ID NO: 25051
  CDS (1)..(327)

SEQ ID NO: 63642 - protein, 108 aa, Pyrobaculum aerophilum; identical to SEQ ID NO: 25052

SEQ ID NO: 63643 - DNA, 342 bp, Sulfolobus tokodaii; identical to SEQ ID NO: 25053
  CDS (1)..(342)

SEQ ID NO: 63644 - protein, 113 aa, Sulfolobus tokodaii; identical to SEQ ID NO: 25054

SEQ ID NO: 63645 - DNA, 324 bp, Thermoplasma volcanium; identical to SEQ ID NO: 25055
  CDS (1)..(324)

SEQ ID NO: 63646 - protein, 107 aa, Thermoplasma volcanium; identical to SEQ ID NO: 25056

SEQ ID NO: 63647 - DNA, 1032 bp, Drosophila melanogaster; identical to SEQ ID NO: 25057
  CDS (2)..(973)

SEQ ID NO: 63648 - protein, 323 aa, Drosophila melanogaster; identical to SEQ ID NO: 25058

SEQ ID NO: 63649 - DNA, 1726 bp, Drosophila melanogaster; identical to SEQ ID NO: 25059
  CDS (52)..(1629)

SEQ ID NO: 63650 - protein, 525 aa, Drosophila melanogaster; identical to SEQ ID NO: 25060

SEQ ID NO: 63651 - DNA, 1254 bp, Cricetulus griseus; identical to SEQ ID NO: 25061
  CDS (84)..(1163)

SEQ ID NO: 63652 - protein, 359 aa, Cricetulus griseus; identical to SEQ ID NO: 25062

SEQ ID NO: 63653 - DNA, 2010 bp, Bacillus anthracis; identical to SEQ ID NO: 25063
  CDS (28)..(2010)

SEQ ID NO: 63654 - protein, 660 aa, Bacillus anthracis; identical to SEQ ID NO: 25064

SEQ ID NO: 63655 - DNA, 1983 bp, Bacillus cereus; identical to SEQ ID NO: 25065
  CDS (1)..(1983)

SEQ ID NO: 63656 - protein, 660 aa, Bacillus cereus; identical to SEQ ID NO: 25066

SEQ ID NO: 63657 - DNA, 2112 bp, Chlorobium tepidum; identical to SEQ ID NO: 25067
  CDS (1)..(2112)

SEQ ID NO: 63658 - protein, 703 aa, Chlorobium tepidum; identical to SEQ ID NO: 25068

SEQ ID NO: 63659 - DNA, 1938 bp, Clostridium perfringens; identical to SEQ ID NO: 25069
  CDS (1)..(1938)

SEQ ID NO: 63660 - protein, 645 aa, Clostridium perfringens; identical to SEQ ID NO: 25070

SEQ ID NO: 63661 - DNA, 1926 bp, Clostridium tetani; identical to SEQ ID NO: 25071
  CDS (1)..(1926)

SEQ ID NO: 63662 - protein, 641 aa, Clostridium tetani; identical to SEQ ID NO: 25072

SEQ ID NO: 63663 - DNA, 2034 bp, Enterococcus faecalis; identical to SEQ ID NO: 25073
  CDS (25)..(2034)

SEQ ID NO: 63664 - protein, 669 aa, Enterococcus faecalis; identical to SEQ ID NO: 25074

SEQ ID NO: 63665 - DNA, 1911 bp, Fusobacterium nucleatum; identical to SEQ ID NO: 25075
  CDS (1)..(1911)

SEQ ID NO: 63666 - protein, 636 aa, Fusobacterium nucleatum; identical to SEQ ID NO: 25076

SEQ ID NO: 63667 - DNA, 2052 bp, Lactobacillus plantarum; identical to SEQ ID NO: 25077
  CDS (1)..(2052)

SEQ ID NO: 63668 - protein, 683 aa, Lactobacillus plantarum; identical to SEQ ID NO: 25078

SEQ ID NO: 63669 - DNA, 2139 bp, Methanosarcina acetivorans; identical to SEQ ID NO: 25079
  CDS (1)..(2139)

SEQ ID NO: 63670 - protein, 712 aa, Methanosarcina acetivorans; identical to SEQ ID NO: 25080

SEQ ID NO: 63671 - DNA, 2007 bp, Methanopyrus kandleri; identical to SEQ ID NO: 25081
  CDS (1)..(2007)

SEQ ID NO: 63672 - protein, 668 aa, Methanopyrus kandleri; identical to SEQ ID NO: 25082

SEQ ID NO: 63673 - DNA, 2148 bp, Methanosarcina mazei; identical to SEQ ID NO: 25083
  CDS (1)..(2148)

SEQ ID NO: 63674 - protein, 715 aa, Methanosarcina mazei; identical to SEQ ID NO: 25084

SEQ ID NO: 63675 - DNA, 2022 bp, Oceanobacillus iheyensis; identical to SEQ ID NO: 25085
  CDS (1)..(2022)

SEQ ID NO: 63676 - protein, 673 aa, Oceanobacillus iheyensis; identical to SEQ ID NO: 25086

SEQ ID NO: 63677 - DNA, 2850 bp, Oryza sativa; identical to SEQ ID NO: 25087
  CDS (44)..(2458)

SEQ ID NO: 63678 - protein, 804 aa, Oryza sativa; identical to SEQ ID NO: 25088

SEQ ID NO: 63679 - DNA, 2049 bp, Pasteurella multocida; identical to SEQ ID NO: 25089
  CDS (1)..(2049)

SEQ ID NO: 63680 - protein, 682 aa, Pasteurella multocida; identical to SEQ ID NO: 25090

SEQ ID NO: 63681 - DNA, 2175 bp, Pyrococcus furiosus; identical to SEQ ID NO: 25091
  CDS (1)..(2175)

SEQ ID NO: 63682 - protein, 724 aa, Pyrococcus furiosus; identical to SEQ ID NO: 25092

SEQ ID NO: 63683 - DNA, 2067 bp, Ralstonia solanacearum; identical to SEQ ID NO: 25093
  CDS (1)..(2067)

SEQ ID NO: 63684 - protein, 688 aa, Ralstonia solanacearum; identical to SEQ ID NO: 25094

SEQ ID NO: 63685 - DNA, 2034 bp, Salmonella typhi; identical to SEQ ID NO: 25095
  CDS (1)..(2034)

SEQ ID NO: 63686 - protein, 677 aa, Salmonella typhi; identical to SEQ ID NO: 25096

SEQ ID NO: 63687 - DNA, 1971 bp, Staphylococcus epidermidis; identical to SEQ ID NO: 25097
  CDS (1)..(1971)

SEQ ID NO: 63688 - protein, 656 aa, Staphylococcus epidermidis; identical to SEQ ID NO: 25098

SEQ ID NO: 63689 - DNA, 2001 bp, Streptococcus pyogenes; identical to SEQ ID NO: 25099
  CDS (4)..(2001)

SEQ ID NO: 63690 - protein, 665 aa, Streptococcus pyogenes; identical to SEQ ID NO: 25100

SEQ ID NO: 63691 - DNA, 1917 bp, Thermoanaerobacter tengcongensis; identical to SEQ ID NO: 25101
  CDS (1)..(1917)

SEQ ID NO: 63692 - protein, 638 aa, Thermoanaerobacter tengcongensis; identical to SEQ ID NO: 25102

SEQ ID NO: 63693 - DNA, 2196 bp, Vibrio cholerae; identical to SEQ ID NO: 25103
  CDS (145)..(2196)

SEQ ID NO: 63694 - protein, 683 aa, Vibrio cholerae; identical to SEQ ID NO: 25104

SEQ ID NO: 63695 - DNA, 2031 bp, Vibrio parahaemolyticus; identical to SEQ ID NO: 25105
  CDS (1)..(2031)

SEQ ID NO: 63696 - protein, 676 aa, Vibrio parahaemolyticus; identical to SEQ ID NO: 25106

SEQ ID NO: 63697 - DNA, 2085 bp, Xanthomonas axonopodis; identical to SEQ ID NO: 25107
  CDS (1)..(2085)

SEQ ID NO: 63698 - protein, 694 aa, Xanthomonas axonopodis; identical to SEQ ID NO: 25108

SEQ ID NO: 63699 - DNA, 2091 bp, Xanthomonas campestris; identical to SEQ ID NO: 25109
  CDS (1)..(2091)

SEQ ID NO: 63700 - protein, 696 aa, Xanthomonas campestris; identical to SEQ ID NO: 25110

SEQ ID NO: 63701 - DNA, 2109 bp, Xylella fastidiosa; identical to SEQ ID NO: 25111
  CDS (1)..(2109)

SEQ ID NO: 63702 - protein, 702 aa, Xylella fastidiosa; identical to SEQ ID NO: 25112

SEQ ID NO: 63703 - DNA, 1683 bp, Homo sapiens; identical to SEQ ID NO: 25113
  CDS (1)..(1587)

SEQ ID NO: 63704 - protein, 528 aa, Homo sapiens; identical to SEQ ID NO: 25114

SEQ ID NO: 63705 - DNA, 22 bp, Primer
atggaaaccgtggcttacgctg

SEQ ID NO: 63706 - DNA, 21 bp, Primer
ttatacgacgcgtacgcccgc

SEQ ID NO: 63707 - protein, 30 aa, consensus; identical to SEQ ID NO: 25513
  MISC_FEATURE (1)..(30): consensus for the disclosure of xaa see table XV

SEQ ID NO: 63708 - protein, 28 aa, consensus
  MISC_FEATURE (1)..(28): consensus for the disclosure of xaa see table XV
XXXXXXXXXXNXXXXXXXXXXXSXXXXX

SEQ ID NO: 63709 - DNA, 1332 bp, Escherichia coli
  CDS (1)..(1332)
atgagtacttcagatagcattgtatccagccagacaaaacaatcgtcctggcgtaaatcagataccacatggacgttaggcttgtttggtacggcaatcggcgccggggtgctgttcttccctatccgcgcaggttttggcggactgatcccgattcttctgatgttggtattggcataccccatcgcattttattgccaccgggcgctggcgcgtctgtgtctttctggctctaacccttccggcaacattacggaaacggtggaagagcattttggtaaaactggcggcgtggttatcacgttcctgtacttcttcgcgatttgcccactgctgtggatttatggcgttactattaccaatacctttatgacgttctgggaaaaccagctcggctttgcaccgctgaatcgcggctttgtggcgctgttcctgttgctgctgatggctttcgtcatctggtttggtaaggatctgatggttaaagtgatgagctacctggtatggccgtttatcgccagcctggtgctgatttctttgtcgctgatcccttactggaactctgcagttatcgaccaggttgacctcggttcgctgtcgttaaccggtcatgacggtatcctgatcactgtctggctggggatttccatcatggttttctcctttaacttctcgccaatcgtctcttccttcgtggtttctaaacgtgaagagtatgagaaagacttcggtcgcgacttcaccgaacgtaaatgttcccaaatcatttctcgtgccagcatgctgatggttgcagtggtgatgttctttgcctttagctgcctgtttacgctgtctccggccaacatggcggaagccaaagcgcagaatattccagtgctttcttatctggctaaccactttgcgtccatgaccggtaccaaaacaacgttcgcgattacactggaatatgcggcttccatcatcgcactcgtggctatcttcaaatctttcttcggtcactatctgggaacgctggaaggtctgaatggcctggtcctgaagtttggttataaaggcgacaaaactaaagtatcgctgggtaaactgaacactatcagcatgatcttcatcatgggctccacctgggttgttgcctacgccaacccgaacatcctcgacctgattgaagccatgggcgcaccgattatcgcatccctgctgtgcctgttgccgatgtatgccatccgtaaagcgccgtctctggcgaaataccgtggtcgtctggataacgtgtttgttaccgtgattggtctgctgaccatcctgaacatcgtatataaactgttttaa

SEQ ID NO: 63710 - protein, 443 aa, Escherichia coli
MSTSDSIVSSQTKQSSWRKSDTTWTLGLFGTAIGAGVLFFPIRAGFGGLIPILLMLVLAYPIAFYCHRALARLCLSGSNPSGNITETVEEHFGKTGGVVITFLYFFAICPLLWIYGVTITNTFMTFWENQLGFAPLNRGFVALFLLLLMAFVIWFGKDLMVKVMSYLVWPFIASLVLISLSLIPYWNSAVIDQVDLGSLSLTGHDGILITVWLGISIMVFSFNFSPIVSSFVVSKREEYEKDFGRDFTERKCSQIISRASMLMVAVVMFFAFSCLFTLSPANMAEAKAQNIPVLSYLANHFASMTGTKTTFAITLEYAASIIALVAIFKSFFGHYLGTLEGLNGLVLKFGYKGDKTKVSLGKLNTISMIFIMGSTWVVAYANPNILDLIEAMGAPIIASLLCLLPMYAIRKAPSLAKYRGRLDNVFVTVIGLLTILNIVYKLF

SEQ ID NO: 63711 - DNA, 1305 bp, Vibrio fischeri ES114
  CDS (1)..(1305)
atgaacacagctacattgccgagtcatcatcatgagagagatggaatgaatgactctgagtggaaaaaagcgacgaaattcgatagtactgatattggttggattgtaatcagtattggtatggccataggcgcagggattgtttttttacctgttcaagttggtattatgggactttgggttttccttttatcttcaattattggttacccagccatgtatttgtttcaaaaactttttattaacactctcgcagaagcaaagacatgtacggattacccaggtgttattactggttatttaggtaaaaactgggggatcgctttaggcgttctctactttataatgttggttatttgggtgctggtttactcgctagcagttactaatgacagttcatcatatttgcattcttttggtgtgactgagggacacttaaacgataacgtattttatggtttaggcctgatctgtgtacttgcttttattggttctaaaggcgagaaattattatttaaactttcagggtttatggcggtaacggttctgtctttggtggcaattatgggactattgctagtatctcgttgggatatggcaaatattccagcaatgggatcatttggaccaatgctaaaagacgcgatcattactctgccttttactttaacttctatcttgtttatccaatcattaagccctatggtgatttcatatcgttcacatgaaaaatctattgaggttgctcgctttaaagcattgcgagcaatgaacattgcttttggtatcttgtttattgttgttttcttctttgccgtctcttttacttttgccattagccaagagcaagcggtagaagcaatgaataaaaacatttcagcattggcgattattgctcattacttccctgggagttgggcaacgattactggtatcgtgattaatatcttcgcagtagtgacatcattttttggtgtgtttatggcattccaagaggcatgtcgtggtattgccatgaatatactattaagacgtatggatgaatctgcgataaataaagagttggtaaataaactaattactgtattcattattttacttgcatggtctgctgttgctttgaatgcgcctatcttatcttttacttcgatttgtagccctgtttttggtttagtaggttgtttaattccagcttatcttgtgtataaagtaccgacacttcataagtacaaaggggtagcaactaatctaattattattactggtattctgctttgtatctctccaatacttgcatttatctaa

SEQ ID NO: 63712 - protein, 434 aa, Vibrio fischeri ES114
MNTATLPSHHHERDGMNDSEWKKATKFDSTDIGWIVISIGMAIGAGIVFLPVQVGIMGLWVFLLSSIIGYPAMYLFQKLFINTLAEAKTCTDYPGVITGYLGKNWGIALGVLYFIMLVIWVLVYSLAVTNDSSSYLHSFGVTEGHLNDNVFYGLGLICVLAFIGSKGEKLLFKLSGFMAVTVLSLVAIMGLLLVSRWDMANIPAMGSFGPMLKDAIITLPFTLTSILFIQSLSPMVISYRSHEKSIEVARFKALRAMNIAFGILFIVVFFFAVSFTFAISQEQAVEAMNKNISALAIIAHYFPGSWATITGIVINIFAVVTSFFGVFMAFQEACRGIAMNILLRRMDESAINKELVNKLITVFIILLAWSAVALNAPILSFTSICSPVFGLVGCLIPAYLVYKVPTLHKYKGVATNLIIITGILLCISPILAFI

SEQ ID NO: 63713 - DNA, 1260 bp, Vibrio fischeri ES114
  CDS (1)..(1260)
atgttaattatgcaaacaacaaatactgcatctatcggtgcaaaaaaaactaagtggacttataaagatttcacttggtgtctttctctgttcggtaccgctgtaggtgctggtgttcttttccttccaatcaaagcgggtgctggtggtttttggcctctagttattcttgctctaatcgctgcaccaatgacttggtttgctcacaagagtttggctcgtttcgttctttcagctaaaaacccagatgcagatattactgatactgtagaagagcatttcggtaaaacaggcgcgaacctaatcacttttgcctactttttcgcgatttatccgattgtacttatctacggtgttggtattacaaacacagtagactctttcatggttaaccaaatgggtatggaatctatccctcgttggttactatcaggtgttcttatcactctgatgacatgtggtgtagtatttggtaaagaactaatgctgaaagcaacttcagcaatggtttaccctcttgtattcatcttaatggctctttctgtatacctaatccctggttggaacacatctatgatgtctgttgacccagattggggttcaatgccttctgttgtttggttagcgattcctatcatcgttttctctttcaaccacagcccagtaatcagccagttctctaaagaacaacgtcgtgtatacggtgaagatgcagttgctaaaactgacatgatcactggcggtgcagcaatgatgctaatgagcttcgttatgttcttcgttttctctgtagttctttctctatctccagagcaactagcgcaagcacaagcacagaacatctctgtactttcttacctagcaaacgtacacgaatctccacttatctcttacttaggtccaatcgttgctttcgctgcgattacttcaagctacttcggtcacttcctaggtgctcacgaaggtctcgttggcctagctaaatctcgctcaaaagcaccagttgctaagctagaaaaagcatctctaatctttatcgttgttactacatggatcgtttctatcatcaacccaagtatcctaggtatgattgaaacaatgggtgctccaatgattgcagctatcctattccttatgcctatcttcgcaatgcgtaaagttccagcaatggctaagtacaaaacttcagcacctgtgcaaatctttacagcattatgtggtgttgcggcgattacttctgtaatctacggcgctctttaa

SEQ ID NO: 63714 - protein, 419 aa, Vibrio fischeri ES114
MLIMQTTNTASIGAKKTKWTYKDFTWCLSLFGTAVGAGVLFLPIKAGAGGFWPLVILALIAAPMTWFAHKSLARFVLSAKNPDADITDTVEEHFGKTGANLITFAYFFAIYPIVLIYGVGITNTVDSFMVNQMGMESIPRWLLSGVLITLMTCGVVFGKELMLKATSAMVYPLVFILMALSVYLIPGWNTSMMSVDPDWGSMPSVVWLAIPIIVFSFNHSPVISQFSKEQRRVYGEDAVAKTDMITGGAAMMLMSFVMFFVFSVVLSLSPEQLAQAQAQNISVLSYLANVHESPLISYLGPIVAFAAITSSYFGHFLGAHEGLVGLAKSRSKAPVAKLEKASLIFIVVTTWIVSIINPSILGMIETMGAPMIAAILFLMPIFAMRKVPAMAKYKTSAPVQIFTALCGVAAITSVIYGAL

SEQ ID NO: 63715 - DNA, 1242 bp, Helicobacter pylori 26695
  CDS (1)..(1242): transl_table=11
atggcacaagaaaaagcagttccaagagatcctaaaaaactcaatgcgtttgatttgcgttggatggtgtccttatttggcacggcggtgggggctgggattttatttttgcctattagagccggtgggcatggggtatgggctattgtggtaatgagcgcgatcattttccctttaacttatctagggcatagagctttagcttatttcataggatctaaagacaaagaagacattaccatggtcgttcgctctcattttggcgctcaatggggttttcttatcactttgctttatttcttagcgatttatcctatttgcttggtttatggggtgggtatcactaacgtgtttgatcattttttcactaaccagttgcatttagcgccttttcatcggggattattggctgtagcgttagtttctttaatgatgttggtgatggtttttaacgctacgattgttacgcgcatttgtaacgctttagtgtatcctttatgcttgattttattgcttttttctttgtatcttatcccttattggcaaggcgctaatctttttgtggtgccgagttttaaagaatttgtgttagcgatttggctaaccttaccggtgcttgtgtttgcattcgaccatagccccatcatttcaaccttcactcaaaatgtgggaaaagaatacggcgttttcaaagaatacaaactcaatcaaattgaattagggacatcgctgatgcttttagggtttgtgatgttttttgtgttttcgtgcgtcatgtgcttgaatgctgatgattttgtgaaagcaagggaacaaaatatccccattttaagctatttggctaacactttaaacaaccctttaatcaattatgcggggcctgtggtggcttttttagcgattttttcatctttttttgggcattattatggggctaaggagggtttagaaggcattattattcaaagcttaaaattgaaaaaagcttctaaacccttgagcgttagcgtaacgatttttttatggctgactatcacgcttgtggcttatattaaccccaatatcttggattttattgaaaatttaggcggccccattatcgcgctcattctgtttgtgatgcccatgatagctttttatagtgtttctagtttgaagcgttttagaaatttcaaagtggatatttttgtgtttgtctttgggagcttgacggctttgagcgtgtttttaggactattttaa

SEQ ID NO: 63716 - protein, 413 aa, Helicobacter pylori 26695
MAQEKAVPRDPKKLNAFDLRWMVSLFGTAVGAGILFLPIRAGGHGVWAIVVMSAIIFPLTYLGHRALAYFIGSKDKEDITMVVRSHFGAQWGFLITLLYFLAIYPICLVYGVGITNVFDHFFTNQLHLAPFHRGLLAVALVSLMMLVMVFNATIVTRICNALVYPLCLILLLFSLYLIPYWQGANLFVVPSFKEFVLAIWLTLPVLVFAFDHSPIISTFTQNVGKEYGVFKEYKLNQIELGTSLMLLGFVMFFVFSCVMCLNADDFVKAREQNIPILSYLANTLNNPLINYAGPVVAFLAIFSSFFGHYYGAKEGLEGIIIQSLKLKKASKPLSVSVTIFLWLTITLVAYINPNILDFIENLGGPIIALILFVMPMIAFYSVSSLKRFRNFKVDIFVFVFGSLTALSVFLGLF

SEQ ID NO: 63717 - DNA, 1254 bp, Vibrio cholerae O1 biovar eltor str. N16961
  CDS (1)..(1254): transl_table=11
gtgaaagactctcaggaagtgacccattttagtgctgcccgttcctcaaaatggactcaacatgatacctattggttactaagcctatttggtacagcagtaggtgcagggattttatttttaccgatcaatattggcttagggggattctggccgctggtgctgatggcagtattagcctttcctatgacctatctgtcccaccgtggactggcgcgttttgtactttcatcacgtcgcccaaatgccgattttactgatgtggtcgaagagcactttggccaaaatgctggacgattgatttccctactctattttttatcgatttttcctattctgcttatctacggtgttggccttaccaacacagtcgatagtttcttggttaaccaagcggacatggtatcgccgccacgcgcactactttctggtgctttagtgtttgggcttatcgctatcatgctcagtggcgagaaaatcatgctgcgcgcttttgccatcatggtttatccgctggcggcgatccttgccctactctcgctgtatttgatcccttactggtcaatgccttcgtttgattttccgcaaaccagcgattttctgcacactgtatggctggccgtaccggtagtggtgttctcattcagccatgctgcggccatttcaagttttgccaatatccagcgtcgtcattatggtgaacaagctgatcaaaagtctgagcagattctgcgccacactagcgtggtcttaattttgtttgtgttgttgtttgtcttctcttgtgtacttgccctttcgccacaagcactgcaagaagccaaagcacaaaacatttcggtgctgacttatctggccaatgtcactgacaacccatttatcgcgacgctcgggcctctggtcgccttcatcgccatcacctcttccttcctcggccacttcttaggggcgcgtgaaagtttatctggcctactgaccaaaaacttaggggtatcactacgtttggcggaacgtctcaccatcggctttttatttgtcaccatctggatcgctgcaatcctcaacccaagcattttgggcatgatggaagcgctttctggtccagtcatcgcaatgattctattcataatgccgatgattgccgtcttcaaagtgcccgccctgcgtgaacatcaaaaacgtttcagcactttcttcgtgttactggttggattgctcgccgtttctgctctgctctacagtttacttcgctaa

SEQ ID NO: 63718 - protein, 417 aa, Vibrio cholerae O1 biovar eltor str. N16961
MKDSQEVTHFSAARSSKWTQHDTYWLLSLFGTAVGAGILFLPINIGLGGFWPLVLMAVLAFPMTYLSHRGLARFVLSSRRPNADFTDVVEEHFGQNAGRLISLLYFLSIFPILLIYGVGLTNTVDSFLVNQADMVSPPRALLSGALVFGLIAIMLSGEKIMLRAFAIMVYPLAAILALLSLYLIPYWSMPSFDFPQTSDFLHTVWLAVPVVVFSFSHAAAISSFANIQRRHYGEQADQKSEQILRHTSVVLILFVLLFVFSCVLALSPQALQEAKAQNISVLTYLANVTDNPFIATLGPLVAFIAITSSFLGHFLGARESLSGLLTKNLGVSLRLAERLTIGFLFVTIWIAAILNPSILGMMEALSGPVIAMILFIMPMIAVFKVPALREHQKRFSTFFVLLVGLLAVSALLYSLLR

SEQ ID NO: 63719 - DNA, 1242 bp, Pasteurella multocida subsp. multocida str. Pm70
  CDS (1)..(1242): transl_table=11
atggcaacaaaatcttgtgtcagttggagcaagtttgatcttgtctgggcattaaatttattcggtaccgctgtgggtgcgggtgtcttatttttacccattaatgcaggaaaaggcgggttttggcccttagtatgtatgacactcctagtaggtcccatgacttacttagcacaccgcggactcactcgttttgtcctatcttctgccaaaagcggcagtgatattactgaagtcgtagaagaacattttgggcaaaccgcaggaaaattcattactttactttatttctttgcgatttttcctattctgctgatttatggtaacggaataactaacacagtcgattcatttattgtacatcaactgcatatgaactcacctaatcgcgccttattggctttcatcctcattgccggcttaatttctgttatgttaatgaacgagaagatcatgctaaaaattaccgagtttttagtctatccattagtctgtattctgctcgccttatcactctatcttattccggaatggaatacctcaatgttaacagaatttccgagtacgcaagccctattcagcaccttatggattacgatccctgtattggttttttcgtttaaccactcaccggctatttcatcttttgcccaatctcaacaacgtgaatatggtgatctcacaaacacagaaacgcatactaaccgcactttaaaaataacctcaagtattttgctggtgtttgtgatgttcttcgtttttagctgtgtattaagtttaactcctgctgaattagcacaagcaaaaacacaaaatatcagtatcttatccttcctcgccaacaaatttgataatccttatatttcttaccttggacctttcgttgccttcttggcaattactagctctttctttggtcactatctcggtgcaaaagaaggactagaagggttaattatcaaaatgtctggcaaaaaagagattaagtgtcaaaaattaaattatttcaccgcacttttcttcttgctaaccctgtggattgtcgccattattaatccaagtattcttggcttaatagaatccttcggcggaccgattattgctgcaattttatttatcatgccgatgtatgcgatccgtaaaattcccgcgatgcaacgttaccaaggacgcttttcgaatctcttcgttaccatcatgggtatgttcgccatctcagcggttgtttatggcttattttaa

SEQ ID NO: 63720 - protein, 413 aa, Pasteurella multocida subsp. multocida str. Pm70
MATKSCVSWSKFDLVWALNLFGTAVGAGVLFLPINAGKGGFWPLVCMTLLVGPMTYLAHRGLTRFVLSSAKSGSDITEVVEEHFGQTAGKFITLLYFFAIFPILLIYGNGITNTVDSFIVHQLHMNSPNRALLAFILIAGLISVMLMNEKIMLKITEFLVYPLVCILLALSLYLIPEWNTSMLTEFPSTQALFSTLWITIPVLVFSFNHSPAISSFAQSQQREYGDLTNTETHTNRTLKITSSILLVFVMFFVFSCVLSLTPAELAQAKTQNISILSFLANKFDNPYISYLGPFVAFLAITSSFFGHYLGAKEGLEGLIIKMSGKKEIKCQKLNYFTALFFLLTLWIVAIINPSILGLIESFGGPIIAAILFIMPMYAIRKIPAMQRYQGRFSNLFVTIMGMFAISAVVYGLF

SEQ ID NO: 63721 - DNA, 1251 bp, Campylobacter jejuni subsp. jejuni NCTC 11168
  CDS (1)..(1251): transl_table=11
atgaatactcctaaatggactagtcacgatacaaggtgggttttatctctttttggaacagctattggagccggcgtacttttgttgcctattagtgctgggcttggtggattgatacctttgttagttatacttgttttagcttttcctatgacttacttagctcatagaaatttatgtcgctttgtgctttcaagttctaatccaaaagatgatattacttttgttgcagaaagttattttggcaagggcggtggatttttaattacacttttgtatttttttgctattttgcctattttattggtttatagtgctaatcttacaacaactttgcttgagttcttaatcaatcagttcaatttcaatgcagatcttactcatgctgctcgttggtgggtgagttttttgattgttggagttttggttttgatttctattcttggtgaaaatgttgtaacaaaagcaatgagttttcttgtttttccttttattatatttttatttattttttcattgcttttaattccacaatggaatttatcgttatttgcaaatgttgatttttccgtaatttcaacaagtaatttttgggttactttatggcttgttattcctgtgatggtatttagttttaatcactctcctatcatttcttcacttgcttgttattgtaaaaaagaatatggtggttatgctgaacctcgcgctagaaaaattatttctttggcaattattcttatggtttttgttgtaatgttttttgttttttcttgtgctttaacctttacaccagaagattttgcatcagcaaaagatcaaaatatcaatattcttacttttatagcaaataaatttcctgaagtttctttactagcttatgttggacctattgttgcacttgtggctattagcaaaagtttcttagggcattatcttggttctcaagaaggcttaaatggtattttatataaagcaagtaatggtagaattcaaggtaaattcgctcaaactttaacagcgatcattacctttgctatcgcgtggcttgttgcgtataaaaatccaagtgttataggaattatcgaggctattggtggtcctgttttggctattttgcttttcttaatgccgctttattgtatttatcgttttgatattttggcaaggtttcgtaataaatttttagatctttttgttttggtaatggggatagttgcaatttctgctgcaattcatgatcttttataa

SEQ ID NO: 63722 - protein, 416 aa, Campylobacter jejuni subsp. jejuni NCTC 11168
MNTPKWTSHDTRWVLSLFGTAIGAGVLLLPISAGLGGLIPLLVILVLAFPMTYLAHRNLCRFVLSSSNPKDDITFVAESYFGKGGGFLITLLYFFAILPILLVYSANLTTTLLEFLINQFNFNADLTHAARWWVSFLIVGVLVLISILGENVVTKAMSFLVFPFIIFLFIFSLLLIPQWNLSLFANVDFSVISTSNFWVTLWLVIPVMVFSFNHSPIISSLACYCKKEYGGYAEPRARKIISLAIILMVFVVMFFVFSCALTFTPEDFASAKDQNINILTFIANKFPEVSLLAYVGPIVALVAISKSFLGHYLGSQEGLNGILYKASNGRIQGKFAQTLTAIITFAIAWLVAYKNPSVIGIIEAIGGPVLAILLFLMPLYCIYRFDILARFRNKFLDLFVLVMGIVAISAAIHDLL

SEQ ID NO: 63723 - DNA, 1332 bp, Salmonella typhimurium LT2
  CDS (1)..(1332): transl_table=11
atggaatcggcaagtaataccagcgtaatcctcgacgcatcagccccggcgcgtcgggcagggatgactgaaagcgaatggcgtgaagccatcaaatttgatagtaccgacaccggttgggtcattatgagtatcgggatggcgattggcgcagggatcgtttttcttcctgtccaggttggcctgatgggactttgggtctttttactctcttctattattggctatccggccatgtacctgttccagcggctgtttattaatacgctggcggaatccccggaatgtaaagactaccccagcgtgatcagcggctatctgggcaaaaactggggtattttattaggcgcgctgtactttgtgatgctcgtcatctggatgttcgtctattctacggcgattactaacgacagcgcctcttatctgcatactttcggcgtaacggaaggattgctttccgatagtccattttatggtctggtgctgatctgcatcctggtggcgatttcctcacgcggtgaaaaattactgttcaaaatctccactggcatggtgctgaccaagctactggtagtggcggcgctgggcgtctctatggtgggtatgtggcatctgtataacattggcgcgctgccgccgatggccctgctgattaaaaacgccattattaccctgccatttacgctgacctcgattttatttatccagacgttaagcccaatggtgatctcttaccgttcacgcgaaaaatctattgaggtcgcacgccataaagcgctgcgtgccatgaatattgcgtttggcatcctgttcgttaccgtatttttctatgcggtttccttcaccctggcgatggggcatgacgaagcggtgaaagcctacgagcagaatatttccgccctggcgatcgccgcgcaatttattagcggcgatggcgctggctgggtcaaagtggttagcgtaattctgaacatctttgccgtcatgaccgccttctttggcgtttatttaggattccgcgaagcgacgcaaggcattgtgatgaatatcctgcgccgtaaaatgcccgccgagaagattaaggaaaatctggtacagcgcggcattatgattttcgctattttgctggcctggagcgccattgtgctcaacgcgccggtactgagcttcacctctatttgtagccctatcttcggtatggtgggctgtttaattccggcatggttggtctacaaggttcccgcattgcacaaatataaaggcgcttcgttgtacctgattattattaccggtctgctgctatgcgtttctccgttcctggcattctcttga

SEQ ID NO: 63724 - protein, 443 aa, Salmonella typhimurium LT2
MESASNTSVILDASAPARRAGMTESEWREAIKFDSTDTGWVIMSIGMAIGAGIVFLPVQVGLMGLWVFLLSSIIGYPAMYLFQRLFINTLAESPECKDYPSVISGYLGKNWGILLGALYFVMLVIWMFVYSTAITNDSASYLHTFGVTEGLLSDSPFYGLVLICILVAISSRGEKLLFKISTGMVLTKLLVVAALGVSMVGMWHLYNIGALPPMALLIKNAIITLPFTLTSILFIQTLSPMVISYRSREKSIEVARHKALRAMNIAFGILFVTVFFYAVSFTLAMGHDEAVKAYEQNISALAIAAQFISGDGAGWVKVVSVILNIFAVMTAFFGVYLGFREATQGIVMNILRRKMPAEKIKENLVQRGIMIFAILLAWSAIVLNAPVLSFTSICSPIFGMVGCLIPAWLVYKVPALHKYKGASLYLIIITGLLLCVSPFLAFS

SEQ ID NO: 63725 - DNA, 1332 bp, Salmonella typhimurium LT2
  CDS (1)..(1332): transl_table=11
atgagtactactgatagcattgtatccagccaggcaaaacagtcgtcatggcgtaaatcggacacgacgtggacgctgggtttatttggtaccgccatcggcgccggggtgctgtttttccctatccgcgccgggtttggcgggcttatccccattcttctgatgctggttttagcttaccccattgcgttctattgtcaccgggcgctggcgcgtctgtgtttatccggatctaatccgtccggcaatattacggaaacggtcgaagagcactttggtaaaacgggcggggtagttatcacgttcctttacttctttgcgatttgtccgctgctgtggatttatggcgtcaccattactaacacgttcatgacgttttgggaaaaccagctgcagatgccagcgttgaatcgcggtttcgtggcgctgttcttgctgctgctgatggcctttgtgatctggtttggtaaagatctgatggttaaggtgatgagttacctggtatggccgtttatcgccagtctggtactaatctcattatcgctgattccttactggaactcggcggttatcgatcaggttgatctcagtaatatcgcgctgaccgggcacgatggcatactggttacggtgtggctgggcatctctatcatggtgttctcctttaacttttcgcccatcgtctcttccttcgtggtgtctaagcgtgaagagtatgagaaagagtttggccgcgaatttaccgagcgtaaatgttcacagatcatctcgcgcgccagtatgctgatggtcgccgtggtgatgttcttcgcctttagctgcctgtttacgctctccccgcagaacatggcggatgcgaaagcgcagaacattccggtactttcctacctggccaaccatttcgcctctttgtcggggacaaaatctacttttgcaacggtgctggagtatggcgcgtctatcatcgcgctggttgctattttcaaatctttcttcggccactacctggggacgctggaagggctgaacggcctggtgctgaaatttggttataaaggcgataaaaccaaagtctctatgggcaagcttaacaccatcagcatgatcttcattatggggtctacctgggtcgtagcttacgcaaacccgaacattctggacctgattgaagcgatgggcgcgccgattatcgcctcgctgttatgcctgctgccgatgtacgccattcgtaaagcgccgtcgctggcgaagtaccgtggtcgtctggataacgtgttcgtcaccctgattggtctgctgaccatcctgaatattgtctacaaattgttctaa

SEQ ID NO: 63726 - protein, 443 aa, Salmonella typhimurium LT2
MSTTDSIVSSQAKQSSWRKSDTTWTLGLFGTAIGAGVLFFPIRAGFGGLIPILLMLVLAYPIAFYCHRALARLCLSGSNPSGNITETVEEHFGKTGGVVITFLYFFAICPLLWIYGVTITNTFMTFWENQLQMPALNRGFVALFLLLLMAFVIWFGKDLMVKVMSYLVWPFIASLVLISLSLIPYWNSAVIDQVDLSNIALTGHDGILVTVWLGISIMVFSFNFSPIVSSFVVSKREEYEKEFGREFTERKCSQIISRASMLMVAVVMFFAFSCLFTLSPQNMADAKAQNIPVLSYLANHFASLSGTKSTFATVLEYGASIIALVAIFKSFFGHYLGTLEGLNGLVLKFGYKGDKTKVSMGKLNTISMIFIMGSTWVVAYANPNILDLIEAMGAPIIASLLCLLPMYAIRKAPSLAKYRGRLDNVFVTLIGLLTILNIVYKLF

SEQ ID NO: 63727 - DNA, 1287 bp, Yersinia pestis KIM
  CDS (1)..(1287): transl_table=11
atgtctgaaatctcgtcttcaaaatctgaattaaaaaagctctataaatcggttccctttacacagtatgatgtcggttgggtcatattatgtatcgggatggctatcggatcaggtatcgtatttatgcctgtacaggttggtattaaggggatttgggtctttattgctgcggttattatttcgtatcctgcaatttatttactgcagaatctctatctgcgtacactttctgaatctgataactgtactgattataccagtgtcattacgcaatatttaggtaagaactggggggtaggtctcggtattgcttattttttaatgttattgcacgggatgttttcttattccctggccgtcacctttgatagtgcctcttacatcaaaacatttggattaactgaaggcttattatcagattcaatatggtacgggttaattatcttgacagttttggttgccattgctgcacaaggtgaaaaaattctatttaaagtttcgggacccatggtttgtgtgaagtttggcatcattgtggtgttgggtgttgtaatggttccttattgggattttaacaatatctccgcttttcctgaactcttctcctttttacgcgatgtcctgttaacactaccgttcacattattctctatcttatttgttcaaattcttagcccaatgaatattgcttatcgtaaagtggaaagcgataaaagaattgccacctaccgggccatcagagcaaaccgtgttgcttatatcattttggctgttgcagtgctgttctttgccttctcttttactttctcgattagccatgagcaggctgtctcggcgtttgaacaaaatatctctgccctggcgattgccgctcaggttattcccggttcgattgtccgtatcatgactgcattattaaatatttttgctatcttgacggcgttcttggggatctatttaggatttcaggaggcgattaaaggtattgtcgttaatattatcagtcgctttatccctgaagagaatattaatcagaaagtgctacacatcggggtctgtgtcggtgtgatattaacgttatggctatgggtctcaacccggttctctattcttttcttcttacaacttggcggcccgttattcggggtggtctcttgtttaattccttgctacctggtttataaagttcctgttttacataaattaaaagggccaactatttggtttatcagctttttcggtattcttctttgtctttccccattctttaaattctttgagtaa

SEQ ID NO: 63728 - protein, 428 aa, Yersinia pestis KIM
MSEISSSKSELKKLYKSVPFTQYDVGWVILCIGMAIGSGIVFMPVQVGIKGIWVFIAAVIISYPAIYLLQNLYLRTLSESDNCTDYTSVITQYLGKNWGVGLGIAYFLMLLHGMFSYSLAVTFDSASYIKTFGLTEGLLSDSIWYGLIILTVLVAIAAQGEKILFKVSGPMVCVKFGIIVVLGVVMVPYWDFNNISAFPELFSFLRDVLLTLPFTLFSILFVQILSPMNIAYRKVESDKRIATYRAIRANRVAYIILAVAVLFFAFSFTFSISHEQAVSAFEQNISALAIAAQVIPGSIVRIMTALLNIFAILTAFLGIYLGFQEAIKGIVVNIISRFIPEENINQKVLHIGVCVGVILTLWLWVSTRFSILFFLQLGGPLFGVVSCLIPCYLVYKVPVLHKLKGPTIWFISFFGILLCLSPFFKFFE

SEQ ID NO: 63729 - DNA, 1119 bp, Shigella flexneri 2a str. 301
  CDS (1)..(1119): transl_table=11
gtggtcctgtttattactgctctggtcgcctggcctttaacatattggccacataaagccttatgccagttcatcctctcatcaaaaacatcagcaggtgaagggataacgggcgcggtaacacactactatggcaagaagattggtaatctgattaccacgctgtacttcatcgccttttttgtcgtcgtgttgatatatgcagtggcaattaccaactcacttacggaacagctggcaaagcatatggttattgatcttcgcatccgtatgttggtgagtctgggtgttgtattaattctgaatctcatttttctgatgggacgtcatgccactattcgggtaatgggatttttggtattcccattgattgcctatttcttatttctttccatttaccttgtcggtagttggcaacctgatctattaacaacccaggtagagttcaatcagaatacccttcaccagatatggatatcgattcccgtgatggttttcgcctttagccatacgcccattatttctacgtttgccatagacagacgtgaaaaatatggcgaacacgctatggataaatgcaaaaaaattatgaaagtcgcttatctcatcatctgcataagtgtactgttctttgtctttagctgcctgctttctattccatcttcgtatattgaagcggctaaagaagaaggggtcaccattttatcggcgctttctatgctgccgaacgccccagcatggttgtcaatttccgggattattgtcgcagtagttgcgatgtcgaaatcattcctgggtacgtactttggcgttattgaaggtgccacagaggtcgtcaaaacaacactacagcaggttggtgtaaagaaaagtcgtgcatttaaccacgcactatcaattatgttggtatcgctgattaccttcattgtttgttgcattaacccgaacgcgatttcgatgatttacgcgatcagcggcccgctcattgccatgatacttttcatcatgcctacgctgtcaacgtatctcatcccggcgcttaaaccctggcgttccatcggaaatctgattacgctgatcgtgggtatcctgtgcgtatcggtaatgttctttagctaa

SEQ ID NO: 63730 - protein, 372 aa, Shigella flexneri 2a str. 301
MVLFITALVAWPLTYWPHKALCQFILSSKTSAGEGITGAVTHYYGKKIGNLITTLYFIAFFVVVLIYAVAITNSLTEQLAKHMVIDLRIRMLVSLGVVLILNLIFLMGRHATIRVMGFLVFPLIAYFLFLSIYLVGSWQPDLLTTQVEFNQNTLHQIWISIPVMVFAFSHTPIISTFAIDRREKYGEHAMDKCKKIMKVAYLIICISVLFFVFSCLLSIPSSYIEAAKEEGVTILSALSMLPNAPAWLSISGIIVAVVAMSKSFLGTYFGVIEGATEVVKTTLQQVGVKKSRAFNHALSIMLVSLITFIVCCINPNAISMIYAISGPLIAMILFIMPTLSTYLIPALKPWRSIGNLITLIVGILCVSVMFFS

SEQ ID NO: 63731 - DNA, 1332 bp, Shigella flexneri 2a str. 301
  CDS (1)..(1332): transl_table=11
atggaaattgcatcgaataaaggcgtcattgcagacgcttcgaccccggcgggtcgtgctggaatgagtgagagcgagtggcgagaagcgatcaaattcgacagtactgacaccggctgggtgattatgagtatcgggatggcgattggcgcggggattgtttttctcccggtgcaggtcggtttgatgggattgtgggtatttttgctctcatcggtgattggttacccggcaatgtatctgtttcagcggttgtttattaatacgctggcagaatcaccagaatgtaaagattacccgagtgtcattagcggttatttaggtaaaaactggggcatcctgttaggtgcgctctatttcgtaatgctggtgatttggatgttcgtctattccaccgccatcaccaacgatagtgcttcctatctgcataccttcggcgtgacggaagggttgctgtcagacagtcccttttatggtctggtactgatttgcattctggtggcgatctcttcacgcggcgagaaattgttattcaaaatttcgaccgacatggtgctgaccaagctgctggtagtcgctgcgctgggcgtgtcgatggtgggaatgtggcatctgtataacgtcggttcgctaccgccgctggggctgctggtgaaaaacgccattattacgctgccgtttaccctgacgtcgattctgtttatccagacgttaagcccgatggtgatctcttatcgctcgcgggaaaaatcaattgaagtggcgcggcataaagcattgcgggcaatgaatatcgcgtttggcattttgtttgtcaccgtctttttctacgccgtgtcgttcacgctggcgatgggacatgacgaagcggtaaaagcctacgagcagaatatttccgcgctggcgattgccgcacagtttattagcggtgacggcgcagcgtgggtgaaagtggtcagcgtcattctcaatatctttgctgtcatgactgcattctttggcgtctatttaggctttcgcgaagcaacgcaagggatcgtaatgaacatcctgcgtcgcaagatgcctgccgagaagattaacgaaaatcttgttcagcgcggcatcatgattttcgccattttgctggcctggagctccatcgtactgaacgcaccggtgttgagcttcacctctatctgtagcccgattttcggcatggtagggtgcctgatcccggcgtggctggtttacaaagtaccggcattgcacaaatacaaagggatgtctctgtacctgattatcgtcactggtttgttgctttgtgtttctctgttcctggcattttcttga

SEQ ID NO: 63732 - protein, 443 aa, Shigella flexneri 2a str. 301
MEIASNKGVIADASTPAGRAGMSESEWREAIKFDSTDTGWVIMSIGMAIGAGIVFLPVQVGLMGLWVFLLSSVIGYPAMYLFQRLFINTLAESPECKDYPSVISGYLGKNWGILLGALYFVMLVIWMFVYSTAITNDSASYLHTFGVTEGLLSDSPFYGLVLICILVAISSRGEKLLFKISTDMVLTKLLVVAALGVSMVGMWHLYNVGSLPPLGLLVKNAIITLPFTLTSILFIQTLSPMVISYRSREKSIEVARHKALRAMNIAFGILFVTVFFYAVSFTLAMGHDEAVKAYEQNISALAIAAQFISGDGAAWVKVVSVILNIFAVMTAFFGVYLGFREATQGIVMNILRRKMPAEKINENLVQRGIMIFAILLAWSSIVLNAPVLSFTSICSPIFGMVGCLIPAWLVYKVPALHKYKGMSLYLIIVTGLLLCVSLFLAFS

SEQ ID NO: 63733 - DNA, 1332 bp, Shigella flexneri 2a str. 301
  CDS (1)..(1332): transl_table=11
atgagtacttcagatagcattgtatccagccagacaaaacaatcgtcctggcgtaaatcagataccacatggacgttaggcttgtttggtacggcaatcggcgccggggtgctgttcttccctatccgcgcaggttttggcggactgatcccgattcttctgatgttggtattggcataccccatcgcattttattgccaccgggcgctggcgcgtctgtgtctttctggctctaacccttccggcaacattacggaaacggtggaagagcattttggtaaaactggcggcgtggttatcacgttcctgtacttcttcgcgatttgcccactgctgtggatttatggcgttactattaccaatacctttatgacgttctgggaaaaccagctcggatttgcaccgctgaatcgcggctttgtggcgctgttcctgttgctgctgatggctttcgtcatctggtttggtaaggatctgatggttaaagtgatgagctacctggtatggccgtttatcgccagcctggtgctgatttctctgtcgctgatcccttactggaactctgcagttatcgaccaggttgacctcggttcgctgtcgttaaccggtcatgacggtatcctgatcactgtctggctggggatttccatcatggttttctcctttaacttctcgccaatcgtctcttccttcgtggtttctaaacgtgaagagtatgagaaagacttcggtcgcgacttcaccgaacgtaaatgttcccaaatcatttctcgtgccagcatgctgatggttgcagtggtgatgttctttgcctttagctgcctgtttactctgtctccggccaacatggcggaagccaaagcgcagaatattccagtgctttcttatctggctaaccactttgcgtccatgaccggtacgaaaacaacgttcgcgattacactggaatatgcggcttccatcatcgcactcgtggctatcttcaaatctttcttcggtcactatctggggacgctggaaggcttgaatggtctgattctgaagttcggttataaaggtgacaaaaccaaagtgtcgctgggtaaactgaatactctcagcatgatcttcatcatgggctccacctgggttgttgcctacgccaacccgaacatcctcgacctgattgaagccatgggcgcaccgattatcgcatccctgctgtgcctgttgccgatgtatgctatccgtaaagcgccgtctctggcgaaataccgtggtcgtctggataacgtgtttgttaccgtgattggtctgctgaccatcctgaacatcgtatacaaactgttttaa

SEQ ID NO: 63734 - protein, 443 aa, Shigella flexneri 2a str. 301
MSTSDSIVSSQTKQSSWRKSDTTWTLGLFGTAIGAGVLFFPIRAGFGGLIPILLMLVLAYPIAFYCHRALARLCLSGSNPSGNITETVEEHFGKTGGVVITFLYFFAICPLLWIYGVTITNTFMTFWENQLGFAPLNRGFVALFLLLLMAFVIWFGKDLMVKVMSYLVWPFIASLVLISLSLIPYWNSAVIDQVDLGSLSLTGHDGILITVWLGISIMVFSFNFSPIVSSFVVSKREEYEKDFGRDFTERKCSQIISRASMLMVAVVMFFAFSCLFTLSPANMAEAKAQNIPVLSYLANHFASMTGTKTTFAITLEYAASIIALVAIFKSFFGHYLGTLEGLNGLILKFGYKGDKTKVSLGKLNTLSMIFIMGSTWVVAYANPNILDLIEAMGAPIIASLLCLLPMYAIRKAPSLAKYRGRLDNVFVTVIGLLTILNIVYKLF

SEQ ID NO: 63735 - DNA, 1272 bp, Shigella flexneri 2a str. 301
  CDS (1)..(1272): transl_table=11
atgcagcacaacacactatcgaaacacaatcagaaattgccgtttacacgctacgacttcggctgggttttattatgcataggcatggcgattggtgccggaaccgtgctgatgccagtacaaattggcttgaagggaatttgggtatttattaccgcagcgatcattgcttatcctgtcacctgggtagtgcaggacatttatttaaaaaccctttctgaaagcgattcctgtaatgactacaccgatattatcagtcattacctggggaagaactggggaattttcctcggggttatctactttttgatgattatccacgggatttttatctactctctctccgtggttttcgacagcgcctcgtacctgaaaaccttcggtttaaccgatgccgatctttcacaatctctactttataaagtcgctattttcgccgtactgatagcgattgcgtctggtggtgaacgattactgtttaagatttctgggccaatggtggtggtcaaagtagggattattgtcgtgttcggttttgcgatgatcccgcactggaatttcgccaatataaccgccttcccgcaagcctccgtctttttccgcgatgtcctgcttaccattccattttgcttcttttctgcggtatttattcaggtacttaacccaatgaatattgcctatcgtaaacgggaagcagataaagtactggcaacccggctcgcgctgcgtacccaccgaattagttatatcacgctcatcgcggtgatcctgttttttgccttttcgtttaccttctcaattagccacgaagaagccgtttctgcctttgaacaaaatatctcggcactggcactggccgcgcaggtgatccctggacatatcattcatatcacctctacggtgctgaatatctttgccgtactgaccgcattctttggcatttatctcggtttccacgaggctattaaaggcattattctcaatctgttaagccgaattattgataccaagaaaattaactcacgcatgctgactctggcgatctgcgcttttatcgtcattacgttgacgatttgggtttcgtttcgtgtatcagtgctggtgttctttcagttgggaagcccgttatatggcattgtgtcgtgcctcattccgtttttcctgatctataaagtcgcacaactggaaaaacttcgcggatttaaagcctggctgattctgctttacggcattttgctatgcttgtcgccactgttgaagctgattgagtaa

SEQ ID NO: 63736 - protein, 423 aa, Shigella flexneri 2a str. 301
MQHNTLSKHNQKLPFTRYDFGWVLLCIGMAIGAGTVLMPVQIGLKGIWVFITAAIIAYPVTWVVQDIYLKTLSESDSCNDYTDIISHYLGKNWGIFLGVIYFLMIIHGIFIYSLSVVFDSASYLKTFGLTDADLSQSLLYKVAIFAVLIAIASGGERLLFKISGPMVVVKVGIIVVFGFAMIPHWNFANITAFPQASVFFRDVLLTIPFCFFSAVFIQVLNPMNIAYRKREADKVLATRLALRTHRISYITLIAVILFFAFSFTFSISHEEAVSAFEQNISALALAAQVIPGHIIHITSTVLNIFAVLTAFFGIYLGFHEAIKGIILNLLSRIIDTKKINSRMLTLAICAFIVITLTIWVSFRVSVLVFFQLGSPLYGIVSCLIPFFLIYKVAQLEKLRGFKAWLILLYGILLCLSPLLKLIE

SEQ ID NO: 63737 - DNA, 1293 bp, Shewanella oneidensis MR-1
  CDS (1)..(1293): transl_table=11
atgcaaaaagatgcgatcagtgttctcgaaacacctcaaagcactcaagaaagcacaacaagacgcttaccttggacgcgccaagatactacttggatgctaagtttatttggtaccgctgtgggggcaggtatcttatttctacccatcaatgcgggcatgggcggtttttggcccttagtcttgatggccattatcatcggacctatgacctatttggctcaccgtggtctttcgcgcttcgtatgctcatctagcattcccggcagtgatattacccaagtagtggaagagcactttgggattggcgcaggtaaagcaattactttgctttatttcttagcgatttatcctatcgtgttgatctatggcgttgggatcaccaatactgtcgatagctttatcgttaatcaattaggcatggcatcaccaccgcgttttctgctttcgggtatcttgattttcggcatgatggccgtgatggtggcgggtgagcaatttatgctgaaggtgactcagctgctggtgtatccgctggtggggattttggcctttatgtctgtgtatcttattcctgaatggaaaatggatgcactgcaggttgtgcctgaaacaggtgcttttttagggactgtgtggttaaccattcctgtattggtgttcgcctttaaccattctccggcgatttcacaattttcggtttccttaaaacgtgaccatggcgcgaatgccgcacgtaaggccgatgtgatcctgcgtaatacttcgatgatgttagtcggatttgtgatgctgtttgtgttctcctgcgtcttgtcgctgtcgcctgaacaattggccgaagcgaaggcaaagaacctgccgattttgtcttatctagcaaacgtgcatgacagcggttttgtcagctattttggtcctttcattgcctttatcgcgattgtgtcttccttctttggtcactatatgggcgctactgaaggtatgaagggcattattgttaagcaattacgctcaagcaaaaagcaagtcagcgaggataagctgaacaagtttatcttagtgtttatgtttgccacgatttggggcgttgcgattaaaaacccaagcattctggggatgattgaggcgctgggcggcccggtgattgcggcaattttgtacttaatgccaatgtatgcggtgtataaagtaccggcacttaaagcataccgtcaccgtatcagcaatgtgtttgtggtgattgctggtttactggcgatgacggcgattctatttggtctactcagttaa

SEQ ID NO: 63738 - protein, 430 aa, Shewanella oneidensis MR-1
MQKDAISVLETPQSTQESTTRRLPWTRQDTTWMLSLFGTAVGAGILFLPINAGMGGFWPLVLMAIIIGPMTYLAHRGLSRFVCSSSIPGSDITQVVEEHFGIGAGKAITLLYFLAIYPIVLIYGVGITNTVDSFIVNQLGMASPPRFLLSGILIFGMMAVMVAGEQFMLKVTQLLVYPLVGILAFMSVYLIPEWKMDALQVVPETGAFLGTVWLTIPVLVFAFNHSPAISQFSVSLKRDHGANAARKADVILRNTSMMLVGFVMLFVFSCVLSLSPEQLAEAKAKNLPILSYLANVHDSGFVSYFGPFIAFIAIVSSFFGHYMGATEGMKGIIVKQLRSSKKQVSEDKLNKFILVFMFATIWGVAIKNPSILGMIEALGGPVIAAILYLMPMYAVYKVPALKAYRHRISNVFVVIAGLLAMTAILFGLLS

SEQ ID NO: 63739 - DNA, 1281 bp, Lactobacillus plantarum WCFS1
  CDS (1)..(1281): transl_table=11
atgacaaatatatttaagggttggagaaaaaatgatactttttggatgctgagtttgttcggaacggcgattggggccggcgtgctattcttaccgattggagttggcacggcaggtattcttggtatcatcatgatacttattttggctttgccaaccacattttttgctcacaggggcctgagtaggtttgtcttgtcggctaaaaatgatggtgatgacattactgatgttgttgaacaacattttggctttaagattggattgctttttaccattatttatttcttctccatttatccaatcttattagtttattctgtttctattacgaatactgtatcgaaatttattaccgaccaaatgcacatgcaaacaccacctcgttggctgttgtcgctagtacttgttgggattctcattggaattgctcgctttggtacctctttgattaccaaagttatgagtggcctggcctttccatttattattgtaatcgttctgttttccttttatcttattccgcattggaacggcgcaatcctctcaacattttccagttctgtatctgggggacatttggttggcactttaggaaacttgtggttacttattcctgttatgatcttttcgtttaaccattctccgatcatctcttcattttccgttgccgaacgtaaagaatatagtggggaaggtaaggacaaagtcgataaaaagatttcgacaattctattgtcggccgaaacgttgatggtcattgtcgcaatgttctttgttattagttgtacattggcgttgactccagaccaaatccttgaagctaaaaatgaaaatgtttcaatccttgattacgttgcgactgctttcaataatccaattattaaatatgtttctcccgtaattgcttttattgcaatcgccaagtcctttttaggacattatctaggaacgagtgaaggcttacgtgggattattcgtaagatggaagaaaaatctaacaagacgctttcaagtcgaactgtttcgacaattgttgatcttgttctgctactaagtgcctggatagttgcctgggtcaatccttccattatgggaatgattgaaaccatcattggaccaatcattgcgtttatcttgttcttgatgccaatgtatgccattcataaaagtcctaagttacagcaatatgccggcaaacacagcaatgtctttgttgtggtaattggattaatcgcagttagtggtatcctgttcaatatcatcaaattgtttatttag

SEQ ID NO: 63740 - protein, 426 aa, Lactobacillus plantarum WCFS1
MTNIFKGWRKNDTFWMLSLFGTAIGAGVLFLPIGVGTAGILGIIMILILALPTTFFAHRGLSRFVLSAKNDGDDITDVVEQHFGFKIGLLFTIIYFFSIYPILLVYSVSITNTVSKFITDQMHMQTPPRWLLSLVLVGILIGIARFGTSLITKVMSGLAFPFIIVIVLFSFYLIPHWNGAILSTFSSSVSGGHLVGTLGNLWLLIPVMIFSFNHSPIISSFSVAERKEYSGEGKDKVDKKISTILLSAETLMVIVAMFFVISCTLALTPDQILEAKNENVSILDYVATAFNNPIIKYVSPVIAFIAIAKSFLGHYLGTSEGLRGIIRKMEEKSNKTLSSRTVSTIVDLVLLLSAWIVAWVNPSIMGMIETIIGPIIAFILFLMPMYAIHKSPKLQQYAGKHSNVFVVVIGLIAVSGILFNIIKLFI

SEQ ID NO: 63741 - DNA, 1326 bp, Vibrio parahaemolyticus RIMD 2210633
  CDS (1)..(1326): transl_table=11
atgagcgtgacagcacctacacaaaccttacctatcggtaaagagccaccgcacgtaaaagcaggcatggccctagacgagtggaaagccgcgaccaagtttgatagcacagactggggatgggtgatcatgagtatcggcatggcaatcggtgccggtattgtctttttaccagtaaaagtaggcgtattgggcctttgggtattcttggcctctgccgtgatcggctacccagcgatgtacttgttccaacgccttttcatcaacactctctcaagttcaccaaagtgccaagattacgctggcgtcatttccggttaccttggtaacaaatggggggcgttattaggtgtgctctacttcatcatgttggtgatttgggtctttgtttactcaacagccatcaacaatgactcggcatctttcctacatagttttggcatcacggaaggcttattgtctgaaaacccgctatatggtctggctttagtgtgcgcgctggtcgctattgcatctcgtggtgaaaagattttgtttaaggtcagtactggtcttgtactgattaaactttgtaccgtcgcattacttggcgtcatgatgatcgaaaaatgggatgtagcgaatgtcggttcgattccagaaacaggcgctggtttgaaagatgcaattgagctactgccgtttactctaacgtctattctctttattcaaagcttgagcccaatggtgatctcataccgctcaaaagaaaaatcgattgaggttgctcgctttaaagccatgcgcgcaatgaaaattgctttcggtatcttgtttgtgacggtcttcttctatgcgatttcctttacgcttgcgatgtcacatgaacaagcggttaaagcagcagaagagaacatctctgctcttgcgatggttgcgcaaggtatggacggcacgacgctaaaactaatgagtttgatgctgaatattttctcagtaatgactgcgttttttggtgtgtacttgggtttccgcgattcttgccaaggtctagcgatgctggctctaaaaaaggtcatgcctgaagagaagatcaataaagacttggtcaccaaaggaatcattctctttgcgattctcatggcgtggggtgcaattgtattgaatctaccagttctgagcttcacatcagtatgtagccctatctttggtttgattggctgtttgattccagcttaccttgtctatcaagtgccttctttacacaaatacaaaggcgcgtcgctttacttgattattgctactggtattttgctgtgcgtatcgcctttcgtcgcatttagttaa

SEQ ID NO: 63742 - protein, 441 aa, Vibrio parahaemolyticus RIMD 2210633
MSVTAPTQTLPIGKEPPHVKAGMALDEWKAATKFDSTDWGWVIMSIGMAIGAGIVFLPVKVGVLGLWVFLASAVIGYPAMYLFQRLFINTLSSSPKCQDYAGVISGYLGNKWGALLGVLYFIMLVIWVFVYSTAINNDSASFLHSFGITEGLLSENPLYGLALVCALVAIASRGEKILFKVSTGLVLIKLCTVALLGVMMIEKWDVANVGSIPETGAGLKDAIELLPFTLTSILFIQSLSPMVISYRSKEKSIEVARFKAMRAMKIAFGILFVTVFFYAISFTLAMSHEQAVKAAEENISALAMVAQGMDGTTLKLMSLMLNIFSVMTAFFGVYLGFRDSCQGLAMLALKKVMPEEKINKDLVTKGIILFAILMAWGAIVLNLPVLSFTSVCSPIFGLIGCLIPAYLVYQVPSLHKYKGASLYLIIATGILLCVSPFVAFS

SEQ ID NO: 63743 - DNA, 1257 bp, Vibrio parahaemolyticus RIMD 2210633
  CDS (1)..(1257): transl_table=11
gtgaaagaatctcgaaatacgttaaattctagtgaattaaacacaacaacctcttggtcaaaacatgacacacattgggtacttagcctattcgggaccgccgttggtgccggtattttgtttctgccaatcaacttgggcattggtggattttggccactagtcgcaatggcgtttttggcatttccaatgacttacctcgcccatcgcggtttagcgcgctttgtattgtcttctaagatcaaaaatgccgactttaccgatgtggttgaagaacactttggcgcaaaagcgggacgttcaatctctctgctttatttcctatcgatttttcctatcctgttaatttacggcgtgggcatcaccaatactgtagacagctttatggtgaaccaagcgggaatggaagccttaccacgcgagctactttcgggcgtattagtgttcgctttgattgccattatgatggcgggcgaaaaagtgatgctgcgcgcgtttgccgttatggtgtacccacttgttgcgattctagctttcctctcattctacttaatgccgaactggacaatgcccgtgcttgatacaccggacatgggtgcgtttgcgagcacaatgtggttagccgttcctgttgtgattttctcgtttagccatgcagcagcgatctctagctttgccaatgttcagcgccgacactacggcgatgatgccgatgcaaaagccgaactgattttacgttgcacgagcatcatgcttatcgcattcgtactattgtttgttttctcgtgcgtattagcactttcgccagagcaacttgcacaggcaaaagcgcaaaacgtatccgtactctcttaccttgcaaacgcaacggataacccattcatcgcaacacttggtcctttggtggcgtttgtcgcgatcacttcttctttccttggtcatttcttaggcgcacgtgaaagcttgaacggcttaatcacaaagcactcaaatttgtctgaaacacgtgttgatcgtattagcgtagtggttcttttcttgtcaatttgggctgcagcaatcatgaacccaagtattttaggcatgatggaagcgttatctgggccagttatcgcaatgatcttgttcattatgccgatgttggcggtacataagattgagtcgatgaagcagtatcgtggaaagctctctacctattttgttctgatcacaggtattgttgcggtaagtgctttggtttttagcttactcagctaa

SEQ ID NO: 63744 - protein, 418 aa, Vibrio parahaemolyticus RIMD 2210633
MKESRNTLNSSELNTTTSWSKHDTHWVLSLFGTAVGAGILFLPINLGIGGFWPLVAMAFLAFPMTYLAHRGLARFVLSSKIKNADFTDVVEEHFGAKAGRSISLLYFLSIFPILLIYGVGITNTVDSFMVNQAGMEALPRELLSGVLVFALIAIMMAGEKVMLRAFAVMVYPLVAILAFLSFYLMPNWTMPVLDTPDMGAFASTMWLAVPVVIFSFSHAAAISSFANVQRRHYGDDADAKAELILRCTSIMLIAFVLLFVFSCVLALSPEQLAQAKAQNVSVLSYLANATDNPFIATLGPLVAFVAITSSFLGHFLGARESLNGLITKHSNLSETRVDRISVVVLFLSIWAAAIMNPSILGMMEALSGPVIAMILFIMPMLAVHKIESMKQYRGKLSTYFVLITGIVAVSALVFSLLS

SEQ ID NO: 63745 - DNA, 1230 bp, Salmonella enterica subsp. enterica serovar Typhi Ty2
  CDS (1)..(1230): transl_table=11
atgtctaaaatttggtcaaaagatgagactctctggagttttgcattatacggaacggctgtaggcgcaggcactcttttccttcccatccagttgggatcggcaggcgcaatcgtgctatttattaccgcgctggtcgcctggcctctaacatactggccgcataaggcgctgtgtcagtttattctttcctcaaagacttctgcaggtgagggaattactggcgccgttactcattattacggcaagaaaatcggcagtattattaccacgctttatttcattgcgttttttgtcgtggtattaatttatgctgtggcgattaccaattccctgacagagcaattagcgaagcatattcagatagatattcgcatccggatggcagttagcttcggcgtagtacttatcctgaatatgattttcttaatgggaagacatgccactcttcgcgtaatgggctttttagtctttccacttatcgcttacttcttgttcctttcgctctacttaaccggaagctggcaaccctcgttactgaccgggcagatgtctttggatagtcacacgttgcaccaggtatggatttctattccggtgatggtttttgcttttagccatacgcccattatttcgacgtttgccatcgacagacgggaaaattttggcgatcaggccatggataaatgcaaaaagatcatgaaggtcgcctacctgattatctgcctgagtgtgctgttctttgtctttagctgcctgctctccattccgccgtcatacattgaagacgcgcgcaacgaaggcgttaccatcctttccgcgctctcgatgatgcccaatgcgccggcctggctctctatttccggtattatcgttgccgtcgtggccatgtcgaaatctttcctcggcacctatttcggcgtcatcgagggcgcaaccgaaatggtaagaaccaccctacagcaggttggcgtgaaaaaaagccgggcgttcaatcgcgcgctgtctatcatgctggtttccgggattacgtttattatttgctgtattaacccgaatgccatctctatgatttatgccattagcggcccgctcattgcgatgattctgtttattatgcccacgttgtcaacgtacctgataccggcattgaaaccctaccgttcaataggtaatttcattacgttggtcgtcggtttactttgcgtatcggtgatgtttttcggctaa

SEQ ID NO: 63746 - protein, 409 aa, Salmonella enterica subsp. enterica serovar Typhi Ty2
MSKIWSKDETLWSFALYGTAVGAGTLFLPIQLGSAGAIVLFITALVAWPLTYWPHKALCQFILSSKTSAGEGITGAVTHYYGKKIGSIITTLYFIAFFVVVLIYAVAITNSLTEQLAKHIQIDIRIRMAVSFGVVLILNMIFLMGRHATLRVMGFLVFPLIAYFLFLSLYLTGSWQPSLLTGQMSLDSHTLHQVWISIPVMVFAFSHTPIISTFAIDRRENFGDQAMDKCKKIMKVAYLIICLSVLFFVFSCLLSIPPSYIEDARNEGVTILSALSMMPNAPAWLSISGIIVAVVAMSKSFLGTYFGVIEGATEMVRTTLQQVGVKKSRAFNRALSIMLVSGITFIICCINPNAISMIYAISGPLIAMILFIMPTLSTYLIPALKPYRSIGNFITLVVGLLCVSVMFFG

SEQ ID NO: 63747 - DNA, 1320 bp, Bacillus cereus ATCC 14579
  CDS (1)..(1320): transl_table=11
atgaatgggaatactgctaaaaaaatagaattgcaatctgaaaatactgtgattacaaacgagaaatatttggatcctaaaaagtggcataagcaagatactacgtgggcattgagcctttttgggacagcaattggagcaggagtactctttttaccaattaatgcaggttcaggtggtttattatcattattactcattacattacttgcctatccagttatgtattactcacatagggcgcttgctaaaatgatatatgcttccaattctgccgatgagggaattacggggacaataagagagtatttcggaaatacagcgagtattatttttaacatcgtatacttcgtctcaatttatacaattgtcttgatgtattcagttgcacttacaaatactgcaagtagttttattgtgaatcaattacatatgaaagagccctcaagagccattttatcgcttgtcttagtactgggtcttatcgctatactaaattttggtcaagatatcactgtaaaaattatgagcttgctagtataccctttcatagcttctctactatttatcgcaatatccctaattcctcagtggaacacatcaatgcttagtttttcagatgtctctactgcttcaaccggaacaggatatttgggaacgatatggatgatactacctatcatagtgttttcatttaaccattctccaatgatttcgtcttttgtgataaaacaaagatctacgtatgggatagaagcaactgatgctaaatgtgctcaaatacaaaagatttgttatatcatgacgttcgttgttgttatgttcttcgtttggagcagcgcactgagtttgactccagatgatttaaaagtggcaaaagagcagaacttatcaatcctatcctatctcgctaatgaacttaattcgccagtaattacgattgcagctcctattattgcttttatggctataacaaagtctttccttggtcattatataggatcatatgaagtaatgcgtgatatgattatcaaatttggtaaaacacgtggaaaagatatagaagaaaaaacagttaagacagtaattcttacttttgtcgtattaacatgctggtatgttgcttatgcaaatccaagtattcttgggctcattgacgctctaagcggtccattagttgctgctatcttatgtctattaccaatgtatgcgatccgtaaagtaccggtattagctaaatatagaggtaaaatgagcaatgtatttgttattattgtaggagtacttacaatcttagcaagtattaaatctttattctaa

SEQ ID NO: 63748 - protein, 439 aa, Bacillus cereus ATCC 14579
MNGNTAKKIELQSENTVITNEKYLDPKKWHKQDTTWALSLFGTAIGAGVLFLPINAGSGGLLSLLLITLLAYPVMYYSHRALAKMIYASNSADEGITGTIREYFGNTASIIFNIVYFVSIYTIVLMYSVALTNTASSFIVNQLHMKEPSRAILSLVLVLGLIAILNFGQDITVKIMSLLVYPFIASLLFIAISLIPQWNTSMLSFSDVSTASTGTGYLGTIWMILPIIVFSFNHSPMISSFVIKQRSTYGIEATDAKCAQIQKICYIMTFVVVMFFVWSSALSLTPDDLKVAKEQNLSILSYLANELNSPVITIAAPIIAFMAITKSFLGHYIGSYEVMRDMIIKFGKTRGKDIEEKTVKTVILTFVVLTCWYVAYANPSILGLIDALSGPLVAAILCLLPMYAIRKVPVLAKYRGKMSNVFVIIVGVLTILASIKSLF

SEQ ID NO: 63749 - DNA, 1380 bp, Helicobacter hepaticus ATCC 51449
  CDS (1)..(1380): transl_table=11
atgaacaaatggaataactttgatacaagctggataatttctctttttggaacagctgtgggtgctgggattttatatctgccaattaaagcaggtggagggggaatctggcctgtaatagcaatgtgttttattatatttcctatggtttatcttagccatcgcgcacttagtcgttttgtatgtcaagcaaatggtaatgataaagatattacatacgccgctgaagaatattttggtcgcaatgtaagtatatttatctcaattctctatttttttgcaatttttcctatttgtctcgcatattgcgtaggcattacaaacacatttgaaagttttatttatcatcagattctcccacttgtcaatgaaaatcacccggcagttgctccacttgggactttagctggatttatacaagacatttattacgacccatatagttttctccaccaaagcgaatctggagcactccttaaacttaaatctgaaaattatgctactttgcacccattttggcgagctgggcttgtttttatcttggtaagtgcttttatgcttattatgctttttagtgaaaaacttatcataaaagtgtgccaatggcttgtatatcctctttgtgctattttatttatattttcactctatcttattccccaatggaatcttgaaagcattacatttgtacccgatatagaagattttttgataattgtatggcttacacttcccgtgcttgtattttcttttaatcactctcctgctatttctacctttgcgctaagtgctaagcgcgaatatggagcagatgctatcataaaatcagattctatacttttgcgcacttcaattatgcttcttgtctttgtaatgttttttgtcatctcttgtgtgctctctcttacaccacaagagcttatagaagctagagcacaaaatatccccgtgctctcatattttgccaataaacttgataatccattgatttcctatggtggtcctttgattgcatttttggcaatttctagttcattttttgggcattattttggtgcacgtgagggtgcatatggcattgtaaggaaatgttgcaaaattgcgggaaacaaagagccaaatctcaaacttattgcagcaatatgcacatttgtaatgtatgttattatgcttattactgcctatatcaatccaagcgttttagggtttattgaggatttaggaggtccgattattgcagctatcctttttcttatgcctattattgctatttatagcgtatctaagatgaaacaattcaaaaacccagctcttgatgcttttgtctttataacagggcttttaacaatatttactattacttataagctcatattgtaa

SEQ ID NO: 63750 - protein, 459 aa, Helicobacter hepaticus ATCC 51449
MNKWNNFDTSWIISLFGTAVGAGILYLPIKAGGGGIWPVIAMCFIIFPMVYLSHRALSRFVCQANGNDKDITYAAEEYFGRNVSIFISILYFFAIFPICLAYCVGITNTFESFIYHQILPLVNENHPAVAPLGTLAGFIQDIYYDPYSFLHQSESGALLKLKSENYATLHPFWRAGLVFILVSAFMLIMLFSEKLIIKVCQWLVYPLCAILFIFSLYLIPQWNLESITFVPDIEDFLIIVWLTLPVLVFSFNHSPAISTFALSAKREYGADAIIKSDSILLRTSIMLLVFVMFFVISCVLSLTPQELIEARAQNIPVLSYFANKLDNPLISYGGPLIAFLAISSSFFGHYFGAREGAYGIVRKCCKIAGNKEPNLKLIAAICTFVMYVIMLITAYINPSVLGFIEDLGGPIIAAILFLMPIIAIYSVSKMKQFKNPALDAFVFITGLLTIFTITYKLIL

SEQ ID NO: 63751 - DNA, 1290 bp, Wigglesworthia glossinidia endosymbiont of Glossina brevipalpis
  CDS (1)..(1290): transl_table=11
atgttttataaaaaacataaaaatatatgtaatatatgtaataataattacaaaaaatcaaatttaatatggatattaagcttatatggtacagcaataggggctggagttttgtttcttccaattaatattggaattaatggcttattttctttattgattattatgataatcgcttttccaatggcatttttttctcatagaggattaacaaggtttgtattgtctagcaaaaaaccaaataaaaatttatttaatgttatacatgaaaactttaataaacaaacatcttttatatttattttattttattttttttctatttatccaatactattaatttatagtactgctataaccaatacagtaatgtcttttattattcatcaattaaatattgcggaacaatcacgtgtttttgtgtcttttatacttatttctgttttaatgggaattattattttaggagaaaaagtaataattaagttcatgagttttttagtaattccatttatactttctttaatttttttttctttttatataattcaattttggaattattcattattttatgaaataaaaaatatttttaatttagatataaatagtttattaaaaattatttggtatattatacctgtaactgtattttcatttaatcattctcctataatatcttcttttgcagttttcaaaaaaagagaatgtagtaattgttgcgaaaaaacatgctctaaaatactattttatagtaatttattaatgatttttacagtaattttctttgtatttagttgcatacttagtgttcctagagaagctatgcaagaagcaaaagataaaaatttatctgtattatcttatttttcaatatattttgaagataatttaatgaattttttaggccctatcatagctattattgctataataaaatctttttttggtcattatttaggagctaaagaaagcatcaataaaatattaatgacgacttttcctaaattaaaaaataaaaaaagaacatatttaacaaattttacaactaactctttaatatttactagttcttggattattgcaatatttaatcctagtattttaaatataatagaagcaataattggacctattatttctataattttatttttaattcctgcatattcaatatataaagttcctaatatgaaacgttataaaaaagaaaaatttactaatttatttttatttgttattggaattttttcatttttagctatgatgcataaattgattatattttaa

SEQ ID NO: 63752 - protein, 429 aa, Wigglesworthia glossinidia endosymbiont of Glossina brevipalpis
MFYKKHKNICNICNNNYKKSNLIWILSLYGTAIGAGVLFLPINIGINGLFSLLIIMIIAFPMAFFSHRGLTRFVLSSKKPNKNLFNVIHENFNKQTSFIFILFYFFSIYPILLIYSTAITNTVMSFIIHQLNIAEQSRVFVSFILISVLMGIIILGEKVIIKFMSFLVIPFILSLIFFSFYIIQFWNYSLFYEIKNIFNLDINSLLKIIWYIIPVTVFSFNHSPIISSFAVFKKRECSNCCEKTCSKILFYSNLLMIFTVIFFVFSCILSVPREAMQEAKDKNLSVLSYFSIYFEDNLMNFLGPIIAIIAIIKSFFGHYLGAKESINKILMTTFPKLKNKKRTYLTNFTTNSLIFTSSWIIAIFNPSILNIIEAIIGPIISIILFLIPAYSIYKVPNMKRYKKEKFTNLFLFVIGIFSFLAMMHKLIIF

SEQ ID NO: 63753 - DNA, 1299 bp, Chromobacterium violaceum ATCC 12472
  CDS (1)..(1299): transl_table=11
atgtctcaagcaatcgcctccaccgcttcccgctccggttcatccggctggtccaagcacgacaccacctggatgctcggcctgtacggcaccgccatcggcgccggcgtcctgttcctcccgatcaacgccggcatcggcggcctgtggccgctgatgctgatggccatcctggccctgccgctgaccttcttcgcccaccgcggcctgacccgcttcgtgctgtccggcagcaaggaaggcgcggacatcaccgaggtggtggaagagcacttcggtctcggcgccggcaagatcatcaccctgctgtacttcttcgccatctacccgatcctgctgatgtacagcgtggccatcaccaacacggtgctgtccttcctgaacaaccagctgcacatcgaagtgggcaccggcatcgccacccgcgccgtgttctcgctggcgctgatcctgggcctgatgtccatcgtgcgcctgggcggccagatgatcgtcaaggcgatgagcatcctggtgtacccgttcgtggtggtgctgatgctgctggcgctgtacctgatcccgcaatggagcgataccgccatccgccacgccggcagcctgggcgacgcgctgtccagcggcgccttctacaagacgctgtggctggccatcccggtgatggtgttctcgttcaaccactcgccgatcatctcgtccttctccgtcgaccagcgcaagcttcacggcgatgacgccgagccggcctccagccgcgtgctgattcgcgcccacaccatgatggtgctgaccgtgatgttcttcgtgttcagctgcgtgttcagcctgagcccggccgacctggccgccgccaaggcccagaacatctccatcctgtcctacctggccaaccacttccaaaacccggtgatggaatgggttgccccgatcatcgccatggtcgccatcagcaagtccttcctgggccactacctgggcgccaaggaaggcttcaacggcctggtgatcaagcagctgcgccagaacggcaagagcatcgaatcgtccaagctggaccgctacaccgccatcttcatgatcgtcacctgctggatcatcgccaccatcaacccgtccatcctgggcatgatcgaaaccctgggcggcccggtgatcgcgatgctgctgttcctgatgccgatgtacgcgatccagaaagtgccggcgatgaagaagtactccggcgccgccagcaacatcttcgtgacgctgatcggcctgatcgccatctccgccatcttctacgatctgatcgcctga

SEQ ID NO: 63754 - protein, 432 aa, Chromobacterium violaceum ATCC 12472
MSQAIASTASRSGSSGWSKHDTTWMLGLYGTAIGAGVLFLPINAGIGGLWPLMLMAILALPLTFFAHRGLTRFVLSGSKEGADITEVVEEHFGLGAGKIITLLYFFAIYPILLMYSVAITNTVLSFLNNQLHIEVGTGIATRAVFSLALILGLMSIVRLGGQMIVKAMSILVYPFVVVLMLLALYLIPQWSDTAIRHAGSLGDALSSGAFYKTLWLAIPVMVFSFNHSPIISSFSVDQRKLHGDDAEPASSRVLIRAHTMMVLTVMFFVFSCVFSLSPADLAAAKAQNISILSYLANHFQNPVMEWVAPIIAMVAISKSFLGHYLGAKEGFNGLVIKQLRQNGKSIESSKLDRYTAIFMIVTCWIIATINPSILGMIETLGGPVIAMLLFLMPMYAIQKVPAMKKYSGAASNIFVTLIGLIAISAIFYDLIA

SEQ ID NO: 63755 - DNA, 1299 bp, Photorhabdus luminescens subsp. laumondii TTO1
  CDS (1)..(1299): transl_table=11
atggatatgactcaaacaggtacgatcgcatcgcaggcgaccagcccaagcgattataaaacctggcgtaaatcagatacagtatggatgcttggcttatacggtactgcgattggtgccggtgtattattcttacccatcaatgctggtattggtggcctactacctcttttggtaatggcgctactggctttcccaatgactttcttcgcccaccgcgggatgtgtcgtttcgttctatcaggtaaaaaccctggcgaagatattaccgaagtcgtagaagaacactttggcaacctggcaggtaaacttattactctgctctacttcttcgctatctacccgattctcttagtttacagcgttgctattaccaacaccgtagacagctttattgttcaccaattacacctgccatcacctcctcgtgctctgctggctctgatcctaattactggtgtaatgaccatcatccgttttggtgaacaggctattgttaaggcaatgagcgtgctggtattcccatttgttgccgttttgatgctactggcgttttatctgatccctaactggaataccgcaatcttcgaaaacatcagcgtttctgcatcgagtgcaagtcatgggctgctcattactctatggctagcgatcccagtaatggtgttctccttcaaccactcgccaattatctcggcatttgcggtggcaaaacgtggagaatatggtgagcatgctgagaaaaaatgctcccgcattctagcttacgcccatatcatgatggttgtaaccgtgatgttcttcgtattcagctgcgtattaagcctgtctccagaaaatctggcagaagccaaagcacaaaatatttctattctgtcttacctggctaaccactttaatacaccagtggttgcctacatcgctccgtttattgcattcatagcaattaccaaatctttccttggccattatctgggtgcacgtgaaggttttaatggtattgtggttaagacattgcgtgaccaaggtaaaactattgagcctaaaaagctgaatcgtatcactaccattttcatgttagtaacgacttggattgtcgctactctgaacccaagtattttggaaatgatcgaaagattaggtggtcctattatcgcaatgttgttgttcattatgccaatgtatgcaatcagcaaagttcctgcaatgcgcaaatatagcggcaagctgagtaatctgtttgtcgtctttatgggattagttgctatctctgctgtcctctactcactgtttgcataa

SEQ ID NO: 63756 - protein, 432 aa, Photorhabdus luminescens subsp. laumondii TTO1
MDMTQTGTIASQATSPSDYKTWRKSDTVWMLGLYGTAIGAGVLFLPINAGIGGLLPLLVMALLAFPMTFFAHRGMCRFVLSGKNPGEDITEVVEEHFGNLAGKLITLLYFFAIYPILLVYSVAITNTVDSFIVHQLHLPSPPRALLALILITGVMTIIRFGEQAIVKAMSVLVFPFVAVLMLLAFYLIPNWNTAIFENISVSASSASHGLLITLWLAIPVMVFSFNHSPIISAFAVAKRGEYGEHAEKKCSRILAYAHIMMVVTVMFFVFSCVLSLSPENLAEAKAQNISILSYLANHFNTPVVAYIAPFIAFIAITKSFLGHYLGAREGFNGIVVKTLRDQGKTIEPKKLNRITTIFMLVTTWIVATLNPSILEMIERLGGPIIAMLLFIMPMYAISKVPAMRKYSGKLSNLFVVFMGLVAISAVLYSLFA

SEQ ID NO: 63757 - DNA, 1254 bp, Vibrio vulnificus YJ016
  CDS (1)..(1254): transl_table=11
atgaaaacaacttcaactacggctcctgccgtacaatcttctagtaagtttacttacaaagatttcacttggtgtctgtcccttttcggtacagcggtaggtgctggtgtacttttccttccaattaaagcgggtgctggcggcttctggccattagttatgctagcgctacttgcagcaccaatgacttggttcgctcacaaatctctcgctcgtttcgttctttctgctaagaaccctgaagcggacatcactgacactgtagaagagcactttggtaagactggcgcaaaccttattacttttgcctatttcttcgctatctacccaatcgttctgatttacggtgttggtatcacaaacacagtagactctttccttgttaaccaaatgggtatggaatccattccacgtccactgctatctggcgcattgatccttgcaatgaccgctggtgtggtatttggtaaagaactgatgctaaaagcaacgtctgcaatggtttacccacttgtatttgtactgcttgcactttctttctacctgatcccagattggaacacgtcaatgatgcaagtagcacctgattggtcttctatgcctgttgtcgtatggctagccatcccgatcatcgtgttctcattcaaccacagcccaatcatctctcagttctctaaagaacagcgcctacagcatggtgacaaagcggttcagaaaaccgatgcgatcactggcggtgcagcgatgatgctaatgggctttgttatgttcttcgttttctctgttgtactgtctatgtctccagagcaactggcttctgcgaaagagcaaaacatctctgtactttcttacctagcgaacgtgcatgagtctccactgatctcttaccttggtccactggttgcgtttgcagcgatcacttctagctacttcggtcacttccttggtgcgcatgaaggtctagttggtctgatcaaatctcgctcaaacagccctatcagcaagatcgagaaagcgtcgctactgttcatcgttatcactacttggatcgtggctatcgttaacccaagtatcctaggcatgattgaaacaatgggcgcaccaatgattgcggcaatcctgttcctaatgcctgtatttgcaatgcaaaaagtgccagcgatggcgaagtacaaaacttcagcagctgtgcagattttcacagttatctgtggtcttgcttctattacttctgtaatctacggcgctctttaa

SEQ ID NO: 63758 - protein, 417 aa, Vibrio vulnificus YJ016
MKTTSTTAPAVQSSSKFTYKDFTWCLSLFGTAVGAGVLFLPIKAGAGGFWPLVMLALLAAPMTWFAHKSLARFVLSAKNPEADITDTVEEHFGKTGANLITFAYFFAIYPIVLIYGVGITNTVDSFLVNQMGMESIPRPLLSGALILAMTAGVVFGKELMLKATSAMVYPLVFVLLALSFYLIPDWNTSMMQVAPDWSSMPVVVWLAIPIIVFSFNHSPIISQFSKEQRLQHGDKAVQKTDAITGGAAMMLMGFVMFFVFSVVLSMSPEQLASAKEQNISVLSYLANVHESPLISYLGPLVAFAAITSSYFGHFLGAHEGLVGLIKSRSNSPISKIEKASLLFIVITTWIVAIVNPSILGMIETMGAPMIAAILFLMPVFAMQKVPAMAKYKTSAAVQIFTVICGLASITSVIYGAL

SEQ ID NO: 63759 - DNA, 1344 bp, Corynebacterium diphtheriae NCTC 13129
  CDS (1)..(1344): transl_table=11
gtgtctcagattgtttcccactcagcatctgctggggtccgcgatggtgtagcaccatcagaatcacctgcctcatctagcgcgccttcttggcgtaaaaccgacaccgtatggagcttgagcctcttcggcacagcaatcggtgcgggcgtattgttcctccccatcaacgccggtatcggcggaatcatccccatgctcgtcatggccgtcgttgcgtacccgatggcccactgggcacaccgaggtcttactcgtttcatcctttcagcatccaaggaagacgcagacctaacggacgtcgtcgatgagcacttcggccacaaggccggcgcatttatcaccgtcttgtacttcttgtcggtctacccgatcttgttggtctactcagttactatcaccaacaccgtgaactccttcttggaaaaccagctgggaatcaccccgctgccacgctggttgatgtcgctcatcttggtcggcggacttatcttcgtagtcagcctcggtcgcacggtgatcgtcaaggccatgtcggttttggtattccccttcatcgccatcttggttgtgctctctgtttacttgatccctaagtggaacaccgcactattccagaccttcgacctgcgcacttcagctgaggcttccggtcatagcatctgggttaccctgctgcttctcgtcccagtgatggttttctccttcaaccactcgccaatcatttcctccttcgcccaggaaaagcgtgctgagtatggtcagtgggctgactacaagaccggtcgcattcttagcgccgcccagatcttgatggtcgttgtggttatgttctttgtgttctcttgcgcattgagcttgtcgccagccgacctcgctgctgctaaagaacaaaacatcaccatcttgtcctacttggctaatcactttgataaccctgtgattcagtgggctgctcccattattgccatgattgctgtggcaaagtccttccttggccactacctcggtgctgctgaaggtttccaaggcttgattgcttcgggtgctgcttctaagggcaagactgttgatactcaaagccgtgcgctggtgctgggcactctcgccttcatgctgatctcttcgtggctggtggcatggctgaacccatccatcctcggaatgatcgagacgatgtgtggtcctacgatcgccatcctgctcttcctgatgcctatgtacgccatccataaggttccggcattggctaagtaccgtggtcgtatttcgaattacttggtcttcggcatgggcctgttggcactgtgcaccatcgtctacagcatcgtccaggctttctag

SEQ ID NO: 63760 - protein, 447 aa, Corynebacterium diphtheriae NCTC 13129
MSQIVSHSASAGVRDGVAPSESPASSSAPSWRKTDTVWSLSLFGTAIGAGVLFLPINAGIGGIIPMLVMAVVAYPMAHWAHRGLTRFILSASKEDADLTDVVDEHFGHKAGAFITVLYFLSVYPILLVYSVTITNTVNSFLENQLGITPLPRWLMSLILVGGLIFVVSLGRTVIVKAMSVLVFPFIAILVVLSVYLIPKWNTALFQTFDLRTSAEASGHSIWVTLLLLVPVMVFSFNHSPIISSFAQEKRAEYGQWADYKTGRILSAAQILMVVVVMFFVFSCALSLSPADLAAAKEQNITILSYLANHFDNPVIQWAAPIIAMIAVAKSFLGHYLGAAEGFQGLIASGAASKGKTVDTQSRALVLGTLAFMLISSWLVAWLNPSILGMIETMCGPTIAILLFLMPMYAIHKVPALAKYRGRISNYLVFGMGLLALCTIVYSIVQAF

SEQ ID NO: 63761 - DNA, 1320 bp, Bacillus thuringiensis serovar konkukian str. 97-27
  CDS (1)..(1320): transl_table=11
atgaacgggaatactgcaaagaaaatagaagttcaagctgaaaataacgcactaaaaaatgagcaatatgcagatccgaaaaagtggcataagcaggatactacatgggcactcagtctatttggaactgcaattggagcaggggtgctctttttaccgattaatgcaggttcaggtggtttattatcattactactaattacattgcttgcatatccagttatgtattactcacatagggcacttgcgaaaatgatatacgcttctaattctgctgatgaggggatcacaggtacaattagagagtatttcggaaataaagcgagtatcatttttaacatcgtatatttcggttcaatttatacaatcgtactaatgtattcggttgcgcttacaaatactgcaagtagttttatcgtgcatcaattgaacatgccagaacctccaagggctattttatcacttgtattagttcttggtcttatcgctatactgaactttggtcaagatattactgtaaaggtaatgagtatgctagtgtatcctttcatagcttctctactgtttattgcaatatctttaattccacagtggaatacgtcaatgcttagcttttcagctgtttctactgcttcaacaggaacaggctattttggaacgatattgatgattttaccaatcatcgtattctcatttaatcattcacctatgatttcatcatttgttgtgaaacagagagctacgtatggaatagaagctactgatgcgaaatgtgcgcaaatacaaaaagtttgttatattatgacattcgttgtagttatgttcttcgtttggagtagcgcactgagcctgactccagatgatttaaaaatggcaaaagagcaaaacttatcaattctttcttaccttgctaatgagcttaattcacctgtaatcacgattgcagctccaatcattgcttttgtggctattacaaagtctttccttggccattatatcggagcgtttgaagtaatgcgtgacatgattattaagtttggtaaatcacgtggaaaagtaatcgaagaaaaaacaattaagacaatcgtccttacttttgttgtattatcatgctggtttgttgcttatacaaatccaagtattcttggacttattgattctctaagtggtccattagttgcggctatcttatgtctattaccgatgtatgcgattcaaaaagtcccagtattagctaagtataaagggaaaatgagtaacgtatttgttattattgtaggtgtgcttactgttttagcaagtattaaatcattattctaa

SEQ ID NO: 63762 - protein, 439 aa, Bacillus thuringiensis serovar konkukian str. 97-27
MNGNTAKKIEVQAENNALKNEQYADPKKWHKQDTTWALSLFGTAIGAGVLFLPINAGSGGLLSLLLITLLAYPVMYYSHRALAKMIYASNSADEGITGTIREYFGNKASIIFNIVYFGSIYTIVLMYSVALTNTASSFIVHQLNMPEPPRAILSLVLVLGLIAILNFGQDITVKVMSMLVYPFIASLLFIAISLIPQWNTSMLSFSAVSTASTGTGYFGTILMILPIIVFSFNHSPMISSFVVKQRATYGIEATDAKCAQIQKVCYIMTFVVVMFFVWSSALSLTPDDLKMAKEQNLSILSYLANELNSPVITIAAPIIAFVAITKSFLGHYIGAFEVMRDMIIKFGKSRGKVIEEKTIKTIVLTFVVLSCWFVAYTNPSILGLIDSLSGPLVAAILCLLPMYAIQKVPVLAKYKGKMSNVFVIIVGVLTVLASIKSLF

SEQ ID NO: 63763 - DNA, 1290 bp, Erwinia carotovora subsp. atroseptica SCRI1043
  CDS (1)..(1290)
atgagcacaattcaagatagcagccacgtgttagaacaggcttcaggatggcgtaaaagcgacaccgtctggatgctcggcctctatggcacggccatcggtgcgggcgtgttattcttacccatcaatgctggcattggtggtttaattccgttaattatcatggcactgattgcctttccgatgacgtattattctcaccgtgcattatgccgctttgtattatccggcaagaaaggtggcgaagatattaccgaagtcgttgaagaacatttcggcgttggtgcgggtaaattaatcactttgctttattttttcgctatttatccgatcctattagtttatagcgtcgctatcaccaatacggtagatagctttattactcaccaattgcatttaccttctccgccgcgtgctgcgctgtcattaatattgatcctcgggttgatgtttattgtccgcttcggtgaagcgatgatcgttaaagcaatgagtgttctggtttacccttttgttgccgtactgatgttgctggcgctttatttaattccgaactggaatacctctgtttttgaaaacatttctctgagttccagcgtaacgggtaacggtctgttggcgacattatggctggctattccggtgatggttttctccttcaaccactcgccaatcatctcctctttcgccgttgccaaacgcaaagaatatggtgatgatgcagagaagaaatgctcacgcattctgtcttacagccacattatgatggtgttgacggtgatgttcttcgttttcagctgcgtactgagcctttctccaaccgagctgatggaagcaaaaacacaaaacatttctattctgtcctatctggcgaaccattttaatagcccggtaatcggctatctggccccagtaattgcaaccatcgcgatctctaaatccttcctgggccactatctgggcgcgggtgaaggctttaacggcatgatcgtgaaatccctgcgcagcagaggaaaaaccatctccagcaccaaactgaaccgtatcacttcgctgttcatgttgatcaccacctggattgtcgcgacgctgaacccaagcattctgggtatgatcgaaaccttgggcggcccgattatcgcgtgcctgctgttcctgatgccgatgtacgccatccagaaagtcccagcgatgaaaaaatacagcggccacattagcaacgtctttgtcaccctcatgggactgatcgctatttccgccattgtttacagcctgcgcgatctgctgtaa

SEQ ID NO: 63764 - protein, 429 aa, Erwinia carotovora subsp. atroseptica SCRI1043
MSTIQDSSHVLEQASGWRKSDTVWMLGLYGTAIGAGVLFLPINAGIGGLIPLIIMALIAFPMTYYSHRALCRFVLSGKKGGEDITEVVEEHFGVGAGKLITLLYFFAIYPILLVYSVAITNTVDSFITHQLHLPSPPRAALSLILILGLMFIVRFGEAMIVKAMSVLVYPFVAVLMLLALYLIPNWNTSVFENISLSSSVTGNGLLATLWLAIPVMVFSFNHSPIISSFAVAKRKEYGDDAEKKCSRILSYSHIMMVLTVMFFVFSCVLSLSPTELMEAKTQNISILSYLANHFNSPVIGYLAPVIATIAISKSFLGHYLGAGEGFNGMIVKSLRSRGKTISSTKLNRITSLFMLITTWIVATLNPSILGMIETLGGPIIACLLFLMPMYAIQKVPAMKKYSGHISNVFVTLMGLIAISAIVYSLRDLL

SEQ ID NO: 63765 - DNA, 1416 bp, Propionibacterium acnes KPA171202
  CDS (1)..(1416): transl_table=11
gtgccacttcccttacgtccctgctggataatcatggacacctccacgactacctgttcgatgcagggtaaggagtatgctaacatcatcaaaatccgaatctcgacgaagttgattcccatgaatacattggtcactgttgaccgacctgccagtatgaccgagcaggaatggcgaaaagccatcaaatttgacagcaccgactggggctggatcattatgagcatcggcatggctatcggtgctggtattgtatttcttccagtgaaggtcggcttagtcggattgtgggttttcctcgtctcatcggtgatcgcctatcccgcgatgtacctgttccagaggctatttattaacactttggccgaatcacccgaatgcaaggactacccaagcgtcatctcaggttatctgggaaagaactggggcttttttatcggtatcctctatttcatcatgttggtgatctgggtatttatttattcgacagccctcaccaacgattccgcctcttttctccattccttcggagtgaccaaaactgtgtggtcgcacaatccgttctatggtctggttgtcatctgcatcatggtggcgatcgcctcacgagcggaaaagatccttttccgaatctcgacggtgatggtactcacgaaactgtctgtcgtgactttcctcggcctcgcgatcatcggcagctggaacctggcgaacgtcggggccttcccgagcttgggctacctggtgaaacagaccatcatcatgctcccattcacattgacctcgatactcttcatccagtcactcagcccgatggtcatctcctaccgggcccactacaggtcaatcgaagtagcacgtcacaaggccttgcgctccatgaacatcgcgttcagcgtactgttcatcacagtctttttctatgccatctccttcaacttaaccatgggacatgacgtagcggtgaaagcctacaatcaaaacatctcgaccttggcgatggtggcccagggcatgggaggcacgaccgtcaagattttctccttgattctcaacatcttcgccgtaatgacggcgtacttcggggtgttcctcggcttccgtgaggcatgccaaggaattgcgatgaacgtgctacgccgcctcatccccgaggagagaatcaacaagaaaattgtttcatggtccatcctcgtctttgcaatcctagtgtcgtggggtgctatcctcctcaatgcccctgtgctgagtttcacctccatctgcagtcccatcttcggcatgatcggttgcctcatcccagcgtatcttgtatttaaagttccctcacttcacaaattccgacgcccgagtctaattctcattatcgcaacaggaattcttctagttgtctcgccattcctggctttcagctaa

SEQ ID NO: 63766 - protein, 471 aa, Propionibacterium acnes KPA171202
MPLPLRPCWIIMDTSTTTCSMQGKEYANIIKIRISTKLIPMNTLVTVDRPASMTEQEWRKAIKFDSTDWGWIIMSIGMAIGAGIVFLPVKVGLVGLWVFLVSSVIAYPAMYLFQRLFINTLAESPECKDYPSVISGYLGKNWGFFIGILYFIMLVIWVFIYSTALTNDSASFLHSFGVTKTVWSHNPFYGLVVICIMVAIASRAEKILFRISTVMVLTKLSVVTFLGLAIIGSWNLANVGAFPSLGYLVKQTIIMLPFTLTSILFIQSLSPMVISYRAHYRSIEVARHKALRSMNIAFSVLFITVFFYAISFNLTMGHDVAVKAYNQNISTLAMVAQGMGGTTVKIFSLILNIFAVMTAYFGVFLGFREACQGIAMNVLRRLIPEERINKKIVSWSILVFAILVSWGAILLNAPVLSFTSICSPIFGMIGCLIPAYLVFKVPSLHKFRRPSLILIIATGILLVVSPFLAFS

SEQ ID NO: 63767 - DNA, 1302 bp, Yersinia pseudotuberculosis IP 32953
  CDS (1)..(1302): transl_table=11
atggacactacgcaaacaagcactcttgcctcggcaagaaaaatctcatcaagtacatggcgcaaaagtgacaccatgtggatgttgggtctgtacggtacagcgattggcgcaggtgtactctttttgcccatcaacgccggtattggtggcctgctaccactgattgttatggctatcattgctttcccaatgacctactacgctcaccgtggcctgtgccgattcgtgttatccggtaaaaatccaggtgaagatattactgaggtggttgaagaacatttcggtgtaggcgcaggtaaactgattaccctgctttacttcttcgctatctaccccattctcttggtgtacagcgtagcaattaccaataccgtggatagtttcattacacatcagatgcacctgccatcaccaccacgcgccattttgtccctgattctgattgtgggcctgatggctatcgtgcgctttggtgaacagaccatcgtcaaagccatgagcatcttggtattcccgtttgttgccgtattgatgatgttggcgatatacctgatcccaaactggtcaggtgcaatattcgaaaacgtatccatggacggtaacggcacaggtagcggcctgtggatgacaatgtggctaatcattcccgtcatggtgttctctttcaaccactcaccgatcatctcagcctttgctgtagcaaagcgcgaagagtacggggtggatgcagagaaaaaatgttcacgcattttgagctttgcccacatcatgatggttatcaccgtcatgttcttcgtcttcagttgcgtactgagcctgtctcctgcggatctgatggatgcaaaaaaccaaaacatctccattttgtcttatctggcaaaccattttaatacgccagtaattgcctatatggcaccggttattgcctttattgccatcactaaatcattcctgggccactatctgggcgcccgtgaaggttttaacggtatggtcattaagtctctgcgtagtagaggcaaaaccattgagcagaacaaactgaaccgcattactgcgttgttcatgttagtcaccacctgggctgtcgcgaccttaaacccaagtatcttggggatgatcgaaacattgggcggccctatcatcgcgatgctcctgttcctgatgccgatgtatgccattcataaagtcccggccatgcgtaaatacagcggccagatcagtaacgtattcgtggtactcatgggcttgatcgccatctctgggatcttattcaacttaagcaacttgtttaattag

SEQ ID NO: 63768 - protein, 433 aa, Yersinia pseudotuberculosis IP 32953
MDTTQTSTLASARKISSSTWRKSDTMWMLGLYGTAIGAGVLFLPINAGIGGLLPLIVMAIIAFPMTYYAHRGLCRFVLSGKNPGEDITEVVEEHFGVGAGKLITLLYFFAIYPILLVYSVAITNTVDSFITHQMHLPSPPRAILSLILIVGLMAIVRFGEQTIVKAMSILVFPFVAVLMMLAIYLIPNWSGAIFENVSMDGNGTGSGLWMTMWLIIPVMVFSFNHSPIISAFAVAKREEYGVDAEKKCSRILSFAHIMMVITVMFFVFSCVLSLSPADLMDAKNQNISILSYLANHFNTPVIAYMAPVIAFIAITKSFLGHYLGAREGFNGMVIKSLRSRGKTIEQNKLNRITALFMLVTTWAVATLNPSILGMIETLGGPIIAMLLFLMPMYAIHKVPAMRKYSGQISNVFVVLMGLIAISGILFNLSNLFN

SEQ ID NO: 63769 - DNA, 1296 bp, Legionella pneumophila str. Lens
  CDS (1)..(1296): transl_table=11
atgtcatcaaatgaatctgcagctatagtatctccgatagtcaaccaaaaactatcgcaatggaaaaaacaagatacgatttggatgttaagcctctatggcacagcaattggtgccggaactcttttccttcctatagatgctggtcttaatggcattttgcctttaatcattatgacaattctggccttccccatgacttattattctcatagggctttatgtcgttttgtcctttcaggctcgtcctcacacaatgacatcactgatgttgtagaagaacactttggctcatttgcgggtaatatgctgactatcctgtacttttttgcgatttatccaattttgcttatgtacagtgtcgcaataacaaataccacggaaagtttcctgattaatcaaatgggaattacccctccgccacgagctcttttagcaatcatattaattcttgggttaatgggtatcgtgcgtttaggacaagaaattattgtcaaatcgatgtcggtattggtatatccttttgccactattctatttctgctttcgctttatttaattccaaattggaataacgctatttttatccaaagcaattccttacatgccaatggagggcatggactattaatgactttatggttaattattccagtgatggtgttctcctttaaccattctcctatcatttcatcttttgctgtgaatcaaaagcagcaatatggtagccaagctgacgagaaaagctcattaattatgaaatacagccacttgatgatggttttctctgtgatgttttttgtatttagctgtgtgttgagcctgtcacctcaagatcttttgcaagcaaggcaacaaaatatttccattttgtcttatctggcgaatcattttaatacccctattatggcctatattgcaccggttattgcattcatagccatttcaaaatcttttctgggacattatttaggtgccaaggaaggtttaagtggaattattgttaagtcattaaaatcaacaacaggcaaaacaattaataagaattccctgcacagaatcattgaaatctttatgattctgacttgttgggttgttgctacaattaatcctaatattttaaaaatgattgaaacattaggaggccccatcatagctgtcttattatttatcatgccaatgtatgccattgctaaagtgccagccatgaaaaaatacaacaaccaaatcagtaacgtatttgttaccgtcatgggcattatttctatctcagccatcatttatggcttaatttaa

SEQ ID NO: 63770 - protein, 431 aa, Legionella pneumophila str. Lens
MSSNESAAIVSPIVNQKLSQWKKQDTIWMLSLYGTAIGAGTLFLPIDAGLNGILPLIIMTILAFPMTYYSHRALCRFVLSGSSSHNDITDVVEEHFGSFAGNMLTILYFFAIYPILLMYSVAITNTTESFLINQMGITPPPRALLAIILILGLMGIVRLGQEIIVKSMSVLVYPFATILFLLSLYLIPNWNNAIFIQSNSLHANGGHGLLMTLWLIIPVMVFSFNHSPIISSFAVNQKQQYGSQADEKSSLIMKYSHLMMVFSVMFFVFSCVLSLSPQDLLQARQQNISILSYLANHFNTPIMAYIAPVIAFIAISKSFLGHYLGAKEGLSGIIVKSLKSTTGKTINKNSLHRIIEIFMILTCWVVATINPNILKMIETLGGPIIAVLLFIMPMYAIAKVPAMKKYNNQISNVFVTVMGIISISAIIYGLI

SEQ ID NO: 63771 - DNA, 1254 bp, Photobacterium profundum SS9
  CDS (1)..(1254): transl_table=11
atgcaaaccacttcgaatacagcagcgactaccgcagcaaaagcaagttggacgtataaagatttcacttgggcactatcactatttggcacagcagtaggcgctggcgttcttttccttccaattaaagcgggcgctggtggcttttggcctctagttattctggctcttattgcactgccaatgacttggtttgcacataaaggtcttgctcgtttcgttctttcagcaaaaaaccctgaagcagatatcactgatactgttgaagagcacttcggtaagtctggcgctaaaatcatcactttagcttacttcttcgctatctacccgatagttctaatttatggtgtaggtattacaaacactgtagattcattccttgttaaccaaatgggtatggattcaattccacgttggttgctatctggcggtctaatcatcgcaatgacagctggtgttgtgttcggtaaagaactgatgcttaaagcaacatctgcaatggtttaccctctcgtatttattctacttgcactatctatttacttaatacctgagtggaatacatcaatggttactgttagccctgattggagcactatgccttcagttatttggctagcaattccaattattgttttctctttcaaccacagcccaatcatcagccagttctctaaagaacagcgtcgcgtttacggtgaagatgcagttaaaaagactgacatgatcactggcggtgcagcaatgatgcttatgagcttcgttatgttcttcgtattctctgttgttctttctctatcaccagagcaactagctattgcacaagaacaaaacatcagtgttctatcgtacctagcgaacattcacgaatctccgctaatttcaattcttggccctctagttgcttttgctgctatcacttcaagctacttcggtcacttccttggtgcacatgaaggtcttgttggtctagcaaaatctaccactaagatgccagttaagaaaattgagaaagtttctcttggtttcatcgttattacaacttggatggttgcggtagttaacccaagcatcctaggtatgattgaaacgatgggtgcgccgatgatcgctgcaatcctgttcctaatgcctgtttttgctatgtacaaagtacctgcaatggctaagtacaagacatctgcaccggtacaggttttcactgctctatgtggtattgctgcgattacatctgtaatctacggcgcattataa

SEQ ID NO: 63772 - protein, 417 aa, Photobacterium profundum SS9
MQTTSNTAATTAAKASWTYKDFTWALSLFGTAVGAGVLFLPIKAGAGGFWPLVILALIALPMTWFAHKGLARFVLSAKNPEADITDTVEEHFGKSGAKIITLAYFFAIYPIVLIYGVGITNTVDSFLVNQMGMDSIPRWLLSGGLIIAMTAGVVFGKELMLKATSAMVYPLVFILLALSIYLIPEWNTSMVTVSPDWSTMPSVIWLAIPIIVFSFNHSPIISQFSKEQRRVYGEDAVKKTDMITGGAAMMLMSFVMFFVFSVVLSLSPEQLAIAQEQNISVLSYLANIHESPLISILGPLVAFAAITSSYFGHFLGAHEGLVGLAKSTTKMPVKKIEKVSLGFIVITTWMVAVVNPSILGMIETMGAPMIAAILFLMPVFAMYKVPAMAKYKTSAPVQVFTALCGIAAITSVIYGAL

SEQ ID NO: 63773 - DNA, 1257 bp, Photobacterium profundum SS9
  CDS (1)..(1257): transl_table=11
gtgtcattatctcaaggtataccattaagtaatatatcggcagaccagagctgttggaaccgtcatgataccagctggatgctgagcttatttggaacagctgttggtgctggtattcttttcttaccgattaatattggtgctggtggcttttggcccttggtaataatggcgttactggcagggccaatgacgttttttgctcaccgtggtttggcgcgttttgttctgtcttcttctcaatcgaatgctgattttaccaatgttgttgaagagcattttggtgtgtcaaccggtcgtattatttctgttctgtatttcttatctattttcccgatcttattgatctatggtgttgggctaactaataccgttgatagttttattgttaaccagcttggcatgtcttctccttcacgcattgtattatcaggtatcttggtacttggtatgatttcagtgatgctggctggtgaaaagatcatgctaaaagtctttgaagttattgtgtatccattagcctttattttagcgggcttatcattatatttggtgcctagctggcatttacctgaaatgtcgaataccttcgatatcgggcaattatcaacaacattatggttagctattcctgttactgtttttgcttttagtcatgctgctgccatttctagttttgctggtgcacagcgtcgtcattatggtgataaagccttacctaaaacggaacaaatcttaaagcgcacgtcagttatgttgatttcttttgtgctgttttttgttttttcatgtgtattgagtttgagctctgaacaattacttgaagctaaaatgcagaatgtttcagtattatcgtatttagccaatgtgcatgacagccaattcattgtcgctctgggaccattaattgcgtttattgccatttcatcttcatttttagggcattttcttggtgctcgcgaaagtttaaatggattattgcaaaagcaaactcgattcagtaataaaaatatggatcgcttgggaattatttttatgttcttttgtatttggggtgcagcagtattaaacccaagtattctaggcatgatggaggcattctctgggccgattattgccatgattttgtttgttatgccaatgatcgcggtttataaagtagaggtattaaagcagtatcgtcgtcattttagtacgtactttattttaggaatggggttattggcagtgtcagcaataatctttaatttggtttaa

SEQ ID NO: 63774 - protein, 418 aa, Photobacterium profundum SS9
MSLSQGIPLSNISADQSCWNRHDTSWMLSLFGTAVGAGILFLPINIGAGGFWPLVIMALLAGPMTFFAHRGLARFVLSSSQSNADFTNVVEEHFGVSTGRIISVLYFLSIFPILLIYGVGLTNTVDSFIVNQLGMSSPSRIVLSGILVLGMISVMLAGEKIMLKVFEVIVYPLAFILAGLSLYLVPSWHLPEMSNTFDIGQLSTTLWLAIPVTVFAFSHAAAISSFAGAQRRHYGDKALPKTEQILKRTSVMLISFVLFFVFSCVLSLSSEQLLEAKMQNVSVLSYLANVHDSQFIVALGPLIAFIAISSSFLGHFLGARESLNGLLQKQTRFSNKNMDRLGIIFMFFCIWGAAVLNPSILGMMEAFSGPIIAMILFVMPMIAVYKVEVLKQYRRHFSTYFILGMGLLAVSAIIFNLV

SEQ ID NO: 63775 - DNA, 1332 bp, Photobacterium profundum SS9
  CDS (1)..(1332): transl_table=11
atggctgatataagcagtgctgagcattcagcaacaataaaaagacaatctgctttacacgaaaaagcaaacatgacagaaagtgaatggaaaaaagcaattaaattcgacagtgttgatgtcggttggattgttatgagtatagggatggcaattggtgctggtattgtttttttacccgtgcaagttggcgtcatgggattgtgggtatttctattatcatctgtgattggttacccagcaatgtatttatttcagaagctctttattaatacactggctgagtctaaagaatgtactgactatcctggtgttattacgggttacttgggtaaaaactgggggatagcattaggtgcactttatttcatcatgttggtcatttgggtactggtgtattctttagcagtgacgaatgatagtgcttcatatcttcactcttttggcgttacagatggtcatttaaacgataatattttttacggactagcattaatttgtatcttggcgtttatcggttcgaaaggtgaaaagttactgtttaagttatccggttttatggcggtaacggtacttttgttagttgcggtaatgggtgtgctgttgattgctcgttgggatatggcgaatattccacagatgggtgcgtggggtaccatgcttaaagatgcgattattaccttaccttttacgttaacctctatcctttttatccaatctttaagcccaatggttatttcataccgttctcatgaaaaatccattgaagtggcacgttataaagcgtcacgagcaatgaaaattgcctttagtattttatttgttattgtgtttttctttgctgtgtcatttaccttggcaattagccaagaacaggcagcagaagcgatgcacaaaaatatttcagctttagccattattgcgcattattttcctggtagctgggcaaccacagcgggtattgtaatcaatatatttgctgttgttacttcattctttggcgtgttcttagcttttcaagaagcatgtcgtggtttggcgatgaatatattgttacgtaaatataaagagtcgcaggtaaataaagcactcgtgaataagctggtaacagtattcattatcttattggcgtggggagcaatcgcgataaatgcacctattttgtctttcacttcgatctgtagccctgtatttggtttggttggctgtttaattccagcttatttagtctataaagtaccgcatttggcaaagtataaaggtgcggcaacaaatatgattatcattactggtgtcttattgtgtatctcgccattgcttgcctttatctaa

SEQ ID NO: 63776 - protein, 443 aa, Photobacterium profundum SS9
MADISSAEHSATIKRQSALHEKANMTESEWKKAIKFDSVDVGWIVMSIGMAIGAGIVFLPVQVGVMGLWVFLLSSVIGYPAMYLFQKLFINTLAESKECTDYPGVITGYLGKNWGIALGALYFIMLVIWVLVYSLAVTNDSASYLHSFGVTDGHLNDNIFYGLALICILAFIGSKGEKLLFKLSGFMAVTVLLLVAVMGVLLIARWDMANIPQMGAWGTMLKDAIITLPFTLTSILFIQSLSPMVISYRSHEKSIEVARYKASRAMKIAFSILFVIVFFFAVSFTLAISQEQAAEAMHKNISALAIIAHYFPGSWATTAGIVINIFAVVTSFFGVFLAFQEACRGLAMNILLRKYKESQVNKALVNKLVTVFIILLAWGAIAINAPILSFTSICSPVFGLVGCLIPAYLVYKVPHLAKYKGAATNMIIITGVLLCISPLLAFI

SEQ ID NO: 63777 - DNA, 1395 bp, Photobacterium profundum SS9
  CDS (1)..(1395): transl_table=11
ttgttgcgcgttctctctcatcggttttaccggtacatggaagatatgacactcagaccctttgaaggctataacactatacctataaaggagatgtccactatggactctgttaaaaacaatacagcgaatacttcggcaagcagcgtaaagaaattggggtggagcaaaagtgataccgtatgggtacttggtttatacggtacagctgtaggtgctggtacactgtttcttccaattaatgccggtgtgggtggtttactccctctgatcatgatgacagtgcttgcacttcctatgactttctttgctcaccgtgccatgacacgcttcgttttatcaagtgcaaacccaggtgcagatatcactgaggtagttgaagaacactttggtgtgggtatgggtaaagtgattactttgctgtatttcttcgctatctatccaattctattggtatacagtgttgctttgactaacaccgttgaaagtttcatggtaaaccagttaggggttacgcctccagcacgtgctttacttgctttaggtttgatcattgctttaatggctattgtacgtttaggcgagcaattaattatcaaagccatgagtatattggtgttcccgtttgttgcagtgcttttaatgctagcgatgtatttggttccttactggaacggctcaattttcgagaacgttatgccgactgacggtggttacagcaccatcatgatggcggtatggttgattttacccgtgatggttttctcttttaaccactcaccagtgatttcatcattcgcagtggcaaaacagaaagaatacggtgccgatgcagaagtacaatgttcgcgcattttagcgcgtagccacattatgatggttgttacagtgatgttcttcgtattcagttgtgtactaagcttatcaccagaaaacttggctgaagcaaaagcacagaatgtttctattctaacgtacttggcaaatcactttgacactccagtcattgcttatgcagcaccagtcgtcgcaattatcgcgatcactaaatctttcttaggtcactatttaggtgctagcgaaggtttgaatggtttggtcgtaaaagttgcacgaggccgcggtaaaactatcgcgccaaaaacactgaatacctttactgcgttgtttatgttgctgactacttgggctgtagcaacgattaacccaagcattttaggaatgattgaaagccttggcggaccgattattgcgatgctgctgttcatcatgccaatgtacgctatcaagaaagtacctgcgatgcgtaagtactctggtgcattgagtaatgtctttgttacagtgattggtttatgttcaatatctgcgattttctactctctcgcacagtaa

SEQ ID NO: 63778 - protein, 464 aa, Photobacterium profundum SS9
MLRVLSHRFYRYMEDMTLRPFEGYNTIPIKEMSTMDSVKNNTANTSASSVKKLGWSKSDTVWVLGLYGTAVGAGTLFLPINAGVGGLLPLIMMTVLALPMTFFAHRAMTRFVLSSANPGADITEVVEEHFGVGMGKVITLLYFFAIYPILLVYSVALTNTVESFMVNQLGVTPPARALLALGLIIALMAIVRLGEQLIIKAMSILVFPFVAVLLMLAMYLVPYWNGSIFENVMPTDGGYSTIMMAVWLILPVMVFSFNHSPVISSFAVAKQKEYGADAEVQCSRILARSHIMMVVTVMFFVFSCVLSLSPENLAEAKAQNVSILTYLANHFDTPVIAYAAPVVAIIAITKSFLGHYLGASEGLNGLVVKVARGRGKTIAPKTLNTFTALFMLLTTWAVATINPSILGMIESLGGPIIAMLLFIMPMYAIKKVPAMRKYSGALSNVFVTVIGLCSISAIFYSLAQ

SEQ ID NO: 63779 - DNA, 1329 bp, Zymomonas mobilis subsp. mobilis ZM4
  CDS (1)..(1329): transl_table=11
atgtcgaataaacgagaccggacagagtcaaatcattcgcaagatacgtccgataatgcagcctctcaattgaccaaagaagaatggcgcgctgccatccgcttcgacagcacagatatcggctggattgttatgagtatcggcatggcaatcggggcagggatcgtcttccttccagttcaagtcggcttgatgggcatttgggttttcctgctttctgccgttgtcggttatcccggcatgtatatgtttcagcggttatttataaatacgctggcatcggctaccgtcagtcaaacttatccagatatgatttctagctatttagggcgcaaatgggggctttttctgggtgcgctttatttcgtcatgctaaccatttggatgttcatctacgcgactgccatcacacgggatagcgcctcttacctacagagttttggtgttacccataaactcctgtcccaaacttcatggtatccgcttgttctcatgattattctggtggcactggcttcgcgtggcgaacggatgctgtttaaattatcgggattaatggttctgaccaagctgcttatcgtggctgccttgggaatatttatgattccacaatggaattttgctaaccttggttcggttccaccaacgggcagcttgatttcaaaagctattatcacattaccttttacgctgacttctattctgtttattcagactttaagcccgatggttatttcttatagagcccgtgaaaaatcgcccgaagttgcccgtcataaagccttgcgggcaatgaatattgcttttgccattttgtttataacggtcttcttctacgcgatatctttcacactcgcgatgagccatgaaagcgcggtttccgcctatcaacagaatatttcggctctcgccatcatggcacaaatattcccagccagttcagttggcctgattggcgttgttctgaatatatttgcagtgatgacagccttcttcggggtctatcttggctttcgtgaagcctgcgtcggaatttttacaacgatatggtcacgctgggtgccttctgaaaaattgcaagggcgctggcttcaatatggtgtaatgatttttgccgttttactggcatggggtgctgttatcgttaacttaccggtgttgtctttcacgacattttgcagtccgattttcgggatcatcggatgccttattcccgtttggctcgtcatgaagcggccagccctgtcaaaatatcgtggagcaggtcttatcttcatcgcgatcatcggtattcttttatgcctgtcaccttttgtgacatggctatag

SEQ ID NO: 63780 - protein, 442 aa, Zymomonas mobilis subsp. mobilis ZM4
MSNKRDRTESNHSQDTSDNAASQLTKEEWRAAIRFDSTDIGWIVMSIGMAIGAGIVFLPVQVGLMGIWVFLLSAVVGYPGMYMFQRLFINTLASATVSQTYPDMISSYLGRKWGLFLGALYFVMLTIWMFIYATAITRDSASYLQSFGVTHKLLSQTSWYPLVLMIILVALASRGERMLFKLSGLMVLTKLLIVAALGIFMIPQWNFANLGSVPPTGSLISKAIITLPFTLTSILFIQTLSPMVISYRAREKSPEVARHKALRAMNIAFAILFITVFFYAISFTLAMSHESAVSAYQQNISALAIMAQIFPASSVGLIGVVLNIFAVMTAFFGVYLGFREACVGIFTTIWSRWVPSEKLQGRWLQYGVMIFAVLLAWGAVIVNLPVLSFTTFCSPIFGIIGCLIPVWLVMKRPALSKYRGAGLIFIAIIGILLCLSPFVTWL

SEQ ID NO: 63781 - DNA, 1263 bp, Francisella tularensis subsp. tularensis Schu 4
  CDS (1)..(1263): transl_table=11
atgaaaaaaccagattactcaaatactacaaaagtcgatatccagtgggtatttacgttatttggtactgcaataggtgcagggttactttatctacctgttcaagcaggggatagcggcctttgggctttagtaacagtacttatttttgctttacctttaacgtattactcacataaaaatatgtcaaatattgtactttgcacagataatggtggtattacagatgtatttacccacaatcttggtagattttttggtttaacctgcgtagtgctatatttctttgcaatattcctaaatatgccaatgtactctattggtctaaatagcgaactaagtaattttcttttaaactacaatattgtaaaaaccaatttatcaacacatatatggtttagttttagtattttagccgttttattaataatagtttctttaggtatcaatataattctaaagtttatgcagcttatagttatattattgattatattagtagtgacactgtccatatatataataccttattggaactttgagtttataactgatagtcattttgatactgttggttatattacaggtgtattaatggtattaccaatcttgatattatcgatgaatcactcacctgttatttctaatctagtaattttttatcgtgattatgtaaaagttgagcgatcacaagaaaaatataaagtttataaaatacttaaaattaatgctctaattctttttatctttgtactgctttttgtaacatcttgcctacttagcactactataccagaccttaatagggctaatgcaaataatctaacaatagtaactctaatacaagagcagcatcatagtactttattgaatattttagcaccaatgatagttttcactgctattattagttcatttataggctgttacataggttcaaaagaagctttgaaatatctatttaaatatttctttaaaaatatttataaaatagaattttctgattcattaataaataaaatctgtgttgggctaatatttatagttctctggatatgcacaatatgtaattttaaaatccttaatattataggcatattagttgcgcctactgtggcttttctactatatgttttacctgtaataataatttacaaaaatatccaatgtaaagattatagacgcgtaatattagactctattttatttataatgggattaataattatatttggccatgtaattggtttacttctaaaataa

SEQ ID NO: 63782 - protein, 420 aa, Francisella tularensis subsp. tularensis Schu 4
MKKPDYSNTTKVDIQWVFTLFGTAIGAGLLYLPVQAGDSGLWALVTVLIFALPLTYYSHKNMSNIVLCTDNGGITDVFTHNLGRFFGLTCVVLYFFAIFLNMPMYSIGLNSELSNFLLNYNIVKTNLSTHIWFSFSILAVLLIIVSLGINIILKFMQLIVILLIILVVTLSIYIIPYWNFEFITDSHFDTVGYITGVLMVLPILILSMNHSPVISNLVIFYRDYVKVERSQEKYKVYKILKINALILFIFVLLFVTSCLLSTTIPDLNRANANNLTIVTLIQEQHHSTLLNILAPMIVFTAIISSFIGCYIGSKEALKYLFKYFFKNIYKIEFSDSLINKICVGLIFIVLWICTICNFKILNIIGILVAPTVAFLLYVLPVIIIYKNIQCKDYRRVILDSILFIMGLIIIFGHVIGLLLK

SEQ ID NO: 63783 - DNA, 1224 bp, Francisella tularensis subsp. tularensis Schu 4
  CDS (1)..(1224): transl_table=11
atgaaaagaaatgaagatttaatgtggtcccttagtctgtatggtacagctatcggtgccggtgtactatttttgccaattcaaactggaatttcaggaattataccaatattagtgatattagtatttatcttcccaatggtgtttttatcacatcgtgcattatgtagatttgtgatatctaacccaaatactaactctgatatcacagtagttgctgatgactattttggtaagcttggtggaattattttcaacattttatatctatttgctatcttgccaatattactggtttatagtgttggtataacaaatactctggctagtttttttaagtatcagtttcattacgatattcaaaatagatttcttttgagtttttttactatactttcgctagtttttatcattaactttggtcagaagcttatcatccgtgttatgagccttctagtttttccatttatcatcgctttgctagtactttcattatggatgattccatattggaatattgagatactgcaaaagagcattgagtacaatcatagtttttctggtattttgatagctatctggataattatgccaatattgatattttcttttaaccactcaccgattatctcttctttagccgtatatgcaaaaaccaaatacaaacaaaatgccgacaaaaaagcctctaagataatcgcttttagtaatattctaatgattattactgtagttatatttgtaattagctcaatgcttaccctctctccaaaagagctaataatcgcaaaagaagagaatatttctatactatcttatctagcaagtcattttaataattattctcttgattatgtagctccaatagtagctctagttgctatgagtaagtctttttttggtcattatttaggttcaaaagaaggtatagatggtctagtttataaagttacaaaaaataaaattagtgaaaaaactataaaaccaattacattatcaatagtgtttttatcatgctggctagttgcttatttaaacccaaatatcttagatatgatatctagtataggtggtctagttttagcggtgatactgtttattatgcctatttatagtatctataaaataaaatatctaaagccttataaaaacctattagcagatagttttatactttttattggcattattgcactatcatcggcaatttatgttttgttgtag

SEQ ID NO: 63784 - protein, 407 aa, Francisella tularensis subsp. tularensis Schu 4
MKRNEDLMWSLSLYGTAIGAGVLFLPIQTGISGIIPILVILVFIFPMVFLSHRALCRFVISNPNTNSDITVVADDYFGKLGGIIFNILYLFAILPILLVYSVGITNTLASFFKYQFHYDIQNRFLLSFFTILSLVFIINFGQKLIIRVMSLLVFPFIIALLVLSLWMIPYWNIEILQKSIEYNHSFSGILIAIWIIMPILIFSFNHSPIISSLAVYAKTKYKQNADKKASKIIAFSNILMIITVVIFVISSMLTLSPKELIIAKEENISILSYLASHFNNYSLDYVAPIVALVAMSKSFFGHYLGSKEGIDGLVYKVTKNKISEKTIKPITLSIVFLSCWLVAYLNPNILDMISSIGGLVLAVILFIMPIYSIYKIKYLKPYKNLLADSFILFIGIIALSSAIYVLL

SEQ ID NO: 63785 - DNA, 1251 bp, Campylobacter jejuni RM1221
  CDS (1)..(1251): transl_table=11
atgaatactcctaaatggactagtcacgatacaaggtgggttttatctctttttggaacagctattggagccggcgtacttttgttacctattagtgctgggcttggtggattgatacctttattagttatacttgttttagcttttcctatgacttacttagctcatagaaatttatgtcgctttgtgctttcaagttctaatccaaaagatgatattacttttgttgcagaaagttattttggcaagggcggtggatttttaattacacttttgtatttttttgctattttgcctattttattggtttatagtgctaatcttacaacaactttgcttgagttcttaatcaatcagttcaatttcaatgcagatcttactcatgctgctcgttggtgggtgagttttttgattgttggagttttggttttgatttctattcttggtgaaaatgttgtaacaaaagcaatgagttttcttgtttttccttttattatatttttatttattttttcattgcttttaattccacaatggaattcatcattatttgcaaatgttgatttttccgtaatttcaacaagtaatttttgggttactttatggcttgttattcctgtgatggtatttagttttaatcactctcctatcatttcttcacttgcttgttattgtaaaaaagaatatggtgattatgctgaacctcgcgctagaaaaattatttctttggcaattattcttatggtttttgttgtaatgttttttgttttttcttgtgctttaacctttacaccagaagattttgcatcagcaaaagatcaaaatatcaatattcttacttttatagcaaataaatttcctgaagtttctttactagcttatgttggacctattgttgcacttgtggctattagcaaaagtttcttaggacattatcttggttctcaagaaggcttaaatggcattttatataaagcaagtaatggtagaattcaaggtaaattcgctcaaactttaacagcgatcattacctttgctattgcttggcttgttgcgtataaaaatccaagtgttataggaattatcgaggctattggtggccctgttttggctattttgcttttcttaatgccactttattgtatttatcgttttgatattttggcaagatttcgtaataaatttttagatctttttattttggtaatggggatagttgcaatttctgctgcaattcatgatcttttataa

SEQ ID NO: 63786 - protein, 416 aa, Campylobacter jejuni RM1221
MNTPKWTSHDTRWVLSLFGTAIGAGVLLLPISAGLGGLIPLLVILVLAFPMTYLAHRNLCRFVLSSSNPKDDITFVAESYFGKGGGFLITLLYFFAILPILLVYSANLTTTLLEFLINQFNFNADLTHAARWWVSFLIVGVLVLISILGENVVTKAMSFLVFPFIIFLFIFSLLLIPQWNSSLFANVDFSVISTSNFWVTLWLVIPVMVFSFNHSPIISSLACYCKKEYGDYAEPRARKIISLAIILMVFVVMFFVFSCALTFTPEDFASAKDQNINILTFIANKFPEVSLLAYVGPIVALVAISKSFLGHYLGSQEGLNGILYKASNGRIQGKFAQTLTAIITFAIAWLVAYKNPSVIGIIEAIGGPVLAILLFLMPLYCIYRFDILARFRNKFLDLFILVMGIVAISAAIHDLL

SEQ ID NO: 63787 - DNA, 1278 bp, Pseudomonas syringae pv. syringae B728a
  CDS (1)..(1278)
atgaatgatcaggctaatggcgtcgtagaacgtctggatgtagctcccgagagcatcgcgtcatggaatcgtaatgacaccacctggatgctcggattgttcggtaccgccatcggtgcgggtaccctgtttttgccaatcaacgcgggtatcggtggtttctggccattgatggcgctggcactgctggcgtttcccatgaccttctacgcccaccgtgggttgacgcgcttcgtgctctcaggacgtgaaggtgccgacatcaccgatgtggtcgaagagcatttcggcaagagtgccggtgcgatgatcaccttgctgtatttcttcgcaattttcccgatcctgctgatctacagcgtggccctcaccaacaccgtcggcagttttcttgagcaccagttgcacatcacgccaccgccgcgcgccgcactggcgtttgtgctgatcatggggctgctggccgtggtgcgttgtggcgagcggttcatcgtcaaggccatgagcctgatggtttatccgttcatcgtcgcactattgtttctggcaatattcctcatcccgcactggaccggcggcattctgagcaccgctaccacgttccctgagctatcggcgttcatacccacgttgtggctggccattccggtgatggtgttctctttcaaccacacaccgatcatctcggcctttgccgtcgatcagaagcgtcagtatggcgaaaacgccgaggtgcgcagttcgcagattctggcccgcgcccacggtctgatggtcgtgatggtgctgttcttcgtgttcagttgcgtgttgaccctgtcgcctgcccaactggccgaggccaaggcgcagaacatctcgatcctgtcttacctggccaaccacttcaacaacccgaccatcgcctttgtcgcgccactgatcgcgttcgtggctatttccaagtcgtttcttggccactacatcggtgcgagcgagggcttgaaaggcctggttctgaaggcgggtcgtcgtcctgcacccaaggccctggaccgcatgaccgcggcgttcatgctggtggtgtgctggctggtggcaacgctcaacccgagcatcctgggcatgatcgaaaccctgggcgggccggtgatttcggctttgctgttcctgatgccgatgtacgccatccacaaagtaccagccatgcgtaaatacgctggcgcgtggtccaactactttgtggtggccgccggtgtggtggcaatttcagcattgatcttttcgctgatccgctga

SEQ ID NO: 63788 - protein, 425 aa, Pseudomonas syringae pv. syringae B728a
MNDQANGVVERLDVAPESIASWNRNDTTWMLGLFGTAIGAGTLFLPINAGIGGFWPLMALALLAFPMTFYAHRGLTRFVLSGREGADITDVVEEHFGKSAGAMITLLYFFAIFPILLIYSVALTNTVGSFLEHQLHITPPPRAALAFVLIMGLLAVVRCGERFIVKAMSLMVYPFIVALLFLAIFLIPHWTGGILSTATTFPELSAFIPTLWLAIPVMVFSFNHTPIISAFAVDQKRQYGENAEVRSSQILARAHGLMVVMVLFFVFSCVLTLSPAQLAEAKAQNISILSYLANHFNNPTIAFVAPLIAFVAISKSFLGHYIGASEGLKGLVLKAGRRPAPKALDRMTAAFMLVVCWLVATLNPSILGMIETLGGPVISALLFLMPMYAIHKVPAMRKYAGAWSNYFVVAAGVVAISALIFSLIR

SEQ ID NO: 63789 - DNA, 1230 bp, Actinobacillus pleuropneumoniae serovar 1 str. 4074
  CDS (1)..(1230)
atggctacgccatctcatcgtttttccctcacttgggtgctaaatctgttcggtactgccgttggtgcaggcgtattatttttaccgattaacgccggtatgagcggtttttatccgctgattgtcatgaccttattagtcgggccgatgacttatctggcacaccgagggctggctcgttttgtgctgtcttccggcaaaccgggtagtgatattaccaacgtagtacgtgaacatttcggcgaaaacgccggtaaatttattaccttactctacttctttgcgatcttcccgattctattaatttatggtgtcggtatcaccaatacggtcggctcatttattgaaaaccaattacagatggctgtaccgcctcgcgcattactctcgggcgtattaattgccgttatgattagcgtaatgttactgagtgaacaagcgatgttaaaaatcaccacttacttagtttatccgttagtgttaattctgttcggtttatctatttacctaattccggaatggaatggtgccgcattacagcaaatgccgagtacaggcgacttcttaaccactttatggctgaccattcccgtattagtgtttgcctttaaccattcgccggcaatttcatcctttgccctttcacaacaaaaacattatcaagatccgcaacaaaccgaagttgaatcaagtaaagtattacgttcaaccgcaatgatcttagtgttattcgtgatgtttttcgtatttagctgcgtacttacgcttactccggaagagcttgcacaagcgaaagcacaaaatatttcaattttgtcttacttagccaataaatttgataatccggttatttcttatttcggacctttcgtggcattcttagcaatcggtagttctttcttcggtcactatttaggtgcgcgtgaaggattagaaggtttagtcaatcaattacgtgataaaccgattgaatcgacaaaattcaaaaaaattactgcggttgttttctttatcacattatggattgtagcaaccattaacccgagtattctcggttttatcgaaagtttaggtggtccgattattgcgatgattctgtttattatgccggtttatgccatttataccgtgccggcattagcaaaatataaaagcagtatcgccagcaatacttttgttaccgtgatgggaaccgtcgctatttcagcgattgtgtacggattattataa

SEQ ID NO: 63790 - protein, 409 aa, Actinobacillus pleuropneumoniae serovar 1 str. 4074
MATPSHRFSLTWVLNLFGTAVGAGVLFLPINAGMSGFYPLIVMTLLVGPMTYLAHRGLARFVLSSGKPGSDITNVVREHFGENAGKFITLLYFFAIFPILLIYGVGITNTVGSFIENQLQMAVPPRALLSGVLIAVMISVMLLSEQAMLKITTYLVYPLVLILFGLSIYLIPEWNGAALQQMPSTGDFLTTLWLTIPVLVFAFNHSPAISSFALSQQKHYQDPQQTEVESSKVLRSTAMILVLFVMFFVFSCVLTLTPEELAQAKAQNISILSYLANKFDNPVISYFGPFVAFLAIGSSFFGHYLGAREGLEGLVNQLRDKPIESTKFKKITAVVFFITLWIVATINPSILGFIESLGGPIIAMILFIMPVYAIYTVPALAKYKSSIASNTFVTVMGTVAISAIVYGLL

SEQ ID NO: 63791 - DNA, 1281 bp, Pseudomonas fluorescens PfO-1
  CDS (1)..(1281)
atgaatgatcaggccaatagcgtcgaacaacgctttgaggcggcagcaccagccgaactgtcgagctggaatcgccatgacactacctggatgttgggactgtttgggacggccatcggcgccggtaccctgtttttgccgatcaacgcaggtctgggtggcttctggccgctggtgatcctcgcgctgctggccttcccgatgacgttttacgcacaccgcggcctgacccgcttcgtgctttccggtcgcgaaggcgccgacatcacagacgtggtggaacagcatttcggcatcaaggccggcgcgctgatcaccctgctgtacttcttcgctatcttcccgatcctgctgatctacagcgtcggcctgaccaacacggtcgccagtttcctcgagcaccaactgcacatcacgcagccaccgcgcgcgctgctgtcgttcgtgctgattctcggcctgctggccgtggtgcgctgcggcgagcaagtgatcgtcaaggccatgagccttatggtgtatccgttcatcgtcgcgctgctgttcctggcggtgtatctgattccgcactggaacggcggcatcctgaccaccgcttcgcaagtgccggcaccgtcggcgctgctgcacacgctgtggctggcgattccggtgatggtgttctcgttcaaccactcgccgatcatctcggcgtttgcggtggatcagaagcgccgttacggcgtccacgctgacgagcgcagctcgcagatcctgtcccgcgcgcacctgctgatggtggtgatggtgctgttcttcgtcttcagttgcgtgctgaccctgtcgccggagcaactggcgcaagccaaggcgcagaacctgtcgatcctgtcttacctggccaaccacttcagcaacccgaccatcgcgttcgcggcgccgctgattgcgtttgtggcgatctccaagtcgttcctcggccactacatcggtgccagcgaaggcctgaagggcttgatcgtcaagagcggcaagcgtccgggcgccaaggcgctggaccgcatcgtggcggcgttcatgctggtggtgtgctggatcgtggcgaccctgaacccgagcatcctcggcatgatcgaaaccatcggtggcccggtcatcgcggcgatcctgttcctgatgcctatgtacgcgatccgcaaagtgccggcgatggcccgttatcgtgggcagatgtcgaacgtgtttgtcaccgcagtgggtctggtggcgatttcggcgttgatctactcgctgactgcttaa

SEQ ID NO: 63792 - protein, 426 aa, Pseudomonas fluorescens PfO-1
MNDQANSVEQRFEAAAPAELSSWNRHDTTWMLGLFGTAIGAGTLFLPINAGLGGFWPLVILALLAFPMTFYAHRGLTRFVLSGREGADITDVVEQHFGIKAGALITLLYFFAIFPILLIYSVGLTNTVASFLEHQLHITQPPRALLSFVLILGLLAVVRCGEQVIVKAMSLMVYPFIVALLFLAVYLIPHWNGGILTTASQVPAPSALLHTLWLAIPVMVFSFNHSPIISAFAVDQKRRYGVHADERSSQILSRAHLLMVVMVLFFVFSCVLTLSPEQLAQAKAQNLSILSYLANHFSNPTIAFAAPLIAFVAISKSFLGHYIGASEGLKGLIVKSGKRPGAKALDRIVAAFMLVVCWIVATLNPSILGMIETIGGPVIAAILFLMPMYAIRKVPAMARYRGQMSNVFVTAVGLVAISALIYSLTA

SEQ ID NO: 63793 - DNA, 1284 bp, Campylobacter lari RM2100
  CDS (1)..(1284): transl_table=11
atgctttctctttttgggactgcagttggtgcggggattttatttttacctattaaggcaggtgttggcggtttttggccagttgttgtaatggctttgattatttttcctatggtatatttaagccatagggctttaagtcgctttgtgtgccaagcaaatggtaatgataaagacattactcatgcggctgaagagtattttggtagaaaagtaagtatttttatttctatactttatttctttgcaatttttccaatttgtttagcatactgtgtgggtataactaatacttttgagagttttatttataatcaattcttgccacttttagatccaaatggttcttttgcaagtgcaattagtgctatgtatcaaacaagtgttaatgagcaaggaaaaactatagctaatttacttcctttttatagagcagtttttgcttttgttttagtaagtatttttatgcttattatgctttttagtgaagaattaatcaccaaagtatgcgagtggcttgtatatcctttatgtgctattttattcttattttctttatatcttatcccacaatggtcttttgagagttttagtgctattcctggtacgaaagaatttatcactatagtatggttaactttaccagttctagtgttttcgtttaaccactcaccagctatttctactttttctctaagtgtaaaaagagaatatcctgaaaattcagtgcaaaaagcaaaccaaattttacttagaacttctgtaatgttgcttgcttttgttatgttttttgtggtatcttgtgtgctttctttaactccaactgagcttgctgaagctagagcgcaaaatatacctgttctttcttattttgctaataagcttgataatccatttatttcttatggtggtccactaatcgcatttttagcaatttcaagttcattttttggacattattttggtgctagagaaggcgcttatggtatagttagaaaatgttgtaaattagcaggcaatgaaaatcctgatttgaaaaaaattgcagtttattctactttagtaatgtatattgttatgttaattactgcttatataaatccaagtattttaggttttattgaaagcctaggtggtccaattattgctgcaatcttatttttaatgcctatgattgcaatttacactgtctctaaaatgaaaaaattccaaaacaaagctttggatgcatttgtatttatcacaggtattttgacaattattactgtaatttatactttttaa

SEQ ID NO: 63794 - protein, 427 aa, Campylobacter lari RM2100
MLSLFGTAVGAGILFLPIKAGVGGFWPVVVMALIIFPMVYLSHRALSRFVCQANGNDKDITHAAEEYFGRKVSIFISILYFFAIFPICLAYCVGITNTFESFIYNQFLPLLDPNGSFASAISAMYQTSVNEQGKTIANLLPFYRAVFAFVLVSIFMLIMLFSEELITKVCEWLVYPLCAILFLFSLYLIPQWSFESFSAIPGTKEFITIVWLTLPVLVFSFNHSPAISTFSLSVKREYPENSVQKANQILLRTSVMLLAFVMFFVVSCVLSLTPTELAEARAQNIPVLSYFANKLDNPFISYGGPLIAFLAISSSFFGHYFGAREGAYGIVRKCCKLAGNENPDLKKIAVYSTLVMYIVMLITAYINPSILGFIESLGGPIIAAILFLMPMIAIYTVSKMKKFQNKALDAFVFITGILTIITVIYTF

SEQ ID NO: 63795 - DNA, 1296 bp, Aeromonas salmonicida
  CDS (1)..(1296): transl_table=11
atgtctgacatgaacattgcagtagaaggcagcgcagccagtaatgcgtcttcccgtggcaacaccaaggccgatctggtctggatgctgggtttgtacggtaccgccatcggtgccggtgtactcttcctgccgatcaacgccggcgtaggtggtttgtggccgctggtggccatggcgattctggcgttggcgctgaccttctttggacaccgtggtctgactcgcttcgtactgtccggctccacccgtgatggcgacatcaccgaagtggtggaagagcactttggcaagaccgcagggaagttcatcaccctgctctacttctttggcatctatcccatagtactgatgtactcggtcggcatcaacaacaaggttgaaagcctgctggttcaccaactcggtatgacagcaccaccccgtgccgtcctgtcgctggcactgatcctgggtctgatggcggtggtacgcctcggtggccagttcatcgtcaaggcgatgagcgtgctggtattcccgttcgtgctgaccctgatgggcctggccttctatctggttccacactggaacggcgccatcatcacagaagcaccggccctgtccgatgccttcaacggcgacttcatcaagaccctgtggctggccattcctgtgatggtgttctccttcaaccactccccgatcatctcctccttcgcggtggacaacaagggtcgttacggcgccggtgctgagaagaagtgcggcaacatactgctgggtgcccacgtcatgatggtcatgaccgtcatgttcttcgtgttcagctgcgtactgagcctctccccggctgatctgtctcccgccaaggaacagaacatcaccattctgtcctacctggccaaccatttcgataacgccttcattgccacagcggctccgctgatcgccatggttgccatcagcaagtccttcctcggccactatctgggtgccaaagagggcatgaacggtctgatgcccaaggcgctgcgcgagaaaggcaagcaggtcgacatcaagcaactggacaaggtgactgccgtcttcatgatactgaccacctgggctgtggttaccgtcaaccccagcatcctcggcatgatcgaagacctgggcgggcccatcatcgccatgctgctgttcctgatgccgatgtacgccatcaccaaggtacctgccatgcgcaaatacgctggcaacatcagaaacggcttcgtgaccctgattgggctgatcgccatgtccggtatcatctacaagatgattgcctga

SEQ ID NO: 63796 - protein, 431 aa, Aeromonas salmonicida
MSDMNIAVEGSAASNASSRGNTKADLVWMLGLYGTAIGAGVLFLPINAGVGGLWPLVAMAILALALTFFGHRGLTRFVLSGSTRDGDITEVVEEHFGKTAGKFITLLYFFGIYPIVLMYSVGINNKVESLLVHQLGMTAPPRAVLSLALILGLMAVVRLGGQFIVKAMSVLVFPFVLTLMGLAFYLVPHWNGAIITEAPALSDAFNGDFIKTLWLAIPVMVFSFNHSPIISSFAVDNKGRYGAGAEKKCGNILLGAHVMMVMTVMFFVFSCVLSLSPADLSPAKEQNITILSYLANHFDNAFIATAAPLIAMVAISKSFLGHYLGAKEGMNGLMPKALREKGKQVDIKQLDKVTAVFMILTTWAVVTVNPSILGMIEDLGGPIIAMLLFLMPMYAITKVPAMRKYAGNIRNGFVTLIGLIAMSGIIYKMIA

SEQ ID NO: 63797 - DNA, 1299 bp, Citrobacter freundii
  CDS (1)..(1299): transl_table=11
atgcaggacgacacattacaactaagcaacaatacagcaaccaccgtaccattctcaaagaaaataccgtttacgaaatatgactttggctgggtattactgtgtatcggcatggcaattggtgctggaacggtactgatgccggtacaaataggcttaacaggcatttgggtatttatcgtcgcctttattattgcctatccagcaacctatattgtgcaggatatttatttaaaaacattatcagaaagtgaaacttgtaatgactataccgatattatcagtcattacctgggaaaaaactggggcgtatttcttggcgtcatctattttttgatgattattcacggcatatttatctattccttatccgtggtttttgacagtgcctcatatatcaaaaccttcggcttaaccgatgccgatctttcacaatcgataatctataaagtggccatttttgccgtgctggtggccattgcttccgggggagaaaaactgctgtttaaaatctccggcccgatggtggtagtcaaagtggggatcatcatcgtgtttggttttgcgatggttccgcactggaacttcgctaatatcagcgcattccctgaagcatcggtcttctttcgcgacgtattgctgaccatcccgttctgcttcttctcggcggtgtttattcaggtgttgaacccaatgaacatcgcctaccgcaagcgggtagcggaccgggttctggccacccgcatggcaatacgcacgcatcgcatcagttacattacgctgattgcggtcattctgtttttctcattctcttttaccttttctattagtcatgaagaggccgtttcggccttcgaacaaaatatttccgcactggcgctggcagcgcaagtcattcctgggcaaattattcatatcacctcaacggtgctaaatatcttcgccgtattaaccgcattctttggtatttatctggggttccacgaggcgattaagggtattattcttaatgttttgagccgcgttattgatgtggagaaaattaatcccctggtgcttacgctgggtatttgcacctttattgttatcaccctggtgatctgggtgtcatttcgtgtatcggtactggtgttcttccagttgggtagcccactttacgggattgtgtcgtgtattattccgtttttcctgatctataaagtaacgcagctggaaaaactacgcgggctgaaaacctggctaatcctgttgtacgggatcctgctgtgcctgtcgccattattgaagctgattgactaa

SEQ ID NO: 63798 - protein, 432 aa, Citrobacter freundii
MQDDTLQLSNNTATTVPFSKKIPFTKYDFGWVLLCIGMAIGAGTVLMPVQIGLTGIWVFIVAFIIAYPATYIVQDIYLKTLSESETCNDYTDIISHYLGKNWGVFLGVIYFLMIIHGIFIYSLSVVFDSASYIKTFGLTDADLSQSIIYKVAIFAVLVAIASGGEKLLFKISGPMVVVKVGIIIVFGFAMVPHWNFANISAFPEASVFFRDVLLTIPFCFFSAVFIQVLNPMNIAYRKRVADRVLATRMAIRTHRISYITLIAVILFFSFSFTFSISHEEAVSAFEQNISALALAAQVIPGQIIHITSTVLNIFAVLTAFFGIYLGFHEAIKGIILNVLSRVIDVEKINPLVLTLGICTFIVITLVIWVSFRVSVLVFFQLGSPLYGIVSCIIPFFLIYKVTQLEKLRGLKTWLILLYGILLCLSPLLKLID

SEQ ID NO: 63799 - DNA, 1290 bp, Escherichia coli
  CDS (1)..(1290): transl_table=11
atggaaacgactcaaaccagcacgattgcgtcgaaagactctcgtagtgcctggcgcaagacagacaccatgtggatgctgggcctttacggcacggcaatcggcgcgggcgtgctgttcctgccaatcaacgccggtgttggcggtatgatcccgctgatcatcatggctatccttgcgttcccgatgacgttttttgctcaccgcggcctgactcgcttcgtactgtctggtaaaaacccgggcgaagacatcaccgaggttgtagaagaacactttggtattggcgcaggtaaactgattaccctgctctacttcttcgctatctacccgatcctgctggtttatagcgtggcaatcaccaataccgttgaaagcttcatgtctcaccagctgggtatgacgccaccgccgcgtgcgattctgtcgctgatcctgatcgtgggtatgatgaccatcgttcgcttcggtgagcagatgatcgttaaagcgatgagtattctggtattcccgtttgttggcgtactgatgctgctggctctgtacctgatcccgcagtggaacggcgctgcactggaaacgctgtctctggacactgcatctgcaaccggaaacggtctgtggatgaccctgtggctggcaattccggtaatggtgttctcgttcaaccactctccgatcatctcttctttcgccgttgcgaagcgtgaagagtacggcgatatggcagaacagaaatgctcgaagatcctggcattcgcacacatcatgatggtgctgaccgtaatgttcttcgtcttcagctgtgtactgagcctgactccggcagacctggctgcggctaaagagcagaacatctcgattctgtcttacctggctaaccactttaacgcaccggttatcgcgtggatggctccgattatcgcgattatcgctatcaccaaatccttcctcggtcactacctgggcgcacgtgaaggcttcaacggtatggtgattaaatctctgcgtggtaaaggtaagtctatcgaaatcaacaagctgaaccgtatcactgcgctgttcatgctggtaacgacctggattgttgccaccctgaacccgagcatcctgggtatgattgaaaccctgggcggtccaatcatcgcgatgatcctgttcctgatgccgatgtacgcaattcagaaagtaccggcaatgcgtaagtacagcggtcacatcagcaacgtattcgttgtcgtgatgggtctgattgcaatctccgcaatcttctactctctgttcagctaa

SEQ ID NO: 63800 - protein, 429 aa, Escherichia coli
METTQTSTIASKDSRSAWRKTDTMWMLGLYGTAIGAGVLFLPINAGVGGMIPLIIMAILAFPMTFFAHRGLTRFVLSGKNPGEDITEVVEEHFGIGAGKLITLLYFFAIYPILLVYSVAITNTVESFMSHQLGMTPPPRAILSLILIVGMMTIVRFGEQMIVKAMSILVFPFVGVLMLLALYLIPQWNGAALETLSLDTASATGNGLWMTLWLAIPVMVFSFNHSPIISSFAVAKREEYGDMAEQKCSKILAFAHIMMVLTVMFFVFSCVLSLTPADLAAAKEQNISILSYLANHFNAPVIAWMAPIIAIIAITKSFLGHYLGAREGFNGMVIKSLRGKGKSIEINKLNRITALFMLVTTWIVATLNPSILGMIETLGGPIIAMILFLMPMYAIQKVPAMRKYSGHISNVFVVVMGLIAISAIFYSLFS

SEQ ID NO: 63801 - DNA, 1239 bp, Haemophilus influenzae
  CDS (1)..(1239): transl_table=11
atgaaatcaacagaaaaactcaaatggaacaaatttgatgcaacgtggatgttaaaccttttcggtacggcggttggcgcgggcgtattgttcttgccgattaacgcagggatgggtggattttggccgttagttttaatggcaattatcgtcgggccaatgacttattttgctcaccgtggcttagcctactttgtactttcatcaaaaaatcctggcagcgatattactgaagtagtggaagaacactttggtaaaacagcgggtaaacttattaccttactttattttttcgcgattttccctattctgttgatttacggtaacggtatcacgaacaccgtagattcttttattgtgaatcaacttggtatggcatcaccaaatcgagtcattctctcttttgtattaattgcggtattgatttccgtgatgttatttaatgaaaaagtgatgttaaaaatcacagaatggcttgtttatccgttagtcttaattttatttgttctttctatttacttaattcctgaatggaatagtgccgtattatatgaatttccaacagtaggcggtttcttaacaactttatggctaaccattcccgtattagtattttcatttaaccattcgccagcaatttcatctttcacttgctcacaattccgtgaatataaaactttcgatggtgcagaacgccatatcagccatacagaaaaaggcgcctcaacgattttgttattcttcgtaatgttcttcgtatttagctgtgtattaacattaacacctgaagaattagtggcagcaaaagaacagaatattagtatcttgtctttcttagcgaataaatttgataatccatatatctcttattttggcccgcttgttgcattcttagcgattactagttcattcttcggtcactatatgggggcacgtgaaggcttagaaggtttatatttaaaaatgaaaggtgaagcagtaaatcgtaaaaaactcaattatgcgaccgcacttttcttcttattaacgttatggggcgttgcgattattaatccaagtatcttaggcttaatcgaatctcttggcggcccaatcattgcgatgattttgtttatcatgccaatgtacgcgattcgaaaaatcccagcaatgaaacgctacagcggacgtttcagtaatgtatttgtaacaattatggggctaattgctatttctgcagttgtttatggattattataa

SEQ ID NO: 63802 - protein, 412 aa, Haemophilus influenzae
MKSTEKLKWNKFDATWMLNLFGTAVGAGVLFLPINAGMGGFWPLVLMAIIVGPMTYFAHRGLAYFVLSSKNPGSDITEVVEEHFGKTAGKLITLLYFFAIFPILLIYGNGITNTVDSFIVNQLGMASPNRVILSFVLIAVLISVMLFNEKVMLKITEWLVYPLVLILFVLSIYLIPEWNSAVLYEFPTVGGFLTTLWLTIPVLVFSFNHSPAISSFTCSQFREYKTFDGAERHISHTEKGASTILLFFVMFFVFSCVLTLTPEELVAAKEQNISILSFLANKFDNPYISYFGPLVAFLAITSSFFGHYMGAREGLEGLYLKMKGEAVNRKKLNYATALFFLLTLWGVAIINPSILGLIESLGGPIIAMILFIMPMYAIRKIPAMKRYSGRFSNVFVTIMGLIAISAVVYGLL

SEQ ID NO: 63803 - DNA, 1290 bp, Shigella flexneri
  CDS (1)..(1290)
atggaaacgactcaaaccagcacgattgcgtcgaaagactctcgtagtgcctggcgcaagacagacaccatgtggatgctgggcctttacggcacggcaatcggcgcgggcgtgctgttcctgccaatcaacgccggtgttggcggtatgatcccgctgatcatcatggctatccttgcgttcccgatgacgttttttgctcaccgcggcctgactcgcttcgtactgtctggtaaaaacccgggcgaagacatcaccgaggttgtagaagaacactttggtattggcgcaggtaaactgattaccctgctctacttcttcgctatctacccgatcctgctggtttatagcgtggcaatcaccaataccgttgaaagcttcatgtctcaccagctgggtatgacgccaccgccgcgtgcgattctgtcgctgatcctgatcgtgggtatgatgaccatcgttcgctttggtgagcagatgatcgttaaagcgatgagtattctggtattcccgtttgttggcgtactgatgctgctggctctgtacctgatcccgcagtggaacggcgcagcactggaaacgctgtctctggacactgcatctgcaaccggaaacggtctgtggatgaccctgtggctggcaattccggtaatggtgttctcgttcaaccactctccgatcatctcttctttcgccgttgcgaatcgtgaagagtacggcgatatggcagaacagaaatgctccaagatcctggcattcgcacacatcatgatggtgctgaccgaaatgatcttcgtcttcatctgcgtactgagcctgactccggcagacctggctgcggctaaagagcacaacatctcgattctgtcttacctggctaaccactttaacgcaccggttatcgcgtggatggctccgattatcgcgattatcgctatcaccaaatccttcctcggccactacctgggcgcacgtgaaggcttcaacggtatggtgattaaatctctgcgtggtaaaggtaagtctatcgaaatcaacaagctgaaccgtatcactgcgctgttcatgctggtaacgacctggattgttgccaccctgaacccgagcatcctgggtatgattgaaaccctgggcggcccaatcatcgcgatgatcctgttcctgatgccgatgtacgcaattcagaaagtaccggcaatgcgtaagtacagcggtcacatcagcaacgtattcgttgtcgtgatgggtctgattgcaatctccgcaatcttctactctctgttcagctaa

SEQ ID NO: 63804 - protein, 429 aa, Shigella flexneri
METTQTSTIASKDSRSAWRKTDTMWMLGLYGTAIGAGVLFLPINAGVGGMIPLIIMAILAFPMTFFAHRGLTRFVLSGKNPGEDITEVVEEHFGIGAGKLITLLYFFAIYPILLVYSVAITNTVESFMSHQLGMTPPPRAILSLILIVGMMTIVRFGEQMIVKAMSILVFPFVGVLMLLALYLIPQWNGAALETLSLDTASATGNGLWMTLWLAIPVMVFSFNHSPIISSFAVANREEYGDMAEQKCSKILAFAHIMMVLTEMIFVFICVLSLTPADLAAAKEHNISILSYLANHFNAPVIAWMAPIIAIIAITKSFLGHYLGAREGFNGMVIKSLRGKGKSIEINKLNRITALFMLVTTWIVATLNPSILGMIETLGGPIIAMILFLMPMYAIQKVPAMRKYSGHISNVFVVVMGLIAISAIFYSLFS

SEQ ID NO: 63805 - DNA, 1332 bp, Escherichia coli
  CDS (1)..(1332)
atggaaattgcatcgaataaaggcgtcattgcagacgcttcgaccccggcgggtcgtgctggaatgagtgagagcgagtggcgagaagcgatcaaattcgacagtactgacaccggctgggtgattatgagtatcgggatggcgattggcgcggggattgtttttctcccggtgcaggtcggtttgatgggattgtgggtatttttgctctcatcggtgattggttacccggcaatgtatctgtttcagcgattgtttattaatacgctggcagaatcaccagaatgtaaagattacccgagcgtcattagcggttatttaggtaaaaactggggcatcctgttaggtgcgctctatttcgtaatgctggtgatttggatgttcgtctattccaccgccatcaccaacgatagtgcttcctacctgcataccttcggcgtgacggaagggttgctgtcagacagtcccttttatggtctggtactgatttgcattctggtggcgatctcctcacgcggcgagaaattgttattcaaaatttcgaccggcatggtgctgaccaagctgctggtggtcgcggcgctgggcgtgtcgatggtgggaatgtggcatctgtataacgtcggttcgctaccgccgctggggctgctggtgaaaaacgccattattacgctgccgtttaccctgacgtcgattctgtttatccagacgttaagtccgatggtgatctcttatcgctcgcgggaaaaatcaattgaagtggcgcggcataaagcattgcgggcaatgaatatcgcgtttggcattttgtttgtcaccgtctttttctacgccgtgtcgttcacgctggcgatgggacatgacgaagcggtaaaagcctatgagcagaatatttccgcgctggcgattgccgcacagtttattagcggtgacggcgcagcgtgggtgaaagtggtcagcgtcattctcaatatctttgctgtcatgactgcattctttggcgtctatttaggctttcgcgaagcaacgcaagggatcgtaatgaacatcctgcgtcgcaagatgcctgccgagaagattaacgaaaatctcgttcagcgcggcatcatgattttcgccattttgctggcctggagcgccatcgtactgaacgcaccggtgttgagcttcacctctatctgtagcccgattttcggcatggtagggtgcctgatcccggcgtggctggtttacaaagtaccagcattgcacaaatacaaagggatgtctctgtacctgattatcgtcactggtttgttgctgtgtgtttctccgttcctggcattttcttga

SEQ ID NO: 63806 - protein, 443 aa, Escherichia coli
MEIASNKGVIADASTPAGRAGMSESEWREAIKFDSTDTGWVIMSIGMAIGAGIVFLPVQVGLMGLWVFLLSSVIGYPAMYLFQRLFINTLAESPECKDYPSVISGYLGKNWGILLGALYFVMLVIWMFVYSTAITNDSASYLHTFGVTEGLLSDSPFYGLVLICILVAISSRGEKLLFKISTGMVLTKLLVVAALGVSMVGMWHLYNVGSLPPLGLLVKNAIITLPFTLTSILFIQTLSPMVISYRSREKSIEVARHKALRAMNIAFGILFVTVFFYAVSFTLAMGHDEAVKAYEQNISALAIAAQFISGDGAAWVKVVSVILNIFAVMTAFFGVYLGFREATQGIVMNILRRKMPAEKINENLVQRGIMIFAILLAWSAIVLNAPVLSFTSICSPIFGMVGCLIPAWLVYKVPALHKYKGMSLYLIIVTGLLLCVSPFLAFS

SEQ ID NO: 63807 - DNA, 1272 bp, Escherichia coli
  CDS (1)..(1272): transl_table=11
atgcagcacaacacactatcgaaacacaatcagaaattgccgtttacacgctacgacttcggctgggttttattatgcataggcatggcgattggtgccggaaccgtgctgatgccagtacaaattggcttgaagggaatttgggtatttattaccgcagcgatcattgcttatcctgccacctgggtagtgcaggacatttatttaaaaaccctttctgaaagcgattcctgtaatgactacaccgatattatcagtcattacctggggaagaactggggaattttcctcggggttatctactttttgatgattatccacgggatttttatctactctctctccgtggttttcgacagcgcctcgtacctgaaaaccttcggtttaaccgatgccgatctttcacaatctctactttataaagtcgctattttcgccgtactggtggcgattgcgtctggtggtgaacgattactgtttaagatttccgggccaatggtggtggtcaaagtagggattattgtcgtgttcggttttgcgatgatcccgcactggaatttcgccaatataaccgccttcccgcaagcctccgtctttttccgcgatgtcttgcttaccattccattttgcttcttttctgcagtatttattcaggtacttaacccaatgaatattgcctatcgtaaacgggaagcggataaagtactggcaacccggctcgcgctgcgtacccaccgaattagttatatcacgctcatcgcggtgatcctgttttttgccttttcgtttaccttctcaattagccacgaagaagccgtttctgcctttgaacaaaatatctcagcactggcgctggccgcgcaggtgatccctgggcatatcattcatatcacctctacggtgcttaatatctttgccgtactgaccgcattctttggcatttatctcggtttccacgaggccattaaaggcattattctcaatctgttaagccgaattattgataccaagaaaattaactcacgcgtgctgactctggcgatctgcgcttttatcgtcattacgttgacgatttgggtttcgtttcgtgtatcggtgctggtgttctttcagttgggaagcccgttatatggtattgtgtcgtgcctcattccgtttttcctgatctataaagtcgcacaactggaaaaacttcgcggatttaaagcctggctgattctgctgtacggcattttgctatgcttgtcgccactgttgaagctgattgagtaa

SEQ ID NO: 63808 - protein, 423 aa, Escherichia coli
MQHNTLSKHNQKLPFTRYDFGWVLLCIGMAIGAGTVLMPVQIGLKGIWVFITAAIIAYPATWVVQDIYLKTLSESDSCNDYTDIISHYLGKNWGIFLGVIYFLMIIHGIFIYSLSVVFDSASYLKTFGLTDADLSQSLLYKVAIFAVLVAIASGGERLLFKISGPMVVVKVGIIVVFGFAMIPHWNFANITAFPQASVFFRDVLLTIPFCFFSAVFIQVLNPMNIAYRKREADKVLATRLALRTHRISYITLIAVILFFAFSFTFSISHEEAVSAFEQNISALALAAQVIPGHIIHITSTVLNIFAVLTAFFGIYLGFHEAIKGIILNLLSRIIDTKKINSRVLTLAICAFIVITLTIWVSFRVSVLVFFQLGSPLYGIVSCLIPFFLIYKVAQLEKLRGFKAWLILLYGILLCLSPLLKLIE

SEQ ID NO: 63809 - DNA, 26 bp, Primer
atgagtacttcagatagcattgtatc

SEQ ID NO: 63810 - DNA, 27 bp, Primer
ttaaaacagtttgtatacgatgttcag

SEQ ID NO: 63811 - protein, 463 aa, consensus
  MISC_FEATURE (1)..(463): consensus for the disclosure of xaa see table XV
DXXWXXXXXGXAXGAGXXFLPXXXGXXGXXXXXXXXXXXXPXXXXXXXXXXXXXXXXXXXXXXDXTXXXXXXXGXXXGXXXXXXYFXXXXXXXXXYXXXXTNXXXSXXXXXXXXXXXXXXXXXXXXXXXXXXXXXXXXXXXXXXXXXXXXXXXXXXXXXXXXXXXXXXXXXXXXXXXXXXXXXXXGXXXXXKXXXXXVXXXXXXXXXXXXXXXPXWXXXXXXXXXXXXXXXXXXXXXXXXXXXXXPXXXFSXXXXXXXSXXXXXXXXXXXXXXXXXXXXXXXXXXXXXXXXXXXXXVXFFXXSXXLXXXXXXXXXAXXXNXXXLXXXAXXXXXXXXXXXXXXXXXXXXXXXXXXXAXXXSFXGXYXGXXEXXXGXXXXXXXXXXXXXXXXXXXXXXXXXXXXXXXXWXXXXXNXXXLXXXXXXXXPXXXXXXXXXPXXXXXKXXXXXXXXXXXXXXXXXXXXG

SEQ ID NO: 63812 - protein, 54 aa, consensus
  MISC_FEATURE (1)..(54): consensus for the disclosure of xaa see table XV
XXXWXXXXXGXAXGXGXXXXPXXXGXXGXXXXXXXXXXXXXXXXXXXXXXXXXX

SEQ ID NO: 63813 - protein, 40 aa, consensus
  MISC_FEATURE (1)..(40): consensus for the disclosure of xaa see table XV
XXXXXXXXXXXXXXXXYXXXXXXXXXXYXXXXXXXXXXXX

SEQ ID NO: 63814 - protein, 42 aa, consensus
  MISC_FEATURE (1)..(42): consensus for the disclosure of xaa see table XV
XXXXXXXXXXXXXXXXXXXXXXXXXXXXXXXXXXXXXXXXXW

SEQ ID NO: 63815 - protein, 24 aa, consensus
  MISC_FEATURE (1)..(24): consensus for the disclosure of xaa see table XV
XXXXXXXXXXXXXXXXXXXXXXXX

SEQ ID NO: 63816 - protein, 37 aa, consensus
  MISC_FEATURE (1)..(37): consensus for the disclosure of xaa see table XV
XXXXXXXXXXXXXXXXXXXXXXXXAXXXXXXXXXXXX

SEQ ID NO: 63817 - protein, 31 aa, consensus
  MISC_FEATURE (1)..(31): consensus for the disclosure of xaa see table XV
XXXXXXXXXXXXXXXXXXGXXXXXXXXXXXX

SEQ ID NO: 63818 - protein, 59 aa, consensus
  MISC_FEATURE (1)..(59): consensus for the disclosure of xaa see table XV
XXXXXXXXXXXXXXXXXXXXXXXXXXXXXPXXXXXXXXXXXXXXXXXXXXXXXXXXGXX

SEQ ID NO: 63819 - DNA, 1008 bp, Escherichia coli; identical to SEQ ID NO: 42264
  CDS (1)..(1008)

SEQ ID NO: 63820 - protein, 335 aa, Escherichia coli; identical to SEQ ID NO: 42265

SEQ ID NO: 63821 - DNA, 1014 bp, Staphylococcus aureus subsp. aureus COL; identical to SEQ ID NO: 42266
  CDS (1)..(1014)

SEQ ID NO: 63822 - protein, 337 aa, Staphylococcus aureus subsp. aureus COL; identical to SEQ ID NO: 42267

SEQ ID NO: 63823 - DNA, 1176 bp, Xanthomonas oryzae pv. oryzae KACC10331; identical to SEQ ID NO: 42268
  CDS (1)..(1176)

SEQ ID NO: 63824 - protein, 391 aa, Xanthomonas oryzae pv. oryzae KACC10331; identical to SEQ ID NO: 42269

SEQ ID NO: 63825 - DNA, 1008 bp, Bacillus halodurans C-125; identical to SEQ ID NO: 42270
  CDS (1)..(1008): transl_table=11

SEQ ID NO: 63826 - protein, 335 aa, Bacillus halodurans C-125; identical to SEQ ID NO: 42271

SEQ ID NO: 63827 - DNA, 1002 bp, Pseudomonas aeruginosa PAO1; identical to SEQ ID NO: 42272
  CDS (1)..(1002): transl_table=11

SEQ ID NO: 63828 - protein, 333 aa, Pseudomonas aeruginosa PAO1; identical to SEQ ID NO: 42273

SEQ ID NO: 63829 - DNA, 1017 bp, Halobacterium salinarum NRC-1; identical to SEQ ID NO: 42274
  CDS (1)..(1017): transl_table=11

SEQ ID NO: 63830 - protein, 338 aa, Halobacterium salinarum NRC-1; identical to SEQ ID NO: 42275

SEQ ID NO: 63831 - DNA, 1017 bp, Deinococcus radiodurans R1; identical to SEQ ID NO: 42276
  CDS (1)..(1017): transl_table=11

SEQ ID NO: 63832 - protein, 338 aa, Deinococcus radiodurans R1; identical to SEQ ID NO: 42277

SEQ ID NO: 63833 - DNA, 1044 bp, Mycoplasma pulmonis UAB CTIP; identical to SEQ ID NO: 42278
  CDS (1)..(1044): transl_table=4

SEQ ID NO: 63834 - protein, 347 aa, Mycoplasma pulmonis UAB CTIP; identical to SEQ ID NO: 42279

SEQ ID NO: 63835 - DNA, 1008 bp, Agrobacterium tumefaciens str. C58; identical to SEQ ID NO: 42280
  CDS (1)..(1008): transl_table=11

SEQ ID NO: 63836 - protein, 335 aa, Agrobacterium tumefaciens str. C58; identical to SEQ ID NO: 42281

SEQ ID NO: 63837 - DNA, 1026 bp, Staphylococcus aureus subsp. aureus Mu50; identical to SEQ ID NO: 42282
  CDS (1)..(1026): transl_table=11

SEQ ID NO: 63838 - protein, 341 aa, Staphylococcus aureus subsp. aureus Mu50; identical to SEQ ID NO: 42283

SEQ ID NO: 63839 - DNA, 990 bp, Sinorhizobium meliloti 1021; identical to SEQ ID NO: 42284
  CDS (1)..(990): transl_table=11

SEQ ID NO: 63840 - protein, 329 aa, Sinorhizobium meliloti 1021; identical to SEQ ID NO: 42285

SEQ ID NO: 63841 - DNA, 1014 bp, Caulobacter crescentus CB15; identical to SEQ ID NO: 42286
  CDS (1)..(1014): transl_table=11

SEQ ID NO: 63842 - protein, 337 aa, Caulobacter crescentus CB15; identical to SEQ ID NO: 42287

SEQ ID NO: 63843 - DNA, 1008 bp, Salmonella typhimurium LT2; identical to SEQ ID NO: 42288
  CDS (1)..(1008): transl_table=11

SEQ ID NO: 63844 - protein, 335 aa, Salmonella typhimurium LT2; identical to SEQ ID NO: 42289

SEQ ID NO: 63845 - DNA, 996 bp, Listeria innocua Clip11262; identical to SEQ ID NO: 42290
  CDS (1)..(996): transl_table=11

SEQ ID NO: 63846 - protein, 331 aa, Listeria innocua Clip11262; identical to SEQ ID NO: 42291

SEQ ID NO: 63847 - DNA, 1053 bp, Ralstonia solanacearum GMI1000; identical to SEQ ID NO: 42292
  CDS (1)..(1053): transl_table=11

SEQ ID NO: 63848 - protein, 350 aa, Ralstonia solanacearum GMI1000; identical to SEQ ID NO: 42293

SEQ ID NO: 63849 - DNA, 1002 bp, Agrobacterium tumefaciens str. C58; identical to SEQ ID NO: 42294
  CDS (1)..(1002): transl_table=11

SEQ ID NO: 63850 - protein, 333 aa, Agrobacterium tumefaciens str. C58; identical to SEQ ID NO: 42295

SEQ ID NO: 63851 - DNA, 984 bp, Brucella melitensis 16M; identical to SEQ ID NO: 42296
  CDS (1)..(984): transl_table=11

SEQ ID NO: 63852 - protein, 327 aa, Brucella melitensis 16M; identical to SEQ ID NO: 42297

SEQ ID NO: 63853 - DNA, 981 bp, Corynebacterium glutamicum ATCC 13032; identical to SEQ ID NO: 42298
  CDS (1)..(981): transl_table=11

SEQ ID NO: 63854 - protein, 326 aa, Corynebacterium glutamicum ATCC 13032; identical to SEQ ID NO: 42299

SEQ ID NO: 63855 - DNA, 999 bp, Streptococcus pyogenes MGAS8232; identical to SEQ ID NO: 42300
  CDS (1)..(999): transl_table=11

SEQ ID NO: 63856 - protein, 332 aa, Streptococcus pyogenes MGAS8232; identical to SEQ ID NO: 42301

SEQ ID NO: 63857 - DNA, 1101 bp, Streptomyces coelicolor A3(2); identical to SEQ ID NO: 42302
  CDS (1)..(1101)

SEQ ID NO: 63858 - protein, 366 aa, Streptomyces coelicolor A3(2); identical to SEQ ID NO: 42303

SEQ ID NO: 63859 - DNA, 1110 bp, Xanthomonas axonopodis pv. citri str. 306; identical to SEQ ID NO: 42304
  CDS (1)..(1110): transl_table=11

SEQ ID NO: 63860 - protein, 369 aa, Xanthomonas axonopodis pv. citri str. 306; identical to SEQ ID NO: 42305

SEQ ID NO: 63861 - DNA, 1056 bp, Yersinia pestis KIM; identical to SEQ ID NO: 42306
  CDS (1)..(1056): transl_table=11

SEQ ID NO: 63862 - protein, 351 aa, Yersinia pestis KIM; identical to SEQ ID NO: 42307

SEQ ID NO: 63863 - DNA, 1002 bp, Oceanobacillus iheyensis HTE831; identical to SEQ ID NO: 42308
  CDS (1)..(1002): transl_table=11

SEQ ID NO: 63864 - protein, 333 aa, Oceanobacillus iheyensis HTE831; identical to SEQ ID NO: 42309

SEQ ID NO: 63865 - DNA, 912 bp, Oceanobacillus iheyensis HTE831; identical to SEQ ID NO: 42310
  CDS (1)..(912): transl_table=11

SEQ ID NO: 63866 - protein, 303 aa, Oceanobacillus iheyensis HTE831; identical to SEQ ID NO: 42311

SEQ ID NO: 63867 - DNA, 1020 bp, Oceanobacillus iheyensis HTE831; identical to SEQ ID NO: 42312
  CDS (1)..(1020): transl_table=11

SEQ ID NO: 63868 - protein, 339 aa, Oceanobacillus iheyensis HTE831; identical to SEQ ID NO: 42313

SEQ ID NO: 63869 - DNA, 987 bp, Streptococcus agalactiae NEM316; identical to SEQ ID NO: 42314
  CDS (1)..(987): transl_table=11

SEQ ID NO: 63870 - protein, 328 aa, Streptococcus agalactiae NEM316; identical to SEQ ID NO: 42315

SEQ ID NO: 63871 - DNA, 1041 bp, Corynebacterium efficiens YS-314; identical to SEQ ID NO: 42316
  CDS (1)..(1041): transl_table=11

SEQ ID NO: 63872 - protein, 346 aa, Corynebacterium efficiens YS-314; identical to SEQ ID NO: 42317

SEQ ID NO: 63873 - DNA, 966 bp, Corynebacterium efficiens YS-314; identical to SEQ ID NO: 42318
  CDS (1)..(966): transl_table=11

SEQ ID NO: 63874 - protein, 321 aa, Corynebacterium efficiens YS-314; identical to SEQ ID NO: 42319

SEQ ID NO: 63875 - DNA, 1005 bp, Pseudomonas putida KT2440; identical to SEQ ID NO: 42320
  CDS (1)..(1005): transl_table=11

SEQ ID NO: 63876 - protein, 334 aa, Pseudomonas putida KT2440; identical to SEQ ID NO: 42321

SEQ ID NO: 63877 - DNA, 981 bp, Pseudomonas putida KT2440; identical to SEQ ID NO: 42322
  CDS (1)..(981): transl_table=11

SEQ ID NO: 63878 - protein, 326 aa, Pseudomonas putida KT2440; identical to SEQ ID NO: 42323

SEQ ID NO: 63879 - DNA, 996 bp, Staphylococcus epidermidis ATCC 12228; identical to SEQ ID NO: 42324
  CDS (1)..(996): transl_table=11

SEQ ID NO: 63880 - protein, 331 aa, Staphylococcus epidermidis ATCC 12228; identical to SEQ ID NO: 42325

SEQ ID NO: 63881 - DNA, 1047 bp, Staphylococcus epidermidis ATCC 12228; identical to SEQ ID NO: 42326
  CDS (1)..(1047): transl_table=11

SEQ ID NO: 63882 - protein, 348 aa, Staphylococcus epidermidis ATCC 12228; identical to SEQ ID NO: 42327

SEQ ID NO: 63883 - DNA, 1008 bp, Bradyrhizobium japonicum USDA 110; identical to SEQ ID NO: 42328
  CDS (1)..(1008)

SEQ ID NO: 63884 - protein, 335 aa, Bradyrhizobium japonicum USDA 110; identical to SEQ ID NO: 42329

SEQ ID NO: 63885 - DNA, 1014 bp, Bradyrhizobium japonicum USDA 110; identical to SEQ ID NO: 42330
  CDS (1)..(1014)

SEQ ID NO: 63886 - protein, 337 aa, Bradyrhizobium japonicum USDA 110; identical to SEQ ID NO: 42331

SEQ ID NO: 63887 - DNA, 1002 bp, Pseudomonas syringae pv. tomato str. DC3000; identical to SEQ ID NO: 42332
  CDS (1)..(1002): transl_table=11

SEQ ID NO: 63888 - protein, 333 aa, Pseudomonas syringae pv. tomato str. DC3000; identical to SEQ ID NO: 42333

SEQ ID NO: 63889 - DNA, 987 bp, Enterococcus faecalis V583; identical to SEQ ID NO: 42334
  CDS (1)..(987): transl_table=11

SEQ ID NO: 63890 - protein, 328 aa, Enterococcus faecalis V583; identical to SEQ ID NO: 42335

SEQ ID NO: 63891 - DNA, 1017 bp, Streptomyces avermitilis MA-4680; identical to SEQ ID NO: 42336
  CDS (1)..(1017)

SEQ ID NO: 63892 - protein, 338 aa, Streptomyces avermitilis MA-4680; identical to SEQ ID NO: 42337

SEQ ID NO: 63893 - DNA, 1008 bp, Streptomyces avermitilis MA-4680; identical to SEQ ID NO: 42338
  CDS (1)..(1008)

SEQ ID NO: 63894 - protein, 335 aa, Streptomyces avermitilis MA-4680; identical to SEQ ID NO: 42339

SEQ ID NO: 63895 - DNA, 972 bp, Bordetella bronchiseptica RB50; identical to SEQ ID NO: 42340
  CDS (1)..(972): transl_table=11

SEQ ID NO: 63896 - protein, 323 aa, Bordetella bronchiseptica RB50; identical to SEQ ID NO: 42341

SEQ ID NO: 63897 - DNA, 1026 bp, Bordetella bronchiseptica RB50; identical to SEQ ID NO: 42342
  CDS (1)..(1026): transl_table=11

SEQ ID NO: 63898 - protein, 341 aa, Bordetella bronchiseptica RB50; identical to SEQ ID NO: 42343

SEQ ID NO: 63899 - DNA, 1032 bp, Chromobacterium violaceum ATCC 12472; identical to SEQ ID NO: 42344
  CDS (1)..(1032): transl_table=11

SEQ ID NO: 63900 - protein, 343 aa, Chromobacterium violaceum ATCC 12472; identical to SEQ ID NO: 42345

SEQ ID NO: 63901 - DNA, 1017 bp, Rhodopseudomonas palustris CGA009; identical to SEQ ID NO: 42346
  CDS (1)..(1017): transl_table=11

SEQ ID NO: 63902 - protein, 338 aa, Rhodopseudomonas palustris CGA009; identical to SEQ ID NO: 42347

SEQ ID NO: 63903 - DNA, 1122 bp, Mycobacterium avium subsp. paratuberculosis str. k10; identical to SEQ ID NO: 42348
  CDS (1)..(1122): transl_table=11

SEQ ID NO: 63904 - protein, 373 aa, Mycobacterium avium subsp. paratuberculosis str. k10; identical to SEQ ID NO: 42349

SEQ ID NO: 63905 - DNA, 1032 bp, Mycobacterium avium subsp. paratuberculosis str. k10; identical to SEQ ID NO: 42350
  CDS (1)..(1032): transl_table=11

SEQ ID NO: 63906 - protein, 343 aa, Mycobacterium avium subsp. paratuberculosis str. k10; identical to SEQ ID NO: 42351

SEQ ID NO: 63907 - DNA, 1011 bp, Bdellovibrio bacteriovorus HD100; identical to SEQ ID NO: 42352
  CDS (1)..(1011): transl_table=11

SEQ ID NO: 63908 - protein, 336 aa, Bdellovibrio bacteriovorus HD100; identical to SEQ ID NO: 42353

SEQ ID NO: 63909 - DNA, 972 bp, Anopheles gambiae str. PEST; identical to SEQ ID NO: 42354
  CDS (1)..(972)

SEQ ID NO: 63910 - protein, 323 aa, Anopheles gambiae str. PEST; identical to SEQ ID NO: 42355

SEQ ID NO: 63911 - DNA, 1014 bp, Staphylococcus aureus subsp. aureus MRSA252; identical to SEQ ID NO: 42356
  CDS (1)..(1014): transl_table=11

SEQ ID NO: 63912 - protein, 337 aa, Staphylococcus aureus subsp. aureus MRSA252; identical to SEQ ID NO: 42357

SEQ ID NO: 63913 - DNA, 1023 bp, Acinetobacter sp. ADP1; identical to SEQ ID NO: 42358
  CDS (1)..(1023): transl_table=11

SEQ ID NO: 63914 - protein, 340 aa, Acinetobacter sp. ADP1; identical to SEQ ID NO: 42359

SEQ ID NO: 63915 - DNA, 981 bp, Erwinia carotovora subsp. atroseptica SCRI1043; identical to SEQ ID NO: 42360
  CDS (1)..(981)

SEQ ID NO: 63916 - protein, 326 aa, Erwinia carotovora subsp. atroseptica SCRI1043; identical to SEQ ID NO: 42361

SEQ ID NO: 63917 - DNA, 981 bp, Propionibacterium acnes KPA171202; identical to SEQ ID NO: 42362
  CDS (1)..(981): transl_table=11

SEQ ID NO: 63918 - protein, 326 aa, Propionibacterium acnes KPA171202; identical to SEQ ID NO: 42363

SEQ ID NO: 63919 - DNA, 1014 bp, Symbiobacterium thermophilum IAM 14863; identical to SEQ ID NO: 42364
  CDS (1)..(1014): transl_table=11

SEQ ID NO: 63920 - protein, 337 aa, Symbiobacterium thermophilum IAM 14863; identical to SEQ ID NO: 42365

SEQ ID NO: 63921 - DNA, 993 bp, Bacillus licheniformis ATCC 14580; identical to SEQ ID NO: 42366
  CDS (1)..(993): transl_table=11

SEQ ID NO: 63922 - protein, 330 aa, Bacillus licheniformis ATCC 14580; identical to SEQ ID NO: 42367

SEQ ID NO: 63923 - DNA, 1038 bp, Mannheimia succiniciproducens MBEL55E; identical to SEQ ID NO: 42368
  CDS (1)..(1038): transl_table=11

SEQ ID NO: 63924 - protein, 345 aa, Mannheimia succiniciproducens MBEL55E; identical to SEQ ID NO: 42369

SEQ ID NO: 63925 - DNA, 1008 bp, Bacillus licheniformis ATCC 14580; identical to SEQ ID NO: 42370
  CDS (1)..(1008): transl_table=11

SEQ ID NO: 63926 - protein, 335 aa, Bacillus licheniformis ATCC 14580; identical to SEQ ID NO: 42371

SEQ ID NO: 63927 - DNA, 1002 bp, Burkholderia mallei ATCC 23344; identical to SEQ ID NO: 42372
  CDS (1)..(1002): transl_table=11

SEQ ID NO: 63928 - protein, 333 aa, Burkholderia mallei ATCC 23344; identical to SEQ ID NO: 42373

SEQ ID NO: 63929 - DNA, 1059 bp, Burkholderia pseudomallei K96243; identical to SEQ ID NO: 42374
  CDS (1)..(1059): transl_table=11

SEQ ID NO: 63930 - protein, 352 aa, Burkholderia pseudomallei K96243; identical to SEQ ID NO: 42375

SEQ ID NO: 63931 - DNA, 1185 bp, Nocardia farcinica IFM 10152; identical to SEQ ID NO: 42376
  CDS (1)..(1185): transl_table=11

SEQ ID NO: 63932 - protein, 394 aa, Nocardia farcinica IFM 10152; identical to SEQ ID NO: 42377

SEQ ID NO: 63933 - DNA, 1032 bp, Nocardia farcinica IFM 10152; identical to SEQ ID NO: 42378
  CDS (1)..(1032): transl_table=11

SEQ ID NO: 63934 - protein, 343 aa, Nocardia farcinica IFM 10152; identical to SEQ ID NO: 42379

SEQ ID NO: 63935 - DNA, 993 bp, Nocardia farcinica IFM 10152; identical to SEQ ID NO: 42380
  CDS (1)..(993): transl_table=11

SEQ ID NO: 63936 - protein, 330 aa, Nocardia farcinica IFM 10152; identical to SEQ ID NO: 42381

SEQ ID NO: 63937 - DNA, 1029 bp, Haloarcula marismortui ATCC 43049; identical to SEQ ID NO: 42382
  CDS (1)..(1029): transl_table=11

SEQ ID NO: 63938 - protein, 342 aa, Haloarcula marismortui ATCC 43049; identical to SEQ ID NO: 42383

SEQ ID NO: 63939 - DNA, 1011 bp, Geobacillus kaustophilus HTA426; identical to SEQ ID NO: 42384
  CDS (1)..(1011): transl_table=11

SEQ ID NO: 63940 - protein, 336 aa, Geobacillus kaustophilus HTA426; identical to SEQ ID NO: 42385

SEQ ID NO: 63941 - DNA, 984 bp, Idiomarina loihiensis L2TR; identical to SEQ ID NO: 42386
  CDS (1)..(984): transl_table=11

SEQ ID NO: 63942 - protein, 327 aa, Idiomarina loihiensis L2TR; identical to SEQ ID NO: 42387

SEQ ID NO: 63943 - DNA, 1005 bp, Silicibacter pomeroyi DSS-3; identical to SEQ ID NO: 42388
  CDS (1)..(1005): transl_table=11

SEQ ID NO: 63944 - protein, 334 aa, Silicibacter pomeroyi DSS-3; identical to SEQ ID NO: 42389

SEQ ID NO: 63945 - DNA, 999 bp, Bacillus clausii KSM-K16; identical to SEQ ID NO: 42390
  CDS (1)..(999): transl_table=11

SEQ ID NO: 63946 - protein, 332 aa, Bacillus clausii KSM-K16; identical to SEQ ID NO: 42391

SEQ ID NO: 63947 - DNA, 1005 bp, Bacillus clausii KSM-K16; identical to SEQ ID NO: 42392
  CDS (1)..(1005): transl_table=11

SEQ ID NO: 63948 - protein, 334 aa, Bacillus clausii KSM-K16; identical to SEQ ID NO: 42393

SEQ ID NO: 63949 - DNA, 984 bp, Rhodobacter sphaeroides 2.4.1; identical to SEQ ID NO: 42394
  CDS (1)..(984)

SEQ ID NO: 63950 - protein, 327 aa, Rhodobacter sphaeroides 2.4.1; identical to SEQ ID NO: 42395

SEQ ID NO: 63951 - DNA, 996 bp, Azotobacter vinelandii; identical to SEQ ID NO: 42396
  CDS (1)..(996)

SEQ ID NO: 63952 - protein, 331 aa, Azotobacter vinelandii; identical to SEQ ID NO: 42397

SEQ ID NO: 63953 - DNA, 1050 bp, Actinobacillus pleuropneumoniae serovar 1 str. 4074; identical to SEQ ID NO: 42398
  CDS (1)..(1050)

SEQ ID NO: 63954 - protein, 349 aa, Actinobacillus pleuropneumoniae serovar 1 str. 4074; identical to SEQ ID NO: 42399

SEQ ID NO: 63955 - DNA, 972 bp, Pseudomonas aeruginosa UCBPP-PA14; identical to SEQ ID NO: 42400
  CDS (1)..(972)

SEQ ID NO: 63956 - protein, 323 aa, Pseudomonas aeruginosa UCBPP-PA14; identical to SEQ ID NO: 42401

SEQ ID NO: 63957 - DNA, 1005 bp, Dechloromonas aromatica RCB; identical to SEQ ID NO: 42402
  CDS (1)..(1005)

SEQ ID NO: 63958 - protein, 334 aa, Dechloromonas aromatica RCB; identical to SEQ ID NO: 42403

SEQ ID NO: 63959 - DNA, 1026 bp, Ralstonia eutropha JMP134; identical to SEQ ID NO: 42404
  CDS (1)..(1026)

SEQ ID NO: 63960 - protein, 341 aa, Ralstonia eutropha JMP134; identical to SEQ ID NO: 42405

SEQ ID NO: 63961 - DNA, 1002 bp, Methylobacillus flagellatus KT; identical to SEQ ID NO: 42406
  CDS (1)..(1002)

SEQ ID NO: 63962 - protein, 333 aa, Methylobacillus flagellatus KT; identical to SEQ ID NO: 42407

SEQ ID NO: 63963 - DNA, 990 bp, Exiguobacterium sp. 255-15; identical to SEQ ID NO: 42408
  CDS (1)..(990)

SEQ ID NO: 63964 - protein, 329 aa, Exiguobacterium sp. 255-15; identical to SEQ ID NO: 42409

SEQ ID NO: 63965 - DNA, 987 bp, Mesorhizobium sp. BNC1; identical to SEQ ID NO: 42410
  CDS (1)..(987)

SEQ ID NO: 63966 - protein, 328 aa, Mesorhizobium sp. BNC1; identical to SEQ ID NO: 42411

SEQ ID NO: 63967 - DNA, 1011 bp, Exiguobacterium sp. 255-15; identical to SEQ ID NO: 42412
  CDS (1)..(1011)

SEQ ID NO: 63968 - protein, 336 aa, Exiguobacterium sp. 255-15; identical to SEQ ID NO: 42413

SEQ ID NO: 63969 - DNA, 1050 bp, Burkholderia cepacia R18194; identical to SEQ ID NO: 42414
  CDS (1)..(1050)

SEQ ID NO: 63970 - protein, 349 aa, Burkholderia cepacia R18194; identical to SEQ ID NO: 42415

SEQ ID NO: 63971 - DNA, 999 bp, Burkholderia cepacia R1808; identical to SEQ ID NO: 42416
  CDS (1)..(999)

SEQ ID NO: 63972 - protein, 332 aa, Burkholderia cepacia R1808; identical to SEQ ID NO: 42417

SEQ ID NO: 63973 - DNA, 1032 bp, Burkholderia cepacia R1808; identical to SEQ ID NO: 42418
  CDS (1)..(1032)

SEQ ID NO: 63974 - protein, 343 aa, Burkholderia cepacia R1808; identical to SEQ ID NO: 42419

SEQ ID NO: 63975 - DNA, 996 bp, Listeria monocytogenes str. 1/2a F6854; identical to SEQ ID NO: 42420
  CDS (1)..(996): transl_table=11

SEQ ID NO: 63976 - protein, 331 aa, Listeria monocytogenes str. 1/2a F6854; identical to SEQ ID NO: 42421

SEQ ID NO: 63977 - DNA, 1044 bp, Rubrivivax gelatinosus PM1; identical to SEQ ID NO: 42422
  CDS (1)..(1044)

SEQ ID NO: 63978 - protein, 347 aa, Rubrivivax gelatinosus PM1; identical to SEQ ID NO: 42423

SEQ ID NO: 63979 - DNA, 1002 bp, Pseudomonas fluorescens PfO-1; identical to SEQ ID NO: 42424
  CDS (1)..(1002)

SEQ ID NO: 63980 - protein, 333 aa, Pseudomonas fluorescens PfO-1; identical to SEQ ID NO: 42425

SEQ ID NO: 63981 - DNA, 1002 bp, Rhodospirillum rubrum; identical to SEQ ID NO: 42426
  CDS (1)..(1002)

SEQ ID NO: 63982 - protein, 333 aa, Rhodospirillum rubrum; identical to SEQ ID NO: 42427

SEQ ID NO: 63983 - DNA, 1017 bp, Ralstonia metallidurans CH34; identical to SEQ ID NO: 42428
  CDS (1)..(1017)

SEQ ID NO: 63984 - protein, 338 aa, Ralstonia metallidurans CH34; identical to SEQ ID NO: 42429

SEQ ID NO: 63985 - DNA, 1020 bp, Ralstonia metallidurans CH34; identical to SEQ ID NO: 42430
  CDS (1)..(1020)

SEQ ID NO: 63986 - protein, 339 aa, Ralstonia metallidurans CH34; identical to SEQ ID NO: 42431

SEQ ID NO: 63987 - DNA, 999 bp, Burkholderia fungorum LB400; identical to SEQ ID NO: 42432
  CDS (1)..(999)

SEQ ID NO: 63988 - protein, 332 aa, Burkholderia fungorum LB400; identical to SEQ ID NO: 42433

SEQ ID NO: 63989 - DNA, 1002 bp, Burkholderia fungorum LB400; identical to SEQ ID NO: 42434
  CDS (1)..(1002)

SEQ ID NO: 63990 - protein, 333 aa, Burkholderia fungorum LB400; identical to SEQ ID NO: 42435

SEQ ID NO: 63991 - DNA, 996 bp, Burkholderia fungorum LB400; identical to SEQ ID NO: 42436
  CDS (1)..(996)

SEQ ID NO: 63992 - protein, 331 aa, Burkholderia fungorum LB400; identical to SEQ ID NO: 42437

SEQ ID NO: 63993 - DNA, 1020 bp, Burkholderia fungorum LB400; identical to SEQ ID NO: 42438
  CDS (1)..(1020)

SEQ ID NO: 63994 - protein, 339 aa, Burkholderia fungorum LB400; identical to SEQ ID NO: 42439

SEQ ID NO: 63995 - DNA, 993 bp, Novosphingobium aromaticivorans DSM 12444; identical to SEQ ID NO: 42440
  CDS (1)..(993)

SEQ ID NO: 63996 - protein, 330 aa, Novosphingobium aromaticivorans DSM 12444; identical to SEQ ID NO: 42441

SEQ ID NO: 63997 - DNA, 1014 bp, Cytophaga hutchinsonii; identical to SEQ ID NO: 42442
  CDS (1)..(1014)

SEQ ID NO: 63998 - protein, 337 aa, Cytophaga hutchinsonii; identical to SEQ ID NO: 42443

SEQ ID NO: 63999 - DNA, 987 bp, Silicibacter sp. TM1040; identical to SEQ ID NO: 42444
  CDS (1)..(987)

SEQ ID NO: 64000 - protein, 328 aa, Silicibacter sp. TM1040; identical to SEQ ID NO: 42445

SEQ ID NO: 64001 - DNA, 1020 bp, Psychrobacter sp. 273-4; identical to SEQ ID NO: 42446
  CDS (1)..(1020)

SEQ ID NO: 64002 - protein, 339 aa, Psychrobacter sp. 273-4; identical to SEQ ID NO: 42447

SEQ ID NO: 64003 - DNA, 1020 bp, Rubrobacter xylanophilus DSM 9941; identical to SEQ ID NO: 42448
  CDS (1)..(1020)

SEQ ID NO: 64004 - protein, 339 aa, Rubrobacter xylanophilus DSM 9941; identical to SEQ ID NO: 42449

SEQ ID NO: 64005 - DNA, 1002 bp, Polaromonas sp. JS666; identical to SEQ ID NO: 42450
  CDS (1)..(1002)

SEQ ID NO: 64006 - protein, 333 aa, Polaromonas sp. JS666; identical to SEQ ID NO: 42451

SEQ ID NO: 64007 - DNA, 954 bp, Corynebacterium glutamicum; identical to SEQ ID NO: 42452
  CDS (1)..(954): transl_table=11

SEQ ID NO: 64008 - protein, 317 aa, Corynebacterium glutamicum; identical to SEQ ID NO: 42453

SEQ ID NO: 64009 - DNA, 981 bp, uncultured bacterium 311; identical to SEQ ID NO: 42454
  CDS (1)..(981): transl_table=11

SEQ ID NO: 64010 - protein, 326 aa, uncultured bacterium 311; identical to SEQ ID NO: 42455

SEQ ID NO: 64011 - DNA, 1035 bp, Yersinia enterocolitica; identical to SEQ ID NO: 42456
  CDS (1)..(1035): transl_table=11

SEQ ID NO: 64012 - protein, 344 aa, Yersinia enterocolitica; identical to SEQ ID NO: 42457

SEQ ID NO: 64013 - DNA, 942 bp, Bacillus subtilis; identical to SEQ ID NO: 42458
  CDS (1)..(942): transl_table=11

SEQ ID NO: 64014 - protein, 313 aa, Bacillus subtilis; identical to SEQ ID NO: 42459

SEQ ID NO: 64015 - DNA, 1020 bp, Bacillus subtilis; identical to SEQ ID NO: 42460
  CDS (1)..(1020): transl_table=11

SEQ ID NO: 64016 - protein, 339 aa, Bacillus subtilis; identical to SEQ ID NO: 42461

SEQ ID NO: 64017 - DNA, 1005 bp, Bacillus subtilis; identical to SEQ ID NO: 42462
  CDS (1)..(1005): transl_table=11

SEQ ID NO: 64018 - protein, 334 aa, Bacillus subtilis; identical to SEQ ID NO: 42463

SEQ ID NO: 64019 - DNA, 1011 bp, Bacillus subtilis; identical to SEQ ID NO: 42464
  CDS (1)..(1011): transl_table=11

SEQ ID NO: 64020 - protein, 336 aa, Bacillus subtilis; identical to SEQ ID NO: 42465

SEQ ID NO: 64021 - DNA, 1002 bp, Bacillus subtilis; identical to SEQ ID NO: 42466
  CDS (1)..(1002): transl_table=11

SEQ ID NO: 64022 - protein, 333 aa, Bacillus subtilis; identical to SEQ ID NO: 42467

SEQ ID NO: 64023 - DNA, 26 bp, Primer
atgactgataaaaccattgcgttttc

SEQ ID NO: 64024 - DNA, 26 bp, Primer
ttatcccaacaactcttccttaacat

SEQ ID NO: 64025 - protein, 413 aa, consensus; identical to SEQ ID NO: 42470
  MISC_FEATURE (1)..(413): consensus for the disclosure of xaa see table XV

SEQ ID NO: 64026 - protein, 82 aa, consensus; identical to SEQ ID NO: 42471
  MISC_FEATURE (1)..(82): consensus for the disclosure of xaa see table XV

SEQ ID NO: 64027 - protein, 26 aa, consensus
  MISC_FEATURE (1)..(26): consensus for the disclosure of xaa see table XV
XXXXXXXXXXXXXAXXXXXXXXXXXX

SEQ ID NO: 64028 - DNA, 945 bp, Escherichia coli; identical to SEQ ID NO: 46012
  CDS (1)..(945)

SEQ ID NO: 64029 - protein, 314 aa, Escherichia coli; identical to SEQ ID NO: 46013

SEQ ID NO: 64030 - DNA, 1017 bp, Thermococcus kodakaraensis; identical to SEQ ID NO: 46014
  CDS (1)..(1017)

SEQ ID NO: 64031 - protein, 338 aa, Thermococcus kodakaraensis; identical to SEQ ID NO: 46015

SEQ ID NO: 64032 - DNA, 918 bp, Staphylococcus aureus subsp. aureus COL; identical to SEQ ID NO: 46016
  CDS (1)..(918)

SEQ ID NO: 64033 - protein, 305 aa, Staphylococcus aureus subsp. aureus COL; identical to SEQ ID NO: 46017

SEQ ID NO: 64034 - DNA, 1002 bp, Gluconobacter oxydans 621H; identical to SEQ ID NO: 46018
  CDS (1)..(1002)

SEQ ID NO: 64035 - protein, 333 aa, Gluconobacter oxydans 621H; identical to SEQ ID NO: 46019

SEQ ID NO: 64036 - DNA, 1017 bp, Mus musculus; identical to SEQ ID NO: 46020
  CDS (1)..(1017)

SEQ ID NO: 64037 - protein, 338 aa, Mus musculus; identical to SEQ ID NO: 46021

SEQ ID NO: 64038 - DNA, 1623 bp, Arabidopsis thaliana; identical to SEQ ID NO: 46022
  CDS (1)..(1623)

SEQ ID NO: 64039 - protein, 540 aa, Arabidopsis thaliana; identical to SEQ ID NO: 46023

SEQ ID NO: 64040 - DNA, 1068 bp, Thermoplasma acidophilum DSM 1728; identical to SEQ ID NO: 46024
  CDS (1)..(1068): transl_table=11

SEQ ID NO: 64041 - protein, 355 aa, Thermoplasma acidophilum DSM 1728; identical to SEQ ID NO: 46025

SEQ ID NO: 64042 - DNA, 846 bp, Streptococcus pyogenes MGAS315; identical to SEQ ID NO: 46026
  CDS (1)..(846): transl_table=11

SEQ ID NO: 64043 - protein, 281 aa, Streptococcus pyogenes MGAS315; identical to SEQ ID NO: 46027

SEQ ID NO: 64044 - DNA, 984 bp, Corynebacterium efficiens YS-314; identical to SEQ ID NO: 46028
  CDS (1)..(984): transl_table=11

SEQ ID NO: 64045 - protein, 327 aa, Corynebacterium efficiens YS-314; identical to SEQ ID NO: 46029

SEQ ID NO: 64046 - DNA, 849 bp, Bacillus cereus ATCC 14579; identical to SEQ ID NO: 46030
  CDS (1)..(849): transl_table=11

SEQ ID NO: 64047 - protein, 282 aa, Bacillus cereus ATCC 14579; identical to SEQ ID NO: 46031

SEQ ID NO: 64048 - DNA, 930 bp, Anopheles gambiae str. PEST; identical to SEQ ID NO: 46032
  CDS (1)..(930)

SEQ ID NO: 64049 - protein, 309 aa, Anopheles gambiae str. PEST; identical to SEQ ID NO: 46033

SEQ ID NO: 64050 - DNA, 1239 bp, Debaryomyces hansenii CBS767; identical to SEQ ID NO: 46034
  CDS (1)..(1239)

SEQ ID NO: 64051 - protein, 412 aa, Debaryomyces hansenii CBS767; identical to SEQ ID NO: 46035

SEQ ID NO: 64052 - DNA, 852 bp, Leptospira interrogans serovar Copenhageni str. Fiocruz L1-130; identical to SEQ ID NO: 46036
  CDS (1)..(852): transl_table=11

SEQ ID NO: 64053 - protein, 283 aa, Leptospira interrogans serovar Copenhageni str. Fiocruz L1-130; identical to SEQ ID NO: 46037

SEQ ID NO: 64054 - DNA, 864 bp, Mycoplasma mobile 163K; identical to SEQ ID NO: 46038
  CDS (1)..(864): transl_table=4

SEQ ID NO: 64055 - protein, 287 aa, Mycoplasma mobile 163K; identical to SEQ ID NO: 46039

SEQ ID NO: 64056 - DNA, 1050 bp, Picrophilus torridus DSM 9790; identical to SEQ ID NO: 46040
  CDS (1)..(1050): transl_table=11

SEQ ID NO: 64057 - protein, 349 aa, Picrophilus torridus DSM 9790; identical to SEQ ID NO: 46041

SEQ ID NO: 64058 - DNA, 879 bp, Rickettsia typhi str. Wilmington; identical to SEQ ID NO: 46042
  CDS (1)..(879): transl_table=11

SEQ ID NO: 64059 - protein, 292 aa, Rickettsia typhi str. Wilmington; identical to SEQ ID NO: 46043

SEQ ID NO: 64060 - DNA, 849 bp, Borrelia garinii PBi; identical to SEQ ID NO: 46044
  CDS (1)..(849): transl_table=11

SEQ ID NO: 64061 - protein, 282 aa, Borrelia garinii PBi; identical to SEQ ID NO: 46045

SEQ ID NO: 64062 - DNA, 930 bp, Bacillus licheniformis ATCC 14580; identical to SEQ ID NO: 46046
  CDS (1)..(930): transl_table=11

SEQ ID NO: 64063 - protein, 309 aa, Bacillus licheniformis ATCC 14580; identical to SEQ ID NO: 46047

SEQ ID NO: 64064 - DNA, 918 bp, Mannheimia succiniciproducens MBEL55E; identical to SEQ ID NO: 46048
  CDS (1)..(918): transl_table=11

SEQ ID NO: 64065 - protein, 305 aa, Mannheimia succiniciproducens MBEL55E; identical to SEQ ID NO: 46049

SEQ ID NO: 64066 - DNA, 921 bp, Nocardia farcinica IFM 10152; identical to SEQ ID NO: 46050
  CDS (1)..(921): transl_table=11

SEQ ID NO: 64067 - protein, 306 aa, Nocardia farcinica IFM 10152; identical to SEQ ID NO: 46051

SEQ ID NO: 64068 - DNA, 912 bp, Legionella pneumophila str. Paris; identical to SEQ ID NO: 46052
  CDS (1)..(912): transl_table=11

SEQ ID NO: 64069 - protein, 303 aa, Legionella pneumophila str. Paris; identical to SEQ ID NO: 46053

SEQ ID NO: 64070 - DNA, 945 bp, Haloarcula marismortui ATCC 43049; identical to SEQ ID NO: 46054
  CDS (1)..(945): transl_table=11

SEQ ID NO: 64071 - protein, 314 aa, Haloarcula marismortui ATCC 43049; identical to SEQ ID NO: 46055

SEQ ID NO: 64072 - DNA, 882 bp, Streptococcus thermophilus CNRZ1066; identical to SEQ ID NO: 46056
  CDS (1)..(882): transl_table=11

SEQ ID NO: 64073 - protein, 293 aa, Streptococcus thermophilus CNRZ1066; identical to SEQ ID NO: 46057

SEQ ID NO: 64074 - DNA, 858 bp, Geobacillus kaustophilus HTA426; identical to SEQ ID NO: 46058
  CDS (1)..(858): transl_table=11

SEQ ID NO: 64075 - protein, 285 aa, Geobacillus kaustophilus HTA426; identical to SEQ ID NO: 46059

SEQ ID NO: 64076 - DNA, 921 bp, Anaplasma marginale str. St. Maries; identical to SEQ ID NO: 46060
  CDS (1)..(921): transl_table=11

SEQ ID NO: 64077 - protein, 306 aa, Anaplasma marginale str. St. Maries; identical to SEQ ID NO: 46061

SEQ ID NO: 64078 - DNA, 933 bp, Idiomarina loihiensis L2TR; identical to SEQ ID NO: 46062
  CDS (1)..(933): transl_table=11

SEQ ID NO: 64079 - protein, 310 aa, Idiomarina loihiensis L2TR; identical to SEQ ID NO: 46063

SEQ ID NO: 64080 - DNA, 927 bp, Azoarcus sp. EbN1; identical to SEQ ID NO: 46064
  CDS (1)..(927): transl_table=11

SEQ ID NO: 64081 - protein, 308 aa, Azoarcus sp. EbN1; identical to SEQ ID NO: 46065

SEQ ID NO: 64082 - DNA, 912 bp, Zymomonas mobilis subsp. mobilis ZM4; identical to SEQ ID NO: 46066
  CDS (1)..(912): transl_table=11

SEQ ID NO: 64083 - protein, 303 aa, Zymomonas mobilis subsp. mobilis ZM4; identical to SEQ ID NO: 46067

SEQ ID NO: 64084 - DNA, 912 bp, Silicibacter pomeroyi DSS-3; identical to SEQ ID NO: 46068
  CDS (1)..(912): transl_table=11

SEQ ID NO: 64085 - protein, 303 aa, Silicibacter pomeroyi DSS-3; identical to SEQ ID NO: 46069

SEQ ID NO: 64086 - DNA, 909 bp, Francisella tularensis subsp. tularensis Schu 4; identical to SEQ ID NO: 46070
  CDS (1)..(909): transl_table=11

SEQ ID NO: 64087 - protein, 302 aa, Francisella tularensis subsp. tularensis Schu 4; identical to SEQ ID NO: 46071

SEQ ID NO: 64088 - DNA, 885 bp, Synechococcus elongatus PCC 6301; identical to SEQ ID NO: 46072
  CDS (1)..(885): transl_table=11

SEQ ID NO: 64089 - protein, 294 aa, Synechococcus elongatus PCC 6301; identical to SEQ ID NO: 46073

SEQ ID NO: 64090 - DNA, 909 bp, Bacillus clausii KSM-K16; identical to SEQ ID NO: 46074
  CDS (1)..(909): transl_table=11

SEQ ID NO: 64091 - protein, 302 aa, Bacillus clausii KSM-K16; identical to SEQ ID NO: 46075

SEQ ID NO: 64092 - DNA, 891 bp, Ehrlichia ruminantium str. Welgevonden; identical to SEQ ID NO: 46076
  CDS (1)..(891): transl_table=11

SEQ ID NO: 64093 - protein, 296 aa, Ehrlichia ruminantium str. Welgevonden; identical to SEQ ID NO: 46077

SEQ ID NO: 64094 - DNA, 903 bp, Dehalococcoides ethenogenes 195; identical to SEQ ID NO: 46078
  CDS (1)..(903): transl_table=11

SEQ ID NO: 64095 - protein, 300 aa, Dehalococcoides ethenogenes 195; identical to SEQ ID NO: 46079

SEQ ID NO: 64096 - DNA, 906 bp, Rhodobacter sphaeroides 2.4.1; identical to SEQ ID NO: 46080
  CDS (1)..(906)

SEQ ID NO: 64097 - protein, 301 aa, Rhodobacter sphaeroides 2.4.1; identical to SEQ ID NO: 46081

SEQ ID NO: 64098 - DNA, 903 bp, Xylella fastidiosa Ann-1; identical to SEQ ID NO: 46082
  CDS (1)..(903)

SEQ ID NO: 64099 - protein, 300 aa, Xylella fastidiosa Ann-1; identical to SEQ ID NO: 46083

SEQ ID NO: 64100 - DNA, 894 bp, Lactobacillus gasseri; identical to SEQ ID NO: 46084
  CDS (1)..(894)

SEQ ID NO: 64101 - protein, 297 aa, Lactobacillus gasseri; identical to SEQ ID NO: 46085

SEQ ID NO: 64102 - DNA, 1026 bp, Magnetospirillum magnetotacticum MS-1; identical to SEQ ID NO: 46086
  CDS (1)..(1026)

SEQ ID NO: 64103 - protein, 341 aa, Magnetospirillum magnetotacticum MS-1; identical to SEQ ID NO: 46087

SEQ ID NO: 64104 - DNA, 936 bp, Magnetospirillum magnetotacticum MS-1; identical to SEQ ID NO: 46088
  CDS (1)..(936)

SEQ ID NO: 64105 - protein, 311 aa, Magnetospirillum magnetotacticum MS-1; identical to SEQ ID NO: 46089

SEQ ID NO: 64106 - DNA, 909 bp, Leuconostoc mesenteroides subsp. mesenteroides ATCC 8293; identical to SEQ ID NO: 46090
  CDS (1)..(909)

SEQ ID NO: 64107 - protein, 302 aa, Leuconostoc mesenteroides subsp. mesenteroides ATCC 8293; identical to SEQ ID NO: 46091

SEQ ID NO: 64108 - DNA, 918 bp, Azotobacter vinelandii; identical to SEQ ID NO: 46092
  CDS (1)..(918)

SEQ ID NO: 64109 - protein, 305 aa, Azotobacter vinelandii; identical to SEQ ID NO: 46093

SEQ ID NO: 64110 - DNA, 885 bp, Nostoc punctiforme PCC 73102; identical to SEQ ID NO: 46094
  CDS (1)..(885)

SEQ ID NO: 64111 - protein, 294 aa, Nostoc punctiforme PCC 73102; identical to SEQ ID NO: 46095

SEQ ID NO: 64112 - DNA, 930 bp, Desulfovibrio desulfuricans G20; identical to SEQ ID NO: 46096
  CDS (1)..(930)

SEQ ID NO: 64113 - protein, 309 aa, Desulfovibrio desulfuricans G20; identical to SEQ ID NO: 46097

SEQ ID NO: 64114 - DNA, 918 bp, Actinobacillus pleuropneumoniae serovar 1 str. 4074; identical to SEQ ID NO: 46098
  CDS (1)..(918)

SEQ ID NO: 64115 - protein, 305 aa, Actinobacillus pleuropneumoniae serovar 1 str. 4074; identical to SEQ ID NO: 46099

SEQ ID NO: 64116 - DNA, 864 bp, Fusobacterium nucleatum subsp. vincentii ATCC 49256; identical to SEQ ID NO: 46100
  CDS (1)..(864): transl_table=11

SEQ ID NO: 64117 - protein, 287 aa, Fusobacterium nucleatum subsp. vincentii ATCC 49256; identical to SEQ ID NO: 46101

SEQ ID NO: 64118 - DNA, 1143 bp, Psychrobacter sp. 273-4; identical to SEQ ID NO: 46102
  CDS (1)..(1143)

SEQ ID NO: 64119 - protein, 380 aa, Psychrobacter sp. 273-4; identical to SEQ ID NO: 46103

SEQ ID NO: 64120 - DNA, 837 bp, Dechloromonas aromatica RCB; identical to SEQ ID NO: 46104
  CDS (1)..(837)

SEQ ID NO: 64121 - protein, 278 aa, Dechloromonas aromatica RCB; identical to SEQ ID NO: 46105

SEQ ID NO: 64122 - DNA, 921 bp, Haemophilus influenzae R2866; identical to SEQ ID NO: 46106
  CDS (1)..(921)

SEQ ID NO: 64123 - protein, 306 aa, Haemophilus influenzae R2866; identical to SEQ ID NO: 46107

SEQ ID NO: 64124 - DNA, 948 bp, Ralstonia eutropha JMP134; identical to SEQ ID NO: 46108
  CDS (1)..(948)

SEQ ID NO: 64125 - protein, 315 aa, Ralstonia eutropha JMP134; identical to SEQ ID NO: 46109

SEQ ID NO: 64126 - DNA, 909 bp, Methylobacillus flagellatus KT; identical to SEQ ID NO: 46110
  CDS (1)..(909)

SEQ ID NO: 64127 - protein, 302 aa, Methylobacillus flagellatus KT; identical to SEQ ID NO: 46111

SEQ ID NO: 64128 - DNA, 894 bp, Crocosphaera watsonii WH 8501; identical to SEQ ID NO: 46112
  CDS (1)..(894)

SEQ ID NO: 64129 - protein, 297 aa, Crocosphaera watsonii WH 8501; identical to SEQ ID NO: 46113

SEQ ID NO: 64130 - DNA, 909 bp, Exiguobacterium sp. 255-15; identical to SEQ ID NO: 46114
  CDS (1)..(909)

SEQ ID NO: 64131 - protein, 302 aa, Exiguobacterium sp. 255-15; identical to SEQ ID NO: 46115

SEQ ID NO: 64132 - DNA, 939 bp, Mesorhizobium sp. BNC1; identical to SEQ ID NO: 46116
  CDS (1)..(939)

SEQ ID NO: 64133 - protein, 312 aa, Mesorhizobium sp. BNC1; identical to SEQ ID NO: 46117

SEQ ID NO: 64134 - DNA, 798 bp, Rubrobacter xylanophilus DSM 9941; identical to SEQ ID NO: 46118
  CDS (1)..(798)

SEQ ID NO: 64135 - protein, 265 aa, Rubrobacter xylanophilus DSM 9941; identical to SEQ ID NO: 46119

SEQ ID NO: 64136 - DNA, 903 bp, Burkholderia cepacia R1808; identical to SEQ ID NO: 46120
  CDS (1)..(903)

SEQ ID NO: 64137 - protein, 300 aa, Burkholderia cepacia R1808; identical to SEQ ID NO: 46121

SEQ ID NO: 64138 - DNA, 876 bp, Kineococcus radiotolerans SRS30216; identical to SEQ ID NO: 46122
  CDS (1)..(876)

SEQ ID NO: 64139 - protein, 291 aa, Kineococcus radiotolerans SRS30216; identical to SEQ ID NO: 46123

SEQ ID NO: 64140 - DNA, 915 bp, Listeria monocytogenes str. 1/2a F6854; identical to SEQ ID NO: 46124
  CDS (1)..(915): transl_table=11

SEQ ID NO: 64141 - protein, 304 aa, Listeria monocytogenes str. 1/2a F6854; identical to SEQ ID NO: 46125

SEQ ID NO: 64142 - DNA, 1038 bp, Rubrivivax gelatinosus PM1; identical to SEQ ID NO: 46126
  CDS (1)..(1038)

SEQ ID NO: 64143 - protein, 345 aa, Rubrivivax gelatinosus PM1; identical to SEQ ID NO: 46127

SEQ ID NO: 64144 - DNA, 918 bp, Pseudomonas fluorescens PfO-1; identical to SEQ ID NO: 46128
  CDS (1)..(918)

SEQ ID NO: 64145 - protein, 305 aa, Pseudomonas fluorescens PfO-1; identical to SEQ ID NO: 46129

SEQ ID NO: 64146 - DNA, 927 bp, Rhodospirillum rubrum; identical to SEQ ID NO: 46130
  CDS (1)..(927)

SEQ ID NO: 64147 - protein, 308 aa, Rhodospirillum rubrum; identical to SEQ ID NO: 46131

SEQ ID NO: 64148 - DNA, 1002 bp, Enterococcus faecium; identical to SEQ ID NO: 46132
  CDS (1)..(1002)

SEQ ID NO: 64149 - protein, 333 aa, Enterococcus faecium; identical to SEQ ID NO: 46133

SEQ ID NO: 64150 - DNA, 960 bp, Magnetococcus sp. MC-1; identical to SEQ ID NO: 46134
  CDS (1)..(960)

SEQ ID NO: 64151 - protein, 319 aa, Magnetococcus sp. MC-1; identical to SEQ ID NO: 46135

SEQ ID NO: 64152 - DNA, 882 bp, Thermobifida fusca; identical to SEQ ID NO: 46136
  CDS (1)..(882)

SEQ ID NO: 64153 - protein, 293 aa, Thermobifida fusca; identical to SEQ ID NO: 46137

SEQ ID NO: 64154 - DNA, 1017 bp, Methanosarcina barkeri str. fusaro; identical to SEQ ID NO: 46138
  CDS (1)..(1017)

SEQ ID NO: 64155 - protein, 338 aa, Methanosarcina barkeri str. fusaro; identical to SEQ ID NO: 46139

SEQ ID NO: 64156 - DNA, 915 bp, Geobacter metallireducens GS-15; identical to SEQ ID NO: 46140
  CDS (1)..(915)

SEQ ID NO: 64157 - protein, 304 aa, Geobacter metallireducens GS-15; identical to SEQ ID NO: 46141

SEQ ID NO: 64158 - DNA, 915 bp, Novosphingobium aromaticivorans DSM 12444; identical to SEQ ID NO: 46142
  CDS (1)..(915)

SEQ ID NO: 64159 - protein, 304 aa, Novosphingobium aromaticivorans DSM 12444; identical to SEQ ID NO: 46143

SEQ ID NO: 64160 - DNA, 1056 bp, Ferroplasma acidarmanus; identical to SEQ ID NO: 46144
  CDS (1)..(1056)

SEQ ID NO: 64161 - protein, 351 aa, Ferroplasma acidarmanus; identical to SEQ ID NO: 46145

SEQ ID NO: 64162 - DNA, 678 bp, Cytophaga hutchinsonii; identical to SEQ ID NO: 46146
  CDS (1)..(678)

SEQ ID NO: 64163 - protein, 225 aa, Cytophaga hutchinsonii; identical to SEQ ID NO: 46147

SEQ ID NO: 64164 - DNA, 894 bp, Clostridium thermocellum ATCC 27405; identical to SEQ ID NO: 46148
  CDS (1)..(894)

SEQ ID NO: 64165 - protein, 297 aa, Clostridium thermocellum ATCC 27405; identical to SEQ ID NO: 46149

SEQ ID NO: 64166 - DNA, 942 bp, Microbulbifer degradans 2-40; identical to SEQ ID NO: 46150
  CDS (1)..(942)

SEQ ID NO: 64167 - protein, 313 aa, Microbulbifer degradans 2-40; identical to SEQ ID NO: 46151

SEQ ID NO: 64168 - DNA, 897 bp, Oenococcus oeni PSU-1; identical to SEQ ID NO: 46152
  CDS (1)..(897)

SEQ ID NO: 64169 - protein, 298 aa, Oenococcus oeni PSU-1; identical to SEQ ID NO: 46153

SEQ ID NO: 64170 - DNA, 900 bp, Pediococcus pentosaceus ATCC 25745; identical to SEQ ID NO: 46154
  CDS (1)..(900)

SEQ ID NO: 64171 - protein, 299 aa, Pediococcus pentosaceus ATCC 25745; identical to SEQ ID NO: 46155

SEQ ID NO: 64172 - DNA, 906 bp, Trichodesmium erythraeum IMS101; identical to SEQ ID NO: 46156
  CDS (1)..(906)

SEQ ID NO: 64173 - protein, 301 aa, Trichodesmium erythraeum IMS101; identical to SEQ ID NO: 46157

SEQ ID NO: 64174 - DNA, 918 bp, Moorella thermoacetica ATCC 39073; identical to SEQ ID NO: 46158
  CDS (1)..(918)

SEQ ID NO: 64175 - protein, 305 aa, Moorella thermoacetica ATCC 39073; identical to SEQ ID NO: 46159

SEQ ID NO: 64176 - DNA, 879 bp, Streptococcus suis 89/1591; identical to SEQ ID NO: 46160
  CDS (1)..(879)

SEQ ID NO: 64177 - protein, 292 aa, Streptococcus suis 89/1591; identical to SEQ ID NO: 46161

SEQ ID NO: 64178 - DNA, 897 bp, Thiobacillus denitrificans ATCC 25259; identical to SEQ ID NO: 46162
  CDS (1)..(897)

SEQ ID NO: 64179 - protein, 298 aa, Thiobacillus denitrificans ATCC 25259; identical to SEQ ID NO: 46163

SEQ ID NO: 64180 - DNA, 909 bp, Silicibacter sp. TM1040; identical to SEQ ID NO: 46164
  CDS (1)..(909)

SEQ ID NO: 64181 - protein, 302 aa, Silicibacter sp. TM1040; identical to SEQ ID NO: 46165

SEQ ID NO: 64182 - DNA, 873 bp, Chloroflexus aurantiacus; identical to SEQ ID NO: 46166
  CDS (1)..(873)

SEQ ID NO: 64183 - protein, 290 aa, Chloroflexus aurantiacus; identical to SEQ ID NO: 46167

SEQ ID NO: 64184 - DNA, 969 bp, Polaromonas sp. JS666; identical to SEQ ID NO: 46168
  CDS (1)..(969)

SEQ ID NO: 64185 - protein, 322 aa, Polaromonas sp. JS666; identical to SEQ ID NO: 46169

SEQ ID NO: 64186 - DNA, 957 bp, Acinetobacter sp; identical to SEQ ID NO: 46170
  CDS (1)..(957): transl_table=11

SEQ ID NO: 64187 - protein, 318 aa, Acinetobacter sp; identical to SEQ ID NO: 46171

SEQ ID NO: 64188 - DNA, 948 bp, Agrobacterium tumefaciens; identical to SEQ ID NO: 46172
  CDS (1)..(948): transl_table=11

SEQ ID NO: 64189 - protein, 315 aa, Agrobacterium tumefaciens; identical to SEQ ID NO: 46173

SEQ ID NO: 64190 - DNA, 882 bp, Anabaena sp; identical to SEQ ID NO: 46174
  CDS (1)..(882)

SEQ ID NO: 64191 - protein, 293 aa, Anabaena sp; identical to SEQ ID NO: 46175

SEQ ID NO: 64192 - DNA, 864 bp, Aquifex aeolicus; identical to SEQ ID NO: 46176
  CDS (1)..(864): transl_table=11

SEQ ID NO: 64193 - protein, 287 aa, Aquifex aeolicus; identical to SEQ ID NO: 46177

SEQ ID NO: 64194 - DNA, 978 bp, Archaeoglobus fulgidus; identical to SEQ ID NO: 46178
  CDS (1)..(978): transl_table=11

SEQ ID NO: 64195 - protein, 325 aa, Archaeoglobus fulgidus; identical to SEQ ID NO: 46179

SEQ ID NO: 64196 - DNA, 930 bp, Bacillus subtilis; identical to SEQ ID NO: 46180
  CDS (1)..(930): transl_table=11

SEQ ID NO: 64197 - protein, 309 aa, Bacillus subtilis; identical to SEQ ID NO: 46181

SEQ ID NO: 64198 - DNA, 960 bp, Bartonella henselae; identical to SEQ ID NO: 46182
  CDS (1)..(960): transl_table=11

SEQ ID NO: 64199 - protein, 319 aa, Bartonella henselae; identical to SEQ ID NO: 46183

SEQ ID NO: 64200 - DNA, 927 bp, Bdellovibrio bacteriovorus; identical to SEQ ID NO: 46184
  CDS (1)..(927): transl_table=11

SEQ ID NO: 64201 - protein, 308 aa, Bdellovibrio bacteriovorus; identical to SEQ ID NO: 46185

SEQ ID NO: 64202 - DNA, 1038 bp, Bradyrhizobium japonicum; identical to SEQ ID NO: 46186
  CDS (1)..(1038)

SEQ ID NO: 64203 - protein, 345 aa, Bradyrhizobium japonicum; identical to SEQ ID NO: 46187

SEQ ID NO: 64204 - DNA, 975 bp, Brucella suis; identical to SEQ ID NO: 46188
  CDS (1)..(975)

SEQ ID NO: 64205 - protein, 324 aa, Brucella suis; identical to SEQ ID NO: 46189

SEQ ID NO: 64206 - DNA, 939 bp, Buchnera aphidicola; identical to SEQ ID NO: 46190
  CDS (1)..(939): transl_table=11

SEQ ID NO: 64207 - protein, 312 aa, Buchnera aphidicola; identical to SEQ ID NO: 46191

SEQ ID NO: 64208 - DNA, 933 bp, Caulobacter crescentus; identical to SEQ ID NO: 46192
  CDS (1)..(933): transl_table=11

SEQ ID NO: 64209 - protein, 310 aa, Caulobacter crescentus; identical to SEQ ID NO: 46193

SEQ ID NO: 64210 - DNA, 870 bp, Clostridium acetobutylicum; identical to SEQ ID NO: 46194
  CDS (1)..(870): transl_table=11

SEQ ID NO: 64211 - protein, 289 aa, Clostridium acetobutylicum; identical to SEQ ID NO: 46195

SEQ ID NO: 64212 - DNA, 885 bp, Clostridium perfringens; identical to SEQ ID NO: 46196
  CDS (1)..(885)

SEQ ID NO: 64213 - protein, 294 aa, Clostridium perfringens; identical to SEQ ID NO: 46197

SEQ ID NO: 64214 - DNA, 870 bp, Clostridium tetani; identical to SEQ ID NO: 46198
  CDS (1)..(870): transl_table=11

SEQ ID NO: 64215 - protein, 289 aa, Clostridium tetani; identical to SEQ ID NO: 46199

SEQ ID NO: 64216 - DNA, 903 bp, Corynebacterium diphtheriae; identical to SEQ ID NO: 46200
  CDS (1)..(903): transl_table=11

SEQ ID NO: 64217 - protein, 300 aa, Corynebacterium diphtheriae; identical to SEQ ID NO: 46201

SEQ ID NO: 64218 - DNA, 894 bp, Corynebacterium efficiens; identical to SEQ ID NO: 46202
  CDS (1)..(894)

SEQ ID NO: 64219 - protein, 297 aa, Corynebacterium efficiens; identical to SEQ ID NO: 46203

SEQ ID NO: 64220 - DNA, 894 bp, Corynebacterium glutamicum; identical to SEQ ID NO: 46204
  CDS (1)..(894): transl_table=11

SEQ ID NO: 64221 - protein, 297 aa, Corynebacterium glutamicum; identical to SEQ ID NO: 46205

SEQ ID NO: 64222 - DNA, 927 bp, Deinococcus radiodurans; identical to SEQ ID NO: 46206
  CDS (1)..(927): transl_table=11

SEQ ID NO: 64223 - protein, 308 aa, Deinococcus radiodurans; identical to SEQ ID NO: 46207

SEQ ID NO: 64224 - DNA, 915 bp, Desulfovibrio vulgaris; identical to SEQ ID NO: 46208
  CDS (1)..(915): transl_table=11

SEQ ID NO: 64225 - protein, 304 aa, Desulfovibrio vulgaris; identical to SEQ ID NO: 46209

SEQ ID NO: 64226 - DNA, 945 bp, Erwinia carotovora; identical to SEQ ID NO: 46210
  CDS (1)..(945): transl_table=11

SEQ ID NO: 64227 - protein, 314 aa, Erwinia carotovora; identical to SEQ ID NO: 46211

SEQ ID NO: 64228 - DNA, 864 bp, Fusobacterium nucleatum; identical to SEQ ID NO: 46212
  CDS (1)..(864): transl_table=11

SEQ ID NO: 64229 - protein, 287 aa, Fusobacterium nucleatum; identical to SEQ ID NO: 46213

SEQ ID NO: 64230 - DNA, 915 bp, Geobacter sulfurreducens; identical to SEQ ID NO: 46214
  CDS (1)..(915): transl_table=11

SEQ ID NO: 64231 - protein, 304 aa, Geobacter sulfurreducens; identical to SEQ ID NO: 46215

SEQ ID NO: 64232 - DNA, 906 bp, Halobacterium sp; identical to SEQ ID NO: 46216
  CDS (1)..(906): transl_table=11

SEQ ID NO: 64233 - protein, 301 aa, Halobacterium sp; identical to SEQ ID NO: 46217

SEQ ID NO: 64234 - DNA, 894 bp, Lactobacillus johnsonii; identical to SEQ ID NO: 46218
  CDS (1)..(894): transl_table=11

SEQ ID NO: 64235 - protein, 297 aa, Lactobacillus johnsonii; identical to SEQ ID NO: 46219

SEQ ID NO: 64236 - DNA, 990 bp, Lactococcus lactis; identical to SEQ ID NO: 46220
  CDS (1)..(990): transl_table=11

SEQ ID NO: 64237 - protein, 329 aa, Lactococcus lactis; identical to SEQ ID NO: 46221

SEQ ID NO: 64238 - DNA, 924 bp, Lactobacillus plantarum; identical to SEQ ID NO: 46222
  CDS (1)..(924): transl_table=11

SEQ ID NO: 64239 - protein, 307 aa, Lactobacillus plantarum; identical to SEQ ID NO: 46223

SEQ ID NO: 64240 - DNA, 915 bp, Listeria monocytogenes; identical to SEQ ID NO: 46224
  CDS (1)..(915): transl_table=11

SEQ ID NO: 64241 - protein, 304 aa, Listeria monocytogenes; identical to SEQ ID NO: 46225

SEQ ID NO: 64242 - DNA, 861 bp, Mesoplasma florum; identical to SEQ ID NO: 46226
  CDS (1)..(861): transl_table=4

SEQ ID NO: 64243 - protein, 286 aa, Mesoplasma florum; identical to SEQ ID NO: 46227

SEQ ID NO: 64244 - DNA, 1017 bp, Methanosarcina acetivorans; identical to SEQ ID NO: 46228
  CDS (1)..(1017): transl_table=11

SEQ ID NO: 64245 - protein, 338 aa, Methanosarcina acetivorans; identical to SEQ ID NO: 46229

SEQ ID NO: 64246 - DNA, 1017 bp, Methanopyrus kandleri; identical to SEQ ID NO: 46230
  CDS (1)..(1017): transl_table=11

SEQ ID NO: 64247 - protein, 338 aa, Methanopyrus kandleri; identical to SEQ ID NO: 46231

SEQ ID NO: 64248 - DNA, 1017 bp, Methanosarcina mazei; identical to SEQ ID NO: 46232
  CDS (1)..(1017): transl_table=11

SEQ ID NO: 64249 - protein, 338 aa, Methanosarcina mazei; identical to SEQ ID NO: 46233

SEQ ID NO: 64250 - DNA, 897 bp, Mycobacterium bovis; identical to SEQ ID NO: 46234
  CDS (1)..(897): transl_table=11

SEQ ID NO: 64251 - protein, 298 aa, Mycobacterium bovis; identical to SEQ ID NO: 46235

SEQ ID NO: 64252 - DNA, 963 bp, Mycobacterium leprae; identical to SEQ ID NO: 46236
  CDS (1)..(963): transl_table=11

SEQ ID NO: 64253 - protein, 320 aa, Mycobacterium leprae; identical to SEQ ID NO: 46237

SEQ ID NO: 64254 - DNA, 924 bp, Neisseria meningitidis; identical to SEQ ID NO: 46238
  CDS (1)..(924): transl_table=11

SEQ ID NO: 64255 - protein, 307 aa, Neisseria meningitidis; identical to SEQ ID NO: 46239

SEQ ID NO: 64256 - DNA, 927 bp, Nitrosomonas europaea; identical to SEQ ID NO: 46240
  CDS (1)..(927): transl_table=11

SEQ ID NO: 64257 - protein, 308 aa, Nitrosomonas europaea; identical to SEQ ID NO: 46241

SEQ ID NO: 64258 - DNA, 912 bp, Oceanobacillus iheyensis; identical to SEQ ID NO: 46242
  CDS (1)..(912)

SEQ ID NO: 64259 - protein, 303 aa, Oceanobacillus iheyensis; identical to SEQ ID NO: 46243

SEQ ID NO: 64260 - DNA, 924 bp, Pasteurella multocida; identical to SEQ ID NO: 46244
  CDS (1)..(924): transl_table=11

SEQ ID NO: 64261 - protein, 307 aa, Pasteurella multocida; identical to SEQ ID NO: 46245

SEQ ID NO: 64262 - DNA, 948 bp, Photorhabdus luminescens; identical to SEQ ID NO: 46246
  CDS (1)..(948): transl_table=11

SEQ ID NO: 64263 - protein, 315 aa, Photorhabdus luminescens; identical to SEQ ID NO: 46247

SEQ ID NO: 64264 - DNA, 951 bp, Photobacterium profundum; identical to SEQ ID NO: 46248
  CDS (1)..(951): transl_table=11

SEQ ID NO: 64265 - protein, 316 aa, Photobacterium profundum; identical to SEQ ID NO: 46249

SEQ ID NO: 64266 - DNA, 963 bp, Prochlorococcus marinus; identical to SEQ ID NO: 46250
  CDS (1)..(963): transl_table=11

SEQ ID NO: 64267 - protein, 320 aa, Prochlorococcus marinus; identical to SEQ ID NO: 46251

SEQ ID NO: 64268 - DNA, 918 bp, Prochlorococcus marinus subsp; identical to SEQ ID NO: 46252
  CDS (1)..(918): transl_table=11

SEQ ID NO: 64269 - protein, 305 aa, Prochlorococcus marinus subsp; identical to SEQ ID NO: 46253

SEQ ID NO: 64270 - DNA, 915 bp, Pseudomonas aeruginosa; identical to SEQ ID NO: 46254
  CDS (1)..(915): transl_table=11

SEQ ID NO: 64271 - protein, 304 aa, Pseudomonas aeruginosa; identical to SEQ ID NO: 46255

SEQ ID NO: 64272 - DNA, 1005 bp, Pyrococcus abyssi; identical to SEQ ID NO: 46256
  CDS (1)..(1005): transl_table=11

SEQ ID NO: 64273 - protein, 334 aa, Pyrococcus abyssi; identical to SEQ ID NO: 46257

SEQ ID NO: 64274 - DNA, 1005 bp, Pyrococcus horikoshii; identical to SEQ ID NO: 46258
  CDS (1)..(1005)

SEQ ID NO: 64275 - protein, 334 aa, Pyrococcus horikoshii; identical to SEQ ID NO: 46259

SEQ ID NO: 64276 - DNA, 936 bp, Rhizobium meliloti; identical to SEQ ID NO: 46260
  CDS (1)..(936): transl_table=11

SEQ ID NO: 64277 - protein, 311 aa, Rhizobium meliloti; identical to SEQ ID NO: 46261

SEQ ID NO: 64278 - DNA, 1047 bp, Rhodopirellula baltica; identical to SEQ ID NO: 46262
  CDS (1)..(1047): transl_table=11

SEQ ID NO: 64279 - protein, 348 aa, Rhodopirellula baltica; identical to SEQ ID NO: 46263

SEQ ID NO: 64280 - DNA, 1101 bp, Rhodopseudomonas palustris; identical to SEQ ID NO: 46264
  CDS (1)..(1101): transl_table=11

SEQ ID NO: 64281 - protein, 366 aa, Rhodopseudomonas palustris; identical to SEQ ID NO: 46265

SEQ ID NO: 64282 - DNA, 1038 bp, Rickettsia conorii; identical to SEQ ID NO: 46266
  CDS (1)..(1038): transl_table=11

SEQ ID NO: 64283 - protein, 345 aa, Rickettsia conorii; identical to SEQ ID NO: 46267

SEQ ID NO: 64284 - DNA, 945 bp, Salmonella typhimurium; identical to SEQ ID NO: 46268
  CDS (1)..(945): transl_table=11

SEQ ID NO: 64285 - protein, 314 aa, Salmonella typhimurium; identical to SEQ ID NO: 46269

SEQ ID NO: 64286 - DNA, 906 bp, Streptomyces avermitilis; identical to SEQ ID NO: 46270
  CDS (1)..(906): transl_table=11

SEQ ID NO: 64287 - protein, 301 aa, Streptomyces avermitilis; identical to SEQ ID NO: 46271

SEQ ID NO: 64288 - DNA, 864 bp, Synechococcus elongatus; identical to SEQ ID NO: 46272
  CDS (1)..(864)

SEQ ID NO: 64289 - protein, 287 aa, Synechococcus elongatus; identical to SEQ ID NO: 46273

SEQ ID NO: 64290 - DNA, 885 bp, Synechococcus sp; identical to SEQ ID NO: 46274
  CDS (1)..(885): transl_table=11

SEQ ID NO: 64291 - protein, 294 aa, Synechococcus sp; identical to SEQ ID NO: 46275

SEQ ID NO: 64292 - DNA, 891 bp, Synechocystis sp; identical to SEQ ID NO: 46276
  CDS (1)..(891)

SEQ ID NO: 64293 - protein, 296 aa, Synechocystis sp; identical to SEQ ID NO: 46277

SEQ ID NO: 64294 - DNA, 1098 bp, Thermoplasma acidophilum; identical to SEQ ID NO: 46278
  CDS (1)..(1098)

SEQ ID NO: 64295 - protein, 365 aa, Thermoplasma acidophilum; identical to SEQ ID NO: 46279

SEQ ID NO: 64296 - DNA, 930 bp, Thermotoga maritima; identical to SEQ ID NO: 46280
  CDS (1)..(930): transl_table=11

SEQ ID NO: 64297 - protein, 309 aa, Thermotoga maritima; identical to SEQ ID NO: 46281

SEQ ID NO: 64298 - DNA, 858 bp, Thermoanaerobacter tengcongensis; identical to SEQ ID NO: 46282
  CDS (1)..(858): transl_table=11

SEQ ID NO: 64299 - protein, 285 aa, Thermoanaerobacter tengcongensis; identical to SEQ ID NO: 46283

SEQ ID NO: 64300 - DNA, 1062 bp, Thermoplasma volcanium; identical to SEQ ID NO: 46284
  CDS (1)..(1062)

SEQ ID NO: 64301 - protein, 353 aa, Thermoplasma volcanium; identical to SEQ ID NO: 46285

SEQ ID NO: 64302 - DNA, 1152 bp, Tropheryma whipplei; identical to SEQ ID NO: 46286
  CDS (1)..(1152): transl_table=11

SEQ ID NO: 64303 - protein, 383 aa, Tropheryma whipplei; identical to SEQ ID NO: 46287

SEQ ID NO: 64304 - DNA, 939 bp, Vibrio cholerae; identical to SEQ ID NO: 46288
  CDS (1)..(939): transl_table=11

SEQ ID NO: 64305 - protein, 312 aa, Vibrio cholerae; identical to SEQ ID NO: 46289

SEQ ID NO: 64306 - DNA, 984 bp, Wigglesworthia glossinidia brevipalpis; identical to SEQ ID NO: 46290
  CDS (1)..(984)

SEQ ID NO: 64307 - protein, 327 aa, Wigglesworthia glossinidia brevipalpis; identical to SEQ ID NO: 46291

SEQ ID NO: 64308 - DNA, 876 bp, Wolinella succinogenes; identical to SEQ ID NO: 46292
  CDS (1)..(876): transl_table=11

SEQ ID NO: 64309 - protein, 291 aa, Wolinella succinogenes; identical to SEQ ID NO: 46293

SEQ ID NO: 64310 - DNA, 927 bp, Xanthomonas campestris; identical to SEQ ID NO: 46294
  CDS (1)..(927): transl_table=11

SEQ ID NO: 64311 - protein, 308 aa, Xanthomonas campestris; identical to SEQ ID NO: 46295

SEQ ID NO: 64312 - DNA, 930 bp, Yersinia enterocolitica; identical to SEQ ID NO: 46296
  CDS (1)..(930)

SEQ ID NO: 64313 - protein, 309 aa, Yersinia enterocolitica; identical to SEQ ID NO: 46297

SEQ ID NO: 64314 - DNA, 975 bp, Yersinia pestis; identical to SEQ ID NO: 46298
  CDS (1)..(975): transl_table=11

SEQ ID NO: 64315 - protein, 324 aa, Yersinia pestis; identical to SEQ ID NO: 46299

SEQ ID NO: 64316 - DNA, 21 bp, Primer
atgagtcgtcctcgtcgtcgc

SEQ ID NO: 64317 - DNA, 22 bp, Primer
ttacgccgggtattcaaccacc

SEQ ID NO: 64318 - protein, 384 aa, consensus; identical to SEQ ID NO: 46302
  MISC_FEATURE (1)..(384): consensus for the disclosure of xaa see table XV

SEQ ID NO: 64319 - protein, 71 aa, consensus; identical to SEQ ID NO: 46303
  MISC_FEATURE (1)..(71): consensus for the disclosure of xaa see table XV

SEQ ID NO: 64320 - protein, 26 aa, consensus
  MISC_FEATURE (1)..(26): consensus for the disclosure of xaa see table XV
GXYXRXXXXXXXXXXXXXXXXXXLXR

SEQ ID NO: 64321 - DNA, 1488 bp, Escherichia coli
  CDS (1)..(1488)
atgaacaaagaaattttggctgtagttgaagccgtatccaatgaaaaggcgctacctcgcgagaagattttcgaagcattggaaagcgcgctggcgacagcaacaaagaaaaaatatgaacaagagatcgacgtccgcgtacagatcgatcgcaaaagcggtgattttgacaccttccgtcgctggttagttgttgatgaagtcacccagccgaccaaggaaatcacccttgaagccgcacgttatgaagatgaaagcctgaacctgggcgattacgttgaagatcagattgagtctgttacctttgaccgtatcaccacccagacggcaaaacaggttatcgtgcagaaagtgcgtgaagccgaacgtgcgatggtggttgatcagttccgtgaacacgaaggtgaaatcatcaccggcgtggtgaaaaaagtaaaccgcgacaacatctctctggatctgggcaacaacgctgaagccgtgatcctgcgcgaagatatgctgccgcgtgaaaacttccgccctggcgaccgcgttcgtggcgtgctttattccgttcgcccggaagcgcgtggcgcgcaactgttcgtcactcgttccaagccggaaatgctgatcgaactgttccgtattgaagtgccagaaatcggcgaagaagtgattgaaattaaagcagcggctcgcgacccgggttctcgtgcgaaaatcgcggtgaaaaccaacgataaacgtatcgatccggtaggtgcttgcgtaggtatgcgtggcgcgcgtgttcaggcggtttctactgaactgggcggcgagcgtatcgatatcgtcctgtgggatgataacccggcgcagtttgtgattaacgcaatggcaccggcagacgttgcttctatcgtggtggatgaagataaacacaccatggatatcgccgttgaagccggtaacctggcgcaggcgattggccgtaacggtcagaacgtgcgtctggcttcgcagctgagcggttgggaactcaacgtgatgaccgttgacgacctgcaggctaagcatcaggcggaagcgcacgcagcgatcgacaccttcaccaaatatctcgacatcgacgaagacttcgcgactgttctggtagaggaaggcttctcgacgctggaagaactggcctatgtgccgatgaaagagctgttggaaatcgaaggccttgatgagccgaccgttgaagcactgcgcgagcgtgctaaaaatgcactggccaccattgcacaggcccaggaagaaagcctcggtgataacaaaccggctgacgatctgctgaaccttgaaggggtagatcgtgatttggcattcaaactggccgcccgtggcgtttgtacgctggaagatctcgccgaacagggcattgatgatctggctgatatcgaagggttgaccgacgaaaaagccggagcactgattatggctgcccgtaatatttgctggttcggtgacgaagcgtaa

SEQ ID NO: 64322 - protein, 495 aa, Escherichia coli [sequence omitted]

SEQ ID NO: 64323 - DNA, 1554 bp, Gluconobacter oxydans 621H
  CDS (1)..(1554)
atggacacgtctgttacacgtcccgaactgctgctggttgccgatgcagtatcccgcgagaagaacatcgaccgcgaggaagtgctcgaagccatggagcaggccatccagaaggctggccgcgcgaagtacgggcatgaaaaggacatccgtgcgacgatcgaccgcaagacgggcgaagtccgtctgagccgctggaccgaagcggtcgagcatgtggagaacgaggacacccagatcccgctgcacatcgcccgcaagttccagccggaaatccaggccggcgagcatctggtcgatccgctgcccccgatcgatttcggccgtatcgcagcgcagacggccaagcaggtcattgtgcagcgggtgcgcgagtacgagcgcaagcgccagtacaacgagttcaaggaccgcgtgggcgagatcgtcaacggaacggtcaagcgtaccgagtacggcaacctcatggtcgagatcggccatacggaagccctgctgcgtcgcgacgagctgatcccccgcgaatccttccgcaattccgaccgcgtccgcgcttacatctatgatgtgcgtgacgagccgcgcggcccgcagatcttcctgtcccgcacgcatccggccttcctggccaagctgttcgcgcaggaagttccggaaatctacgacggcatcatcgagatcaaggccgtgtcccgtgatccgggatcgcgcgccaaaatggccgtgatttcccgcgatgcggcaatcgacccggtcggtgcctgcgtcggtatgcgcggctcccgcgttcaggctgtcgtggccgaactgcagggcgagaagatcgacatcatcccctggagcccgcaggctgcgaccttcgtcgtcaacgcgctggccccggctgaagtcagtaaggtggtgatggatgaggaagccggccgcgtcgaagttgtggtgccggacgagcagctttcgctcgccatcggtcgccgtggccagaacgtgcgtctggccagccagctgacacgctgggacatcgacatcctgacggaggccgaggaatcggagcgtcgtcaggaagagttccgcaagcgctcctcgcagttcgtcgaggcgctggacgtcgatgacgtgattgcaggcctgctggtgacggaaggcttccacacgatcgaggaactggcctacaccgatccgggcgagctgaacgatattgaaggctttgacgagagcgtggccgaagagctcatgcatcgcgctaacgactatctggccagcaaggaacaggccctggacgaccagcgcaaggcgctgggtgtcacggatgacgtggccgagctgggaacatttacgaaccagatgctggtgacgctgggtgagaagggtgtgaagacgctcgacgatctggcggatctggctggtgacgagctggtggagatcctcggtgaggaggccatcgacgaagatgccgccaacgagattatcatggcagcgcgtgcacactggttcgatggtgaagaagccgactcggcaaagcccgaaaatggtgacggggagtcgaccgacgtctga

SEQ ID NO: 64324 - protein, 517 aa, Gluconobacter oxydans 621H
MDTSVTRPELLLVADAVSREKNIDREEVLEAMEQAIQKAGRAKYGHEKDIRATIDRKTGEVRLSRWTEAVEHVENEDTQIPLHIARKFQPEIQAGEHLVDPLPPIDFGRIAAQTAKQVIVQRVREYERKRQYNEFKDRVGEIVNGTVKRTEYGNLMVEIGHTEALLRRDELIPRESFRNSDRVRAYIYDVRDEPRGPQIFLSRTHPAFLAKLFAQEVPEIYDGIIEIKAVSRDPGSRAKMAVISRDAAIDPVGACVGMRGSRVQAVVAELQGEKIDIIPWSPQAATFVVNALAPAEVSKVVMDEEAGRVEVVVPDEQLSLAIGRRGQNVRLASQLTRWDIDILTEAEESERRQEEFRKRSSQFVEALDVDDVIAGLLVTEGFHTIEELAYTDPGELNDIEGFDESVAEELMHRANDYLASKEQALDDQRKALGVTDDVAELGTFTNQMLVTLGEKGVKTLDDLADLAGDELVEILGEEAIDEDAANEIIMAARAHWFDGEEADSAKPENGDGESTDV

SEQ ID NO: 64325 - DNA, 1170 bp, Lactobacillus acidophilus NCFM
  CDS (1)..(1170)
atgtctaaagaaatgctagaagcgttcgctacattggaaaagaacaagggcattgaacaagatgttattgttgatgcaattaaggccgctttggtagctgcatacaagaaaaattataatcaagcacaaaacgttgaagttgattttgatgagagaaaaggcaattttaaagttatggcagttaagactgttgttgatgaagttcaagatgatcgccttgaagttagcttaaaagatgctttggcaatcaaccgtgcttatgaagtaggcgatgaaattcgttttgaagttactccaaagaattttggtcgtattgctgctcaaactgcaaagcaagtaattatgcaacgtcttcgtgaagctgaaagaaatcatattattgatgaatattctcaatacgaagatgaacttgtcactggtacagttgaaagacgcgacaatcgttttgtctatgtgaagattggtaacgttgaagcagtaatgcctcatcgtgatcaaatgccaaatgaagtttataacccacaagatcaaattcgtgtgcttgtaactcatgttggctcagattctaagggagcacaaatcactgtttcaagaactgcaccagatatggtaaagcgcttgtttgaacaagaagttcctgaaatttacgatggaactgttgaaattgtttcaatcgcgcgcgaagctggtgaccgtacaaagatggcagttaagtcaaatgaccctaatattgaccctgttggtacttgcgttggtcaaaagggtgcacgtgtacaaaatgtagttaatgaacttggtggagaaaatattgatattgtaaaatatgaagaagatccatctgactatattgctaatgcattgaatcctgctgaagtaattgctgttcaatttggcgaagacgaggaggaaaagagtgcgttagttattgtcccagattaccaattatcacttgctattggtaaaaaaggacaaaacgtacgtcttgcagctcgtttaacaggctataaaattgatattcgaccagagtctgaagtagaatttgttgatgaaaagtcaactgattctgtaagtaaagaagatacagattcttctgaagatgttgtatctactgaagaatcaactgctgatgtaactactgaagaaaaaagcgaagataacactgaagaatag

SEQ ID NO: 64326 - protein, 389 aa, Lactobacillus acidophilus NCFM
MSKEMLEAFATLEKNKGIEQDVIVDAIKAALVAAYKKNYNQAQNVEVDFDERKGNFKVMAVKTVVDEVQDDRLEVSLKDALAINRAYEVGDEIRFEVTPKNFGRIAAQTAKQVIMQRLREAERNHIIDEYSQYEDELVTGTVERRDNRFVYVKIGNVEAVMPHRDQMPNEVYNPQDQIRVLVTHVGSDSKGAQITVSRTAPDMVKRLFEQEVPEIYDGTVEIVSIAREAGDRTKMAVKSNDPNIDPVGTCVGQKGARVQNVVNELGGENIDIVKYEEDPSDYIANALNPAEVIAVQFGEDEEEKSALVIVPDYQLSLAIGKKGQNVRLAARLTGYKIDIRPESEVEFVDEKSTDSVSKEDTDSSEDVVSTEESTADVTTEEKSEDNTEE

SEQ ID NO: 64327 - DNA, 1563 bp, Wolbachia endosymbiont strain TRS of Brugia malayi
  CDS (1)..(1563)
atgattgctgatcgcaaaagaagtgttaaacagaaaagtgacaaaaataacttagtaggaaatcttgatataataaagacagcgggggagatttcacttcagaaaggtctagattttgaagttataatgaaagcattagaaagtgctatagaagcagtagcttatcaaaagtatggtagcaaaagtaaggttgtggttaatatagatagaagcacaggtgaggttatttcgtacagagaattaaaggtcgttgatgatgaaccaaatggagaagagcataacggatatgggtcaattacgcttacacaagccaaattaataaaggaggatgcaaaagttggagacactattaatgaattgctctctcttaatactgatcttgcctcagcaagaattgcccagcaaaggattgctcaagtaattaaatatgaagagttaaagaagcaatatgaagaatttaaggacaaagtaggggaaataaggtatggtattgttaaacaagtagaatattcagatctgattatagacataaatggtactagggcatatcttccattgcgaaatttaatcggtggtgaattatttcgcgaaggtgataagattaaagcttatatacaaactgttaagcgctctgacgatggacgtcaaattattctttctcgggcaagtgaaggctttttggaggcattactaagtcaggagataccggagattgctgatgggttagtgacagttaagggtatagctagagatgctggttcaaggtccaaagttgccgttttctctcccgataagaatattgatccagtaggtgcatgtgttggagttaagggagagagaataaaagccatcatacatgaattaaatggtgaaaaaattgatgtcgtgcattacttttcagacttaggccaatttgttattaaagcaatcactcctgcggaagtatcgaaggttattattgatgaaagtgaaaattgcgtagaactaatagtcgctgaagatcaattgagtttggcaataggaaaaaagggtcaaaatgtgagactagcttcggagcttattgggtggaagattgagatactaagcactcaacaagaatcggaaaggcgcaatagagagcttagtcagtgttcagctctattcgctgaagctttaaacttagaggagattatgggtcaactgttagtcacagaaggcttttcaagtgtagaagatatatcgaatgcttccattaaagagcttgcttcaatagaaggctttaacgaggatattgcaagtgaactgcgtaacagggcaaatagatatctaaaagcagaaaatgatagaaaaatagaagagttaaaaagtttaggtatggaaagtgatgtgatcaatttacctttatcaatagatgataaaattgctcttagtgaacatggtattaaaactttagaaaacatagcagatttgtcaagctatgaattttgtagtatactttcttcttcagcgagtgataaagaaaacttaaaaaacacagtgaactcaataatcatggaagcgcgcaagaagcttggtgtaatataa

SEQ ID NO: 64328 - protein, 520 aa, Wolbachia endosymbiont strain TRS of Brugia malayi
MIADRKRSVKQKSDKNNLVGNLDIIKTAGEISLQKGLDFEVIMKALESAIEAVAYQKYGSKSKVVVNIDRSTGEVISYRELKVVDDEPNGEEHNGYGSITLTQAKLIKEDAKVGDTINELLSLNTDLASARIAQQRIAQVIKYEELKKQYEEFKDKVGEIRYGIVKQVEYSDLIIDINGTRAYLPLRNLIGGELFREGDKIKAYIQTVKRSDDGRQIILSRASEGFLEALLSQEIPEIADGLVTVKGIARDAGSRSKVAVFSPDKNIDPVGACVGVKGERIKAIIHELNGEKIDVVHYFSDLGQFVIKAITPAEVSKVIIDESENCVELIVAEDQLSLAIGKKGQNVRLASELIGWKIEILSTQQESERRNRELSQCSALFAEALNLEEIMGQLLVTEGFSSVEDISNASIKELASIEGFNEDIASELRNRANRYLKAENDRKIEELKSLGMESDVINLPLSIDDKIALSEHGIKTLENIADLSSYEFCSILSSSASDKENLKNTVNSIIMEARKKLGVI

SEQ ID NO: 64329 - DNA, 1377 bp, Ureaplasma parvum serovar 3 str. ATCC 700970
  CDS (1)..(1377): transl_table=4
atgtctaactcatttaaatcaaaagaatttattgaatactttaaagatacagcaaaacaaaatgaaattgaatttgaagttttatcttcaattattaaagaagcatttgaaaaagcttatttacgaacacatcctggtgaaaattttgaaacaaatattgatcttaaacaaggaacaattaattgttttcgaaatttagtggtcgttgagaatgaaaaagtacataatgaagatttagaaacatgtttggatgatgctgttgaaattttattagatgatgctcgtaaaatcaatgcaaatgctcaaattggcgatcttattaaacaacatatttcaattgataattttaaaagtattgaagtaggtcaaattggaagtttattgcgtcaaaaaattactgaaattcataataaaagagtagctgatttttgaaaaccatctttaatgaaaatgattcgtgcaaaagttgcagaagttaattataacaaacaacgtaatgaaattactggagtaaaagttgaactagatgaccaatgaaaaacattaggttatttaagtcgtaaagatcgtattggtgatgaaaagtttaaggttggtgaaacttatgattttcttattaaagaagttaaagaacaaagccgtttatggccaattttactatctagaacagagccagaattagttgaagaaattttaaaacgcgaagttgttgatattaaaaatggaaatattgaaatcaaaaaaattgctcgaatagctggttttaaaactaaggtagctgtaagcactaatttattaaatattgaaccagttgctgttgttgtcggaaataaaggtttaactataacgtcaatttctaaacaattaaataatgaacgtattgatattattcgttatgctgatgacaaacgtatttttattgctaatgccattggtttagataaattaaaaggacttttagttcaagaaaatgaaagtggtcaacgttctgcaattgctattgtaagcaaggatgatttaccaagtgttatcggtcgtggtggagcaaatattcgtttaattgctaaaattactgaatgaaatattgatgtaaaaacaattgagcaagcattcgaagaaaatattttatacgaaaaatttgatgaaaaaatttatcgttcatgaaatattgaatcaattaataaaaaaaatgtcacaaatgatgaaatgttagctttaattgatagtatagaagatgataaaattgaacaagatgtccaattaaatcacccattaaaacaacaagaaaaaaaagttgtttcttcaaatgatgaagatggtgaaaatgatgaaacacaattagaatatcttgaaggattcgaagattttaaattctaa

SEQ ID NO: 64330 - protein, 458 aa, Ureaplasma parvum serovar 3 str. ATCC 700970
MSNSFKSKEFIEYFKDTAKQNEIEFEVLSSIIKEAFEKAYLRTHPGENFETNIDLKQGTINCFRNLVVVENEKVHNEDLETCLDDAVEILLDDARKINANAQIGDLIKQHISIDNFKSIEVGQIGSLLRQKITEIHNKRVADFWKPSLMKMIRAKVAEVNYNKQRNEITGVKVELDDQWKTLGYLSRKDRIGDEKFKVGETYDFLIKEVKEQSRLWPILLSRTEPELVEEILKREVVDIKNGNIEIKKIARIAGFKTKVAVSTNLLNIEPVAVVVGNKGLTITSISKQLNNERIDIIRYADDKRIFIANAIGLDKLKGLLVQENESGQRSAIAIVSKDDLPSVIGRGGANIRLIAKITEWNIDVKTIEQAFEENILYEKFDEKIYRSWNIESINKKNVTNDEMLALIDSIEDDKIEQDVQLNHPLKQQEKKVVSSNDEDGENDETQLEYLEGFEDFKF

SEQ ID NO: 64331 - DNA, 1014 bp, Aquifex aeolicus VF5
  CDS (1)..(1014): transl_table=11
atggtaaaggcacagctccaaaaattgatagagcaggtagcaacggaacacgaccttccggaaagagttgtggagcgtgcactaaaaaacgcgataatcacagccataaggaaagagaagaaaatcagggacgaactggaagttgagtttaccgatgaaggtatcaaggtatacgtagtaaggagaaaagggaacaagaaatttaagtttcctttagatatatcccctgaggatctgaatagattggcagcttatgcggcaaaggaagagttttacaaagaacttgaaagggcggaacaggaaaggggataccttgagtttaaggaacttgaaggggaaatagtttacgggatagtaagaaaagttctcgaaaatggggacgttatagttgatctgggaaggatagacgctatactcccgaaacgggaacaactccccacggataactttaaaacgggagataaggtaaaggctcttttacttgaggtgagaaagcgcagaggggagccggttttaatactctcaagaacgcaccctaactttttgagaaaactacttgagcaggaagttcccgaaataaaggagggattagttgagataaaggcagttgcgagaattcccggagaaagggctaaggtggctgtggaagcaaaggaaatgaagatggatcctgttggtatagtcgttggtttaaagggaatgagaattcaaaaggtatccgaagagctgggtggtgaaaagatagacgtgataaggtggagcgacgatatagcggaattaataaagcgggcacttgctcccgcacatccagaaaagataaaacttttcccttacgagaagagggcagaagttgccgttcccgaggaagaactttccttggctataggtaagaaaggcatcaacgtaaagctggcttctaagctaacaggctggcacatagacgtgctctcaactaaggactttgagaagcttgaagaattgagaaagaaagaagatgaaggacaaacctcttaa

SEQ ID NO: 64332 - protein, 337 aa, Aquifex aeolicus VF5
MVKAQLQKLIEQVATEHDLPERVVERALKNAIITAIRKEKKIRDELEVEFTDEGIKVYVVRRKGNKKFKFPLDISPEDLNRLAAYAAKEEFYKELERAEQERGYLEFKELEGEIVYGIVRKVLENGDVIVDLGRIDAILPKREQLPTDNFKTGDKVKALLLEVRKRRGEPVLILSRTHPNFLRKLLEQEVPEIKEGLVEIKAVARIPGERAKVAVEAKEMKMDPVGIVVGLKGMRIQKVSEELGGEKIDVIRWSDDIAELIKRALAPAHPEKIKLFPYEKRAEVAVPEEELSLAIGKKGINVKLASKLTGWHIDVLSTKDFEKLEELRKKEDEGQTS

SEQ ID NO: 64333 - DNA, 1458 bp, Treponema pallidum subsp. pallidum str. Nichols
  CDS (1)..(1458): transl_table=11
atgttcggcgtcagtaacgatgacattagaaagtatgcgcaggagaaggggcttgatgaagactttgcctttaaaatcgtcgagcaaacactgaaggccgcttataagactacatttaagacagatgaaaacgccgtcgttacctttggtgaggagcgggtgtgtatctatgcgcgcaagcgcgtggttgaagaggtgtacgaccgcgtctcggaagtggatttgtctacggcacttgagcttgatcccactacttctttagatagcgaagtgctggtggagcttgagtccgaagattttaagcgtggatctgtgcaggctgccgtccagcgtatcactgagctgagcagagaaattcaaaaggacgctctgtatgctgagtacaagagcaaagaaggagagattatcgttggctactaccaacgcgcgcgaaacgagcatatctacgttgacctaggaaaagttgagggcctgatgccaaagtcgcaccagctgccccaggatgattatcgtcaaaacgaccgcattaagtcgcttgtgcgtgaggtgcgcaaacatccaaagtcgagcgttgtccagctcattctttcacgaactgactctgcttttgtaaaagagctgctcgccgtggaggtgccggagatctacgacggtattgttgaggtggcaaaaatagtgcgggagccagggtaccgtacaaagatcgccgtcaccagtaggcgtgatgatgtggatcctgttggtgcctgcgtaggtcctcggggcatacgcatccgcatggttattaaagaattgaatgacgagaagatagatgtgcttgagtattctccggatccagttattttcatcaaaaatgcgctttctcctgctgaggtgctgaacgtcgtggtacttgatgaggagaagcgttctgcacttgccattgttgctgaaagccagctgtctatcgcgataggaaagcaaggtttgaacgtgcgtttagcgaatcggcttgtggactggaatatcgatgtgaagacagagagtcagtttgaagagatggatgtgtacactgacacgcgtcgtgcggcagaaaatctttttgataacgattatcaagaagagtctgagttttcttcatacgtgggatttacgccggagctcattaagattctgcaggacaacggtatccaagacgtacagactttggtagatttgggcgaggaaggcttgcgtgcgcttgagggcatggacgaggcgcacgtacaagaattgctcgccgccattgaggagaattttgaagttgtcgaggagggggaggaggcttcagttacatcttctcccgggactggtggtgatgaggatcaggcgttgcagtgtcctgagtgtggggtgcgcattactactgacatgagtgagtgtcctcactgtggtattggcctcagctttgagtttgaatacgaagagaacgaggaatag

SEQ ID NO: 64334 - protein, 485 aa, Treponema pallidum subsp. pallidum str. Nichols
MFGVSNDDIRKYAQEKGLDEDFAFKIVEQTLKAAYKTTFKTDENAVVTFGEERVCIYARKRVVEEVYDRVSEVDLSTALELDPTTSLDSEVLVELESEDFKRGSVQAAVQRITELSREIQKDALYAEYKSKEGEIIVGYYQRARNEHIYVDLGKVEGLMPKSHQLPQDDYRQNDRIKSLVREVRKHPKSSVVQLILSRTDSAFVKELLAVEVPEIYDGIVEVAKIVREPGYRTKIAVTSRRDDVDPVGACVGPRGIRIRMVIKELNDEKIDVLEYSPDPVIFIKNALSPAEVLNVVVLDEEKRSALAIVAESQLSIAIGKQGLNVRLANRLVDWNIDVKTESQFEEMDVYTDTRRAAENLFDNDYQEESEFSSYVGFTPELIKILQDNGIQDVQTLVDLGEEGLRALEGMDEAHVQELLAAIEENFEVVEEGEEASVTSSPGTGGDEDQALQCPECGVRITTDMSECPHCGIGLSFEFEYEENEE

SEQ ID NO: 64335 - DNA, 1035 bp, Thermotoga maritima MSB8
  CDS (1)..(1035): transl_table=11
atgaacataggcttgctggaagccctcgaccagctggaggaagaaaaaggaatttccaaagaagaggtcattcctatccttgaaaaagcactggtgagcgcttacaggaagaactttggaaattccaagaacgtggaggttgttatagataggaacacgggaaacataaaagtgtatcagctcctcgaagttgtggaagaagtggaagatccagcaacacagatatctctcgaggaggcgaaaaagatcgaccccctcgcggaagttgggtctattgtgaagaaggaactgaacgttaagaattttggaagaatagccgcgcagacggcgaagcaggttctcattcagagaatcagagaactcgagaaggagaaacagttcgagaagtattccgaactcaaaggaacggttacaaccgctgaagtcataagagtcatgggcgagtgggcagacatcagaataggaaagctcgagacaaggcttccaaagaaagagtggatccccggtgaggaaatcaaagccggtgatctggtgaaggtctacatcatcgatgtggttaaaacaaccaaggggccgaagatactcgtgagcaggagagtaccggagttcgtaattggcctgatgaaactcgaaattccggaagtggagaatggaatcgtggaaataaaggctatcgccagagaacccggtgttcgaacaaaggtggcagttgcatcgaacgatccgaacgtggatcccataggtgcctgcatcggtgaaggaggatcgaggatagccgccatactgaaggagctcaagggtgaaaaactcgacgttctgaagtggtcggacgatcccaaacagctcatagcgaacgcccttgcgccggctaccgtcatagaagtggagatactcgacaaagagaacaaggccgcacgcgttctagttcctccgacacagctttccctcgccataggaaaaggagggcagaacgcgagactcgctgcaaagctcacaggatggaaaatagacataaaaccgatcatgaacctgtga

SEQ ID NO: 64336 - protein, 344 aa, Thermotoga maritima MSB8
MNIGLLEALDQLEEEKGISKEEVIPILEKALVSAYRKNFGNSKNVEVVIDRNTGNIKVYQLLEVVEEVEDPATQISLEEAKKIDPLAEVGSIVKKELNVKNFGRIAAQTAKQVLIQRIRELEKEKQFEKYSELKGTVTTAEVIRVMGEWADIRIGKLETRLPKKEWIPGEEIKAGDLVKVYIIDVVKTTKGPKILVSRRVPEFVIGLMKLEIPEVENGIVEIKAIAREPGVRTKVAVASNDPNVDPIGACIGEGGSRIAAILKELKGEKLDVLKWSDDPKQLIANALAPATVIEVEILDKENKAARVLVPPTQLSLAIGKGGQNARLAAKLTGWKIDIKPIMNL

SEQ ID NO: 64337 - DNA, 1488 bp, Vibrio cholerae O1 biovar eltor str. N16961
  CDS (1)..(1488): transl_table=11
atgagtaaagaaattttagcggtagttgaggcggtttctaacgagaaagcggtacctcgtgagcgtatttttgaagcgctggaaactgcgttagcgacttcaaccaaaaagaagtatgaaatcgagatcgatgtgcgcgtagccatcgatcgcaaaacaggtgcgtttgaaacgttccgccgttggttagtggttgagaatgttgagcacccaaccaaagagatctcatttgaagcggcgagctttgatgatgactcggttcaactgggtgactatatcgaagatcagatcgaatcagtaacctttgaccgtattaccacgcaaactgcgaaacaagtgatcgtacaaaaagtgcgtgaagcagaacgtgcacagattgttgaacaattcatcgataacgaaggtgaattggtgactggtgtagtgaagaaagtgaaccgtgaaaccgtgatcctcgatctgggtaacaacgctgaagcggttatcctacgtgaagatcaactgccacgcgaaaacttccgtcctggcgatcgtgttcgtggtttgctgtacaaagtggctccagaagcacgtggtttccaactcttcatcactcgttctaagccagaaatgttggcagaactgttccgtgtagaagttccagaaattggtgaagagctgattgagctgaaagcggctgcgcgtgatcctggttcacgtgccaagatcgcggtaaaaaccaatgataagcgtatcgaccctgttggtgcgtgtgtgggtatgcgtggtgcacgtgtacaagcggtttctggcgaactgggtggcgagcgtattgatatcgttttgtgggatgataacccagcgcaattcgtcattaatgccatggcaccagccgatgtggcatcgatcattatggatgaagatgcacactcaatggatatcgctgttgaggctgataaccttgcgcaagcgatcggtcgtaacggtcaaaacgtacgtttggcttctcaactgaccggttgggaactgaatgtgatgacggttgcggatctacagaagaaacaccaagaagagtcaatggcatccatcgagaacttcatgaagtatctcgatattgagcaagattttgctgagctgctggttgaagaaggcttctctacgctagaagagatcgcttacgtaccaatgaatgagctgcttgatgttgatggcatggatgaagatctggcagatgagctacgtagtcgtgcgaaagaagcgctgacgacgattgctttggcaaaagaagagtcgttcgaaggccttgagcctgcagaagatctgcttgcattagcaggactggaacgcgacatggcattcaaactggcagcgaaaggtgttgcgacactggaagatctggctgaccaaggtgtggatgatttagaaggtattgaaggtctgaccgaacagcgtgcgggtgagcttattatggcggctcgtaacatttgttggtttggtgaagacgcataa

SEQ ID NO: 64338 - protein, 495 aa, Vibrio cholerae O1 biovar eltor str. N16961
MSKEILAVVEAVSNEKAVPRERIFEALETALATSTKKKYEIEIDVRVAIDRKTGAFETFRRWLVVENVEHPTKEISFEAASFDDDSVQLGDYIEDQIESVTFDRITTQTAKQVIVQKVREAERAQIVEQFIDNEGELVTGVVKKVNRETVILDLGNNAEAVILREDQLPRENFRPGDRVRGLLYKVAPEARGFQLFITRSKPEMLAELFRVEVPEIGEELIELKAAARDPGSRAKIAVKTNDKRIDPVGACVGMRGARVQAVSGELGGERIDIVLWDDNPAQFVINAMAPADVASIIMDEDAHSMDIAVEADNLAQAIGRNGQNVRLASQLTGWELNVMTVADLQKKHQEESMASIENFMKYLDIEQDFAELLVEEGFSTLEEIAYVPMNELLDVDGMDEDLADELRSRAKEALTTIALAKEESFEGLEPAEDLLALAGLERDMAFKLAAKGVATLEDLADQGVDDLEGIEGLTEQRAGELIMAARNICWFGEDA

SEQ ID NO: 64339 - DNA, 1485 bp, Pasteurella multocida subsp. multocida str. Pm70
  CDS (1)..(1485): transl_table=11
atgagtaaagaacttttattggctgcagaagcggtatcaaatgaaaaattattaccacgtgaaaagatttttgaagcgttagaaagtgcgcttgccctttcaaccaaaaagaagtatgagcaagaaattgatgtgcgtgtggtgattaacacaaaaacgggggagtttgatactttccgtcgttggttggttgtggacgaagtaactaatccgacaaaagaaatcaccttagaagcggcacaatttgacgatcctaatgtgcaactaggtgattatgtagaagatcaaattgaatctgtggcctttgaccgcatcacgatgcaaactgcacgtcaggtgattagcacgaaaatccgcgaagcagagcgtaacaaaattgttgagcaattccgttctcaagaaggcgagattgtgaccggcacagtgaaaaaagtgaatcgcgacaatattgtattagatttaggtcaacaagccgaagccgtgatattacgtgaagatatgttaccgcgtgaaaatttccgtccgggagatcgtgtccgtggtgtgttatataaagtgagcccagaaagcaaaggtgctcaattatttgttacccgtgctaaaccggaaatgttaattgagttattccgtattgaggttcctgaaattggtgaagaactgatcgaaattaaaaatgctgcgcgtgatccgggttctcgagcgaaaattgcagtgaaaagcaatgataaacgtattgacccagtgggtgcttgtgttggtatgcgtggtgcgcgtgtacaagcgattaccaatgaattaggtggtgaacgtgtggatatcgtactttgggatgataaccctgcgcaatttgtgatcaatgcgatggcaccagcagatgttacttctatcgtggtggatgaagattcacatgcaatggatatcgcagtcgaaccagccaatcttgcacaagcgattggtcgaaatggtcaaaatgtgcgtttagcaacccaactaacaagttggacattaaacgtgatgaccactgatgagctgaaccaaaaacatcaagcagaagataataaagtattgaaattattcatgaatgcgttagaaattgatgaagattttgcgcatatcttaattgaggaaggtttctctacattagaagaactggcttatgtttcagtcagtgaattaaccgcaattgatggcttagaagatgaagatttggtcgaagaattgcaagcgcgtgccaaaaatgcgattacggctgcggcattagcagaagaagaagccttaaaacaagcgcatattgaagatcgtttactcgcattagagggaatgaatcgccatattgcgttgaaattagcagaaaaacaaattactactctggaagaacttgcagaacaaggtgttgatgatttagcggatattgaagatttgacagcagaacaagccgccgattttattatggcggcacgtaatatctgttggttcagtgagtaa

SEQ ID NO: 64340 - protein, 494 aa, Pasteurella multocida subsp. multocida str. Pm70
MSKELLLAAEAVSNEKLLPREKIFEALESALALSTKKKYEQEIDVRVVINTKTGEFDTFRRWLVVDEVTNPTKEITLEAAQFDDPNVQLGDYVEDQIESVAFDRITMQTARQVISTKIREAERNKIVEQFRSQEGEIVTGTVKKVNRDNIVLDLGQQAEAVILREDMLPRENFRPGDRVRGVLYKVSPESKGAQLFVTRAKPEMLIELFRIEVPEIGEELIEIKNAARDPGSRAKIAVKSNDKRIDPVGACVGMRGARVQAITNELGGERVDIVLWDDNPAQFVINAMAPADVTSIVVDEDSHAMDIAVEPANLAQAIGRNGQNVRLATQLTSWTLNVMTTDELNQKHQAEDNKVLKLFMNALEIDEDFAHILIEEGFSTLEELAYVSVSELTAIDGLEDEDLVEELQARAKNAITAAALAEEEALKQAHIEDRLLALEGMNRHIALKLAEKQITTLEELAEQGVDDLADIEDLTAEQAADFIMAARNICWFSE

SEQ ID NO: 64341 - DNA, 1482 bp, Pseudomonas aeruginosa PAO1
  CDS (1)..(1482): transl_table=11
atgagcaaagaagtactgctggttgttgagtcggtatccaacgaaaagggcgtaccggccggcgtgattttcgaggcgctggagctggctctggcgaccgccaccaagaaacgtttcgaggacgaggtcgacctgcgcgtcgagatcaatcgtcataacggcagctacgagactttccgtcgttggcacgtcgtcgccgacgaggactaccaggaccccgccaccgagatcaccgtcgaggacgtccaggagcagaagccgggcgcgaaggtcggcgaggtcatcgaagaaaagatcgaatccatcgagttcggccgcatcgctgcgcagactgccaagcaggtcatcgtgcagaaggtccgcgaggccgagcgcgcccaggtggtcgatgcctaccgcgagaaggtcggcgagatcatttccggtaccgtgaagaaggtcacccgcgacaacgtcatcgtcgatctcggcaacaacgccgaggcgctgctggcccgcgaccagatcattccacgcgagaccttccgcgttggcacccgcgtgcgtgccctgctgaaggagatccgtaccgagaaccgcggtcctcagctggtcctgtcgcgtaccgcgccggaaatgctgatcgagctgttccgcatcgaagtaccggaaatcgccgagcagttgatcgacgtgatggccgccgcccgtgacccgggctcgcgcgccaagatcgccgttcgttccaaggacaagcgcatcgacccgcagggcgcctgcatcggtatgcgcggttcgcgcgtccaggcggtatccggcgagatcggtggagagcgggtggacatcgtcctgtgggacgacaacccggcgcaattcgtgatcaacgccatggctccggccgaggtggcggcgatcatcgtcgacgaggatacccataccatggatatcgccgtcgccgaggacaatctggcgcaggctatcggccgcagtggccagaacgtccgtctggccagccagttgaccggctggaccctgaatgtgatgaccgaggcggatatccaggccaagcaacaggccgagaccggggatatcctgcagcgcttcgtcgacgagctggatgtcgacgaggaactggcccaggtactggtggaagagggcttcacgactcttgaggaaatcgcctacgtaccgatggaagagatgctcagcatcgatggcttcgacgaagacatcgtcaacgagctgcgctcccgtgccaaggatcgcctgctgaccaaggccattgcgaccgaagagaagctcgccgacgcacaaccggcagaagacctgctcagcctcgatggcatgagcaaggagctggccctggacctggcgctgcgtggcgtaaccacccgtgaagatctggccgagcaatcgatcgacgatctgctcgacatcgacggcatggacgaagagcgtgccggcaagttgatcatggccgcccgggcccattggttcgagtaa

SEQ ID NO: 64342 - protein, 493 aa, Pseudomonas aeruginosa PAO1
MSKEVLLVVESVSNEKGVPAGVIFEALELALATATKKRFEDEVDLRVEINRHNGSYETFRRWHVVADEDYQDPATEITVEDVQEQKPGAKVGEVIEEKIESIEFGRIAAQTAKQVIVQKVREAERAQVVDAYREKVGEIISGTVKKVTRDNVIVDLGNNAEALLARDQIIPRETFRVGTRVRALLKEIRTENRGPQLVLSRTAPEMLIELFRIEVPEIAEQLIDVMAAARDPGSRAKIAVRSKDKRIDPQGACIGMRGSRVQAVSGEIGGERVDIVLWDDNPAQFVINAMAPAEVAAIIVDEDTHTMDIAVAEDNLAQAIGRSGQNVRLASQLTGWTLNVMTEADIQAKQQAETGDILQRFVDELDVDEELAQVLVEEGFTTLEEIAYVPMEEMLSIDGFDEDIVNELRSRAKDRLLTKAIATEEKLADAQPAEDLLSLDGMSKELALDLALRGVTTREDLAEQSIDDLLDIDGMDEERAGKLIMAARAHWFE

SEQ ID NO: 64343 - DNA, 1518 bp, Neisseria meningitidis Z2491
  CDS (1)..(1518): transl_table=11
ttggagatgttcaaaatgagtcgtgaaatgttacagctggcagaagcactggcaagcgaaaaaaacgttgatgcggaagtcgtcttccaagcactggaattcgccctgtctaccgccgccaagaaaaaggcagaccgcgaacacatggacgtgcgcgtccaaatcaaccgcgacaccggcgaataccaaaccttccgccgctggctgattgtcgccgatgaagactatacctatcccgatgtcgaaaaaaccatcgaggaaatccaagaggaaattcccggcactaccatccaaatcggcgaatactacgaagagcagctgcccaacgaaggcttcggccgccaagccgcgcaaaccgccaaacaaatcatcctgcaacgcatccgcgatgccgagcgcgagcagaatctgaacgagtttctcgccgtcaaagaagacatcgtgtctggcacggtcaaacgcgtcgaacgccacggcatcatcgtcgaagtcgttgccggcaaactggacgcgctgattccgcgcgaccaaatgattccgcgcgaaaacttccgcagcggcgaccgcatccgcgccctcttcctgcgcgtcgaagaaatcggcaacaccggccgcaaacaagtcatcctgagccgtacttccggcgatttcctcgtcaaactgtacgccaatgaagtacctgaaattgcagacggcatgcttgaaatccgcgctgtcgcccgcgacccgggccagcgtgccaaagtcgccgtcaaagccaacgaccagcgcatcgatccgcaaggcacctgtatcggcgttcgcggttcgcgtgtcaatgccgtcagcaacgaattgtccggcgagcgcatcgacgttgtcctttggtcgcccgagcctgcccaattcgtcatgagcgcgctctcacccgccgaagtcagccgcatcgtcatcgacgaagacaaacacgccgtcgatgtcatcgttgccgaagaccagctcgcgctcgccatcggacgcggcggtcaaaacgtgcgccttgcttccgacctgaccggctggcagctcaacatcatgacttccgccgaggcagacgaacgcaatgcggcagaagatgccgccatccgccgcctgtttatggatcacttgaacgtggacgaagaaaccgccgacgtactggttcaggaaggttttgcaaccttggaagaagtcgcctatgttcctgccgccgaactgcttgccattgaaggatttgacgaagaaatcgtcgatatgctccgcaaccgcgcccgcgatgccatcctgaccatggcgattgccgccgaagaaaaactgggcgaagtgtccgacgatatgcgcaacctcgaaggcatagatgccgatatgctccgcagccttgccgaagcaggcattaccacccgcgacgacttggcagagcttgctgtggacgaactgattgaaatcaccggtgtaaacgaagaaaccgcaaaagccgtcatcctgaccgcacgcgaacactggtttaccgaagacaaataa

SEQ ID NO: 64344 - protein, 505 aa, Neisseria meningitidis Z2491
MEMFKMSREMLQLAEALASEKNVDAEVVFQALEFALSTAAKKKADREHMDVRVQINRDTGEYQTFRRWLIVADEDYTYPDVEKTIEEIQEEIPGTTIQIGEYYEEQLPNEGFGRQAAQTAKQIILQRIRDAEREQNLNEFLAVKEDIVSGTVKRVERHGIIVEVVAGKLDALIPRDQMIPRENFRSGDRIRALFLRVEEIGNTGRKQVILSRTSGDFLVKLYANEVPEIADGMLEIRAVARDPGQRAKVAVKANDQRIDPQGTCIGVRGSRVNAVSNELSGERIDVVLWSPEPAQFVMSALSPAEVSRIVIDEDKHAVDVIVAEDQLALAIGRGGQNVRLASDLTGWQLNIMTSAEADERNAAEDAAIRRLFMDHLNVDEETADVLVQEGFATLEEVAYVPAAELLAIEGFDEEIVDMLRNRARDAILTMAIAAEEKLGEVSDDMRNLEGIDADMLRSLAEAGITTRDDLAELAVDELIEITGVNEETAKAVILTAREHWFTEDK

SEQ ID NO: 64345 - DNA, 1206 bp, Deinococcus radiodurans R1
  CDS (1)..(1206): transl_table=11
ttgcaaggagtggttatgtcccaggacgtgaactttgcggaggcgctgcgtgaagtggcgcaggcccgcaacatcaatgaactgcaactgatcgaagcgttcgagcagtcgcttcagcaggcgtatgtgcgcaacgtcgagcccgacaagcgcatcgaagtgcacctcgacccccagagcggcgtgctcgaagtgctgatcgtgcgcgaagtggtcgaaaaggtcgaagacgagcacatgcagatttcgctcgccgacgccctcgaactcgaccccggcgtggaaatcgggatggagatggaatttccggtggaccaggagatgttcagccgcatcgcgctgcaagccgccaagcagaccctgacccagaagatgcgcgaaactgagcgcaacgtggtcttcaacgagtacaaggaccgcgaagggcaggtgctcaacgcgcaggtggtgcgcagcgacaacaagggcaactggtttgtcgagctcggcgcgggcgaagcgattttgcccccccgcgagcagatccccggcgaaaagctgacccccggcggacgcgtcaagatctacctcaaggaagtccgcaagacccctaaggggccgaccatcctggcttcacgcgcggatgaaaggctgctcgactacctgctcaagcaggaaattcccgaagtcgccaacggcatcgtggaagtcaaggcgattgcccgtgaagccggtcagcgctccaaggtggcggtgttctcgcacaactccaacgtggaccccatcggcgcgtgcatcgggcaccgtggcaaccgcattcaggccgtgaccggcgaactcgggcgcgagcgggtggacgtcatcttgtgggacgccaacacccgcgagttcatccgcaacgcgctctcgcccgccaaggtcggccccatcgaagtgcagcaagacagccgcgacgccaccgtcaccgtgacgcccgaccagctctcgctcgccatcggcaagggcggccagaacgtgcgcctcgcggccaagctgaccggcttcaagatcgacctgcgcgaaacggcggccatcagcgacctcgacgcggcgatgcagcaggcgctggaagaagagcagcagggcggcggcaatgaaaacgccgcgcagtcggccttcgacgcgctgttcaaggactccaagtcggtggcgaccgccagccccgacgatgtcaaccccgaaagctga

SEQ ID NO: 64346 - protein, 401 aa, Deinococcus radiodurans R1
MQGVVMSQDVNFAEALREVAQARNINELQLIEAFEQSLQQAYVRNVEPDKRIEVHLDPQSGVLEVLIVREVVEKVEDEHMQISLADALELDPGVEIGMEMEFPVDQEMFSRIALQAAKQTLTQKMRETERNVVFNEYKDREGQVLNAQVVRSDNKGNWFVELGAGEAILPPREQIPGEKLTPGGRVKIYLKEVRKTPKGPTILASRADERLLDYLLKQEIPEVANGIVEVKAIAREAGQRSKVAVFSHNSNVDPIGACIGHRGNRIQAVTGELGRERVDVILWDANTREFIRNALSPAKVGPIEVQQDSRDATVTVTPDQLSLAIGKGGQNVRLAAKLTGFKIDLRETAAISDLDAAMQQALEEEQQGGGNENAAQSAFDALFKDSKSVATASPDDVNPES

SEQ ID NO: 64347 - DNA, 1305 bp, Chlamydia muridarum
  CDS (1)..(1305): transl_table=11
atgaacaaggatcttgtggctatttttgactacatggaaagagagaaaggtattcaacgctctacaatagtaggagctattgaatccgctctgaaaattgctgcgaaaaagactcttagagatgacgcgaatgtgtccgtgagtatcaatcctcgcaccggagacatagaagttttttgtgaaaaacagatcgttgaaaaatgccaaaatccaagtaaggaaattcccttagataaagcccgtgaatatgatccagattgtcaaatcgggcaatatatggatgttccttttgtctctgatcaatttggaagaattgcagctcatgcagctcgccaaattatcggtcagaaacttcgtcatgccgaacgcgatgtaatttatgaagagtatcgccatcgaaaaaatgaaatcatttcgggggtgattaaaagtttctctcgcggatcaaacttagtggttgatttggggaaagtagaggggttacttcccgctcgcttttatcctaaaacggaaaaacataaagtaggcgataagatttatgcgcttctttacgaagtacaggaatctgaaaatggcggagctgaagttattctcagtagaagtcacccagaatttgtaaaacaattattcatgcaagaagtcccagaattagaagaagggtctgttgagattgtgaaaattgcaagagaagctggctatcgaacaaaaatggcagtgcgctcttcttcccctcaaacagatgctgtaggggcttttgtaggtatgcgtggctctcgcatcaaaaacatcattcgagaattaaatgacgaaaaaatagacgttgtaaattattcccctgtatcgacagaattgttacaaaatttgctctatcctgtagagattcaaaagatcgctattttagaagacgataaagttatcgctattatcgtccaagattcggactatgcaactgttattggtaaacggggtatcaatgctcgtctaatcagtcaaattttgggctatgaacttgaagtccaaagaatgagtgaatacaacaagctattagaaattcaacgcttacagctagctgaattcgaagatcctcgattggatcagcctttagaagtggaaggaattaatacgttaatagtgcagaacttagagcacgcaggatacgacacgattaggaaaatattgctggctagtgctagcgaattggcttctgttccaggaattagtttagagttagcttacaaaatcctcgaacaggtcagcaaatatggagcatgcaaagttgacgaaaaacctaaagttgaagattaa

SEQ ID NO: 64348 - protein, 434 aa, Chlamydia muridarum
MNKDLVAIFDYMEREKGIQRSTIVGAIESALKIAAKKTLRDDANVSVSINPRTGDIEVFCEKQIVEKCQNPSKEIPLDKAREYDPDCQIGQYMDVPFVSDQFGRIAAHAARQIIGQKLRHAERDVIYEEYRHRKNEIISGVIKSFSRGSNLVVDLGKVEGLLPARFYPKTEKHKVGDKIYALLYEVQESENGGAEVILSRSHPEFVKQLFMQEVPELEEGSVEIVKIAREAGYRTKMAVRSSSPQTDAVGAFVGMRGSRIKNIIRELNDEKIDVVNYSPVSTELLQNLLYPVEIQKIAILEDDKVIAIIVQDSDYATVIGKRGINARLISQILGYELEVQRMSEYNKLLEIQRLQLAEFEDPRLDQPLEVEGINTLIVQNLEHAGYDTIRKILLASASELASVPGISLELAYKILEQVSKYGACKVDEKPKVED

SEQ ID NO: 64349 - DNA, 1512 bp, Xylella fastidiosa 9a5c
  CDS (1)..(1512): transl_table=11
atgagcaaggaacttttattggtagttgatgtggtcgccaacgaaaagggtgttccacgccagatcatctttgatgccattgaggttgcgttggcgtcggcggcgaagaagcgttatcaagatcgggacattctaacgcgtgtcactatcgatcaaaagagcggcaactatgagacttaccgccgttgggaggttgtcgctgatgatgtggtgatggaatcgccggagcgccagattcgtctcatggatgcgcttgatgaagctgatggtgtagaggttggtgattacattgaagagcagattgagaatccggattttggtcgtatctctgcacaggccgctaaacaagtgattgtgcaacgtgtgcgtgaggctgaacgtcagcaggttgttgatgcgtggaaaaatcgtgttggcgagttagtaactggcgtagtcaaacgtgttgaacgcggtaatatttatgtcgatttaggtgggggtactgaggcttttatccctaaggacaagggtatcccgcgagatgtaatacgtcctggagatcgtgtgcgtggttacttggctgaggtgcgttctgagtcacgtggcccgcagcttttcattagtcgctctgctccagaatttatgatcgaattgtttaaattggaagtcccggaagttggtcagggtttggtcgagatcaaagggtgtgcccgtgatcctggcgacagggcaaaaattgctgtgattgcgcatgataatcgcactgatccgatcggtgcttgcataggtatgcgtggttcgcgtgtgcaggctgtctccaacgaactcaacggtgaacgtgtagatattgtattgtggaacgaaaacccggctaactttgttatcaatgcgatggctcccgctgaggtacagtcgatcattgttgatgaggagaagcactcgatggatttggctgttgctgaggatcgtttggcccaggcgattggtaaaggcggccagaatgtacgtttggccagtcgcttgacgggttggcaattgaatgtgatgaccgccgagcaggttgctgctaagtcggaagccgagcaggttgccgcccgtcgactgtttatggagcgcttggaagtggatgaggagattgcatccattctggttatggagggattcaacactatagaggaaatcgcttatgttcctgtcggtgagctcctggcagtggaaggttttgacgaggatattgttgaggagctccgcgctcgggcacgtgatgcgttactgaatgcagccttggccgaagaggagggtttggaacattctggtccagcgccggatttgttggagctcaatggtatggatgaaatcactgcgcacgcgcttgctgctcatggagtgcgtactagcgaggacctttcagatttggctgctgacgagattgtcgagtttgatattcaaggcatgaccgtccagcgtgcagctgtattgatacttgctgctcgtgccgaggaaattgctcgtttggagcgtggcgaatga

SEQ ID NO: 64350 - protein, 503 aa, Xylella fastidiosa 9a5c
MSKELLLVVDVVANEKGVPRQIIFDAIEVALASAAKKRYQDRDILTRVTIDQKSGNYETYRRWEVVADDVVMESPERQIRLMDALDEADGVEVGDYIEEQIENPDFGRISAQAAKQVIVQRVREAERQQVVDAWKNRVGELVTGVVKRVERGNIYVDLGGGTEAFIPKDKGIPRDVIRPGDRVRGYLAEVRSESRGPQLFISRSAPEFMIELFKLEVPEVGQGLVEIKGCARDPGDRAKIAVIAHDNRTDPIGACIGMRGSRVQAVSNELNGERVDIVLWNENPANFVINAMAPAEVQSIIVDEEKHSMDLAVAEDRLAQAIGKGGQNVRLASRLTGWQLNVMTAEQVAAKSEAEQVAARRLFMERLEVDEEIASILVMEGFNTIEEIAYVPVGELLAVEGFDEDIVEELRARARDALLNAALAEEEGLEHSGPAPDLLELNGMDEITAHALAAHGVRTSEDLSDLAADEIVEFDIQGMTVQRAAVLILAARAEEIARLERGE

SEQ ID NO: 64351 - DNA, 1653 bp, Mycoplasma pulmonis UAB CTIP
  CDS (1)..(1653): transl_table=4
atgttagaaaaccaaagccaaaatcctgagctaaaaatctcatctaaaaaagcaaggtcacttttaaagtctaataaaactattgacttctttttatctcttgaaaatttgtcaagagataaaaagttaaaaatatcaacagttaaacaaatttttcaagaggcctttttccaagttattaaaaatgactttgatccagatgctgatttggaaattgtttatgatgatgaaaaaaaagaagtaactttttataacaacaatgccatagttatagaagatgcccttgaagaggcagatgatgattattcagctgaagagatgctagtaagctttgttagacttagtgatgctagaaaagaaaaaagtgatgttcaaataggtgatatagttaaaaaacaaattaaacatgatgaacttaagctaaatgaagttaaaaagattttttcaatatttcaacaaaaccttgcaaaagaggcaaagcaaagtgttctagatttttatagctcaaaaattggacaaaaaatccaagttaaaatcgaagagtttaaaaacagaggattttttggaagcgtcgttggtgatatggaaactaaagtttttttaccaaataaagaaattaacaaaaattctaaaattgctttgggtaaaaaaattgatgtttattttattgaatttgccaaggaatttcaaaataaatcagagactcttttaattgtttcacttaatagccctcttgaggttatcaatgttttaaaagagactttcgaagaaatagccaatggttcaattattattaaaaaaattgctagaaaagctggaattagaaccaaaattgcagttgaaaaaagccatctagcctctgaaggacttaacatcattggaacacttattggccaaagcggagatagaaataaaataataagtgaaaaattaaacaatgaaaaaattgactttgttatttataaagaagatcttcaagaatttattgttgaatctctaaaaccagctaatgtcatttcaattgaaagagttgtgccagaaacacatattcctgcttttaatgtagttgttcctaattctcaaatgtcagttgccatcggtaaggccggaatgaacaccattttatcaagtgagctaagtcaatctagaattaacattgaaactcttgataaagccaaagaaaaaggatgatctattctttgaaatggaaatgtaaaagagcatgaattagaagaaattgaaaaacactcatgacaaaacaaaaaagttattagtcaatttagcactcgtcgctcaaaagctagaagacaaaatgatttttcaaattatgcaaacgattttggaaaaggctttaatattgatgaatttaaaaaagactttgaagactttgaagcttactttgaagaaaacaaccttgtagcaagtgatgaaatggatacaagcttagatatggcaataaatgactttgaagctcctaagcttgaaaaaactagccaagagcaagagtcagaaagtcaagaaagccaagaaaaagctcaaagcaataataagcaaattaacagactaaaaaattatgtaattaatgacaaagatttttcagattttgcccttgatggaatagacttagatgactttgatgattcagagtgataa

SEQ ID NO: 64352 - protein, 550 aa, Mycoplasma pulmonis UAB CTIP
MLENQSQNPELKISSKKARSLLKSNKTIDFFLSLENLSRDKKLKISTVKQIFQEAFFQVIKNDFDPDADLEIVYDDEKKEVTFYNNNAIVIEDALEEADDDYSAEEMLVSFVRLSDARKEKSDVQIGDIVKKQIKHDELKLNEVKKIFSIFQQNLAKEAKQSVLDFYSSKIGQKIQVKIEEFKNRGFFGSVVGDMETKVFLPNKEINKNSKIALGKKIDVYFIEFAKEFQNKSETLLIVSLNSPLEVINVLKETFEEIANGSIIIKKIARKAGIRTKIAVEKSHLASEGLNIIGTLIGQSGDRNKIISEKLNNEKIDFVIYKEDLQEFIVESLKPANVISIERVVPETHIPAFNVVVPNSQMSVAIGKAGMNTILSSELSQSRINIETLDKAKEKGWSILWNGNVKEHELEEIEKHSWQNKKVISQFSTRRSKARRQNDFSNYANDFGKGFNIDEFKKDFEDFEAYFEENNLVASDEMDTSLDMAINDFEAPKLEKTSQEQESESQESQEKAQSNNKQINRLKNYVINDKDFSDFALDGIDLDDFDDSEW

SEQ ID NO: 64353 - DNA, 1032 bp, Mycobacterium tuberculosis CDC1551
  CDS (1)..(1032): transl_table=11
atggctgctctgcatgccatcgaggtggaccggggtatctcggtcaatgaactgctcgaaacgatcaagtccgcgctgttgactgcctaccggcacacccaaggtcaccagaccgatgcgcgcatcgagatcgaccggaaaaccggtgtcgttcgggtgatcgcccgtgagaccgatgaggctggcaatctcatcagcgagtgggacgacactccagagggcttcggccggatcgccgccacgacggcacgccaagtgatgttgcagcgattccgcgacgccgagaacgagcgcacctacggcgagttctccacccgcgagggcgagatcgttgcgggagtgatccagcgcgatagccgggccaacgcccgcggtctggtcgtcgtccggattggcaccgagaccaaggcttccgagggtgtgatcccggccgctgagcaggtaccgggggagagctatgaacatggcaaccggctgcgctgctacgtagttggtgtaacccgaggtgcccgcgagccgctgattacgctgtcgcgcacgcaccccaatctggtgcgcaagctgttctcgctggaagtccccgagatcgccgacggatcggtggagatcgtcgcggtggcccgggaggccggccaccgctccaagatcgctgtgcggtccaacgttgccggcttgaacgccaagggtgcttgcatcggtccgatggggcaacgggtccgcaacgtgatgagcgagctgtccggggagaagatcgacatcatcgactatgacgacgatccggcgcgttttgtcgccaacgcgttgtcgccggccaaggtggtgtcggtgtcggtgatcgaccagaccgcccgggccgcccgcgtggtggtgcccgatttccaattgtcgctggcaatcggaaaggaagggcagaacgcccggctggctgcccggctcaccgggtggcgtatcgatattcgcggcgatgcgccgccgcccccgcccggtcagcccgaacccggagtcagccgcggtatggcgcacgaccgctag

SEQ ID NO: 64354 - protein, 343 aa, Mycobacterium tuberculosis CDC1551
MAALHAIEVDRGISVNELLETIKSALLTAYRHTQGHQTDARIEIDRKTGVVRVIARETDEAGNLISEWDDTPEGFGRIAATTARQVMLQRFRDAENERTYGEFSTREGEIVAGVIQRDSRANARGLVVVRIGTETKASEGVIPAAEQVPGESYEHGNRLRCYVVGVTRGAREPLITLSRTHPNLVRKLFSLEVPEIADGSVEIVAVAREAGHRSKIAVRSNVAGLNAKGACIGPMGQRVRNVMSELSGEKIDIIDYDDDPARFVANALSPAKVVSVSVIDQTARAARVVVPDFQLSLAIGKEGQNARLAARLTGWRIDIRGDAPPPPPGQPEPGVSRGMAHDR

SEQ ID NO: 64355 - DNA, 1062 bp, Clostridium acetobutylicum ATCC 824
  CDS (1)..(1062): transl_table=11
atgaatcaggaattcatccaggcacttaaagaaattgtggaggaaaaaggaataagcgaggagctccttttttcaaccattgaagatgcattagtcgcagcatataagaaaaattacgctaaactcacagaaaatgtccataatgttagagtgagtatgaatagagaaaatggagaaatacatgtttattcacaaaaaaaggtagttcaagaaatagaggatagtatatgtgaaatttctcttgatgatgctaaaagtatagaccctaaatatcaattggatgatatagttgatatagaaataactcctaagagtttcggaagagttgcagcgcaagcagccaaacaagttgttattcaacgaataaaagaggctgaaagaagtctattatatgatgaattttcagaaaaagaatttgatataataacaggaactgtacttagaaaggataaaggaaacattttaattgatttgggaagaatagaagcaatcttaggtccatctgagcaaataccaggagaagattacatatataattctaaaataaaattatatattgttgaggttaagaacactacaaaaggagcacaggtggttatttcaagaactcatccgggtctagttaaaagattatttgaattagaagtacccgagatttacaatggaatagtggaaataaagggtatctcaagagaagcaggatcaagaactaaaatagctgtttattcccatgatgaaaatgtagatgctatgggagcttgtgtaggtccaaaaggaatgagagttcaaaatatagtaaatgaacttaaaaatgaaaaaatagatataataaaatggagtaagcttccagaagaatttatatcaaattcacttagtcctgcaaaagtattagacgtatatattgatgaagatacaaaatcagcaagggcaatagtagaagataatcaactatctcttgctataggaaaagaaggccaaaatgtaaggcttgcagcaaaacttacagaatggaaaatagatataaagagtaaatctcaatatgacagcgaagtacatgaataa

SEQ ID NO: 64356 - protein, 353 aa, Clostridium acetobutylicum ATCC 824
MNQEFIQALKEIVEEKGISEELLFSTIEDALVAAYKKNYAKLTENVHNVRVSMNRENGEIHVYSQKKVVQEIEDSICEISLDDAKSIDPKYQLDDIVDIEITPKSFGRVAAQAAKQVVIQRIKEAERSLLYDEFSEKEFDIITGTVLRKDKGNILIDLGRIEAILGPSEQIPGEDYIYNSKIKLYIVEVKNTTKGAQVVISRTHPGLVKRLFELEVPEIYNGIVEIKGISREAGSRTKIAVYSHDENVDAMGACVGPKGMRVQNIVNELKNEKIDIIKWSKLPEEFISNSLSPAKVLDVYIDEDTKSARAIVEDNQLSLAIGKEGQNVRLAAKLTEWKIDIKSKSQYDSEVHE

SEQ ID NO: 64357 - DNA, 1629 bp, Sinorhizobium meliloti 1021
  CDS (1)..(1629): transl_table=11
atggcagtcagtgctaaccggctcgaacttctgcagatcgcagatgctgtggcacgcgaaaaggtgatcgaccgcgagatcgttctggccgcgatggcggacgcgatccagaaggcggctcgttcgcgctacggttcggaatcgaacatccgcgccgacatcaatccgaagaccggtgaaatccgtctgcagcgtctcctggaagtggtcgagaaggccgaggactattcgacccagatcccgatcgagctcgcccgcgaccgcaatcccgatgcgaagctcggcgatttcatcgccgatccgctgccgcccatggacttcggccgtatcgccgcccagtccgccaagcaggtaatcgtgcagaaggtgcgcgaagccgagcgcgatcgtcagtacgacgagttcaaggatcgggtcggcgagatcgtcaacggcactgtcaagcgcgtcgaatacggcaacgtcatcgtcgatctcggccgcggcgagggcatcatccgccgcgacgagatgatcccgcgtgagaacatgcgctatggcgaccgcgtccgtgccttcgtctacgacgtccgccgcgagcagcgcggaccgcagatcttcctgtcgcgcacgcatccgcagttcatggtgaagctcttcaccatggaggtgccggaaatctacgacggcatcatccagatcaagtcggttgcccgcgacccgggctcgcgcgccaagatcgccgtcgtctccaacgattcgtcgatcgatccggtcggcgcctgcgtcggtatgcgcggctcgcgcgtgcaggccgtggtcggcgagctccagggcgagaagatcgatatcattccctggtcgccggatccggcttccttcatcgtcaatgcgctgcagccggcggaagtggccaaggtggttctcgacgaggacgcggaacgcatcgaggtcgtggttccggacgagcagctttcgctcgccatcggccgccgcggccagaacgtgcgccttgcgtcgcagctgaccggctgggacatcgatatcctcaccgagcaggaggagagcgagcgtcgccagaaggaattcaacgagcgcacgcagctcttcatggatgcgctggacgtcgacgagatggtcggtcaggtgctcgcctccgagggctttgcccaggtcgaagagctcgcctatgtcgaactcgacgaaatctcctcgatcgagggcttcgacgaggatacggcaaacgagctccagacccgcgcccgcgaatatctcgaaaagatcgaggcggaaatggatgccaagcgcaaggagctcggcgtttccgacgagctgcgcacgatcgatggcctcaccagccagatgctggtcgctctcggcgaggaaggcatcaagacgatcgaggactttgccggctgcgccgccgacgacctggtcggctggaccgagcgcaaggatggcgagaccaagcgcttcgaaggcatcttctcgaagttcgaagtcacccgggaagaggccgaaacgatgatcgtgcaggctcgtctggccgccggctggatcaccgaagaggacctggtcaagcagcaggaggaggaacaggagcaggatgagacgatcgaggtcgccgaaggcgcggatcaggacgcctga

SEQ ID NO: 64358 - protein, 542 aa, Sinorhizobium meliloti 1021
MAVSANRLELLQIADAVAREKVIDREIVLAAMADAIQKAARSRYGSESNIRADINPKTGEIRLQRLLEVVEKAEDYSTQIPIELARDRNPDAKLGDFIADPLPPMDFGRIAAQSAKQVIVQKVREAERDRQYDEFKDRVGEIVNGTVKRVEYGNVIVDLGRGEGIIRRDEMIPRENMRYGDRVRAFVYDVRREQRGPQIFLSRTHPQFMVKLFTMEVPEIYDGIIQIKSVARDPGSRAKIAVVSNDSSIDPVGACVGMRGSRVQAVVGELQGEKIDIIPWSPDPASFIVNALQPAEVAKVVLDEDAERIEVVVPDEQLSLAIGRRGQNVRLASQLTGWDIDILTEQEESERRQKEFNERTQLFMDALDVDEMVGQVLASEGFAQVEELAYVELDEISSIEGFDEDTANELQTRAREYLEKIEAEMDAKRKELGVSDELRTIDGLTSQMLVALGEEGIKTIEDFAGCAADDLVGWTERKDGETKRFEGIFSKFEVTREEAETMIVQARLAAGWITEEDLVKQQEEEQEQDETIEVAEGADQDA

SEQ ID NO: 64359 - DNA, 1647 bp, Caulobacter crescentus CB15
  CDS (1)..(1647): transl_table=11
atggccatcggcatcgccgccaaccggcttgaactcctgcagatcgccgacgcggtcgcccgtgaaaagggcatcgagaaggaagtcgtcatcgaggccatcgaggacgccctgcagaaagccgcccgcgcccgctacggcgccgagcatgacatccgcgtcaagatcgaccccaagacgggcgagacgacccagaagcgcgtgatcgaggtcgtgtccgacgacgctgaactggaaggcgagatcggcaagatgcccttctcgatcgccaagcgcacctggcgcgacgccgagatcggcaaggtctacgaagaagtcctgccgccgttcgagatcggtcgcgtccagacccagatggcccgtcaggtcgtcatgcataaggtccgcgaggccgagcgcgagcgtcagtacgacgagtacaaggatcgcgtcggcgagatcgtcaacggcagcgtcaagcgcgtcgagtacggcaacgtgatcgtggatctgggccgtggcgaaggcatcatgcgccgcgaccagtcgatcccgcgcgagaacttcaatgtcggcgatcgcatccgcgcctacatctacgacgtccgtcgcgagaccaagggcccgcagatcatgctgagccgcgcgcacggcggcttcatggccaagctgttcgcccaggaagtgccggaagtctatgacggcgtcatcgagatccgcgccgtcgcgcgtgaccccggttcgcgcgccaagatggccgtcatctcgaacgacggctcgatcgacccggttggcgcctgcgtcggtatgcgtggttcgcgcgtgcaggcggtcgtcgccgagctgcaaggcgagaagatcgacatcatccagtggtcggaagacgaagccaccttcatcgtcaacgccctggccccggctgaagtctccaaggtcgtcatggacgaggaagacgagcgcgtcgaagtggtggtgccggacgaacagctgtcgctggccatcggccgccgcggccagaacgtccgtctggcctcgcagctgaccggctggcagatcgacatcatgaccgaaagccaggagagcgagcgccgtcagcgcgagttcgctgagcgcacggccctgttccaggaagccctggacgtcgacgaggtcatcgcccagctgctggtcaccgaaggcttcgctgcggtggaagacgtcgcctatgtcgagccgcatgaaatcgcctcgatcgagggcttcgacgaagaaaccgccgaggagctgcaaacccgcgctcgcgagttcctcgaaaaggaagccgccgagctggacgccaagcgcaaggccctgggcgtcgaagacgagctgctgaccatcgagggcgtgaccctggccatggccgtggccctgggcgaaggcgacgtgaagtcgatcgaagacctcgccggtctggtgcctgacgacatgcgcggctggttcgaaaacaagggcggtgagcgcgtgcgcgaaccgggcatcctggaaagcttcaacctgtcgcccgaggacgccgaggccctgatcatgcgcgctcgtatcgccatgggctgggtcgaggcgccgccggagcccgagccggagccggagttcgaggaagagtcctcggccgaaggcgacgtcgtcgctgaagctgaagaagaggcctaa

SEQ ID NO: 64360 - protein, 548 aa, Caulobacter crescentus CB15
MAIGIAANRLELLQIADAVAREKGIEKEVVIEAIEDALQKAARARYGAEHDIRVKIDPKTGETTQKRVIEVVSDDAELEGEIGKMPFSIAKRTWRDAEIGKVYEEVLPPFEIGRVQTQMARQVVMHKVREAERERQYDEYKDRVGEIVNGSVKRVEYGNVIVDLGRGEGIMRRDQSIPRENFNVGDRIRAYIYDVRRETKGPQIMLSRAHGGFMAKLFAQEVPEVYDGVIEIRAVARDPGSRAKMAVISNDGSIDPVGACVGMRGSRVQAVVAELQGEKIDIIQWSEDEATFIVNALAPAEVSKVVMDEEDERVEVVVPDEQLSLAIGRRGQNVRLASQLTGWQIDIMTESQESERRQREFAERTALFQEALDVDEVIAQLLVTEGFAAVEDVAYVEPHEIASIEGFDEETAEELQTRAREFLEKEAAELDAKRKALGVEDELLTIEGVTLAMAVALGEGDVKSIEDLAGLVPDDMRGWFENKGGERVREPGILESFNLSPEDAEALIMRARIAMGWVEAPPEPEPEPEFEEESSAEGDVVAEAEEEA

SEQ ID NO: 64361 - DNA, 1377 bp, Synechocystis sp. PCC 6803
  CDS (1)..(1377): transl_table=11
atgtctcttgttagtttaccggggctcccggcaatgattagtgaaattagtaagcgcaataatttacccaccacggcggtggaagaagctctacgggaagctttattgaagggctacgagcgttttcggcgatcgcagttgatgggacaccaattccccgaagaatatttcaacaactttgaggtggaattagacacggaagaagaaggctttcgggtactttccaccaaacggattgtggaggaagtggaaaattctgaccaacaaatttccctcaaggaagtgctggaagtggccgaagaagctcaactgggggacgaagtagtgctggatgtgaccccagaacaaaaggactttgggcgcatggccgccattcaaactaagcaggtattactgcaaaaactgcgggatcaacaacgaaaaattatccaagaagaattccaagacctggaaggcactgttctcaatgcccgggccctgcgctttgaaaggcagtccatcattgtggcggtgcagagtagttttggtcagccagaggtagaagcagaattgcccaaacgggaacagttacccaacgataattaccgggctaactccaccttccgggtgtatctcaaacgggtacgggaaggctcccaaagaggtccccaattggtggtttcccgggcagcggcggggttggtggtggatttatttagtgtggaagtgccggaaattgaagaagaggtggtgcgcattgttgccgtggccagggaagccaaacccccttccccttccgtggggccccgaacaaaaattgcggtggacactctagagcgggatgtggatccggtgggagcctgcattggcgctcggggttcccgtatccatgcggtggtcaacgaactccggggggaaaaaattgatgtgatccgttggtccccagacccggccacgtatattgcccaggccctcagtccagcccgggtggaccaggtttacctcatccatgcggaggagcgccatgccctggtaattgtggcggaggatcaactcagtttggcgattggcaaggagggacaaaacgtccggttggcggcccgcctaaccggttggaaaattgacatcaaagatcccgaaacctatgcccgggataaggaagccattgaacaatctattttggagcgggcggcggcttcagcccaggccagggcagaacgggaagcagcagaacaggaggcccaagctaaattagaagcggaaatggctgctttggaagccgaggaagctgaagagttagaggaaaccccagaggcgatcgccgaggtggaagaagaagtagaggaatgggaccaagaccaagggccggagttaggggaggaagaagagttaagctag

SEQ ID NO: 64362 - protein, 458 aa, Synechocystis sp. PCC 6803
MSLVSLPGLPAMISEISKRNNLPTTAVEEALREALLKGYERFRRSQLMGHQFPEEYFNNFEVELDTEEEGFRVLSTKRIVEEVENSDQQISLKEVLEVAEEAQLGDEVVLDVTPEQKDFGRMAAIQTKQVLLQKLRDQQRKIIQEEFQDLEGTVLNARALRFERQSIIVAVQSSFGQPEVEAELPKREQLPNDNYRANSTFRVYLKRVREGSQRGPQLVVSRAAAGLVVDLFSVEVPEIEEEVVRIVAVAREAKPPSPSVGPRTKIAVDTLERDVDPVGACIGARGSRIHAVVNELRGEKIDVIRWSPDPATYIAQALSPARVDQVYLIHAEERHALVIVAEDQLSLAIGKEGQNVRLAARLTGWKIDIKDPETYARDKEAIEQSILERAAASAQARAEREAAEQEAQAKLEAEMAALEAEEAEELEETPEAIAEVEEEVEEWDQDQGPELGEEEELS

SEQ ID NO: 64363 - DNA, 1119 bp, Listeria innocua Clip11262
  CDS (1)..(1119): transl_table=11
atgagcacagaattattagatgctcttcatgtgttagaacatgataaaggtatttcaagagaggttttagtggaagcgattgaagctgctcttacttctgcatataaacgaaatttcaaagatgcacaaaacgtacgcgtagatttaaatatggaaaacggttctatccgtgtattagctagaaaagaagcggtagagcaagtatttgactctcgtcttgagatttcgatggaagaagcgcacaaactgaatccagtatacaaaccaggtgacgtcgtggaacttgaagtaacaccgaaagattttggacgtatcgctgctcaaacagcgaaacaagtcgttactcagcgtgttcgtgaagcggaacgtggcatcatttatgatgagttcatcgaccgtgaagatgatattatgactggtattgttgaacgtcaagattctcgttttatctatgtaaaccttggtaaaatcgaagccattttatctcaaaacgaacaaatgccaaacgaaacttatcatgcacatgaccgcattaaagtgtatttaacaaaagtagaaaagactacaaaaggaccacaaatctttgtatcccgtacacatccgggcttacttaaacgtctttttgaaatggaagtacctgaaatttatgatggcgttgtagaaatcaaatcagttgctcgtgaagctggagatcgttcaaaaatctctgtttacacagcaaatgaagaagtggacccagttggtgcatgtgtaggaccaaaaggcgcacgtgtccaaactatcgtcaatgaacttaaaggcgaaaaaatcgatatcgttgaatggtcagaagatcctttcacattcgtagccaatgctcttagcccttcaaaagtgctagatgttattgtaaacgaagcagaccaagctacaaccgttatcgtaccggattatcagttatcacttgcaattggtaaacgtggtcaaaatgcccgtttagcagcgaaattaactggctggaaaatcgatattaaaagcgaaacagttgcaactgaactaggtatctaccctcgtaatgacgtagaagcacctgttgttgaagaagcagagagcgaaacttttacagaagatgaagagtaa

SEQ ID NO: 64364 - protein, 372 aa, Listeria innocua Clip11262
MSTELLDALHVLEHDKGISREVLVEAIEAALTSAYKRNFKDAQNVRVDLNMENGSIRVLARKEAVEQVFDSRLEISMEEAHKLNPVYKPGDVVELEVTPKDFGRIAAQTAKQVVTQRVREAERGIIYDEFIDREDDIMTGIVERQDSRFIYVNLGKIEAILSQNEQMPNETYHAHDRIKVYLTKVEKTTKGPQIFVSRTHPGLLKRLFEMEVPEIYDGVVEIKSVAREAGDRSKISVYTANEEVDPVGACVGPKGARVQTIVNELKGEKIDIVEWSEDPFTFVANALSPSKVLDVIVNEADQATTVIVPDYQLSLAIGKRGQNARLAAKLTGWKIDIKSETVATELGIYPRNDVEAPVVEEAESETFTEDEE

SEQ ID NO: 64365 - DNA, 1278 bp, Nostoc sp. PCC 7120
  CDS (1)..(1278): transl_table=11
atgtcaatggttagtttaccaggattaaaagatttaatagaaagtattagtcgtgagcggaatttgccccgattagcggttcaggctgctattagagaagcattacttaagggttatgaacgttatcgtcgcgctcaaaacatcgagcgcaaacagtttgatgaagattattttgataactttgaagtcgagctagatattgatgaggaaggatttcgcgttctttccacaaaatccattgttgaagaagttaataattctgaccatcaaatttccttagatgaagtgcagcaagtagctcccgaagcccaattgggggactcagtggtactagatgtcactccagaccaaggtgaatttgggcgcatggctgccatgcaaaccaagcaagtactggcacaaaaactacgagatcaacagcgccagatggtgcaagaagagttccaagacttagaaggcacagttctccaggccagagttttgcgatttgagcgccaatcagtaattctggcagttagcagcacctttggacaaccagaagtagaagccgaattacccaagcgcgaacaattgcccaatgacaattatcgggcaaatgccacatttaaggtttatctcaaaaaagtttctcaaggtcagcaacgagggccacagttattagtatcccgtgctgatgcaggtttagtagtttatctatttgccaacgaagtaccagaaattgaagacgaagtggtacggatagttgccgtagccagggaggcaaaccccccttcccgctatgtaggcccaaggactaaaatagcagtagatacccttgatcgtgatgtagatcccgtaggagcttgtattggtgctaggggatcacgcattcaggtagtagtcaacgaattacgcggcgaaaaaattgacgtgattcgctggtctccagacccggcaacatatattgcgaatgccctcagcccggcgcgagtcgatgaagtgcgcctcatggacccagaaactcgacaaactcacgtattagtcgcggaagaccaactgagtttggctattggcaaagaagggcaaaacgtgcgattagctgcccgattgactggctggaaaatagatattaaagataaagccaagtatgaccaagtagccgaagatgctaaatttgtggcggcgcgtgcaaaatatcaactagaggaagatgacatcgaatcagacgagctagactatgaagaaaatcaacaaggagaattagaagacgaatcttttgaccccaactatgaagagtaa

SEQ ID NO: 64366 - protein, 425 aa, Nostoc sp. PCC 7120
MSMVSLPGLKDLIESISRERNLPRLAVQAAIREALLKGYERYRRAQNIERKQFDEDYFDNFEVELDIDEEGFRVLSTKSIVEEVNNSDHQISLDEVQQVAPEAQLGDSVVLDVTPDQGEFGRMAAMQTKQVLAQKLRDQQRQMVQEEFQDLEGTVLQARVLRFERQSVILAVSSTFGQPEVEAELPKREQLPNDNYRANATFKVYLKKVSQGQQRGPQLLVSRADAGLVVYLFANEVPEIEDEVVRIVAVAREANPPSRYVGPRTKIAVDTLDRDVDPVGACIGARGSRIQVVVNELRGEKIDVIRWSPDPATYIANALSPARVDEVRLMDPETRQTHVLVAEDQLSLAIGKEGQNVRLAARLTGWKIDIKDKAKYDQVAEDAKFVAARAKYQLEEDDIESDELDYEENQQGELEDESFDPNYEE

SEQ ID NO: 64367 - DNA, 1617 bp, Agrobacterium tumefaciens str. C58
  CDS (1)..(1617): transl_table=11
atggcagtgagtgctaaccggcttgagcttctgcagatcgccgatgctgtggcgcgcgaaaaggtcatcgaccgcgaaatcgtgcttgccgcaatggccgacgctatccagaaagccgcccgctcgcgctatggttcggaaaccaacatccgcgccgacatcaactccaagaccggcgaaatccgcctgcagcgtcttctggaagtggtggaagcagccgaagactattcgacccagattccgctcgaacttgcccgcgaccgcaaccccgacgccaagctcggcgacttcatcgccgatccgctgccgccgatggatttcggccgtatcgctgcccagtccgccaagcaggtcatcgtgcagaaggtacgtgaagccgagcgcgatcgtcagtatgacgagttcaaggaccgcatcggcgaaatcgtcaacggcaccgtgaagcgcgtcgaatatggcaatgtcatcgtcgatctcggccgtggcgaaggcatcatccgtcgcgacgagatgatcccgcgcgaaaacatgcgttatggcgaccgcgttcgcgcctatgtctacgacgttcgccgcgaacagcgtggcccgcagattttcctgtcgcgtacccatccgcagttcatggtgaagctgttcaccatggaagtcccggaaatctacgacggcatcatccagatcaagtcggttgcccgtgaccccggttcgcgcgccaaaatcgccgtcatctcgaacgatagctcgatcgatccggtcggcgcctgcgtcggtatgcgcggttcgcgcgttcaggccgttgtcggcgaactccagggcgagaagatcgacatcattccgtggagccaggaaccggcttccttcatcgtcaacgccctgcagccggcggaagtcgccaaagtcgttctggatgaagaatccgagcgtatcgaagtggttgttcccgacgagcagctgtcgctcgccatcggccgccgcggtcagaacgtgcgtctggcatcgcagctgaccggctgggatatcgacatcatgaccgagcaggaagaatccgagcgtcgccagaaggaattcaacgagcgcacggcactcttcatggaagcgctggatgtcgacgaaatggtcggccaggttctggcttcggaagggttcgcgcaggttgaagaactggcctatgtcgatctcgacgaaattacctcgatcgatggcttcgacgaagacactgctgatgaaatccagacccgcgcccgcgaatatctggaacggctggaagccgaaatggacgccaagcgcaaggaactcggcgttaccgacgagctgcgccagatcgatggcctgacctcgcagatgatggtcgcgctcggtgaagacggcatcaagaccatcgaggactttgccggctgcgcagcggacgatctggtcggctggagcgaacgcaaggacggcgagacgaagaagttcgaaggcatcttctccaagctcgatgtttcgcgcgtcgaagccgagaacatggtggtgcaggcccgtcttctggcaggctggatcaccgctgaagagcttgcttccgaacaggaagtcgaggcggaagctgccgaggaggcggataccgccgaacaggaatga

SEQ ID NO: 64368 - protein, 538 aa, Agrobacterium tumefaciens str. C58
MAVSANRLELLQIADAVAREKVIDREIVLAAMADAIQKAARSRYGSETNIRADINSKTGEIRLQRLLEVVEAAEDYSTQIPLELARDRNPDAKLGDFIADPLPPMDFGRIAAQSAKQVIVQKVREAERDRQYDEFKDRIGEIVNGTVKRVEYGNVIVDLGRGEGIIRRDEMIPRENMRYGDRVRAYVYDVRREQRGPQIFLSRTHPQFMVKLFTMEVPEIYDGIIQIKSVARDPGSRAKIAVISNDSSIDPVGACVGMRGSRVQAVVGELQGEKIDIIPWSQEPASFIVNALQPAEVAKVVLDEESERIEVVVPDEQLSLAIGRRGQNVRLASQLTGWDIDIMTEQEESERRQKEFNERTALFMEALDVDEMVGQVLASEGFAQVEELAYVDLDEITSIDGFDEDTADEIQTRAREYLERLEAEMDAKRKELGVTDELRQIDGLTSQMMVALGEDGIKTIEDFAGCAADDLVGWSERKDGETKKFEGIFSKLDVSRVEAENMVVQARLLAGWITAEELASEQEVEAEAAEEADTAEQE

SEQ ID NO: 64369 - DNA, 999 bp, Corynebacterium glutamicum ATCC 13032
  CDS (1)..(999): transl_table=11
gtgaatattgatgtccaggctttaaaagccatcgagtctgaaaaaggaatcccagttccagacttgctgcgcaccatcgcctctgcacttttgcattcgtacatggataatcgcgaaactgttgcgtctgcgaacctgaaaccacgcgtggacatcgattccacaactggcacggtcaacgtcatcgtctcagaattcgacgaaaacggagagctcgcttccgaatacgacgacaccccatccaacttcggacgagtcagcgcccgcgctgttcgcgacgcgatcgttaagtccctgcgcgaagcagaagcaagccgagcattcgatgcgtacgcagattatgaaggcaccgttgtgtccggcatcgttcaagcagatgcccgcgcagctgaacgcggaatcatcatcgtgcagctgggtaccgaagcggacaaccaagacggcgttttgctcccagccgagcagatccctggcgaaaagctcaagcacggcgaccgcgtcaagtgcttcgtcgttggcgtgggcaagggcaacactgacatccagatcaacctgtctcgtactcaccctgagctggtgcgccgactgtttgaactggaaatcccagaagttgctgacggatccgtggaaattgttgctatctcccgcgaagccggacaccgctccaaggttgctgttcaagccaaggtgaagaacctcaacgccaagggcgcttgcattggcccacgtggacagcgtgtgtccaacatcatgcgtgaactcggtggagaaaaaatcgacatcatcgattactccgaagatccagcaaccttcgttggaaatgcactggcaccatccaaggttgtcaacgtagaggtcaccgatcttgaagctcaaaccgcgcgcgtaactgtccctgactaccagctttcactagcaatcggtaaagaaggtcaaaacgcccgcttggctgcccgcctgaccggctggaagatcgacatccactctgacatcgattaa

SEQ ID NO: 64370 - protein, 332 aa, Corynebacterium glutamicum ATCC 13032
MNIDVQALKAIESEKGIPVPDLLRTIASALLHSYMDNRETVASANLKPRVDIDSTTGTVNVIVSEFDENGELASEYDDTPSNFGRVSARAVRDAIVKSLREAEASRAFDAYADYEGTVVSGIVQADARAAERGIIIVQLGTEADNQDGVLLPAEQIPGEKLKHGDRVKCFVVGVGKGNTDIQINLSRTHPELVRRLFELEIPEVADGSVEIVAISREAGHRSKVAVQAKVKNLNAKGACIGPRGQRVSNIMRELGGEKIDIIDYSEDPATFVGNALAPSKVVNVEVTDLEAQTARVTVPDYQLSLAIGKEGQNARLAARLTGWKIDIHSDID

SEQ ID NO: 64371 - DNA, 1074 bp, Fusobacterium nucleatum subsp. nucleatum ATCC 25586
  CDS (1)..(1074): transl_table=11
atgaaggctaaggattctaaaaatttcttagaagcattagatgagcttgaaagagaaaaaggaattagcaaagagagtgtattagaagccatagagttagcacttttagcagcatataaaaagaactatggtgaagatgaaaatgttgaagttatagtagatagagaaaatggagatataaaggtttttgcaagtaaaattattgtaaatgctgatgatcttttagatccaaataaagaaatttctcttgaagatgcaaaaaaaataaagaaaagggtaaaagttggagatactttaaaatttgaagtaaattgtgaagattttagaagaaatgcagttcaaaatggtaaacaaatagttatccagaaagttagagaagctgaaagagaacacatctttaataaatttaaagaaagagaagacagcatagtaactggtataattagaagaattgataatagaaagaatatttttattgaaatagatggaatagaattaatacttccaccagctgaacaatcaatttctgatgtatatagagttggagaaagaataaaagtatatattttaagtgttgagaaaacaaataaatttccaaaaatattgatttcaagaaagaatgaaggacttttgaaaaaactatttgaaatagaaattccagaaataacatcaggaataattgaaattaaatcagttgcaagagaagcaggttcaagagcgaaggttgcagtgtactcagaagtacctaacattgacactgttggagcttgtataggacaaagaggagcaagaattaaaaatattgttgatgaattaaatggagaaagaatagatatagttgaatggaaaccagttatagaagaatttgtttcagcagttcttagtccagcagttgtatcaaatgttacaattttagaagatggaacagcaagagtattagttgaaccatctcaattatcattagcaataggaaagaatgggcaaaatgcaagacttgcagctagattgacaggaatgagagtagatattaaagttattgatagtgaagctttaaaagaggaagaaaatgagtag

SEQ ID NO: 64372 - protein, 357 aa, Fusobacterium nucleatum subsp. nucleatum ATCC 25586
MKAKDSKNFLEALDELEREKGISKESVLEAIELALLAAYKKNYGEDENVEVIVDRENGDIKVFASKIIVNADDLLDPNKEISLEDAKKIKKRVKVGDTLKFEVNCEDFRRNAVQNGKQIVIQKVREAEREHIFNKFKEREDSIVTGIIRRIDNRKNIFIEIDGIELILPPAEQSISDVYRVGERIKVYILSVEKTNKFPKILISRKNEGLLKKLFEIEIPEITSGIIEIKSVAREAGSRAKVAVYSEVPNIDTVGACIGQRGARIKNIVDELNGERIDIVEWKPVIEEFVSAVLSPAVVSNVTILEDGTARVLVEPSQLSLAIGKNGQNARLAARLTGMRVDIKVIDSEALKEEENE

SEQ ID NO: 64373 - DNA, 1041 bp, Thermoanaerobacter tengcongensis MB4
  CDS (1)..(1041): transl_table=11
atgaatgcagaatttattgaggcattgaattcaatatgcgaagaaaaaggaatacctaaagagactatgtttgaggctatagaggcggctttggtttctgcctacagaaaaaattacggaacagcccaaaacgtgaagattgtaatggacagagagacaggagatgttaaggtatatgcccaaaagactgtggtggaagaagtaaaaaatgaccttttggaaataagcttagaagatgcgaggaagataaataaaaaataccagattggtgatattgtagatatagaagtgactcccaaaaactttggcaggattgcggcacagaacgcaaaacaggtggtaatacagaggataagggaagcagaaagaaatgtgatttatgaagagttcctggcaaaagagacagaagtagtaactgggattgtgacaagagcagcaaaaaataacgtgctcatcaatctaggaagggtggaggcgatacttactccttcagagcaaattccgggagaaactttttcacctggagacaggataaaggtgtacatcgtagaagtaaaaaaaaccacaaaaggacctcaaatcataatctctcggtctcatcctgggctggttaaaaggctttttgaactagaatcgcccgagattcagcagggtatagttgaaataaggagcattgcgagagaaccaggttcccgcacaaaaatggctgtgttcagcagagaccccaatgtagaccctattggagcctgtgtaggctacaaaggttctagagttcaggctgttgtcaatgaattaaaaggagaaaagatagacattgtgaagtggagttcaaaacctcaggagtttatcatgaatgcactaagccctgcaaaagctataagcgtggagattgtagatgagaaagaaaaagtggcaagggtaattgtaccagattatcagctctctttggcaataggtaaagaggggcagaatgcgcggctagcagcgaagctcactggatggaagatagatataaaaagcgagtcgatggtcaaaagttga

SEQ ID NO: 64374 - protein, 346 aa, Thermoanaerobacter tengcongensis MB4
MNAEFIEALNSICEEKGIPKETMFEAIEAALVSAYRKNYGTAQNVKIVMDRETGDVKVYAQKTVVEEVKNDLLEISLEDARKINKKYQIGDIVDIEVTPKNFGRIAAQNAKQVVIQRIREAERNVIYEEFLAKETEVVTGIVTRAAKNNVLINLGRVEAILTPSEQIPGETFSPGDRIKVYIVEVKKTTKGPQIIISRSHPGLVKRLFELESPEIQQGIVEIRSIAREPGSRTKMAVFSRDPNVDPIGACVGYKGSRVQAVVNELKGEKIDIVKWSSKPQEFIMNALSPAKAISVEIVDEKEKVARVIVPDYQLSLAIGKEGQNARLAAKLTGWKIDIKSESMVKS

SEQ ID NO: 64375 - DNA, 1023 bp, Streptomyces coelicolor A3(2)
  CDS (1)..(1023)
atggacatcgacatgagcgccctgcggggcttggtacgggagaaggagatctccttcgacctgctggtcgaagcgatcgagtcggccctcctcatcgcctaccaccgcaccgagggaagccgccggcacgcgcgcgtggagctcgaccggaacaccggccatgtgaccgtgtgggcgaaggaggaccccgacgacctcgaggagggccaggcggcccgcgagttcgacgacaccccgtccgacttcggccgcatcgccgccaccaccgccaagcaggtcatcctgcagcggctgcgcgacgccgaggacgacgcgaccctcggcgagtacgccggccgtgagggcgacatcgtcaccggcgtggtccagcagggccgcgacccgaagaacgtgctggtggacatcggcaagctggaggccatcctgccggtgcaggagcaggtgccgggcgagacctacccgcacggcgcgcgtctgcgctcgtacgtcgtccgggtggccaagggcgtccggggcccctccgtgacgctctcccgcacgcaccccaacctggtgaagaagctgttcgccctggaggtgccggagatcgccgacggatccgtcgagatctccgcgatcgcccgcgaggccggccaccgcaccaagatcgccgtgcgctccacccgctcgggcctgaacgccaagggcgcctgcatcggccccatgggcggccgggtgcgcaacgtcatgggcgagctgaacggcgagaagatcgacatcgtcgactggtcggacgacccggccgagatggtggcgaacgcgctctccccggcccgcgtctccaaggtggaggtcgtggatctggcggcccgctccgcacgcgtgatcgtgcccgactaccagctctcgctggccatcggcaaggagggccagaacgcccgtctcgcggcccggctgaccggctggcggatcgacatccgcccggacaccgagcagccctccgacgcgtcgccggagcagtcgtccggcggccgcggggaatag

SEQ ID NO: 64376 - protein, 340 aa, Streptomyces coelicolor A3(2)
MDIDMSALRGLVREKEISFDLLVEAIESALLIAYHRTEGSRRHARVELDRNTGHVTVWAKEDPDDLEEGQAAREFDDTPSDFGRIAATTAKQVILQRLRDAEDDATLGEYAGREGDIVTGVVQQGRDPKNVLVDIGKLEAILPVQEQVPGETYPHGARLRSYVVRVAKGVRGPSVTLSRTHPNLVKKLFALEVPEIADGSVEISAIAREAGHRTKIAVRSTRSGLNAKGACIGPMGGRVRNVMGELNGEKIDIVDWSDDPAEMVANALSPARVSKVEVVDLAARSARVIVPDYQLSLAIGKEGQNARLAARLTGWRIDIRPDTEQPSDASPEQSSGGRGE

SEQ ID NO: 64377 - DNA, 1512 bp, Xanthomonas campestris pv. campestris str. ATCC 33913
  CDS (1)..(1512): transl_table=11
atgagcaaggaacttttgctggtagtggatgcggtcgccaacgaaaaaggcgtgccgcgtgaggtgatcttcgacgcgatcgaggccgctttggcttccgcggcgaagaagcgctatcccgaccaggacgtgctgacgcgcgtgaccatcgatcacaaggatggcaattacgaaaccttccgccgttgggaagtggtggccgacgatgtggtgatggagtcgcccgaccgccaggtgcgcctgatggatgccatcgaggaagccgacggcgtcgatgtcggtgactacgtcgaagagcaaatcgaaaacccggacttcggccgcatcgccgcgcaggccgccaagcaggtcatcgtgcagcgtgtgcgcgaagccgagcggcagcaggtggtcgatgcgtggaaggatcgcgtgggtgagttgatcaccggcgtggtcaagcgtgccgagcgcggcaacatctttgtggacctgggcggtaatgccgaagccttcattccgaaggacaagggcattccgcgcgatgtgctgcgcccgggcgaccgtgtgcgcggttatctggccgaagtgcgctcagagccgcgtggcccgcagctgttcatcagccgcgccgcaccggaattcatgatcgagctgttcaagctggaagtgccggaagtgggccagggcctggtcgagatcaaggcctgcgcacgtgatccgggtgaccgcgccaagatcgcggtgattgcgcacgacacccgcaccgacccgatcggtgcgtgcatcggcatgcgcggttcgcgcgtgcaggcggtatctaacgagctcaatggcgagcgcgtggacatcgtgttgtggaacgagaacccggccaacttcgtgatcaacgcgatggcgcctgccgaagtgcagtcgatcatcgtcgatgaagacaagcattcgatggacctggccgtggcggaagaccgcctggcacaggcgatcggcaagggcggccagaacgtgcgtctggccagccgcctgaccggttggcagctcaacgtgatgaccgccgaccaggtggccgccaagtccgaggctgaacaggcatcggcgcgccagctgttcatggatcgcctggaagtggacgaggaaatttccgcgatcctggtgtccgaaggcttcaacacggtcgaagaaattgcctacgtgccggttggcgagctgctggcggtggagggtttcgacgaagacatcgtcgaagaactgcgcgcccgtgcccgcgacgcgctgctcaatgccgcgctggccgaggaagaaggactggaagggactcagcccaccgaggacctgctggcgttggaggggatggacgaggaaacggcctttgctctggccgagcacggcgtgcgcaccagcgaggacttgtccgacctggcagcggacgagatcgtcgacttcggcatcgagggcatgacccaggagcgcgccgcggcgctgatcctggcggcccgcgccgaggagatcgcccgtttggagcgcggcgaatga

SEQ ID NO: 64378 - protein, 503 aa, Xanthomonas campestris pv. campestris str. ATCC 33913
MSKELLLVVDAVANEKGVPREVIFDAIEAALASAAKKRYPDQDVLTRVTIDHKDGNYETFRRWEVVADDVVMESPDRQVRLMDAIEEADGVDVGDYVEEQIENPDFGRIAAQAAKQVIVQRVREAERQQVVDAWKDRVGELITGVVKRAERGNIFVDLGGNAEAFIPKDKGIPRDVLRPGDRVRGYLAEVRSEPRGPQLFISRAAPEFMIELFKLEVPEVGQGLVEIKACARDPGDRAKIAVIAHDTRTDPIGACIGMRGSRVQAVSNELNGERVDIVLWNENPANFVINAMAPAEVQSIIVDEDKHSMDLAVAEDRLAQAIGKGGQNVRLASRLTGWQLNVMTADQVAAKSEAEQASARQLFMDRLEVDEEISAILVSEGFNTVEEIAYVPVGELLAVEGFDEDIVEELRARARDALLNAALAEEEGLEGTQPTEDLLALEGMDEETAFALAEHGVRTSEDLSDLAADEIVDFGIEGMTQERAAALILAARAEEIARLERGE

SEQ ID NO: 64379 - DNA, 1176 bp, Staphylococcus aureus subsp. aureus MW2
  CDS (1)..(1176): transl_table=11
gtgtcaagtaatgaattattattagctactgagtatttagaaaaagaaaagaagattcctagagcagtattaattgatgctattgaagcagctttaattactgcatacaaaaagaattatgatagtgcaagaaatgtccgtgtggaattaaatatggatcaaggtactttcaaagttatcgctcgtaaagatgttgttgaagaagtatttgacgacagagatgaagtggatttaagtacagcgcttgttaaaaaccctgcatatgaaattggtgatatatacgaagaagatgtaacacctaaagattttggtcgtgtaggtgctcaagcagcgaaacaagcagtaatgcaacgtcttcgtgatgctgaacgtgaaattttatttgaagaatttatagacaaagaagaagacatacttactggaattattgaccgtgttgaccatcgttatgtatatgtgaacttaggtcgtatcgaagctgttttatctgaagcagaaagaagtcctaacgaaaaatatattcctaacgaacgtatcaaagtatatgttaacaaagtggaacaaacgacaaaaggtcctcaaatctatgtttctcgtagccatccaggtttattaaaacgtttatttgaacaagaagttccagaaatttacgatggtactgtaattgttaaatcagtagcacgtgaagctggcgatcgctctaaaattagtgtcttctctgaaaacaatgatatagatgctgttggtgcatgtgttggtgccaaaggcgcacgtgttgaagctgttgttgaagagctaggtggcgaaaaaatcgacatcgttcaatggaatgaagatccaaaagtatttgtaaaaaatgctttaagcccttctcaagttttagaagttattgttgatgaaacaaatcaatctacaatagttgttgttcctgattatcaattgtcattagcgattggtaaaagaggacaaaacgcacgtctagctgctaaattaaccggctggaaaattgatattaaatcagaaacagatgcgcgcgaagcgggtatctatccagtagttgaagctgaaaaagtaactgaagaagatgttgctttagaagatgctgacacaacagaatcaaccgaagaggtaaatgatgtttcagttgaaacaaatgtagagaaagaatctgaataa

SEQ ID NO: 64380 - protein, 391 aa, Staphylococcus aureus subsp. aureus MW2
MSSNELLLATEYLEKEKKIPRAVLIDAIEAALITAYKKNYDSARNVRVELNMDQGTFKVIARKDVVEEVFDDRDEVDLSTALVKNPAYEIGDIYEEDVTPKDFGRVGAQAAKQAVMQRLRDAEREILFEEFIDKEEDILTGIIDRVDHRYVYVNLGRIEAVLSEAERSPNEKYIPNERIKVYVNKVEQTTKGPQIYVSRSHPGLLKRLFEQEVPEIYDGTVIVKSVAREAGDRSKISVFSENNDIDAVGACVGAKGARVEAVVEELGGEKIDIVQWNEDPKVFVKNALSPSQVLEVIVDETNQSTIVVVPDYQLSLAIGKRGQNARLAAKLTGWKIDIKSETDAREAGIYPVVEAEKVTEEDVALEDADTTESTEEVNDVSVETNVEKESE

SEQ ID NO: 64381 - DNA, 1107 bp, Bacillus anthracis str. A2012
  CDS (1)..(1107): transl_table=11
atgagcactgagttgttagatgccttgctcgtattagagtcagaaaaaggaattagcaaagatattattattgatgcgattgaagcagcgttaatctctgcttataaacgcaattttaaccaagcacaaaacgttcgtgtgagctttaacccacaagtgggaacaatccaggttttagcacgtaaagacgttgttgataatgtgtttgatccacgtcttgaaatttctgttgaagaagcaagacaaattaatccaaactatcaagatggtgacgtactagaaattgaagtaacaccaaaagatttcggtcgtattgcagcacaaactgcaaaacaagttgtaacacaacgagtgcgtgaagctgagcgtggtgttatttactctgagtttagtgaccgtgaagaagatatcatggttggtatcgtacaacgtcaagatgctcgtttcatctatgtaagcttagggaaagtagaagctttattacctgtaagtgagcaaatgccaaacgaacaatacaaaccacatgatcgtattcgcgtattcattacgaaagtagaaaaaacaacaaaaggaccacaaatttacgtatcacgtacacatcctggtcttttaaaacgtttattcgaaatggaagttcctgaaatctatgatggaacggttgaaattcgttctgtagcacgtgaagcaggagatcggtctaaaatctctgtacatgcagagaacattgatgttgatccagtaggttcttgtgtaggaccgaaaggacaacgtgtacaacgcattgtagacgaactaaaaggtgaaaagattgacatcgttcgctggtcaaatgatccagtagaatatgttgccaatgctttaagcccatcacaagttgtgaaagtacttgtagatgaagaagaaaaagcaacaactgttgttgttccagaccaccaactgtcattagctatcggtaaacgtggacaaaatgcacgtcttgcagctaaattaacaggttggaaaattgatattaagagtgagtctgatgcgaaacaacttggtattgtaacagaagaagatagcgtagtcgcattcggattcgattcagttgaagacgaaatcgaatag

SEQ ID NO: 64382 - protein, 368 aa, Bacillus anthracis str. A2012
MSTELLDALLVLESEKGISKDIIIDAIEAALISAYKRNFNQAQNVRVSFNPQVGTIQVLARKDVVDNVFDPRLEISVEEARQINPNYQDGDVLEIEVTPKDFGRIAAQTAKQVVTQRVREAERGVIYSEFSDREEDIMVGIVQRQDARFIYVSLGKVEALLPVSEQMPNEQYKPHDRIRVFITKVEKTTKGPQIYVSRTHPGLLKRLFEMEVPEIYDGTVEIRSVAREAGDRSKISVHAENIDVDPVGSCVGPKGQRVQRIVDELKGEKIDIVRWSNDPVEYVANALSPSQVVKVLVDEEEKATTVVVPDHQLSLAIGKRGQNARLAAKLTGWKIDIKSESDAKQLGIVTEEDSVVAFGFDSVEDEIE

SEQ ID NO: 64383 - DNA, 1566 bp, Chlorobium tepidum TLS
  CDS (1)..(1566): transl_table=11
atgccaagaaagcagctaaagggtgaaactcatgatcagaaggcgcagattgccagcgctttcggagaaatcgagcagtcgaagatttttctggacaagcgttccgaaagcgctgctgtcaagatggatattgccgacctgctcaaggagatcatccagaaacagctcaggaaagattacgatcccgaggtggagtccaatatcttcatcaatcccgaacgcggcgatttcgaggtctatattctgaaaaaaatcgtcaaagaggtcgatcttcccactatcgaaatcggtctcgacgaagttcgccagatcgacgattcgcttgagctgggtgattattacgaggaagggccgatcaagctcgatgattatctgacccgcaagtcgatacagatcatcaagcagtcggtgcagaaaaaggttcgcgatctggagcgcctggccgtgtacgaggaatgcctcgaaaaggtcggcgaggtggtggccggtgaggtttaccaggtcagaccgaacgaggtgatttttacctacaatacctccaaggatcatcgtgtggagctggtgctgccgaagtcggaaatgatgaagaaggacaacccgcgccgcacgccgcgtatgaagttgtacgtcaagcgcatcgagcgcgagaaggtcaaggtgcgaaacgacgacggcaccgttgaggagcgagagaagccggacggcggtatgaaggtgatcgtttcgcgcgtcgatgaccgcttcctttacaagctctttgaaagcgaggttccggagattctcgatggtttgatcgtcatcaagggcatcgcccgcgtgccgggcgaacgagccaaggttgcggttgaatcgaccagctcgcgtatcgatccggttggcgctacggtcggttaccgcggcaagcgcatccagagcatcgtcaaggagctgaacaacgagaacatcgatgtcatctactacaccgacgagccgcaggtgttcatcgcccgtgcgctgcagccggccaagatcgacccgatgaccgtgcacgccgacatgaagacccgcaaggcgcgcgttatgctcaagcccgaccagatcaaatacgctatcggcaagaacggcaacaacatccatctggccgaaaagctgacgggctatgaaatcgacgtctatcgcgacgtgatcgacaagtcgctcgaagacccgaacgacatcgacatcatcgagttccgcgaagagttcggcgacgatatgatctaccagctgctcgacggcggtctcgatacggccaagaagattctgaaaggcggcgtcgaaaaaatcgaggaggctctgctcggcacgcagaagagcgaagagctgttcgtctttaacaagactcgcaagccggtcaagccaaaagagcgccggatcaccgacgacgaaaagcgctactggaagaagatcgccgagaccatctatcgcaccgtcagggagcagttcaacgatgaagatctcaaggcgcttctcgatgacagccatgaacggtcgctcaagggcgacgggatcgatccggaagagattcgggacaaagaaacaaactga

SEQ ID NO: 64384 - protein, 521 aa, Chlorobium tepidum TLS
MPRKQLKGETHDQKAQIASAFGEIEQSKIFLDKRSESAAVKMDIADLLKEIIQKQLRKDYDPEVESNIFINPERGDFEVYILKKIVKEVDLPTIEIGLDEVRQIDDSLELGDYYEEGPIKLDDYLTRKSIQIIKQSVQKKVRDLERLAVYEECLEKVGEVVAGEVYQVRPNEVIFTYNTSKDHRVELVLPKSEMMKKDNPRRTPRMKLYVKRIEREKVKVRNDDGTVEEREKPDGGMKVIVSRVDDRFLYKLFESEVPEILDGLIVIKGIARVPGERAKVAVESTSSRIDPVGATVGYRGKRIQSIVKELNNENIDVIYYTDEPQVFIARALQPAKIDPMTVHADMKTRKARVMLKPDQIKYAIGKNGNNIHLAEKLTGYEIDVYRDVIDKSLEDPNDIDIIEFREEFGDDMIYQLLDGGLDTAKKILKGGVEKIEEALLGTQKSEELFVFNKTRKPVKPKERRITDDEKRYWKKIAETIYRTVREQFNDEDLKALLDDSHERSLKGDGIDPEEIRDKETN

SEQ ID NO: 64385 - DNA, 1506 bp, Yersinia pestis KIM
  CDS (1)..(1506): transl_table=11
ttggatgaggcaactaggatgaacaaagagattctggctgttgtagaagcagtttccaatgagaaatcccttccgcgcgagaagatttttgaggcgttggaaaccgctctagcgacagcaaccaagaaaaaatacgaacaagagattgaagtccgcgtcagtattgaccgtaaaaccggtgattttgatactttccgccgttgggtcgctgttgacgaagtgactatgccaacccgtgaaatcacgttggatgcggctcaatttgaagatccttctctccaattgggtgattatgtcgaagaccagattgaatcggtgacttttgaccgcattaccacccaaacagccaagcaagtcatcgtacaaaaagtacgtgaagctgaacgggcgatggttgttgagcagttccgtcaatatctggggcaaattgtcactggtattgttaagaaagttagccgtgacagtattgcactggatctgggccacaatgcggaagctgttattggtcgtgaagatatgctcccgcgtgaaaatttccgcccaggtgaccgtatccgtggtgttctgtatgacgtgcgtccagaagctcgtggcgcacagttgtttgtcagccgttcacgttctgaaatgttggtcgaactgttccgcattgaagtaccagaaattggtgaagagctgatcgaaattaaagccgctgcccgtgatcctggctctcgtgctaaaattgcggtcaaaaccaatgacaagcgtatcgatccggttggtgcttgcgttggtatgcgtggtgcccgtgttcaggctgtgtccagcgagcttggcggcgagcgcattgatattgtattgtgggatgataatccagcccagtttgttattaacgctatggcgccagctgatgttgcgtctattgtggttgatgaagacaaacacacgatggatgttgccgttgaagccagtaatttggcccaggcaattggtcgtaatggccagaacgtacgtttagccgcgcagcttagtggctgggaactgaacgtaatgacggcggacgatcttcaggcgaagcatcaggccgaggctcatgccgctattgataccttcactaaatatcttgatatcgatgaagactttgccaccgtattggtagaagaaggtttctcttctctggaagagttggcttatgtgccaatgaaagaacttctggaaatcgatggtcttgacgaagatacggttgaagcgctgcgtgatcgcgccaaagctgcattgaccacgctggccctggcacaagaagaaagttttggcgaccagaaacccgctgatgacctgttgaatttagcgggtctggaacgtagcatggcattcaaattggctgcgcgcggtgtatgtacgctggaagatcttgccgagcagggtatcgacgatttggcagatattgaagggcttagcgatgagcaagccggtgagctgattatggccgcacgtaatatctgttggtttggcgataatgcgtaa

SEQ ID NO: 64386 - protein, 501 aa, Yersinia pestis KIM
MDEATRMNKEILAVVEAVSNEKSLPREKIFEALETALATATKKKYEQEIEVRVSIDRKTGDFDTFRRWVAVDEVTMPTREITLDAAQFEDPSLQLGDYVEDQIESVTFDRITTQTAKQVIVQKVREAERAMVVEQFRQYLGQIVTGIVKKVSRDSIALDLGHNAEAVIGREDMLPRENFRPGDRIRGVLYDVRPEARGAQLFVSRSRSEMLVELFRIEVPEIGEELIEIKAAARDPGSRAKIAVKTNDKRIDPVGACVGMRGARVQAVSSELGGERIDIVLWDDNPAQFVINAMAPADVASIVVDEDKHTMDVAVEASNLAQAIGRNGQNVRLAAQLSGWELNVMTADDLQAKHQAEAHAAIDTFTKYLDIDEDFATVLVEEGFSSLEELAYVPMKELLEIDGLDEDTVEALRDRAKAALTTLALAQEESFGDQKPADDLLNLAGLERSMAFKLAARGVCTLEDLAEQGIDDLADIEGLSDEQAGELIMAARNICWFGDNA

SEQ ID NO: 64387 - DNA, 1188 bp, Thermosynechococcus elongatus BP-1
  CDS (1)..(1188): transl_table=11
atgaccatctatcgcttacccggcctacgggccatgatcaatgaaatcagccaagagcggaatttgcccaagcacgcagtgcatcaagccctcaaggaagcactgcttaagggatacgaacgctatcgccgcagtttgcgctcggatcatagtcactttgaggaggatcactttgccaactttgaagtggaactagatacggagcaggagggctttcggattttggccaccaaaaccattaaagaaacagtagagaaccccgatcgcgagattgcgcttgccgatgtgattgaggtggtgcaggatgcccgcgtcggcgatacggtgctgctggatgtcacccccgaccatcaagaatttggccgcatggctgcgatgcaaaccaagcaggtgttggcacaaaaattgcgggatcaacagcgtcgcctcatccaagaggaattcaaagagcttgagggcaccgtactcctgggccgcgtcctccgttttgagcggcaatcggtaattatggctgtgcgcagtgatgctagccaaccggaagtggaggccgaactgccgaaatgggaacaactgcccaacgacaactaccgcgccaactcgacattcaaggtctatcttaagcgcgtcaaagaaggcccccaacgcggcccccaattggaggtttcccgtgccgatgctggcttggtggtctatctctttgccaatgaagtgccagaaattgaggatgaagtggtgcggattgttgccattgcccgcgaagccaatcccccgaatcataaagtgggaccgcgtaccaaaattgcggtggataccttagaacgggatgtcgatcctgtgggcgcctgtattggggcacggggatcccgcattcaagcggtggtgaatgaactgcggggcgaaaaaattgatgtgatccgctggtcgccggatccagccacctatattgccaattccctgagtccggcaccggtggaggaggtgcggctcatcaaccccgaagcccgcatcgcccatgtccttgtggcaccggataaggtctcccaagccattggtaaagaaggtcaaaatgtgcgcttagcaacccgcctcacgggctggaaaattgaggtgcgcgatagttctcagtacaactacgaagaggaggatcgcttggccatggctgctctcgaagaacaggttgccagttag

SEQ ID NO: 64388 - protein, 395 aa, Thermosynechococcus elongatus BP-1
MTIYRLPGLRAMINEISQERNLPKHAVHQALKEALLKGYERYRRSLRSDHSHFEEDHFANFEVELDTEQEGFRILATKTIKETVENPDREIALADVIEVVQDARVGDTVLLDVTPDHQEFGRMAAMQTKQVLAQKLRDQQRRLIQEEFKELEGTVLLGRVLRFERQSVIMAVRSDASQPEVEAELPKWEQLPNDNYRANSTFKVYLKRVKEGPQRGPQLEVSRADAGLVVYLFANEVPEIEDEVVRIVAIAREANPPNHKVGPRTKIAVDTLERDVDPVGACIGARGSRIQAVVNELRGEKIDVIRWSPDPATYIANSLSPAPVEEVRLINPEARIAHVLVAPDKVSQAIGKEGQNVRLATRLTGWKIEVRDSSQYNYEEEDRLAMAALEEQVAS

SEQ ID NO: 64389 - DNA, 1140 bp, Streptococcus agalactiae 2603V/R
  CDS (1)..(1140): transl_table=11
atgctagaagccttccgtattttggaagaagaaaaacacattaataaagaagatattattgatgcagttactgagtcactaaaatctgcctataagcgtcgttatggtcaatcagaatcatgcgttattgaatttaacgagaagaaagcagactttaccgtctatactgttcgtgaagttgttgatgaagtttttgatagccgtttggaaattagcctaaaagatgcccttgctattagctcagcgtatgaacttggtgataagattcgctttgaggaatctgttacagaatttggacgcgtggcagctcagtcagcaaaacaaactattatggaaaaaatgcgtcgtcaaatgcgtgaagtaaccttcaatgaatacaaacaacacgaaggtgaaattatgactggtactgttgaacgatttgaccaacgttttatttatgtcaatctcggttcacttgaggcgcaattatcgcatcaagatcagattcctggagagagctttaaatctcatgatatgattgatgtttatgtctataaagtggagaataatcctaaaggagtcaacgtttttgttagccgtagtcatccagagtttatcaaacgcattatggagcgagaaattccagaagtatttgatggaactgttgagattatgagcgtctctcgtgaggctggagatcgtactaaagttgctgtacgcagtcataattcaaacgttgatgcgattggaacaattgttggacgcggtggaagtaacattaaaaaagttatcagtaatttccatcctaaacgcgttgatgctaaaacaggattggagatcccggttgaagaaaacattgatgttattcaatgggttgaagatccagcggaattcatttacaatgctattgcaccagccgaagttgatatggtactttttgatgatgaagatacaaaacgtgctactgtagttgttccagatagcaagttatcgctagctattggtcgccgaggacaaaatgtgcgtttagcagctcatttgactggctatcgtattgatattaaatctgcaagtgaatacgaaaaaatggaagcgcaagaacttcaaactgaggaagtagctcaagaatctgaagttatttcagataaggcagaataa

SEQ ID NO: 64390 - protein, 379 aa, Streptococcus agalactiae 2603V/R
MLEAFRILEEEKHINKEDIIDAVTESLKSAYKRRYGQSESCVIEFNEKKADFTVYTVREVVDEVFDSRLEISLKDALAISSAYELGDKIRFEESVTEFGRVAAQSAKQTIMEKMRRQMREVTFNEYKQHEGEIMTGTVERFDQRFIYVNLGSLEAQLSHQDQIPGESFKSHDMIDVYVYKVENNPKGVNVFVSRSHPEFIKRIMEREIPEVFDGTVEIMSVSREAGDRTKVAVRSHNSNVDAIGTIVGRGGSNIKKVISNFHPKRVDAKTGLEIPVEENIDVIQWVEDPAEFIYNAIAPAEVDMVLFDDEDTKRATVVVPDSKLSLAIGRRGQNVRLAAHLTGYRIDIKSASEYEKMEAQELQTEEVAQESEVISDKAE

SEQ ID NO: 64391 - DNA, 1095 bp, Oceanobacillus iheyensis HTE831
  CDS (1)..(1095): transl_table=11
gtgagcatgcagttatttgatgcgattgagaatttagcaaaagaaaagggaattgataaggatatcttaatggaggccttagaagcagctttaatctcagcgtataagaaaaatttcaaatctgcttccaatgtaagagtagagttgaatgaagaaacaggaaaaatggcagtttatgcacgtaaaacagtggtagatgaaatagaagatgtacagcaagaaattccattagatgaagcaaagaaaattgatccaaactatgaagttgatgatgtgatcgaagtagaagtaacaccgaaagattttggacgtattgctgcacaagctgcaaaacaagttgtgactcaacgagttcgagaagcggagagaggcgtgattttctcagaatatgttgatcgagaagaagatgtcatgactggtataatacaacgaaaagatccacgctttgtttacgttaatttaggtaaaattgaagcaaaattagctgagtctgagcagatgcctacggaagattatcatgtgcatgatcgactaaaagtgtttgttacgaaagtagaaaatacaagtaagggtccacaaatttttatttctagatcacaccctggtttgttgaaaagactatttgaaatggaagtacctgaaatttatgatggaactgtagaaattaagtcagtagctcgtgaagcaggagatcgctcaaaaatttctgtgtatgccccagatcctgaaatagatccagttggttcttgtgttggacaacgtggacaacgagtgcaggcaatagtaacagaactcaaaggtgagaaaatagacattgttcaatggtcagaagatccagtggtatatgtatctaatgcgttgagtccatctaaagtggttaaggtttcggtaaacgaggaagagaaatcaacgacagtagtcgttccagattaccaattatccctagctattggtaagagaggccaaaatgccagattagctgctaaactaacaggatggaagatagatattaaaagtgaatccgaagcaagagaagaaggattgctagacgatggtgaatcttattctgacaatgaaaacgacttgtttgaataa

SEQ ID NO: 64392 - protein, 364 aa, Oceanobacillus iheyensis HTE831
MSMQLFDAIENLAKEKGIDKDILMEALEAALISAYKKNFKSASNVRVELNEETGKMAVYARKTVVDEIEDVQQEIPLDEAKKIDPNYEVDDVIEVEVTPKDFGRIAAQAAKQVVTQRVREAERGVIFSEYVDREEDVMTGIIQRKDPRFVYVNLGKIEAKLAESEQMPTEDYHVHDRLKVFVTKVENTSKGPQIFISRSHPGLLKRLFEMEVPEIYDGTVEIKSVAREAGDRSKISVYAPDPEIDPVGSCVGQRGQRVQAIVTELKGEKIDIVQWSEDPVVYVSNALSPSKVVKVSVNEEEKSTTVVVPDYQLSLAIGKRGQNARLAAKLTGWKIDIKSESEAREEGLLDDGESYSDNENDLFE

SEQ ID NO: 64393 - DNA, 1068 bp, Bifidobacterium longum NCC2705
  CDS (1)..(1068): transl_table=11
atggaactggacctgacaggaatacacaagctcgccgccgagcaaggaatcgaccccggaaccctggatgatgcgctggcagaggccctgcgcctcgcctacctcaagaccccgcacgccgccaggcacgcgcgtgtggagcttgacgaacgttccggcaatttcaccgtctgggccgccgacgaaatcccggtcgaacccaccgaagacaacccttaccccgttcccaagctgggcgaggaatacgacgacaccccgcgtgacttcggccgtctcgccgccgccactgcacgccaggtcatcacccagctgttccgccgcgccgaagatgagaaggtattcggcgcgttctccggtcagaagggcaagctcatcaccggcatcatccaacaggatgcttccgacccctccaacgtgcatgtcgcgatgggcgatgtcgaagccattctgcctcgccgtgagcaggtgcccggcgaacgttaccgccacggcgaacgcatccgcgtgtacgtggtgaacgtggcccgtggcatcaagggcccggaaatcgtggtgtcccgctcccacccggagctggtccgcaagctgttcgagcgtgaagtgccggaactggtctccggtgccgtgtccatcatggccatcgctcgtgaggccggcgcccgcaccaagatcgcggtcaaggccaacaccgatggcgtgaacccgaagggtgcgctgatcggccccggcggcgctcgcgtgcgtgccgttatggagaaccttggcccggagaagatcgacatcgtcgactactccgacgatccggccaagttcgtggcagccgcgctgtccccggctgtggccaccggcgtacaggtgatcagcgagaagaacaagaccgccatcgccttcatccacgacgaccagctatccctggccatcggcaaggaaggccagaacgcacgactggcagccaagctgaccggctggaagatcggcatcgaatccgccgaggcccatgccaagaaggtcgccgccgaaaaggccgcccaggctgcggccgaggctgctgctccggaagccgaatag

SEQ ID NO: 64394 - protein, 355 aa, Bifidobacterium longum NCC2705
MELDLTGIHKLAAEQGIDPGTLDDALAEALRLAYLKTPHAARHARVELDERSGNFTVWAADEIPVEPTEDNPYPVPKLGEEYDDTPRDFGRLAAATARQVITQLFRRAEDEKVFGAFSGQKGKLITGIIQQDASDPSNVHVAMGDVEAILPRREQVPGERYRHGERIRVYVVNVARGIKGPEIVVSRSHPELVRKLFEREVPELVSGAVSIMAIAREAGARTKIAVKANTDGVNPKGALIGPGGARVRAVMENLGPEKIDIVDYSDDPAKFVAAALSPAVATGVQVISEKNKTAIAFIHDDQLSLAIGKEGQNARLAAKLTGWKIGIESAEAHAKKVAAEKAAQAAAEAAAPEAE

SEQ ID NO: 64395 - DNA, 1614 bp, Brucella suis 1330
  CDS (1)..(1614): transl_table=11
atggcagtcagtgctaacaggctggagcttctgcagatcgccgatgcggtcgcccgcgagaagtcgattgaccgtgagatcgttcttgcggccatggccgatgcgatccagaaggccgcgcgttcgcgctatggccaggaaagcaatatccgcgccgacatcaatgcgaagtccggcgagatcaagttgcagcgcctgctggaagtcgtggagaatgtcgaggattacgcaacgcagatttcgctgttcatggcgcgcgaccgtaatcccgatgcgcaggttggcgacttcattgccgatcagcttccgccgatggatttcggccgcatcgcagcccagtctgccaagcaggttattgtgcagaaagtgcgcgaagccgaacgtgaccgccagtatgacgaatacaaggatcgcgttggcgaaatcgtcaacggcaccgtcaagcgtgtcgaatatggcaatgtgatcgtggatctgggccgtggcgaagcgatcgtgcgccgcgacgaactgatcccgcgcgaagccttccgctatggcgaccgcatccgcgcctatgtctatgatgtgcgccgcgaacagcgtggcccgcagattttcctgtcgcgcacccatccgcaattcatggcgaagctcttcaccatggaagtgccggaaatctatgacggcatcatcgagatcaagtcggtcgctcgcgatccgggttcccgcgccaagatcgccgtcgtctcgcgcgatgcgtccattgacccggtcggcgcctgcgtcggtatgcgcggctcccgcgttcaggctgttgtggccgagttgcagggcgaaaagatcgatatcattccgtggtcgccggatgcggcttccttcatcgtcaacgcgcttcagcccgctgaagttgccaaggttgttctcgatgaagatgccgaacgtattgaagttgtcgttccgaatgaccaactatcacttgcaatcggtcgtcgcggccagaacgtccgcctcgcctcgcagcttaccggctgggacatcgacatcctgacggaagacgaggaatccgaacgtcgccagaaggaattcgcagaacgttcaaacctgttcatggaagccctcaacgttgacgaaatggtcggtcaggttcttgcctccgaaggtttcgcctccgttgaagaactggcctatgtggatgcaggcgaaatttcgtccattgacggtttcgacgaagacacggcaggcgaaatccaggatcgcgcccgcgaatatctggagcgtatcgaagccgagcaggatgcccgccgcaaggaactgggcgttgccgacgaactgcgcgaactgccgggcatgaccacggccatgctggttgccgttggtgaagacggcgtgaagaccatggaagatttcgccggttatgcggtggacgatctggtcggctggcgcgagcgcaaggatggcgacaccatcaaccatagtggtgttctgacgccgttcgacctttcgcgtgtcgatgcggagcagatggtgctggcagcgcgcttgaaagcgggctggatcaccgaagaggaactggctgcggcttccgaagacgtggaagctgaagaagctggcgacgaggaagctgcgtcgtaa

SEQ ID NO: 64396 - protein, 537 aa, Brucella suis 1330
MAVSANRLELLQIADAVAREKSIDREIVLAAMADAIQKAARSRYGQESNIRADINAKSGEIKLQRLLEVVENVEDYATQISLFMARDRNPDAQVGDFIADQLPPMDFGRIAAQSAKQVIVQKVREAERDRQYDEYKDRVGEIVNGTVKRVEYGNVIVDLGRGEAIVRRDELIPREAFRYGDRIRAYVYDVRREQRGPQIFLSRTHPQFMAKLFTMEVPEIYDGIIEIKSVARDPGSRAKIAVVSRDASIDPVGACVGMRGSRVQAVVAELQGEKIDIIPWSPDAASFIVNALQPAEVAKVVLDEDAERIEVVVPNDQLSLAIGRRGQNVRLASQLTGWDIDILTEDEESERRQKEFAERSNLFMEALNVDEMVGQVLASEGFASVEELAYVDAGEISSIDGFDEDTAGEIQDRAREYLERIEAEQDARRKELGVADELRELPGMTTAMLVAVGEDGVKTMEDFAGYAVDDLVGWRERKDGDTINHSGVLTPFDLSRVDAEQMVLAARLKAGWITEEELAAASEDVEAEEAGDEEAAS

SEQ ID NO: 64397 - DNA, 1383 bp, Leptospira interrogans serovar Lai str. 56601
  CDS (1)..(1383): transl_table=11
atggcagttaagaagatacaatcggaaggaaatctgttggaagcgatccaacaattttgtgcggataaatccctggatagggaagcagttatgggagtcattcgagattctttgataaccgcatataaaaaaaaatccggactggaggaatcttcagaattggaaaaaccttctccagttaccgtagagtttgcttctggaaaagatagcgtagtcatcgcaattgcaaaaaaggtagtttctggaaatccttcttccgcattggaaatcagtttagaggatgctaaagcaattgatgcatcagcggaaattggatccgtaatttcttttcgagaaaaaccagtagaactttccagaatcatttctagccaagcgaaacaaatggtgtttcaaagactcaaagatatggagaaagaacttctctttaacgagtataaggcgaaggaaggagagttgactcacggatattttcagagatggaaaaaagatgccatgagcatcgatctcggaaaggtggaagggattatgccccgccgagaacaaaatccgggtgaaaagtatcatagcggagatagactcaaagcaattattcaaagggtagaattacgtcctagagaaccaattccggtcattacactttctagggcatctgcggattttgttcgtaaattgttcgaaatggaaattccagaaatctacgatggtttagtcgaaattatcaatgtagctagacaaccttctattcgtacaaaagttgtagtacgcgctacccgcggagacatagacccagtaggggcttgtgtaggtatgaaaggggttcggattcaatcaatcgtaagagaacttggaaacgaaaggattgatattgtagaatcctccgatgacgcttccgaatttatagcaaatgcaatttctcctgcaaaaccggtggaagtaaaagtggacggttctggtagagaagcaatggtagtcgtgcctgatgatcaactttctcttgcgatcggaatcaatggatctaatgtaaaactcgcttctcagttggctggttacaaaattgatattaaaaccgtgacacaatataacgccgaacttgcttcaccagaagcaagagaaaggctggaaagacttttttactctcctgtggaagaaaccaaagtttcgatggaacaagaagaggaggaagaacttacgcctttggaagatcttcctggtctctctgctcgtatcgtaggaattttgaagagcgagggaattaaagatttggaaactctaattgagtatagccaagacgatctggcaaaattacaaggaatcggacatactacagccggacagattctcaaattgctccgagagtccgtagaatgggtggaggataactga

SEQ ID NO: 64398 - protein, 460 aa, Leptospira interrogans serovar Lai str. 56601
MAVKKIQSEGNLLEAIQQFCADKSLDREAVMGVIRDSLITAYKKKSGLEESSELEKPSPVTVEFASGKDSVVIAIAKKVVSGNPSSALEISLEDAKAIDASAEIGSVISFREKPVELSRIISSQAKQMVFQRLKDMEKELLFNEYKAKEGELTHGYFQRWKKDAMSIDLGKVEGIMPRREQNPGEKYHSGDRLKAIIQRVELRPREPIPVITLSRASADFVRKLFEMEIPEIYDGLVEIINVARQPSIRTKVVVRATRGDIDPVGACVGMKGVRIQSIVRELGNERIDIVESSDDASEFIANAISPAKPVEVKVDGSGREAMVVVPDDQLSLAIGINGSNVKLASQLAGYKIDIKTVTQYNAELASPEARERLERLFYSPVEETKVSMEQEEEEELTPLEDLPGLSARIVGILKSEGIKDLETLIEYSQDDLAKLQGIGHTTAGQILKLLRESVEWVEDN

SEQ ID NO: 64399 - DNA, 1500 bp, Shewanella oneidensis MR-1
  CDS (1)..(1500): transl_table=11
atgaataaagagattctgctagtcgctgaagcggtttcaaatgaaaaggccgttccacgcgagaaaatttttgaagcgctagagactgcgctggctaccgctaccaagaaaaaatacgaaggtgatatcgacgttcgtgttgctatcgaccgtaaaactggcgcttatgaaactttccgccgttggatggtgatcgatgacaacggtgttgcgttagaaaacccataccgtgagatcacactggaagcggcacgtttcgaagaaccagagatccaacctggcgaatacattgaagaccaaattgaatcagtggcttttgaccgtattaccactcaaaccgccaagcaagtcatcgtgcagaaggtgcgtgaagctgagcgggcgcaagtggttgagcagttccaagataaagaaggcgaactgatcactggtgttgttaagaaagcaacccgtgaaagtgtcgttgtcgacttaggcaataacgctgacggcgtattgttccgtgaagacttgatttcacgcgaatctttccgtcctggtgaccgtgttcgtgcactgctttactcagttcgtcctgaagcgcgtggcgcgcagttatttttaactcgcactaagccagacatgcttattgagctgttccgcgttgaagtaccggaaattgccgatgaattgattgaagtgatgggcgcagcgcgcgaccctggtgcgcgagctaagatcgccgtgaaatcaaacgaccgtcgtatcgaccccatcggtgcttgcgttggtatgcgtggtgcgcgtgttcaagccgtatcgaatgaactcggtggtgagcgtgttgatatcgtgctgtgggatgataatccagcacaatatgtgatcaacgccatggcgccagctgatgtggcttctatcatcgtagatgaagacaaccactcaatggatatcgccgttgaagcagaaagtttggctcaggccattggtcgcaatgggcaaaacgttcgtttagcaactcagctgactggctgggaactgaacgtgatgacagtggaagacatgaataagaaacaccaagccgaaagcgctaaggtgaagagcttatttatgaaatctctggatgtagatgaagattttgcacaagtactggctgatgaaggttttacttcgctcgaagaagtggcttatgtgcctgtgtctgaattattagcaattgatggtttcgatgaggatctcgttgaagcattacgtgaacgtgcaaaggctgcgatctcaactcgagcgctcgcatctgaagaagcactagatggtgtggagccaagtgaagagttattagcacttgaaggtgttgaaagacacttagcctatgttttagcaagcaaaggtatcgtaactctagaagatttggctgaacaaggcattgatgatttgatcgaaattgaagaattgacagaagaaaaagcaggtgagctgatcatggccgcccgcaacatctgttggtttggcgaagaagcataa

SEQ ID NO: 64400 - protein, 499 aa, Shewanella oneidensis MR-1
MNKEILLVAEAVSNEKAVPREKIFEALETALATATKKKYEGDIDVRVAIDRKTGAYETFRRWMVIDDNGVALENPYREITLEAARFEEPEIQPGEYIEDQIESVAFDRITTQTAKQVIVQKVREAERAQVVEQFQDKEGELITGVVKKATRESVVVDLGNNADGVLFREDLISRESFRPGDRVRALLYSVRPEARGAQLFLTRTKPDMLIELFRVEVPEIADELIEVMGAARDPGARAKIAVKSNDRRIDPIGACVGMRGARVQAVSNELGGERVDIVLWDDNPAQYVINAMAPADVASIIVDEDNHSMDIAVEAESLAQAIGRNGQNVRLATQLTGWELNVMTVEDMNKKHQAESAKVKSLFMKSLDVDEDFAQVLADEGFTSLEEVAYVPVSELLAIDGFDEDLVEALRERAKAAISTRALASEEALDGVEPSEELLALEGVERHLAYVLASKGIVTLEDLAEQGIDDLIEIEELTEEKAGELIMAARNICWFGEEA

SEQ ID NO: 64401 - DNA, 1794 bp, Mycoplasma penetrans HF-2
  CDS (1)..(1794): transl_table=4
atgaaaattaaatcttttttagaaaatctagataaaatagctaaagaaaaagatacatcaaaagaaaatatagtaaatattttaaaaactgctttggaaaaatcttatttaaaagagaatccagatttggacattgaagtagttgttgatttaaacaaagagtcaatcaaactttttgaaaaaagagttgttgttgataaatcagaagatgaaattgatgatgacaaagaaatcaatattagtgaagctcaagaattaaaaaaatcatataaattgggtgacactgtaagcactgaagttaatattgataaatttgaaagaagaattacatctcactttgcacaaatcttaactcataacttaaatgatatttctaactctaaagtttatgaagaatgaaaagataaagtaggaaatattattagagcagaagttgaaaaggttgataatagattagttgaagtaaacttaggttctactaaaggggttgttttaagatctgaacaaatccctggtgaagaactacaacctggtcaaagttatttgtttttaattaaagaagttaaatctcaacaaactaaaggttgaccaatcatcttatcaagagcagatgaaggtttattaagatacttattgaaaactgaaatttctgaaatttcagatggaattattgaaattaaaagaatatctagaattgtaggatataaaactaaagttgcaattctttctagagttcctggtgttgatgctgttggaacagctgttggaccaaaaggagaaagaattaaaaagatttctagcacattaaacaatgaaagaattgatgtaattttatatgatgaagatcctaagcaattcttagtaaatgcttgtcatcctgaaaaaattgtgggtgttgaaattacagatgatgaagatattccagggtcaaaaatagtaactattgtatgtcctgaagaaagtttaattaagttaattggtaaaaatggaattaatgttagattactttctaaattaactggttgaagtattgatattatttctgaaaaattagcaattgaagacaaaattgaatttgaagatgtttcacaattagtttcttctaaaactagacaaccaagaagtcaatttggtggttatagattaaacaatgctaataataaaaaatctacaagcaacaaacctggtagcaaacctaatttctatagtggtttctcttcagatgattcaattgaaactgactttgatattgatcaatacaaagcagaattggatagcattacagatgatgatgtagaacaattattaaatactaataccaatagttcttcaagaaaaaataaaaagcaaattgaagatgatgaagaagtagtattttatgaatcatcaaaagaaaaaaatgattcacaagattcaactccagtaactgaagaagtagtaaatgaccaaattacttttaaatataaagaagaaaaacctgcttctgaaactaaatcaaaaaaagaaaaaccagcagtagtaagttcagatgatgatgaccaagattatgaacctgtatcacttgttagaaaagattcttctgacattgatgatattggaggagatgatccttgattattaagagctaaaaaagaaaataaatctagcaaatctaaaaactacaacaaagcgcctaaacctaaaaaagaaaaggtgagtgtatttgatgagttaatggataatacagatgacatttcagtagatagtgaaatagatacttctgaacttgataatctggaactagaagatgaataa

SEQ ID NO: 64402 - protein, 597 aa, Mycoplasma penetrans HF-2
MKIKSFLENLDKIAKEKDTSKENIVNILKTALEKSYLKENPDLDIEVVVDLNKESIKLFEKRVVVDKSEDEIDDDKEINISEAQELKKSYKLGDTVSTEVNIDKFERRITSHFAQILTHNLNDISNSKVYEEWKDKVGNIIRAEVEKVDNRLVEVNLGSTKGVVLRSEQIPGEELQPGQSYLFLIKEVKSQQTKGWPIILSRADEGLLRYLLKTEISEISDGIIEIKRISRIVGYKTKVAILSRVPGVDAVGTAVGPKGERIKKISSTLNNERIDVILYDEDPKQFLVNACHPEKIVGVEITDDEDIPGSKIVTIVCPEESLIKLIGKNGINVRLLSKLTGWSIDIISEKLAIEDKIEFEDVSQLVSSKTRQPRSQFGGYRLNNANNKKSTSNKPGSKPNFYSGFSSDDSIETDFDIDQYKAELDSITDDDVEQLLNTNTNSSSRKNKKQIEDDEEVVFYESSKEKNDSQDSTPVTEEVVNDQITFKYKEEKPASETKSKKEKPAVVSSDDDDQDYEPVSLVRKDSSDIDDIGGDDPWLLRAKKENKSSKSKNYNKAPKPKKEKVSVFDELMDNTDDISVDSEIDTSELDNLELEDE

SEQ ID NO: 64403 - DNA, 1224 bp, Staphylococcus epidermidis ATCC 12228
  CDS (1)..(1224): transl_table=11
gtgtcaagtaatgaattattattagctactgaatatttagaaaaggaaaagaaaattcctagagaagttttaattgatgcaattgaagcagctttaattactgcgtacaagaaaaactatgatagtgccagaaatgtaagagtagaattaaatatggacgaaggttcatttagagtgattgcacgtaaagaagtcgtagaagaagtgtttgatgacagagatgaagttgatttaagtactgctttagtcaaaaatcctgcctatgaagtaggagatatttatgaacaagatgtaacaccgaaagacttcggacgtgtaggagctcaagcagctaagcaagctgtgatgcaacgacttagagacgcagaaagagaaattttatatgatgaatttatcgataaagaagaagatattctaacaggtgtgattgaccgtgtagaccatcgctatgtatatgtgaatttaggaagaattgaagctgtgctgtcagaagctgaaagaagtcctaatgagaaatatattcctaatgaacgtatcaaggtgtacgtaaataaagttgaacagactacaaaaggtccacaaatttacgtatcaagaagtcatcctggattactaaaacgcttattcgaacaagaagttccagaaatttatgatggtactgttattgttaaatcagtagcgcgtgaagctggagatcgttctaaaattagcgtgtattctgataatcctgatatagatgctgttggcgcatgtgtaggttctaaaggagcacgagtagaagcggttgttgaagaacttggtggcgaaaaaatcgatatcgtccaatgggatgaagatccgaaagtatttgttcgtaatgctttaagtccatcacaagttttagaagtaattgttgatgaagagaatcaatcaactgtagttgtagttcctgattaccaattatccttagctataggtaaaagagggcaaaacgcacgtttagctgctaaattaacaagttggaagatagatattaaatcagaatctgatgcccgagaagctggaatttatcctgttattgaatcagaagaagttgcagatgaaattgttaattccggtgacgaagatgttgagtttgataatgttaacttggaagagacaaacttaactagtacagaattagctgctgaaactgatgaagataaaaaagataaaacagaagaagataatgacacagaatcatag

SEQ ID NO: 64404 - protein, 407 aa, Staphylococcus epidermidis ATCC 12228
MSSNELLLATEYLEKEKKIPREVLIDAIEAALITAYKKNYDSARNVRVELNMDEGSFRVIARKEVVEEVFDDRDEVDLSTALVKNPAYEVGDIYEQDVTPKDFGRVGAQAAKQAVMQRLRDAEREILYDEFIDKEEDILTGVIDRVDHRYVYVNLGRIEAVLSEAERSPNEKYIPNERIKVYVNKVEQTTKGPQIYVSRSHPGLLKRLFEQEVPEIYDGTVIVKSVAREAGDRSKISVYSDNPDIDAVGACVGSKGARVEAVVEELGGEKIDIVQWDEDPKVFVRNALSPSQVLEVIVDEENQSTVVVVPDYQLSLAIGKRGQNARLAAKLTSWKIDIKSESDAREAGIYPVIESEEVADEIVNSGDEDVEFDNVNLEETNLTSTELAAETDEDKKDKTEEDNDTES

SEQ ID NO: 64405 - DNA, 1611 bp, Bradyrhizobium japonicum USDA 110
  CDS (1)..(1611)
atggcagtcagcgccaatcgacttgaactgctccagatcgccgatgccgtcgcgcgcgagaaatcgatcgaccgcggcatcgtcatcgcggcgatggaggacgccatcgccaaggcggcgcgggcccgttacggcagcgaaactgacgttcacgccgagatcgacccgaagaagggcgagctgcggctgtcgcgccacatgctggtggtcgagaaggtcgaaaaccactccaaccagatttcgctggtggatgcgcagcgcgccaatcccggcgcccaggtcggtgacaccatcgccgacaccctgccgccgctcgaatatggccgcatcgctgcgcagtcggccaagcaggtgatcgtgcagaaggtgcgcgaggccgagcgcgaccggcaatatcaggaattcaaggaccgcatcggcgacatcgtcaacggcgtcgtcaagcgcgtcgaatatggcagcgtgatcgtcgatctcggccgcggtgaagccatcatccgccgcgacgagatgctgccgcgcgaagtgttccgcaacggcgaccgcgtccgcgcctatatcttcgacgtccgccgcgagacccgcggcccgcagatcttcctctcccgcacccatccgcagttcatggcgaagctgttcgcgcaggaagtgccggaaatctatgacggcatcgtcgagatcaaggcggttgcccgcgatcccggctcgcgcgcgaaaatcggcgtgatttcccgcgattcctcggtcgatccggtcggcgcctgcgtcggcatgcgcggctcgcgcgtgcaggccgtggtgaacgaattgcagggcgagaagatcgacatcattccctggtcgcccgacatcgcgaccttcgtggtcaacgcgctggcgccggccgaagtctccaaggtcgtcatcgacgaagaccgcgagcgcatcgaggtcgtggtgcccgataccaacaaccagctctcgctggcgatcggccgccgcggccagaacgtgcgcctcgcctcgcagctcaccggctgggatatcgacatcctgaccgagcaggaggaatcggagcgccgccaggccgacttcgagaactccacccgcgtcttcatggaatcgctcaacgtcgacgaagtggtcggccagctgctggcgtccgaaggcttcacctcggtcgaggaactcgccatggtggacatcaaggagctcgccggcatcgagggttttgacgaggagaccgcgcaggagctccagaaccgcgcccgcgaatatctcgagcagcaggaagccgagctcgaggccaagcgcgtggaactcggcgtcgaggacgctctcaaggacgtgcccggcgtcacctcgaagatgctggtcaagttcggcgagaacgacatcaagaccgtcgacgacctcgccggctgcgccaccgacgatctggtcggctggaccgagcgcaaggaaggtggcgaaaccaccaaatatccgggtgcgctcgacggtatcgagatttcccgtgacgatgccgaagcgatgatcatgcaggcccgcgtcaaggccggctggatcaccgaggccgatctcgccaagcccgctgaagaggctgaggcgagcgaagatcagccggcttaa

SEQ ID NO: 64406 - protein, 536 aa, Bradyrhizobium japonicum USDA 110
MAVSANRLELLQIADAVAREKSIDRGIVIAAMEDAIAKAARARYGSETDVHAEIDPKKGELRLSRHMLVVEKVENHSNQISLVDAQRANPGAQVGDTIADTLPPLEYGRIAAQSAKQVIVQKVREAERDRQYQEFKDRIGDIVNGVVKRVEYGSVIVDLGRGEAIIRRDEMLPREVFRNGDRVRAYIFDVRRETRGPQIFLSRTHPQFMAKLFAQEVPEIYDGIVEIKAVARDPGSRAKIGVISRDSSVDPVGACVGMRGSRVQAVVNELQGEKIDIIPWSPDIATFVVNALAPAEVSKVVIDEDRERIEVVVPDTNNQLSLAIGRRGQNVRLASQLTGWDIDILTEQEESERRQADFENSTRVFMESLNVDEVVGQLLASEGFTSVEELAMVDIKELAGIEGFDEETAQELQNRAREYLEQQEAELEAKRVELGVEDALKDVPGVTSKMLVKFGENDIKTVDDLAGCATDDLVGWTERKEGGETTKYPGALDGIEISRDDAEAMIMQARVKAGWITEADLAKPAEEAEASEDQPA

SEQ ID NO: 64407 - DNA, 1086 bp, Clostridium tetani E88
  CDS (1)..(1086): transl_table=11
atgaatgaggaattcatagtagcattaaaagaaattgttaaagaaaagggtattagtgcggaactactttttaatactatagaagatgctttagttgctgcatataaaaagaattactcaaaacaaggtgcaacaagtcaacatgtaaatgtgtctatgaatagggaaactggagaaatccatgtttactcaagaaaaaatgtagtagaagaagtagaagatgaattcaatgaaatattcgtagaagatgctaaaacaatagatcctagatatgagttagaagatatagttgatatagaagttacaccagaaaaatttggaagagtagcagctcaagcggctaaacaagtagttgtgcaaagaataaaggaagaagagagaagaattgtatataatgaattcatagaaaaagaatgtgatataataacaggtaatgttattagaaaagataaaaccaatgtatttattaacttaggtaaaatagaggcagttctaggacctaatgaacagatgccaggagaagaatataattttaatgataaattaaaactatatatagttgaagtaaaaaatactactaaaggtgcacaagtagtagtatctagaacccatccaggtctagttaagagattatttgaattagaagtgccagaaatatataatggtattgtggaaataaaaagtatttctagagaagcaggatcaagaacaaaaattgcagtacattcaaatgatgaaaatgttgactctatgggagcttgtgtaggtccaaaaggaacaagagttcaaaatatagtaaatgaacttaaaaatgaaaaaattgatataattaaatggagtaagttacctgatgaatttatatcaaatgcacttagtccggcaagagtactaaaagtggatgtagatgaagaaagtaaatcagcaaaagttttagtagaagataatcagctttccctagctataggtaaggaaggacaaaatgttagactggctgcaaaattaacaggatggaaaatagatataaaaagcttatcacaaatttcagaagtagaagaggatatagaagttgtagaaagtgaaaattaa

SEQ ID NO: 64408 - protein, 361 aa, Clostridium tetani E88
MNEEFIVALKEIVKEKGISAELLFNTIEDALVAAYKKNYSKQGATSQHVNVSMNRETGEIHVYSRKNVVEEVEDEFNEIFVEDAKTIDPRYELEDIVDIEVTPEKFGRVAAQAAKQVVVQRIKEEERRIVYNEFIEKECDIITGNVIRKDKTNVFINLGKIEAVLGPNEQMPGEEYNFNDKLKLYIVEVKNTTKGAQVVVSRTHPGLVKRLFELEVPEIYNGIVEIKSISREAGSRTKIAVHSNDENVDSMGACVGPKGTRVQNIVNELKNEKIDIIKWSKLPDEFISNALSPARVLKVDVDEESKSAKVLVEDNQLSLAIGKEGQNVRLAAKLTGWKIDIKSLSQISEVEEDIEVVESEN

SEQ ID NO: 64409 - DNA, 960 bp, Tropheryma whipplei str. Twist
  CDS (1)..(960): transl_table=11
gtgcatatgaagattgatttatcagttctgcgtgcggttgagcgcgagcagcgtgtcgcttttgatgatctagtccgcatcgctgagcaggcggttgttatggcttaccttagacatactggcctggaggatgcggatcttgtgaaggcaaagctcaaccgcaagaccggcgagatcgatctgcgcgtcaaacacgatggcgattttatcccgtacaaatcagatgcttttagccggatggctgccactgcagccaagcgtgttataacgagcaaaatgcgcacccttagtgacgattcgacgtttgcccgatacaaaacaaagatcggcaccgtcctgtctggagttatttcgcagagtacttctcaaaactttaggatggtttctctcgatcgtcggacagaagcaattttacgccctgaagagcagatacctggtgaggaatacccgcacggtaagatggtcaaggtttatgttactgatgttacactgggcccccgggggtctaatgtttatgtttcacgaacccatcctggcctgattaacggtctgtttttacaagaagtgccagagatcgcctccggcactgtggagattgttgctgtttcgcgagaggcaggtcatcgtacaaaagtctctgtcaggagtaatagcaagtcaacaagtgcggtgggtgcatgtgttggagagtatggctgccgtgtgcgtgctgttacctcggagatctgtaatgaaaagatagatataataagttactctgatgatcttggtcagtacgtggcaaatgctatttctccggcgactgctgctgatgtttttgtcttagattctagacagaaggttgttcgtgtgtatgtttcgaaggaggagtactcccttgcaattggcaaggagggtcagaatgccaggcttgctgctcgtctgacgggtgcaaagattgatatcaggattgacgagtag

SEQ ID NO: 64410 - protein, 319 aa, Tropheryma whipplei str. Twist
MHMKIDLSVLRAVEREQRVAFDDLVRIAEQAVVMAYLRHTGLEDADLVKAKLNRKTGEIDLRVKHDGDFIPYKSDAFSRMAATAAKRVITSKMRTLSDDSTFARYKTKIGTVLSGVISQSTSQNFRMVSLDRRTEAILRPEEQIPGEEYPHGKMVKVYVTDVTLGPRGSNVYVSRTHPGLINGLFLQEVPEIASGTVEIVAVSREAGHRTKVSVRSNSKSTSAVGACVGEYGCRVRAVTSEICNEKIDIISYSDDLGQYVANAISPATAADVFVLDSRQKVVRVYVSKEEYSLAIGKEGQNARLAARLTGAKIDIRIDE

SEQ ID NO: 64411 - DNA, 1503 bp, Salmonella enterica subsp. enterica serovar Typhi Ty2
  CDS (1)..(1503): transl_table=11
atgaacaaagaaattttggctgttgttgaagccgtctccaacgaaaaagcgctgccacgcgaaaaaatttttgaagcgctggaaagtgcgctggcgacagcaacaaagaaaaaatatgagcaggagatcgatgttcgtgtagaaatcgatcgtaaaagcggtgattttgatactttccgccgttggttgatcgttgaagaagtgaccatgccgacgaaggaaattacgctggaagcggcgcgctttgaagacgaaagcctgaatgtcggcgactatgttgaagatcagattgaatctgtcacctttgaccgtatcaccacgcagactgcgaaacaggttatcgtgcagaaagtccgtgaagctgaacgcgcgatggttgtcgatcagttccgcgaccaggaaggcgaaatcgtcactggcgtggtgaagaaagtgaaccgcgacaatatctctttggaaattaaatccgaagggatggccggtaacgctgaagcggtgattctgcgtgaagatatgctgccgcgcgaaaacttccgccctggcgaccgtattcgcggcgtgctgtatgctgttcgcccggaagcgcgtggcgcgcagctgttcgtcacccgttccaagccggaaatgctgatcgagctgttccgcatcgaagtgccggaaatcggcgaagaagtgattgaaattaaagcggcggctcgcgatccgggttctcgtgcgaaaatcgcagtgaaaaccaacgataagcgtatcgatccggtcggcgcttgcgtggggatgcgcggcgcgcgcgttcaggcggtctctaccgaactgggcggtgagcgtatcgatatcgtgctgtgggatgataacccggcgcagttcgtcattaatgcgatggcgccggcagatgtcgcgtctatcgtggtggacgaagataaacataccatggatatcgccgttgaagccggtaatctggcgcaggcgatcggacgtaatggtcagaacgtccacttggcttcgcaattgagcggctgggaactcaacgtaatgaccgttgatgacttgcaggctaaacatcaggctgaagcacatgccgctatcgagatctttactaaatatcttgatattgatgaagagttcgcgaccgttctggtagaagaaggtttctccacgctcgaagaactggcctatgtgccaatgaaagaactgctggaaattgacggccttgatgagccgaccgttgaagcactgcgcgagcgtgctaaaaacgcactggccactctggcgcaggaccaggaagcaagcctaggtgataacaaaccggctgacgatctgctgaatctggaaggattagatcgcgatatggctttcaaactggcggctcgtggtgtttgtacgctggaagatctcgccgaccagggcattgatgatctggctgatatcgaagggttgaccgacgaaaaagccggtgagctgattatggctgcccgtaatatttgctggttcggcgacgaagcgtaa

SEQ ID NO: 64412 - protein, 500 aa, Salmonella enterica subsp. enterica serovar Typhi Ty2
MNKEILAVVEAVSNEKALPREKIFEALESALATATKKKYEQEIDVRVEIDRKSGDFDTFRRWLIVEEVTMPTKEITLEAARFEDESLNVGDYVEDQIESVTFDRITTQTAKQVIVQKVREAERAMVVDQFRDQEGEIVTGVVKKVNRDNISLEIKSEGMAGNAEAVILREDMLPRENFRPGDRIRGVLYAVRPEARGAQLFVTRSKPEMLIELFRIEVPEIGEEVIEIKAAARDPGSRAKIAVKTNDKRIDPVGACVGMRGARVQAVSTELGGERIDIVLWDDNPAQFVINAMAPADVASIVVDEDKHTMDIAVEAGNLAQAIGRNGQNVHLASQLSGWELNVMTVDDLQAKHQAEAHAAIEIFTKYLDIDEEFATVLVEEGFSTLEELAYVPMKELLEIDGLDEPTVEALRERAKNALATLAQDQEASLGDNKPADDLLNLEGLDRDMAFKLAARGVCTLEDLADQGIDDLADIEGLTDEKAGELIMAARNICWFGDEA

SEQ ID NO: 64413 - DNA, 1320 bp, Bacteroides thetaiotaomicron VPI-5482
  CDS (1)..(1320): transl_table=11
atggccaaaaaagaagaaacaatcagcttgattgatacattttcggaatttaaggaactgaagaatatcgatagaacgacgatggttagcgtacttgaagagtcgttccgtagcgtaatcgcgaaaatgtttggcaccgatgagaattacgacgtgatcgtgaacccggacaagggtgacttcgagatatggcgtaaccgtgaagttgtggccgatgaagatttgacaaaccccaatatgcagatttcgctgacggaagcacagaaaatcgatgcttcatacgaagaaggcgaagaagtgactgatgaggtgatctttgccaagttcggacgtcgtgctatcctgaatctccgtcagacactggcttcaaagattctggaacttgaaaaggacagtatttataataaatatattgataaagtaggtacaatcatcaacgcggaagtataccagatctggaaaaaggaaatgttgcttctggacgatgaaggaaacgaactgctgttgcctaagactgaacagatcccgagcgacttttatcgtaaaggtgaaacagcccgtgcagtggttgcccgcgtagacaacaagaacaataatccgaagattattttgtcacgtacttctcccgttttcctgcaacgtctgttcgaaatggaagtgcctgaaatcaatgatggtttgattaccattaaaaagattgcccgtatccctggcgaacgtgccaagatcgcagtggaatcttatgatgacagaatcgatcccgtaggcgcctgcgtaggtgtaaaggggagtcgtattcatgggattgttcgtgaattacgcaatgaaaatatcgacgtgatcaattacacatcgaacatttcattgtttatccagcgtgccttgagcccggctaagatttcttctatccgtctgaatgaggaagagaaaaaggctgaggtattccttaaaccggaagaggtatcgcttgctattggtaaaggcggtttgaatatcaaactggccagtatgttgactgagtacactatcgacgtgttccgtgaattggatgagaatgtggctgacgaggatatctatctcgacgagttcagagatgaaatcgacggatgggtgatcgatgcaatcaaggctatcggtatcgatactgcgaaggctgtgttgaatgcgcctcgcgagatgttgattgaaaagacggacctggaagaagagacagtggacgaggtaatacgtattttgaaatcggagtttgaagaagaaccggcagcagagatggagcctgagacagaggcggaacctgaagctgaaccaacacaagagtaa

SEQ ID NO: 64414 - protein, 439 aa, Bacteroides thetaiotaomicron VPI-5482
MAKKEETISLIDTFSEFKELKNIDRTTMVSVLEESFRSVIAKMFGTDENYDVIVNPDKGDFEIWRNREVVADEDLTNPNMQISLTEAQKIDASYEEGEEVTDEVIFAKFGRRAILNLRQTLASKILELEKDSIYNKYIDKVGTIINAEVYQIWKKEMLLLDDEGNELLLPKTEQIPSDFYRKGETARAVVARVDNKNNNPKIILSRTSPVFLQRLFEMEVPEINDGLITIKKIARIPGERAKIAVESYDDRIDPVGACVGVKGSRIHGIVRELRNENIDVINYTSNISLFIQRALSPAKISSIRLNEEEKKAEVFLKPEEVSLAIGKGGLNIKLASMLTEYTIDVFRELDENVADEDIYLDEFRDEIDGWVIDAIKAIGIDTAKAVLNAPREMLIEKTDLEEETVDEVIRILKSEFEEEPAAEMEPETEAEPEAEPTQE

SEQ ID NO: 64415 - DNA, 1200 bp, Enterococcus faecalis V583
  CDS (1)..(1200): transl_table=11
atgagcaaagaaatgttaaatgcattagacgtattagaagctgaaaaagggattcctaaagatacggtgattgaagcgttacaagcagctttagtttctgcatataaaagacattatggacaagcaagcaacgtcgaagttgaatttgaaccaaaaaaaggcaatattcatgtgtatgctgtcaaagaagtaacagaagaagtatttgattcacaattggaagtttcattaaaagatgccgttgcattaaatggtgcatatgaaatcggcgacaaaattcgttttgaagttacgccaaaagactttggccgcattgctgcccaaacagcaaagcaagtaattttacaacgtgtccgtgaagcagaaagaacaattatttataatgaatttagcgaatatgaaaatgacatcatgcaaggaattgttgaacgtcaagatcgtcgttatatttatgtaaacttaggtaaaatcgaagcagtcttatcaaaacaagatcaaatgccaaatgaattttaccaaccgcatgatcggattaaagtttacgtatcacgtgttgaaaacacatcaaaaggcccacaagtttttgtaagccgtagtcatccagatttactaaaacgtctttttgaacaagaaattccagaagtttatgatggaattgttgaaatcgtaagcgtcgctcgtgaagctggcgatcgttcaaaagtagccgttcgttcaacagatcctaatattgacccagtgggtacctgtgttggtccaaaaggccaacgtgtccaagcgattgtgaatgaattaaaaggcgaaaatatggatattgtggaatggaacgaagatccagctatttatattagtaatgccttgaatccagctcaagtattagatgttatttttgatccagaaaatagcaaagcatgtacagttgttgtacctgattatcaattgtcattagcaattggtaaacgtggtcaaaatgcgcgcttagctgctaaattaacgggccataaaattgatatcaaatcagaatctgatatggctgaattttatgaacaacaagccaatcaagaagttgccgaagtggcagaagaaatggatgaagcaattatccattcagatatgacggcagatgattacgaaaacttggctgctgaagaagcagttgttgaagcagaaattacagaagaattacctgaacaagaataa

SEQ ID NO: 64416 - protein, 399 aa, Enterococcus faecalis V583
MSKEMLNALDVLEAEKGIPKDTVIEALQAALVSAYKRHYGQASNVEVEFEPKKGNIHVYAVKEVTEEVFDSQLEVSLKDAVALNGAYEIGDKIRFEVTPKDFGRIAAQTAKQVILQRVREAERTIIYNEFSEYENDIMQGIVERQDRRYIYVNLGKIEAVLSKQDQMPNEFYQPHDRIKVYVSRVENTSKGPQVFVSRSHPDLLKRLFEQEIPEVYDGIVEIVSVAREAGDRSKVAVRSTDPNIDPVGTCVGPKGQRVQAIVNELKGENMDIVEWNEDPAIYISNALNPAQVLDVIFDPENSKACTVVVPDYQLSLAIGKRGQNARLAAKLTGHKIDIKSESDMAEFYEQQANQEVAEVAEEMDEAIIHSDMTADDYENLAAEEAVVEAEITEELPEQE

SEQ ID NO: 64417 - DNA, 1512 bp, Coxiella burnetii RSA 493
  CDS (1)..(1512): transl_table=11
atgaataaagacattttattaatagttgattcgatgtctaatgagcgtggcgtttcaaaagaagtaatttttgaagcgattgaggctgcattagcagcggtaacggcaaaacgttacgaagaagacgatgtcaaaattcgtgtggctatcgatcaaaaaacgggagattacgaatccttccggtgctggactgtcgtggaagatacgaatgaatcgctggaattccccaatcaagagatgaccttaaaacaagcgagagaaatcgactccgacttagaagtgggcgacgttatcgaggaacccgtggaatccgtcaaatttggacggattgcggtgcaacaagccaagcaagttatcgttcaaaaagtccgggaagccgagcgagcaaaaatcattcgccaatatgaaaaacgagtgggcgaactggttatcggggtggttaagcgagtcacgcgtgagagcattattttggatatgggtgaaaatgcagaagcgctcttacttcgtgaagaaatgattccgcgggaagcgtttcgcatcaacgatcgtttacgcgcttatttatatagcgtttgccaagacaaaaagcgcggacctcaattgttggtgagccgaacccgccctgaatttttagttgaactctttaagatcgaagtccctgaaattggtgaggaagtcatcgaaatcaaaggcgccgctcgcgatccagggtcacgcgcgaaaattgcggttaagacgaacgatggacgcattgatcctatcggtgcttgcgtaggcatgcggggttcgcgagtgcaagcggtttctaacgaattggggggggaacgcattgatatcgtattgtgggacgataatcccgcccaattggtaattaatgcaatggccccggccgaagttgcttctatcgttgtggatgaggattctcatacgatggatatcgctgttaacaaagatcaattatcgcaagccattggtcgaagtggtcaaaatgtccgcttagccagcgaattgacagggtggacactaaatgtaatgagtgaagccgaaatggcccagaaacacgaaaaagaagccggtaaaattaaaacggcatttatggaaaaattagatgtcgatgaagaagtcgccgatgccttggttcaagcgggatttatgaatttggaagaagtcgcttatgtgccgaaagaagaattgcaaggtgtcgagggatttgatgaagatatcagcgctgagttgcaaagaagagccggtgatgtcttgttaactcaggaaatcgccaaacaagaattggatgaaaagaaaccggcggaagatttgttgaccttaccaggaatgacaacggaattggctcggcagcttgtcgagaatgaagtattgacccgtgacgatttagcggaaaaatcagtactcgatttaaaagaaattattgaaatcgatgacgaagcggctgctaatttaattatggcagcacgagcgcattggtttgcagaagaagagagcgagaagagttaa

SEQ ID NO: 64418 - protein, 503 aa, Coxiella burnetii RSA 493
MNKDILLIVDSMSNERGVSKEVIFEAIEAALAAVTAKRYEEDDVKIRVAIDQKTGDYESFRCWTVVEDTNESLEFPNQEMTLKQAREIDSDLEVGDVIEEPVESVKFGRIAVQQAKQVIVQKVREAERAKIIRQYEKRVGELVIGVVKRVTRESIILDMGENAEALLLREEMIPREAFRINDRLRAYLYSVCQDKKRGPQLLVSRTRPEFLVELFKIEVPEIGEEVIEIKGAARDPGSRAKIAVKTNDGRIDPIGACVGMRGSRVQAVSNELGGERIDIVLWDDNPAQLVINAMAPAEVASIVVDEDSHTMDIAVNKDQLSQAIGRSGQNVRLASELTGWTLNVMSEAEMAQKHEKEAGKIKTAFMEKLDVDEEVADALVQAGFMNLEEVAYVPKEELQGVEGFDEDISAELQRRAGDVLLTQEIAKQELDEKKPAEDLLTLPGMTTELARQLVENEVLTRDDLAEKSVLDLKEIIEIDDEAAANLIMAARAHWFAEEESEKS

SEQ ID NO: 64419 - DNA, 1305 bp, Chlamydophila caviae GPIC
  CDS (1)..(1305): transl_table=11
atgaataaagatcttgtagctatttttgactacatggaaaaggaaaaaggaattcaacgccccgttatcataggcgctattgagtccgccttaaaaattgcagcaaaaaaaacactaagagatgatgctaacgtttctgtaaatattaatcctcgcactggtgatatagaggtcttctgtgagaaagaaatcgtagaagtatgtgaaaatcccagtaaagagattcctctagacaaggctagagaatacgatcctgaatgccaaattgggcaatacatggacgttccctttgtttctgagcatttcggaagaattgctgcgcatgcagcccgacaaattatcggccaaaaactacgtcatgctgaaagagatgttatctatgaagaatatcgacatagggtcaatgaaattctttctggcgtcgtcaaacgattcgccaaaggatcaaatttaatcatagatttaggaaaagttgaaggtcttctacccgcacgttgttatcctaaaacagagaaacacaaagttggcgataagatttatgctttattacaagaagttcaagaatccgaaaatggtggagctgaagtcattcttagccgcagccatcccgaattcgttaaacaacttttcttacaagaagttccagaattggaagaaggttttgtagaaattgttaaaattgctcgtgaagcaggctacagaactaaattagctgtaagttcatctgatccaaaaacagatcctgtaggagcttttgttggaatgagaggttctcgagtgaagaatatcattcgagagttaaacgatgagaaaatagatattgtaaactattctcccgtaaccacagaattattacaaaatttgctttgccccatagaaattcaaaagattgcaatcttagaagatgacaaggttattgctatagtcgttcatgatgctgattacgcaacagtaatcggtaagcgaggaattaacgctcgattaattagtcaaattttagactacgagctcgaagttcaacgcatgagcgaatacaataaactattagaaattcaacgcctacagttagcggaatttgataaccctcagttagatgagccgctagatatggaaggcattagtaagttggttgtccagaatcttgtacatgcaggatacgacacgatcagaaaggtattattagccagtgctaatgatcttgcttctgttcctggaatcagtttagaacttgcttataagatccttgagcaagtcagcaaatatggagaaggcaaagttgacgaaaaacctaaaattgaagattaa

SEQ ID NO: 64420 - protein, 434 aa, Chlamydophila caviae GPIC
MNKDLVAIFDYMEKEKGIQRPVIIGAIESALKIAAKKTLRDDANVSVNINPRTGDIEVFCEKEIVEVCENPSKEIPLDKAREYDPECQIGQYMDVPFVSEHFGRIAAHAARQIIGQKLRHAERDVIYEEYRHRVNEILSGVVKRFAKGSNLIIDLGKVEGLLPARCYPKTEKHKVGDKIYALLQEVQESENGGAEVILSRSHPEFVKQLFLQEVPELEEGFVEIVKIAREAGYRTKLAVSSSDPKTDPVGAFVGMRGSRVKNIIRELNDEKIDIVNYSPVTTELLQNLLCPIEIQKIAILEDDKVIAIVVHDADYATVIGKRGINARLISQILDYELEVQRMSEYNKLLEIQRLQLAEFDNPQLDEPLDMEGISKLVVQNLVHAGYDTIRKVLLASANDLASVPGISLELAYKILEQVSKYGEGKVDEKPKIED

SEQ ID NO: 64421 - DNA, 1107 bp, Bacillus cereus ATCC 14579
  CDS (1)..(1107): transl_table=11
atgagcactgagttattagatgctttgctcgtattagaatctgaaaaaggcattagcaaagacattattattgatgcgattgaagcagctttaatctctgcttataagcgcaattttaatcaagcacaaaacgttcgtgtgagctttaacccagaagtgggaacaattcaagttttagcacgtaaagacgtagtagacaatgtgtttgatccacgtcttgaaatttctgtagaggaagcaagacaaattaatccaaactaccaagatggtgacgtactagaaattgaagtaacaccaaaagactttggtcgtattgcagcacaaactgcaaaacaagttgtaacacaacgagtgcgtgaagcagagcgcggtgttatttactctgagtttagtgatcgtgaagaagatattatggtaggtattgtacaacgtcaagatgctcgtttcatctatgtaagcttaggaaaagtagaagctttattacctgtaagtgagcaaatgcctaatgagcaatacaaaccacatgatcgtattcgcgtattcattacgaaagtagaaaaaacgacaaaaggaccacaaatttacgtatcacgtacacatcctggtcttttaaaacgtttattcgaaatggaagttcctgaaatctatgatggaactgtagaaattcgttctgtagcacgtgaagctggcgatcgctctaagatctctgtatatgcagagaacactgatgttgatccagttggttcttgtgtaggaccaaaagggcaacgtgtacaacgcattgtagacgaattaaaaggtgaaaaaattgccatcgttcgctggtcaaatgatccagttgaatatgttgcaaatgcattaagcccatcacaagttgttaaagtacttgtagatgaagaagaaaaagcgacaacagtagttgttccagaccaccagctatcattagctatcggtaagcgtggacaaaatgcacgtcttgcagctaaattaacaggctggaaaattgacattaagagtgagtctgatgcgaaacaacttggtattgtaacagaagaagatagcgtaatcgcatttggattcgattcagtggaagacgaaatcgaatag

SEQ ID NO: 64422 - protein, 368 aa, Bacillus cereus ATCC 14579
MSTELLDALLVLESEKGISKDIIIDAIEAALISAYKRNFNQAQNVRVSFNPEVGTIQVLARKDVVDNVFDPRLEISVEEARQINPNYQDGDVLEIEVTPKDFGRIAAQTAKQVVTQRVREAERGVIYSEFSDREEDIMVGIVQRQDARFIYVSLGKVEALLPVSEQMPNEQYKPHDRIRVFITKVEKTTKGPQIYVSRTHPGLLKRLFEMEVPEIYDGTVEIRSVAREAGDRSKISVYAENTDVDPVGSCVGPKGQRVQRIVDELKGEKIAIVRWSNDPVEYVANALSPSQVVKVLVDEEEKATTVVVPDHQLSLAIGKRGQNARLAAKLTGWKIDIKSESDAKQLGIVTEEDSVIAFGFDSVEDEIE

SEQ ID NO: 64423 - DNA, 1473 bp, Nitrosomonas europaea ATCC 19718
  CDS (1)..(1473): transl_table=11
atgagccgcgagattttactgttggtcaatgctttggcgcatgagaagaatgtggataaaaatatcgtttttaccgcactcgaaatggcgctggcttctgctgccaagaagcatacccgggatgatattgacgtgcgtgtctcgatcgatcgtgataccggtggatttcactgttttcgcagatggctgatcgttgcagatgatccggtagagcacccggagcggcaaattacggtgagtgaggctgtagggcgcaatccacaggctgttcctggggaatatatagaggatctgatggaggatgtcacttttgaccggatcggtgcacaggctgccaaacaggtcattttccagaagatacgtgatgccgagcgcgaacagaatctgaatgattttcttgatcgcggggaatatctggtgtacggcgtgatcaagcgtatggaccgtggaaatgcaatcattgagtttggcaagatcgaagcagttctgccacgcgaccagatgatttcacatgaaaatctgcgcatgggcgaccgtgtccgtgcctatcttctgagaatcgatcggtcggtgagagggccacagctggtattgtccaggacttcaccggcgtttctggccaaactgttcgagcttgaagtgcccgagatagaagaggggattctggaaatcaaagcagcagcgagagatcctggttccagagcaaaaatcgctgtcaaatcgaatgacagtcgcgtggatccgatcggtacctgcgtgggtatgcgcggttcgagagtacaggcagttaccagtgagcttgccggtgagcgggtggatatcattcagtggtcggatgatcaggccacattcgtcgtaaatgctttggcacccgctgtgatcagcagcatcgtggtggatgaggagaagcattgtatggatatcgtggtggatgaggagaatctggctcaggccatcggccggggcgggcagaatgtccggctggcatctgaattgacgggctggcagctcaatatcatgacagaggaagagtcacaggaaaaaactgaagaagaagctgcttccatttgtgagctgttcatggagaaacttgatgtcgatgaagacgtcgggcgtatcctggtggaagagggattctccactctggaagaggtcgcctatattccaattgaagaaatgttggaaatacaggagtttgatcgtgagacaattgaggagttacgtaaccgtgcccgtaacgccttgttgacggatgccattgcgactgaagaaaaaattggccatgcgtccgaagcgctgcttgccctggaaggaatggatatcgagctggtgcgtgaattggcggaaaaagggatcagtactcaggaagagcttgctgatctggcggcagatgatctggtcgaattgacgggcatagactttgaacgtgcaagtaaaattatcatcaaggcacgtgaaccctggttcgcatga

SEQ ID NO: 64424 - protein, 490 aa, Nitrosomonas europaea ATCC 19718
MSREILLLVNALAHEKNVDKNIVFTALEMALASAAKKHTRDDIDVRVSIDRDTGGFHCFRRWLIVADDPVEHPERQITVSEAVGRNPQAVPGEYIEDLMEDVTFDRIGAQAAKQVIFQKIRDAEREQNLNDFLDRGEYLVYGVIKRMDRGNAIIEFGKIEAVLPRDQMISHENLRMGDRVRAYLLRIDRSVRGPQLVLSRTSPAFLAKLFELEVPEIEEGILEIKAAARDPGSRAKIAVKSNDSRVDPIGTCVGMRGSRVQAVTSELAGERVDIIQWSDDQATFVVNALAPAVISSIVVDEEKHCMDIVVDEENLAQAIGRGGQNVRLASELTGWQLNIMTEEESQEKTEEEAASICELFMEKLDVDEDVGRILVEEGFSTLEEVAYIPIEEMLEIQEFDRETIEELRNRARNALLTDAIATEEKIGHASEALLALEGMDIELVRELAEKGISTQEELADLAADDLVELTGIDFERASKIIIKAREPWFA

SEQ ID NO: 64425 - DNA, 1128 bp, Helicobacter hepaticus ATCC 51449
  CDS (1)..(1128): transl_table=11
atggaaaagattttagatattattgatttaattgcttatgataaaggcttagaatcgcaagctgtgttagaaattgtcaaagaaggcttaattaaaattgctcaagaagagattaatccacattatgattattttgttgagcaagatgctaaagagcgcacactcaagcttttttatcgtatgaaagtatgtgcagatgagcaagatttaagcgaggagaatctagggacattcctccctctttctcaagcaaaaggacttggtgatgtaagcataggtgatgaagtagattgcgaattgcaattagatgctatgagtagaggggctattaataagctttttttaaatcttgaatacaatttgcaacgttccattgaaaatcaaatcttgcaaaacttccgcgcaatggtgggtaaaatcgttaatgggcaagttgtgggcatagatgatagcggcaatacctttatagaaattgaaagtatccgcgcaatattgccacaaaaaaatcgcattaagggcgaaaatttcaaagttggtgattgtgtgcgagcaattttaaaatttgtaggcattaatcgtaatggattgcaagtggaactttcccgcacaacgccgaaatttttagaagaactcctcgcaatggaagtgccagagataaaagataatgaagtgattatccacaaaagtgcgagaatacccggtgatagggcaaaagttgctgtatattcaaatagtgcacgtattgaccccattgggtgctgcgtaggcgttaaaggtgtaagaatcaatgctgtaagcaaagaattagcaaatgaaaatattgactgcgtggagtatcatagcacacttgaaatttttgtcgctaaggctttgacccccgcacaagtagtcagtgttaagattgaagaggcacaagagggagagcgaaaaaaagcaatcgtgcaaataaaaagtgagcaaaaaagtaaagctattggtaaaaatggtgtaaatatacgtcttgcaagtatgttatgtgaatgcgatattgaactccaagaaattacagaatctaagccacttgaaaatgaaaataccccagctgaaaaaacaggtatagacgcgcttagctccctctttaagtcttaa

SEQ ID NO: 64426 - protein, 375 aa, Helicobacter hepaticus ATCC 51449
MEKILDIIDLIAYDKGLESQAVLEIVKEGLIKIAQEEINPHYDYFVEQDAKERTLKLFYRMKVCADEQDLSEENLGTFLPLSQAKGLGDVSIGDEVDCELQLDAMSRGAINKLFLNLEYNLQRSIENQILQNFRAMVGKIVNGQVVGIDDSGNTFIEIESIRAILPQKNRIKGENFKVGDCVRAILKFVGINRNGLQVELSRTTPKFLEELLAMEVPEIKDNEVIIHKSARIPGDRAKVAVYSNSARIDPIGCCVGVKGVRINAVSKELANENIDCVEYHSTLEIFVAKALTPAQVVSVKIEEAQEGERKKAIVQIKSEQKSKAIGKNGVNIRLASMLCECDIELQEITESKPLENENTPAEKTGIDALSSLFKS

SEQ ID NO: 64427 - DNA, 1497 bp, Rhodopirellula baltica SH 1
  CDS (1)..(1497): transl_table=11
atgaatccgcaagacattttgcgatacgtcgattcgctgcatcgcgataaaaacatcgatccagaactgctgtttcaggcgatcgagtcggctctacaaagcgcggcaaagaagcagtacggcgaagaatcggatgtgattgtatcgatcagtcgcgacaatggagcgatcgccgcgaccttggctggcgaacctcttggtgacgatcaaattggtcgcatcggagctcaaacggcgaagcaagtcatcatccaaaaggtccgcgaagcagaacgcgacgccttgatgttggaataccgcgatcagatcggtgagatcgtcagcggaatgattgggcgtgctgacggcggcgtggcgaccgtcaacctgggcaacgtcgaagccatcctgccacgcagcgaacaaattcctggtgaaagcctgcatgcgaacgaacgcgttcgtgcgatcgtatttgaagtccgtccatccggtggcaaccgcgttcgcgttgtgttgtctcgcacccggccgcaattcgtacaacgtttgtttgaacaagagattcccgaactgaacgacggcgtgattgccatcaagtcgatctctcgtgaacctggctaccgaagcaaggttgccgttagcagcgaagatcagcaaatcgatccaatcagtgtttgcgtgggctatcgcggcagccggatcaaagccgttcgcgaagagttggccggtgagcacatcgacgtggtccgctatgacagcgatcccgaagtgttgatccccaacgccttgcaacctgctgaagtcgatcaagttttgttgtgcgacatgatcggtcgtgcgatcgtgttggttcaagaagaccagctttcgctcgcgattggtcgtcgtggccaaaacgtgcgattggccagcaagctctgcggctgggacattgaaatcatgaccaacgccgagctcgaagaacagatcgaacgagcggtgggtggttttagccagattccaggcatcaccgaagaaatcgctcaggcgttggtcgaacagggttatttgtcatatgacgacttgtccgtgatcgagcccgacctgttcatggaaatgagcggcttgagcgaagcggatgtcgatcggatcgtcgaaacggcggaagccaaagcggaagaggcagaacaagccgccgcggaagaacgacgcgttcgtcgcgaccaggaacgaaccgaccaaaacgctcctgcactggcaaaggctgaaactccagctgccgaagagagcacggaagaagcaaccgctgaaaccgcggatgcggagaacgcagaagcagccgatggtgatcagccagctgctgaagttgcaaccgaaacatcggagactacctccaccgaagaggcccccgtcgaacccgctgatgaagtgagtgggccagtcgcggatgagggcgagactgaatccgaagagccagagccgatcgccgaagcggttgaatcgtctgaggccgaaggtaacaagcaggaaggttga

SEQ ID NO: 64428 - protein, 498 aa, Rhodopirellula baltica SH 1
MNPQDILRYVDSLHRDKNIDPELLFQAIESALQSAAKKQYGEESDVIVSISRDNGAIAATLAGEPLGDDQIGRIGAQTAKQVIIQKVREAERDALMLEYRDQIGEIVSGMIGRADGGVATVNLGNVEAILPRSEQIPGESLHANERVRAIVFEVRPSGGNRVRVVLSRTRPQFVQRLFEQEIPELNDGVIAIKSISREPGYRSKVAVSSEDQQIDPISVCVGYRGSRIKAVREELAGEHIDVVRYDSDPEVLIPNALQPAEVDQVLLCDMIGRAIVLVQEDQLSLAIGRRGQNVRLASKLCGWDIEIMTNAELEEQIERAVGGFSQIPGITEEIAQALVEQGYLSYDDLSVIEPDLFMEMSGLSEADVDRIVETAEAKAEEAEQAAAEERRVRRDQERTDQNAPALAKAETPAAEESTEEATAETADAENAEAADGDQPAAEVATETSETTSTEEAPVEPADEVSGPVADEGETESEEPEPIAEAVESSEAEGNKQEG

SEQ ID NO: 64429 - DNA, 1485 bp, Wigglesworthia glossinidia endosymbiont of Glossina brevipalpis
  CDS (1)..(1485): transl_table=11
atgaataaagaaattttagctgtagtagaagctgtttcaaatgaaaaagctcttccaagagaaaagatttttgaagctttagagaaagctttagctgctgctacaaaaaaaaaacatgagaaagatattgatgtaagaattagcattgatagaaaatcaggatcatttggaacttttagacgatggatgatagtagatgaagtgacacaaccaactaaagagattactttagaagcagcaaaaatagaaaatccagaagctaaactaaaagagtacattgaggataaaataaaatcagttctatttgatagaataactacacaaactgcaaaacaagttatcgtacaaaaagtaagagaagcagaaagatctatgatagtaaataaatttaaagagcgcaaaggagaaattattacaggaatagtaaaaaaattaaatagagacggagttagtttagatctaggaagtcatgcagaggcagtgataaataaagaagatatgttgccaaaagaatattttagaccaggagatagagttagaggtgttctttattatattaatccagaatctaaaggagctcagttgtttataagtagatctaaaaaagaaatgttaattgaattgtttagaatagaagttccagaaataggagaagaagttattaatataaaagctactgctagagatcctggtttaagatctaaaatagcagttcaaactaacgataaaagaatagatccaattggggcttgcgtaggaatgagaggagctagagttcaagctgtatctagagaattaggaggagaaagaatagatatagttttatgggatgaaaatccagctcaatttgtaattaatgctatgtctcctgcagatgttacttcaattgtaatagatgaagataatcatacaatggatattgcagttaatagtgaaaatttagctcaagctattggtaagaatggtcagaacatcagacttgcttctcaactaagcggttgggagttaaatgttatgacagaaaaagatttaaaaaataaaaataaagctgaagaagaaaattcaatgaatttatttttagaacatctaaatattaatcaagagttagcaaaaaatttagtaaaagaaggtttttctaaaatagaagatattgcttacattccaattaatgaattattatccatagatattttaaacgaaaaaaccgcaaaattgttaaaagaacaagcacaatatgcattaacaaaaattgctttgatgaaagaagaaaaagagttaacatcgttagatgaaaaattaataaaactatctggagtaaattctaatatagcttataaatttgcagaaaaaggaatatttacattagaggatttagcagaacaaggaattgatgatatatctgatattaaagacttaagcaataaaaaagccggtgaattaattatggccgcaaggaatatatgttggtttaataataacacataa

SEQ ID NO: 64430 - protein, 494 aa, Wigglesworthia glossinidia endosymbiont of Glossina brevipalpis
MNKEILAVVEAVSNEKALPREKIFEALEKALAAATKKKHEKDIDVRISIDRKSGSFGTFRRWMIVDEVTQPTKEITLEAAKIENPEAKLKEYIEDKIKSVLFDRITTQTAKQVIVQKVREAERSMIVNKFKERKGEIITGIVKKLNRDGVSLDLGSHAEAVINKEDMLPKEYFRPGDRVRGVLYYINPESKGAQLFISRSKKEMLIELFRIEVPEIGEEVINIKATARDPGLRSKIAVQTNDKRIDPIGACVGMRGARVQAVSRELGGERIDIVLWDENPAQFVINAMSPADVTSIVIDEDNHTMDIAVNSENLAQAIGKNGQNIRLASQLSGWELNVMTEKDLKNKNKAEEENSMNLFLEHLNINQELAKNLVKEGFSKIEDIAYIPINELLSIDILNEKTAKLLKEQAQYALTKIALMKEEKELTSLDEKLIKLSGVNSNIAYKFAEKGIFTLEDLAEQGIDDISDIKDLSNKKAGELIMAARNICWFNNNT

SEQ ID NO: 64431 - DNA, 1482 bp, Haemophilus ducreyi 35000HP
  CDS (1)..(1482): transl_table=11
atgagtaaagaaattttattagccgctgaagcggtatctaatgagaaattattaccaaaagaggctatttttgaagcacttgaaaccgcattagccatttctaccaaaaagaaaaaaggaatagatattgatattcgtgtagtcattaaccgcaaaacaggtgaatttcaaacgttccgtcgttggttgattgttgaacaagtacataatatgacgcgtgaaatcagtttggcagcggcacaatatgaagatccaaatgtacaattaggtgattttgttgaagatgaaatagaatccattccattcgatcgtatcacgatgcaaactgctcgtcaggtaattagcaccaaaattcgtgaagctgaacgtaataaagtcattgaacaattccgtacgcaattaaattgcattgtgacggcaaccgtgaaaaaagtaaatcgtgagcaaattatcttagatttaggcaatcaagcagaagcggttattattcgtgaagatatgttgccacgcgaaaacttccgcccaggcgatcgcattcgtggtgtgttatacgcaattaaaccagagtcaaaagggccacaactatttgttacccgtgctaaaccggtaatgttagaagtattattcaagttagaagtgcctgaaataggtgaagaagtaattgaaatcaaaggcgcatcacgtgatgcgggctcacgctcaaaaattgcagtaaaatcaaatgacaaacggattgatcctgtcggtgcttgtgtcggtatgcgaggtgcacgcgtacaagccatcagtaatgagctaggtggcgaacgcgttgatattgtgttatgggatgataatccagcgcaatttgtgattaatgctatgtcgccggcagaagtcagccatattgtggtagatgaagataaacacgcaatggatattgcagtagaaactaaaaatttagcccaagccattggacgtaatgggcaaaatgttcgtttagcaactcaattaactggttggtctttaaacgtaatgactaccgaagatttaaatgagaaacatcaagctgaagataataaaatcattgatttatttgttacatcattacaaattgatgaagaatttgctcatctcttagttgatgaaggcttttcaagcctagaagaaattgcctttatcgcggtcaatgaattggtagatattgatggcattgatgatgaaaatctcgcagaagaattgcaaacacgtgctaaagctgcaattacagaaaaagcattagccgaagaagaagcattaaaacgggcagatatcgaagatcgactcttaaatcttgacggcttagaacgccatattgcattcaaattagccgaaaaaggcattgtgacattagaagaattggcagagcaaggaattgatgatttagccgatatccaagaattatcagcagaaaaagctggagaattaattatgaatgctcgccaaatttgttggtttagttaa

SEQ ID NO: 64432 - protein, 493 aa, Haemophilus ducreyi 35000HP
MSKEILLAAEAVSNEKLLPKEAIFEALETALAISTKKKKGIDIDIRVVINRKTGEFQTFRRWLIVEQVHNMTREISLAAAQYEDPNVQLGDFVEDEIESIPFDRITMQTARQVISTKIREAERNKVIEQFRTQLNCIVTATVKKVNREQIILDLGNQAEAVIIREDMLPRENFRPGDRIRGVLYAIKPESKGPQLFVTRAKPVMLEVLFKLEVPEIGEEVIEIKGASRDAGSRSKIAVKSNDKRIDPVGACVGMRGARVQAISNELGGERVDIVLWDDNPAQFVINAMSPAEVSHIVVDEDKHAMDIAVETKNLAQAIGRNGQNVRLATQLTGWSLNVMTTEDLNEKHQAEDNKIIDLFVTSLQIDEEFAHLLVDEGFSSLEEIAFIAVNELVDIDGIDDENLAEELQTRAKAAITEKALAEEEALKRADIEDRLLNLDGLERHIAFKLAEKGIVTLEELAEQGIDDLADIQELSAEKAGELIMNARQICWFS

SEQ ID NO: 64433 - DNA, 1419 bp, Prochlorococcus marinus subsp. marinus str. CCMP1375
  CDS (1)..(1419): transl_table=11
atggcattagttcttctccctggactcaataatttaatcgaagacataagtgaggagaaaaaactccctgctcaagtcgtcgaaacagctcttagggaagctttgctcaaagggtatgaaagatatcgcaaaacgctttacttaggaataaatgagaatccttttgaagaagaatatttcagcaatttcgacataggtttagaccttgatcaagaaggatatagggtattagcaagcaaaataattgttgaagaagttgatagtgaagaccatcaaatagcactagcagaagtaatgcaagtcgctgaagatgcccaagcaggtgacactgtcgtacttgatgtaactccagagaaagaggagtttggtcgaatggctgcttcaaccacaaaacaagttctttcgcaaaagctaagagatcagcaaagacgaatgattcaggaagaatttgcagatcttgaggaccctgtcttaacagctcgcgtaattcgttttgaacgtcaatcagtgatcatggcagtaagttctgggttgggaaggccagaagtcgaagcagagctacctaggagagaccagttgccaaacgataactatcgagccaatgcaacattcaaagtctttcttaaagaagttagtgaagttcctagacgcggtcctcagttatttgtgagtcgagccaatgcaggtttagttgtttatttatttgaaaatgaagttcctgaaatccaagaaggttctgtaagaattgttgctgttgctcgagaagcaaatccccctagtagatctgtagggccacggacaaaagttgcagtagatagtattgaaagagaagtagatccagttggagcatgtattggagctagaggttcaagaattcaacaagtggtcaatgagcttagaggggaaaaaattgatgtcatacgttggtctactgacccaattcaatacatttgcaattctctcagtccagccagagttgagaacgtaagattagtagacccagatgggcaacacgcgcatgtacttgttcctcctgatcaattaagtctcgcaataggtagagaaggtcaaaacgtaagacttgcagccaggctaactggatggaaaattgatattaaaaactctcaagaatacgaccaatctgccgaagatgccattgtggctgagcttatcactcacagagaagaagaagaatccctacaaaaagaagccgaagatcgccttgctgctgagcaagctgcgagggctgaagaagatgctcgtctaagagagctataccctcttcctgaagatgaagaagaagaatctgaaaatatagaaaacgacacaagtagtctcgaaatgaattacaacgatgaagaaagtaaagattcttatataccagaagaatctaattccaatgaggatagagagcggtga

SEQ ID NO: 64434 - protein, 472 aa, Prochlorococcus marinus subsp. marinus str. CCMP1375
MALVLLPGLNNLIEDISEEKKLPAQVVETALREALLKGYERYRKTLYLGINENPFEEEYFSNFDIGLDLDQEGYRVLASKIIVEEVDSEDHQIALAEVMQVAEDAQAGDTVVLDVTPEKEEFGRMAASTTKQVLSQKLRDQQRRMIQEEFADLEDPVLTARVIRFERQSVIMAVSSGLGRPEVEAELPRRDQLPNDNYRANATFKVFLKEVSEVPRRGPQLFVSRANAGLVVYLFENEVPEIQEGSVRIVAVAREANPPSRSVGPRTKVAVDSIEREVDPVGACIGARGSRIQQVVNELRGEKIDVIRWSTDPIQYICNSLSPARVENVRLVDPDGQHAHVLVPPDQLSLAIGREGQNVRLAARLTGWKIDIKNSQEYDQSAEDAIVAELITHREEEESLQKEAEDRLAAEQAARAEEDARLRELYPLPEDEEEESENIENDTSSLEMNYNDEESKDSYIPEESNSNEDRER

SEQ ID NO: 64435 - DNA, 1506 bp, Candidatus Blochmannia floridanus
  CDS (1)..(1506): transl_table=11
atgaataaagagattttagctgttgtagaagtagtttctaatgaaaaagcagttcctaaagaaaaaatttttttagcgttagaaatggctttagctgctgctactagaaagaaatatagtcaagatattgatataagagtttctattgatcgtaaatcggggaaaattagtacttttaggcgttgggttgtagttaatcaagtgatacaacctactcgagaaatgacattagaagcagcacagttggagaatttggaaattaaaataaatgattatgttgaagatattgtggaatctgttacttttgatcgtattactacacaaaccgcaaagcaagttatcattcaaaagattcgtgaagcagaacgtatgataattatagagcaatttttaagtcgtcagggtgagattgttacaggaataataaaaaaaattagtcgttattctgttagtgtagatttgggtaataatgcggaagggataattaagcgtgaagaaatgttacctagagaaaattttcgagtaggtgatcggatacgtgggatattgtatttagtgaagactgattcgaagggatctaatttatttataagtcgtacttgcactgaaatgttaattgaattatttcgtattgaagttccagaaattggagaagaattaataacaatacaagctgctgctagagatcctggttctagatctaaaattgctgtaaaaacaaatgataaacgtattgatcctataggagcatgtgtgggtatgagaggtgctagagtacaggctgtttctagtgaattaggaggagaaagggttgacgtaatattatgggatgataatcctgtgcaatttgtagttaatgctatgattcctgctgatattgtttctatgattgtagatgaagataaacatacaatggatattgcggtagaagaatcaaatttggcacagattattggaagaaatggtcaaaatattcgattgatatctcaattaatagattgggaattgaatgtaatgacagtagttgaattagaaaaaaaacgtcaatctgaagatcgtaatatattagatatttttatgcgtgtgttaaatataaatgaagaatctgctaaggttttaattgattctggattttcttctcttgaagaattggcttatataccaatttctgaattgttatcgataggagtttttgataaagaagaaatagatttgttgcgttttaaagcaaaagatgctttaaaagatttatctaataaagataataatgatgataatagtacgattatgaattcagtttctgaattattaaaattatctagtcttaagtatgaaatagcgttaaaattaattaattatggaatttataagttagaagatttagcagagcaagatattgtgagtttatccgggattaaagatttaaatttaactgaggaagaaattggagagttaattatggaagctcgtaatatttgttggtttaatcatgatagcaataaataa

SEQ ID NO: 64436 - protein, 501 aa, Candidatus Blochmannia floridanus
MNKEILAVVEVVSNEKAVPKEKIFLALEMALAAATRKKYSQDIDIRVSIDRKSGKISTFRRWVVVNQVIQPTREMTLEAAQLENLEIKINDYVEDIVESVTFDRITTQTAKQVIIQKIREAERMIIIEQFLSRQGEIVTGIIKKISRYSVSVDLGNNAEGIIKREEMLPRENFRVGDRIRGILYLVKTDSKGSNLFISRTCTEMLIELFRIEVPEIGEELITIQAAARDPGSRSKIAVKTNDKRIDPIGACVGMRGARVQAVSSELGGERVDVILWDDNPVQFVVNAMIPADIVSMIVDEDKHTMDIAVEESNLAQIIGRNGQNIRLISQLIDWELNVMTVVELEKKRQSEDRNILDIFMRVLNINEESAKVLIDSGFSSLEELAYIPISELLSIGVFDKEEIDLLRFKAKDALKDLSNKDNNDDNSTIMNSVSELLKLSSLKYEIALKLINYGIYKLEDLAEQDIVSLSGIKDLNLTEEEIGELIMEARNICWFNHDSNK

SEQ ID NO: 64437 - DNA, 1479 bp, Bordetella bronchiseptica RB50
  CDS (1)..(1479): transl_table=11
atgagtcgcgaaattcttctgttggtcgatgctttggcgcgcgaaaagaacgtcacccgcgaagtggtgttcggggcgctcgaaagcgcgctggcttcggcaatgaaaaagcgcttcaaggacgatgcggacatccgcgtctccatcgatcgtgaaaccggcggccacgaaggctttcgccggtggctggtcgtgcccgacgaggctggcctgcaagagcccgacaagcaggagctgctgtccgaggcgcgcgaaatggcgcccgacatcgaagtgggcgagtacatcgaggaagcgctcgagccggtcgagttcggccgtatcggcgcgcaggccgccaagcaggcgatcctgcagaagatccgcgatgccgagcgcgagcaggtcctgaacgacttcctcgaccgcggcgagacgattatttccgggtccatcaagcggatggacaagggcgacgtgatcatcgaaaccggcaagatcgaagcgcgcctgccgcgctccgagatgatcccgaaggaaaacctgcgggtcggcgaccgcgtgcgcgccttcgtgctgcgggtcgaccacgccgcgcgcggccagcaggtcatcctgtcgcgcacttcgcccgagttcatccgccaattgttcgaaaacgaagtgcccgagatcgaacagggcctgctggagatcaaggccgcggcacgcgacccgggcgtgcgcgccaagatcgccgtggtggcctacgacaagcgtatcgacccgatcggcacctgcgtgggcatgcgcggttcgcgcgtgaccgccgtgcgcaacgagctgggcggcgagcaggtcgatatcgtgctgtggtcggaagacccggcgcaattcgtgatcggcgcgctggcgccggccaacgtcgaatccatcgtggtggacgaagacaagcacgcgatggacgtggtggtcgacgaggaaaacctgcccaaggccatcggcgccaaggggcagaacgtgcgcctggcgtccgagctgaccggctggcagatcaacatcatgacgccggaggaaagcctcaatcgccaggaaaccgagcgtgccgcgttgcgcgcgacgttcatgagcaagctggacgtcgacgaagaggtggccgacatcctgatcgatgaaggcttcaccggtatcgaagagattgcctacgtgcccatgcaggaactgctggagatcgaggcattcgacgaggacaccatcaatgagctgcgtgcccgtgcccgcaatgcgctgctgaccgaggcgatcgcccaggaagagcgccttgaaacggcccaggacctgctcgaactcgagggcatcacgccggagctggccgccaagctggccgaacggcaggtgcatacgcgtgacgatctggccgagctgtcgaccgacgagctggccgagatcgccggcctgcaggaagaggaagccagcgatctgatcatgcgtgcccgcgcccactggttcgacgaggaatga

SEQ ID NO: 64438 - protein, 492 aa, Bordetella bronchiseptica RB50
MSREILLLVDALAREKNVTREVVFGALESALASAMKKRFKDDADIRVSIDRETGGHEGFRRWLVVPDEAGLQEPDKQELLSEAREMAPDIEVGEYIEEALEPVEFGRIGAQAAKQAILQKIRDAEREQVLNDFLDRGETIISGSIKRMDKGDVIIETGKIEARLPRSEMIPKENLRVGDRVRAFVLRVDHAARGQQVILSRTSPEFIRQLFENEVPEIEQGLLEIKAAARDPGVRAKIAVVAYDKRIDPIGTCVGMRGSRVTAVRNELGGEQVDIVLWSEDPAQFVIGALAPANVESIVVDEDKHAMDVVVDEENLPKAIGAKGQNVRLASELTGWQINIMTPEESLNRQETERAALRATFMSKLDVDEEVADILIDEGFTGIEEIAYVPMQELLEIEAFDEDTINELRARARNALLTEAIAQEERLETAQDLLELEGITPELAAKLAERQVHTRDDLAELSTDELAEIAGLQEEEASDLIMRARAHWFDEE

SEQ ID NO: 64439 - DNA, 1449 bp, Prochlorococcus marinus str. MIT 9313
  CDS (1)..(1449): transl_table=11
atggctctcgttctactccccggcctcaacaacctgatcgaagacatcagcgaggagaagaaactccctacccaagtggtggaagcagccctgcgtgaggccctcctcaaaggatatgaacgctaccgacgcactctttatctaggtatcagtgaggaccctttcgaagaagagtatttcagcaacttcgatgttggactagagcttgaagatgaaggttatcgggtcctggccagcaaaatcatcgttgaagaggtggagagcgaagaccaccagattgctcttcaagaagtgatgcaagtcgctgaagacgcccagatcggtgacaccgtggtgctcgacgttacccccgagaaggaagacttcggccggatggctgccgccacaaccaagcaggtactggcgcaaaagctacgcgaccagcagcgccgcatgattcaagaggaatttgccgatctagaagatcccgtgctcacagctcgtgtgatccgttttgaacgtcattcggtgatcatggcggtgagttctggtcttgggcgccctgaagtggaggccgagctcccacgccgcgaccagctccccaacgacaattatcgcgccaacgccaccttcaaagtctttctgaaggaagtcagcgaagtgccccgacgagggcctcagttgttcgttagccgctccaacgccggactagtggtttacctatttgagaacgaggtgcccgaaatccaagaaggctcagtgcgcattgtggccgtagcccgtgaagccaatcctccttctcgttccgtgggcccacgcaccaaggtggcagttgacagcattgaacgtgaagtggaccctgtcggcgcctgcatcggtgcccgcggctcacgcattcagcaagtggttaatgaactacgcggcgaaaaaatcgatgtgatccgctggtcacctgacccaggtcaatacattgccaattcccttagccctgctcgcgttgagatggtgcgactggtggatccagaagggcagcatgcccacgtcctagtccccccagatcaactaagcctggccatcggacgagaaggacaaaatgtacgcctagcagctcgtctaaccggatggaaaatcgacatcaaaaactcccaggaatatgaccaggccagtgaggacaccaccgtcgccgagctgatttctcagcgagaggaagaagaggctctccaacgcgatgccgaagcccgcctggcagctgaacaagccacccgagcagaagaggatgcacgcctaagagagctttaccccctaccggaagatgaagaagagtatgaccaagaagaacctgctaagacgatggctgaagacgaaaatgaatccgacggccaatctgacgacttgagcaaccaacctgacgcctcaagcgaacaacgctcaaatgaagaatcactagaagaagaggacagagctcggtga

SEQ ID NO: 64440 - protein, 482 aa, Prochlorococcus marinus str. MIT 9313
MALVLLPGLNNLIEDISEEKKLPTQVVEAALREALLKGYERYRRTLYLGISEDPFEEEYFSNFDVGLELEDEGYRVLASKIIVEEVESEDHQIALQEVMQVAEDAQIGDTVVLDVTPEKEDFGRMAAATTKQVLAQKLRDQQRRMIQEEFADLEDPVLTARVIRFERHSVIMAVSSGLGRPEVEAELPRRDQLPNDNYRANATFKVFLKEVSEVPRRGPQLFVSRSNAGLVVYLFENEVPEIQEGSVRIVAVAREANPPSRSVGPRTKVAVDSIEREVDPVGACIGARGSRIQQVVNELRGEKIDVIRWSPDPGQYIANSLSPARVEMVRLVDPEGQHAHVLVPPDQLSLAIGREGQNVRLAARLTGWKIDIKNSQEYDQASEDTTVAELISQREEEEALQRDAEARLAAEQATRAEEDARLRELYPLPEDEEEYDQEEPAKTMAEDENESDGQSDDLSNQPDASSEQRSNEESLEEEDRAR

SEQ ID NO: 64441 - DNA, 1428 bp, Synechococcus sp. WH 8102
  CDS (1)..(1428): transl_table=11
atggctctcgttctgcttccaggcctcagcaacctgatcgacgacatcagcgaagagaagaagttgccgcctcaggtggtggaagcagccctgcgcgaagccctgctgaagggctatgagcgttatcggcgcaccatgtatttgggcatcagcgaagacccctttgacgaggagtatttcagcaatttcgatgtcggactcgacctggaggaagagggctaccgggttctggcgagcaaaatcatcgtggaggaggtggaaagcgaagaccaccagatcgccctgcaggaggtgatgcaggtggcggacgacgcccaggagggcgacaccgtggtgcttgacgtcactccggagaaggaggatttcggccgcatggcggctgccaccacaaagcaggtgctggcccagaagctgcgggatcaacagcgccgcatgatccaggaggagttcgccgatctggaagaccctgtgctgaccgcacgggtgattcggtttgagcgtcaatccgtgatcatggccgtgagctcagggttgggccggcctgaagtggaagccgaactgcctcgccgcgatcagctacccaacgacaactaccgcgccaatgccaccttcaaggtgttcctcaaagaggtgagcgaggtgccgcggcgcggcccgcagcttttcgtcagccgctccaatgcgggtttggtcgtttacctctttgaaaacgaggtgcccgaaatccaggagggatcggtccggatcgtggcggtggcaagggaagccaacccaccatcacggtccgtcggcccccgcaccaaggtggcggtggacagcatcgaacgggaagtggatccagtgggtgcctgcatcggcgcccgcggttcacgcattcagcaggtggtgaacgaactgcgcggcgagaagatcgatgtgatccgctggtcccaggaccccggccagtacatcgccaactccctcagtccggcgcgggttgaaatggttcgcctggtggatcctgtcggtcagcacgcccatgtgctggttccccccgaccaactcagcctggccatcggtcgtgaagggcagaacgtgcggctggcggcacggttgacgggctggaaactcgacatcaaaaactccaccgagtacgaccagtccgcggaagacgccgtggttgccgaactgatctctcaacgggaacaggaagaggcgctgcagatggaagcggaggaacggctggctgctgagcaggccgcacgggccgaagaagatgctcgcctgcgggagctctatccgctgcctgaagacgatgaggattacgtggagggagaccagttgggcgaaagcgagcaaaccgaggccaccgcttctgaagagatgcccggagaggagccgaccagcgaggaacctgcccctgaggacgacggcgaggttgcccggtga

SEQ ID NO: 64442 - protein, 475 aa, Synechococcus sp. WH 8102
MALVLLPGLSNLIDDISEEKKLPPQVVEAALREALLKGYERYRRTMYLGISEDPFDEEYFSNFDVGLDLEEEGYRVLASKIIVEEVESEDHQIALQEVMQVADDAQEGDTVVLDVTPEKEDFGRMAAATTKQVLAQKLRDQQRRMIQEEFADLEDPVLTARVIRFERQSVIMAVSSGLGRPEVEAELPRRDQLPNDNYRANATFKVFLKEVSEVPRRGPQLFVSRSNAGLVVYLFENEVPEIQEGSVRIVAVAREANPPSRSVGPRTKVAVDSIEREVDPVGACIGARGSRIQQVVNELRGEKIDVIRWSQDPGQYIANSLSPARVEMVRLVDPVGQHAHVLVPPDQLSLAIGREGQNVRLAARLTGWKLDIKNSTEYDQSAEDAVVAELISQREQEEALQMEAEERLAAEQAARAEEDARLRELYPLPEDDEDYVEGDQLGESEQTEATASEEMPGEEPTSEEPAPEDDGEVAR

SEQ ID NO: 64443 - DNA, 1479 bp, Chromobacterium violaceum ATCC 12472
  CDS (1)..(1479): transl_table=11
atgagtcgcgagattttgttgctggtggatgccctggcgagcgagaagaatgtcagcaaggatgtggtgttttccgcccttgagatggcgcttgcctcggccaccaagaagaagtttaccgatgacgagatggatgtgcgcgtcgagatcgaccgccacaccggtcagtaccagaccttccgccgctggctggtggtggaggacgagctgctggaatccgaaagcaaggaaatcggcctgatcgacgcgcgcgaccgcgatccgcgcatcgagttgggcgccttcatcgaagagccgatggaggccgtcgaattcggccgcatcggcgcgcagaccgccaagcaggtgatcctgcagcgcatccgcgacgccgagcgcgaacagctgctgaacgaattcctgcagcgccgcgagcacctggtgatcggcaccatcaagcgcatcgagcgcggcaacgccatcgtcgagtgcggcaagctggaagccgtgctgccgcgcgaccagatgattccgaaggaaaacctgcgcgtgggcgaccgcgtgaaggcctatctgctgcgcatcgaccgccagggccgcggcccgcaactgatcctgtcgcgcaccgcgccggaattcctggtcaagctgttcgagctggaagtgccggagatcgaggaaggcatgctggaaatccgcgccgccgtgcgcgatccgggcatgcgcgccaagatcgccgtcaaggccaacgacgcccgcatcgatccgcagggcacttgcatcggcatgcgcggctcgcgcgtgcaggcggtgacccaggaactggcgggcgagcgcgtcgacatcgtgctgtgggcgccggaaccggcccagttcgtgatcaacgcgctgtcgccggccgaagtcagccgcatcatggtggacgaagacaatcacagcatggacgtgatcgtcgaggaagagcagctggcgctggccatcggccgcagcgggcagaacgtcaagctcgccgccgagctgaccggctggtacctgaacatcatgaccgtggccgaagcggaagagaagcatcaggccgaagacgccgcgctgcgccagctgttcgtcagcgcgctgagcgtggatgaagacaccgccgccaaactggtggaagagggcttcgccgcgctggaggaagtggcctacgtgccgctggaagaaatgctggaaatcgaaggcttcaacgaggagctggtgggcgagcttcgcagccgcgcccgtgatgcgctcctgacgcaggccatcgcgtccgaagagcaggtcgagaacgtagccgacgacctgaaggacgttgaaggcctggatgccgagctggttcgcaagctggccgcaggcggcgtgaccacccgcgacgatctggccgacctggccgttgacgatctggtggacatgaccggcatggaagcggaagctgcacgcgcaatcatcatgaaggcgcgcgaacactggttcaaccagtaa

SEQ ID NO: 64444 - protein, 492 aa, Chromobacterium violaceum ATCC 12472
MSREILLLVDALASEKNVSKDVVFSALEMALASATKKKFTDDEMDVRVEIDRHTGQYQTFRRWLVVEDELLESESKEIGLIDARDRDPRIELGAFIEEPMEAVEFGRIGAQTAKQVILQRIRDAEREQLLNEFLQRREHLVIGTIKRIERGNAIVECGKLEAVLPRDQMIPKENLRVGDRVKAYLLRIDRQGRGPQLILSRTAPEFLVKLFELEVPEIEEGMLEIRAAVRDPGMRAKIAVKANDARIDPQGTCIGMRGSRVQAVTQELAGERVDIVLWAPEPAQFVINALSPAEVSRIMVDEDNHSMDVIVEEEQLALAIGRSGQNVKLAAELTGWYLNIMTVAEAEEKHQAEDAALRQLFVSALSVDEDTAAKLVEEGFAALEEVAYVPLEEMLEIEGFNEELVGELRSRARDALLTQAIASEEQVENVADDLKDVEGLDAELVRKLAAGGVTTRDDLADLAVDDLVDMTGMEAEAARAIIMKAREHWFNQ

SEQ ID NO: 64445 - DNA, 1335 bp, Porphyromonas gingivalis W83
  CDS (1)..(1335): transl_table=11
atggccaagaagcaagagacgatcagcatgatagaatcgctggcagaattcaaagagctgaaaaacattgacaaagagacgatgatcaacgtcctggaggattccttccggaacgttctggcaaaaatcttcggatcggacgacaacttcgacgtaatcatcaatccggagaaaggcgacttcgaaatatggcgcacccgtcaggtagtagaggacggtgccgtagaggacgaaagtcgcgaagtgtctctgtcggatgctcacgagatcgaccccgaggcggaggtcggtgaggaagtaacggactccgtgaacttcgcttcattcggtcgccgtgccattctcaatcttcgccaagctctctccagcaagattatggagcttcagaaggaaaacctgttcaatacattcacggaacgtatcgggcagctcatttcggctgaagtatatcaggtatggaagcgtgaggctctgcttatcgacgacgacggcaacgaactcctgatgccgaagagcgagcagatcccaagcgactttttccgcaaaggtgagaccgttcacgccgttgtggagcgcgtggagaacgccaacaacaatcccaagatcatcgtatcgcgtacaagcggagagttcctcaagaggcttttcgagctgaatgtaccggagattgccgatggcctgatcaccatccgctgcgtagcccgtatcccgggagagagggccaagatggccgtagagtcttacgacgatcgtatcgaccccgtaggagcctgtgtgggtatgaacggttcgcgcatacgaggtatcgtgcgcgaactgagaggcgagaatatcgacgttacgcagtacacgacgaacaccgccctcttcatccagcgggcactcagccctgcacgtatatcttcgattcgcctgctcgaagcagagcataaggccgaagtattcctgcgccccgaagaagtgcctttggccatcggaaagaatgcctcgaatatcaagctggcatcggggctgacgggttatcagatcgaagtgttccgtgacatagacgatatggacgaagaagacatctatctggacgaattcaacgacgagatcgaccagtggatcatcgacctgttcaagaatatcggttgcaatacggccaagagcgtgctcagcaagaacagagaagatctgatcaaagagacggatttggaagactccaccatagactatgtactcggagtcctgagtgccgaatttgccgatgaggatcaggtgactgataatcaaagtaccgattcggatgatttggacaatttctctgccgaagacgatctgaagcaagagtaa

SEQ ID NO: 64446 - protein, 444 aa, Porphyromonas gingivalis W83
MAKKQETISMIESLAEFKELKNIDKETMINVLEDSFRNVLAKIFGSDDNFDVIINPEKGDFEIWRTRQVVEDGAVEDESREVSLSDAHEIDPEAEVGEEVTDSVNFASFGRRAILNLRQALSSKIMELQKENLFNTFTERIGQLISAEVYQVWKREALLIDDDGNELLMPKSEQIPSDFFRKGETVHAVVERVENANNNPKIIVSRTSGEFLKRLFELNVPEIADGLITIRCVARIPGERAKMAVESYDDRIDPVGACVGMNGSRIRGIVRELRGENIDVTQYTTNTALFIQRALSPARISSIRLLEAEHKAEVFLRPEEVPLAIGKNASNIKLASGLTGYQIEVFRDIDDMDEEDIYLDEFNDEIDQWIIDLFKNIGCNTAKSVLSKNREDLIKETDLEDSTIDYVLGVLSAEFADEDQVTDNQSTDSDDLDNFSAEDDLKQE

SEQ ID NO: 64447 - DNA, 1152 bp, Gloeobacter violaceus PCC 7421
  CDS (1)..(1152): transl_table=11
gtgtcgatgattcatttgcccggcgtcaatcaacagattgagacgatcagccggcagcggaatttacccaagcacgccgtcaaagaggcgctgatcgaggcgctcaaaaaaggttacgagcgctttcgcaagacctaccgcgacccgcgcgaaaatagcgaagagatggccttcgacaacttcatcgtcgaactcgacaccgaccgcgaggggtttcgggtgctcgccaccaagaccatcgtcgaaacggtgagcgacaccgaccaggaaatcgccctgattgaggtgcgcgaagtggccccggacgccgaacccggcggcacggtcgtcgtcgatgtcacccccgaaaaaggtgacttcggccgcatggccgccatccagaccaagcaggtgctctcccaaaaactgcgcgaccagcagcgcaagctcattcaagaagagttccgcgaactggaaggcacggtattgcaggcccgggtgatgcgcttcgagggtcgctcggtgatctgtgcggtctccagcggcttcggccagaacgaagtggaagcggaattgcccaagaacgagcagctccccaacgagccctaccggatcggctcggcgtttaaagtcttcctgcgcaaagtctgggaaggttcgcgccgcggcccgcagctactcgtctcccgcgccgacgccgggctggtggtgtacctgttcgccaacgaagtgcccgaaattgaagatgagatcgtccgcatcgtggcggtcgctcgcgaggcgaacccaccctcgcgcaccgtcggcccgcgcaccaagatcgctgtcgatacgcttgagcgcgatgtggatccggtgggagcctgcatcggggcgcgcggctcgcgcatccaggcggtcgtcaacgaactgcgcggcgaaaaaatcgacgtcatccgctggtcccccgacccggccacctacatctccaacgccctctcaccggcgcgggtgatccaggtgcgcctggtggacccggacgcgcgccaggcccacgtcatcgtccccgacgatcagctgtcgctcgccatcggcaaagaaggccagaacgtccgcctcgccgcccgcctcaccggctggaagattgacatcaaaaaatcaagcgagtacagcgcggaagcggcatattcctag

SEQ ID NO: 64448 - protein, 383 aa, Gloeobacter violaceus PCC 7421
MSMIHLPGVNQQIETISRQRNLPKHAVKEALIEALKKGYERFRKTYRDPRENSEEMAFDNFIVELDTDREGFRVLATKTIVETVSDTDQEIALIEVREVAPDAEPGGTVVVDVTPEKGDFGRMAAIQTKQVLSQKLRDQQRKLIQEEFRELEGTVLQARVMRFEGRSVICAVSSGFGQNEVEAELPKNEQLPNEPYRIGSAFKVFLRKVWEGSRRGPQLLVSRADAGLVVYLFANEVPEIEDEIVRIVAVAREANPPSRTVGPRTKIAVDTLERDVDPVGACIGARGSRIQAVVNELRGEKIDVIRWSPDPATYISNALSPARVIQVRLVDPDARQAHVIVPDDQLSLAIGKEGQNVRLAARLTGWKIDIKKSSEYSAEAAYS

SEQ ID NO: 64449 - DNA, 1509 bp, Photorhabdus luminescens subsp. laumondii TTO1
  CDS (1)..(1509): transl_table=11
atgaataaagaaattctggctgttgtggaagcggtttccaacgaaaaatcccttccacgcgaaaagatcttcgaggcgctggaaacagcattggccacagccaccaagaaaaaatatgaacaagatatcgatgttcgtgtcagcattgaccgtaaatctggtgattttgacactttccgtcgttggttagttgttgaagaagtgactcagccgactcgtgaaattacgctagaagcggctagatttgaagagcctgaaatcgatttgggtagctataccgaagatcaaattgaatcagtaacgtttgatcgtattacaacgcaaaccgctaaacaggttattgtacaaaaagtacgtgaggctgagcgcgctatggttgttgatcagttccgcgaacagcaaggtgagatcatcaccagtgtggttaagaaagtcaatcgtgagaatatcactcttgatttaggcaataatgctgaggccgttatccttcgcgaagatatgttaccaagggaaaattttcgcccaggtgaccgcgtgcgtggtgtactgtatgatgttcgccctgaagcacgaggtgcgcaactgtttgtcagtcgttcccgcccggaaatgctggttgaactgttccgtattgaggttccggaaattggtgaggagctgattgaaattaaagctgctgcccgcgatccgggatctcgcgctaagattgcagtaaaaacgaatgacaagcgtatcgatccggtaggtgcttgcgttggcatgcgtggcgcgcgagtacaggctgtttccagtgaactgggcggcgaacgaatcgatatcgtactgtgggatgataatcctgctcagtttgtcattaatgctatggctccggctgatgttgcatctattgttgtcgacgaagacaagtgtacgatggatgttgccgttgaaagcaacaacttagcgcaggctatcggccgtaatggtcaaaatgtgcgcctggctgcgcagttgttgaaaaaacatcgtggtgatgacaaatgggaattaaatgtcatgactgctgaagagttacaagcaaaacatcaggcagaagctcatgcttctattgatacattcactaagcatctcgatattgatgaagaatttgctactgttctagtcgaagaagggttctcaactctggaagaattggcctatgtaccaattaaggaacttctagaaattgaaggccttgatgaggaaactatcgaagtcctgcgtgaacgtgcgaaagctgctttaactactctggaactggctcagaaagaaagcctcagtgataaacaaccaactgaagagttgttaaatctgactggtatgaatcgtactctggcatttgacctagctgcccgtggcatctgtacgctggaagatcttgccgagcagggtatcgacgacctatctgatattgaaggtttgaatgatgagaaaacaggcgagctcatcatggctgcccgaaatatctgttggtttggcgatgatgcgtaa

SEQ ID NO: 64450 - protein, 502 aa, Photorhabdus luminescens subsp. laumondii TTO1
MNKEILAVVEAVSNEKSLPREKIFEALETALATATKKKYEQDIDVRVSIDRKSGDFDTFRRWLVVEEVTQPTREITLEAARFEEPEIDLGSYTEDQIESVTFDRITTQTAKQVIVQKVREAERAMVVDQFREQQGEIITSVVKKVNRENITLDLGNNAEAVILREDMLPRENFRPGDRVRGVLYDVRPEARGAQLFVSRSRPEMLVELFRIEVPEIGEELIEIKAAARDPGSRAKIAVKTNDKRIDPVGACVGMRGARVQAVSSELGGERIDIVLWDDNPAQFVINAMAPADVASIVVDEDKCTMDVAVESNNLAQAIGRNGQNVRLAAQLLKKHRGDDKWELNVMTAEELQAKHQAEAHASIDTFTKHLDIDEEFATVLVEEGFSTLEELAYVPIKELLEIEGLDEETIEVLRERAKAALTTLELAQKESLSDKQPTEELLNLTGMNRTLAFDLAARGICTLEDLAEQGIDDLSDIEGLNDEKTGELIMAARNICWFGDDA

SEQ ID NO: 64451 - DNA, 1614 bp, Rhodopseudomonas palustris CGA009
  CDS (1)..(1614): transl_table=11
atggccgtcagcgccaataggctggaactgctgcagatcgccgatgcggtggctcgcgagaaaaccatcgaccgcagcatcgtgattgcggcgatggaagacgcgatcgccaaggcggcgcgcgcccgctacggctcggagaccgacgtccatgccgagatcgacccgaagaagggcgagctgcggctgtcgcgccatatgcttgtggtcgagcaggtcgaaaaccccgccaaccagatttcgctgaaggacgcgcagcgcgccaatcccggcgcgcagatcggcgacaccatcgccgacaccctgccgccgctggaatacggccgtatcgccgcgcagtcggccaagcaggtgatcgtgcagaaggtccgtgaggccgagcgcgaccgccagtacatggaattcaaggaccggatcggcgacatcgtcaacggcgtcgtcaagcgcgtcgaatacggcagcgtgatcgtcgaccttggccgcggcgaagcgatcatccgccgcgacgagatgctgccgcgcgagtcgttccgcaacggcgaccgcgtccgcgcctatgtgttcgacgtccgccgcgagactcgcggcccgcagatcttcctgtcgcgcacccatccgcagttcatggccaagctgttcgcgcaggaagtgccggaaatctacgacggcatcgtcgagatcaaggcggtcgcccgcgatcccggctcgcgcgccaagatcggcgtcgtctcgcgggactcctcggtcgatccggtcggcgcctgcgtcggtatgcgcggttcgcgcgtgcaggcggtggtgaacgaactgcagggcgagaagatcgacatcattccgtggtcgccggacatcgccaccttcgtggtcaacgcgctggcgccggccgaagtctcgaaggtcgtgatcgacgaagatcgcgaacgcatcgaggttgtggttccggataccaataaccaactatccttggcgattggtcgccgcggtcagaacgtgcggctcgcttcgcagctcaccggctgggacatcgacatcctgaccgagagcgaggaatccgagcgccgccaggccgacttcgagaagaccacccgggccttcatggacgcgctgaacgtcgacgaggtcgtcggccagctgctcgcctccgaaggtttcacctcggtcgaagaactggcgctggtcgacccgcgcgaactcgcctcgatcgaaggtttcgacgaggaaaccgccgccgaactgcagacccgcgccagcgaatatctcgaccggattgaatccgagctcgaggcccggcgcctggagctcggcgtcgaagatgctctgaaggacgttcccggcgtcacctcgaagatgctggtcaagttcggcgagaacgacgtcaagacggtcgaagatctggccggctgcgccaccgacgatctggtgggttggaccgagcgcaaggacggcgccgagccggtgaagtatcctggcattctcgacggcatggagatgtcgcgcgaggacgccgaacacctgatcatgcaggcccgcgtcaaggccggctggatcgacgagtcggagctcgcctccgaagaagaccccgcggacgaagcgtccgacgagtcggcggactga

SEQ ID NO: 64452 - protein, 537 aa, Rhodopseudomonas palustris CGA009
MAVSANRLELLQIADAVAREKTIDRSIVIAAMEDAIAKAARARYGSETDVHAEIDPKKGELRLSRHMLVVEQVENPANQISLKDAQRANPGAQIGDTIADTLPPLEYGRIAAQSAKQVIVQKVREAERDRQYMEFKDRIGDIVNGVVKRVEYGSVIVDLGRGEAIIRRDEMLPRESFRNGDRVRAYVFDVRRETRGPQIFLSRTHPQFMAKLFAQEVPEIYDGIVEIKAVARDPGSRAKIGVVSRDSSVDPVGACVGMRGSRVQAVVNELQGEKIDIIPWSPDIATFVVNALAPAEVSKVVIDEDRERIEVVVPDTNNQLSLAIGRRGQNVRLASQLTGWDIDILTESEESERRQADFEKTTRAFMDALNVDEVVGQLLASEGFTSVEELALVDPRELASIEGFDEETAAELQTRASEYLDRIESELEARRLELGVEDALKDVPGVTSKMLVKFGENDVKTVEDLAGCATDDLVGWTERKDGAEPVKYPGILDGMEMSREDAEHLIMQARVKAGWIDESELASEEDPADEASDESAD

SEQ ID NO: 64453 - DNA, 1158 bp, Geobacter sulfurreducens PCA
  CDS (1)..(1158): transl_table=11
gtggaaacgaccttcaacctcaagcacattattgaccagatcgtcaaggagaaggggattgaccggcacatcgtcgtggaagccctggagcaggcggtactcaccgctgcgaacaagaagttccgcaatactcgtgatcttgaggcccactataacccggaagttggcgaagttgagctctttgagttcgttaccgtggtcgacgaggttcaggattcctacaaggaaatcgacatggaagaggcccgggagatcgaccctgacgtggaagtgggcgattctctcggtatgaagctggatgcaagcggttttacccgtatcgccgcccagaccgccaagcaggtcatcatccagaaggtgcgcgaggcggagcgggaaactattttcaacgagttcaaggaccggatcggcgaactggtgaccggcgttgtgcgccgctttgaaaaaggtgatctggtaatcgatctcgggcgcgccgaagcggtgctttcccataaggagcaggcgccgcgcgaggtgtatcgccagggtgaccgcgttaagactctgatcaccgacatccggatgaccccaaaggggccccagatcgttctgtcgcgtacccatcccggcgtccttgccaagcttttcgaggcggaggttccggagatcgccgaagggatcgtggagatcaaggccgttgtacgtgagccgggcagccgggccaagatcgccgtctactcccatgattccgatgtggatcccgttggggcctgcgtgggtatgcggggtagccgcgtgcagaatgtggtgtccgagctgaggggtgaaaagatcgatatcatcccctggtccgatgacgcggcacgctttgcgtgcaatgcgctgcaaccggccgtggtgtcgaaggtgtacattgacgacgagaaccgctccatggagataatcgtcgccgacgaccaactgtcgctggctatcggtaaaaaagggcagaacgtgcggcttgccgcaaagcttaccggctggcgcatcgacatcaagagcgaaaccactgctgccgaggcggaactgctccagtattcctcctatgatggggccaccgaagaggttgctgaagaggccgcccaagccgttgagaccgaaggcgaagcggttgcagaggagcaggtggaagcatag

SEQ ID NO: 64454 - protein, 385 aa, Geobacter sulfurreducens PCA
METTFNLKHIIDQIVKEKGIDRHIVVEALEQAVLTAANKKFRNTRDLEAHYNPEVGEVELFEFVTVVDEVQDSYKEIDMEEAREIDPDVEVGDSLGMKLDASGFTRIAAQTAKQVIIQKVREAERETIFNEFKDRIGELVTGVVRRFEKGDLVIDLGRAEAVLSHKEQAPREVYRQGDRVKTLITDIRMTPKGPQIVLSRTHPGVLAKLFEAEVPEIAEGIVEIKAVVREPGSRAKIAVYSHDSDVDPVGACVGMRGSRVQNVVSELRGEKIDIIPWSDDAARFACNALQPAVVSKVYIDDENRSMEIIVADDQLSLAIGKKGQNVRLAAKLTGWRIDIKSETTAAEAELLQYSSYDGATEEVAEEAAQAVETEGEAVAEEQVEA

SEQ ID NO: 64455 - DNA, 1389 bp, Bdellovibrio bacteriovorus HD100
  CDS (1)..(1389): transl_table=11
atggctgaaaatgtgttttcagatctttccaaggtgattgatcaagtcggaaaagacaaaggtatcgacaaacaggttgttatcgatgcaatcactcagggtatgctggtagctgcacgtaaaaaatacggtacttaccgcgagatcgaagctgcatacaacgaagacaccggcgaagttgaactgtttgagttcaaagaagttgttcctcgtgaaaaatacatcgatgaagaagttgagattcctcttgatgaagctcagaagctggatccaaatgttcagctggatgactccattggtatcaaaatggaagcttccgacctgggccgtatcgctgctcagactgcaaaacaaatcatcatgcagaaagtgcgtgatgcggaacgcaacatcatcttcaatgaatttgaagagcgcaaaggcgagatcgcttccggtatcgcacgtcgtgttgaaaaaggcgcgatcgttgtcgatttgggccgcactgaggcttacattccgcctcgtgaacagatcccgggcgaacaatacaagccaggcgatcgcattcagggttacctttctgaagttcgtcagacgacacgtggtcctcagatcatcatgtcccgcgctgatgaacgttatttgatgaaacttttcgaaatggaagttccagagatctacgacggtgttgtggaaatcatggcagccgctcgtgaaccaggacagcgcgcgaaaatcgcggttcgttccaaagacaactccgtggacccggtaggggcttgcgtgggtatgaagggttcccgtgttcagaatatcgttcaggagcttcgtggcgagaaaatcgacatcgttccttgggacgaggatatcactcgtttcgcgtgcaacgctttggcgcctgcggaaatctcccgcgtgttcctggatgatgccaaccgcgaaatggaaatcgttgttccggactctcaattgtctttggctatcggtaaacgtggtcaaaacgtgcgtctggcagcgaaactgacaacttggaagctggatatcatttctgaatcttcagcggcttcccgcacagcggaatccatcttcaatctgatgttgatcccgggcatgagcgaaaccatggctcagaacatcttccagtccggcttcggttcattccaggctgtggcgacggcggctgttgaagagctgatgacaatccctggttacgacgatccagacaaagccgaaaagctttccaaagaagccaaaggcctggttgcgaagtatgaatctgaaggtgtgccggttccaaccgctccttcagttgccaaggacaaaggttccaacgtgtctgcaaaagagcaggccgatcttctgttgaagcaagagttgaaaaaactcgaagctgaagaagagtag

SEQ ID NO: 64456 - protein, 462 aa, Bdellovibrio bacteriovorus HD100
MAENVFSDLSKVIDQVGKDKGIDKQVVIDAITQGMLVAARKKYGTYREIEAAYNEDTGEVELFEFKEVVPREKYIDEEVEIPLDEAQKLDPNVQLDDSIGIKMEASDLGRIAAQTAKQIIMQKVRDAERNIIFNEFEERKGEIASGIARRVEKGAIVVDLGRTEAYIPPREQIPGEQYKPGDRIQGYLSEVRQTTRGPQIIMSRADERYLMKLFEMEVPEIYDGVVEIMAAAREPGQRAKIAVRSKDNSVDPVGACVGMKGSRVQNIVQELRGEKIDIVPWDEDITRFACNALAPAEISRVFLDDANREMEIVVPDSQLSLAIGKRGQNVRLAAKLTTWKLDIISESSAASRTAESIFNLMLIPGMSETMAQNIFQSGFGSFQAVATAAVEELMTIPGYDDPDKAEKLSKEAKGLVAKYESEGVPVPTAPSVAKDKGSNVSAKEQADLLLKQELKKLEAEEE

SEQ ID NO: 64457 - DNA, 1488 bp, Treponema denticola ATCC 35405
  CDS (1)..(1488): transl_table=11
atgtctgaaggaataattgaggcaattcgggaatttgcacaggaaaaaggaattgatgacgattttgttttgcacattgtagagcaggctctaaaagcatcttataaaaaacaattcggaacagatgcaaatgccgtattcaatgaagaaacaggaaaaatatactcaaagaaaataataacggaagatgcaaaaaatccggtttttgatataagtttagaagaagcaaaaaaattggccccctcttgcgaggcaggtgatgaacttttagtcgaagtcgatccgaaaagcttaggtattaattctgtcaaggtcggaatgcaaagagcaatccaatgtatcagagaaatgcaaaaagataccctttatgcagaatacagtacaaaggtaggagaaatcataatcggttactaccatcgggaacgaaacggaaacatctatgtcgacttaggaaaggttgagggcttattacctaaaaaatatcagtgtccgggagatcactttggaaggaatgcagcagccggagaagaatcaagaataaaagcccttgtacgggaagtaaaaaaacaccgtcaatcaaacgtagtacagctgatcctttcaagaaccgatgcggaatttgtaaggcagatactggaagtggaagtgcccgaaattgaaagcggaatagtaaagattcataatattgtacgtgaaccaggttatagaacaaagatagcggtttcaactgacagagatgatatagatcctgtaggagcctgtgtaggagcaaagggagcaagaattcaagcagttatcgcagagttggatgatgaaaagatagatattctaccctactctgaagaccctaaggcctatataaaaagcgccctttcacctgcagaagtcatggatgttatgatattggatgcggaaaaaagaaaggcccttgcaatcgtttccgactcccaattatcgctggctataggaaaacacggtttaaacgtacgccttgcaaaccgccttgtagactggaacatagatgtaaaaaccgaagaacagtttaaacaaatggatatttacacggatgccagaaaggctgtcgaaaacttattcactgatgaaacaagtgatgaagatgaagaatatgaggaaatttccaatgttgccgaacttccgggaattaccgaagatattcttacagtattacgtaataacgaaattgaagatatacaagacttgattaacatggaagatgatgaaatcagggcattggaaggtcttactacagagatggctgatacccttcttgacattatagctaatgccgttgaagttgtagaagacgatggagatgaaagcgatgaagaaagcgagcctgtttcggatgatgagggtgaagttgaagaatttgaatgccctgaatgcggtcataaaataacaacagatatgacaaaatgccccaattgcggagtagatcttgcttttgaatatgaggacgaagagtag

SEQ ID NO: 64458 - protein, 495 aa, Treponema denticola ATCC 35405
MSEGIIEAIREFAQEKGIDDDFVLHIVEQALKASYKKQFGTDANAVFNEETGKIYSKKIITEDAKNPVFDISLEEAKKLAPSCEAGDELLVEVDPKSLGINSVKVGMQRAIQCIREMQKDTLYAEYSTKVGEIIIGYYHRERNGNIYVDLGKVEGLLPKKYQCPGDHFGRNAAAGEESRIKALVREVKKHRQSNVVQLILSRTDAEFVRQILEVEVPEIESGIVKIHNIVREPGYRTKIAVSTDRDDIDPVGACVGAKGARIQAVIAELDDEKIDILPYSEDPKAYIKSALSPAEVMDVMILDAEKRKALAIVSDSQLSLAIGKHGLNVRLANRLVDWNIDVKTEEQFKQMDIYTDARKAVENLFTDETSDEDEEYEEISNVAELPGITEDILTVLRNNEIEDIQDLINMEDDEIRALEGLTTEMADTLLDIIANAVEVVEDDGDESDEESEPVSDDEGEVEEFECPECGHKITTDMTKCPNCGVDLAFEYEDEE

SEQ ID NO: 64459 - DNA, 1755 bp, Mycoplasma mycoides subsp. mycoides SC str. PG1
  CDS (1)..(1755): transl_table=4
atgttaaacggaacagaattattagaatcaattaaattaatagaaaaagaaaaaggaattagcaaagaaagtattataaatggtcttaaagaaggtttacaaaaagcttatgaaagattttatgatactgatgcaattattaaaattgatattaatgaaaatacaggattaattactatgcatcaagaattaaaagtggttgatgatgaacaacttgatgacgattgattagagattacactatcaaaagcaaaattaaaaaatcctgatattcaaattgatgatactatttataaaccaattgaatttagtgaagaattttcaagaatggtagttaaccaagtaagacaaatttttcaacaaaagatcagagaggctgaaagagcaagaatttatgaacaatttgttagtttagaaggtgaagttgttcaagctaaaatagttggaatgaatagagaaaataattatgttttagatataaatggtacaactgcttatttatgaaaatcaaaaactattaataatgaaatttttcaaattaatgaaattattgatgtttatattgaagttgttgaaaaagaaagcaaattatctcaaatctcaatttcaagaactgcccctaattttttaactaaattaattgaaagagaagttccagaagtaagaatgggaattgttgaaatcaaagctgttagtcgtgaacctggaaaacgttcaaaagttgctgtaattactcataataataatgttgaaccaattggagctattattggagttggtggtaatagaattaatagaattagtgatattttaaaaggtgaaaaaatcgatattattagatgggatgaagatcaaatcacttatttaattaatgcaatgacaccagtgaaagtaatttctattaataaaattggtgatgaatatgatatagttgttccagatactcaattatcattagcaattggaaaacaaggagttgcagctaagctaattgctagtttattaaaaactaagattaatattttttcatattcaactgctttaaaagaaaatatggacattttatgaaatggtgatacaactaaacaagaagttgaaactaatacatacattccaaaaactaaaacaactaaaaaagaagaaaaaccagtaataacaactattaaaaaacctgtaaaacaaacaattaaaaaagaagaaaatcaaattgatgttgatgctttaattgcttttcaagctgaagttgaacatgaacaagaattaaaagatcaagaagagttattaaaacaagaatatatatataaagaatatgaaaataactttaatgattttgaaaatgaaaaagaaattgttttagctgaaaaacaattagaatctcaaaatcaaataataaaagaaccagttgttgaagttcaagaagttgaaattgaaaaacaatcaaaaactgaagatcaaataattgaaaataaacaaccagaaactagaactgaggttgaaactaaacctaatacagttgaacaagttaataaattaaatactaataagccaaataataaatttgaacaaaatagatttagttataaaaaacaaaaacaaaaagaagaagaactagagcttgattttgatattaaaaacgaaccagatattgatgaaattgatgcaaacttaaaagcatttaatgatgcaattttaaaacaagaagatgatgaagatcttgatatagatttagatgattatgacaaatattatgattaa

SEQ ID NO: 64460 - protein, 584 aa, Mycoplasma mycoides subsp. mycoides SC str. PG1
MLNGTELLESIKLIEKEKGISKESIINGLKEGLQKAYERFYDTDAIIKIDINENTGLITMHQELKVVDDEQLDDDWLEITLSKAKLKNPDIQIDDTIYKPIEFSEEFSRMVVNQVRQIFQQKIREAERARIYEQFVSLEGEVVQAKIVGMNRENNYVLDINGTTAYLWKSKTINNEIFQINEIIDVYIEVVEKESKLSQISISRTAPNFLTKLIEREVPEVRMGIVEIKAVSREPGKRSKVAVITHNNNVEPIGAIIGVGGNRINRISDILKGEKIDIIRWDEDQITYLINAMTPVKVISINKIGDEYDIVVPDTQLSLAIGKQGVAAKLIASLLKTKINIFSYSTALKENMDILWNGDTTKQEVETNTYIPKTKTTKKEEKPVITTIKKPVKQTIKKEENQIDVDALIAFQAEVEHEQELKDQEELLKQEYIYKEYENNFNDFENEKEIVLAEKQLESQNQIIKEPVVEVQEVEIEKQSKTEDQIIENKQPETRTEVETKPNTVEQVNKLNTNKPNNKFEQNRFSYKKQKQKEEELELDFDIKNEPDIDEIDANLKAFNDAILKQEDDEDLDIDLDDYDKYYD

SEQ ID NO: 64461 - DNA, 1275 bp, Parachlamydia sp. UWE25
  CDS (1)..(1275): transl_table=11
atgaacaaagatctgattgcaatctttgaatatttagaacgagaaaaaggcattaagcgagagcttgttatcagtgcgattgaagaatctttacaagcagcagctcgtaaaagcgtgagcggagcctccaatgtaacagtcactatccatccaaaaactgggaatattgatgtttattgtgaaaaggaaattgtggatgatgtagaagttccctctcaagaaatttctttactagcagcgcgtgaaattgacccagatgctgaaattggacagtttatcgacatcgttgtgactcccaaagattttggtcgaattgctgcgcaaaaagcccgtcaaattattacacaaaaacttcgcggggctgaaagagatgtaatttatgaagaatatcgccaccgaattaacgaactgatttcaggaacaattaagcgatttgttagaggttctaatttaattattgatcttggaaaagttgaagcgattttaccaacccgggaatatcctaaaactgaaaaatatcaagtgggtgaaaaagttctagcccttgttctcgaagttaaagatactgaaaatggtggcgctgaagtgattttatcacgtagccacccagagtttgtaaaacaacttttagtacaagaagttccggaggtaagtgatggaacaattattattgacaagattgttcgtgatgcaggttatcgcacgaaactaaccgttcgctcgactgatttgaaagttgatcctgtcggagcttgcgttggaatgaggggcaatcgcgtaaagaacattgtacgtgaacttcataacgaaaaaattgatattattcctttttcaaatgatcctattgaacttttgcaaaatgccctatctcccatagaaattcgaaagatcaatttaaatgaagaagatggtatcatttctattgttgtagaagacgatgattttgcagcagtcattggtaaaaaaggaatgaatgcgcgccttaatagtcgacttattggatatgacttagaggtacagcgtatgacagattataatcgtgccatggcaattgaaagaaacgaattggctgcaacagatgacccaactcttgatcaacccttggtaggtattgaaggaatcaacagtttaatctttgaccatctggttgatgctggttatcatacattaaaatctctgctaacggcaactcctaaagaattagccgcaataccaggcattagccttgaaatggcagataaaattttagaacaaataagaaaacaaaggacatag

SEQ ID NO: 64462 - protein, 424 aa, Parachlamydia sp. UWE25
MNKDLIAIFEYLEREKGIKRELVISAIEESLQAAARKSVSGASNVTVTIHPKTGNIDVYCEKEIVDDVEVPSQEISLLAAREIDPDAEIGQFIDIVVTPKDFGRIAAQKARQIITQKLRGAERDVIYEEYRHRINELISGTIKRFVRGSNLIIDLGKVEAILPTREYPKTEKYQVGEKVLALVLEVKDTENGGAEVILSRSHPEFVKQLLVQEVPEVSDGTIIIDKIVRDAGYRTKLTVRSTDLKVDPVGACVGMRGNRVKNIVRELHNEKIDIIPFSNDPIELLQNALSPIEIRKINLNEEDGIISIVVEDDDFAAVIGKKGMNARLNSRLIGYDLEVQRMTDYNRAMAIERNELAATDDPTLDQPLVGIEGINSLIFDHLVDAGYHTLKSLLTATPKELAAIPGISLEMADKILEQIRKQRT

SEQ ID NO: 64463 - DNA, 1287 bp, Desulfovibrio vulgaris subsp. vulgaris str. Hildenborough
  CDS (1)..(1287): transl_table=11
atgagcatggaactcaagaaagccatcgaccagataagcaaggacaagggcctcgaacgcgacatgctcgtcgcaacccttgaagaggccgtccgcacatcggtcgttcgcaagtatggcgacgacatcgacgtcgaggtctcgtacaacgacgaaagcggcgagatcgaagtctaccagttcaagatcgtcgtcgccgaactggatgacgaggacgaggacggcaacgcccacatcgtcctcgaagaagcccgcaagcacgaccccagcgtccagatcgacgacgagatgggcttccgcctcaaggtcgaggatctcggccgcatcgccgcccagtccgccaagcaggtcatcatccagcgcatgcgtgacgccgagcaggagctcatctacgacgagttcaaggaccggcgtggcgagatcatcagcggcatcatccagcgccgggacaaggccggctggatcatcaacctcgggcgtaccgaggccctgctccccaaagaggagcagatcccccgcgagcactacaagcgcggcgaccgggttcaggccatcatcatcgaggtacgcaaggaaggacgcgggccgcaggtcatcgtctcgcgctctcaccgcgactacatggcagcgctcttccgccgcgaggttcccgaggtcgacgacggtaccgtgcagatcatgggcgtggcccgcgaccccggcagccgtgccaaggtcgccgtgctctcgcgtgagcgtgacgtcgatcccgtgggcgcgtgtgtcggcattcgcggctcccgcatccagaacgtcgtgcaggagcttcgcggcgaacgcatcgacatcgtggtgtggagccctgaaatcgccacctacgcccgcaatgccctgtctcctgccgtcatttcgcgcatcgtggtcgatgaagaggagaatctcctcgaagtcatcgtgcctgacgaccagctcaccaacgccatcgggcgcaaggggcagaacgtcaagctggccgcgaagctgctgggctggaagatagatatctatacggaaacccggtacaatgaggccaacgccatcgggcgcggcctcgagcagatcgccagcgttgccgaaatctccatcgagcaattcgtcacggcgggtttccagtccattgaacgtttgcgggaagcctccgacgaggaactcgccagcgggctcggcatcgatgacaatcgcatcgccgacctgcgtgctgctatcaacttcctcagccctgcgccttccgcctcagacggggacgacgcagacggggagacggaataa

SEQ ID NO: 64464 - protein, 428 aa, Desulfovibrio vulgaris subsp. vulgaris str. Hildenborough
MSMELKKAIDQISKDKGLERDMLVATLEEAVRTSVVRKYGDDIDVEVSYNDESGEIEVYQFKIVVAELDDEDEDGNAHIVLEEARKHDPSVQIDDEMGFRLKVEDLGRIAAQSAKQVIIQRMRDAEQELIYDEFKDRRGEIISGIIQRRDKAGWIINLGRTEALLPKEEQIPREHYKRGDRVQAIIIEVRKEGRGPQVIVSRSHRDYMAALFRREVPEVDDGTVQIMGVARDPGSRAKVAVLSRERDVDPVGACVGIRGSRIQNVVQELRGERIDIVVWSPEIATYARNALSPAVISRIVVDEEENLLEVIVPDDQLTNAIGRKGQNVKLAAKLLGWKIDIYTETRYNEANAIGRGLEQIASVAEISIEQFVTAGFQSIERLREASDEELASGLGIDDNRIADLRAAINFLSPAPSASDGDDADGETE

SEQ ID NO: 64465 - DNA, 1587 bp, Bartonella henselae str. Houston-1
  CDS (1)..(1587): transl_table=11
atggctacaagcgctaacaggcttgaaattctgcaaattgcagatgctgttgcacgtgaaaagtcgattgaccgtgaaattgtcatttctgcgatggccgatgctattcagaaagcggcgcgttctcgttatggtcaagaaaccaacatccgtgctgagatcaattcaaaaacaggtgaaattaaattacagcgtctccttaaaattgttgatatcattgaagactatacaagtgaaattactttatctgatgcactcaaacgtcaagcggatgctaaagtgggtgattttttcgccgatcttttaccccccatggattttggacgcatcgctgcgcaatctgctaaacaagttattgtacaaaaagtacgcgatgcagagcgtgaacaacaatatgaagaatttaaaaataaaattggtgaaattatttccggtacggtaaaacgtgtcgaatatggcaatgttatcgttgatctaggacgcggtgaagctattgtgcgtcgtgatgaattaattccacgtgaatctttccgctatggagatcgtattcgcgcctttgttcacgatgtgcatcgcgaaccacgcggtccgcaaattttcctttcacgcacacatccccagtttatggtaaaactttttaccatggaagtgccagaaatttatgatggtattatagaaatcaaatccgttgcccgcgatccaggttcacgtgctaaaattgcggttgtctcacgcgatggctcgattgatcccgttggagcatgcgttggaatgcgaggaagtcgtgtacaagctgttgttgcagaattacaaggcgaaaaaattgatattattccttggtcacctgatgctgcaacatttatcgtcaatgcactacaacccgccgaagtttctaaagtcgtcctcgatgaagatgctgaacgtattgaagttattgtgcctgatgaccagcttagccttgctattggtcggcgtggacaaaatgtccgtttagcttcccaactaacaggatggaatattgatatcttaacggagcaagaagaatctgaaaaccgtcaaaaagaatttactgaacgcagcaaactgtttatggaatctttagatgtcgacgaaatgatcgggcaggttatggcatcagaaggcttttcttccattgaggaaatcgcttatattgatcttgaagaaatcgcttctattgatggttttgatcatgaaactgctgctgaaatccaaaaccgtgcacaggaatatttagaacgcaaagaaaaagaacttgatgaaaaacgtaaaaaactcggtgtttgtgatgaactgcgaatgcttcctggaatgacaagtgctatgttggttgctattggtgaagatggtgtcaaaacaatggaagattttgcaggctatgcagtcgatgatttggctggctggagagaacgtaaggaaggtcaaacacagaatttttctggtatcctgactccattcgatattacacgcgctgatgctgaagctatggttttagctgcacgtgtgcaagcaggctggataaatcaagctgaccttgttacagaaaattctgcagaaaatgaaaaataa

SEQ ID NO: 64466 - protein, 528 aa, Bartonella henselae str. Houston-1
MATSANRLEILQIADAVAREKSIDREIVISAMADAIQKAARSRYGQETNIRAEINSKTGEIKLQRLLKIVDIIEDYTSEITLSDALKRQADAKVGDFFADLLPPMDFGRIAAQSAKQVIVQKVRDAEREQQYEEFKNKIGEIISGTVKRVEYGNVIVDLGRGEAIVRRDELIPRESFRYGDRIRAFVHDVHREPRGPQIFLSRTHPQFMVKLFTMEVPEIYDGIIEIKSVARDPGSRAKIAVVSRDGSIDPVGACVGMRGSRVQAVVAELQGEKIDIIPWSPDAATFIVNALQPAEVSKVVLDEDAERIEVIVPDDQLSLAIGRRGQNVRLASQLTGWNIDILTEQEESENRQKEFTERSKLFMESLDVDEMIGQVMASEGFSSIEEIAYIDLEEIASIDGFDHETAAEIQNRAQEYLERKEKELDEKRKKLGVCDELRMLPGMTSAMLVAIGEDGVKTMEDFAGYAVDDLAGWRERKEGQTQNFSGILTPFDITRADAEAMVLAARVQAGWINQADLVTENSAENEK

SEQ ID NO: 64467 - DNA, 1485 bp, Acinetobacter sp. ADP1
  CDS (1)..(1485): transl_table=11
atgagccgtgaaattcttaccgttgtagaaacggttagtaatgaaaaaggtgttagtcgtgaagcgatcttcgaagcgctggaacaagctcttgttgcggcaacgaagaaaaaattctacgaaggcacaaatgcagaagaagcacaattacgtgtagaaattgaccgcaaaacaggtgattaccgcacgttccgtcagtggacacttgttgcggatgaagatcatgaaatgccagcatgccaagacgcgatttctgatgttgatgcatcaaaatggtcaattggtgatgtgcgtgagcttgaagtagagtcgatcgaatttggtcgtattgcagcacaaattgccaagcaagtgattgtacagaaaattcgtgaagcagaacgcgcattaattgccgatgcttacgaatcaaaagtgggtgagctgatttacggtgaagtgaaaaagcaaaccaaagatggtttcatcattgatcttggtgacaatgcggaagcgtatctggcacgtgaagagatgattgcaaaagaaattttgcgtccaaaacaacgtatgaatgcaattttatacagtgtcaatcgtgaaggtcgtggtgcgcaattgttattgtcgcgcgcgcgtcctgaaatgttaatggcattgatgaagaaagaaattccagaaatttctgaagaaatcattgagatcaaggctgctgcgcgtcaaccaggtgtgcgtgccaaaattgcggtgaaaaccaacgatcatcgtatcgatccagtcggtgcgtgtattggtatgcgtggtacacgtattcaagcagttcagcaagaactcaatggtgagcgtattgatgtggtggtgtggtcagatgatccagcacagtatatcgcaagcgcacttgaacctgcggatgtgtcgggaattgtacttgatgaagatacacgcagtgctgacattatttttgctaccaatgatcagctagctcgcgctattggatcacaaggtcaaaatgttcgtcttgcttcagaattaactggctataaactcgacatgatgcttgaagaagagtatcgtgctcgtcagcaaaatgaagcgcagcaatatctggatatgtttgtaacacgtctggatattgaagaagatctcgcaatggcactggttgaaatgggctttacttcacttgaagaaattgcttatgtgccaccagaaacatttgacgaaatcgaacttgatcaggaactggttgagttattgcaaagtcgtgcaaaagaagcagcattaacagatgcattaaaacagcaagaaaatgttcaggaaccaagtgttgagctccttgcaatggcaggaatgacacaagaactggcatatgctcttgcagcacgtggtgtcgtgacagttgatgacttggctgatcaggctactgatgatatttctgatatcgaagggcttagtgaagagaaagcgggtcaactgatcatgaaagcacgcgaatcatggtttaattag

SEQ ID NO: 64468 - protein, 494 aa, Acinetobacter sp. ADP1
MSREILTVVETVSNEKGVSREAIFEALEQALVAATKKKFYEGTNAEEAQLRVEIDRKTGDYRTFRQWTLVADEDHEMPACQDAISDVDASKWSIGDVRELEVESIEFGRIAAQIAKQVIVQKIREAERALIADAYESKVGELIYGEVKKQTKDGFIIDLGDNAEAYLAREEMIAKEILRPKQRMNAILYSVNREGRGAQLLLSRARPEMLMALMKKEIPEISEEIIEIKAAARQPGVRAKIAVKTNDHRIDPVGACIGMRGTRIQAVQQELNGERIDVVVWSDDPAQYIASALEPADVSGIVLDEDTRSADIIFATNDQLARAIGSQGQNVRLASELTGYKLDMMLEEEYRARQQNEAQQYLDMFVTRLDIEEDLAMALVEMGFTSLEEIAYVPPETFDEIELDQELVELLQSRAKEAALTDALKQQENVQEPSVELLAMAGMTQELAYALAARGVVTVDDLADQATDDISDIEGLSEEKAGQLIMKARESWFN

SEQ ID NO: 64469 - DNA, 1530 bp, Erwinia carotovora subsp. atroseptica SCRI1043
  CDS (1)..(1530)
atgaacaaagagattctggctgttgttgaagcagtttccaatgagaaatcccttccgcgcgagaagatttttgaagcgttggaaaccgcactggcgacagcgaccaagaaaaaatacgagcaggaaattgatgtacgcgtcagtattgatcgcaaaacgggcgattttgataccttccgtcgttggttagtggtgaatgaagtcactctgccaactcgcgaaattacgcttgatgctgcgcaatttgaagatccttctcttgatgttggcggttacgttgaagatcaaatcgaatccgtaacctttgaccgtattacgacgcaaacagcaaaacaggttatcgtacagaaagttcgtgaagctgaacgtgcgatggttgttgatcagttccgtcaacaagaaggcgaaattatcaccggtgtcgtgaagaaggtaaaccgtgataatatttcgcttgaagtcagaccaatcgatggttctaacaccagtgcagaagcggtaattggccgtgaagatatgctgcctcgtgaaaatttccgccctggcgaccgtattcgtggcgtactgtactctgttcgtcccgaagctcgcggtgctcaactgtttgtcagccgttcccgtccggaaatgctggttgaactcttccgcattgaagtgccagaaatcggtgaagaaattatcgagattaaggcagcggcccgcgatccgggttcacgtgcgaaaattgcagtgaagacgaatgacaagcgtatcgatcctgtcggtgcttgtgtcggtatgcgcggtgcgcgtgtacaggccgtttccagtgaactgggcggcgagcgtattgatgtcattctgtgggatgacaacccagcacagtttgtgatcaatgcaatggcacctgctgatgtggtatcgatcgtcgttgatgaagatacctacacgatggatatcgctgttgagtcgagcaatctggctcaggcgattggtcgaaacgggcagaacgtacgtctggcttcccaactgttgaaacagcatcgttcagaagatcgttgggaactgaacgtgatgacagtggaagatcttcaagccaagcatcaggccgaagcacatgctgcaatcgacgtctttaccaagcaccttgatattgatgaagagtttgcgactgtgctggttgaagaaggtttctcttcacttgaagaattggcctacgtgccaatcaaggaactgttggctatcgaaggctttgatgaagaaaccgttgaagcattgcgtgaacgtgctaaagctgcattaacaacgctggcactggcgcatgaagaaagccttggtgacggtcaacctgctgaagacttgcttagcttgcctgggctgtcgcgtgagttggcgttcaagcttgctgcgatcggtgtttgtacgctggaagatcttgctgaacagggcgttgacgacctgacagatattgaagagctcaatgatgagcaagcgggcgaattgattatggccgcacgtaatatctgttggtttggcgacgacaacgaataa

SEQ ID NO: 64470 - protein, 509 aa, Erwinia carotovora subsp. atroseptica SCRI1043
MNKEILAVVEAVSNEKSLPREKIFEALETALATATKKKYEQEIDVRVSIDRKTGDFDTFRRWLVVNEVTLPTREITLDAAQFEDPSLDVGGYVEDQIESVTFDRITTQTAKQVIVQKVREAERAMVVDQFRQQEGEIITGVVKKVNRDNISLEVRPIDGSNTSAEAVIGREDMLPRENFRPGDRIRGVLYSVRPEARGAQLFVSRSRPEMLVELFRIEVPEIGEEIIEIKAAARDPGSRAKIAVKTNDKRIDPVGACVGMRGARVQAVSSELGGERIDVILWDDNPAQFVINAMAPADVVSIVVDEDTYTMDIAVESSNLAQAIGRNGQNVRLASQLLKQHRSEDRWELNVMTVEDLQAKHQAEAHAAIDVFTKHLDIDEEFATVLVEEGFSSLEELAYVPIKELLAIEGFDEETVEALRERAKAALTTLALAHEESLGDGQPAEDLLSLPGLSRELAFKLAAIGVCTLEDLAEQGVDDLTDIEELNDEQAGELIMAARNICWFGDDNE

SEQ ID NO: 64471 - DNA, 1416 bp, Mesoplasma florum L1
  CDS (1)..(1416): transl_table=4
atggtaaacggagcacaaatattagaagcattagcttcattagaaagtgaaaaaagcattagcaaagaagttgctattgaaggaattaaagaaggattccaaaaggcttatgaaagattttttgatacagaagctgtagttaaaactgaaattaatgaacaaacaggatcaatcaacttgtttcaagaattaatggtagtagcaacagatgatgaaatcgaagatgattgattagaaattgttttagaagatgctttaaaaatcaataaagaagcaaaagttggagataaagtatacaaaccaattgattttgatgaagaattctcaagagtagctgttggacaagtaagacaaatcttccaacaaaaaattagagctactgaaagagctatgatttatgaaaaatttattcaattagaaggtgaaattgttagaggtaaaatcgttggaatgaacgatcaaggaacttcatacattttagatattgatggagtacatacttcattatgaaaccaaaaaacaatcaacagagaagaatttgttgttaacgaattagttgatgttttattagaagaagttgctagagaaaataaatactcacaattagttgtttcaagagtagcacctaaatttttagctaaattagttgaaaaagaagtaagtgaagttgctcaaggattagttgaagtaatgtcagtttcaagagaaccaggtaaacgtgcaaaaattgctgttttatcacatgatgaagatgtagaaccaattggagctattgttggagttaaaggttcaagaatcaataacatttcaaaagaattaagaggagaaaaaattgatgttgttaaatgagatgatgaaatcattccatttattattaacgcaatggcacctgttaaggttatttctgtaaatgaagttgaaggtgaatttgatatagtagttcctaatcaacaattatcattagctattggtaaaggtggaatggctgctaaattagttgctaacttattaaaacgtcgtattaacatttacagcttagaaaatgctattactgacaacatggatgttttatgaaatggaaacattacagaagaagaagtaaacaacccagactttattaacgaagtaaacaaacgtaaaatcaactctcaaacagttaaaccagaataccacaaaaattcatttagaaatgcacaagcaaataatgaagaagaattaatgagtttccaagctgaagttgaggaagaatacaaccaagttgaagaattaattgaagaaacaaatgcagttgttcaagaaaataaagatttagagtcaattcaatctgaactagaatcatttaatgatattttaaatgatgaagatgaagaagattttgaagaagacgaatacgaagatttatatgatcaagaataa

SEQ ID NO: 64472 - protein, 471 aa, Mesoplasma florum L1
MVNGAQILEALASLESEKSISKEVAIEGIKEGFQKAYERFFDTEAVVKTEINEQTGSINLFQELMVVATDDEIEDDWLEIVLEDALKINKEAKVGDKVYKPIDFDEEFSRVAVGQVRQIFQQKIRATERAMIYEKFIQLEGEIVRGKIVGMNDQGTSYILDIDGVHTSLWNQKTINREEFVVNELVDVLLEEVARENKYSQLVVSRVAPKFLAKLVEKEVSEVAQGLVEVMSVSREPGKRAKIAVLSHDEDVEPIGAIVGVKGSRINNISKELRGEKIDVVKWDDEIIPFIINAMAPVKVISVNEVEGEFDIVVPNQQLSLAIGKGGMAAKLVANLLKRRINIYSLENAITDNMDVLWNGNITEEEVNNPDFINEVNKRKINSQTVKPEYHKNSFRNAQANNEEELMSFQAEVEEEYNQVEELIEETNAVVQENKDLESIQSELESFNDILNDEDEEDFEEDEYEDLYDQE

SEQ ID NO: 64473 - DNA, 972 bp, Propionibacterium acnes KPA171202
  CDS (1)..(972): transl_table=11
atggacatcgacctgtcaactctgcgcatgatcgagcgggacaaggacatcccgcttgactatctgctgacgaccctagaggacgccctcctcaacgcatatgacaagactgaggctccggttaacggtgccaaggttcagctggaccgcaagactgggaatgtcgctgtcatgctcccggagaaggacgaggaggggcaggtcgtcggctggtatgacggcactcccgaggacttcggacgcgtagctgcatcaactgcccggcaggtcattttccaacggctgcgcgaggccgaggacgagcagaaatacggtcatttttccgccgttgagggtgacgtcatcaccggagtcgtccagcagtcttaccgcgatacccggaccgttcgcgtcgacctgggctcattggagggcattatgcctccggcggaacaggttcccggggagaaatattcccatgggcgtcgtatccgtgtgtacgtcgtggccgtgcgcaaggaagcccgtggcccgcaggtcattgtctcgcgcactcacccgaacttggtgcgcaagctttttgctatggaggtacccgagatcgagcagggggtcgtcgagatcaaggcgctggctcgtgaggccggtcaccgctcgaagattgctgtcgtctcgcataatcctgacgtttctgccaagggagcttgcattggtccgatgggtcagcgggtacgtgctgtgatgcacgagttggatgaggaaaagatcgacattattgattggtcagaggatccggccgaatttgtgggcgctgccctgtctccgtccaaggtgtcctcggtgacggtcattgacccgaaagctaagaccgctcgggcgattgttccggattatcagctgtcgctagcaattggccgcgaggggcagaacgcccgactggctgctcgcctgacggggtggcggatcgatattcgtccagataacaaggtctga

SEQ ID NO: 64474 - protein, 323 aa, Propionibacterium acnes KPA171202
MDIDLSTLRMIERDKDIPLDYLLTTLEDALLNAYDKTEAPVNGAKVQLDRKTGNVAVMLPEKDEEGQVVGWYDGTPEDFGRVAASTARQVIFQRLREAEDEQKYGHFSAVEGDVITGVVQQSYRDTRTVRVDLGSLEGIMPPAEQVPGEKYSHGRRIRVYVVAVRKEARGPQVIVSRTHPNLVRKLFAMEVPEIEQGVVEIKALAREAGHRSKIAVVSHNPDVSAKGACIGPMGQRVRAVMHELDEEKIDIIDWSEDPAEFVGAALSPSKVSSVTVIDPKAKTARAIVPDYQLSLAIGREGQNARLAARLTGWRIDIRPDNKV

SEQ ID NO: 64475 - DNA, 999 bp, Leifsonia xyli subsp. xyli str. CTCB07
  CDS (1)..(999): transl_table=11
atggacatcgacctcagcgtcttgcgtctcatggagcgcgagagggagatcccgttcgaggaactggtgcagatcatcgagcaggccatcctgaccgcctatctgaagcacaccgaccaggccgatcaccgccacggcgagccgcctgccgcgcgggtgcatctggaccgcaagacgggtcatgtcaccgtctacgtccccgagagggacgacgacggcaacgtcatcggcgaggccgaggacagcccgagcgacttcggccgcatcgccgcgttcgcggcgaagcaggtgatcaaccagcggctgcgcgacctcgcggacgacgcggtgctcggcgagttccgcggatgcgagggcgacatcgtcgccggggtgatccagcagggccccaatccgcggatggtgcatatcgacctcggcagcgtggaggccattctgcctccggaggagcaagtacacggcgaagagtacccgcacggctcccgtatccgcgtgtacgtcacgagtgtcgccaagggtccgaagggtccgtcgatcaccgtctcgcgcacgcatccgacgctggtcaggaagctgttcgccctcgaggtgccagagatcgcgagcggcgtggtggagatcgtgtcgatcgcccgcgaggccgggcaccgcaccaagatcgccgtccgggcgacggagcccggtgtgaacgccaaaggcgcgtgcatcggggagctcgggcagcgcgttcgcgcggtcacggccgaactcaacagcgaaaagatcgacatcgtcgactattcgcccgatctcgcgaccttcgtctcgagcgccctctcgccggcgaaggtgaccagtgcgttcgtgatcgacgaaagcctcaaggccgtgcgtgcgctggtgccggactaccagctgtcgctcgcgatcggcaaagaaggccagaacgcccgcctcgccgccaagctgacgggcgcgaagatcgacatccagccggattcgatcctggaccgcgagtag

SEQ ID NO: 64476 - protein, 332 aa, Leifsonia xyli subsp. xyli str. CTCB07
MDIDLSVLRLMEREREIPFEELVQIIEQAILTAYLKHTDQADHRHGEPPAARVHLDRKTGHVTVYVPERDDDGNVIGEAEDSPSDFGRIAAFAAKQVINQRLRDLADDAVLGEFRGCEGDIVAGVIQQGPNPRMVHIDLGSVEAILPPEEQVHGEEYPHGSRIRVYVTSVAKGPKGPSITVSRTHPTLVRKLFALEVPEIASGVVEIVSIAREAGHRTKIAVRATEPGVNAKGACIGELGQRVRAVTAELNSEKIDIVDYSPDLATFVSSALSPAKVTSAFVIDESLKAVRALVPDYQLSLAIGKEGQNARLAAKLTGAKIDIQPDSILDRE

SEQ ID NO: 64477 - DNA, 1401 bp, Desulfotalea psychrophila LSv54
  CDS (1)..(1401): transl_table=11
atgctgtcggatttaaaacgcataattgaccaaattagtagagatcgtggaattgataagggaatattggtcagcgctatagaagaagctgttgagtctgctgctaaaaagaaatttggtagccgtcgtgacatagaagttcgctataatgaagagtatggcgaggttgatgtctttcaatttagaaccgtggttgaagaaatagaggatgagcagacagagattgctcttgaagacgctcggattcttgatccagccgttcagttgggagatgatcttggcgaaaaaatgtccaatatcactgatcttggtcgtatcgctgctcaatcggcaaaacaggttattattaaccgcatgaaagatgccgaacgagatgttatttatgacatgtataaggatcgtgttggcgaggttgtcagtggtatcgttcagcgttttgaacgcggcaatatggttgttaacctgggtcgcaccgatgctattttgccaaaagaacatcagattcctaagcgaacctttaagcagggtgatcgtattcgtgcttatctgcttgaggtccgtcagaccagtcgcgattgtcagctgattctttctcgtacatgtgatgagttcttagaaaaactctttcagatggaagtacctgagatgagtgagggcattgttcgtgttctgggtgtgagtcgtgagcctggttttcgggcaaaaattgcggtgagctcttcggaaagtgatgtcgatccagtaggtgcctgtgttggtatgaagggttctcgtgtgcagaatgttgtacaggaattgcagggagaacgtattgatattgttacttggagtccagatattgccaagtatgtttacaatgccttagcgccagcgcatgtaagtatggtacgtaatgacgaagagagaaactcattgcttgttgttgtgccaaatgaccaactttctttggccatcggtagacagggccagaatgtacgtttagcctcaaggttgcttggttgtcgtattgatgtaaagagcgagcaacgctatgctaatttgcaggatcctggataccaaagtttacttaaaattcacggtatagatgaaggtcttgccgatcagctctgggcaagaggtattgtttcaacggctgttcttgcgcagactgagattgctgatcttaccgttttacgagctataaatgaggagtttgcggccgctcttgttaaggatgcgcaggcaaatccatttgtagcagaggaaacagagataagttctgtagaggcgagtgaggctgagaatataaatgctgatactgtagatgctgaatcttctgaagaggctgttgtggttgaagagatcacagataatgctgaagcaggacaggatccagaagaaccaacaactcagcaacaatag

SEQ ID NO: 64478 - protein, 466 aa, Desulfotalea psychrophila LSv54
MLSDLKRIIDQISRDRGIDKGILVSAIEEAVESAAKKKFGSRRDIEVRYNEEYGEVDVFQFRTVVEEIEDEQTEIALEDARILDPAVQLGDDLGEKMSNITDLGRIAAQSAKQVIINRMKDAERDVIYDMYKDRVGEVVSGIVQRFERGNMVVNLGRTDAILPKEHQIPKRTFKQGDRIRAYLLEVRQTSRDCQLILSRTCDEFLEKLFQMEVPEMSEGIVRVLGVSREPGFRAKIAVSSSESDVDPVGACVGMKGSRVQNVVQELQGERIDIVTWSPDIAKYVYNALAPAHVSMVRNDEERNSLLVVVPNDQLSLAIGRQGQNVRLASRLLGCRIDVKSEQRYANLQDPGYQSLLKIHGIDEGLADQLWARGIVSTAVLAQTEIADLTVLRAINEEFAAALVKDAQANPFVAEETEISSVEASEAENINADTVDAESSEEAVVVEEITDNAEAGQDPEEPTTQQQ

SEQ ID NO: 64479 - DNA, 1449 bp, Borrelia garinii PBi
  CDS (1)..(1449): transl_table=11
atgataaagggcacgggacatatgattgtaagtattgcaaatgatcgcagtatgagtatagagtctattagaaaaacaattaaagaatcagttttgatagcttataaaaagtactttggaagcaatgagaatgcttttgttaagtttgatgataatacgggagatttagttgtttatgcaaaaaagaaaattgtagaagaggtgaaagattctttacttgaaatattagaaaaagatatctcaaaggaaaatattgtagaaggtgattatgcttatattgaaattaatcccaaggtttttgataggctttctattcaggttgcaaaacaaagaaccaaaaatgatttgcaaggaattgaggataatgagattttatcagaatttaaaagtaagttaaataaggttgttattggatatgttcaacaaaatagaaatggcgatctttatgtcaatcttggcaatacggatggcataatacctaagaagtatcagtcgccaagagaggtttatagccttaatgataagattagagttttggtttataatgtcaaaaagggtaaaaatggtattgaagttattctttctaggactcatccaaagtttattgaagagcttttagcacttgaaattcctgaaattgaagaaggtattattaaaattcataaaatagttcgtgatccggggtacagaattaaagttgctgtttattctgaaaaagaagagattgatcctgttggtccttgtataggacaaaaaggagttagaattcaatctataattaaggaacttgaaggagaaaaaattgatattatcccttacagtaaagacattaaagaattcataaaggattctttgactcctgctaaaatagatcatgtctatattcttgacgaggatttacataaggctttagtagttgttagcgatgatcaactttcccttgctataggtaaaatggggcaaaatgtcagacttgctaatagacttcttgactgggctattgatgttaaaactagcagtcaatttgcagaaatgaaagctaattcggagtttaagcaagaaacactcgaaatgtttgataaagttatgcaagatgttgttgaagaggaacaatttgaggatatcagcaaaataagtgatcttaaattacttgattcttctgtgatttctaatttatcaaaagagggacttgatgatattaacaattttttacaggcagatgaggaagtgctttttaatcttggagtaagctatgaaaagcaagaagaaattaacaaaatattaaaagagggaatgataataattgctaatgaaaatgatgagtctatggaaaaggtagaagaagatcaagaacttctttgtcctgaatgtggcgttgttattaatgaaaatatgacctcctgtccggggtgtaaaatagggcttagctttgagtttgaggaggagtaa

SEQ ID NO: 64480 - protein, 482 aa, Borrelia garinii PBi
MIKGTGHMIVSIANDRSMSIESIRKTIKESVLIAYKKYFGSNENAFVKFDDNTGDLVVYAKKKIVEEVKDSLLEILEKDISKENIVEGDYAYIEINPKVFDRLSIQVAKQRTKNDLQGIEDNEILSEFKSKLNKVVIGYVQQNRNGDLYVNLGNTDGIIPKKYQSPREVYSLNDKIRVLVYNVKKGKNGIEVILSRTHPKFIEELLALEIPEIEEGIIKIHKIVRDPGYRIKVAVYSEKEEIDPVGPCIGQKGVRIQSIIKELEGEKIDIIPYSKDIKEFIKDSLTPAKIDHVYILDEDLHKALVVVSDDQLSLAIGKMGQNVRLANRLLDWAIDVKTSSQFAEMKANSEFKQETLEMFDKVMQDVVEEEQFEDISKISDLKLLDSSVISNLSKEGLDDINNFLQADEEVLFNLGVSYEKQEEINKILKEGMIIIANENDESMEKVEEDQELLCPECGVVINENMTSCPGCKIGLSFEFEEE

SEQ ID NO: 64481 - DNA, 1083 bp, Symbiobacterium thermophilum IAM 14863
  CDS (1)..(1083): transl_table=11
atgaaagccgagattctcgaggcgctggatgacctggtgcgtgagagaggcatctcgcgggaggtcctgatcgaggcgatcgaggcggccctgatctccgcctatcgccgcaatttcggctcggcgcagaacgtgcgggtcttcttcgacgacaagaccggcgagtaccgggtctacgcgcagaaggagatcgtggaagaggtgaccgacccgcggctgcaggtcagtctcgaggaggctcggatgaagaacccgagcttgcagttgggcgacgtctttgaagtcgaggtcaccccccgggatttcggccgcattgccgcgcagaccgccaaacaggtggtggtccagcgcatccgtgaagccgagcgcgggatgatctacgaggagtactccagccgggagggcgagatcgtcaccggtctggtccagcgccaggaccccaagacccggacggtctacctggagctcgcacggggcgtggaggccgtgctcacggccaacgagcagatccccggcgagcgctacgtggagaaccagcgcatcaaggcctacgtgatcgaggtcaagcggaccacgaaggggccggcgatcgcggtgtcccggacccacccgggcctgctgaagcggctgttcgagctggaggtgcccgagatccacgacggcacggtcgagatcaaggggatcgcccgggaggccggctcccggtccaagatcgcggtgatggcccgggatcccaacgttgaccccgtgggcgcctgcgtgggccagaagggccagcgggtgcagaacatcgtcgatgagctgcagggcgagaagatcgatgtggtggagtggtccccggatcccgaggtcttcgtggccaaggcgctctccccggccaaggtcacgcaagtcgtatgcgacgaggagagccgcatcgcccgcgtgatcgtgccggactaccagctgtcgctggccatcggcaaggaggggcagaacgcccgcctggcggccaagctgaccggctggaagatcgacatcaagtccgagtcgcaggcggaagccggcgcctgggacgagctcagcgaggacgacatcgggtag

SEQ ID NO: 64482 - protein, 360 aa, Symbiobacterium thermophilum IAM 14863
MKAEILEALDDLVRERGISREVLIEAIEAALISAYRRNFGSAQNVRVFFDDKTGEYRVYAQKEIVEEVTDPRLQVSLEEARMKNPSLQLGDVFEVEVTPRDFGRIAAQTAKQVVVQRIREAERGMIYEEYSSREGEIVTGLVQRQDPKTRTVYLELARGVEAVLTANEQIPGERYVENQRIKAYVIEVKRTTKGPAIAVSRTHPGLLKRLFELEVPEIHDGTVEIKGIAREAGSRSKIAVMARDPNVDPVGACVGQKGQRVQNIVDELQGEKIDVVEWSPDPEVFVAKALSPAKVTQVVCDEESRIARVIVPDYQLSLAIGKEGQNARLAAKLTGWKIDIKSESQAEAGAWDELSEDDIG

SEQ ID NO: 64483 - DNA, 1506 bp, Mannheimia succiniciproducens MBEL55E
  CDS (1)..(1506): transl_table=11
gtgagcaaagagattttattagctgcggaagcagtatcaaatgaaaaattattaccgcgtgagaagatttttgaagcgttagaaagtgcgattgccctttcaacaaagaaaaaatacgaacaggaaattgatgttcgcgttgcgattaaccaaaaaaccggtgagtttgacactttccgtcgctggttggtggttgatgaagtggttaacccgacaaaagaaattactttagaagcggcgcaattcgaagatcctgacattcagttaggcgattatgtggaagatcaaatcgattccgtagcctttgaccgtattaccatgcaaaccgcccgtcaggtaatcagtactaaaattcgtgaagcggaacgcaacaaagtagttgaacaattccgttccgaagaaggaaaaatcgtaacaggtacggtaaaaaaagttacccgcgattcaattattctggacttaaccggtaacaaagaagatccggcgaaggcggaagcggttattacccgcgaagatatgttgcctcgtgaaaacttccgtccgggcgatcgcgtacgcggtgtgctttataaagttaatccggaaagtaaaggtgcgcaattgtttgtaacccgcgcaaaaccggtaatgcttgaagagttgttccgtttggaagtaccggaaatcggtgaagaattaatcgaaattaaaggcgcttctcgcgatgcgggattgcgtgcaaaaattgcggttaaaagtaatgacaaacgtattgacccggttggcgcttgcgtcggtatgcgcggttcacgcgttcaggctatcaccaatgaattaggcggtgagcgtgtggatatcgtactttgggatgataatccggctcaattcgtgattaacgccatggcacctgcggatgtaaattcaattgtggttgatgaagataatcactcgatggatattgccgttgaacaggaaaatttagcacaagctattggtcgtaacggtcaaaacgtgcgtttagcgacccagttaaccggctggacgttaaatgtgatgactacggaagaattgcagcaaaaacatcaggcggaagataataaggtattaaatttattcatgacttctcttgagcttgatgaagactttgcacagcttctcattgatgaagggttctcaagccttgaagaattagcttatgtgccggtaagcgaattaacggcaattgacggtcttgaagacgaagatttggttgaagagttgcaaaaccgtgcgaaagatgcgttaaccgctaaagcggtggcggaagaagaagcgttaaaacaagccgaggttgaagacagattattaaatctcgaaggtatggaacgtcatattgcattcagattagctgagaaaaatattaaaactcttgaggagttagccgaacaaggtgttgatgatttagcggatattgaagagttaagtgcagaaaaagcggcggatttaattatggcggctcgtaatatctgttggtttggtgatgaataa

SEQ ID NO: 64484 - protein, 501 aa, Mannheimia succiniciproducens MBEL55E
MSKEILLAAEAVSNEKLLPREKIFEALESAIALSTKKKYEQEIDVRVAINQKTGEFDTFRRWLVVDEVVNPTKEITLEAAQFEDPDIQLGDYVEDQIDSVAFDRITMQTARQVISTKIREAERNKVVEQFRSEEGKIVTGTVKKVTRDSIILDLTGNKEDPAKAEAVITREDMLPRENFRPGDRVRGVLYKVNPESKGAQLFVTRAKPVMLEELFRLEVPEIGEELIEIKGASRDAGLRAKIAVKSNDKRIDPVGACVGMRGSRVQAITNELGGERVDIVLWDDNPAQFVINAMAPADVNSIVVDEDNHSMDIAVEQENLAQAIGRNGQNVRLATQLTGWTLNVMTTEELQQKHQAEDNKVLNLFMTSLELDEDFAQLLIDEGFSSLEELAYVPVSELTAIDGLEDEDLVEELQNRAKDALTAKAVAEEEALKQAEVEDRLLNLEGMERHIAFRLAEKNIKTLEELAEQGVDDLADIEELSAEKAADLIMAARNICWFGDE

SEQ ID NO: 64485 - DNA, 1263 bp, Bacteroides fragilis YCH46
  CDS (1)..(1263): transl_table=11
atggccaagaaagaagaaacaatcagcttgattgatacattttcggaatttaaggaactgaagaatatcgatagaaccacgatggtaagcgtgctcgaagagtcgttccgcagtgtgatcgcgaaaatgtttggcactgatgaaaattacgacgtaattgtgaatccggataagggtgactttgaaatatggcgtaaccgtgaggtagtggcagacgaggatttgactaacccgaatatgcaaatttcgttgactgaagcacaaaaaatcgatgcttcttacgaagtgggtgaagaagtaaccgatgaagtgattttcgctaagttcggtcgccgtgctattttgaatcttcgtcagacactggcttctaaaattcttgagcttgaaaaggacagtatttataataaatacattgataaagtaggtactatcatcaacgcagaagtataccagatctggaaaaaagagatgttgttgcttgacgatgaaggaaacgagttattgttgccgaaaacagagcagataccaagcgatttttatcgtaaaggagaaactgcccgtgcagtggtggcacgcgtggacaacaaaaacaacaatccgaaaattatcctctcgcgtacttctccggttttcctgcagcgcttgttcgagatggaagtgcctgaaataaacgatggcctgattaccatcaaaaagattgcccgtattcccggtgaacgtgccaagattgcggtagaatcttatgatgacagaattgaccctgtaggagcctgcgtaggtgtaaagggaagtcgtattcatggcatcgtacgtgaacttcgcaatgaaaacattgatgtgattaattatacatctaatatttcattgtttatccagcgtgctttaagcccggctaagatttcttctattcgtctgaatgaagaagaacgtaaagcagaagtattcttgaaaccggaagaagtatcgttggctattggtaaaggcggtttgaatattaaactggccagtatgttgactgagtacaccattgatgtgttccgtgagttagatgaaaacgcgcaggatgaagatatttatttggacgagttcagagatgaaatcgacggatgggtgatcgatgctatcaaggctattggcattgatacggctaagtctgtattgaatgcacctcgcgaaatgctgattgaaaaaacggatcttgaagaagaaacggtggacgaggtattacgcattttgaaatcggagtttgaagataatgaataa

SEQ ID NO: 64486 - protein, 420 aa, Bacteroides fragilis YCH46
MAKKEETISLIDTFSEFKELKNIDRTTMVSVLEESFRSVIAKMFGTDENYDVIVNPDKGDFEIWRNREVVADEDLTNPNMQISLTEAQKIDASYEVGEEVTDEVIFAKFGRRAILNLRQTLASKILELEKDSIYNKYIDKVGTIINAEVYQIWKKEMLLLDDEGNELLLPKTEQIPSDFYRKGETARAVVARVDNKNNNPKIILSRTSPVFLQRLFEMEVPEINDGLITIKKIARIPGERAKIAVESYDDRIDPVGACVGVKGSRIHGIVRELRNENIDVINYTSNISLFIQRALSPAKISSIRLNEEERKAEVFLKPEEVSLAIGKGGLNIKLASMLTEYTIDVFRELDENAQDEDIYLDEFRDEIDGWVIDAIKAIGIDTAKSVLNAPREMLIEKTDLEEETVDEVLRILKSEFEDNE

SEQ ID NO: 64487 - DNA, 1500 bp, Methylococcus capsulatus str. Bath
  CDS (1)..(1500): transl_table=11
atggcgaataaagaaatcctgctggtagtcgacgtggtgtcgaacgaaaaggacatcgaaaaagaagtcatcttttccgcgatcgaagaggcgctccgcaccgccacgatcaagcggcatgacggcaggtacgatgtgcgcgtgagtatcgaccgcaagaccggcgactacgaaaccttccgccgctggcaggtggtggaaccccgggaggaattcggcaacggtgtcgaattcccggaaagagagatatccctcgaagaagcgcgcaagactcaccccggcatcaccgtcggcgagttcgtagaagaacccttcgactccatcgagttcggccgcatcgccgcgcagaccgccaagcaggtgatcgtgcagaaagtgcgcgaggccgaacggcgcaagatcgcggacgcctatcagagccgcgtcggcgagctggtcaccggcgtcatcaagcgcatcgagcggggcaatgtcttcctcgacctcggcggcaacgtcgaggccttcatccctcgtgacgagatgatcccgcgcgaatccgtccgttccggggaccgcctgcgcggcatcctcagcgcggtccggccggatgccagggggccgcagcttttcgtcagccgcaccgcgccggaactcctgatcgcgctattccggctggaagtccccgaggtcagtgaaaacctcatcgaaatcaagggagcagcccgcgatcccggagtacgcgccaaagtggcggtcaagagcaacgacccccgcctcgacccggtcggcgcctgcgtcggcatgcgcggctcgcgggtccaagccgtgtccaacgaactggcgggagaacgcatcgacatcatcctgtggaacgagaacgaggcccagttcgtggtcaacgccatgtcgccagccgaaatcgtttccatcgtcgtggacgaagaccgccacagcatggatattgccgtcgccgacgaaaacctgtcgcaggccatcggccgcggcggtcagaacgtgcggctggcgtccgagcttaccggctggacgcttaacgtcatgagttccacccaggccgacgccaagacccaggaagaaacccggcgtctgatccaaaccttcgtcgaacaactcggcgtcgatggggaggtcgcggaaatcctcgtccgggaaggcttctccagcgtggaagaactcgcctacgtaccgaccaaggaattgctcgaaatcgaggaattcgacgaggatatcgtggaagaattgcgtaaccgggcacgggatgcgctgctcatcaaggccatcgcatccgaggagaaactcgaagaggtcgagcccagcgaggatctgctggagctcgaaggcatggatcgcgaattggcctatcgcctcgcgcgccatggcattcgcacgctggaagacttggccgaccaggccgtcccggatcttttggacatcgaagacatggaagaggaaaaggccgctgaactcatcatgaaggcgcgcgcctcgtggttttcctga

SEQ ID NO: 64488 - protein, 499 aa, Methylococcus capsulatus str. Bath
MANKEILLVVDVVSNEKDIEKEVIFSAIEEALRTATIKRHDGRYDVRVSIDRKTGDYETFRRWQVVEPREEFGNGVEFPEREISLEEARKTHPGITVGEFVEEPFDSIEFGRIAAQTAKQVIVQKVREAERRKIADAYQSRVGELVTGVIKRIERGNVFLDLGGNVEAFIPRDEMIPRESVRSGDRLRGILSAVRPDARGPQLFVSRTAPELLIALFRLEVPEVSENLIEIKGAARDPGVRAKVAVKSNDPRLDPVGACVGMRGSRVQAVSNELAGERIDIILWNENEAQFVVNAMSPAEIVSIVVDEDRHSMDIAVADENLSQAIGRGGQNVRLASELTGWTLNVMSSTQADAKTQEETRRLIQTFVEQLGVDGEVAEILVREGFSSVEELAYVPTKELLEIEEFDEDIVEELRNRARDALLIKAIASEEKLEEVEPSEDLLELEGMDRELAYRLARHGIRTLEDLADQAVPDLLDIEDMEEEKAAELIMKARASWFS

SEQ ID NO: 64489 - DNA, 1029 bp, Nocardia farcinica IFM 10152
  CDS (1)..(1029): transl_table=11
atgaacatcgaaatcgaagccctgcgcgcgatcgtcgccgacaaggggatctcgatcgagacggtgatctccgcgatcgagtcggccctgctcaccgcctaccggcacaccgagggccaccagcccaacgcgcgcgtcgacatcaaccagcgcaccggcgcggtccgggtgatggcgcgcgagctcgacgccgacggcaacgtcatctccgagtgggacgacacccccgaaggcttcgggcgcatcgccgcgaccaccgcccggcaggtcgtgttgcagcgcctgcgcgacgcggagaacgagaagtccttcggcgagttctccacccacgagggcgacatcgtcggcggtgtggtgcagcgcgacgcgcgcgccaacgcccgcggcaccgtcgtggtccgcataggcagcgaactgcacggcaccgagggcctgatcccgcccgccgagcaggtgccgggcgagacctacgagcacggtgaccggatcaagtgctacgtcgtcggcgtctcgcgcggtccgcgcggcccgcagatcacgctctcgcgcacacaccccaacctggtccgccgcctcttcgcactcgaggtgcccgagatcgccgacggctcggtggagatcgtggcggtcgcccgcgaggccgggcatcgctccaagatcgcggtgcgctccacggtgcccggcgtcaacgccaagggcgcctgcatcggcccgatgggccagcgcgtgcgcaacgtgatgagcgagctggccggggagaagatcgacatcatcgactacgccgacgacccggcgaccttcgtcggcaacgcgctctcgccctcgaaggtggtctcggtcaccatcgtcgatcccgacgcccgcgcggcgcgggtggtggtcccggacttccagctctcgctggccatcggcaaggaagggcagaacgcgcggctcgcggcccggctcaccggctggcgcatcgacatccgcagcgacgccgccccggacgtgggcgacggcatgcggacggaggcgcatcgcagttga

SEQ ID NO: 64490 - protein, 342 aa, Nocardia farcinica IFM 10152
MNIEIEALRAIVADKGISIETVISAIESALLTAYRHTEGHQPNARVDINQRTGAVRVMARELDADGNVISEWDDTPEGFGRIAATTARQVVLQRLRDAENEKSFGEFSTHEGDIVGGVVQRDARANARGTVVVRIGSELHGTEGLIPPAEQVPGETYEHGDRIKCYVVGVSRGPRGPQITLSRTHPNLVRRLFALEVPEIADGSVEIVAVAREAGHRSKIAVRSTVPGVNAKGACIGPMGQRVRNVMSELAGEKIDIIDYADDPATFVGNALSPSKVVSVTIVDPDARAARVVVPDFQLSLAIGKEGQNARLAARLTGWRIDIRSDAAPDVGDGMRTEAHRS

SEQ ID NO: 64491 - DNA, 1479 bp, Legionella pneumophila str. Paris
  CDS (1)..(1479): transl_table=11
atgagcaaagaattgttattagttgctgaggcattatcaaacgaaagaggcgttagtaaagacgtcattatacttgccattcaggctgcactggaatctgcaactcgaaagattcttggtttagatataggtgtgcgtatcaaaatagattctaaaaccggtgactatgaaacctttagatactgggatgtagtgaatgaagaagaattagagtttccggaccgccaactgtccttggaacaagcaaaagagcgaaaaccctcggctgctgttggtgaccgaattgaagaaattattccttccatagaatttggaagaattgaagcgcaaacagcgcgacaagttattatgcaaaaagtcagagaagcggaacgtgaattgatcatagaccaattccgtagcaagcttgggcagctaatctatggaactgttaaaaaagtaactcgtgacaatgtaattattgatttaggtggtaaagcagaggctttcttgccacgctctgaaatgttgcctcatgaaatgtttcgtcccaatgacagagttcgagcatatctgtatgaaatcacgccgcaggcgagaggaccacaattgttcgtaagcagaactcgaaatgaaatgctcattgaattattccgtattgaagttccggaaattggtgaaaatataatagatatcaaagctgcagcgcgcgatccgggaaatagagccaaaattgctgttaaaaccaatgatgggcgtattgaccccatcggtgcttgtgttggtatgcgtggagcaagggtacaagcggtttccagtgaattaggcggtgagcgagttgatatcattctatgggatgataaccctgcccaattagtcataaatgctatggccccagctgatattacatctatcgttgtggatgaagatactcatactatggatttagctgttgcgaaagaacaattatcgcaggcaattggtcgaaacggacaaaatgttcgtttggctagccaattaactggttggacattgaatgtcatgacaacggaagagtttgaaagcaaaaatcaagaggaatcaagtaaaatagttaatctgtttaccaacgcgctagaaatcgatgaggaaatagcgacattattggtagctcatggattttcttctctcgaagaagtggcttatgttccgaaggaggagctgctggctattgaagaatttgatgaagagatagttgaagagttaagaaacagagcaaatgacaagttattggagatggcactgtcatcgggcaaaggattatctggtactccagatgattcccttatcaatatggaaggcatgacagaggatttggcaaataaattagcaagtaaaggaattacaacaatggaagatcttgcagagcaatctgtagatgaattaatggaaatagaaggcattagtgaagaaaaagcaggtgctttaattatgaaagcaagagagccatggtttcaataa

SEQ ID NO: 64492 - protein, 492 aa, Legionella pneumophila str. Paris
MSKELLLVAEALSNERGVSKDVIILAIQAALESATRKILGLDIGVRIKIDSKTGDYETFRYWDVVNEEELEFPDRQLSLEQAKERKPSAAVGDRIEEIIPSIEFGRIEAQTARQVIMQKVREAERELIIDQFRSKLGQLIYGTVKKVTRDNVIIDLGGKAEAFLPRSEMLPHEMFRPNDRVRAYLYEITPQARGPQLFVSRTRNEMLIELFRIEVPEIGENIIDIKAAARDPGNRAKIAVKTNDGRIDPIGACVGMRGARVQAVSSELGGERVDIILWDDNPAQLVINAMAPADITSIVVDEDTHTMDLAVAKEQLSQAIGRNGQNVRLASQLTGWTLNVMTTEEFESKNQEESSKIVNLFTNALEIDEEIATLLVAHGFSSLEEVAYVPKEELLAIEEFDEEIVEELRNRANDKLLEMALSSGKGLSGTPDDSLINMEGMTEDLANKLASKGITTMEDLAEQSVDELMEIEGISEEKAGALIMKAREPWFQ

SEQ ID NO: 64493 - DNA, 1488 bp, Photobacterium profundum SS9
  CDS (1)..(1488): transl_table=11
atgaacaaagaaatcttggctgtcgttgaagcggtatccaatgaaaaagctgttcctcgtgagcgtatctttgaagcactagagatcgcactggcaacagcaacaaagaaaaaacacgaagcagaaattgatgttcgtgttgctatcgatcgtaagacgggccaagttgcaacattccgtcgttggcttgctgttgacgaagtcactcaaccgacattagaaatgacgattgaagcggcacagtacgatgatgaaaccatcgaacttggtggatttgttgaagacgaaatcgaatcagtaacattcgaccgcattacaacacaaactgctaagcaagtaatcgtacagaaagtacgtgaagctgaacgcgagcaaattgttgagcagtttatggataacgaaggtgagttaatcactggtatcgttaaaaaagtaaaccgtgatgcagtaattattgatttaggtaataatgcagaagccgtaatccaacgtgatgatcagcttcctcgtgaaaacttccgttcaggtgaccgtattcgtggtcttttatacgcagtgcgtcctgaagcgcgtggtttccaattgttcatgacacgttctaaagcagaaatgttgttagaactattccgcattgaagtgccagaaatcggtgaagagctgattgaactaatgggcgcggctcgcgatcctggttcacgtgcgaaaattgcagtgaaaacgaacgacaaacgtattgacccagttggtgcgtgtgttggtatgcgtggcgcacgagtacaagccgtttctagtgaacttgctggtgagcgtattgatatcgttctttgggacgaaaacgcagcacagtatgttatcaacgcaatggcgcctgctgaagttgcttcaatcattgttgatgaagatagccacacaatggacattgctgttgagaaagataatcttgctcaagcaattggtcgtagtggtcagaatatccgtttagcatcacagcttactggctgggaactaaatgtaatgactgtagaagatctacagaagaagcacaaagaagaagcacaagtatcgattgatacgtttactaaatacctagacattgatgaagacttcgcgacgctattggttcaagaaggcttcacaacactagaagaaatcgcttacgttcctgttagcgagcttatggatgttgaaggtcttgatgaagacgcaattaatgagctacgtaagtgtgcgaaagaagcactgactacgcttgcccttgcgcaagaagaatcatttgaaggtgtggagcctgcagctgatcttcttggtcttgacggtttagagcgtgaattggcgtttaggctagctgcgaaaggtatttgtacgctggaagatcttgctgaccaaggcacagatgatttgctcgatctcgaagagatgggcgaagcaaaagcgggtgagcttattatggctgcgcgtaatatttgttggtttagcgacgaagcgtaa

SEQ ID NO: 64494 - protein, 495 aa, Photobacterium profundum SS9
MNKEILAVVEAVSNEKAVPRERIFEALEIALATATKKKHEAEIDVRVAIDRKTGQVATFRRWLAVDEVTQPTLEMTIEAAQYDDETIELGGFVEDEIESVTFDRITTQTAKQVIVQKVREAEREQIVEQFMDNEGELITGIVKKVNRDAVIIDLGNNAEAVIQRDDQLPRENFRSGDRIRGLLYAVRPEARGFQLFMTRSKAEMLLELFRIEVPEIGEELIELMGAARDPGSRAKIAVKTNDKRIDPVGACVGMRGARVQAVSSELAGERIDIVLWDENAAQYVINAMAPAEVASIIVDEDSHTMDIAVEKDNLAQAIGRSGQNIRLASQLTGWELNVMTVEDLQKKHKEEAQVSIDTFTKYLDIDEDFATLLVQEGFTTLEEIAYVPVSELMDVEGLDEDAINELRKCAKEALTTLALAQEESFEGVEPAADLLGLDGLERELAFRLAAKGICTLEDLADQGTDDLLDLEEMGEAKAGELIMAARNICWFSDEA

SEQ ID NO: 64495 - DNA, 1548 bp, Anaplasma marginale str. St. Maries
  CDS (1)..(1548): transl_table=11
atggtgaatctgtataattttgataatctagagctgatcagagttgctcgggatgttgcggagcagaagggtctgaatctggaaatggtggtagatgcaatagagcaggctttggagcttgtgagccgcagcaagtatggtgactgtaagatcaaggcctcaatagacagaaaaacgggtgtggtctctatctccaggcaggctctggtggtcaatgatgatatgagctttgacagcgaacagtacggtattccgcctggtgaggtaagcaaatacaagctggtcaaggtttctgatgcggttgctgatggcaaggatgtaaaggttggcgatatcttgttcgagccgttgcctcctgtggatgttgactataactctgccaaagttgcgaggcagaaagttgcgcagctgataatgatccaggagcgcaagcgccagtatgaggagttcaaggaccgggttggagatcttgtctacggggtcgtcaagcgggtcgagtacaacaacgtggtggttgatctcaacggtagtgaagggtacctgcctgtctacaacaccataaggggggaggtcttccgcccaaatgatagggtgaaggctcacgtagaagaggtgcggcaagaagagctgtctggtccccagatctttctttctagggtcagcaaaaggttcatggagctcctgttcaagcaggagatacctgaagtatacgatgggatagtgtccataaaggcgctggctagggaccctggttctaggtcgaaggtggccgttttctcctcagacaaaaacgtggatcctgtgggtgcgtgcattggtgcgcggggtgtgagaatacaaaatatagtctctgagctgcacggggagaagatagacgttgtgttgtattcatcagacctcgcgaagtttgtggtgagcgcgatagcccctgctgaggttgtgaaggtcatcatagacgaagatgtggagaagatagagctggttgttccggaaaatcaggtcagcctggcaataggtcggtatggccaaaacataagactggcctctgaactcgtgggatgggagattgacgtcattggggatgagacggaatctacacggaaggccaaggagcttagttctggggctaaggtcttcgttgatgggttggatgtcgaggagattatagggcagctgctggtgagcgaaggtttttctacgatagaagatttggacaaggttgatgttgccgagattaccgcgatagacgggtttaacgaagagattgcggtggagctcaaaaagcgtgctgctgagtatctgacccgtagacgcgaagaagcgcttgagacgctgaaaaatatgtctgtgagtgaggaggttctggagcttccgtatctggagatagaagatgttgtcaagctgtgtgagggtggcataagaagcgtggaggacatcgcctcgatgtgtaccgatgagttttatgatatggttcccaaggcaagattgagtaaagagcaggtggattccatcattttggagtctcgcaagcgagtggggtggatttag

SEQ ID NO: 64496 - protein, 515 aa, Anaplasma marginale str. St. Maries
MVNLYNFDNLELIRVARDVAEQKGLNLEMVVDAIEQALELVSRSKYGDCKIKASIDRKTGVVSISRQALVVNDDMSFDSEQYGIPPGEVSKYKLVKVSDAVADGKDVKVGDILFEPLPPVDVDYNSAKVARQKVAQLIMIQERKRQYEEFKDRVGDLVYGVVKRVEYNNVVVDLNGSEGYLPVYNTIRGEVFRPNDRVKAHVEEVRQEELSGPQIFLSRVSKRFMELLFKQEIPEVYDGIVSIKALARDPGSRSKVAVFSSDKNVDPVGACIGARGVRIQNIVSELHGEKIDVVLYSSDLAKFVVSAIAPAEVVKVIIDEDVEKIELVVPENQVSLAIGRYGQNIRLASELVGWEIDVIGDETESTRKAKELSSGAKVFVDGLDVEEIIGQLLVSEGFSTIEDLDKVDVAEITAIDGFNEEIAVELKKRAAEYLTRRREEALETLKNMSVSEEVLELPYLEIEDVVKLCEGGIRSVEDIASMCTDEFYDMVPKARLSKEQVDSIILESRKRVGWI

SEQ ID NO: 64497 - DNA, 1500 bp, Idiomarina loihiensis L2TR
  CDS (1)..(1500): transl_table=11
atgagtaaagaaatactgttagtcgcagaagcggtttcaaacgaaaaagcagtaccacgcgaaaaaatatttgaagcgttagagtcagcattggctcatgcgaccaaaaagaagtacgacggcgatattgaagttcgtattgatatcgatcgtaccactggcgaatttgatacattccgtcgttggttagtcgttgaagacacggattctggattagaacatccttaccgtgaaataagcttgtcggcagcgcaatacgaagatccatcggtacaggccggtgactacgtagaagagcaaatcgattcgatacagttcgaccgtattacgacccagactgcaaaacaagttatcgtacaaaaagtacgtgaagccgaacgagctcaggttgttgatgaataccgtgagcaagtgggtgaaatggtcagcggtattgttaagcgtgcgaatcgggagcacgttattctggatttaggtaataacgcggaagcgattatttatcgtgacgaaatgttaccgcgtgaatctgtgcgtccaggtgatcgcattcgcggtttgctctatgacgttcgtccagaagctcgtggtgcacaattatttgtaagcagaaccaatcctaacttcttgttggaattgttccgtatcgaggtgcctgaaataggcgaagagatgattgagctacgcggtgctgcccgagacccgggttcgcgtgctaaaattgcggttaagagtaacgataagcgtatagaccctgttggggcttgcgttggtatgcgcggtgcacgagttcaggcggtatccggtgagcttggtggcgagcgcgtagacattgtgctttgggatgataacccggcacagtacgtcattaacgcgatggcgcctgctgaagtagcgtctatagttgtggatgaagatgcacatactatggatattgcggttgcggcagataacctggctcaagctattggtaaaggtggacagaacgttcgcctggccagtcagctaaccggctggacactgaatgttatgaccgaagacgagttcaacgaaaaaaatgaagctgaaactcagcgtctattgaacttgttcgtatcgactttagatatcgatgaagattttgccaatgtactggttgatgaaggcttctcttcacttgaagaagtggcttatgtcccggttgcagaattccttgatattgaagggatggacgaagatatcgtagaagaattgcgtagcagagcacgtgcttatttaaccacgaaagctctggctaccgaagaatctctggaatcggctgaaccagatgacacactgttgaaccttgaaggaatggagcgtcacctggcttatgtattagccagcaaaggcgtgacaactctggaagagttagcggaacagggtgttgacgacttagccgatattgaagaattaaatgaacagcaggctggcgatttaattatgaaagctcgcaatatttgctggttcaatgaagaacagtag

SEQ ID NO: 64498 - protein, 499 aa, Idiomarina loihiensis L2TR
MSKEILLVAEAVSNEKAVPREKIFEALESALAHATKKKYDGDIEVRIDIDRTTGEFDTFRRWLVVEDTDSGLEHPYREISLSAAQYEDPSVQAGDYVEEQIDSIQFDRITTQTAKQVIVQKVREAERAQVVDEYREQVGEMVSGIVKRANREHVILDLGNNAEAIIYRDEMLPRESVRPGDRIRGLLYDVRPEARGAQLFVSRTNPNFLLELFRIEVPEIGEEMIELRGAARDPGSRAKIAVKSNDKRIDPVGACVGMRGARVQAVSGELGGERVDIVLWDDNPAQYVINAMAPAEVASIVVDEDAHTMDIAVAADNLAQAIGKGGQNVRLASQLTGWTLNVMTEDEFNEKNEAETQRLLNLFVSTLDIDEDFANVLVDEGFSSLEEVAYVPVAEFLDIEGMDEDIVEELRSRARAYLTTKALATEESLESAEPDDTLLNLEGMERHLAYVLASKGVTTLEELAEQGVDDLADIEELNEQQAGDLIMKARNICWFNEEQ

SEQ ID NO: 64499 - DNA, 1476 bp, Azoarcus sp. EbN1
  CDS (1)..(1476): transl_table=11
atgagccgcgagatattgctgcttgtggatgcgctggcgcgcgaaaagaatgtggccaaggacatcgtcttcggcgcactggagagtgcgctcgcctccgcaaccaagaaacgcatcaacgatgaagccgacgtgcgtgtaacgatcgatcgcgacaccggggactacgagtctttccgccgctgggtcgtgatgcccgacgaggaggtcgtcaacgacgaagccgagatgggcatcatcgacgcccgcgagatggtcccgggtatcgagctcggggaatacatcgaggagccgctcgagccaatcgatttcggtcgcatcggcgcccaggcggccaagcaggtcatcctgcagcgcatccgcgacgccgagcgcgagcagatcctgaacgacttcctcgaacgcaaggaacacctggtttcgggctcgatcaagcgcatggagcgcggcaacgcgatcatcgagatcggccggctcgaagccgtgatcccgcgcgaccagatgattccgcgggaaaacttgcgcgtcggcgaccgggtcaaggcattcctgctgcgtatcgatcggggcgcccggggcccgcagttgatcctgtcacgcaccgcgccggaattcgtcggcaagctcttcgagctcgaagtcccggaaatcgaggacgggctgctcgagatcaaggcctgcgcacgcgaccctggcctgcgggcgaagatcgccgtgcagtcgaacgatccgcgcatcgatccgatcggcacgtgcgtcggcctgcgcggttcgcgcgtcaccgcggtgcgcaacgaaattgccggcgagcagatcgacatcatcgtctggtcagccgatccggcgcagttcgtcatcgcagccttgcagccggccgaagtggtgtccatcgtcgttgacgaggaaagccacgccatggatgtcgtggtcgacgagaacaacctggcgatcgcgatcgggcgcaacgggcagaacgtcaagctcgcttccgaactcacgggctggacgatcaatctgatgagtgaggaagagtccgcgcagaagaccggccaggaacgcgaggggctgcgcgagctgttcatggaaaagctcgatgtggatgatgaactcgcggatatcctgatcgacgaaggtttctcgtcgctcgaggaaatcgcatatgtgccgctcgcggagatgctcgagatcgaggctttcgacgagggtacggtcaacgagctgcgtaatcgggctcgaaatgtgcttcttaccgaggcgatcgtcacggaagagcatctggagaacgtttccgacgacctgatcaacctggaaggaatggacaagtcgcttgccgccacgctggcccggcacggtgtcctgacccgggatgatctggccgacctggctgtggatgagctggtcgagatcgccgggatcgaacaagaacgggcaagtgcgttgatttcggtcgcgcgggcgcactggttcgaagaatga

SEQ ID NO: 64500 - protein, 491 aa, Azoarcus sp. EbN1
MSREILLLVDALAREKNVAKDIVFGALESALASATKKRINDEADVRVTIDRDTGDYESFRRWVVMPDEEVVNDEAEMGIIDAREMVPGIELGEYIEEPLEPIDFGRIGAQAAKQVILQRIRDAEREQILNDFLERKEHLVSGSIKRMERGNAIIEIGRLEAVIPRDQMIPRENLRVGDRVKAFLLRIDRGARGPQLILSRTAPEFVGKLFELEVPEIEDGLLEIKACARDPGLRAKIAVQSNDPRIDPIGTCVGLRGSRVTAVRNEIAGEQIDIIVWSADPAQFVIAALQPAEVVSIVVDEESHAMDVVVDENNLAIAIGRNGQNVKLASELTGWTINLMSEEESAQKTGQEREGLRELFMEKLDVDDELADILIDEGFSSLEEIAYVPLAEMLEIEAFDEGTVNELRNRARNVLLTEAIVTEEHLENVSDDLINLEGMDKSLAATLARHGVLTRDDLADLAVDELVEIAGIEQERASALISVARAHWFEE

SEQ ID NO: 64501 - DNA, 1626 bp, Zymomonas mobilis subsp. mobilis ZM4
  CDS (1)..(1626): transl_table=11
atgatcgatatggctagtgccatttctgccaacaaggctgagttgcttgcgatcgccgatgccgtggcgcgtgaaaagctgattgaccgtgctatcgttatcgaagcgatggaagaagctattcagcgtgcagcacgcgcccgctatggcgccgaaaatgacattcgagcaaaaattgatccgaaaaccggtgacatgcgtctgtggcgtgtcgttgaagtagtcgatcaggtcgatgactttttcaaacaggtttctgtcgtcgacgctcaaaaattacaaaatggtgctgcggttggggattttatcgtcgatccactgcctccgatcgaatttggccgcattgccgcacaggctgctaagcaggttattttccaaaaagtccgcgatgctgaacgtgaacggcaatatgcagaatttaaagatcgtatcggtgaaatcatcaccggtatcgtcaagcgtattgaatttggtcatgtcgttgttgatcttggtcgcgcagaaggtgctttacgccgcgatcaacagattccgcgtgaaacttttcgtgtcggtgatcgggttcgttccttgatcatgaatgtccgccgtgaaaatcgtggcccccagattttgctttcgcgctctcatccgaatttcatgaagaagttgtttgcgcaagaagtgccggaaatttacgacggtatcattgaaatcaaagcctgctcccgtgatccgggcagccgcgccaaaattgctgttgtcagtcaggataacacgattgatccggtcggtgcctgcgtgggtatgaagggtagccgtgttcaggccgttgttcaggaagttcaaggcgaaaagatcgacattattccgtggtcggaagatcttgcaaccttcgtcgtaaactccttgcagccagcacaggtttctcgcgttgttattgatgaagatgacagccgtatcgaagccgttgtgccagatgatcaactttcattggctattggccgtcgcgggcagaatgtccgccttgccagccagttgacggggtctgctatcgatattctgaccgaagccgatgcttcggaacggcgacagaaagaattcgttgctcattcggaattattccagcacgaccttgatgttgatgaaaccttggcacaattgctggtagccgaaggctttggtagccttgaagaagttgcctatgttgatcaggctgaaatttccgctattgaaggtatcgacgaagagcttgcttctgaattgcagaaccgcgcccgcgaagctttagagcagcgtgaagcggaagcacgtgaagaaagacgcaagcttggtgttgaagacgcactggccgatttaccctatatgacagaagcaatgcttttgaccttgggaaaagctggtattaagacgcttgatgatctaggtgatctttcaactgacgaacttgttcacaaaaaacgtcaggatcaaagacgccgtcattcgtctgataacaatgaagaagacggtattctggctgaatatggcctcagtcaggaacaggggaatgaaattatcatggcagcacgagcccattggttcgatgacgctgaagatgaaacccattcctcggaagacactgaaacaaggtcggagaaagcctaa

SEQ ID NO: 64502 - protein, 541 aa, Zymomonas mobilis subsp. mobilis ZM4
MIDMASAISANKAELLAIADAVAREKLIDRAIVIEAMEEAIQRAARARYGAENDIRAKIDPKTGDMRLWRVVEVVDQVDDFFKQVSVVDAQKLQNGAAVGDFIVDPLPPIEFGRIAAQAAKQVIFQKVRDAERERQYAEFKDRIGEIITGIVKRIEFGHVVVDLGRAEGALRRDQQIPRETFRVGDRVRSLIMNVRRENRGPQILLSRSHPNFMKKLFAQEVPEIYDGIIEIKACSRDPGSRAKIAVVSQDNTIDPVGACVGMKGSRVQAVVQEVQGEKIDIIPWSEDLATFVVNSLQPAQVSRVVIDEDDSRIEAVVPDDQLSLAIGRRGQNVRLASQLTGSAIDILTEADASERRQKEFVAHSELFQHDLDVDETLAQLLVAEGFGSLEEVAYVDQAEISAIEGIDEELASELQNRAREALEQREAEAREERRKLGVEDALADLPYMTEAMLLTLGKAGIKTLDDLGDLSTDELVHKKRQDQRRRHSSDNNEEDGILAEYGLSQEQGNEIIMAARAHWFDDAEDETHSSEDTETRSEKA

SEQ ID NO: 64503 - DNA, 1470 bp, Francisella tularensis subsp. tularensis Schu 4
  CDS (1)..(1470): transl_table=11
atgagcaaagaattattgttagtattagaaactgtagcaaatgaaaaagatatctcaaaagatcttttatttgaagctatggaagaggctttggctattataactaagaaagaacttgatgagcatatgaatatcgaggttaaaatcgatagagttacgggtgatttcaaggctgatagagtttggcatattgtttctgaagatgaagatttaattgattattcaaaagagctttatgaagatgtcgttcaagaaaaaggctataatgtaaaagctggcgatgttatgcgtgaacctgttgaggtcaaagaatatgggcgtatagctgcgacaatggctaagcaaattctaatgaagaaaatcaaaaattttgaaagagaaaagtcagctagattttatcaaaataaaattggcgatattgtttacggcgagataaagcgcgctacatatgaaatcttagttgttgatttgggcaataatgctgaggggattttacctaaaaaagatctaatagctagagaaagatatcgagttggtgacaaaataagagcatgtgttgaagctgttgagagtgatgagtctggcaagccaaatacgattatgttaagtcgttcaagcaatactatgcttaaagctttatttaagcttgaggttccggaggttgaagaagagcttattaatatagtgaatgtagttcgtgaacctggttttaggtctaaagtaactgttaaaagtaatgatcaaagaatagatccttgtggtgcctgtgttggtgtgagaggttctagaatacattctataatgagtgagctaaatggtgagaaggttgatgttatactttggaatgaagatatggttcagtatgcaattaactcattatcaccagttgatgcagcagacatcttagaagtgaatgttgatgaagaaactaattcgatagatattgttgttaagcaagaaagtttatctaaagcaattggtaaaaatggtgttaatgtaagattagcaagttcgttaataggttggaaaattaatgttctatcagatgctgagcaggaagaaaaacaaatgtctatagtagagaaatttgttgaagccttagatatagatcacgattttgcattagtattgattgaagagggtatagagactcttgaagatttagcatatttagatagagctgagcttttagaaattgaagggtttgatgaagagatcgttgatgagcttcaagagagagcaaaagcagttattttatctcaagctttaggaggtaaaaaaccagctcaagatttgttagatatgcaaggtatgagtctggatttggctgagcagctagcgcaaaataatatagttactatggaagatctagcagagctatctgtagatgagttgcttgatattgtggatatagatgaagagcaagcaactaatttaattatgcaagcaagagctccttggtttgaataa

SEQ ID NO: 64504 - protein, 489 aa, Francisella tularensis subsp. tularensis Schu 4
MSKELLLVLETVANEKDISKDLLFEAMEEALAIITKKELDEHMNIEVKIDRVTGDFKADRVWHIVSEDEDLIDYSKELYEDVVQEKGYNVKAGDVMREPVEVKEYGRIAATMAKQILMKKIKNFEREKSARFYQNKIGDIVYGEIKRATYEILVVDLGNNAEGILPKKDLIARERYRVGDKIRACVEAVESDESGKPNTIMLSRSSNTMLKALFKLEVPEVEEELINIVNVVREPGFRSKVTVKSNDQRIDPCGACVGVRGSRIHSIMSELNGEKVDVILWNEDMVQYAINSLSPVDAADILEVNVDEETNSIDIVVKQESLSKAIGKNGVNVRLASSLIGWKINVLSDAEQEEKQMSIVEKFVEALDIDHDFALVLIEEGIETLEDLAYLDRAELLEIEGFDEEIVDELQERAKAVILSQALGGKKPAQDLLDMQGMSLDLAEQLAQNNIVTMEDLAELSVDELLDIVDIDEEQATNLIMQARAPWFE

SEQ ID NO: 64505 - DNA, 1326 bp, Synechococcus elongatus PCC 6301
  CDS (1)..(1326): transl_table=11
atgtcaatggtcaccctgcccggcctagagcagctgatctacgccattagcgagcaaaaaaaactgcccgccaatgtcattgaagaagccctcaaagaagccttgctcaagggctacgagcgctatcgccgtacccagcagatgggtgagcagtttgaagaagactacttcgacaacattgacgttgaactcgatgtcgaacaggaaggctttcgggtactggcaaccaaaaccatcgtcaatcaggtcgaaaatcctgaccatcagattgccctcgccgatgttcaggaagtggctccagatgcccaagcaggcgaaatcgtcgttctagatgtcacacccgataaagacgactttgggcgaatggcggctattcagactaagcaagtcctgtcgcaaaaactgcgcgatcaccagcgcaaactgatccaagaagagttccaagatctagaagatccggtcttgatggccaaggtgctgcgcttcgagcgccagtctgtgatcttgggggtcagcagtggtttaggacgtcctgaagtcgaggcagaactgccccgtcgcgaacaactgcccaacgacaactaccgggccaacgccaccttccgcgtcttcctcaaggaagtcagtgaagaaccccgtcgtggaccgcagttgattgtctctcgggctaacgccggtctggttgtctacttgttcgaaaacgaagttcctgaaatccaagatggtgtcgtccgcattgtggcggtagcgcgggaagcgaatccgccgactcggcatgttgggccgcgcaccaaaatcgctgtcgataccttggaacgcgaagtcgatccggttggggcttgcatcggggcgcggggatcgcggattcaggtggtcgtcaacgaattgcggggcgaaaaaattgatgtgatccgctggtcgccggatccggccacctatattgccaatgccctcagccctgcccgggttcaggaagtgcgcttggtcgatcccgaaggtcggatcgcccacgttttggtcaacgacgaccaactcagtctcgcgatcggcaaagagggtcagaacgtgcgcctcgcggctcgactgaccggctggaaaatcgacatcaaggacgtggcgctctacgacgcagtcacggaaggtcaacggatttctgaactgattcaagaacgccaagagcgggcggcgattgctgccgaagaagaagcccgtgctgccgccgaagctgctgaactggcggaatgggaggcggaagaggctgctctcgcagccgctgaacctgcggcagaactcgcagctgctgaagctgaggaagagactgtttga

SEQ ID NO: 64506 - protein, 441 aa, Synechococcus elongatus PCC 6301
MSMVTLPGLEQLIYAISEQKKLPANVIEEALKEALLKGYERYRRTQQMGEQFEEDYFDNIDVELDVEQEGFRVLATKTIVNQVENPDHQIALADVQEVAPDAQAGEIVVLDVTPDKDDFGRMAAIQTKQVLSQKLRDHQRKLIQEEFQDLEDPVLMAKVLRFERQSVILGVSSGLGRPEVEAELPRREQLPNDNYRANATFRVFLKEVSEEPRRGPQLIVSRANAGLVVYLFENEVPEIQDGVVRIVAVAREANPPTRHVGPRTKIAVDTLEREVDPVGACIGARGSRIQVVVNELRGEKIDVIRWSPDPATYIANALSPARVQEVRLVDPEGRIAHVLVNDDQLSLAIGKEGQNVRLAARLTGWKIDIKDVALYDAVTEGQRISELIQERQERAAIAAEEEARAAAEAAELAEWEAEEAALAAAEPAAELAAAEAEEETV

SEQ ID NO: 64507 - DNA, 1089 bp, Campylobacter jejuni RM1221
  CDS (1)..(1089): transl_table=11
atggaaaagatagcagatattatcgaatctattgctaatgaaaaaaatttaaacttagagaatgtaagagaaaaggtagctaccgctttaatcaatactgcaaaaagaatttatggacaagaatatgagttttttgtggatcctaaaaatttaaatctttatcaaaaaattaccatagtagcagataatgacgagagattgcaaaataaaagtgagagttttatcgcgttaagtaaggcaaaatcagaagctccagatgttgaaataggagatgaattaacctatgaatgttctttggaaaatttaggaagaactgcggtaaataccttgcataaagaacttgaatatcatatacaaaaattattagaacaaactatttttgaaaaatataaaaacaaagtagggcaaatggtttttggtacagttgttagagtggataatgaagaaaatacttttattgaaatagatgaattaagagcttttttaccgagaaaaaatcgcattaaaggggaaaaatttaaaataggtgatgtggtaaaagctgtgatacgccgtgtttatacagataaaggtattaaaatcgagcttagtcgtacaagtcctaaatttttagaatgtttacttgaagctgaggttccagaaatcaaagatggttatgtcaatattataggatgtgctagaattccaggtgaaagagcaaaaatcattcttcaggccaatggagcaaatatcgatcctgtaggagctacagtaggtgttaaaggtgtaagaattaatgcggtaagcaaagagcttcataatgaaaatattgattgtatagaatttacaaatgagagtgaaattttaatttctcgtgccttggctcctgctattgtaaattctgtaaaaattgaagataaaaaagctattgtaagtttaaatagcgaacaaaaaagcaaagctataggaaaaaatggtattaatattcgccttgcttctatgttaagtggttatgaaatagagctcaatgaattaagctcatcgcagctaaataatgccatcagcaatgaagaagcaatgaaaaatcttcaagatttgtttaaaatttaa

SEQ ID NO: 64508 - protein, 362 aa, Campylobacter jejuni RM1221
MEKIADIIESIANEKNLNLENVREKVATALINTAKRIYGQEYEFFVDPKNLNLYQKITIVADNDERLQNKSESFIALSKAKSEAPDVEIGDELTYECSLENLGRTAVNTLHKELEYHIQKLLEQTIFEKYKNKVGQMVFGTVVRVDNEENTFIEIDELRAFLPRKNRIKGEKFKIGDVVKAVIRRVYTDKGIKIELSRTSPKFLECLLEAEVPEIKDGYVNIIGCARIPGERAKIILQANGANIDPVGATVGVKGVRINAVSKELHNENIDCIEFTNESEILISRALAPAIVNSVKIEDKKAIVSLNSEQKSKAIGKNGINIRLASMLSGYEIELNELSSSQLNNAISNEEAMKNLQDLFKI

SEQ ID NO: 64509 - DNA, 1476 bp, Dehalococcoides ethenogenes 195
  CDS (1)..(1476): transl_table=11
atgaaaagcgactttttgctcgctatcacccagctctcggcagaaaagaatctgccaaaggaagtagtacttgctaccgttgagtcggctttggtatcggcttatcgtaaagagagctttgctccaaaccagaatatcgcggtgaagatagaccagctgactggcaaggtaaaggtcatggccgaaaagctggtagttgaaaaagtgactgacagccgccaggaaatgcgtttgcttgaggccaaacggctgaaagctgatgccaagataggcgaccttatgatggttgaagatactccggctgatgccgggcgtattgctgcccaaactgccaagcaggttatcctgcagcgtctgcatgaagcggaaaatacggctatttttgacgaatatgcctccaaggcgggtgacaccctggtaggcgtggttcagcgtatagagcccaagcagattactgttgatataggccgggtggaagccataatgcccgccagcgaacaggcatacggtgaaaggtatcgggccgggcagcgtataaaggtgtatgtagtggatgtggctaaaacagccaaaggcccggctgttattgtttcgcgttctcaccccggtttggtacggcgtctgtttgaaatggaagtgccggaggtttttaaccagctggtagagataaaggcggttgcccgtgaagccggttcacgctctaaagtagcggtaggcgctttacagccggggattgacccggtgggttgctgtgtgggtttgcggggtatccgcattcagaatattgtcagtgagctgaacggcgaaaagatagatgtggtggcctgggatagtgaaatagctaattttattgccaattcacttagcccggctcaggttacaaaagttattctgaacgaagctgaaaaatctgctattgtggtcatacctgaccgccagctgagtttgggtattggtaaagaaggacagaatgtgcgtctggcggttaagctgaccggctggcggattgatattaagagtgcctctgatgaagaggtggaacgggcggaagaaactgcccgcaagcagggggaaactgaaaagcctgccataaccgaaaaggttattgaaaaacagcctgccgctgcacctgctgccaaggccgaagcagaacctattgagccggtcatgcctgaggctataatagccgaaccggcggtgaaggaaacacctgccaagactgaagccgtgcctgaagaacagggtgtggtggtaccccttaatgtgctggataaagtggctgagggtgatacagtcaaactgcgttttgcagaagatttgctgccccggcgtgaaatagtcatagatgataaaaacaagggtaaaaacaagaaaaagaccgtcaaaggcaaagataccgctgaagatggtatcaagctgaagggcaaaaaacggcggaatgtaacggattatgaatcagaggaaatcgacttctaa

SEQ ID NO: 64510 - protein, 491 aa, Dehalococcoides ethenogenes 195
MKSDFLLAITQLSAEKNLPKEVVLATVESALVSAYRKESFAPNQNIAVKIDQLTGKVKVMAEKLVVEKVTDSRQEMRLLEAKRLKADAKIGDLMMVEDTPADAGRIAAQTAKQVILQRLHEAENTAIFDEYASKAGDTLVGVVQRIEPKQITVDIGRVEAIMPASEQAYGERYRAGQRIKVYVVDVAKTAKGPAVIVSRSHPGLVRRLFEMEVPEVFNQLVEIKAVAREAGSRSKVAVGALQPGIDPVGCCVGLRGIRIQNIVSELNGEKIDVVAWDSEIANFIANSLSPAQVTKVILNEAEKSAIVVIPDRQLSLGIGKEGQNVRLAVKLTGWRIDIKSASDEEVERAEETARKQGETEKPAITEKVIEKQPAAAPAAKAEAEPIEPVMPEAIIAEPAVKETPAKTEAVPEEQGVVVPLNVLDKVAEGDTVKLRFAEDLLPRREIVIDDKNKGKNKKKTVKGKDTAEDGIKLKGKKRRNVTDYESEEIDF

SEQ ID NO: 64511 - DNA, 1608 bp, Rhodobacter sphaeroides 2.4.1
  CDS (1)..(1608)
atggcaatcacctctgccaaccagcttgaactgctgcaaaccgccgaggcggtcgcgcgggagaagatgatcgatcccgatctggtgatccaggcgatggaagagagcctcgcgcgggccgccaagtcgcgctacggctcggatctcgacatccgggtgaagatcgaccgcaagaccggccgcgccaccttcgcccgcatccgcaccgtggtcgaggacgagctgatcgagaatcaccacgctcaggtgacggtgaagcaggcgagaagctatctcgcggatcccaagatcggcgacgagatcatcgacgaagtgccgccggtggatctcggccggatcgccgcgcaatcggccaagcaggtcatcctgcagaaggtgcgcgaggccgagcgcgaccgtcagtatgacgagttcaaggaccgcaagggcacgatcatcaacggcgtggtcaagcgcgaggaatacggcaacatcatcgtcgacatcggccgcggcgagggcatcctgcgccgcaacgagaagatcggccgcgagagctaccgtccgaacgaccgcatccgcgcctatatcaaggacgtccgccgcgaggcccgtggcccgcaggtcttcctcagccgcaccgatccgcagttcatggccgagctcttcaagatggaagtgccggagatctacgacggcatcatcgagatcaaggccgtggcccgcgacccgggctcgcgcgcgaagattgcggtcatctcctacgacaactcgatcgacccggtcggcgcctgcgtcggtatgcgcggcagccgcgtgcaggccgtcgtgaacgagctgcagggcgagaagatcgacatcatcccgtggaaccaggatcaggccacgttcctcgtgaacgcgctgcagccggccgaggtctccaaggtcgtgatcgacgaggaagccggcaagatcgaggtggtggtgcccgacgagcagctctcgctcgccatcggccgccgcggccagaacgtgcgcctcgcgagccagctgacggccctcgacatcgacatcatgaccgaagccgacgaatcggctcgccgccaggccgagttcgccgagcggacgaatctcttcatggagacccttgatatcgacgagatgatggcccaactactggtgtccgaagggttcacgaaccttgaggaagtcgcttacgtcgatcccgaggaactcctttcgatcgatgggttcgacgaggacacggccgccgagcttcaggcccgcgcccgcgaccatctggaagaagccaaccgcaaggccctggaatccgcccgcgccctcgggctcgaggattccctcgccggtttcgaagggctgaccccgcagatgctcgaggcgctcgcgaaggacggcatcaagacgctcgaagacttcgccacctgcgcggactgggagctggccggcggctggaccacggtgaacgggcagcgggtgaaggacgagggcgtcctcgagaagttcgacgtgagcctcgaggaagcgcagcatctggtgatgaccgcacgcgtcatgctgggctgggtcgatccgaccgaactcgcgccggaagccgaggaagaagaagagacggagggcgaggcctga

SEQ ID NO: 64512 - protein, 535 aa, Rhodobacter sphaeroides 2.4.1
MAITSANQLELLQTAEAVAREKMIDPDLVIQAMEESLARAAKSRYGSDLDIRVKIDRKTGRATFARIRTVVEDELIENHHAQVTVKQARSYLADPKIGDEIIDEVPPVDLGRIAAQSAKQVILQKVREAERDRQYDEFKDRKGTIINGVVKREEYGNIIVDIGRGEGILRRNEKIGRESYRPNDRIRAYIKDVRREARGPQVFLSRTDPQFMAELFKMEVPEIYDGIIEIKAVARDPGSRAKIAVISYDNSIDPVGACVGMRGSRVQAVVNELQGEKIDIIPWNQDQATFLVNALQPAEVSKVVIDEEAGKIEVVVPDEQLSLAIGRRGQNVRLASQLTALDIDIMTEADESARRQAEFAERTNLFMETLDIDEMMAQLLVSEGFTNLEEVAYVDPEELLSIDGFDEDTAAELQARARDHLEEANRKALESARALGLEDSLAGFEGLTPQMLEALAKDGIKTLEDFATCADWELAGGWTTVNGQRVKDEGVLEKFDVSLEEAQHLVMTARVMLGWVDPTELAPEAEEEEETEGEA

SEQ ID NO: 64513 - DNA, 1509 bp, Magnetospirillum magnetotacticum MS-1
  CDS (1)..(1509)
atggaacggatcgccgcacttccccgccccgaacttcttcaggtggcagacgccgtcgcccgcgataaaggcatcgaccgcgacgaggttctcgaagccatggagcaggccattcagaaggccggtcgctccaaatatggccacgagcacgatattcgcgcccatatcgaccgcaagaccggcgaaattcagcttgcccgctatatcgaagtggtcgaggaggtggaaaacgaagccacccagcagaccttgaagcaggtgctgaagaagaagccggacgcccaggtcggcgacttcctggtcgatccgctgccgcccatcgattttggccgcatcgcagcgcaaaccgccaagcaggtcatcgtccagaaggtccgcgacgccgagcgtcagcgccagttcaacgaatacaaggaccgcgtcggcgagatcagcaacggtctggtcaagcgcgtcgagttcggcaatgtcatcgtcgatctgggtcgggccgaggcgctgctgcgccgcgacgagttgatcccgcgcgagactttccgcactggcgaccgcgtgcgcgcttatatctacgacgtccgccaggagccgcgtggcccgcagatcttcctgtcgcgcacccatcccatcttcatggccaagctgttcgcccaggaagtgccggagatctatgacggcatcatcgagatcaaggctgtggcccgtgatcccggctcgcgcgccaagatcgccgtgcagtcccacgattcctccatcgatcccgtcggcgcctgcgtcggcatgcgagggagccgtgttcaggcggtggtggccgagctgcagggcgagaagatcgacatcatccagtggtcgcccgacgtcgccaccttcgtggtgaacggcctggctcccgccgaggtcaccaaggtggtgctggacgaggaagccggccgcatcgaggtggtggttcccgacgaccagctgtcgctcgccatcgggcggcgcggccagaatgtgcgtctggccagccagctgacccagtggaatatcgacatcctcaccgaggccgaggaatccgagcgccgcaccgaggaattccgctcgcgctccaatatgttcatccaggccctggacgtggacgacgtcattgcccatctgctggtgaccgagggcttctcctccgtcgaagaggtggcctacgtccccagcgaggatatcgccgatatcgagggctttgacgagaacgtcgccgaggagcttcagacccgtgcgcgcaacttcctggccgagcaggacgagcgctacgaccagatgcgcaaggacatgggcgtcgccgacgagatggccgccatcgaggggctggctccgtccatgctggtcaagctgggcgacaagggcatcaagaccctggacgacctgggcgatctggccggtgacgaactgctcgacatcctgggcaaggatgccatgagcgaggacgaggccaacgcggtcatcatggcggcccgtgctcattggttcgaggaaaagtaa

SEQ ID NO: 64514 - protein, 502 aa, Magnetospirillum magnetotacticum MS-1
MERIAALPRPELLQVADAVARDKGIDRDEVLEAMEQAIQKAGRSKYGHEHDIRAHIDRKTGEIQLARYIEVVEEVENEATQQTLKQVLKKKPDAQVGDFLVDPLPPIDFGRIAAQTAKQVIVQKVRDAERQRQFNEYKDRVGEISNGLVKRVEFGNVIVDLGRAEALLRRDELIPRETFRTGDRVRAYIYDVRQEPRGPQIFLSRTHPIFMAKLFAQEVPEIYDGIIEIKAVARDPGSRAKIAVQSHDSSIDPVGACVGMRGSRVQAVVAELQGEKIDIIQWSPDVATFVVNGLAPAEVTKVVLDEEAGRIEVVVPDDQLSLAIGRRGQNVRLASQLTQWNIDILTEAEESERRTEEFRSRSNMFIQALDVDDVIAHLLVTEGFSSVEEVAYVPSEDIADIEGFDENVAEELQTRARNFLAEQDERYDQMRKDMGVADEMAAIEGLAPSMLVKLGDKGIKTLDDLGDLAGDELLDILGKDAMSEDEANAVIMAARAHWFEEK

SEQ ID NO: 64515 - DNA, 1098 bp, Leuconostoc mesenteroides subsp. mesenteroides ATCC 8293
  CDS (1)..(1098)
atgagtaaagaattagtggaagcacttaatgctcttgaatcagaacgaggaattgatcgtttagttgttgtcgaagcgcttgaagacgcattgaaagccgcctacaagaagcaatacaataccgctgataatgtcgaagcaacattcgacgataaaaagggcaacattagtattaaacaagtaaagcatgttgttttagatgatgatcttgaagatgaagaaatagagatttctttatccgatgcattggcaatcaatcgagcatatgaagcaggagatgagattcgctttgatgttacgccaaaagattttggtcgtatggcggcacaagctgcaaaacaagtgattgtgcaaaaaatgcgtgaagctggacgacaagctatttataacaagttttctgattatgaagatgaaattataacaggtgaagttgaccgacaagatgcacgattcctatatgtgaacttacctggcaatcaagaagctgtaatggccccaaacgatcaaatgcccaatgagcggtatcacatgggagatcgtattaaggtcttggttaacaaagttgaaaacaatgccaagggaccacaagtctttgtatcacgaacagcagctgatttggttaaacgattgtttgaacaagaggtgccagaagtttatgatggtactgttgaaatcatgtctattgcgcgtgaggctggtgatcgctcaaaaattgccgtttatacgcatgatactgacttagatccagttggggccatggttggtcaacgtggtgcacgtgtacaaagcgttgttaacgaactagctggtgaaaatatggatattgtggagtgggttgaagatgaagcacagtatattgcgaatgctttaaacccttcagaagtaactgatgtcatttttgatccagccaacgaccgtgcggtaacggttattgttccagataatcagttatctctagcaatcgggaaaaagggtcaaaatgctcgcttagcagcacgtttaacgggattcaagattgacattaaatctgaaagtgaagcagcagctagcttagacccaacaccagctgctacagctgctgacgaaaacgaagaataa

SEQ ID NO: 64516 - protein, 365 aa, Leuconostoc mesenteroides subsp. mesenteroides ATCC 8293
MSKELVEALNALESERGIDRLVVVEALEDALKAAYKKQYNTADNVEATFDDKKGNISIKQVKHVVLDDDLEDEEIEISLSDALAINRAYEAGDEIRFDVTPKDFGRMAAQAAKQVIVQKMREAGRQAIYNKFSDYEDEIITGEVDRQDARFLYVNLPGNQEAVMAPNDQMPNERYHMGDRIKVLVNKVENNAKGPQVFVSRTAADLVKRLFEQEVPEVYDGTVEIMSIAREAGDRSKIAVYTHDTDLDPVGAMVGQRGARVQSVVNELAGENMDIVEWVEDEAQYIANALNPSEVTDVIFDPANDRAVTVIVPDNQLSLAIGKKGQNARLAARLTGFKIDIKSESEAAASLDPTPAATAADENEE

SEQ ID NO: 64517 - DNA, 1419 bp, Azotobacter vinelandii
  CDS (1)..(1419)
atgattttcgaggccctggaactggcgctggccactgccaccaagaagcgctacgaggacgatgtcgatctgcgtgtgcagatcaaccgtcaaagcggcgcgtacgacactttccgtcgctggaccgtcgtcgaggacgatttgctggagaatccggctgccgaactgacgctcgacgaggcccgtgagcgcaagcctgacgtcagggtcggggatgtaatcgaggaaaagatcgagtccattgagttcggtcgaattgccgcgcagactgccaaacaggtgatcgtgcagaaggtgcgggaggccgagcgcgcccaggtggtggatgtctaccgcgaacgtgtgggggagatcatttccggcactgttaaaaaggtgacccgggacaatgtcatcgtcgatctcggcaacaatgccgaggcgctgctggcgagggaggatatcatccctcgcgagaccttccgggtcggtgcgcgggtacgggctctgctgaaggagattcgcccggagaaccgcggtccgcagttgatcctgtcgcgtaccgcaccgggcatgctcatcgagttgttccgcatcgaggtgccggaaatcgccgaagggttgatcgaggtgaaggctgcttcccgtgatccggggtcgcgcgccaagatcgccgtgcgttccaaggacaaacgtatcgatccgcagggagcctgcatcggcatgcgcggttctcgtgtgcaggccgtctccggcgagttggggggtgagcgtgtcgatatcgtgctgtgggacgataatccggcccagttcgtgatcaacgcaatggcaccggccgaggtggcggcgatcattgtcgacgaggacgcccatgcgatggatgtcgccgtggccgacgacaacctggcccaggccatcggccgcggcgggcagaatgtgcggctggccagccaactgaccggctggaccctgaatgtgatgaccgagggcgatatccaggccaagcaacgggccgagacgggcgacatcctgcgctccttcgtcgaagagcttgaggtcgacgaggagctggcgcaggtgctggtggaggaaggcttcaccagcctggaagagattgcctatgtaccgatggaagaaatgctcgccatcgatggtttcgatgaggaaatcgtcaacgagttgcgcgcgcgcgccaaggaccgcctgctgaccaaggctattgctactgaagaaaagctggtggaagcccatccggccgaagacctgctctcgctcgagggtatggacaaggagctggcggttgagctggcgatgcgcggggtgattacccgcgaagacctagccgagcagtcgatcgacgacctgctcgacatcgacggcatggatgaagagcgtgccggcaagctgatcatggccgcccgagcccattggttcgagtaa

SEQ ID NO: 64518 - protein, 472 aa, Azotobacter vinelandii
MIFEALELALATATKKRYEDDVDLRVQINRQSGAYDTFRRWTVVEDDLLENPAAELTLDEARERKPDVRVGDVIEEKIESIEFGRIAAQTAKQVIVQKVREAERAQVVDVYRERVGEIISGTVKKVTRDNVIVDLGNNAEALLAREDIIPRETFRVGARVRALLKEIRPENRGPQLILSRTAPGMLIELFRIEVPEIAEGLIEVKAASRDPGSRAKIAVRSKDKRIDPQGACIGMRGSRVQAVSGELGGERVDIVLWDDNPAQFVINAMAPAEVAAIIVDEDAHAMDVAVADDNLAQAIGRGGQNVRLASQLTGWTLNVMTEGDIQAKQRAETGDILRSFVEELEVDEELAQVLVEEGFTSLEEIAYVPMEEMLAIDGFDEEIVNELRARAKDRLLTKAIATEEKLVEAHPAEDLLSLEGMDKELAVELAMRGVITREDLAEQSIDDLLDIDGMDEERAGKLIMAARAHWFE

SEQ ID NO: 64519 - DNA, 1389 bp, Desulfitobacterium hafniense DCB-2
  CDS (1)..(1389)
atgaatatggagttcattgaggccctccatgaattggagaaagacagagggatctcagcggatattctgtttgaagccattgaagcggccctgatatctgcttacaagaaaaattttgcttcattacagaatgtccgggtacatatcgaccgtatgactggagagttcaaagttttcgcccggaaaaacgtggtggaagaggttgaagattcacgaactcaggtaagtatggaagaagcacagaagattgaccccaactatgccatcgatgatgtggtggaatacgaagtcacgccccgtgaatttgggcggattgcggctcagacagctaaacaagtagtagtgcaaagaattcgtgaagctgagcggggcatgatttacgatgaatatatcaaccgggaaggggatatcgttaccggaattgttcagcgctatgatcagaaaaacgtcattgttgatttaggtaaggtagaggccattctgacagcacaggaacaaattcccggtgagacttatcaaccctttgagcggattaagacctttgtggtagaagtcaaaaaaacaaccaaagggcctcaggtcatgctctcccgtacccacccgggtctgattaaacgtttgtttgaactggaagtgccggaaatccatgacggactggttgagattaaaggtgtgtcccgggaggcgggagcccgctctaaaatcgctgtttattcccgggatgccaatgtagatcctgtgggggcttgcgtaggaccgaaaggcagccgggttcaaaccattgttaccgagttgaagggtgaaaagatagacatcgtcaattattccacagatcctgaggaatttgtggctaatgccctttccccggccaaagttgtgggagtataccctaaacctaatgagaaagtggctttggtcgtagttcccgactatcaattatccctggcgatcggcaaagaaggtcaaaatgcccgtttggccgccaagctgaccaattggaagattgacattaagagtgagtcccaggccctggcccaaaatcttattcccgataagaatgaagtccagggagaatacgaagagtacgacgaattcgctgattatgcagagtatgaaaactacgatgaatatgaagactatagcgaatacgatgactatgaagagaatgaggactacgatgaaaacgcgactatggggagaattatgatgatgagctggtttatgatgagaatgaccagtatgaggaattcgatgcttatcaaaatgaagaacttccctacgaagaaagcgaagactatgcagcgactccggataacggggagcctaaggccgaaaatgctgaggaaaactatgcctacacagagtcaggcgataaggaagaacgactga

SEQ ID NO: 64520 - protein, 462 aa, Desulfitobacterium hafniense DCB-2
MNMEFIEALHELEKDRGISADILFEAIEAALISAYKKNFASLQNVRVHIDRMTGEFKVFARKNVVEEVEDSRTQVSMEEAQKIDPNYAIDDVVEYEVTPREFGRIAAQTAKQVVVQRIREAERGMIYDEYINREGDIVTGIVQRYDQKNVIVDLGKVEAILTAQEQIPGETYQPFERIKTFVVEVKKTTKGPQVMLSRTHPGLIKRLFELEVPEIHDGLVEIKGVSREAGARSKIAVYSRDANVDPVGACVGPKGSRVQTIVTELKGEKIDIVNYSTDPEEFVANALSPAKVVGVYPKPNEKVALVVVPDYQLSLAIGKEGQNARLAAKLTNWKIDIKSESQALAQNLIPDKNEVQGEYEEYDEFADYAEYENYDEYEDYSEYDDYEENEDYDENATMGRIMMMSWFMMRMTSMRNSMLIKMKNFPTKKAKTMQRLRITGSLRPKMLRKTMPTQSQAIRKND

SEQ ID NO: 64521 - DNA, 1272 bp, Nostoc punctiforme PCC 73102
  CDS (1)..(1272)
atggttactttacctggattaaaagaattaattgaaagtataagtcgtgagcggaatttaccccgtcttgcagttcaatcagctattagagaagcactattaaaaggctacgaacgttatcgtcgcgcccaaaatttagagcgaaaacagtttgacgaagattattttgaaaattttgaagtagaactcgatattgacggagagggatttcgcgttctttccaccaaaaccatcgttgaagaagtaaataacacagaccatcagatttctctagacgaagttcaacaagtagctcccgaagcgcagttaggggactctgttgtgctagatgtgactcccgatcaaggagaatttggtcggatggcggcaatgcaaaccaagcaagtattggcgcaaaaattacgggatcaacagcgccagatggtgcaagaagagttccaagatttagaaggaactgttttgcaagcaagagtcctacggtttgagcggcaatctgtggttttggcagttagcagtggctttggtcagccagaagtagaagccgaattaccgaagcgggaacagttgcctaacgataattatcgggcaaatgccaccttcaaggtatatctgaaaaaagtttcccaaggtcaacaacgagggccacagttgctggtgtctcgtgctgatgcaggtttagtggtttacctgtttgccaacgaagtcccagaaatcgaagatgaagtggtacggattgttgccgtagcaagggaggcaaaccccccctcccgttatgtcggtccccggactaaaatagcagtagataccctcgatcgcgatgtcgatccagttggtgcttgtatcggagccaggggatcgcgaattcaagtggtagtcaacgaattacgcggtgaaaaaatagatgtaattcgctggtcgccagacccagcaacatacatcgctaatgctttaagtccagcacgggtggatgaagtacgcctcatggacccagaatcccggcaaactcacgtactcgtggctgaagatcaattaagtttagctattgggaaagaaggacaaaacgtccgtttggcagcccgcctgactggttggaaaatagacatcaaagacaaagctaaatacgactatgccggagaagatgagaaatttaccgccgtcagagcaaaatatcagacagaggaagatgatcttgaattagacgaagaattagaagatgaaaatcaggacgaattagaagaggaggatagttttgacaataacgatgacgaataa

SEQ ID NO: 64522 - protein, 423 aa, Nostoc punctiforme PCC 73102
MVTLPGLKELIESISRERNLPRLAVQSAIREALLKGYERYRRAQNLERKQFDEDYFENFEVELDIDGEGFRVLSTKTIVEEVNNTDHQISLDEVQQVAPEAQLGDSVVLDVTPDQGEFGRMAAMQTKQVLAQKLRDQQRQMVQEEFQDLEGTVLQARVLRFERQSVVLAVSSGFGQPEVEAELPKREQLPNDNYRANATFKVYLKKVSQGQQRGPQLLVSRADAGLVVYLFANEVPEIEDEVVRIVAVAREANPPSRYVGPRTKIAVDTLDRDVDPVGACIGARGSRIQVVVNELRGEKIDVIRWSPDPATYIANALSPARVDEVRLMDPESRQTHVLVAEDQLSLAIGKEGQNVRLAARLTGWKIDIKDKAKYDYAGEDEKFTAVRAKYQTEEDDLELDEELEDENQDELEEEDSFDNNDDE

SEQ ID NO: 64523 - DNA, 933 bp, Bifidobacterium longum DJO10A
  CDS (1)..(933)
atggagcttgacgaacgttccggcaacttcaccgtgtgggccgccgacgaaattccggtcgaacccaccgaagacaacccttaccccgttcccaagctgggcgaggaatacgatgacaccccgcgtgacttcggccgtctcgccgcagccaccgcacgccaggtcatcacccagctgttccgccgcgccgaagatgagaaggtattcggttcgttctccggccagaagggcaagctcatcaccggcatcatccagcaggatgcttccgacccctccaacgtgcatgtcgcgatgggcgatgtcgaagccattctgcctcgccgtgagcaggtgcccggcgaacgttaccgccacggcgaacgcatccgcgtgtacgtggtgaacgtggcccgtggcatcaagggcccggaaatcgtggtgtcccgctcccacccggagctggtccgcaagctgttcgagcgcgaagtgccggaactggtctccggtgccgtgtccatcatggccatcgctcgtgaggccggcgcccgcaccaagatcgcggtcaaggccaacaccgatggcgtgaacccgaagggcgcgctgatcggccccggcggcgctcgcgtgcgtgccgttatggagaaccttggcccggagaagatcgacatcgtcgactactccgacgatccggccaagttcgtggcagccgcgctgtccccggctgtggccaccggcgtgcaggtgatcagcgagaagaacaagaccgccatcgccttcatccacgacgaccagctgtccctggccatcggcaaggaaggccagaacgcacgactggcagccaagctgaccggctggaagatcggcatcgaatccgccgaggcccatgccaagaaagtcgccgccgaaaaggccgcccaggctgcggccgaggctgctgctccggaagccgaatag

SEQ ID NO: 64524 - protein, 310 aa, Bifidobacterium longum DJO10A
MELDERSGNFTVWAADEIPVEPTEDNPYPVPKLGEEYDDTPRDFGRLAAATARQVITQLFRRAEDEKVFGSFSGQKGKLITGIIQQDASDPSNVHVAMGDVEAILPRREQVPGERYRHGERIRVYVVNVARGIKGPEIVVSRSHPELVRKLFEREVPELVSGAVSIMAIAREAGARTKIAVKANTDGVNPKGALIGPGGARVRAVMENLGPEKIDIVDYSDDPAKFVAAALSPAVATGVQVISEKNKTAIAFIHDDQLSLAIGKEGQNARLAAKLTGWKIGIESAEAHAKKVAAEKAAQAAAEAAAPEAE

SEQ ID NO: 64525 - DNA, 1482 bp, Actinobacillus pleuropneumoniae serovar 1 str. 4074
  CDS (1)..(1482)
atgagtaaagagattttattagccgcagaagcggtatctaacgagaagttattgccaaaagaagctatctttgaagcgcttgaaacggcattagccatttcgactaaaaagaaaaaagagatggatatcgatgtgcgtgtggtaatcgaccgtaaaaccggtgatttccaaactttccgccgctggattgtggttgagcaagtacacaatatgactcgcgagatcagtttagacgcggcgcaatacgaaaatcctagcgtgcaattaggcgatatcgttgaagacgaagtggattcgattccattcgaccgtattacgatgcaaaccgcacgccaagtgatcagtaccaaaattcgtgaagcggaacgtaataaagtgattgaacaattccgttcacaattaaataccatcattactgcaaccgttaaaaaagtaaaccgcgagcaaattatcttggatttaggtaatcaagcggaagcggtaatcgtgcgtgaagatatgcttccgcgtgaaaacttccgtccgggcgaccgtgtacgcggcgtattatatgcgattaaacctgaatcaaaaggcccgcaacttttcttaacacgtgcaaaaccggtcatgttggaagagctatttaaacttgaagtaccggaaatcggtgaagatgtcattgaaattaaaggcgcatcacgtgatccgggttctcgtgcgaaaattgcggtgaaatcacatgataaacgtatcgatccggtcggcgcttgtgtcggtatgcgcggcgcacgtgtgcaagcaattagcaacgaattgggcggcgagcgtgtggatatcgtactttgggacgataatccggcgcaattcgtgattaacgcaatggcaccggcggaagtaagcgcgattgtcgtggatgaagataagcacgcgatggatattgcggttgaaggtaaaaatttagcccaagcaatcggtcgtaacggtcagaacgtacgtttagcgacacaattaaccggctggacgttaaatgtcatgactaccgaagatttagataagaaacatcaagcggaagataacaaagttattagtttatttgtttccgcgttagaaatcgacgatgaattcgctcaattattggtggatgaaggcttctctagcttagaagaaatcgcattcattccggtaagcgaattaaccgcaattgacggtatcgaagatgaaaatctagcggaagaattacaaactcgtgcgaaaaacgcaattaccgcaaaagcgttagcggaagaagaagcgttaaaacaagcgcatattgaagatcgtttattaaatttagaaggtttagatcgccatattgcatttaaactggctgaaaaaggcatcacaacgcttgaagaactggcggaacaagcaactgacgacctttcggatattgaagaattatcagcggataaagcaagcgaattaattatggctgcacgtcaaatttgctggtttagctaa

SEQ ID NO: 64526 - protein, 493 aa, Actinobacillus pleuropneumoniae serovar 1 str. 4074
MSKEILLAAEAVSNEKLLPKEAIFEALETALAISTKKKKEMDIDVRVVIDRKTGDFQTFRRWIVVEQVHNMTREISLDAAQYENPSVQLGDIVEDEVDSIPFDRITMQTARQVISTKIREAERNKVIEQFRSQLNTIITATVKKVNREQIILDLGNQAEAVIVREDMLPRENFRPGDRVRGVLYAIKPESKGPQLFLTRAKPVMLEELFKLEVPEIGEDVIEIKGASRDPGSRAKIAVKSHDKRIDPVGACVGMRGARVQAISNELGGERVDIVLWDDNPAQFVINAMAPAEVSAIVVDEDKHAMDIAVEGKNLAQAIGRNGQNVRLATQLTGWTLNVMTTEDLDKKHQAEDNKVISLFVSALEIDDEFAQLLVDEGFSSLEEIAFIPVSELTAIDGIEDENLAEELQTRAKNAITAKALAEEEALKQAHIEDRLLNLEGLDRHIAFKLAEKGITTLEELAEQATDDLSDIEELSADKASELIMAARQICWFS

SEQ ID NO: 64527 - DNA, 1485 bp, Psychrobacter sp. 273-4
  CDS (1)..(1485)
atgagtcgtgaaatcttaacggtagtagaaactgtcagtaacgagaagggcttaaatcctgaagatatctttgaagcaattgaagatgccttggtagtctcgactaagaaaaaagtatataccgatcagccagaagtagaagtgcgggtctcaatcgaccgtgcaacgggcgattatgatacttatcgttattggacagtggttgcagatgaagaccatgaaatgcctgcttgtcagcttgcgattactgaccttgatcaagacgaatggtcaattggtgatgtcaaagaagagcaaattgagtcgattgaattcggtcgtattgctgccactcaagccaaacaagttatcatccaaaagattcgtgaagctgagcgtaatttagtagcagatgcttttgagccacgtgttggcgagatgatgtacggcgaagtcaaaaaacaaacccgtgatggttacattattgatttaggtgacaacgctgaaggttatttgtcacgtgatcagatgttgccacgtgagcagctgcgtgcaaaatcgcgtatcaatgctattttgtatcatgtgaaccgtgaaaaccgcggcgcacagttattattgtcacgtacgcatcctgaaatgctctcggcattgatgcaaaaagaagtgcctgagattgcagaacaaatcatcgaaattcgtaatgtcgctcgcttgccgggtactcgtgctaaaatagcggttaagaccaacgatcatcgtatcgatccggttggtgcttgtatcggtatgcgtggtacacgtatccaagcggtacagcaagagcttgatggcgagcgtattgatgtggtggtttggtcagatgatcctgcccaatttatcatcagctctttggagcccgcagacgtaagcagtatcatcttagatgaagatacgcagtcggctgatattatctttagcaccaacgatcaattggcgcgtgcaattggctcacaaggtcaaaacgtacgcttagcctctgagctgaccggctataagctgaatatgatgctagaagaagagtatcagcagcgtcaagcaaacgaatctaaagcttttattgaactattctatgaacgtctagaagtggataaagacttagcacaagcgcttgtcgatattggttttaccagtattgaagaagtggcttatgtaccagtcgaaaccttctacgatatcgagggattagatgatgacgcgattgatatgatccaagagcgtgcaaaagaagtggtcatcgcagacgaattggtcaaacaacagaacatgaaagagccaagtcaagaactacaagatcttgaaggaatgacggtcagttgggcttataaaatggctcaaaaagacatcattaccgttgatgacttggcagaacaagccgtctttgatttagaagatatcgaagatttagataccgaaaccgcaggaaaactcatcatgaaagctcgggaatcttggttcaatgaataa

SEQ ID NO: 64528 - protein, 494 aa, Psychrobacter sp. 273-4
MSREILTVVETVSNEKGLNPEDIFEAIEDALVVSTKKKVYTDQPEVEVRVSIDRATGDYDTYRYWTVVADEDHEMPACQLAITDLDQDEWSIGDVKEEQIESIEFGRIAATQAKQVIIQKIREAERNLVADAFEPRVGEMMYGEVKKQTRDGYIIDLGDNAEGYLSRDQMLPREQLRAKSRINAILYHVNRENRGAQLLLSRTHPEMLSALMQKEVPEIAEQIIEIRNVARLPGTRAKIAVKTNDHRIDPVGACIGMRGTRIQAVQQELDGERIDVVVWSDDPAQFIISSLEPADVSSIILDEDTQSADIIFSTNDQLARAIGSQGQNVRLASELTGYKLNMMLEEEYQQRQANESKAFIELFYERLEVDKDLAQALVDIGFTSIEEVAYVPVETFYDIEGLDDDAIDMIQERAKEVVIADELVKQQNMKEPSQELQDLEGMTVSWAYKMAQKDIITVDDLAEQAVFDLEDIEDLDTETAGKLIMKARESWFNE

SEQ ID NO: 64529 - DNA, 1473 bp, Dechloromonas aromatica RCB
  CDS (1)..(1473)
atgagccgtgaaattttgctgctggtcgatgctctggcccgcgaaaaaaatgtcagcaaggagatcgtctttggcgcccttgagctggcactcgcgtcagcgaccaaaaagcgcatcaatgacgaggccgatgttcgtatctcaatcgatcgcgacactggtagcttcgaatcattccgtcgctggcaggttgtgccggataacgaatacgtcaacgaattcctcgaaattccgttgtccgatgcccagaaggatgatcctgaaatcgagcccggcgactctctggaagagccgcttgagccgatcgattttggtcgtatcggtgctcaggctgccaaacaggttattttgcagaagatccgcgacgccgagcgcgagcagattctggctgactttcttggtcgcggcgagcatgtcgtttccggtaccatcaagcgcatggagcgtggcaacgccattattgaggctggtaaaattgaagccatgctgccgcgcgaccagatgatccccaaggaaaatctgcgtgtcggcgacagagttcgtgcctatttgctgcgcattgatcgcaatgcccgtggtccgcaaatcatcctttcgcgcaccgctccggaatttgtcatcaagctttttgacatggaagtgccggaaatttccgatggcctgatggaactcaaggcctgtgcccgtgaccccggtctgcgcgccaaaatcgctgtcaagtcgaacgatccccgtgttgatccaatcggtacctgcgtcggtttgcgcggttcccgggttaccgccgttcgtaacgaaatcggtggcgagaatatcgacatcgtgctgtggtcagccgatccggcgcaattcgttatcggcgcgttgtcgccagctgaagtgtcctccatcgtggttgatgaagaaaagcacgcaatggatgtcgtggtcgacgaggataaccttgcgatcgccatcggtcgcaacgggcagaacgttcgcctggcctccgaactgactggctggaccatcaatctgatgacgcaggacgagtcggccaagaaatccgaagccgaattcgccgagacgcgcgtcgtctttatggaaaagctggatatcgatgaagaacttgccgatctgctgatcgaggaagggttctcgacgctggaagaagtggcctacgtgccgctggcagaaatgctggaaatcgaaggtctggatgaggaaatcgtaaatgagttgcgtaatcgggctcgtaacgtcctgctcaccgaggctatcgcaactgaagaaaagctggaaagtgtttccgaagacctgattggtctcgaaggcatgagcaaggaactggccgccaaactggctggacacgatgtcaaaacccgggatgatctcgcggaattggctgttgatgaattgacggaaatgaccggcattgacgatgagcgtgccaaggatcttatcctgaaggcacgggctcactggttcgagtga

SEQ ID NO: 64530 - protein, 490 aa, Dechloromonas aromatica RCB
MSREILLLVDALAREKNVSKEIVFGALELALASATKKRINDEADVRISIDRDTGSFESFRRWQVVPDNEYVNEFLEIPLSDAQKDDPEIEPGDSLEEPLEPIDFGRIGAQAAKQVILQKIRDAEREQILADFLGRGEHVVSGTIKRMERGNAIIEAGKIEAMLPRDQMIPKENLRVGDRVRAYLLRIDRNARGPQIILSRTAPEFVIKLFDMEVPEISDGLMELKACARDPGLRAKIAVKSNDPRVDPIGTCVGLRGSRVTAVRNEIGGENIDIVLWSADPAQFVIGALSPAEVSSIVVDEEKHAMDVVVDEDNLAIAIGRNGQNVRLASELTGWTINLMTQDESAKKSEAEFAETRVVFMEKLDIDEELADLLIEEGFSTLEEVAYVPLAEMLEIEGLDEEIVNELRNRARNVLLTEAIATEEKLESVSEDLIGLEGMSKELAAKLAGHDVKTRDDLAELAVDELTEMTGIDDERAKDLILKARAHWFE

SEQ ID NO: 64531 - DNA, 1488 bp, Haemophilus influenzae R2846
  CDS (1)..(1488)
atgagtaaagaaattttactggcggcggaagctgtatccaatgaaaaattattaccacgtgagaaaatttttgaagcattagagagtgcgattgcgatttctactaagaagaagtttgaatatgaaacggatattcgcgtttcaattaatcccaaaacaggagaatttgatacttttcgccgttggttagtcgtagatgaagtaaaagtaccaacgaaggaaattactttggaagcggcgcaatttgatgatccaaatttgcaacttggagagtatgtagaagatcaaattgaatctattgcatttgaccgtattgcaatgcaaacagcacgtcaagttattagcactaaaattcgtgaagccgaacgtgcaaaagtggttgaacaatttcgtgaagaagaaggaaaaattgtaacaggcactgtaaaaaaagtaagtcgagacagtattattttagatcttggcaataaagcggaagcgatgattgcacgtgaagatatgttaccacgtgaaaacttccgtccgggagatcgtgttcgtggggtgctttataaagtaaatcctgaaggcaaaactgcacaattatttgtgacacgttctaaaccagaaatgttgatcgaattattccgtattgaagtgcctgaaattggcgaagaaatgattgaaattcgtggtgcagctcgtgatgctggctctcgcgctaaaattgcagtgaaatcaaatgataagcgaattgatccagttggtgcttgtgtaggaatgcgtggtgcgcgtgttcaagccattaccaatgaacttggtggtgagcgtgtagatatcgtgctttgggatgataatccagcacaatttgtgattaatgcgatggcgcctgcggatgtttcttctattatcgttgatgaagataatcattctatggatattgctgttgaagctgataatcttgctcaagccattggtcgtaatggtcaaaacgtgcgtttagcaacacaattaacaggttggacactaaacgtaatgacgactgatgagttaaatgctaagcatcaagcagaagataacaaagtgttaaatttatttattaacgcattagaacttgatgaagaatttgctcaaatccttgtagaagaaggcttcacaagtttagaagaaattgcttatgtgccaatgaatgaattgacagcaattgatggtttggaagatgaagatcttgttgaagaacttcaaactcgtgctaaaaatgcgattacagccgcagcagtagctgaagaagaggcattgaaaaaagcaaatattgaagatcgcttattgaatttagatggtatgaatcgccatgtggcattcagattagctgaaaaacaaattactactctcgaagaactcgccgaacagggtgtagatgatttagcagatattgaagaattaacagcagaacaggcagcagatttaattatggctgcacgtaatatctgttggtttggcgaagaataa

SEQ ID NO: 64532 - protein, 495 aa, Haemophilus influenzae R2846
MSKEILLAAEAVSNEKLLPREKIFEALESAIAISTKKKFEYETDIRVSINPKTGEFDTFRRWLVVDEVKVPTKEITLEAAQFDDPNLQLGEYVEDQIESIAFDRIAMQTARQVISTKIREAERAKVVEQFREEEGKIVTGTVKKVSRDSIILDLGNKAEAMIAREDMLPRENFRPGDRVRGVLYKVNPEGKTAQLFVTRSKPEMLIELFRIEVPEIGEEMIEIRGAARDAGSRAKIAVKSNDKRIDPVGACVGMRGARVQAITNELGGERVDIVLWDDNPAQFVINAMAPADVSSIIVDEDNHSMDIAVEADNLAQAIGRNGQNVRLATQLTGWTLNVMTTDELNAKHQAEDNKVLNLFINALELDEEFAQILVEEGFTSLEEIAYVPMNELTAIDGLEDEDLVEELQTRAKNAITAAAVAEEEALKKANIEDRLLNLDGMNRHVAFRLAEKQITTLEELAEQGVDDLADIEELTAEQAADLIMAARNICWFGEE

SEQ ID NO: 64533 - DNA, 1467 bp, Methylobacillus flagellatus KT
  CDS (1)..(1467)
atgagtcgcgaaatattgttattggtcgatgcgttggcccatgagaagaatgtggccaaaaccgttatttttacggcattggagctggctctggcctctgctaccaaaaaacgttttactgaagatgctgatgttcgtgtggaaattgatcgcgacagtggagagtatcgttctttccgccgttggcaggtggtcgaggcagatgcgttggaaaatcctgccgcacagattgcggtggatgatgcacgtgccgagggatttgccgtaggcgactatattgaagagcctctagagtcagtggagtttgggcgtattggggcccaggctgccaagcaggttattctgcaaaaggtgcgtgaggccgagcgagagcagattctggatgattttttagcgcgcaaggaacatttggtgacaggagtcatcaagcgcatggaaaaaggcaacgctatcattgaggttggtcgtcttgagtctgtgctgcctcgtgagcaaatgatccctaaggaaaacttgcgggtcggcgatcgtgtgcgtgcctatctttctcgtattgagcgtagtgggcgtggcccacaactcattctttcccgtgtggcgcctgaattcttgattaagctgttcgagctcgaagtgccggagattgaagagggcttgctggagattaagtcggctgcgcgcgatccaggcttacgatccaagattgcagtgaagtcgaatgaccagcgattggacccagtcgggacttgtgtgggcatgcgtggttcgcgtgtgcaggctgtgacaggagagttggcaggtgagcgtgtcgatatcgtcttgtggtccatggatcctgcccagttcgtcatcaatgcgatggctcccgcagaagtgtccggcattgtggtggatgaagacgcgcacagcatggatgtcatcgtcgatgaagagcaattggcccaggcgatcggtcgcaacgggcagaatgtgcgccttgcttcggagctgacgggttggacattaaatatcctcactgaggaagaggctgctaaaaagagcgaggaagaacatagcagcatcttgcagctttttgtcgagaagctggatgtcgatgaagaggttgctgatatcctggtgcaggaaggattcagtaccctggaagaaatcgcctatgtgcctttggctgaaatgagcgagatcgaggctttcgatgaagatactatcaatgaattgcgcaagcgtgcccgcgctgccttgttgaccgaagcgattgccaaggaagagaaggccggagaagcttctgaggatttgctgcatatggaaggcatggacgaagcgactgcgcggactctggctggtaaaggtgtagccacaatggatgatttggcagaccttgccgtagatgacttggttgaattgacaggcatggatgtagagcgcgccaagcaattgatcatgacggcgcgtgccccctggtttgcttga

SEQ ID NO: 64534 - protein, 488 aa, Methylobacillus flagellatus KT
MSREILLLVDALAHEKNVAKTVIFTALELALASATKKRFTEDADVRVEIDRDSGEYRSFRRWQVVEADALENPAAQIAVDDARAEGFAVGDYIEEPLESVEFGRIGAQAAKQVILQKVREAEREQILDDFLARKEHLVTGVIKRMEKGNAIIEVGRLESVLPREQMIPKENLRVGDRVRAYLSRIERSGRGPQLILSRVAPEFLIKLFELEVPEIEEGLLEIKSAARDPGLRSKIAVKSNDQRLDPVGTCVGMRGSRVQAVTGELAGERVDIVLWSMDPAQFVINAMAPAEVSGIVVDEDAHSMDVIVDEEQLAQAIGRNGQNVRLASELTGWTLNILTEEEAAKKSEEEHSSILQLFVEKLDVDEEVADILVQEGFSTLEEIAYVPLAEMSEIEAFDEDTINELRKRARAALLTEAIAKEEKAGEASEDLLHMEGMDEATARTLAGKGVATMDDLADLAVDDLVELTGMDVERAKQLIMTARAPWFA

SEQ ID NO: 64535 - DNA, 1275 bp, Crocosphaera watsonii WH 8501
  CDS (1)..(1275)
atgtcattagttagtttaccgggattgagccagatgatcgaagaaattagtcaaaggcataacttacccaaatcatcggttcaagaagctctcaaagaagctttaatcaaaggttatgagaggtttcgccgttctcaaagtttagatcgtcaacaattttatgacgaatattttgataattttgaagtagaactggacacagacgacgaggggtttcgtattctttccactaaaaaaattgtcgaagaagtagaaaatatcgaccatcatatctccctagaagaagttcaagaagtggcaccagaagcagaacttggtgatgaagtagtcttagatgtaaccccgaatcaaaaagattttggtcgcatggccgccattcaaaccaaacaagtcctactccagaaattacgggaccagcagcgcaaacttatccaagaagaatttaacgaactagaaggcactgttctcaatgctagggttttacgttttgagagacaagacatcattgtagccgtacaaagtgcttttggtcagcccgaagttgacgctattttacccaaacgagagcaacttcccaacgataattatcgagccaatgcctcctttaaagtattactgaaaaaagttagagaaggctcccatcgtgggccccaattattggtttcccgtggtgctgccgggttagttgtggatatgttttctgtggaagtaccagaaatagaagaagatatcgtccgcattgtagcggtttctcgggaagctaaccctccctcccgttatgtcggccctagaacaaaaattgctgtagataccctcgaacgagatgttgatcccgtcggagcctgtattggggcaagaggatctcgtattcaagcagtggttaatgaactcaggggagaaaaaatagatgttattcgttggtctcccgatcctgccacctatattgccaatgctttgagtccggcccgtgtagatgaagtagtgttattaaacgccgaagaacgtcatgctttggtattagtccccgaagatcaactcagtctagctattgggaaagaaggtcaaaacgttcgcttagctgcccgtttaacaggatggaaaattgatatcaaagatattgttctttataaagctgaagcggagaaacaacaactagaagcagaaaccaatgaagaaatcgattacgaggacgaggaatctccattagaagaaatgactctaaccccagaaaaccacgacctcgatgaagataacgagacagaaaatcaagagtaa

SEQ ID NO: 64536 - protein, 424 aa, Crocosphaera watsonii WH 8501
MSLVSLPGLSQMIEEISQRHNLPKSSVQEALKEALIKGYERFRRSQSLDRQQFYDEYFDNFEVELDTDDEGFRILSTKKIVEEVENIDHHISLEEVQEVAPEAELGDEVVLDVTPNQKDFGRMAAIQTKQVLLQKLRDQQRKLIQEEFNELEGTVLNARVLRFERQDIIVAVQSAFGQPEVDAILPKREQLPNDNYRANASFKVLLKKVREGSHRGPQLLVSRGAAGLVVDMFSVEVPEIEEDIVRIVAVSREANPPSRYVGPRTKIAVDTLERDVDPVGACIGARGSRIQAVVNELRGEKIDVIRWSPDPATYIANALSPARVDEVVLLNAEERHALVLVPEDQLSLAIGKEGQNVRLAARLTGWKIDIKDIVLYKAEAEKQQLEAETNEEIDYEDEESPLEEMTLTPENHDLDEDNETENQE

SEQ ID NO: 64537 - DNA, 1128 bp, Exiguobacterium sp. 255-15
  CDS (1)..(1128)
atgggaccacagttacttgaagcaatcgaacaaatcgctaaagaaaaagagattgataagaatatcatcatcgatgcgctcgaacaggcattgatttccgcttaccgtcgcaactttggaaaagagtcggaggcagtaaaagtcgagtttgatcaacagacaggagatatccgtgtcttcgccttgaaagaggtcgttgaacgcttgacgcagccggaagaacagctttcactcgaggaagcacacgaaatcgatccgacgtatgaactcggtgatttccacaaagttgaagtgacaccaggtgattttggacgtgttgcagcacaaacggccaaacaaatcgtcacacaaaagatgcgcgaagcagaacgggaacgcatttacaatcatttcgcggaccgggaagatgaaatcatgacggggatggtcgaacgtcaagatgcgcgtaatctatacgttaacctcgaaggtattgaagcggtcttgacgacacacgaacagatgccgaatgaacgttttggaattcgggaatacatcaaagtatacgtgacgaaagtcgatccgatggtcaaaggatcaggcgcatcgattctcgtatcgcggacgcacccgggcttattaaaacgactgtttgaaatcgaagtaccggaaatcgcgagcggcgaagtcgaagtgaagtcggtggcacgtgaagccggcgaccgttcgaaaattgccgttgcttctgacgaaatcgatcctgtcggcgcatgtgtaggtcaaaaaggcgcacgtgttcaacgcatcgtcaacgaattgaacggtgaaaagattgatatcgtccgttattcagatgatccgaaagaatacgttgccaatgctttaagcccggcacaagttgttgctgtatacgtcaacgaaccggctaaagcaacaatcgtcgtcgtccctgacttccaattgtcactcgcaatcggaaaacgcggtcaaaatgcccgtctggccgccaagttgacaggatggaaaatcgacatcaagagcgaatcagaagcagaatcgatggaattgaaggatgtcttcatgaaagtcgaacctgcgacagcagaagcagttggcgtggaaacggtccaagtcgaaggcgaggaataa

SEQ ID NO: 64538 - protein, 375 aa, Exiguobacterium sp. 255-15
MGPQLLEAIEQIAKEKEIDKNIIIDALEQALISAYRRNFGKESEAVKVEFDQQTGDIRVFALKEVVERLTQPEEQLSLEEAHEIDPTYELGDFHKVEVTPGDFGRVAAQTAKQIVTQKMREAERERIYNHFADREDEIMTGMVERQDARNLYVNLEGIEAVLTTHEQMPNERFGIREYIKVYVTKVDPMVKGSGASILVSRTHPGLLKRLFEIEVPEIASGEVEVKSVAREAGDRSKIAVASDEIDPVGACVGQKGARVQRIVNELNGEKIDIVRYSDDPKEYVANALSPAQVVAVYVNEPAKATIVVVPDFQLSLAIGKRGQNARLAAKLTGWKIDIKSESEAESMELKDVFMKVEPATAEAVGVETVQVEGEE

SEQ ID NO: 64539 - DNA, 1611 bp, Mesorhizobium sp. BNC1
  CDS (1)..(1611)
atgaacatggctgtcagtgcaaacaggctggagctcttgcagatcgctgatgcggtggctcgcgagaaatcgatcgacaagacgatcgtaattcaggcgatggcggatgctatccagaaggccgctcgctcgcgctatggccaggaaaccaacatccgcgcggacatcaacgctcaaacgggcgagatgaagctgcaaaggctgatggaagttgtcgagaatgtggaagaacccgcacggcagatttccattgtagacgcgcgcacgcgcaatccggatgcgcaggctggcgattttatcgcggagcagcttccgccgatggatttcggccgtatcgctgcgcagtcggccaaacaggtgatcgttcagaaagtgcgcgaggccgagcgcgaccggcagtatgaggaatataaggatcgcgtaggcgagatcgtcaacggcacggtcaagcgcgtggaatatgggaacgtgattgtggatcttggccgcggcgagggcattatccgccgtgacgaattgatcccgcgcgagtctttcaaatatggcgatcgcgttcgtgcctatgtctatgacgtgcgtcgcgagcagcggggcccgcagatctttctttcccgcacccatccgcaattcatggcgaagctcttcaccatggaggtgccggagatttatgacgggatcatcgagatcaaatcggtggcccgcgatccgggcagccgcgccaagattgcggtgatcagccacgattcctcgatcgacccggtcggcgcctgcgtgggtatgcgcgggtccagggttcaggccgtggtggccgagctccagggggagaagatcgacatcattccctggaacgagaacgcggcgagcttcatcgtcaatgcgcttcagccggcggaagtctcgaaagtcgtgctcgacgaagacgccgagcgcatcgaggtggttgttcccgacgaccagctttcccttgccattggacgtcgcggccagaacgtgcggcttgcctcccagctcaccggctgggacatcgacatcctgacggaggaagaggagtctcagcgccggcagaaagagttcaccgaacgctcgaacctctttatggacgctctcaacgtcgatgaaatggtcggccaggtgctggcgtccgaagggttcaccagcgtcgaggaaatcgcctatgtggacgcggacgaaatctcttctatcgacggcttcgacgaggatacggccgaggagattcaggcgcgtgcccgggaatatctcgagcgcatcgaggctgaacgggatgccaagcgcagagaactcggtgtctccgacgatctgcgcgaaattcctggcatgaccactgcaatgatggtcaagctcggcgaggacggcgtaaaaaccatagaggatttcgcgggctatgcggttgacgacctcgtaggctggagggagcgcaaggacggtgagaacaagttcttcccgggcgtcttttcagatctcgacctcagccgcgccgaggcggaacagatggtggtcgcagctcgtctgaagatgggctggatcagcgaagatgacctgcagtcggaagccgaggaagaaaccgaggaaacccagccgatggaaggctga

SEQ ID NO: 64540 - protein, 536 aa, Mesorhizobium sp. BNC1
MNMAVSANRLELLQIADAVAREKSIDKTIVIQAMADAIQKAARSRYGQETNIRADINAQTGEMKLQRLMEVVENVEEPARQISIVDARTRNPDAQAGDFIAEQLPPMDFGRIAAQSAKQVIVQKVREAERDRQYEEYKDRVGEIVNGTVKRVEYGNVIVDLGRGEGIIRRDELIPRESFKYGDRVRAYVYDVRREQRGPQIFLSRTHPQFMAKLFTMEVPEIYDGIIEIKSVARDPGSRAKIAVISHDSSIDPVGACVGMRGSRVQAVVAELQGEKIDIIPWNENAASFIVNALQPAEVSKVVLDEDAERIEVVVPDDQLSLAIGRRGQNVRLASQLTGWDIDILTEEEESQRRQKEFTERSNLFMDALNVDEMVGQVLASEGFTSVEEIAYVDADEISSIDGFDEDTAEEIQARAREYLERIEAERDAKRRELGVSDDLREIPGMTTAMMVKLGEDGVKTIEDFAGYAVDDLVGWRERKDGENKFFPGVFSDLDLSRAEAEQMVVAARLKMGWISEDDLQSEAEEETEETQPMEG

SEQ ID NO: 64541 - DNA, 1146 bp, Rubrobacter xylanophilus DSM 9941
  CDS (1)..(1146)
atgaataccgcgctgctttcggcactgcacgagatcgagaccgagaagggcattcccttcgagaccgtcaagcgggttctcgaggagtccctgctcgccgcctacagggagcgcgagggggcggtcgagggcgccgaggtcgtcctggaccgggagacgggcgacctgcgggtgatgaaggacggcgaggacatcacccccgaggacttcgacttcacccggatagcggcctccctgatgcggcagaacttcatgcagcgcctcaacgaggtgcacaaccagcagctggtcaaggagtacggcgagcgcatcggggacgtcgtcaccgggatcgtccagcaggcccaccggcggatgacgatcatagacctgggccgggtggaggcgctcttgccggccagcgagcaggtgccgggcgagcgctacgagaacggccagcgcctgaaggtctacctcctggacataaaggaggccgggcgggggccgagcatcatcgtcagccgcaggcacgaggggcttctgcggggcctgttcgagctggaggtgcccgagatctacgacggcctcgtggagataaaggccgtggcccgggaggccgggctgcgctcgaaggtcgccgtgtggtccaacgagccggggatagacccggtgggggcctgcgtggggccgcggggcagccgggtgcgggccgtggtctccgagctcaggaacgagaagatagacatcatccagtgggaccccgacccggcgcggttcatcgcgaaggcgctctcgccggcgcgggtgcgggaggtgtacctggacgaggaggagaagcaggccgaggtgatcgtgccggacgaccagctctcgctggccatcggccgcgagggccagaacgcccgcctcgccgtgaagctgaccgactggaagatagacatcaagcccgagagccaggccgtcgagtacgaggaggaggacgagtgggagcccgacgagggctcgagcatgcaccgctgccgggcggtcctctccaacgggaagcggtgcgccaacatggcgctgcccggctccctcttctgcggcataccgtcgcaccaggcccaggccaaggagttcgagggcctgaccgagggctcgcaggaggaggaggtggcggatgagtaa

SEQ ID NO: 64542 - protein, 381 aa, Rubrobacter xylanophilus DSM 9941
MNTALLSALHEIETEKGIPFETVKRVLEESLLAAYREREGAVEGAEVVLDRETGDLRVMKDGEDITPEDFDFTRIAASLMRQNFMQRLNEVHNQQLVKEYGERIGDVVTGIVQQAHRRMTIIDLGRVEALLPASEQVPGERYENGQRLKVYLLDIKEAGRGPSIIVSRRHEGLLRGLFELEVPEIYDGLVEIKAVAREAGLRSKVAVWSNEPGIDPVGACVGPRGSRVRAVVSELRNEKIDIIQWDPDPARFIAKALSPARVREVYLDEEEKQAEVIVPDDQLSLAIGREGQNARLAVKLTDWKIDIKPESQAVEYEEEDEWEPDEGSSMHRCRAVLSNGKRCANMALPGSLFCGIPSHQAQAKEFEGLTEGSQEEEVADE

SEQ ID NO: 64543 - DNA, 1554 bp, Ehrlichia canis str. Jake
  CDS (1)..(1554)
atggttaatctacagaattttgataacttagaattaataagggtggctaaggatattgctgaccaaaaaggcttaaatttggatataataataagggctatagaagaagctattcaattaactagccgcagtaagtatggaaattgtaagattaaagttacagtagatagaaaaactggtgttgtgtcaacttatagacaagtattagttattaatgataatggtgaaattgttattcctgaaaataagaaaagtgaaatagattcttctgatataagcaaatataagttgattactttaacggaagctaagcaaattgatgaaaatgctgaggttggagatataatgctagagcatttacctgttattgatcttgattatagttctgctaagattgcaaagcaaaaaattgctcaagttattatatcagaagagcgtaaaaagcaatatgaagattttaaagatcgtataggtgatattgtttatggtactgctaaacgtatagaatataataatgttattgtagatttaaatggaaatgaaggttatttatcagctgcaaatttaataaaaggtgaagtatttcgtgttggagacagagtaaaagcacatatagaggatgtaagaaaagaaaattcaggacctcaaatatttctttcaagaataagtaaaggatttatggaacaattgttcaagcaagaaattccagaaatatatgatggaatagtgacaattaaggcaatagcgagagatccaggatctaggtcaaaggttgctgttttttcttcagataaaaatattgatccagttggtgcgtgtgttggtgcaagaggtgtaaggattcagagtattatttatgaattgcatggtgagaaaattgatgtaattttatattctccagaacttgctaaatttatagttaatgctatagctccagcagaggttttaaaggttattattgatgaagataaagaaaaagtagaattaatcattcctgaaaatcagctaagtttagcaattggtagatatggacagaatattagattagcatcggaattgattggttggaaaatagatgtaataggtgatgaaactgaatctagtagaaaagcaaaagaattaagtgaaggatcaaaaatatttgttgaagggttagatgttgaggaaataataggacaattattgtttactgaaggatttgttagtattgaggatatagatcaagcatctgttagtgatattgctgcaatagatgggtttaatgaagagatagcagaagagttaaaaagtagagcagctgattatttgacgcgtaaagatgctgaaataaagcaaattttagataatttatcagttgataaggatgttactactttgccatttttaaaaccaagtgatattatagcattgtctgagaatggtattaaaagtcttgaagatattgctgggttatgtacagatgaatttttcgatattgttcctaatattgcgttaactaaggatcaaattgactctgttatattagagtctcgtaaaaaaataggatggttataa

SEQ ID NO: 64544 - protein, 517 aa, Ehrlichia canis str. Jake
MVNLQNFDNLELIRVAKDIADQKGLNLDIIIRAIEEAIQLTSRSKYGNCKIKVTVDRKTGVVSTYRQVLVINDNGEIVIPENKKSEIDSSDISKYKLITLTEAKQIDENAEVGDIMLEHLPVIDLDYSSAKIAKQKIAQVIISEERKKQYEDFKDRIGDIVYGTAKRIEYNNVIVDLNGNEGYLSAANLIKGEVFRVGDRVKAHIEDVRKENSGPQIFLSRISKGFMEQLFKQEIPEIYDGIVTIKAIARDPGSRSKVAVFSSDKNIDPVGACVGARGVRIQSIIYELHGEKIDVILYSPELAKFIVNAIAPAEVLKVIIDEDKEKVELIIPENQLSLAIGRYGQNIRLASELIGWKIDVIGDETESSRKAKELSEGSKIFVEGLDVEEIIGQLLFTEGFVSIEDIDQASVSDIAAIDGFNEEIAEELKSRAADYLTRKDAEIKQILDNLSVDKDVTTLPFLKPSDIIALSENGIKSLEDIAGLCTDEFFDIVPNIALTKDQIDSVILESRKKIGWL

SEQ ID NO: 64545 - DNA, 1479 bp, Rubrivivax gelatinosus PM1
  CDS (1)..(1479)
atgaaccgcgatctgttggactttgtggatgcgatcgctcgcgagaagagcgtcgagcgtgatgtcgtgttcgaggccgtcgaggcggcgctcgcctcggcgagcaagaaactgcatggcggcgaggtcgacatccgcgtatcggtcgaccgcgacacgggcgagtacgaaacgtttcgccgctggctcgtcgtgcccgacagcgccggcctgcagaacgccgacgccgaggaactgctgaccgatgcccgcgaccgcatcgaagacatcgaggaaggcgactacatcgaggaagccatcgagtcggtgtcgatcgggcgcatcggtgcgcaggccgccaagcaggtgatcctgcagaaggtgcgcgacgccgagcgcgagcagttgctcaatgacttcctgtcgcgcggcgacaagatcttcgtcggcaccgtcaagcgcctcgacaagggcgacctcgtcgtcgagagcggccgggtcgaggggcgtctgaagcgaagtgagctgattgccaaggaaaacctccgcaccggcgaccgcgttcgcgcctacatcacggaagtggacaccacgcaacgcgggccgcagatcatgctgtcgcgcagcgcacctggcttcatggtggaactgttccgccacgaggttccggagatcgagcagggcctgctcgagatcaaaagctgcgcccgagatgcaggttcgcgcgccaagatcgccgtgctgtcgcacgacaagcgggtcgacccgatcggcacctgcgtgggtgtgcgcggctcgcgcgtcaatgccgtcaccaacgaactggctggcgagcgtgtcgacatcgtgctgtggtcggccgatccggcgcagttcgtgatcggcgcgttggcgccggccaatgtgcagtcgatcgtggtcgacgaggaaaagcatgcgatggacgtggtggtcgacgaggagaacctcgccatcgccatcggccgcggcggccagaatgtgcgcctcgcttctgagctgaccggctggcgcatcaacatcatgagcgccgaggagtcgcaggacaagcaggcgaccgaatcggagtcgatccgcaagctgtttgtcgagaagctcgacgtcgatgccgaggtggccgacatcctgatcgccgagggcttcaccagcctcgaggaagtggcctacgtgccgctgcaggaaatgctggagatggagtccttcgatgaggacaccgtccacgagttgcgcacgcgggccaaggacgcactgctgacgatggagatcgcccaggaagagaagctcgaaagcgtttcgcaggatctgcgcgacctcgaggggctcgacgccgagctgatcgccaggctggccgaaggcggcatccacacgcgcgacgacctggccgatctcgcggtcgacgaactgaccgagctgaccggcgtggccgacgagcaggcgaaggccctgatcatgaaggcgcgcgagcactggttcactgcctga

SEQ ID NO: 64546 - protein, 492 aa, Rubrivivax gelatinosus PM1
MNRDLLDFVDAIAREKSVERDVVFEAVEAALASASKKLHGGEVDIRVSVDRDTGEYETFRRWLVVPDSAGLQNADAEELLTDARDRIEDIEEGDYIEEAIESVSIGRIGAQAAKQVILQKVRDAEREQLLNDFLSRGDKIFVGTVKRLDKGDLVVESGRVEGRLKRSELIAKENLRTGDRVRAYITEVDTTQRGPQIMLSRSAPGFMVELFRHEVPEIEQGLLEIKSCARDAGSRAKIAVLSHDKRVDPIGTCVGVRGSRVNAVTNELAGERVDIVLWSADPAQFVIGALAPANVQSIVVDEEKHAMDVVVDEENLAIAIGRGGQNVRLASELTGWRINIMSAEESQDKQATESESIRKLFVEKLDVDAEVADILIAEGFTSLEEVAYVPLQEMLEMESFDEDTVHELRTRAKDALLTMEIAQEEKLESVSQDLRDLEGLDAELIARLAEGGIHTRDDLADLAVDELTELTGVADEQAKALIMKAREHWFTA

SEQ ID NO: 64547 - DNA, 1551 bp, Rhodospirillum rubrum
  CDS (1)..(1551)
atggaacgaaccgttggcatgagccggcccgaactagtccaggtggccgataccgtggcccgcgacaagagcatcgagcgcgaggaagtgttcgccgccatggagcaggccattcagaaggccggtcgctccaaatacggccatgaacacgatatccgggcgcgcatcgatcgcaagaccggcgaaatccgtctggcccgttacatcgaagtggtcgaggaggtggagaacgaattcacccagatcaccctggccggcgccaagcgcaagaaagccgatatcgaactgggtgaattcctggtcgatcccctgccccccatcgacttcgggcggatcgccgcccagaccgccaagcaggtgatcgttcagaaggtccgcgacgccgagcgcgagcgccagttcgccgaatacaaggatcgcctgggcgagatcatcaatggtctggtcaagcgcgtcgaattcggcaatgtcatcgtcgacatgggccgggccgaagcgctgctgcgccgggacgaggtcatcccgcgcgagcacttcaagaacggcgaccgcatccgcgcctatatcatggacgttcgccaggaaccccgcggcccgcagatcttcctgtcgcggacccacgagcagttcatggccaagctgttcgcccaggaagtgcccgaaatctacgacggcatcatcgagatcaaatcggtggcgcgcgatcccggatcgcgcgccaagatcgccgtgctgtccaacgaccacgccatcgatccggtcggcgcctgcgtcggcatgcgcggcagccgcgttcaggcggtggtcgccgagcttcagggcgagaagatcgacatcattcaatgggcgaccgatccggcgaccttcgtcgtcaacgccctggccccggccgaggtcgccaaggtcgtgcttgacgaggaagccaaccgcatcgaagtggtggtgcccgacgagcaattgtcgctggccatcggccggcgcgggcagaacgtccgtctggcctcgaagctgaccggctgggatatcgatatcctgaccgaggccgaggaaagcgaacgccgccaggacgaattccgcatccgcacccaggccttcatcgaagccctggacgttgacgacgtcatcgcccaccttctggtgaccgaaggcttcaccaccgtcgaggacgtggccttcgtggccattgccgagttgagcgagatcgaaggcttcgacgaggacgtggcctccgagctgcagaaccgcgcccaggtcttcctggccgaacgcgagcgtttgaacgaagagcgccgcaaggaactgggcgtcgtcgacgagatggccgaaatcgaggggctgaccgccgccatgctggtcgccctgggcgaaaagggcgtgaaaaccctcgacgatctcggcgatctggccagcgacgaattgatcgagatcgttggcggcctgaatgaggacgacgccaacgccgtgatcatggcggcgcgcgcccattggttcggcgaagccggcgactcggccgacgacgcgacggcgaagaccccggagcaggatgcctga

SEQ ID NO: 64548 - protein, 516 aa, Rhodospirillum rubrum
MERTVGMSRPELVQVADTVARDKSIEREEVFAAMEQAIQKAGRSKYGHEHDIRARIDRKTGEIRLARYIEVVEEVENEFTQITLAGAKRKKADIELGEFLVDPLPPIDFGRIAAQTAKQVIVQKVRDAERERQFAEYKDRLGEIINGLVKRVEFGNVIVDMGRAEALLRRDEVIPREHFKNGDRIRAYIMDVRQEPRGPQIFLSRTHEQFMAKLFAQEVPEIYDGIIEIKSVARDPGSRAKIAVLSNDHAIDPVGACVGMRGSRVQAVVAELQGEKIDIIQWATDPATFVVNALAPAEVAKVVLDEEANRIEVVVPDEQLSLAIGRRGQNVRLASKLTGWDIDILTEAEESERRQDEFRIRTQAFIEALDVDDVIAHLLVTEGFTTVEDVAFVAIAELSEIEGFDEDVASELQNRAQVFLAERERLNEERRKELGVVDEMAEIEGLTAAMLVALGEKGVKTLDDLGDLASDELIEIVGGLNEDDANAVIMAARAHWFGEAGDSADDATAKTPEQDA

SEQ ID NO: 64549 - DNA, 1476 bp, Ralstonia metallidurans CH34
  CDS (1)..(1476)
atgagccgcgaagttctgttgctcgtcgatgcgctagcgcgcgaaaagaacgtcgacaaggatgtggttttcggtgcgctggaggcggctctcgcctcggccaccaagaaacgtttcgaggaggacgtggatattcgcgttcatatcgaccgcgaatccggtgagcacgagacgttccgccgctggctcgtcgttcctgatgaacagggtctgcaggagccggacaagcagatcctgctgttcgaggcacgcgagcagaatgccgatatccagctcgacgactacatcgaagagcagatcgagtcggtcgagttcggtcgtatcggcgcgcaggcggccaaacaggttatcctgcagcgtattcgtgacgccgagcgcgagcagatcctgaacgattatctggatcgtggcgaaaagatcatgaccggcacggtcaagcgcgccgacaagaagggcttgatcgtcgagtcgggccgcgtggaagcgctgctggcacgtgaccagatcatcccgaaggaaaacctgcgcaccggcgaccgtgtgcgcgcgtatatcctcaatgtggaccgcgccgcgcgtggcccgcagatcgaactgtcgcgtaccgcgcctgagttcctgatcaagctcttcgagaacgaagtgcctgaaatggaacagggcttgctggagatcaaggctgccgcccgcgatccgggtgtgcgcgcgaagatcgccgtcgtggcgcatgacaagcgtatcgatccgatcggtacctgtgtgggcgtgcgaggcacgcgcgtgacggccgtgcgtaacgagatcggcggcgaggccgtggacatcgtgctgtggtcggaggatccggcgcagttcgtcatcggcgcgctggcaccggcacaagtgcagtcgatcgtggtcgacgaagagaagcacagcatggacgtggtggtcgacgaggaaaacctcgccgtctccatcggccgcagtggtcagaacgtacgcctggcgtcggagctgaccggctggcagatcaacatcatgacgcaggaagaatcggcgcagaagcaggccgaggaaagcgaagtggtgcgcaagctgttcatggccaagctggacgtggacgaggaagtggcggatatcctgatcgaggaaggcttctcctcgctggaagaagtggcctacgtgcccatcagtgaaatgatggaaatcgaggcattcgacgaggacaccgtcaacgagctgcgcaatcgcgcccgcgatgcgctgctgacgatggaactggcccgggaagaaaaggtggaagaggtgtcgcaggatctgcgctcgctcgacggcctgacgcccgagctgatcggcaaactggccgaaggcaacatccacacacgcgacgacctggccgagctggccgtggacgaactggtcgaactggccggcgtgggcgaggaagaagccaaggcgctgatcatgaaagcacgggaacattggtttaactga

SEQ ID NO: 64550 - protein, 491 aa, Ralstonia metallidurans CH34
MSREVLLLVDALAREKNVDKDVVFGALEAALASATKKRFEEDVDIRVHIDRESGEHETFRRWLVVPDEQGLQEPDKQILLFEAREQNADIQLDDYIEEQIESVEFGRIGAQAAKQVILQRIRDAEREQILNDYLDRGEKIMTGTVKRADKKGLIVESGRVEALLARDQIIPKENLRTGDRVRAYILNVDRAARGPQIELSRTAPEFLIKLFENEVPEMEQGLLEIKAAARDPGVRAKIAVVAHDKRIDPIGTCVGVRGTRVTAVRNEIGGEAVDIVLWSEDPAQFVIGALAPAQVQSIVVDEEKHSMDVVVDEENLAVSIGRSGQNVRLASELTGWQINIMTQEESAQKQAEESEVVRKLFMAKLDVDEEVADILIEEGFSSLEEVAYVPISEMMEIEAFDEDTVNELRNRARDALLTMELAREEKVEEVSQDLRSLDGLTPELIGKLAEGNIHTRDDLAELAVDELVELAGVGEEEAKALIMKAREHWFN

SEQ ID NO: 64551 - DNA, 1476 bp, Burkholderia fungorum LB400
  CDS (1)..(1476)
atgagtcgcgaagtgttgatgctggtggatgcgctggcacgcgagaagaatgtcgacaaagacgtggtatttgccgcgctcgaagcggctctcgcttcggcctccaagaaactcttcgaagaagatgcggatatccgcgtccatatcgaccgtgaaagcggcgagcacgaaacgtttcgccgctggaaggtggtgccggacgaagccggtttgcaggagccggatcaggaaatcctgctgttcgaagcacgcgagcagaagcccgagatccagctcgacgagtacatcgaagagccggtgccgtcgatcgagttcggccgtatcggcgcgcaggccgccaagcaggtgatcctgcagaaggtgcgcgacgccgaacgcgaacagatcctgaacgacttcctcgagcgcggcgagcacatcatgaccggctcggtgaagcgcctggataaaggcaacttcatcgtcgaaaccggccgtgtcgaggcgctgctgcgccgcgaccagctgattccgaaggaaaacctgcgcgtgggcgaccgcgtgcgcgcctacatcgcgaaggtcgatcgcaccgcgcgcggtccgcagatcgaactctcgcgtacggcgcccgaattcctgatgaagctgttcgaaatggaagtgccggaaatcgaacagggtttgctggaaatcaaggcggccgcgcgagatccgggcgtgcgcgccaagatcggcgtggtcgcatacgacaagcgcatcgatccgatcggcacctgcgtcggcattcgcggttcgcgcgtgcaggctgtacgtaacgagctcggtggcgaaaacgtcgacatcgtgctatggtcggaagatcccgcacagttcgtgatcggcgcgctcgcgccggcagccgtccagtcgatcgtcgtcgatgaagaaaagcattcgatggacgtcgtcgtagacgaaaacgaactggcggtcgcgatcggccgcagcggccagaacgtccgtcttgccagcgaactcaccggctggcagatcaacatcatgacgccggacgaatctgcgcagaagcagaatcaggaacgcggcgtactgcgtgacctgttcatggcgcgtctcgatgtcgacgaagaagtggccgacatcctgatcgacgaaggctttacgagcctcgaagagatcgcctatgtgccgctcaacgaaatgctcgaaatcgaagcattcgacgaagacaccgttcacgaactgcgtaatcgctcgcgcgacgcgctgttgacgctggcgatcgcgaatgaagaaaaggtcgaaaatgtagcgctcgacctgaagagcctggacggcatggacgccgacctgctcgcaaaactggccgaacatcagatccagacgcgcgacgaactcgccgagctggctgtggatgaactggtcgagatgaccggaatggaagaggatgccgctaaggcgttgatcatgaaagcacgtgaacactggttccagtga

SEQ ID NO: 64552 - protein, 491 aa, Burkholderia fungorum LB400
MSREVLMLVDALAREKNVDKDVVFAALEAALASASKKLFEEDADIRVHIDRESGEHETFRRWKVVPDEAGLQEPDQEILLFEAREQKPEIQLDEYIEEPVPSIEFGRIGAQAAKQVILQKVRDAEREQILNDFLERGEHIMTGSVKRLDKGNFIVETGRVEALLRRDQLIPKENLRVGDRVRAYIAKVDRTARGPQIELSRTAPEFLMKLFEMEVPEIEQGLLEIKAAARDPGVRAKIGVVAYDKRIDPIGTCVGIRGSRVQAVRNELGGENVDIVLWSEDPAQFVIGALAPAAVQSIVVDEEKHSMDVVVDENELAVAIGRSGQNVRLASELTGWQINIMTPDESAQKQNQERGVLRDLFMARLDVDEEVADILIDEGFTSLEEIAYVPLNEMLEIEAFDEDTVHELRNRSRDALLTLAIANEEKVENVALDLKSLDGMDADLLAKLAEHQIQTRDELAELAVDELVEMTGMEEDAAKALIMKAREHWFQ

SEQ ID NO: 64553 - DNA, 1521 bp, Magnetococcus sp. MC-1
  CDS (1)..(1521)
atgacagttgaaattttacaggtagccgatcaggttgcgcgggaaaagggtattgatcgcaaggttgtgatcgaagccatggagagtgccattcagaccgcttcgcgcaagaagtatggtgccaataaaaatattcaggcccgctttgatcccaaatctggagagtttcaactaaaccagctgcgtgaagtggtggacctggaccaggatgaagatctggattttgatgaggatatccatatctccttggaaaaggcgttgactatgaacccagaggcggtgcccggcgactttattgccgagcagctgccccccatggagtttggccgcatcgccgcacagaccgccaagcaggtgattgtgcaaaaggtgcgtgacgccgagcgtgagcgcatttttgaagagtatgcggatcgtcaaggcgagatggtcaacggtctggttaagcgggttgagcgcaataacattcatgtggatctgggtcgtacctcgggctttttgcctcatgaagagcagctgccccgtgaacattaccgcccgggcgaccggatacgtgcctttattaaagaggtgcgcgaagtaacccgtggtccgcaaattattctttcgcgcacccatccccaaatggtggtacgcttgttcgagatggaggtccccgagatctacgacggcattgtcgagattaaggcggttgcgcgtgatccgggtcatcgtagtaaaatcgctgtacgttccaatgatgcccatgtggatcctgttggggcctgtgtggggatgcgtggctcccgtgtgcagagtgtggtgacggagctgcaaggggagcgcattgatattattgagtggtcccacgaccccgccgtgtttgtgtgtaacgccctagccccggctgaggtggttaaggtggtggtggacgaggaggatcgcaacatcaaggtggtggtggatgaaaccgccctctccttggccattggtcggcgtggtcaaaacgtgcgtttggcatcggagctgacgggatggcgcattgatattattaccgagcaggaagagcgtaacctacgcgaagagatgtttggtgagctgcaacagaccttcatgaaggatttggatctgggtgaagaggtggcggctgtcttggtcaacgaaggttttacttcggcggaagaggtggcctatgtgcccctgaacgagctgaccagcatcgagggttttgatgaagagattgcgcaagagttgcgcaaccgggcccgggatacactgctgcaacaggcgttacagaccgaagagcgcaaggccgagctgcacattgacgagcgtttggcgcagttgggtctgttgaccgatgatgctctgattgcgttggctgaaaaaaatgttaacaccctggatgatttggccgatctggctaccgatgaattggtggagatgttcgacggtgagctgacgactgaggatgccgaaaccttgatcctgggagcccgccgtgcggctggatggtttgatgacgaggaagaaaccgcataa

SEQ ID NO: 64554 - protein, 506 aa, Magnetococcus sp. MC-1
MTVEILQVADQVAREKGIDRKVVIEAMESAIQTASRKKYGANKNIQARFDPKSGEFQLNQLREVVDLDQDEDLDFDEDIHISLEKALTMNPEAVPGDFIAEQLPPMEFGRIAAQTAKQVIVQKVRDAERERIFEEYADRQGEMVNGLVKRVERNNIHVDLGRTSGFLPHEEQLPREHYRPGDRIRAFIKEVREVTRGPQIILSRTHPQMVVRLFEMEVPEIYDGIVEIKAVARDPGHRSKIAVRSNDAHVDPVGACVGMRGSRVQSVVTELQGERIDIIEWSHDPAVFVCNALAPAEVVKVVVDEEDRNIKVVVDETALSLAIGRRGQNVRLASELTGWRIDIITEQEERNLREEMFGELQQTFMKDLDLGEEVAAVLVNEGFTSAEEVAYVPLNELTSIEGFDEEIAQELRNRARDTLLQQALQTEERKAELHIDERLAQLGLLTDDALIALAEKNVNTLDDLADLATDELVEMFDGELTTEDAETLILGARRAAGWFDDEEETA

SEQ ID NO: 64555 - DNA, 1635 bp, Novosphingobium aromaticivorans DSM 12444
  CDS (1)..(1635)
atggccagtgcaatttccgcgaaccgcgccgaactgcttgcgatcgccaacgcggtcgccaccgagaagatgatcgacaagtcgatcgtcatcgaggcgatggaagaggcgatccagaagtccgcgcgcaaccgctacggcgccgagaacgacattcgcgccaagctcgacccgcgcaccggcgacctgcgcctgtggcgcgtggtggaagtggtcgaggtggtcgaggactacttcaagcaggtcgatctcaagcaggccgagaagctccagcccggcgccaagatcggcgacttcatcgtcgatccgctgcccccggtcgatctcggccgcatcgacgcgcagtcggccaagcaggtcatcttccagaaggtccgcgacgccgagcgtgatcgccagtacgacgagttcaaggaccgcgccggcgaagtcatcaccggcgtgatcaagtcggtcgaattcggccacgtgatcgtcaacctcggccgcgccgaaggcgtgatccgccgcgaccagcagatcccccgcgaagtgccccgcgtgggcgagcgcgtgcgtgcgctgatcctcaaggtcgagcgccagaaccgcggtccgcagatcttcctgtcccgcgcgcaccccgaattcatgaagaagctcttcgcgcaggaagtgcccgagatctacgatggcatcatcgagatcaaggccgccgcccgcgacccgggctcgcgcgccaagatcggcgtgatcagccgcgacagcagcatcgacccggtcggcgcctgcgtcggtatgaagggtagccgcgtccaggcggtcgtgcaggaactgcagggcgagaagatcgacatcatcccctggagcgaggacaccgcgactttcgtcgtcaacgctctccagcccgcgaccgtcagccgcgtggtgatcgacgaggaagagagccgcatcgaggtcgtcgtgcccgatgaccagctctcgctcgccatcggtcgccgcggtcagaacgtgcgccttgcctcgtcgctgacgggctcggccatcgacatcatgaccgaggcggaagcttcggagaagcgccagaaggaattcgccgagcgctcgaagatgttcgaggaagagctcgacgtcgacgaaaccctctcgcagctcctcgtcgccgaaggcttcaccgagctggaggaagtggcctacatcgaaatggccgaactggccgcgatcgagggcttcgacgaggaactcgccgaggaactgcagagccgcgcgtccgaggcgatcgaacgccgcgaggaggctctgcgcgagcagcgtcgtgcccttggcgtcgacgatgccctggccgaactgccgcacctgaccgaagcgatgctcgtcgcgctcggcaaggccggcatcaagacgctcgacgatcttgccgatctcgcgaccgatgaactcatcgccaagaagcgcgccgaacagcgtcgccgcaacgacaagggcccgcgcgagcggaccgagcgttcggagcggacagaggacaagggcggcgtgctcggcgaatttggcctgagcgaagaacagggcaacgagatcatcatggccgcgcgtgcccactggttcgaagacgaaccggtagctgaggaggccgccgatgcggattcctcacaatga

SEQ ID NO: 64556 - protein, 544 aa, Novosphingobium aromaticivorans DSM 12444
MASAISANRAELLAIANAVATEKMIDKSIVIEAMEEAIQKSARNRYGAENDIRAKLDPRTGDLRLWRVVEVVEVVEDYFKQVDLKQAEKLQPGAKIGDFIVDPLPPVDLGRIDAQSAKQVIFQKVRDAERDRQYDEFKDRAGEVITGVIKSVEFGHVIVNLGRAEGVIRRDQQIPREVPRVGERVRALILKVERQNRGPQIFLSRAHPEFMKKLFAQEVPEIYDGIIEIKAAARDPGSRAKIGVISRDSSIDPVGACVGMKGSRVQAVVQELQGEKIDIIPWSEDTATFVVNALQPATVSRVVIDEEESRIEVVVPDDQLSLAIGRRGQNVRLASSLTGSAIDIMTEAEASEKRQKEFAERSKMFEEELDVDETLSQLLVAEGFTELEEVAYIEMAELAAIEGFDEELAEELQSRASEAIERREEALREQRRALGVDDALAELPHLTEAMLVALGKAGIKTLDDLADLATDELIAKKRAEQRRRNDKGPRERTERSERTEDKGGVLGEFGLSEEQGNEIIMAARAHWFEDEPVAEEAADADSSQ

SEQ ID NO: 64557 - DNA, 1257 bp, Cytophaga hutchinsonii
  CDS (1)..(1257)
atggatacttcaactttaatagaatcgtttgcagagtttgcaaaattcaagagtatagaccgccctaccatgatgaaaatcgtggaagatgtgttccgcactatgatccgtaaaaaatacggaacagatgacaatttcaacgttatcattaacgtagacaaaggtgatcttgagatttggtggatgagagaaattgtttcagatgattttgctgaagatagttttgattatgatccgaacaaacacatttcgttgactgatgcccacttaattgaaaaagatttcgaagaaggtgaagaagtggcaactgaagtaaaattagaggattttggaagaagaatggttcagacggcacgtcagacactgattcaaaaagtaaaagaccttgaaaaagataatcttttccagaaatataaagacctggtaggtgaaattatcaacggggaaatttatcaggtattaagcaaagagattttattgatcgatgcagatggtaatgaattagcattgcctaaatacgagcagatcccgaaagaccgtttccgtaaaggcgataatgtacgcgctattgtacaccgcgttgaaatgcataatggaaatccaaaaattattttatccagaacgtcacctaaatttttagaacgtttgtttgaacttgaagtgccggaagtatatgatggattgatttcaatccgtaatatcgttcgtgaaccgggtgagcgtgctaaagttgctgttgaatcgtacgatgaccgtattgatccggtaggcgcatgtgttggtatgaaaggttcccgtattcacagcattgtacgtgagttagagaatgaaaatatagatgtaatcaattttacggataacattgacttgtttattgcgcgtgcattaagccctgctaaaataagcagccttaaagtggaagcggataaaggaagagcttctgtttacttaaagccggatcaggtttctcttgcaatcggtaaaggtggccagaacattaaacttgccagcaaattagtaggcctggaaattgacgtattcagagaattaacaggtaatgaagacaacgaagatgttgacttaacagaatttgttgatgaaattgaagattggatattagaagaattaaaacgtatcggtctggatacagcgaagagtgtattagctctaagtaaagatgacttagtacgtcgtactgaattggaagaagaaacggttgaagacgtacttcaaattctaagacaggaatttgaataa

SEQ ID NO: 64558 - protein, 418 aa, Cytophaga hutchinsonii
MDTSTLIESFAEFAKFKSIDRPTMMKIVEDVFRTMIRKKYGTDDNFNVIINVDKGDLEIWWMREIVSDDFAEDSFDYDPNKHISLTDAHLIEKDFEEGEEVATEVKLEDFGRRMVQTARQTLIQKVKDLEKDNLFQKYKDLVGEIINGEIYQVLSKEILLIDADGNELALPKYEQIPKDRFRKGDNVRAIVHRVEMHNGNPKIILSRTSPKFLERLFELEVPEVYDGLISIRNIVREPGERAKVAVESYDDRIDPVGACVGMKGSRIHSIVRELENENIDVINFTDNIDLFIARALSPAKISSLKVEADKGRASVYLKPDQVSLAIGKGGQNIKLASKLVGLEIDVFRELTGNEDNEDVDLTEFVDEIEDWILEELKRIGLDTAKSVLALSKDDLVRRTELEEETVEDVLQILRQEFE

SEQ ID NO: 64559 - DNA, 1482 bp, Microbulbifer degradans 2-40
  CDS (1)..(1482)
atgaaaaaagaaatattgctcgtcgcggacgctgtatcaaacgaaaaaggcgttgataaaggtattatattcgaagcaatcgaattggccttggcatcagccaccaaaaaacgttacgacgaagatgctgatattaaagtaacgattgaccgcaaagatggcgattatgtaactgttcgtcgctggttagttgtagacgacgataccttggccgagcttggaactcagttcactaccgaagaagctattgagaaagatccatcgctcaagcctggcgatgtgtacgaagaagttattgaaaacgtagattttggtcgaattgcagcgcaaaccgctaagcaagttattgttcaaaaagtacgtgaagcagagcgcgcacaaattgttgatgagtaccgcggccgtgttggtgaattaattgccggtaccgtaaagaaagtgactcgcgataatattattgtggatcttggcggcaatgctgaaggtttgcttcctcgcgaagagttagttggccgtgaagtatttcgtatgaacgatcgcgtgcgtgccgtactggctgatgtgcgtccagaagcgcgtggcccacagctctttttgagccgtgcatgcccagagatgttaatcgagctgtttaaaatcgaagtgcctgaaatagcagaagaagttatttctttaaatgctgcggcgcgcgacccaggctctagagcaaaaattgcagtagctacaaacgacggccgtatagacccggttggtgcttgtgttggtatgcgcggttcgcgtgtacaggcagtatctaacgaattgggtaacgagcgtattgatattattctatgggatgataacccggctcaatttgttattaatgcaatggcgccggcagaaattgaatctattgttgtagatgaagaagccggctctatggatgtagctgtagccgaagataatttagcgcaagctattggtcgcggcggtcagaatgtgcgcttggcgtcagagcttaccggttgggaaatcaacgtgatgagcgttgaccagtggaatgaaaaacaagccgccgaggcgggcagtgcacgcgatgtgtttatcaatgcacttgatatagatgaagatgtggccgacgtgttggtggatgaaggctttaccaccttagaagaagtcgcgtacgtgcctttggaagaatttttggccattgaaggctttgatgaagaaattgcagaagagctacgcaatagagcgaaagatgccttgttgactcaagcattggctggcgaagagaaaaatcagcctgctgatgatttggttaacatggaaggcatggatgacgctttggctcaaactcttgcagcgcgcggtgtgatctgtatggaagatctcgcggagcaggcggttgatgagctgatggaaattgacggcatggacgaagagcgcgcggctgcgttaattatgaaagcccgcgagccctggtttgcagacgaagcctag

SEQ ID NO: 64560 - protein, 493 aa, Microbulbifer degradans 2-40
MKKEILLVADAVSNEKGVDKGIIFEAIELALASATKKRYDEDADIKVTIDRKDGDYVTVRRWLVVDDDTLAELGTQFTTEEAIEKDPSLKPGDVYEEVIENVDFGRIAAQTAKQVIVQKVREAERAQIVDEYRGRVGELIAGTVKKVTRDNIIVDLGGNAEGLLPREELVGREVFRMNDRVRAVLADVRPEARGPQLFLSRACPEMLIELFKIEVPEIAEEVISLNAAARDPGSRAKIAVATNDGRIDPVGACVGMRGSRVQAVSNELGNERIDIILWDDNPAQFVINAMAPAEIESIVVDEEAGSMDVAVAEDNLAQAIGRGGQNVRLASELTGWEINVMSVDQWNEKQAAEAGSARDVFINALDIDEDVADVLVDEGFTTLEEVAYVPLEEFLAIEGFDEEIAEELRNRAKDALLTQALAGEEKNQPADDLVNMEGMDDALAQTLAARGVICMEDLAEQAVDELMEIDGMDEERAAALIMKAREPWFADEA

SEQ ID NO: 64561 - DNA, 1422 bp, Oenococcus oeni PSU-1
  CDS (1)..(1422)
atggcatcagattacagaagagagttgttttctgcgttacaggcattacaagctgagaaaggcatcagccaggaagatgcaattacgtctttaaaagatactttagtgactgcttataagaagaattttgaaggggaaaccaatgtcgaagttgatgtcgatcctgaaaaacaggagtttaatcttttacaaattaaagaggtcattcctgatggagatatgattgacccctattcggaaatttatttgaaagatgcacgagagattaattctgcatacgaagccggtgatcagatcaaattcgaaattaatccgcgtgattttggccgtttggctgctcaatcagggaaaaataaatctactcaaacaattcgtgaaaaagaaaaggaggcaattcacgctcgttacgaaggtttcgagcatgaaattgtgtctgcgagggttgctcgtgaagaccaacgctttttgtgggttaccatgcctgatggtcaagaggcggccatgggagacaaggatcgtatacctggcgaaacctacaagaccggtgatccaatcaaagttttgattaatcgggtcgaggattctgctactcgcggtccacagatctacgtttctcgaacgagtccggaattagttaaacgtttattcgaacaggaagttccggaagtttacgatggcactgtcgtgattgaatcaattgcccgggaagccggtgatcgttcgaaagtggcagttcggacaaccgattccaaccttgaccccattggtactctggttgggactcgtggttcgcgtgttcaggctgttgttaatgaattgcatggcgagaacatggatattgttgaatgggtcgaagacgaagcacagtatatcgccaatgctttgaatccggccgaggtcgtcgacgtaattttcagtccggataacgataatgaagttactgttattgtgcctgattatcagttgagtttggctattggaaaacgtggtcagaatgcacgtttggctgccaagctaactaagtttaaaattgatattaaatcagaaacacaggcggaaaacgacccacagcttcaggctattctcgaagaatccgctaaatatgcagaggaagaagatcaatcggacgaaaccgacgaaacggatgaggctttggaagacgagaccgaatacgccgacgccaatgaatatttttctgaaggcgctgatcaatccgatgcatcagaagaggagaaaacttccgagtccgctgaagaaagtagttcagccgaagaagattcttcaaaagcaaaggctaaaatgactgaagccgaagttaaagaggctcaggacgaatttgccgctgccctaaagaatgttgatttcgatgctattttggaagaaaaagagggcgacgacaacaaaaagagcgacgataaataa

SEQ ID NO: 64562 - protein, 473 aa, Oenococcus oeni PSU-1
MASDYRRELFSALQALQAEKGISQEDAITSLKDTLVTAYKKNFEGETNVEVDVDPEKQEFNLLQIKEVIPDGDMIDPYSEIYLKDAREINSAYEAGDQIKFEINPRDFGRLAAQSGKNKSTQTIREKEKEAIHARYEGFEHEIVSARVAREDQRFLWVTMPDGQEAAMGDKDRIPGETYKTGDPIKVLINRVEDSATRGPQIYVSRTSPELVKRLFEQEVPEVYDGTVVIESIAREAGDRSKVAVRTTDSNLDPIGTLVGTRGSRVQAVVNELHGENMDIVEWVEDEAQYIANALNPAEVVDVIFSPDNDNEVTVIVPDYQLSLAIGKRGQNARLAAKLTKFKIDIKSETQAENDPQLQAILEESAKYAEEEDQSDETDETDEALEDETEYADANEYFSEGADQSDASEEEKTSESAEESSSAEEDSSKAKAKMTEAEVKEAQDEFAAALKNVDFDAILEEKEGDDNKKSDDK

SEQ ID NO: 64563 - DNA, 1089 bp, Pediococcus pentosaceus ATCC 25745
  CDS (1)..(1089)
atgagtaaagaaatgattaccgctcttgatatcttagaaaaagaaaagggaatcaaaaaagaagttatcgttgaagcacttgaagctgcattagtttcggcattcaagcgtaattacggacaggctcaaaacgttgaagtagaatttaatgatcgtaaaggtgatattcatgtttacgccgttaaaaaagttgttgaagaagttgaagatgatcaattggaagttagtttagctgacgccttgatgatcaatcgagcatacgaattggatgatgaaatcagatttgaagttactcctaaaaactttggccgaattgcagctcaaactgctaaacaagttattatgcaacgggttcgcgaagctgaacgtggtgtaatttacgaaaagtatggtcaatacgaagatgaaattgttacaggcgaagtatcacaccgtgacaatcgttacgtatatgttgacttgggtggggtcgaagctgtgatggctaagtcagaccaaatcccaggtgaacaatatgaacctcatgatcatattaaagtttatattacgaaggtggaaaataacggtaagggacctcaaatttttgcttcaagaacggattcgggacttttgaaacggctctttgaacaagaagttcctgaagtttatgatggaacggtcgagattatgtcgattgctcgtgaagctggtgatcgtgctaaaattgcggtacgttctaatgatcctgatattgatgcagttgggacatgtgtgggtgctaagggccaacgtgttcaaacgattgtcaatgaacttcatggtgaaaacatggatattattgaatggaaagaggacccagcagaatatatagctaatgctttgaaaccttctgaagttattgacgtattatttaatgaagaagatgaaaattactgcatggtaatcgttccagattaccagctttcattagcaattggtcgtcgtggacaaaatgcgcgtttagctgctaaacttgttaacttcaagattgacatcaaatcggaaacagatgcatcagaatatgctgaagaagaagattctgaagaaagtacagaagaaaccgctgaataa

SEQ ID NO: 64564 - protein, 362 aa, Pediococcus pentosaceus ATCC 25745
MSKEMITALDILEKEKGIKKEVIVEALEAALVSAFKRNYGQAQNVEVEFNDRKGDIHVYAVKKVVEEVEDDQLEVSLADALMINRAYELDDEIRFEVTPKNFGRIAAQTAKQVIMQRVREAERGVIYEKYGQYEDEIVTGEVSHRDNRYVYVDLGGVEAVMAKSDQIPGEQYEPHDHIKVYITKVENNGKGPQIFASRTDSGLLKRLFEQEVPEVYDGTVEIMSIAREAGDRAKIAVRSNDPDIDAVGTCVGAKGQRVQTIVNELHGENMDIIEWKEDPAEYIANALKPSEVIDVLFNEEDENYCMVIVPDYQLSLAIGRRGQNARLAAKLVNFKIDIKSETDASEYAEEEDSEESTEETAE

SEQ ID NO: 64565 - DNA, 1281 bp, Trichodesmium erythraeum IMS101
  CDS (1)..(1281)
atgtcaatggttagtttgcctggacttaaagagttaatcggaaatattagtaaagaacgtaatttaccaaaacaagcagttcagactgctttacgagaagctctattaaaaggatatgaacgctacagacgaactcaacgtgtagatggagtcaacttcacagatgattacttcgaaaattttgaaatagaactggatattgaagaagaaggttatcgagtattagctacaaaaactattgttgaagaagtaacaaatccagatcatcatatagctctccaagaagttttagaagtagcctcagaagctcagttaaatgatacagtattcttggatgtgacacccgaaaaaaatgaatttggtcgcatggctgctatacagactaaacaagtattagctcaaaagctacgagatcaacaacgaaaaatgattcaagaagaatttcaagatttagaaggagaagttctccaagccagagttttgagatttgaaaaacagtcagttatcttagctgtaagtagtggatttggtagactagaagtagaagctgaactgcctaaaaaagaacaactacctaatgataactaccgtgctaatgctacttttaaagtctatttgaagcgagtttgtgaagggtcaactcgtgggcctcaattacttgtgtctagagctgatgccggcttagtggtttatttatttgaaaatgaagtcccagaaattgaagatgaagtcgtaagaattgtggcagttgctagagaggcaaatcccccatctcggcatgttggtcccagaactaaaatagcagttgatactttagaaagggatgtagatccagtgggagcttgcattggtgcaaggggctcaagaattcaggtagttgtgaatgagttgagaggtgaaaaaatagatgtaattcgctggtctccagacccttctatatatatagctaattctcttagtccagctagagtagatgaagttcgtttaattgatccagaggaaaggaggtctcatattttggtgtctgaagaccaacttagtttggctatcggcaaggaaggacaaaatgtgcgtttagctgctcgtttgacagggtggaaaattgatattaaggacacaaatagatatgaccatgctgaagaagatagcaaagttgcggctgaagtctctcatcgtcaagcgttagctgaacaagaagaaaataaaattgaggaatcagaattagaagtaatagaaaatactttcgacaaaaattttaatgaaccagatgattctttttaa

SEQ ID NO: 64566 - protein, 426 aa, Trichodesmium erythraeum IMS101
MSMVSLPGLKELIGNISKERNLPKQAVQTALREALLKGYERYRRTQRVDGVNFTDDYFENFEIELDIEEEGYRVLATKTIVEEVTNPDHHIALQEVLEVASEAQLNDTVFLDVTPEKNEFGRMAAIQTKQVLAQKLRDQQRKMIQEEFQDLEGEVLQARVLRFEKQSVILAVSSGFGRLEVEAELPKKEQLPNDNYRANATFKVYLKRVCEGSTRGPQLLVSRADAGLVVYLFENEVPEIEDEVVRIVAVAREANPPSRHVGPRTKIAVDTLERDVDPVGACIGARGSRIQVVVNELRGEKIDVIRWSPDPSIYIANSLSPARVDEVRLIDPEERRSHILVSEDQLSLAIGKEGQNVRLAARLTGWKIDIKDTNRYDHAEEDSKVAAEVSHRQALAEQEENKIEESELEVIENTFDKNFNEPDDSF

SEQ ID NO: 64567 - DNA, 1089 bp, Moorella thermoacetica ATCC 39073
  CDS (1)..(1089)
atgaacagtgagtttatccaggcactacgggacctggagagggaaaagggtattaacgccgatattttactggaggccattgaagcggctttaatctcggcttacaagaagaactttggctccctgcagaatgtcagggtggacatccagcgtgataccggggagattaaggttctggcccagcgccaggtggtagaagaggtaaccgatccccggcaggagatctccctcgaggaagctcgggccatcaacagtaaatatgaactgggggacatagtggagaaagaggttactcccagggattttggccgcatcgctgcccaaacggccaaacaggtggtcgtccagcgcatccgggaagccgagcgcggcttgatttatgaagaatttatcggccgggaaaatgacctcgttacgggtgtagtccagcgccaggagggcaaaaacattatccttgacctgggccgggccgaggcgatcctgcttcccagcgaacagagccccggagagacctaccgccagggcgaacgcctgaaggtctatgtcctggaggtcaggaagactaacaaagggccccagattctcgtgtcccggacccatcccggcttgataaagaggcttttcgagctggaagttccggaaatccacgatggcattgttgaaattaagggagtcgccagggaacctggggcgcgctccaagattgccgttcattcccgggatgaaaaggtggatccggtgggctcctgcgtaggtcccaagggggcacgggtacaggctgtggtccaggagctgcggggcgagaaggtagatatcattaaatggagcgatgacccggctgtttatgtggccaactccttgagcccggcccgggtcctggacgtgactgtcgacgaagaaaataaggtgagccaggtcatcgttcctgataaccagctctccctggccattggtaaggaaggccagaatgcccgcctggcagccaggatcaccggctggaaaatcgatattaaaccggaatccgaagctggcgattgggattcctgggatgccgacctggatcttgacggcacgatagaggaggagtaa

SEQ ID NO: 64568 - protein, 362 aa, Moorella thermoacetica ATCC 39073
MNSEFIQALRDLEREKGINADILLEAIEAALISAYKKNFGSLQNVRVDIQRDTGEIKVLAQRQVVEEVTDPRQEISLEEARAINSKYELGDIVEKEVTPRDFGRIAAQTAKQVVVQRIREAERGLIYEEFIGRENDLVTGVVQRQEGKNIILDLGRAEAILLPSEQSPGETYRQGERLKVYVLEVRKTNKGPQILVSRTHPGLIKRLFELEVPEIHDGIVEIKGVAREPGARSKIAVHSRDEKVDPVGSCVGPKGARVQAVVQELRGEKVDIIKWSDDPAVYVANSLSPARVLDVTVDEENKVSQVIVPDNQLSLAIGKEGQNARLAARITGWKIDIKPESEAGDWDSWDADLDLDGTIEEE

SEQ ID NO: 64569 - DNA, 1479 bp, Thiobacillus denitrificans ATCC 25259
  CDS (1)..(1479)
atgagccgtgagatgttgatgctggccgacgcgctggcgcgcgaaaagaacgtggacaaggaggtggtgttcgaggccctcgagcaggcgctcgcctcggccaccaagaagcgcttcaaggaagagtccgacgtgcgcgtcgcgatcgatcgcgaaaccggtgactacgaatccttccgtcgctggctggtcgtgaccgaggccgagctcgaatccgagggctaccagatcctgctggtcgacgcccaggacaagatcccggacatcgaaatcggcgactacatcgaagagccgctcgaaaacgtcgagttcggccgcatcggtgcccaggccgccaagcaggtcatcctgcagaagatccgcgatgccgagcgcgagcagatcatcagcgacttcctcgcccgcaaggaacacctcgtcaatggcgtcgtgaagcgcatcgaccgtggcaacgcgatcatcgaatccggccgcgtcgaaggcttcctgcaccgcgaccagatgatcccgcgcgagaacctgcgtgtcggcgaccgcgtgcgcgcctacctgctgcgcatcgaccgcggcaaccgcggcccgcaggtcgtgctgtcgcgcaccgccccagaattcatcatgaagctgttcgagctcgaagtgcccgagatcgaggaaggcctgctcgagatcaaggccgcggcccgtgatcccggcctgcgcgccaagatcgccgtcgtctcgcacgatccgcgcatcgacccgatcggcacctgcatcggccttcgtgggtcgcgcgtcacctcggtgaccaacgaactcgccggcgagcgcgtcgacatcatccactggtcggccgatccggcacagtacgtgatcaatgccctcgcgccggccgaagtcagctcgatcgtcgtcgacgaagatacgcacagcatggacgtcgtcgtcgacgaggaacaactcgcgatggcgatcggccgcggtggccagaacgtgcgcctggcgtccgaactgaccggctgggaactcaacatcatgtcgcgcgaggcggctgaagagaaacagtcgagcgaaagccagaagacgctgcagctcttcatcgagaagctcgacgtcgacgaggaagtcgcccagattctggtcgacgagggcttctccacgctcgaggaagtcgcctacgtgccgctcaacgaaatgctcgagatcgaagccttcgatgaagcgctcgtcaacgaactgcgcaaccgggcgcgcaacgccctgctgaccgcggccatcgtcggcgaggagcaggtcgaggcctcggccggcgacctgctgtcgctcgacggcatggacgccgaaaccgcacgcttgcttgccagcaagggggtccacacgaccgaggatctggcggagctggcggtcgacgagctgaccgaaatggccgcgatggacgcggaacgcgccaaacaattgatcatggccgcacgcgcgccctggttcgcccaaggctaa

SEQ ID NO: 64570 - protein, 492 aa, Thiobacillus denitrificans ATCC 25259
MSREMLMLADALAREKNVDKEVVFEALEQALASATKKRFKEESDVRVAIDRETGDYESFRRWLVVTEAELESEGYQILLVDAQDKIPDIEIGDYIEEPLENVEFGRIGAQAAKQVILQKIRDAEREQIISDFLARKEHLVNGVVKRIDRGNAIIESGRVEGFLHRDQMIPRENLRVGDRVRAYLLRIDRGNRGPQVVLSRTAPEFIMKLFELEVPEIEEGLLEIKAAARDPGLRAKIAVVSHDPRIDPIGTCIGLRGSRVTSVTNELAGERVDIIHWSADPAQYVINALAPAEVSSIVVDEDTHSMDVVVDEEQLAMAIGRGGQNVRLASELTGWELNIMSREAAEEKQSSESQKTLQLFIEKLDVDEEVAQILVDEGFSTLEEVAYVPLNEMLEIEAFDEALVNELRNRARNALLTAAIVGEEQVEASAGDLLSLDGMDAETARLLASKGVHTTEDLAELAVDELTEMAAMDAERAKQLIMAARAPWFAQG

SEQ ID NO: 64571 - DNA, 1617 bp, Silicibacter sp. TM1040
  CDS (1)..(1617)
atggctatcacctctgcaaaccagctggagctgttgcaaaccgccgaggccgtggcgcgtgagaaaatgatcgatcccggtctggtggtcgaagcgatggaagaatccctcgcccgcgccgccaagagccgctacggcagcgagatggacattcgtgtctccattgaccgcaagaccggtaaggcgactttcactcgtgtgcgcaccgtggtcgaagacgaagagctcgaaaactaccagtccgagctgaccgtcgcgcaggccaagcagtatatggaagaccccaaggtcggcgacaccatcgttgatgaggttcccccggtcgagatgggccggatcgcggcacaatccgccaagcaggtgatcctgcagaaagtgcgcgaagcagagcgggatcgtcagtacgaagagttcaaggatcgcaacggcaccatcatcaatggcgtcgtcaagcgagaggaatacggcaacgtcatcgtcgatatcggatctggcgaaggcattctgcgtcgcaacgagaaaatcggccgtgagagctatcgcccgaacgaccgtattcgctgcttcatcaaggacgtacgccgcgaaccccgtggcccgcagatcttcctcagccgcaccgcgccggagttcatggccgagctcttcaagatggaagtgcctgaaatctatgacggcatcatcgagatcaaggctgtggcccgtgaccccggttcgcgtgcaaagatcgctgttgtgtcctatgacgggtcgatcgatccggttggcgcctgtgtcggtatgcgtggctcccgcgtgcaggcggtcgtgaacgaactgcagggcgaaaagatcgacatcatcccttggaacgaagatcagccgaccttccttgtgaacgcgctgcagcccgcagaggtctccaaggttgtcttggacgaagaagccggcaagatcgaagtggttgtgcccgacgagcagctttctctggcgattggccgtcgcggtcagaacgtacgtctggcgtctcagctgaccaacctcgacatcgacatcatgacggaagaggaagaatccgcacgccgtcagaaggaattcgaggcgcgcaccgcactgttcatggaaacgctcgatctcgacgagttctttgcacagcttctggtttctgaaggcttcaccaacctcgaagaggtcgcctatgtcgaactcgacgaactcttggtgatcgatggcgtcgacgaaggcaccgccgaagaactgcaggcccgcgcgcgcgattatctcgaagccaaggccaaggccgcgctcgacaacgcccgcagcatgggcgtcgaggacagccttattgactttgacggcctgacaccccagatggttgaggcactggcgaaggatgatgtgaaatcgcttgaagacttcgcaacctgtgcggactgggagcttgcgggtggctggaccaccgtcaacggcgagcgtgtcaaggatgaagggattctcgagcccttcgatgtgagcctcgaagaggcgcaaaatctggtgatgacggcgcggattatgctcggctgggtcgacccggcagaacttgaatccgatgctgatgatctcgaggaagaagccgaaggggaagcggaagcctga

SEQ ID NO: 64572 - protein, 538 aa, Silicibacter sp. TM1040
MAITSANQLELLQTAEAVAREKMIDPGLVVEAMEESLARAAKSRYGSEMDIRVSIDRKTGKATFTRVRTVVEDEELENYQSELTVAQAKQYMEDPKVGDTIVDEVPPVEMGRIAAQSAKQVILQKVREAERDRQYEEFKDRNGTIINGVVKREEYGNVIVDIGSGEGILRRNEKIGRESYRPNDRIRCFIKDVRREPRGPQIFLSRTAPEFMAELFKMEVPEIYDGIIEIKAVARDPGSRAKIAVVSYDGSIDPVGACVGMRGSRVQAVVNELQGEKIDIIPWNEDQPTFLVNALQPAEVSKVVLDEEAGKIEVVVPDEQLSLAIGRRGQNVRLASQLTNLDIDIMTEEEESARRQKEFEARTALFMETLDLDEFFAQLLVSEGFTNLEEVAYVELDELLVIDGVDEGTAEELQARARDYLEAKAKAALDNARSMGVEDSLIDFDGLTPQMVEALAKDDVKSLEDFATCADWELAGGWTTVNGERVKDEGILEPFDVSLEEAQNLVMTARIMLGWVDPAELESDADDLEEEAEGEAEA

SEQ ID NO: 64573 - DNA, 1512 bp, Rickettsia akari str. Hartford
  CDS (1)..(1512)
atgtctaatataggtaatgtagaaattttacaaattatagattctgtagctcgtgagaaaggaatatcaaaagaaattttggtttcaactgttgaacaagcggtacaagtagcaggacgaaaaaaatacggtaatgaatataatattaaagctcagataaataggaaaaccggtgagataaatcttttaagaatcttaaaaatagtagaagatgtacaagattacttaacgcaaatctcacttgcagaagctttaagaaagaatccggaagctaaaatcggtgatgagatatatgaatatttaccaccgattgatcatgcgagagtatcagcgcaagctgcaaaacaagtgataactcaacgtgttatagaagctgagcgtgaaaaacaatatcatgactttaaagatagaaaaggcgaaattataaacgggatagttaagagaatagaatacggtgatataatagttgacttgagtcgtgctgaagcaataataaaaaaagatcaattaattaatggtgagaattttaaacctaatgatcggataaaagcatatgtacaggatgtaaggcaagagacaaaaggaccgcagattttcttgtctagagtagataaccagatgctagttaaactatttaagatagaagtacctgaaattcttgaagatattattcaaataaaatcagtagcacgtgatcccggttcaagagcaaaaatagcggtatttgcttcggatagtagtatagatcccgtaggctcatgtgtaggtattagaggtaatagagtaaaagcagtaacaaatgagttaaacggagagaaaattgatatagtattatggagtaatgatcttgcacagtttatagttaatgctcttgcaccgcttgcacctggggagattacaaaaattttgattgatgaggataggcataaggtagaagtagtagtttcacaagaaaatcaaagtattgcaataggtagaagagggcagaatgttcgtttagcttctaagcttacaggttggaatatcgatataatgactgaagagcaggaatcaaaaagaagaaacgaagagtttgtgacttctacgcaattatttatggaagctttagatgttgaagaagttataggtcagcttttatcggtaacgggatttaattcggtagaacaaattgccagtagtgaggttagtactttgacaagaatcgaaggttttgaggaagaacttgcagtagagatcaaaaatcgagctgttaattacgtcgaccttaagaatgaaaagattatcaaaaagttagaggatttaggagttgagcaagaattaatagatatattagcattaccgcttgaattaatattaaaatttgccgaatatggtataaagaccatagaagatttaggagagatgagtgtaaatgaatttaaaaatttagctccaaattctaatataacggacgaaaatattaaattactgattaaaactgctagacggcacggtgaattaaaggatagttag

SEQ ID NO: 64574 - protein, 503 aa, Rickettsia akari str. Hartford
MSNIGNVEILQIIDSVAREKGISKEILVSTVEQAVQVAGRKKYGNEYNIKAQINRKTGEINLLRILKIVEDVQDYLTQISLAEALRKNPEAKIGDEIYEYLPPIDHARVSAQAAKQVITQRVIEAEREKQYHDFKDRKGEIINGIVKRIEYGDIIVDLSRAEAIIKKDQLINGENFKPNDRIKAYVQDVRQETKGPQIFLSRVDNQMLVKLFKIEVPEILEDIIQIKSVARDPGSRAKIAVFASDSSIDPVGSCVGIRGNRVKAVTNELNGEKIDIVLWSNDLAQFIVNALAPLAPGEITKILIDEDRHKVEVVVSQENQSIAIGRRGQNVRLASKLTGWNIDIMTEEQESKRRNEEFVTSTQLFMEALDVEEVIGQLLSVTGFNSVEQIASSEVSTLTRIEGFEEELAVEIKNRAVNYVDLKNEKIIKKLEDLGVEQELIDILALPLELILKFAEYGIKTIEDLGEMSVNEFKNLAPNSNITDENIKLLIKTARRHGELKDS

SEQ ID NO: 64575 - DNA, 1476 bp, Ralstonia eutropha JMP134
  CDS (1)..(1476)
atgagccgcgaagttctgttgctcgtcgatgcgcttgcgcgtgagaagaacgtcgacaaggatgtggtattcggcgcgctggaggctgcactggcctcggcgaccaagaagcgtttcgaggaagacgtggatatccgtgtcgctatcgaccgggaatcgggcgagcacgagacgttccgccgctggcttgttgtccctgatgaacagggcctgcaggagccggacaagcagatcctgctgttcgaggcgcgcgatgacgacgccagcctcgagctgggcgactatgtcgaacagcagatcgagtcggtcgaattcggtcgtatcggcgcgcaggccgccaagcaggtgatcctgcagcgtatccgcgacgccgagcgtgagcagatcctgaacgattacctcgagcgcggcgaaaagatcatgaccggcacggtcaagcgtgccgacaagaagggcctgatcgtcgaatccggtcgcgtggaagcgctgctggcacgcgaccagatcatcccgaaggaaaacctgcgcaccggcgaccgtgtgcgtgcgtacatcctgaatgtggatcgcgccgcgcgcggcccgcagatcgaactgtcgcgcaccgcgcccgagttcctgatcaagctcttcgagaacgaagtgccggagatggagcagggcttgctcgagatcaaggcggctgcccgtgacccgggcgtgcgtgccaagatcgccgtcgtggcgcatgacaagcgtatcgatccgatcggtacctgcgtcggcgtgcgcggtacgcgggtgacggccgtgcgcaacgagatcggcggcgaagccgtggacatcgtgctctggtccgaagatccggcgcagttcgtgatcggcgcgctggcgccggcacaggtacagtcgatcgtcgtggacgaggaaaagcactgcatggatgtggtcgtcgatgaggagaacctcgcggtggccatcggtcgcagtggtcagaacgtacgcctggcgtccgagctgaccggctggcagatcaacatcatgacgcaggaagagtcggcgcagaaacaggccgaggaaagcgatgccgtgcgcaagctgttcatggccaagctcgacgtcgacgaagaagtggcggacatcctgatcgaggaagggttctccacgctggaagaagtggcctatgttcccatcagtgaaatgatggaaatcgaggcgtttgatgaagacaccgtcaacgagctgcgcaaccgcgcacgtgatgcgctcctgacgatggaactggcccgggaagagaaggtggaagaggtgtcgcaggatctgcgctcgctcgacggcctgaatcccgagctgatcggcaagttggccgaaggtgatatccatacgcgtgacgacctggccgaactggccgtcgacgaactcgtcgagatgacgggcgtcaccgaggaagaagccaaggcgctgatcatgaaagcacgggaacattggtttaactga

SEQ ID NO: 64576 - protein, 491 aa, Ralstonia eutropha JMP134
MSREVLLLVDALAREKNVDKDVVFGALEAALASATKKRFEEDVDIRVAIDRESGEHETFRRWLVVPDEQGLQEPDKQILLFEARDDDASLELGDYVEQQIESVEFGRIGAQAAKQVILQRIRDAEREQILNDYLERGEKIMTGTVKRADKKGLIVESGRVEALLARDQIIPKENLRTGDRVRAYILNVDRAARGPQIELSRTAPEFLIKLFENEVPEMEQGLLEIKAAARDPGVRAKIAVVAHDKRIDPIGTCVGVRGTRVTAVRNEIGGEAVDIVLWSEDPAQFVIGALAPAQVQSIVVDEEKHCMDVVVDEENLAVAIGRSGQNVRLASELTGWQINIMTQEESAQKQAEESDAVRKLFMAKLDVDEEVADILIEEGFSTLEEVAYVPISEMMEIEAFDEDTVNELRNRARDALLTMELAREEKVEEVSQDLRSLDGLNPELIGKLAEGDIHTRDDLAELAVDELVEMTGVTEEEAKALIMKAREHWFN

SEQ ID NO: 64577 - DNA, 1329 bp, Chloroflexus aurantiacus
  CDS (1)..(1329)
atgaaaagcgatttttacgcggcaattactcagattgcatccgagcgcggtattccaaaagaggccatcatcgatgtgatggaacgggcattggtgagtgcgtatcgacgtttattaggcccgaatccgccggctatcgatgtggttgtcaagctcgatccggtaagtggtgtggcgcgggtgtacgctgagaaacaggttgttgatgaagtgtacgatgagcgttttgagatcgatctcgaagcggctcgccgcattaaacctgatgcgcagatcggcgaggcagtcctggtcgagagtaccccgcgtgatttcgggcggattgctgctcaaaccgccaagcaagttgtcttgcagggcatcaaggatattgagcgcaattacatctacagcgagtttgaggatcgcgaaggggaattgctcacggcaaccgttcagcgcaataacggcccgcgcggtaacgtgattcttgaacttgggaaagccgaagccatcattccaccgaaagagcaggtagcgaatgaccgctactaccacgggcagcggctgaaagtctatttgatggaagtcaagaaggatgagcgagggccacgcctgatcgcctctcgtgcgcataagaatttgatcctccgtctcttcgagatggaggtgcctgaaatctacaatggcgccgttgagattaagtctatcgctcgcgagccggggctgcgcacgaaggtcgccgtcgccgctcgtcaagaggggatcgatccggttggttcgtgtgtcggtatgcgcggtatccgcattcagaatatcgtgaacgagctgaacggcgagaagatcgatgttgtgcagtggtcgtctgatccgcgcgagtacattgccaacgcactttcgccggctcaggtggtcgaagttcatcttaatgatcacgagcacaccgccctggttattgtgcccgataagcaattgtcactggcaattggtaaagaagggcaaaatgtacgcctggccgagaagctgaccggttggcgaatcgatatcaagagtgcctcggtgctgcttgaagaggaacgagcagcggctgaggcgcgtgcggaggcggaagctgaacagatggcgattgaggctgagctggcaatggctccgatagagacacgagtggtgcaaccggatggtaccattcgctaccgtggccatcgctatggccctcttggttccgatctggtcggtaagacggtacaggtgcgagcgacctcgcagaagatttttatctattacaatgaccgcctgttcgcttcctacattttgctggaaggtggacaggtagtgcccgatgaggagtaa

SEQ ID NO: 64578 - protein, 442 aa, Chloroflexus aurantiacus
MKSDFYAAITQIASERGIPKEAIIDVMERALVSAYRRLLGPNPPAIDVVVKLDPVSGVARVYAEKQVVDEVYDERFEIDLEAARRIKPDAQIGEAVLVESTPRDFGRIAAQTAKQVVLQGIKDIERNYIYSEFEDREGELLTATVQRNNGPRGNVILELGKAEAIIPPKEQVANDRYYHGQRLKVYLMEVKKDERGPRLIASRAHKNLILRLFEMEVPEIYNGAVEIKSIAREPGLRTKVAVAARQEGIDPVGSCVGMRGIRIQNIVNELNGEKIDVVQWSSDPREYIANALSPAQVVEVHLNDHEHTALVIVPDKQLSLAIGKEGQNVRLAEKLTGWRIDIKSASVLLEEERAAAEARAEAEAEQMAIEAELAMAPIETRVVQPDGTIRYRGHRYGPLGSDLVGKTVQVRATSQKIFIYYNDRLFASYILLEGGQVVPDEE

SEQ ID NO: 64579 - DNA, 1521 bp, Polaromonas sp. JS666
  CDS (1)..(1521)
atgaatcgcgaactgttgatgttggttgatgccatctcgcgtgagaaaaatgttgaacgtgacgtcgtttttggggctgtcgagcttgcgctcgcctcggccaccaagaaggtgtacgaagacggcgtggacatccgcgtggtggtagaccgtgacagcggcaattacgagactttccgccgctggctggtggtgcctgatgaagccggcctgcaaaatccggaagccgaagagctggtgagcgacgctcgcgaagaaattcccgacattgaagaaggcgactacatcgaaaaaccggtggagagtctgcctatcggtcgcatcggcgcacaagccgccaagcaggtcatcctgcaaaaaatccgcgatgccgagcgcgaaatgctgctcaacgacttcatgtcgcgcggcgacaagatttttgtcggcaccgtcaagcgcatggacaagggcgacatcattgtcgaatctggccgtgtcgaggggcggctgcgtcgcagcgacatgatccccaaggaaaatctgcgtgccggagaccgcgtccgcgccatgatcatggaggtcgacaccaccctgcgcggtgcccccatcatcctgtcgcgcaccgccccagagtacatgatcgagctgttccgccaggaagtgcccgagatcgagcagggcctgctagagatcaagtcctgcgcccgtgaccccggttcgcgcgccaagatcgccgtgttgtcgcacgacaagcgggtggatcccatcggcacttgtgtcggggttcgcggcacccgtgtcaatggcgtgaccaatgagctcgccggcgaacgcgtcgatatcgtgctgtggagcgaagacccggcccagttcgtgattggcgcactggcgcctgccaatgtgtcatccatcgtggtggacgaagagcgccacgccatggacgtcgtggtcgacgaagaaaacctggccatttcgatcggccgcggtggccagaacgtgcgcctggctgcagagctgaccggctggaagatcaacatcatgacggccgacgagtcggcccagaagcaggcgaccgaaaccgataccagccgcaagctcttcatggaaaagcttgatgtggacgaggaaatcgccgacatcctgatctccgaaggcttcaccagcctggaagaagtcgcgtatgtgccgctgcaggaaatgctcgagatcgaatcgtttgatgaagacacggtcaatgagttgcgcacccgcgccaaagatgcactgttgacgatggaaatcgccaaggaagaaaatgccgaaggtgtttcgcagaacctgcgtgacgttgaaggcattacgcccgagctgatcgccaaacttaccgaagcgggtgtccatacccgcgacgacctggccgatctggctgtggacgaactcaccgatatcaccggccagtctgcggacgaagccaaggccctgatcatgactgctcgcgcccattggtttaccaatgacgcaagtgacaccgctgcacctgcaacggcccaagagcaatga

SEQ ID NO: 64580 - protein, 506 aa, Polaromonas sp. JS666
MNRELLMLVDAISREKNVERDVVFGAVELALASATKKVYEDGVDIRVVVDRDSGNYETFRRWLVVPDEAGLQNPEAEELVSDAREEIPDIEEGDYIEKPVESLPIGRIGAQAAKQVILQKIRDAEREMLLNDFMSRGDKIFVGTVKRMDKGDIIVESGRVEGRLRRSDMIPKENLRAGDRVRAMIMEVDTTLRGAPIILSRTAPEYMIELFRQEVPEIEQGLLEIKSCARDPGSRAKIAVLSHDKRVDPIGTCVGVRGTRVNGVTNELAGERVDIVLWSEDPAQFVIGALAPANVSSIVVDEERHAMDVVVDEENLAISIGRGGQNVRLAAELTGWKINIMTADESAQKQATETDTSRKLFMEKLDVDEEIADILISEGFTSLEEVAYVPLQEMLEIESFDEDTVNELRTRAKDALLTMEIAKEENAEGVSQNLRDVEGITPELIAKLTEAGVHTRDDLADLAVDELTDITGQSADEAKALIMTARAHWFTNDASDTAAPATAQEQ

SEQ ID NO: 64581 - DNA, 1116 bp, Bacillus subtilis
  CDS (1)..(1116): transl_table=11
atgagcagtgaattattagatgctctcacgattcttgaaaaagaaaaaggcatcagtaaagaaattatcatcgaagcaatcgaagctgcgttaatttctgcttataagcggaattttaatcaagcgcaaaatgtacgggtggatctaaaccgtgaaactggctccatccgtgtatttgcaagaaaagatgtcgttgacgaagtatacgaccagagattagaaatctcaattgaagaggcacagggcatccatccggaatatatggtcggcgatgtcgtcgaaatcgaagttacacctaaggatttcgggcgcatagctgctcaaacagcgaagcaggtcgtcacacagcgtgtgcgcgaagctgagcgcggtgtgatttattctgaatttatcgaccgtgaagaagacatcatgacagggatcgtccagcgtctggacaataaatttatctacgtgtctttaggcaaaatagaagccttgctgccggttaatgagcaaatgccgaatgaaagctacaagccccatgaccgcattaaggtatatatcacaaaagtagaaaaaacaacgaagggtccgcagatttatgtgtcaagaacacatccaggcctgttaaagcgtttgtttgaaattgaagtgcctgaaatttatgatggaactgtcgagctaaaatctgttgccagagaagccggcgaccgttcgaaaatttctgttcgcacagatgatcctgacgttgatcctgtcggttcatgcgtagggcctaaaggccagcgtgtgcaagcaatcgtcaatgaattaaaaggtgaaaaaattgacattgtcaactggtccagtgatcctgtagaatttgtcgcgaatgcgctcagcccttccaaagtgcttgatgtcattgttaatgaagaagaaaaagcgacaactgttattgttcctgattaccagctgtctctggcaattggaaaaagaggacaaaacgcacgcttagctgctaaactgacaggctggaagattgatattaagagcgaaacggacgcaagagaacttggaatctatccgagagaacttgaagaagatgatgagccgctctttacggagcctgaaactgctgaatcggatgaataa

SEQ ID NO: 64582 - protein, 371 aa, Bacillus subtilis
MSSELLDALTILEKEKGISKEIIIEAIEAALISAYKRNFNQAQNVRVDLNRETGSIRVFARKDVVDEVYDQRLEISIEEAQGIHPEYMVGDVVEIEVTPKDFGRIAAQTAKQVVTQRVREAERGVIYSEFIDREEDIMTGIVQRLDNKFIYVSLGKIEALLPVNEQMPNESYKPHDRIKVYITKVEKTTKGPQIYVSRTHPGLLKRLFEIEVPEIYDGTVELKSVAREAGDRSKISVRTDDPDVDPVGSCVGPKGQRVQAIVNELKGEKIDIVNWSSDPVEFVANALSPSKVLDVIVNEEEKATTVIVPDYQLSLAIGKRGQNARLAAKLTGWKIDIKSETDARELGIYPRELEEDDEPLFTEPETAESDE

SEQ ID NO: 64583 - DNA, 1449 bp, Borrelia burgdorferi
  CDS (1)..(1449): transl_table=11
atgataaagggcacggggcatatgattgtaaatattgcaaatgatcgtggcatgagtatagattctattagaaaaacaattaaagaatcagtattaatagcttataagaagtattttggaagcaatgagaatgcttttattaagtttgatgatgatacgggagatttgtctgtttatgcaaaaaagaaaattgtaaaagaggtaaaagattctttgcttgaaatattagaaaaagatatctcaaaggaaaatattgtagaaggtgattatgcttacattgaaattaatcccaaagtttttgataggctttctattcaggttgcaaaacaaagaaccaaaaatgacctgcaaggaattgaggataatgagattttatcagaatttaaaagcaagttgaataaggttgttattgggtacgttcaacaaaatagaaatggtgatctttatgttaatcttggtaatacggatggtataattcccaagaaatatcaatcgccaagagaagtttataaccttaatgataagattagagttttagtttataatgtcaaaaagggtaaaaatggtattgaagttattctttctaggacccatccaaagtttattgaagagcttttagcgcttgaaattccagaaattgaagaaggtattattaagattcataaaatagttcgcgatcctggttacagaatcaaagtcgctgtttattctgaaaaagaagagattgatcctgttggtccttgtataggacaaaaaggagtcagaattcaatctataattaaggaacttgaaggagaaaaaattgatattattccctatagtaaagatattaaagaatttataaaggattctttgactccttcaaagatagaacatgtttatattcttgacgaggatttacataaagctttagtggttgttagtgatgaccagctttctcttgctataggtaaaatgggtcaaaatgttagacttgctaatagacttcttgactgggctattgatgttaaaactagcagtcaatttgcagaaatgaaggctaattcggagtttaagcaagaaacactcgaaatgtttgataaagttatgcaagatgttgttgaggaggagcaatttgaagagattagtaaaataagtgatcttaaattgcttgatccttctgtgatttctaatttatcaaaagaggggtttgatgatattaacaattttttacaagcagatgagggagtgctttttaatcttggtgtaagttatgaaaaacaagaagaaattaacaaaatattaaaagaggggatgataataattgctaatgacaatgatgagtctatggaaaaggtagaagaagatgaagagcttctttgtcctgaatgcggtgttgttattaatgaaaatatgacctcctgtccgggttgtaaaatagggcttagttttgagtttgaggaggagtag

SEQ ID NO: 64584 - protein, 482 aa, Borrelia burgdorferi
MIKGTGHMIVNIANDRGMSIDSIRKTIKESVLIAYKKYFGSNENAFIKFDDDTGDLSVYAKKKIVKEVKDSLLEILEKDISKENIVEGDYAYIEINPKVFDRLSIQVAKQRTKNDLQGIEDNEILSEFKSKLNKVVIGYVQQNRNGDLYVNLGNTDGIIPKKYQSPREVYNLNDKIRVLVYNVKKGKNGIEVILSRTHPKFIEELLALEIPEIEEGIIKIHKIVRDPGYRIKVAVYSEKEEIDPVGPCIGQKGVRIQSIIKELEGEKIDIIPYSKDIKEFIKDSLTPSKIEHVYILDEDLHKALVVVSDDQLSLAIGKMGQNVRLANRLLDWAIDVKTSSQFAEMKANSEFKQETLEMFDKVMQDVVEEEQFEEISKISDLKLLDPSVISNLSKEGFDDINNFLQADEGVLFNLGVSYEKQEEINKILKEGMIIIANDNDESMEKVEEDEELLCPECGVVINENMTSCPGCKIGLSFEFEEE

SEQ ID NO: 64585 - DNA, 1488 bp, Buchnera aphidicola
  CDS (1)..(1488): transl_table=11
atgaataaagaaatcttagctgttgtagaagctgtgtctaatgaaaaatcactgccacgtgaaaaaatttttgaagctttagaaattgcattagcaacggcaactaagaaaaaatatgaacaagaaattgatgtaagagttagtataaatcgtaaaactggaaattttagtacctttagacgatggatggtagtagatattgttgttcatccaacaaaagagattactttagaagcagcttgttttgaaggtgaacaagttaaaattaatgattatgtagaagataaaattgaatctgtaaattttgatagaataacaactcaaactgctaaacaagtcattgttcaaaaagtacgtgaagcagaacgagcaatgctagtcgatcaatttcgtaaacatattggtcaaatcatcaccggtatagttaaaaaaattagtcgagataatttgactttagatttaggtaataatgccgaagctttaattttacgtgaaggtatgttacctcgagaaaattttcgtcctggagatcgtattcgtggtattttatacggagtatatccagaagctcgtggcgcacagttgtttctgagtcgttcaaaaactgaaatgcttattgagctttttcgtatagaagttcccgaaattggagaagaagttattgaaattaaagcagctgcacgtgatccaggttctcgtgctaaaattgcagtaaaaaccaatgataaacgaattgatccaataggagcttgtgtaggaatgagaggtgcacgagtacaagctgtatctagtgaattatgtggagaacgaattgatattatcttatgggatgataatcctgctcaatttgtcattaacgctatggctcctgctgatgtcgtttctattatagtagatgaagatcaccatactatggacattgctgtagactcgagtaatttagcacaagcgattggacgtaatggtcaaaatgttcgtttagcttctcagattagtggttgggaacttaatgttatgactacagaagatcttagatctaaacacaaagaagaagcttatgctgcttttaatatttttaagaaaaatttaaatgttagtgaaaaagtcattaaaactttagttaaagaaggtttttcttctctcgaagaattagcgtatataccacttaatgagttgttagaaattaataatttaacagagagagaagtgcaattagttcgtgaaggcgctaaaaatggattgcttcttcttgagttagatcaaaaaaatcagatcaaaaataaaaaaattgaacaagctttattgaatgtaaatggtatgaatgagctattagctttaaagttagcagaaaaaaatatatttactgtggaagaattagctaatcagggaatagatgatttaattgatattgaaaatttaaattctgagcaagctggtttgttaattatggcagctcgtaatatatgttggtttagcagcaaagtctga

SEQ ID NO: 64586 - protein, 495 aa, Buchnera aphidicola
MNKEILAVVEAVSNEKSLPREKIFEALEIALATATKKKYEQEIDVRVSINRKTGNFSTFRRWMVVDIVVHPTKEITLEAACFEGEQVKINDYVEDKIESVNFDRITTQTAKQVIVQKVREAERAMLVDQFRKHIGQIITGIVKKISRDNLTLDLGNNAEALILREGMLPRENFRPGDRIRGILYGVYPEARGAQLFLSRSKTEMLIELFRIEVPEIGEEVIEIKAAARDPGSRAKIAVKTNDKRIDPIGACVGMRGARVQAVSSELCGERIDIILWDDNPAQFVINAMAPADVVSIIVDEDHHTMDIAVDSSNLAQAIGRNGQNVRLASQISGWELNVMTTEDLRSKHKEEAYAAFNIFKKNLNVSEKVIKTLVKEGFSSLEELAYIPLNELLEINNLTEREVQLVREGAKNGLLLLELDQKNQIKNKKIEQALLNVNGMNELLALKLAEKNIFTVEELANQGIDDLIDIENLNSEQAGLLIMAARNICWFSSKV

SEQ ID NO: 64587 - DNA, 1494 bp, Buchnera aphidicola
  CDS (1)..(1494): transl_table=11
atgaataaagaaattctagcagttgtagaagcggtttctaatgaaaaatcgttacctcgtgaaaaaatttttgaagcattagaatgcgcattagctattgctactaagaaaaaatacgatcaagaaattgatgtacgagttaaaataaatagaaaaaatggaaattttgaaacgtttcgtcgatggttagtggttaatcaagtattacaaccaactaaagaaattactttagaagctgctaaatttgaagacgtgacagtaaaagttaatgattatatagaagataagatgatttctgtaacatttgatagaataacaacacaaactgctaaacaagttattgttcaaaaagttcgtgaagcagaaagagcaatgattgtagaacaatttaggaaatattttggaaagattctaacaggaatagtaaaaaaaataaatagagaaagtattactttagatttaggtaataatgctgaagctttgattttgaaagaagatatgcttcctagagaaaactttagattaggtgatcgtgttcgaggtgtgttatatgctatttaccccgaatctcgcggagctcaattatttgtaactcgatctaaaccagaaatgttaattgaattatttaaaattgaagttccagaaataggagaagaaattattgaaataaaatcagcagcacgcgatccaggatcacgtgctaaaatagctgtaaaaagtaatgataaaagagttgatgcagttggagcatgtgtaggtatgcgtggtgcacgcgttcaagcagtttctagtgaattgtgtggtgagagaatagacattgtattatgggataaaaattcagcacaattcattattaattcaatggctccagctgaagtttcatctattgtattagatgaagatcgtcatactattgatatagctgtagattctaacaatttagctcaagcaattggaagaaatgggcaaaatgtacgtttagcgtctcaattaagtggatgggaaataaatgtaatgacagtagatgatttaaaattaaaacatcaggaagagaaagataaaattttaaatatttttacaaaatatttaaaaattgatcagaaaatttctaatattttaattgacgaagggttttcttctatagaagaattagtttacattccatttaatgaattactaaatattaattctataacacaagaattagcatattctatacgagaaagtgcaaaaaaggctttatgtgctatagagttagaaaataaaaaagtaattaatgaacgtaaattgcataaagatttgttaaatttaaaaggtatgaaccaaaaacttgcttttaaattagcaaaaaaaaatatttttagtttagaagatttggccgaacaggggattgatgatttgatagatattgaaaatttaaattctaatactgctggaatgttaattatggctgctagaaatatatgttggtttggtaataaaactagtgcatag

SEQ ID NO: 64588 - protein, 497 aa, Buchnera aphidicola
MNKEILAVVEAVSNEKSLPREKIFEALECALAIATKKKYDQEIDVRVKINRKNGNFETFRRWLVVNQVLQPTKEITLEAAKFEDVTVKVNDYIEDKMISVTFDRITTQTAKQVIVQKVREAERAMIVEQFRKYFGKILTGIVKKINRESITLDLGNNAEALILKEDMLPRENFRLGDRVRGVLYAIYPESRGAQLFVTRSKPEMLIELFKIEVPEIGEEIIEIKSAARDPGSRAKIAVKSNDKRVDAVGACVGMRGARVQAVSSELCGERIDIVLWDKNSAQFIINSMAPAEVSSIVLDEDRHTIDIAVDSNNLAQAIGRNGQNVRLASQLSGWEINVMTVDDLKLKHQEEKDKILNIFTKYLKIDQKISNILIDEGFSSIEELVYIPFNELLNINSITQELAYSIRESAKKALCAIELENKKVINERKLHKDLLNLKGMNQKLAFKLAKKNIFSLEDLAEQGIDDLIDIENLNSNTAGMLIMAARNICWFGNKTSA

SEQ ID NO: 64589 - DNA, 1188 bp, Helicobacter pylori J99
  CDS (1)..(1188): transl_table=11
atggaaaaaatcagcgaccttatagaatgcattgcgtatgaaaaaaatttgcctaaagagatgatttcaaaagtgattcaaggctgtttgttaaaaatggcgcaaaatgaattggaccccctagcgcgctacttggtggttgaagaaaacaagcagctccagcttatccagttggtggaagttttagaagacgatgatgaaaggttggttaacgatccttctaaatacatcagtctgtctaaagccaaagaaatggatccaagcgttaagattaaagacgaattgtcctatagtttgagtttggagagcatgaagcaaggagcgatcaaccgcctttttaaagatttgcaataccagctagaaaaggcgttagaagacagccactttgaagcgttccaaaagcgccttaacagcgttttaatggggcaagtgattttagtggatcacaatcaaaacacttttattgaaatcgagcagcaattccaaggcgttctttccatgcgccatcgcatcaagggcgaaagttttaaaataggcgatagcatcaaggcggttttaacgcaagtcaaacgcacgaaaaagggcttactattagagctgagtcgcaccacccctaaaatgcttgaagccttgttggaattagaagtccctgaaattaaagataaagagattgaaatcatccattgcgcgcgaatcccaggcaacagggcgaaagtgagctttttttcccataactctaggattgatcccataggcgcagccgtgggggttaagggcgtgcgcatcaatgcgataagtaacgaattgaataaagaaaacattgattgcatagagtattctaatgtgcctgaaatttatatcactctcgcactcgctccagccaaaattttaagcgttgaaattaaaaaaatccccatagaagaattgagtgctgaagaaaaagaatccattcaagagcgtttcattgtcaataaccatttgcaaaaggctaaagtacgtttattagacattgaaaaatctaaggctatcggtaaaggcggggtgaatgtgtgcttagcgtccatgcttacaggctatcacatagagtttgaaaccattcctagcgtcaaggaaaacgcagaaaatgaaaacgaaaaagaaacgccaaaagtaggggtagaagctttagagtctttgtttaagaattga

SEQ ID NO: 64590 - protein, 395 aa, Helicobacter pylori J99
MEKISDLIECIAYEKNLPKEMISKVIQGCLLKMAQNELDPLARYLVVEENKQLQLIQLVEVLEDDDERLVNDPSKYISLSKAKEMDPSVKIKDELSYSLSLESMKQGAINRLFKDLQYQLEKALEDSHFEAFQKRLNSVLMGQVILVDHNQNTFIEIEQQFQGVLSMRHRIKGESFKIGDSIKAVLTQVKRTKKGLLLELSRTTPKMLEALLELEVPEIKDKEIEIIHCARIPGNRAKVSFFSHNSRIDPIGAAVGVKGVRINAISNELNKENIDCIEYSNVPEIYITLALAPAKILSVEIKKIPIEELSAEEKESIQERFIVNNHLQKAKVRLLDIEKSKAIGKGGVNVCLASMLTGYHIEFETIPSVKENAENENEKETPKVGVEALESLFKN

SEQ ID NO: 64591 - DNA, 1164 bp, Thermus thermophilus
  CDS (1)..(1164): transl_table=11
atgaacagggagttcgtggaagccatgcagcacctggccctggagcgcggggtcagcgtggaggagatcctggaggccttcaaggaggccctgcgcaaggcctacatcaagcggcagaagggctacaagaaggaggagattgaccaggggaagggccccgaggtggacgtctacattgacccgaactcgggccgcattgagatggtggaggtccggcgggtggtggagaaggtggaggaccccgacaaggagatcgccctcgccgaggccctccagtacgaccccgaggtccaggtgggggacgagatggagttccccatcaacccggaggagctctcccgcatggccatccaggacctgcgccagatcctgacccagcgcctcaaggagtcggagcgcaaccggatctacaacgagtacaaggacaaggaggggcaggtcctcaccggggtggtcacccgggtggacaaccggggcaacgtcttcgtggagctgggccggggcgaggcctacctcccccggagcgagcagatccccacggagaagtaccaccccggccagcggatcaaggtctacctgaagaaggtggacaagtccgccaagggcccctccctcctggtgagccgggcccacgagaagcttttggagcacctcctcaagcaggaggtgcccgagatcgccgagggcatcgtggagatcaaggccatcgcccgggagcccggccgccggagcaaggtggcggtcacgagccacaaccccaacgtggaccccatcggggcctgcatcgggcacaagggccagcgcatccaggcggtttccgccgagctcggccgggagaaggtggacatcatcctgtggtccaaggaccccaaggagttcatccgcaacgccctctcccccgcccaggtgggctccattgagcttgaccccgaggcgaagaaggcccgggtcaaggtcaccaaggaccagcactccctggccatcggcaccggggggcagaacgtccgcctggcctccaagctcaccgggtacgacatccactttgaggaggcggagatctccgacctggacgaggccctgcggcgcgccgccgaggaggaggccgaggcccgggaaaggaaggcccgcgaggagtttgagaagctcttccgtgacctcggatga

SEQ ID NO: 64592 - protein, 387 aa, Thermus thermophilus
MNREFVEAMQHLALERGVSVEEILEAFKEALRKAYIKRQKGYKKEEIDQGKGPEVDVYIDPNSGRIEMVEVRRVVEKVEDPDKEIALAEALQYDPEVQVGDEMEFPINPEELSRMAIQDLRQILTQRLKESERNRIYNEYKDKEGQVLTGVVTRVDNRGNVFVELGRGEAYLPRSEQIPTEKYHPGQRIKVYLKKVDKSAKGPSLLVSRAHEKLLEHLLKQEVPEIAEGIVEIKAIAREPGRRSKVAVTSHNPNVDPIGACIGHKGQRIQAVSAELGREKVDIILWSKDPKEFIRNALSPAQVGSIELDPEAKKARVKVTKDQHSLAIGTGGQNVRLASKLTGYDIHFEEAEISDLDEALRRAAEEEAEARERKAREEFEKLFRDLG

SEQ ID NO: 64593 - DNA, 26 bp, Primer
atgaacaaagaaattttggctgtagt

SEQ ID NO: 64594 - DNA, 22 bp, Primer
ttacgcttcgtcaccgaaccag

SEQ ID NO: 64595 - protein, 427 aa, consensus
  MISC_FEATURE (1)..(427): consensus for the disclosure of xaa see table XV
KXXXXXXXXXXXXXAXXXXXXXXXXXXXXXXXXXXXXXXXXXXXXXXXXXXXGXXXXXXXXXXVXXXXXXXXXXXXXXXXXXXXXXXXXXXXXXXXXXXXXXXXXXXXXXXXXXXXXFXRXXXXXXXQXXXQXXRXXEXXXXXXXXXXXXXXXXXGXXXXXXXXXXXXXXXXXXXXXXXXXXXEXXXXXXXXXPXEXXXXXXXXXXXXXXXXXXXXVXXXXXXGXXXXXXXXXXXXXXXXXXXXXSRXXXXXXXXLFXXEVPEXXXXXXXIXXXARXXXXXXXXXGXRXKXAVXXXXXXXXXXDPXGXCXGXXGXRXXXXXXELXXXXXXXXXXXXXXXXEXXDXXXXXXXXXXXXXXAXXXXXXXPAXXXXXXXXXXXXXXXXXXXXXXXXXXXXXXXXXXXXXXXLXXAIGXXGQNXRLAXXLXG

SEQ ID NO: 64596 - protein, 153 aa, consensus
  MISC_FEATURE (1)..(153): consensus for the disclosure of xaa see table XV
XXXXRXXXXXXXXXXXXEXXEXXXXXXXXXXXXRXXXXXXXXXGXXXKXXVXXXXXXXXXXXXXGXXXGXXGXRXXXXXXXXXXEXXDXXXXXXXXXXXXXXXXXPXXXXXXXXXXXXXXXXXXXXXXXXXXXXXXXXXIGXXGXXXXLXXXX

SEQ ID NO: 64597 - DNA, 725 bp, Escherichia coli K12; identical to SEQ ID NO: 31626
  CDS (4)..(432)

SEQ ID NO: 64598 - protein, 142 aa, Escherichia coli K12 [sequence omitted]

SEQ ID NO: 64599 - DNA, 982 bp, Spinacia oleracea (spinach); identical to SEQ ID NO: 31628
  CDS (40)..(792)

SEQ ID NO: 64600 - protein, 250 aa, Spinacia oleracea (spinach); identical to SEQ ID NO: 31629

SEQ ID NO: 64601 - DNA, 444 bp, Mycobacterium tuberculosis; identical to SEQ ID NO: 31630
  CDS (1)..(444)

SEQ ID NO: 64602 - protein, 147 aa, Mycobacterium tuberculosis; identical to SEQ ID NO: 31631

SEQ ID NO: 64603 - DNA, 453 bp, Chlamydia trachomatis; identical to SEQ ID NO: 31632
  CDS (1)..(453)

SEQ ID NO: 64604 - protein, 150 aa, Chlamydia trachomatis; identical to SEQ ID NO: 31633

SEQ ID NO: 64605 - DNA, 429 bp, Pseudomonas aeruginosa; identical to SEQ ID NO: 31634
  CDS (1)..(429)

SEQ ID NO: 64606 - protein, 142 aa, Pseudomonas aeruginosa; identical to SEQ ID NO: 31635

SEQ ID NO: 64607 - DNA, 474 bp, Caulobacter crescentus; identical to SEQ ID NO: 31636
  CDS (1)..(474)

SEQ ID NO: 64608 - protein, 157 aa, Caulobacter crescentus; identical to SEQ ID NO: 31637

SEQ ID NO: 64609 - DNA, 757 bp, Arabidopsis thaliana (mouse-ear cress); identical to SEQ ID NO: 31638
  CDS (1)..(726)

SEQ ID NO: 64610 - protein, 241 aa, Arabidopsis thaliana (mouse-ear cress); identical to SEQ ID NO: 31639

SEQ ID NO: 64611 - DNA, 465 bp, Agrobacterium tumefaciens; identical to SEQ ID NO: 31640
  CDS (1)..(465)

SEQ ID NO: 64612 - protein, 154 aa, Agrobacterium tumefaciens; identical to SEQ ID NO: 31641

SEQ ID NO: 64613 - DNA, 465 bp, Brucella melitensis; identical to SEQ ID NO: 31642
  CDS (1)..(465)

SEQ ID NO: 64614 - protein, 154 aa, Brucella melitensis; identical to SEQ ID NO: 31643

SEQ ID NO: 64615 - DNA, 438 bp, Listeria monocytogenes; identical to SEQ ID NO: 31644
  CDS (1)..(438)

SEQ ID NO: 64616 - protein, 145 aa, Listeria monocytogenes; identical to SEQ ID NO: 31645

SEQ ID NO: 64617 - DNA, 456 bp, Nostoc sp. PCC 7120; identical to SEQ ID NO: 31646
  CDS (1)..(456)

SEQ ID NO: 64618 - protein, 151 aa, Nostoc sp. PCC 7120; identical to SEQ ID NO: 31647

SEQ ID NO: 64619 - DNA, 438 bp, Haloarcula marismortui; identical to SEQ ID NO: 31648
  CDS (1)..(438)

SEQ ID NO: 64620 - protein, 145 aa, Haloarcula marismortui; identical to SEQ ID NO: 31649

SEQ ID NO: 64621 - DNA, 441 bp, Mycoplasma genitalium; identical to SEQ ID NO: 31650
  CDS (1)..(441): transl_table=4

SEQ ID NO: 64622 - protein, 146 aa, Mycoplasma genitalium; identical to SEQ ID NO: 31651

SEQ ID NO: 64623 - DNA, 441 bp, Borrelia burgdorferi (Lyme disease spirochete); identical to SEQ ID NO: 31652
  CDS (1)..(441)

SEQ ID NO: 64624 - protein, 146 aa, Borrelia burgdorferi (Lyme disease spirochete); identical to SEQ ID NO: 31653

SEQ ID NO: 64625 - DNA, 429 bp, Pyrococcus horikoshii; identical to SEQ ID NO: 31654
  CDS (1)..(429)

SEQ ID NO: 64626 - protein, 142 aa, Pyrococcus horikoshii; identical to SEQ ID NO: 31655

SEQ ID NO: 64627 - DNA, 432 bp, Neisseria meningitidis; identical to SEQ ID NO: 31656
  CDS (1)..(432)

SEQ ID NO: 64628 - protein, 143 aa, Neisseria meningitidis; identical to SEQ ID NO: 31657

SEQ ID NO: 64629 - DNA, 429 bp, Vibrio cholerae; identical to SEQ ID NO: 31658
  CDS (1)..(429)

SEQ ID NO: 64630 - protein, 142 aa, Vibrio cholerae; identical to SEQ ID NO: 31659

SEQ ID NO: 64631 - DNA, 423 bp, Methanococcus jannaschii; identical to SEQ ID NO: 31660
  CDS (1)..(423)

SEQ ID NO: 64632 - protein, 140 aa, Methanococcus jannaschii; identical to SEQ ID NO: 31661

SEQ ID NO: 64633 - DNA, 435 bp, Clostridium acetobutylicum; identical to SEQ ID NO: 31662
  CDS (1)..(435)

SEQ ID NO: 64634 - protein, 144 aa, Clostridium acetobutylicum; identical to SEQ ID NO: 31663

SEQ ID NO: 64635 - DNA, 483 bp, Helicobacter pylori; identical to SEQ ID NO: 31664
  CDS (19)..(444)

SEQ ID NO: 64636 - protein, 141 aa, Helicobacter pylori; identical to SEQ ID NO: 31665

SEQ ID NO: 64637 - DNA, 429 bp, Treponema pallidum subsp. pallidum (syphilis spirochete); identical to SEQ ID NO: 31666
  CDS (1)..(429)

SEQ ID NO: 64638 - protein, 142 aa, Treponema pallidum subsp. pallidum (syphilis spirochete); identical to SEQ ID NO: 31667

SEQ ID NO: 64639 - DNA, 849 bp, Methanobacterium thermoautotrophicum; identical to SEQ ID NO: 31668
  CDS (1)..(849)

SEQ ID NO: 64640 - protein, 282 aa, Methanobacterium thermoautotrophicum; identical to SEQ ID NO: 31669

SEQ ID NO: 64641 - DNA, 525 bp, Deinococcus radiodurans; identical to SEQ ID NO: 31670
  CDS (1)..(525)

SEQ ID NO: 64642 - protein, 174 aa, Deinococcus radiodurans; identical to SEQ ID NO: 31671

SEQ ID NO: 64643 - DNA, 426 bp, Campylobacter jejuni; identical to SEQ ID NO: 31672
  CDS (1)..(426)

SEQ ID NO: 64644 - protein, 141 aa, Campylobacter jejuni; identical to SEQ ID NO: 31673

SEQ ID NO: 64645 - DNA, 447 bp, Ureaplasma urealyticum; identical to SEQ ID NO: 31674
  CDS (1)..(447): transl_table=4

SEQ ID NO: 64646 - protein, 148 aa, Ureaplasma urealyticum; identical to SEQ ID NO: 31675

SEQ ID NO: 64647 - DNA, 438 bp, Staphylococcus aureus; identical to SEQ ID NO: 31676
  CDS (1)..(438)

SEQ ID NO: 64648 - protein, 145 aa, Staphylococcus aureus; identical to SEQ ID NO: 31677

SEQ ID NO: 64649 - DNA, 522 bp, Plasmodium falciparum; identical to SEQ ID NO: 31678
  CDS (1)..(522)

SEQ ID NO: 64650 - protein, 173 aa, Plasmodium falciparum; identical to SEQ ID NO: 31679

SEQ ID NO: 64651 - DNA, 468 bp, Rickettsia prowazekii; identical to SEQ ID NO: 31680
  CDS (1)..(468)

SEQ ID NO: 64652 - protein, 155 aa, Rickettsia prowazekii; identical to SEQ ID NO: 31681

SEQ ID NO: 64653 - DNA, 429 bp, Xylella fastidiosa; identical to SEQ ID NO: 31682
  CDS (1)..(429)

SEQ ID NO: 64654 - protein, 142 aa, Xylella fastidiosa; identical to SEQ ID NO: 31683

SEQ ID NO: 64655 - DNA, 438 bp, Halobacterium sp. NRC-1; identical to SEQ ID NO: 31684
  CDS (1)..(438)

SEQ ID NO: 64656 - protein, 145 aa, Halobacterium sp. NRC-1; identical to SEQ ID NO: 31685

SEQ ID NO: 64657 - DNA, 429 bp, Buchnera sp; identical to SEQ ID NO: 31686
  CDS (1)..(429)

SEQ ID NO: 64658 - protein, 142 aa, Buchnera sp; identical to SEQ ID NO: 31687

SEQ ID NO: 64659 - DNA, 447 bp, Lactococcus lactis subsp. lactis; identical to SEQ ID NO: 31688
  CDS (1)..(447)

SEQ ID NO: 64660 - protein, 148 aa, Lactococcus lactis subsp. lactis; identical to SEQ ID NO: 31689

SEQ ID NO: 64661 - DNA, 429 bp, Haemophilus influenzae; identical to SEQ ID NO: 31690
  CDS (1)..(429)

SEQ ID NO: 64662 - protein, 142 aa, Haemophilus influenzae; identical to SEQ ID NO: 31691

SEQ ID NO: 64663 - DNA, 471 bp, Archaeoglobus fulgidus; identical to SEQ ID NO: 31692
  CDS (1)..(471)

SEQ ID NO: 64664 - protein, 156 aa, Archaeoglobus fulgidus; identical to SEQ ID NO: 31693

SEQ ID NO: 64665 - DNA, 438 bp, Bacillus subtilis; identical to SEQ ID NO: 31694
  CDS (1)..(438)

SEQ ID NO: 64666 - protein, 145 aa, Bacillus subtilis; identical to SEQ ID NO: 31695

SEQ ID NO: 64667 - DNA, 450 bp, Thermotoga maritima; identical to SEQ ID NO: 31696
  CDS (1)..(450)

SEQ ID NO: 64668 - protein, 149 aa, Thermotoga maritima; identical to SEQ ID NO: 31697

SEQ ID NO: 64669 - DNA, 468 bp, Aeropyrum pernix; identical to SEQ ID NO: 31698
  CDS (1)..(468)

SEQ ID NO: 64670 - protein, 155 aa, Aeropyrum pernix; identical to SEQ ID NO: 31699

SEQ ID NO: 64671 - DNA, 450 bp, Chlamydophila pneumoniae, Chlamydia pneumoniae; identical to SEQ ID NO: 31700
  CDS (1)..(450)

SEQ ID NO: 64672 - protein, 149 aa, Chlamydophila pneumoniae, Chlamydia pneumoniae; identical to SEQ ID NO: 31701

SEQ ID NO: 64673 - DNA, 435 bp, Mycoplasma pulmonis; identical to SEQ ID NO: 31702
  CDS (1)..(435): transl_table=4

SEQ ID NO: 64674 - protein, 144 aa, Mycoplasma pulmonis; identical to SEQ ID NO: 31703

SEQ ID NO: 64675 - DNA, 447 bp, Streptococcus pneumoniae; identical to SEQ ID NO: 31704
  CDS (1)..(447)

SEQ ID NO: 64676 - protein, 148 aa, Streptococcus pneumoniae; identical to SEQ ID NO: 31705

SEQ ID NO: 64677 - DNA, 435 bp, Aquifex aeolicus; identical to SEQ ID NO: 31706
  CDS (1)..(435)

SEQ ID NO: 64678 - protein, 144 aa, Aquifex aeolicus; identical to SEQ ID NO: 31707

SEQ ID NO: 64679 - DNA, 438 bp, Bacillus halodurans; identical to SEQ ID NO: 31708
  CDS (1)..(438)

SEQ ID NO: 64680 - protein, 145 aa, Bacillus halodurans; identical to SEQ ID NO: 31709

SEQ ID NO: 64681 - DNA, 438 bp, Staphylococcus carnosus; identical to SEQ ID NO: 31710
  CDS (1)..(438)

SEQ ID NO: 64682 - protein, 145 aa, Staphylococcus carnosus; identical to SEQ ID NO: 31711

SEQ ID NO: 64683 - DNA, 438 bp, Sulfolobus acidocaldarius; identical to SEQ ID NO: 31712
  CDS (1)..(438)

SEQ ID NO: 64684 - protein, 145 aa, Sulfolobus acidocaldarius; identical to SEQ ID NO: 31713

SEQ ID NO: 64685 - DNA, 492 bp, Saccharomyces cerevisiae; identical to SEQ ID NO: 31714
  CDS (1)..(492)

SEQ ID NO: 64686 - protein, 163 aa, Saccharomyces cerevisiae; identical to SEQ ID NO: 31715

SEQ ID NO: 64687 - DNA, 444 bp, Mycobacterium leprae; identical to SEQ ID NO: 31716
  CDS (1)..(444)

SEQ ID NO: 64688 - protein, 147 aa, Mycobacterium leprae; identical to SEQ ID NO: 31717

SEQ ID NO: 64689 - DNA, 429 bp, chloroplast Porphyra purpurea; identical to SEQ ID NO: 31718
  CDS (1)..(429)

SEQ ID NO: 64690 - protein, 142 aa, chloroplast Porphyra purpurea; identical to SEQ ID NO: 31719

SEQ ID NO: 64691 - DNA, 450 bp, Sulfolobus solfataricus; identical to SEQ ID NO: 31720
  CDS (1)..(450)

SEQ ID NO: 64692 - protein, 149 aa, Sulfolobus solfataricus; identical to SEQ ID NO: 31721

SEQ ID NO: 64693 - DNA, 456 bp, Synechocystis sp; identical to SEQ ID NO: 31722
  CDS (1)..(456)

SEQ ID NO: 64694 - protein, 151 aa, Synechocystis sp; identical to SEQ ID NO: 31723

SEQ ID NO: 64695 - DNA, 420 bp, chloroplast Odontella sinensis; identical to SEQ ID NO: 31724
  CDS (1)..(420)

SEQ ID NO: 64696 - protein, 139 aa, chloroplast Odontella sinensis; identical to SEQ ID NO: 31725

SEQ ID NO: 64697 - DNA, 444 bp, Streptomyces coelicolor; identical to SEQ ID NO: 31726
  CDS (1)..(444)

SEQ ID NO: 64698 - protein, 147 aa, Streptomyces coelicolor; identical to SEQ ID NO: 31727

SEQ ID NO: 64699 - DNA, 474 bp, Schizosaccharomyces pombe; identical to SEQ ID NO: 31728
  CDS (1)..(474)

SEQ ID NO: 64700 - protein, 157 aa, Schizosaccharomyces pombe; identical to SEQ ID NO: 31729

SEQ ID NO: 64701 - DNA, 540 bp, Burkholderia mallei ATCC 23344; identical to SEQ ID NO: 31730
  CDS (112)..(540)

SEQ ID NO: 64702 - protein, 142 aa, Burkholderia mallei ATCC 23344; identical to SEQ ID NO: 31731

SEQ ID NO: 64703 - DNA, 438 bp, Bacillus cereus ZK; identical to SEQ ID NO: 31732
  CDS (1)..(438)

SEQ ID NO: 64704 - protein, 145 aa, Bacillus cereus ZK; identical to SEQ ID NO: 31733

SEQ ID NO: 64705 - DNA, 462 bp, Bacteroides fragilis; identical to SEQ ID NO: 31734
  CDS (1)..(462)

SEQ ID NO: 64706 - protein, 153 aa, Bacteroides fragilis; identical to SEQ ID NO: 31735

SEQ ID NO: 64707 - DNA, 438 bp, Bacillus licheniformis DSM 13; identical to SEQ ID NO: 31736
  CDS (1)..(438)

SEQ ID NO: 64708 - protein, 145 aa, Bacillus licheniformis DSM 13; identical to SEQ ID NO: 31737

SEQ ID NO: 64709 - DNA, 444 bp, Mannheimia succiniciproducens MBEL55E; identical to SEQ ID NO: 31738
  CDS (1)..(444)

SEQ ID NO: 64710 - protein, 147 aa, Mannheimia succiniciproducens MBEL55E; identical to SEQ ID NO: 31739

SEQ ID NO: 64711 - DNA, 465 bp, Borrelia garinii PBi; identical to SEQ ID NO: 31740
  CDS (1)..(465)

SEQ ID NO: 64712 - protein, 154 aa, Borrelia garinii PBi; identical to SEQ ID NO: 31741

SEQ ID NO: 64713 - DNA, 432 bp, Symbiobacterium thermophilum; identical to SEQ ID NO: 31742
  CDS (1)..(432)

SEQ ID NO: 64714 - protein, 143 aa, Symbiobacterium thermophilum; identical to SEQ ID NO: 31743

SEQ ID NO: 64715 - DNA, 468 bp, Rickettsia typhi; identical to SEQ ID NO: 31744
  CDS (1)..(468)

SEQ ID NO: 64716 - protein, 155 aa, Rickettsia typhi; identical to SEQ ID NO: 31745

SEQ ID NO: 64717 - DNA, 444 bp, Propionibacterium acnes; identical to SEQ ID NO: 31746
  CDS (1)..(444)

SEQ ID NO: 64718 - protein, 147 aa, Propionibacterium acnes; identical to SEQ ID NO: 31747

SEQ ID NO: 64719 - DNA, 447 bp, Leifsonia xyli; identical to SEQ ID NO: 31748
  CDS (1)..(447)

SEQ ID NO: 64720 - protein, 148 aa, Leifsonia xyli; identical to SEQ ID NO: 31749

SEQ ID NO: 64721 - DNA, 429 bp, Desulfotalea psychrophila; identical to SEQ ID NO: 31750
  CDS (1)..(429)

SEQ ID NO: 64722 - protein, 142 aa, Desulfotalea psychrophila; identical to SEQ ID NO: 31751

SEQ ID NO: 64723 - DNA, 432 bp, Gracilaria tenuistipitata var; identical to SEQ ID NO: 31752
  CDS (1)..(432)

SEQ ID NO: 64724 - protein, 143 aa, Gracilaria tenuistipitata var; identical to SEQ ID NO: 31753

SEQ ID NO: 64725 - DNA, 525 bp, Debaryomyces hansenii CBS767; identical to SEQ ID NO: 31754
  CDS (1)..(525)

SEQ ID NO: 64726 - protein, 174 aa, Debaryomyces hansenii CBS767; identical to SEQ ID NO: 31755

SEQ ID NO: 64727 - DNA, 468 bp, Kluyveromyces lactis NRRL Y; identical to SEQ ID NO: 31756
  CDS (1)..(468)

SEQ ID NO: 64728 - protein, 155 aa, Kluyveromyces lactis NRRL Y; identical to SEQ ID NO: 31757

SEQ ID NO: 64729 - DNA, 453 bp, Mesoplasma florum; identical to SEQ ID NO: 31758
  CDS (1)..(453): transl_table=4

SEQ ID NO: 64730 - protein, 150 aa, Mesoplasma florum; identical to SEQ ID NO: 31759

SEQ ID NO: 64731 - DNA, 429 bp, Acinetobacter sp; identical to SEQ ID NO: 31760
  CDS (1)..(429)

SEQ ID NO: 64732 - protein, 142 aa, Acinetobacter sp; identical to SEQ ID NO: 31761

SEQ ID NO: 64733 - DNA, 504 bp, Candida glabrata CBS138; identical to SEQ ID NO: 31762
  CDS (1)..(504)

SEQ ID NO: 64734 - protein, 167 aa, Candida glabrata CBS138; identical to SEQ ID NO: 31763

SEQ ID NO: 64735 - DNA, 465 bp, Bartonella quintana; identical to SEQ ID NO: 31764
  CDS (1)..(465)

SEQ ID NO: 64736 - protein, 154 aa, Bartonella quintana; identical to SEQ ID NO: 31765

SEQ ID NO: 64737 - DNA, 465 bp, Bartonella henselae; identical to SEQ ID NO: 31766
  CDS (1)..(465)

SEQ ID NO: 64738 - protein, 154 aa, Bartonella henselae; identical to SEQ ID NO: 31767

SEQ ID NO: 64739 - DNA, 477 bp, Fremyella diplosiphon; identical to SEQ ID NO: 31768
  CDS (1)..(477)

SEQ ID NO: 64740 - protein, 158 aa, Fremyella diplosiphon; identical to SEQ ID NO: 31769

SEQ ID NO: 64741 - DNA, 435 bp, Mycoplasma mobile; identical to SEQ ID NO: 31770
  CDS (1)..(435): transl_table=4

SEQ ID NO: 64742 - protein, 144 aa, Mycoplasma mobile; identical to SEQ ID NO: 31771

SEQ ID NO: 64743 - DNA, 429 bp, Photobacterium profundum; identical to SEQ ID NO: 31772
  CDS (1)..(429)

SEQ ID NO: 64744 - protein, 142 aa, Photobacterium profundum; identical to SEQ ID NO: 31773

SEQ ID NO: 64745 - DNA, 432 bp, Parachlamydia sp; identical to SEQ ID NO: 31774
  CDS (1)..(432)

SEQ ID NO: 64746 - protein, 143 aa, Parachlamydia sp; identical to SEQ ID NO: 31775

SEQ ID NO: 64747 - DNA, 441 bp, Bdellovibrio bacteriovorus; identical to SEQ ID NO: 31776
  CDS (1)..(441)

SEQ ID NO: 64748 - protein, 146 aa, Bdellovibrio bacteriovorus; identical to SEQ ID NO: 31777

SEQ ID NO: 64749 - DNA, 456 bp, Mycoplasma mycoides; identical to SEQ ID NO: 31778
  CDS (1)..(456): transl_table=4

SEQ ID NO: 64750 - protein, 151 aa, Mycoplasma mycoides; identical to SEQ ID NO: 31779

SEQ ID NO: 64751 - DNA, 444 bp, Corynebacterium diphtheriae; identical to SEQ ID NO: 31780
  CDS (1)..(444)

SEQ ID NO: 64752 - protein, 147 aa, Corynebacterium diphtheriae; identical to SEQ ID NO: 31781

SEQ ID NO: 64753 - DNA, 459 bp, Onion yellows phytoplasma; identical to SEQ ID NO: 31782
  CDS (1)..(459)

SEQ ID NO: 64754 - protein, 152 aa, Onion yellows phytoplasma; identical to SEQ ID NO: 31783

SEQ ID NO: 64755 - DNA, 435 bp, Desulfovibrio vulgaris; identical to SEQ ID NO: 31784
  CDS (1)..(435)

SEQ ID NO: 64756 - protein, 144 aa, Desulfovibrio vulgaris; identical to SEQ ID NO: 31785

SEQ ID NO: 64757 - DNA, 492 bp, Thermus thermophilus; identical to SEQ ID NO: 31786
  CDS (1)..(492)

SEQ ID NO: 64758 - protein, 163 aa, Thermus thermophilus; identical to SEQ ID NO: 31787

SEQ ID NO: 64759 - DNA, 450 bp, Leptospira interrogans; identical to SEQ ID NO: 31788
  CDS (1)..(450)

SEQ ID NO: 64760 - protein, 149 aa, Leptospira interrogans; identical to SEQ ID NO: 31789

SEQ ID NO: 64761 - DNA, 438 bp, Bacillus cereus; identical to SEQ ID NO: 31790
  CDS (1)..(438)

SEQ ID NO: 64762 - protein, 145 aa, Bacillus cereus; identical to SEQ ID NO: 31791

SEQ ID NO: 64763 - DNA, 459 bp, Wolbachia pipientis wMel; identical to SEQ ID NO: 31792
  CDS (1)..(459)

SEQ ID NO: 64764 - protein, 152 aa, Wolbachia pipientis wMel; identical to SEQ ID NO: 31793

SEQ ID NO: 64765 - DNA, 429 bp, Treponema denticola; identical to SEQ ID NO: 31794
  CDS (1)..(429)

SEQ ID NO: 64766 - protein, 142 aa, Treponema denticola; identical to SEQ ID NO: 31795

SEQ ID NO: 64767 - DNA, 444 bp, Mycobacterium paratuberculosis; identical to SEQ ID NO: 31796
  CDS (1)..(444)

SEQ ID NO: 64768 - protein, 147 aa, Mycobacterium paratuberculosis; identical to SEQ ID NO: 31797

SEQ ID NO: 64769 - DNA, 432 bp, Geobacter sulfurreducens; identical to SEQ ID NO: 31798
  CDS (1)..(432)

SEQ ID NO: 64770 - protein, 143 aa, Geobacter sulfurreducens; identical to SEQ ID NO: 31799

SEQ ID NO: 64771 - DNA, 444 bp, Lactobacillus johnsonii; identical to SEQ ID NO: 31800
  CDS (1)..(444)

SEQ ID NO: 64772 - protein, 147 aa, Lactobacillus johnsonii; identical to SEQ ID NO: 31801

SEQ ID NO: 64773 - DNA, 489 bp, Nanoarchaeum equitans; identical to SEQ ID NO: 31802
  CDS (1)..(489)

SEQ ID NO: 64774 - protein, 162 aa, Nanoarchaeum equitans; identical to SEQ ID NO: 31803

SEQ ID NO: 64775 - DNA, 471 bp, Ashbya gossypii; identical to SEQ ID NO: 31804
  CDS (1)..(471)

SEQ ID NO: 64776 - protein, 156 aa, Ashbya gossypii; identical to SEQ ID NO: 31805

SEQ ID NO: 64777 - DNA, 690 bp, Oryza sativa; identical to SEQ ID NO: 31806
  CDS (1)..(690)

SEQ ID NO: 64778 - protein, 229 aa, Oryza sativa; identical to SEQ ID NO: 31807

SEQ ID NO: 64779 - DNA, 420 bp, Wolinella succinogenes; identical to SEQ ID NO: 31808
  CDS (1)..(420)

SEQ ID NO: 64780 - protein, 139 aa, Wolinella succinogenes; identical to SEQ ID NO: 31809

SEQ ID NO: 64781 - DNA, 429 bp, Vibrio vulnificus; identical to SEQ ID NO: 31810
  CDS (1)..(429)

SEQ ID NO: 64782 - protein, 142 aa, Vibrio vulnificus; identical to SEQ ID NO: 31811

SEQ ID NO: 64783 - DNA, 456 bp, Porphyromonas gingivalis; identical to SEQ ID NO: 31812
  CDS (1)..(456)

SEQ ID NO: 64784 - protein, 151 aa, Porphyromonas gingivalis; identical to SEQ ID NO: 31813

SEQ ID NO: 64785 - DNA, 429 bp, Photorhabdus luminescens; identical to SEQ ID NO: 31814
  CDS (1)..(429)

SEQ ID NO: 64786 - protein, 142 aa, Photorhabdus luminescens; identical to SEQ ID NO: 31815

SEQ ID NO: 64787 - DNA, 459 bp, Gloeobacter violaceus; identical to SEQ ID NO: 31816
  CDS (1)..(459)

SEQ ID NO: 64788 - protein, 152 aa, Gloeobacter violaceus; identical to SEQ ID NO: 31817

SEQ ID NO: 64789 - DNA, 429 bp, Chromobacterium violaceum; identical to SEQ ID NO: 31818
  CDS (1)..(429)

SEQ ID NO: 64790 - protein, 142 aa, Chromobacterium violaceum; identical to SEQ ID NO: 31819

SEQ ID NO: 64791 - DNA, 552 bp, Neurospora crassa; identical to SEQ ID NO: 31820
  CDS (1)..(552)

SEQ ID NO: 64792 - protein, 183 aa, Neurospora crassa; identical to SEQ ID NO: 31821

SEQ ID NO: 64793 - DNA, 453 bp, Synechococcus sp; identical to SEQ ID NO: 31822
  CDS (1)..(453)

SEQ ID NO: 64794 - protein, 150 aa, Synechococcus sp; identical to SEQ ID NO: 31823

SEQ ID NO: 64795 - DNA, 456 bp, Rhodopirellula baltica; identical to SEQ ID NO: 31824
  CDS (1)..(456)

SEQ ID NO: 64796 - protein, 151 aa, Rhodopirellula baltica; identical to SEQ ID NO: 31825

SEQ ID NO: 64797 - DNA, 432 bp, Prochlorococcus marinus subsp; identical to SEQ ID NO: 31826
  CDS (1)..(432)

SEQ ID NO: 64798 - protein, 143 aa, Prochlorococcus marinus subsp; identical to SEQ ID NO: 31827

SEQ ID NO: 64799 - DNA, 453 bp, Prochlorococcus marinus; identical to SEQ ID NO: 31828
  CDS (1)..(453)

SEQ ID NO: 64800 - protein, 150 aa, Prochlorococcus marinus; identical to SEQ ID NO: 31829

SEQ ID NO: 64801 - DNA, 453 bp, Prochlorococcus marinus; identical to SEQ ID NO: 31830
  CDS (1)..(453)

SEQ ID NO: 64802 - protein, 150 aa, Prochlorococcus marinus; identical to SEQ ID NO: 31831

SEQ ID NO: 64803 - DNA, 429 bp, Helicobacter hepaticus; identical to SEQ ID NO: 31832
  CDS (1)..(429)

SEQ ID NO: 64804 - protein, 142 aa, Helicobacter hepaticus; identical to SEQ ID NO: 31833

SEQ ID NO: 64805 - DNA, 423 bp, Haemophilus ducreyi; identical to SEQ ID NO: 31834
  CDS (1)..(423)

SEQ ID NO: 64806 - protein, 140 aa, Haemophilus ducreyi; identical to SEQ ID NO: 31835

SEQ ID NO: 64807 - DNA, 420 bp, Candidatus Blochmannia floridanus; identical to SEQ ID NO: 31836
  CDS (1)..(420)

SEQ ID NO: 64808 - protein, 139 aa, Candidatus Blochmannia floridanus; identical to SEQ ID NO: 31837

SEQ ID NO: 64809 - DNA, 429 bp, Bordetella pertussis; identical to SEQ ID NO: 31838
  CDS (1)..(429)

SEQ ID NO: 64810 - protein, 142 aa, Bordetella pertussis; identical to SEQ ID NO: 31839

SEQ ID NO: 64811 - DNA, 618 bp, Arabidopsis thaliana; identical to SEQ ID NO: 31840
  CDS (1)..(618)

SEQ ID NO: 64812 - protein, 205 aa, Arabidopsis thaliana; identical to SEQ ID NO: 31841

SEQ ID NO: 64813 - DNA, 1001 bp, Chlorarachnion sp; identical to SEQ ID NO: 31842
  CDS (48)..(869)

SEQ ID NO: 64814 - protein, 273 aa, Chlorarachnion sp; identical to SEQ ID NO: 31843

SEQ ID NO: 64815 - DNA, 453 bp, Chlamydophila caviae; identical to SEQ ID NO: 31844
  CDS (1)..(453)

SEQ ID NO: 64816 - protein, 150 aa, Chlamydophila caviae; identical to SEQ ID NO: 31845

SEQ ID NO: 64817 - DNA, 444 bp, Streptomyces avermitilis; identical to SEQ ID NO: 31846
  CDS (1)..(444)

SEQ ID NO: 64818 - protein, 147 aa, Streptomyces avermitilis; identical to SEQ ID NO: 31847

SEQ ID NO: 64819 - DNA, 435 bp, Nitrosomonas europaea; identical to SEQ ID NO: 31848
  CDS (1)..(435)

SEQ ID NO: 64820 - protein, 144 aa, Nitrosomonas europaea; identical to SEQ ID NO: 31849

SEQ ID NO: 64821 - DNA, 429 bp, Coxiella burnetii; identical to SEQ ID NO: 31850
  CDS (1)..(429)

SEQ ID NO: 64822 - protein, 142 aa, Coxiella burnetii; identical to SEQ ID NO: 31851

SEQ ID NO: 64823 - DNA, 426 bp, Tropheryma whipplei; identical to SEQ ID NO: 31852
  CDS (1)..(426)

SEQ ID NO: 64824 - protein, 141 aa, Tropheryma whipplei; identical to SEQ ID NO: 31853

SEQ ID NO: 64825 - DNA, 603 bp, Dictyostelium discoideum; identical to SEQ ID NO: 31854
  CDS (1)..(603)

SEQ ID NO: 64826 - protein, 200 aa, Dictyostelium discoideum; identical to SEQ ID NO: 31855

SEQ ID NO: 64827 - DNA, 429 bp, Xylella fastidiosa; identical to SEQ ID NO: 31856
  CDS (1)..(429)

SEQ ID NO: 64828 - protein, 142 aa, Xylella fastidiosa; identical to SEQ ID NO: 31857

SEQ ID NO: 64829 - DNA, 429 bp, Vibrio parahaemolyticus; identical to SEQ ID NO: 31858
  CDS (1)..(429)

SEQ ID NO: 64830 - protein, 142 aa, Vibrio parahaemolyticus; identical to SEQ ID NO: 31859

SEQ ID NO: 64831 - DNA, 429 bp, Pseudomonas syringae; identical to SEQ ID NO: 31860
  CDS (1)..(429)

SEQ ID NO: 64832 - protein, 142 aa, Pseudomonas syringae; identical to SEQ ID NO: 31861

SEQ ID NO: 64833 - DNA, 444 bp, Lactobacillus plantarum; identical to SEQ ID NO: 31862
  CDS (1)..(444)

SEQ ID NO: 64834 - protein, 147 aa, Lactobacillus plantarum; identical to SEQ ID NO: 31863

SEQ ID NO: 64835 - DNA, 435 bp, Clostridium tetani; identical to SEQ ID NO: 31864
  CDS (1)..(435)

SEQ ID NO: 64836 - protein, 144 aa, Clostridium tetani; identical to SEQ ID NO: 31865

SEQ ID NO: 64837 - DNA, 462 bp, Bacteroides thetaiotaomicron; identical to SEQ ID NO: 31866
  CDS (1)..(462)

SEQ ID NO: 64838 - protein, 153 aa, Bacteroides thetaiotaomicron; identical to SEQ ID NO: 31867

SEQ ID NO: 64839 - DNA, 438 bp, Staphylococcus epidermidis; identical to SEQ ID NO: 31868
  CDS (1)..(438)

SEQ ID NO: 64840 - protein, 145 aa, Staphylococcus epidermidis; identical to SEQ ID NO: 31869

SEQ ID NO: 64841 - DNA, 444 bp, Yersinia pestis; identical to SEQ ID NO: 31870
  CDS (1)..(444)

SEQ ID NO: 64842 - protein, 147 aa, Yersinia pestis; identical to SEQ ID NO: 31871

SEQ ID NO: 64843 - DNA, 429 bp, Wigglesworthia glossinidia brevipalpis; identical to SEQ ID NO: 31872
  CDS (1)..(429)

SEQ ID NO: 64844 - protein, 142 aa, Wigglesworthia glossinidia brevipalpis; identical to SEQ ID NO: 31873

SEQ ID NO: 64845 - DNA, 459 bp, Synechococcus elongatus; identical to SEQ ID NO: 31874
  CDS (1)..(459)

SEQ ID NO: 64846 - protein, 152 aa, Synechococcus elongatus; identical to SEQ ID NO: 31875

SEQ ID NO: 64847 - DNA, 447 bp, Streptococcus mutans; identical to SEQ ID NO: 31876
  CDS (1)..(447)

SEQ ID NO: 64848 - protein, 148 aa, Streptococcus mutans; identical to SEQ ID NO: 31877

SEQ ID NO: 64849 - DNA, 447 bp, Streptococcus agalactiae; identical to SEQ ID NO: 31878
  CDS (1)..(447)

SEQ ID NO: 64850 - protein, 148 aa, Streptococcus agalactiae; identical to SEQ ID NO: 31879

SEQ ID NO: 64851 - DNA, 429 bp, Shewanella oneidensis; identical to SEQ ID NO: 31880
  CDS (1)..(429)

SEQ ID NO: 64852 - protein, 142 aa, Shewanella oneidensis; identical to SEQ ID NO: 31881

SEQ ID NO: 64853 - DNA, 438 bp, Oceanobacillus iheyensis; identical to SEQ ID NO: 31882
  CDS (1)..(438)

SEQ ID NO: 64854 - protein, 145 aa, Oceanobacillus iheyensis; identical to SEQ ID NO: 31883

SEQ ID NO: 64855 - DNA, 441 bp, Mycoplasma penetrans; identical to SEQ ID NO: 31884
  CDS (1)..(441): transl_table=4

SEQ ID NO: 64856 - protein, 146 aa, Mycoplasma penetrans; identical to SEQ ID NO: 31885

SEQ ID NO: 64857 - DNA, 444 bp, Corynebacterium efficiens; identical to SEQ ID NO: 31886
  CDS (1)..(444)

SEQ ID NO: 64858 - protein, 147 aa, Corynebacterium efficiens; identical to SEQ ID NO: 31887

SEQ ID NO: 64859 - DNA, 465 bp, Brucella suis; identical to SEQ ID NO: 31888
  CDS (1)..(465)

SEQ ID NO: 64860 - protein, 154 aa, Brucella suis; identical to SEQ ID NO: 31889

SEQ ID NO: 64861 - DNA, 450 bp, Bifidobacterium longum; identical to SEQ ID NO: 31890
  CDS (1)..(450)

SEQ ID NO: 64862 - protein, 149 aa, Bifidobacterium longum; identical to SEQ ID NO: 31891

SEQ ID NO: 64863 - DNA, 447 bp, Streptococcus pyogenes; identical to SEQ ID NO: 31892
  CDS (1)..(447)

SEQ ID NO: 64864 - protein, 148 aa, Streptococcus pyogenes; identical to SEQ ID NO: 31893

SEQ ID NO: 64865 - DNA, 453 bp, Chlorobium tepidum; identical to SEQ ID NO: 31894
  CDS (1)..(453)

SEQ ID NO: 64866 - protein, 150 aa, Chlorobium tepidum; identical to SEQ ID NO: 31895

SEQ ID NO: 64867 - DNA, 375 bp, Candidatus Tremblaya princeps; identical to SEQ ID NO: 31896
  CDS (1)..(375)

SEQ ID NO: 64868 - protein, 124 aa, Candidatus Tremblaya princeps; identical to SEQ ID NO: 31897

SEQ ID NO: 64869 - DNA, 429 bp, Xanthomonas axonopodis; identical to SEQ ID NO: 31898
  CDS (1)..(429)

SEQ ID NO: 64870 - protein, 142 aa, Xanthomonas axonopodis; identical to SEQ ID NO: 31899

SEQ ID NO: 64871 - DNA, 444 bp, Corynebacterium glutamicum; identical to SEQ ID NO: 31900
  CDS (1)..(444)

SEQ ID NO: 64872 - protein, 147 aa, Corynebacterium glutamicum; identical to SEQ ID NO: 31901

SEQ ID NO: 64873 - DNA, 429 bp, Streptococcus pyogenes; identical to SEQ ID NO: 31902
  CDS (1)..(429)

SEQ ID NO: 64874 - protein, 142 aa, Streptococcus pyogenes; identical to SEQ ID NO: 31903

SEQ ID NO: 64875 - DNA, 489 bp, Methanosarcina mazei; identical to SEQ ID NO: 31904
  CDS (1)..(489)

SEQ ID NO: 64876 - protein, 162 aa, Methanosarcina mazei; identical to SEQ ID NO: 31905

SEQ ID NO: 64877 - DNA, 432 bp, Thermoanaerobacter tengcongensis; identical to SEQ ID NO: 31906
  CDS (1)..(432)

SEQ ID NO: 64878 - protein, 143 aa, Thermoanaerobacter tengcongensis; identical to SEQ ID NO: 31907

SEQ ID NO: 64879 - DNA, 435 bp, Fusobacterium nucleatum; identical to SEQ ID NO: 31908
  CDS (1)..(435)

SEQ ID NO: 64880 - protein, 144 aa, Fusobacterium nucleatum; identical to SEQ ID NO: 31909

SEQ ID NO: 64881 - DNA, 432 bp, Methanosarcina acetivorans; identical to SEQ ID NO: 31910
  CDS (1)..(432)

SEQ ID NO: 64882 - protein, 143 aa, Methanosarcina acetivorans; identical to SEQ ID NO: 31911

SEQ ID NO: 64883 - DNA, 480 bp, Methanopyrus kandleri; identical to SEQ ID NO: 31912
  CDS (1)..(480)

SEQ ID NO: 64884 - protein, 159 aa, Methanopyrus kandleri; identical to SEQ ID NO: 31913

SEQ ID NO: 64885 - DNA, 429 bp, Pyrococcus furiosus; identical to SEQ ID NO: 31914
  CDS (1)..(429)

SEQ ID NO: 64886 - protein, 142 aa, Pyrococcus furiosus; identical to SEQ ID NO: 31915

SEQ ID NO: 64887 - DNA, 435 bp, Clostridium perfringens; identical to SEQ ID NO: 31916
  CDS (1)..(435)

SEQ ID NO: 64888 - protein, 144 aa, Clostridium perfringens; identical to SEQ ID NO: 31917

SEQ ID NO: 64889 - DNA, 429 bp, Ralstonia solanacearum; identical to SEQ ID NO: 31918
  CDS (1)..(429)

SEQ ID NO: 64890 - protein, 142 aa, Ralstonia solanacearum; identical to SEQ ID NO: 31919

SEQ ID NO: 64891 - DNA, 564 bp, Pyrobaculum aerophilum; identical to SEQ ID NO: 31920
  CDS (1)..(564)

SEQ ID NO: 64892 - protein, 187 aa, Pyrobaculum aerophilum; identical to SEQ ID NO: 31921

SEQ ID NO: 64893 - DNA, 465 bp, Rhizobium meliloti; identical to SEQ ID NO: 31922
  CDS (1)..(465)

SEQ ID NO: 64894 - protein, 154 aa, Rhizobium meliloti; identical to SEQ ID NO: 31923

SEQ ID NO: 64895 - DNA, 702 bp, Oryza sativa; identical to SEQ ID NO: 31924
  CDS (1)..(702)

SEQ ID NO: 64896 - protein, 233 aa, Oryza sativa; identical to SEQ ID NO: 31925

SEQ ID NO: 64897 - DNA, 465 bp, Rhizobium loti; identical to SEQ ID NO: 31926
  CDS (1)..(465)

SEQ ID NO: 64898 - protein, 154 aa, Rhizobium loti; identical to SEQ ID NO: 31927

SEQ ID NO: 64899 - DNA, 429 bp, Pasteurella multocida; identical to SEQ ID NO: 31928
  CDS (1)..(429)

SEQ ID NO: 64900 - protein, 142 aa, Pasteurella multocida; identical to SEQ ID NO: 31929

SEQ ID NO: 64901 - DNA, 846 bp, Ceratopteris richardii; identical to SEQ ID NO: 31930
  CDS (54)..(479): n means a or g or c or t/u

SEQ ID NO: 64902 - protein, 141 aa, Ceratopteris richardii; identical to SEQ ID NO: 31931
  misc_feature (101)..(101): Xaa can be Arg or Gln or Leu or Pro
  misc_feature (134)..(134): Xaa can be Asn or Asp or His or Tyr

SEQ ID NO: 64903 - DNA, 414 bp, Arabidopsis thaliana; identical to SEQ ID NO: 31932
  CDS (1)..(414)

SEQ ID NO: 64904 - protein, 137 aa, Arabidopsis thaliana; identical to SEQ ID NO: 31933

SEQ ID NO: 64905 - DNA, 432 bp, Cyanidium caldarium; identical to SEQ ID NO: 31934
  CDS (1)..(432)

SEQ ID NO: 64906 - protein, 143 aa, Cyanidium caldarium; identical to SEQ ID NO: 31935

SEQ ID NO: 64907 - DNA, 432 bp, Guillardia theta; identical to SEQ ID NO: 31936
  CDS (1)..(432)

SEQ ID NO: 64908 - protein, 143 aa, Guillardia theta; identical to SEQ ID NO: 31937

SEQ ID NO: 64909 - DNA, 435 bp, Buchnera aphidicola; identical to SEQ ID NO: 31938
  CDS (1)..(435)

SEQ ID NO: 64910 - protein, 144 aa, Buchnera aphidicola; identical to SEQ ID NO: 31939

SEQ ID NO: 64911 - DNA, 618 bp, Drosophila melanogaster; identical to SEQ ID NO: 31940
  CDS (31)..(567)

SEQ ID NO: 64912 - protein, 178 aa, Drosophila melanogaster; identical to SEQ ID NO: 31941

SEQ ID NO: 64913 - DNA, 839 bp, Homo sapiens; identical to SEQ ID NO: 31942
  CDS (40)..(576)

SEQ ID NO: 64914 - protein, 178 aa, Homo sapiens; identical to SEQ ID NO: 31943

SEQ ID NO: 64915 - DNA, 26 bp, Primer
atgaaaacttttacagctaaaccaga

SEQ ID NO: 64916 - DNA, 24 bp, Primer
ttagatgtcaagaacttgcggttg

SEQ ID NO: 64917 - protein, 162 aa, consensus; identical to SEQ ID NO: 31946
  MISC_FEATURE (1)..(162): consensus for the disclosure of xaa see table XV

SEQ ID NO: 64918 - protein, 58 aa, consensus; identical to SEQ ID NO: 31947
  MISC_FEATURE (1)..(58): consensus for the disclosure of xaa see table XV

SEQ ID NO: 64919 - protein, 26 aa, consensus
  MISC_FEATURE (1)..(26): consensus for the disclosure of xaa see table XV
XXXXXXXMXXXXXXXXXXXXXXXXXX

SEQ ID NO: 64920 - DNA, 933 bp, Escherichia coli
  CDS (1)..(933)
atgatcatcgttaccggcggcgcgggctttatcggcagcaacatcgttaaagccctgaatgataaaggcatcaccgatattctggtggtggacaacctgaaagacggcaccaagtttgtgaacctggtggatctgaatatcgcagactatatggataaggaagacttcctgatccagattatggctggcgaagagttcggcgatgtcgaagcgattttccacgaaggcgcgtgctcttccaccaccgagtgggacggcaagtatatgatggataacaactatcaatactccaaggagctgctgcactactgcctggagcgtgaaatcccgttcctgtacgcttcttccgcagccacctacggcggacgcacctccgactttattgaatcccgcgagtacgaaaaaccgttgaacgtctacggttactcaaaattcctgtttgatgaatatgttcgccaaatcctgccggaagcgaactcgcagattgttggcttccgctatttcaacgtttatggaccgcgtgaaggccataaaggcagcatggcgagcgtcgctttccatctcaacacccagcttaataacggtgaatcaccgaagctgttcgaaggtagcgagaactttaaacgcgacttcgtctatgttggcgatgtggcagatgtaaacctgtggttcctggaaaatggcgtttccggcatcttcaacctcggcaccggtcgtgcggaatccttccaggctgtagctgatgctacgctggcttatcacaagaaaggccagatcgaatacattccgttcccggataagctgaaaggccgctaccaggcgttcactcaggcagatctgacaaatctgcgcgcggcgggttacgacaaaccgttcaaaaccgttgctgaaggtgtaacggaatacatggcctggctgaatcgcgacgcataa

SEQ ID NO: 64921 - protein, 310 aa, Escherichia coli [sequence omitted]

SEQ ID NO: 64922 - DNA, 936 bp, Anopheles gambiae str. PEST
  CDS (1)..(936)
atgaaggttatttttgttaggaacaggaaaaagatgaattatttagtaacaggaggatctggttttataggatcacatctggtagaaaaattattaagagaaggacattctgtcataaatgtggacaactttgataatttctatgactaccagataaaagttcaaaatacactggaatcagtagacgggctggaaaagatttttcagatgcattcttttgatatggtaatacaccttgctgcattagcgggtgtacggccatctatcgaaaaacctcttgaatatgaagaagtgaacatccgtggtaccatgaatctttgggagctttgtaaagattttgaaatcagtaagtttgtatgtgcttcatcttccagtgtttatggtaataatgacaaggtgccgtttgcagaaacagattttgtcgacgagcctatatctccttatgccgctaccaagaaatgtggtgaaatattaggacatgtataccatagtctgtataaaattgacatgatccagctgcgtttctttacagtatacgggccaaggcaaagaccagatcttgccattcataaatttgctgatttactgcatcttaacgaaaaaattcctttttacggagatggcactactgccagagattacacctttatagacgatattatagatggtgttaccaaatcaattcgttatcttcataatcatgagggtgtttatgagatactaaatctgggggagagtgatgtaataaccctacaggagatggtttcgatactatcagaagagttaaatacagttcctgttcttcaccggttgcctatgcaggccggagatgtacagagaacaaatgctgacatcctgaaagcaaaaactttaataggctatcagccaaagactaagttccaaaatggcataaaaatatttgtggaatggttttag

SEQ ID NO: 64923 - protein, 311 aa, Anopheles gambiae str. PEST
MKVIFVRNRKKMNYLVTGGSGFIGSHLVEKLLREGHSVINVDNFDNFYDYQIKVQNTLESVDGLEKIFQMHSFDMVIHLAALAGVRPSIEKPLEYEEVNIRGTMNLWELCKDFEISKFVCASSSSVYGNNDKVPFAETDFVDEPISPYAATKKCGEILGHVYHSLYKIDMIQLRFFTVYGPRQRPDLAIHKFADLLHLNEKIPFYGDGTTARDYTFIDDIIDGVTKSIRYLHNHEGVYEILNLGESDVITLQEMVSILSEELNTVPVLHRLPMQAGDVQRTNADILKAKTLIGYQPKTKFQNGIKIFVEWF

SEQ ID NO: 64924 - DNA, 927 bp, Thermococcus kodakaraensis
  CDS (1)..(927)
atgatcaaaaataagttagttgtcgtcactgggggagcgggctttataggctctcatatagcctgggagcttatcaaggacaacgatgtggtaatcatcgacaatctatacactggaaaagaagaaaacgttccaccaggggcgaagctcgtcaaagccgatataagagactacgaggcaatagccgagctgataagcaacgccgactacgtttttcatgaggccgcccaggtgagcgtcgtcgagagcatcagggatccggtttttactgaggaggtcaacgtcctcggaacgctcaacattattaaagcacttctcgaagggcatgggaagttgatctttgcctcttccgcagctgtttatggagacaaccctaacctcccactaaaggagactgagagacctagaccactctccccctacggggtgaccaaagcaaccgccgaggagtacctccgcgtcttccacgagctttacggcctgccagttgtttctctccgctacttcaacgtctttggaccgaggcagagcaccaaccagtacgcgggagtgataagcatcttcatcaaccgcgcgctgaagggtgaacccctcgttatcttcggcgacggaaagcagacgagggacttcatctacgtcaaggacgtggttaaggctaaccttctggtagccgagagcagaaaagctaacggaagggttttcaacgtcgcgacagggagagagaccacgatccttgaactcgctatgaagattatagaaatcaccggaacgactagctcggtagtctttgataaaccgaggcctggtgacataagacacagcagggccgacataagcgagattagaaagctgggctttgagccagagtggtctcttgaagaaggactgaaaaaaacagtagaatggtacgccaaaaataatccttag

SEQ ID NO: 64925 - protein, 308 aa, Thermococcus kodakaraensis
MIKNKLVVVTGGAGFIGSHIAWELIKDNDVVIIDNLYTGKEENVPPGAKLVKADIRDYEAIAELISNADYVFHEAAQVSVVESIRDPVFTEEVNVLGTLNIIKALLEGHGKLIFASSAAVYGDNPNLPLKETERPRPLSPYGVTKATAEEYLRVFHELYGLPVVSLRYFNVFGPRQSTNQYAGVISIFINRALKGEPLVIFGDGKQTRDFIYVKDVVKANLLVAESRKANGRVFNVATGRETTILELAMKIIEITGTTSSVVFDKPRPGDIRHSRADISEIRKLGFEPEWSLEEGLKKTVEWYAKNNP

SEQ ID NO: 64926 - DNA, 951 bp, Thermococcus kodakaraensis
  CDS (1)..(951)
atgaaagtcctagttacgggcggtgctggctttatcggttcccacctcgttgacgggctgatggagagtggctatgaggtcagagttctggacaacctgagcgccgggagcttggacaacgtaaagcactggctcgataacgagcgcttcgagttcataaaaggtgacatggttgacctcgagaccgtaaaaaaggccattgaaggcgttgatgttgtcttccacctcgcggctaaccctgaagttagaatcagcgcccagagccctgaaacgctctacgaaagcaacgtcacgataacctacaacctcttggaggctatgaggaattccgacgttgaatacctcgtcttcacgagctcctcaacggtctacggcgatgctgaagtcattccaactcctgagagctacggccctcttaagccgataagtgtctacggtggtgcaaagctcgcggctgaggctataataagtggctacgcccacatattcggctttaaggccttgagcttccgcctggcgaacatcatcggcaagcgctcgaaccacggcgttatatacgacttcatcaacaaactgcggaagaacccgaacgagctggaaatccttggagatggaactcagaggaagagctacctccacgtgagcgacaccgttgagggaatgctccacatcttcgaacacttcaagaaaagcggcgagacctacgacgtctataaccttggcaacgacgactggataacagtgaaggagatagcagaaatagttagcgaggagatggggttgagcccgaagttccgctttactggcggggtagatggcggaaggggctggaagggcgacgttaagctcatgctcctcgacataggcaaggccaagtccaccggttggagaccaaagatgaacagctacgaggccgtcagaagaacggttaaggagcttcttgaggggtga

SEQ ID NO: 64927 - protein, 316 aa, Thermococcus kodakaraensis
MKVLVTGGAGFIGSHLVDGLMESGYEVRVLDNLSAGSLDNVKHWLDNERFEFIKGDMVDLETVKKAIEGVDVVFHLAANPEVRISAQSPETLYESNVTITYNLLEAMRNSDVEYLVFTSSSTVYGDAEVIPTPESYGPLKPISVYGGAKLAAEAIISGYAHIFGFKALSFRLANIIGKRSNHGVIYDFINKLRKNPNELEILGDGTQRKSYLHVSDTVEGMLHIFEHFKKSGETYDVYNLGNDDWITVKEIAEIVSEEMGLSPKFRFTGGVDGGRGWKGDVKLMLLDIGKAKSTGWRPKMNSYEAVRRTVKELLEG

SEQ ID NO: 64928 - DNA, 981 bp, Gluconobacter oxydans 621H
  CDS (1)..(981)
atgattatcgtcaccggcggggccggattcattggttcgtgccttcatgcagccctgcgtcgccggggcttgcggacggttgtggttgaccggctcagggacggggtgaagtggcggaatctggcgtcccatgcgccggatcgcatcatcacgcctgacgcgcttgagggtttcctcgcgtcggagccggatgtcgaagctgtgttccacatgggggcgatcagcgccaccacggcgcgggatggcgatctggtctggtcgagcaacgtggacctgtcgcagacgctgtggcgctggtgtgcggcgcggggcgtgcggatgatttacgcctcctcggccgcgacctatggcgccgcggaccggccggagatgttccgtgacgggctggagaatatcgacgggctgcgaccgctgaacctgtatggctggtccaagcaggcattcgatctgtgggtgaagcgggaaatcgaagccggtgcgccggtgccgccgcaatgggccgggctcaagttcttcaacgtctatgggccgaacgagtatcacaaggggtcgatgatctctgtggtgaaggtcaagtatgacgaggtcgtgcagggccatgcggcaaagctgttccgctcggatgtgcctggtctggctgacgggcagcagaagcgggacttcatctgggtcggggatgtgatgaacgtcatgctgtggctgttcgaccatccggaggtcagcggtctgttcaactgcggaacgggcgtggcgcggagctatctcgatctggcgcatgcggtctgcgatgcggcaaagcgggcgcgggatgtggagttcgtggacatgcctgagaagctgcgcgggcagtaccagtccttcacctgtgcggatatgagtcgcctgcgcgctacgggatatgatgcgccgtttacgtctcttgaagacggaatcgggcagtatgtgcgcgagtatctctcccagcctcaccccaatctctga

SEQ ID NO: 64929 - protein, 326 aa, Gluconobacter oxydans 621H
MIIVTGGAGFIGSCLHAALRRRGLRTVVVDRLRDGVKWRNLASHAPDRIITPDALEGFLASEPDVEAVFHMGAISATTARDGDLVWSSNVDLSQTLWRWCAARGVRMIYASSAATYGAADRPEMFRDGLENIDGLRPLNLYGWSKQAFDLWVKREIEAGAPVPPQWAGLKFFNVYGPNEYHKGSMISVVKVKYDEVVQGHAAKLFRSDVPGLADGQQKRDFIWVGDVMNVMLWLFDHPEVSGLFNCGTGVARSYLDLAHAVCDAAKRARDVEFVDMPEKLRGQYQSFTCADMSRLRATGYDAPFTSLEDGIGQYVREYLSQPHPNL

SEQ ID NO: 64930 - DNA, 969 bp, Gluconobacter oxydans 621H
  CDS (1)..(969)
atgaaagttctggttaccggggttgccgggtttatagggtttcatgttgcgcgggcccttctgaagcagggcatggaggtcgtaggcgtcgatactctcaatgcctattatgatccggccctcaaagccgcccgactggagcagcttgagccttatccggggttcagctttctgaaagtagacgtagccagtcctgcagccatgcaggacttggtcgcgcggcactccgatctggaaggtgtcatccatcttgcggcccaggccggggttcggcattcgatggtcgatccctattcctatgtgacgtccaacgtcatggggcaggtcgctcttctggaagcctgccgtcatctgaaaaagctgacgcatgttgtgtatgcgtcctcctcctccgtttatggccgcaatcagagcgttcctttccgggagacggatcgggttgaaaggcccagttccgtatatgctgtaaccaagcgtgctgccgaactgatgtctgagtcctacgcgtatctgcacggtattccgcagacggggctccggttttttaccgtgtatggtccctggggaaggcccgatatggcgtattacgggtttgcgaaagcaatttcggaagggcgcccggtgaccctttatgaaggaaagcacctttcccgagatttcacctatatcgatgacatcgtcaggggcgtgcagcaggttctgggcaggccgccggaagccgggatgtcgcgggtgcttaatctgggaggggataagccggaaagagtgacccgcatgattgagctgcttgagcagaatctgggaaagaaagctttcgtggagcggcgtcccagaccggtggctgatatggaatcaacctgggcttctttggaaaatgtcagggaattctgcggttggaagccggccgtgtcttttgaagacgggatgaaggaattctgtctgtggttcagaaagtttcacgaaatctga

SEQ ID NO: 64931 - protein, 322 aa, Gluconobacter oxydans 621H
MKVLVTGVAGFIGFHVARALLKQGMEVVGVDTLNAYYDPALKAARLEQLEPYPGFSFLKVDVASPAAMQDLVARHSDLEGVIHLAAQAGVRHSMVDPYSYVTSNVMGQVALLEACRHLKKLTHVVYASSSSVYGRNQSVPFRETDRVERPSSVYAVTKRAAELMSESYAYLHGIPQTGLRFFTVYGPWGRPDMAYYGFAKAISEGRPVTLYEGKHLSRDFTYIDDIVRGVQQVLGRPPEAGMSRVLNLGGDKPERVTRMIELLEQNLGKKAFVERRPRPVADMESTWASLENVREFCGWKPAVSFEDGMKEFCLWFRKFHEI

SEQ ID NO: 64932 - DNA, 987 bp, Gluconobacter oxydans 621H
  CDS (1)..(987)
atgcgttatcttgtcaccggtggggcaggcttcgtcggtagtcatgctgttcttgctctactcgatgcaggtcatgatgttgtcgttctggataacttgagcacaggatatcgcgaggcagttcctgatggcgtacctttccacaaggtagaccttctggattatgccgctacgtcagccgtggtggcgcaaggaaaatgggacggcgttctgcattttgcggctctttcgctggttggcgacagcatgcgtgatcctttccactatcttcgccagaactacctgacagcactgaatctcgtacagatttgtgttgagcatggcgtcaaaaagatcgtgttctcttcgacggcagctcttttcggcggaccggaacggctcgaccccatccccgaaaccgcacctgtgcagcccggctccccgtatggcgagagcaagttcatgattgagcgtgtgctgcactgggcagatgcgatctatgggctcagaagcgcatgtctgcgatatttcaatgcggcgggcgcggatccccaaggacgtgcaggtgaagaccatcgtcccgaaacccacctgattcccctgaccattgatgcggcactcggccgccgtcctgcactaaagctgttcggtaccgactatccgacccgggatggatcctgcgtgcgtgactatattcatgttacggatcttgcggatgctcatgtcagggctttgggacagatcgaccatcgcagcgtcacatataacatcggcaatggccagggatactcaaacctcgaagtcatccagagtgtcgagcgcgtcagtggtcggaaagttccgtgggaagctgctcccagacgagagggagatccagcccttctggtggcggattccacaaccctcaggaacgatacgggatggacaccccgcttcgggaatattgacagtatcgtggaaacggcattgcgctggcgtgaaagccatcctaacggttacggaatgtga

SEQ ID NO: 64933 - protein, 328 aa, Gluconobacter oxydans 621H
MRYLVTGGAGFVGSHAVLALLDAGHDVVVLDNLSTGYREAVPDGVPFHKVDLLDYAATSAVVAQGKWDGVLHFAALSLVGDSMRDPFHYLRQNYLTALNLVQICVEHGVKKIVFSSTAALFGGPERLDPIPETAPVQPGSPYGESKFMIERVLHWADAIYGLRSACLRYFNAAGADPQGRAGEDHRPETHLIPLTIDAALGRRPALKLFGTDYPTRDGSCVRDYIHVTDLADAHVRALGQIDHRSVTYNIGNGQGYSNLEVIQSVERVSGRKVPWEAAPRREGDPALLVADSTTLRNDTGWTPRFGNIDSIVETALRWRESHPNGYGM

SEQ ID NO: 64934 - DNA, 993 bp, Lactobacillus acidophilus NCFM
  CDS (1)..(993)
atgaaagttttagttgtaggtggtgcgggctacattggctcacatgccgttcgtgaattagtcaaagaaggtaatgatgtcgttgtactcgactctttatacaccggtcacagaaaggctgtcgatcctaaagcaaagttttatcaaggcgacatcgaggatactttcttagtatcaaagattttacgtgatgaaaaaattgacgctgtaatgcattttgcagcttattcattagtacccgaatcagttaaaaaaccacttaaatactacgataacaatgtttctggtatgatttcattattaaaagcaatgaatgatgcagatgtgaaatatttagtattctcaagttctgcagctacttacggtattcctaagaagttgccaattactgaagatactccacttgatccaattaacccatatggtgaaactaagatgatgatggaaaagatcatggcttgggctgacaaagctgacggtattaaatatactgctcttcgttacttcaatgtagctggtgcttcaagcgatggtactattggtgaagatcacggtcccgaaactcaccttattccaaatattttgaagagtgccatttcaggtgatggtaagtttactatcttcggcgatgattacaataccaaggatggtactaacgtccgtgattatgttcaagttgaagacttaattgatgctcacattttagcattgaagcatatgatgaagactaataaatctgacgtattcaatttaggtaccgcacaaggttactctaacttagaaatcttagaaagtgctaaaaaagttactggtattgatattccgtatacaatggggcctcgccgtggcggtgatcctgattcactagttgccgactcaactaaggcaagaactattttaggctggaagccaaaacatgaaaatgttgatgaagtaatcgaaaccgcttggaagtggcacaagagtcacccaaagggctacgaagacaagtaa

SEQ ID NO: 64935 - protein, 330 aa, Lactobacillus acidophilus NCFM
MKVLVVGGAGYIGSHAVRELVKEGNDVVVLDSLYTGHRKAVDPKAKFYQGDIEDTFLVSKILRDEKIDAVMHFAAYSLVPESVKKPLKYYDNNVSGMISLLKAMNDADVKYLVFSSSAATYGIPKKLPITEDTPLDPINPYGETKMMMEKIMAWADKADGIKYTALRYFNVAGASSDGTIGEDHGPETHLIPNILKSAISGDGKFTIFGDDYNTKDGTNVRDYVQVEDLIDAHILALKHMMKTNKSDVFNLGTAQGYSNLEILESAKKVTGIDIPYTMGPRRGGDPDSLVADSTKARTILGWKPKHENVDEVIETAWKWHKSHPKGYEDK

SEQ ID NO: 64936 - DNA, 942 bp, Vibrio fischeri ES114
  CDS (1)..(942)
atgatcattgtaactggcggcgctggcatgattggcagcaacattgttaagtctttaaataacaaaggttttaacgacattttagtggttgataacctaaaagatggtaaaaaattcaagaacctagtggatcttgatatcactgattacatggataaagaagacttcattacgcaaattatggcgggtgatgactttggtcctatcgaagctattttccatgaaggtgcttgctctgctacaactgagtgggatggcaaatacattatgatgaacaactatgagtactctaaagagttgcttcatttctgtattgagcgtgaaattccattcctttacgcatcatcagcagctacttacggtgaaacagatacgtttatcgaagagcgtgcatacgaaggtgctttaaacgtttacggttattctaaacaacagtttgataactacgttcgtcgcctatgggctgatgctgaagagcacaacgaaacgctatctcaaattacgggtttccgttacttcaatgtgtatggtcctcgtgaacaacataaaggttctatggcttcagttgctttccatttaaataaccaaatgaatgcgggcgataaccctaaactgtttgaaggtagtgacgagtttaaacgtgatttcgtttacgttggtgatgttgctgcagttaacctttggttcttagaaaatggcgtatctggtatttataactgtggtactggccgtgctgaaccattccgcgctgttgctgaagcggtaattaaacaccacggtaaaggtgaagtggaaactatcccattccctgagcacctaaaaggcgcataccaagaatttactcaagctgatctaactaagcttcgtgctgctggttgtgatgttgagtttaagtcagtagctgatggtgttgctgaatatatggcgatgattaataagtag

SEQ ID NO: 64937 - protein, 313 aa, Vibrio fischeri ES114
MIIVTGGAGMIGSNIVKSLNNKGFNDILVVDNLKDGKKFKNLVDLDITDYMDKEDFITQIMAGDDFGPIEAIFHEGACSATTEWDGKYIMMNNYEYSKELLHFCIEREIPFLYASSAATYGETDTFIEERAYEGALNVYGYSKQQFDNYVRRLWADAEEHNETLSQITGFRYFNVYGPREQHKGSMASVAFHLNNQMNAGDNPKLFEGSDEFKRDFVYVGDVAAVNLWFLENGVSGIYNCGTGRAEPFRAVAEAVIKHHGKGEVETIPFPEHLKGAYQEFTQADLTKLRAAGCDVEFKSVADGVAEYMAMINK

SEQ ID NO: 64938 - DNA, 1005 bp, Neisseria gonorrhoeae FA 1090
  CDS (1)..(1005)
atgaccatcatcgtaacaggcgcggccggctttatcggcagcaacatcgtcaaagccctcaaccaacgcggcattaccgacatcgtcgccgtcgataatctgacaaaaggcgaaaaattcaaaaaccttgccgagtgcgaaatcgcccattatctcgacaaacacgaatttatccgccaagtgagggaacacattttaccttatcaaaacatcgaagccgttttccatcaaggcgcgtgttccgatacgatgaaccacgacggtttgtatatgatggaaaacaactaccagtacacgctggatttgttggactggtgtcaggacgaacgcatccccttcctttatgcctccagtgcggcggtttacggcaaaggcgaaatcttccgcgaagagcgcgaactcgaaaaaccgcttaatgtgtacggctactccaaattcctgtttgaccaagtattgcgccgccgcatgaaagaaggtctcaccgcccaagtcgtcggcttccgctacttcaacgtttacggacaacacgaacaacacaaaggccgcatggcatccgtcgccttccaccatttccaccaataccgcgaacacggttacgtcaacctgttcggcagcaacgacggctacggcaacggcgaacaaacccgcgacttcgtcagcgtcgaagacgtcgccaaaatcaacctctacttcttcgaccatcccgaactttccggcatctacaacctcggcaccggccgcagccaacagttcaacgaactcgccgccgccgccgtcaacgcctgccgcgccgccgaaggcaaatctgaattgagcttgaaagagttggtagaagaagaacttatccgctatatcccctttcccgacgcgctcaaaggcaaataccagggcttcacccaagccgacatcaccaaattgcgcgaagccggatataaggaagaatttttcgatgtcaaagcaggtgtcaaccgctacgtcaaatggatgctggaaaatttggcttaa

SEQ ID NO: 64939 - protein, 334 aa, Neisseria gonorrhoeae FA 1090
MTIIVTGAAGFIGSNIVKALNQRGITDIVAVDNLTKGEKFKNLAECEIAHYLDKHEFIRQVREHILPYQNIEAVFHQGACSDTMNHDGLYMMENNYQYTLDLLDWCQDERIPFLYASSAAVYGKGEIFREERELEKPLNVYGYSKFLFDQVLRRRMKEGLTAQVVGFRYFNVYGQHEQHKGRMASVAFHHFHQYREHGYVNLFGSNDGYGNGEQTRDFVSVEDVAKINLYFFDHPELSGIYNLGTGRSQQFNELAAAAVNACRAAEGKSELSLKELVEEELIRYIPFPDALKGKYQGFTQADITKLREAGYKEEFFDVKAGVNRYVKWMLENLA

SEQ ID NO: 64940 - DNA, 918 bp, Archaeoglobus fulgidus DSM 4304
  CDS (1)..(918): transl_table=11
atgattgtggtgacgggaggagcaggatttataggcagccatgtcgtcgataaactgtcagaatcaaacgaaatagtagttattgacaacctctccagcggaaacgaggagtttgtcaacgaggcggcaaggctcgttaaagctgatttggctgctgatgacatcaaggattacctgaaaggtgctgaagaggtctggcacatcgccgcgaacccagatgtgagaattggggctgaaaatcccgatgaaatttacagaaacaacgttctcgcaacttacagactgctcgaggccatgagaaaagcgggggtgtcaaggatagttttcacctccacttcgaccgtttacggtgaggctaaggtgattccaactcccgaggactaccccacgcacccaataagcctttacggtgcttcgaagcttgcctgcgaagctctgatcgagtcctactgccatacctttgacatgcaggcgtggatttacagattcgccaatgtcatcgggaggaggagcacacacggcgtgatatacgacttcataatgaagctgaaaaggaatccggaggagcttgaaattctcggtaatggagagcagaacaaatcctacatctacatttccgactgcgttgatgcgatgcttttcggtctgaggggcgatgagagagtcaacatattcaacataggcagcgaggatcagattaaggtgaagagaattgccgaaatagtctgcgaggagcttggactgtctcccagattcagattcacgggaggagatagggggtggaagggagacgtgccggtaatgctcctcagcattgaaaagctgaaaaggctgggatggaagccaagatacaacagcgaggaagctgtgagaatggccgtgagagacctcgttgaagatttagacgaacagaactga

SEQ ID NO: 64941 - protein, 305 aa, Archaeoglobus fulgidus DSM 4304
MIVVTGGAGFIGSHVVDKLSESNEIVVIDNLSSGNEEFVNEAARLVKADLAADDIKDYLKGAEEVWHIAANPDVRIGAENPDEIYRNNVLATYRLLEAMRKAGVSRIVFTSTSTVYGEAKVIPTPEDYPTHPISLYGASKLACEALIESYCHTFDMQAWIYRFANVIGRRSTHGVIYDFIMKLKRNPEELEILGNGEQNKSYIYISDCVDAMLFGLRGDERVNIFNIGSEDQIKVKRIAEIVCEELGLSPRFRFTGGDRGWKGDVPVMLLSIEKLKRLGWKPRYNSEEAVRMAVRDLVEDLDEQN

SEQ ID NO: 64942 - DNA, 1002 bp, Mesorhizobium loti MAFF303099
  CDS (1)..(1002): transl_table=11
atgcggatgacggttttggtgacaggcggcgccggctatatcggcagccacatggtctgggaattgctggatgcgggtgagagagtggtcgtgctcgaccgcctttccaccggcttcgaatgggcggtggcgccggaggcaaagctggtcgttggcgatgtcgccgacaaggaattggtcggttcgatcatcagggacaatcatgtcgacgcgatcatccatttcgccggttccatcgtggtccccgaatcggtcgccgacccgctcgcctactacgagaacaacacctcaaagacccgcacgttgatcgaaaccgcggtgcgcgagggtgtgccgcatttcatcttttcctcgaccgccgccgtctatggcggcgctgggctggagccggtgcgcgaggatgcccgcctggcgccggaatcgccctatggcctgtccaagctgatgagcgagtggatgttgcgcgatgccggcctcgcgcacgacatccgctacacggcgctgcgctatttcaacgtcgccggcgccgacccgaagggccgcaccggccagtcgacgccgggcgccacccatctcatcaaggtcgcctgcgagaccgcgctcggcaagcgtcccttcatgcaggtgttcggtaccgactatccgacgccggacggcacctgcatgcgcgactacatccatgtcagcgacctggcagccgcgcatcgcctggcgctgcagcggctgcgcgccgggggtacgagcctcgtcgccaattgcggctatagccatggctattcggtgcttgaggtgatcgacagcgttcggcgcgcttttggccgcgatttcgaggtgaagatgggcgaccggcgtcccggcgatgcggcagcggtggtcgccaattcggaccttgcccgggcggaactcggttggacgccgcagcgcgacgatctcgaccagatcgttgccgacgcactcgcctgggaacgcatcctgaccagcaagaactccgcccgcggctga

SEQ ID NO: 64943 - protein, 333 aa, Mesorhizobium loti MAFF303099
MRMTVLVTGGAGYIGSHMVWELLDAGERVVVLDRLSTGFEWAVAPEAKLVVGDVADKELVGSIIRDNHVDAIIHFAGSIVVPESVADPLAYYENNTSKTRTLIETAVREGVPHFIFSSTAAVYGGAGLEPVREDARLAPESPYGLSKLMSEWMLRDAGLAHDIRYTALRYFNVAGADPKGRTGQSTPGATHLIKVACETALGKRPFMQVFGTDYPTPDGTCMRDYIHVSDLAAAHRLALQRLRAGGTSLVANCGYSHGYSVLEVIDSVRRAFGRDFEVKMGDRRPGDAAAVVANSDLARAELGWTPQRDDLDQIVADALAWERILTSKNSARG

SEQ ID NO: 64944 - DNA, 1029 bp, Mesorhizobium loti MAFF303099
  CDS (1)..(1029): transl_table=11
atgaaggttctggtcaccggcgccgccggcttcataggctatcatgtcgccaggcggctcctggagcgtggcgacgaggttgtcggcatcgacagcgtcaacgactattatgacccgcggatcaagcaggcgcggctgcggctgctggccgaagccagccgcggcagcaatgccggctatcatttcatccacggcaatcttgccgagagagaaatcgtggacggctgctttgccgatcacgacttcgaccgggtgatccatctcgccgcccaggccggggtccgctacagcctggaaaacccgcgcgcctatgtcgaaagcaacatcgtcgctttcaccaacatgctggaggcctgccgcaatgccggcatggcgcacctgacctatgccagcacctcgagtgtttacggcgccaacaccgacatgccgttttcggagcaccgcccggccgatcatccgctgcagttctacgccgcgaccaagcgcgccaacgagctgatggcgcacagctacagccatctgttcgggctgccgaccaccgggctgcggttcttcaccgtatacggcccctgggggcgtcccgacatggcgctgttcctgtttacaaggagcatcctggccggcgagccgatcaagctgttcaacaatggcaaccacacgcgcgacttcacctatatcgatgacatcgccgaaggtgtgatccgggccagcgacagtcctgccgccggcaatcccgcctgggattcaggccatccggatccggcaacgagcagcgcgccctggcgcatcttcaacatcggcaacaacaatccggtcaagctgaccgcctatgtcgaggcgctggaaagcgcgcttggccgcaaggccgtcatcgagctcttgccgctgcaggccggcgacgtgccggacactttcgccgacaccaccgcgctgcaggaggctgttggctaccgccccggcacgtccgtgtcggacggggtagggcggttcgtcgagtggtacaaggcgtattttgggtggggtggctga

SEQ ID NO: 64945 - protein, 342 aa, Mesorhizobium loti MAFF303099
MKVLVTGAAGFIGYHVARRLLERGDEVVGIDSVNDYYDPRIKQARLRLLAEASRGSNAGYHFIHGNLAEREIVDGCFADHDFDRVIHLAAQAGVRYSLENPRAYVESNIVAFTNMLEACRNAGMAHLTYASTSSVYGANTDMPFSEHRPADHPLQFYAATKRANELMAHSYSHLFGLPTTGLRFFTVYGPWGRPDMALFLFTRSILAGEPIKLFNNGNHTRDFTYIDDIAEGVIRASDSPAAGNPAWDSGHPDPATSSAPWRIFNIGNNNPVKLTAYVEALESALGRKAVIELLPLQAGDVPDTFADTTALQEAVGYRPGTSVSDGVGRFVEWYKAYFGWGG

SEQ ID NO: 64946 - DNA, 933 bp, Mesorhizobium loti MAFF303099
  CDS (1)..(933): transl_table=11
atggttgcaaaatgtctggtccttggcggcggcggcttcatcggctcgaatatatgccggcgcctgagcgctgagggtctgtcggtgactgcctttgggcgccgaaaaggtattgcaccactgccacgtgaaatcgcttggttcgaaggagacttcagagacaatttggcggtgacgaaggctctgcaaagtcacgacaccgtaatccaccttgtccattccacttggccatcgactgcggatgcggacatggcagccgatattcgcgacagcgtcattccctcagtcgagctgctcgatgcctgcgtcaggtctggagtaaagcgaataatctatttctcctcgggagggactgtctacggagaggtcgacgagattcccattagggaagatagtcctaccaaccccgttggggcctacggtgtttcgaaactaatgattgagcactacgttcgattgtacgagcgcaaatacggcctcaacagtttcattgtgcggttggccaatccattcggtccatggcaggttgaggcgcacaatcagggtctggttgcgtttgccgggcacctgattcagagcgatcggcaagtcactgtttacggcgatggcagcgctcgccgcgactatgtttatgtcgaggatgtcgccaatttcgtcgcccggctcatcaactacaacggcgccaagcgcacttttaatgtcggcggaggcggcaatggtcaatcgatcctcgacgtcatccatgcgattgaaacatcgttaggcaagagggccatgatcaaacgtgagccatcaagaccatttgatgtaccatccaacgtcctgtccatcgagcgcgccgaaaaggaactggggtggaggccggcgacatcgttccccgacgggattgattacaccctatcctggcagcgagaattttatgctaggccgtga

SEQ ID NO: 64947 - protein, 310 aa, Mesorhizobium loti MAFF303099
MVAKCLVLGGGGFIGSNICRRLSAEGLSVTAFGRRKGIAPLPREIAWFEGDFRDNLAVTKALQSHDTVIHLVHSTWPSTADADMAADIRDSVIPSVELLDACVRSGVKRIIYFSSGGTVYGEVDEIPIREDSPTNPVGAYGVSKLMIEHYVRLYERKYGLNSFIVRLANPFGPWQVEAHNQGLVAFAGHLIQSDRQVTVYGDGSARRDYVYVEDVANFVARLINYNGAKRTFNVGGGGNGQSILDVIHAIETSLGKRAMIKREPSRPFDVPSNVLSIERAEKELGWRPATSFPDGIDYTLSWQREFYARP

SEQ ID NO: 64948 - DNA, 939 bp, Thermoplasma volcanium GSS1
  CDS (1)..(939): transl_table=11
atggaaaacaaaaggatactcataacagggggcgccggcttcataggttcgaatatggtggagcatttgctgcctaaaaatgaagtgactgtcattgataacctgagcataactgatgataggtacataaaaaaattctatgataatcctaattttaaattcataaagaaggacatactgaatggaatagatggatatcactatgacattgttgtgcacctggcagctgattctgatgtgaggaatggatcttcaaatcctgcgcttgatatgaaggtcaacgttgaaggcacaatcagtgtgctagaaatgatgaggaagtctgacataaaagacatattatttgcttccagctcaacggtgtatggagaagcaaaggttatacctacacctgagaactatggaccacttttgcccatatcttcttacggagcctctaaacttgcagcagaggcttttatatcagcatacgctagctactacggttttaacgcgcttcttttcaggtttgcaaatgttgttggaaaaaactcaacgcatggcgtaatatttgattttataaataaacttaagaacaacaagaaagaactagaagttctaggagacggaactcaagcgaagtcatacatacacgttgaagatctcatcggatcaatgatatacgtttatgaacacgtaaaaggcgttgaaccattcaacctaggcaatgacgatgttactagtgtcgataagattgcaaaatttgtgctggaggctatgggacttaaagatacggcaattgtacaccgcggtggatacaatggaagagggtggcctggagacgtaaaatatgccatgatggatatagctaagcttaaaaaaacaggttggaaaaataagtatagcagcgatgaagctgtgaagaaatctataaatgaagtaatgaatcagatactgtag

SEQ ID NO: 64949 - protein, 312 aa, Thermoplasma volcanium GSS1
MENKRILITGGAGFIGSNMVEHLLPKNEVTVIDNLSITDDRYIKKFYDNPNFKFIKKDILNGIDGYHYDIVVHLAADSDVRNGSSNPALDMKVNVEGTISVLEMMRKSDIKDILFASSSTVYGEAKVIPTPENYGPLLPISSYGASKLAAEAFISAYASYYGFNALLFRFANVVGKNSTHGVIFDFINKLKNNKKELEVLGDGTQAKSYIHVEDLIGSMIYVYEHVKGVEPFNLGNDDVTSVDKIAKFVLEAMGLKDTAIVHRGGYNGRGWPGDVKYAMMDIAKLKKTGWKNKYSSDEAVKKSINEVMNQIL

SEQ ID NO: 64950 - DNA, 924 bp, Thermoplasma volcanium GSS1
  CDS (1)..(924): transl_table=11
atggctatagaaaataaagagattctagttacaggtggcgcaggtttcataggttcaaatcttgttgctagattatctgaaaagaaccacgtttatgttttagattctttacaaactggttccctacataacatagatgggctttcgaacgttgaatttattaaggattatgccaaaaacgtatcaaactactgtataaacccagattatatatttcacatcggcgtgtattcatcttcaccaatgtataggtctaatccctttctggtcagcgaagcaatacacgacatgatagctatactggaactcgcaaagaaatctaaaacaccagtcgtgtttgcatctacatcctcaatatataacggtgtaaaaccgccccatagggaaaatgtaaccccacttgtttcagattattatactgaagcaaggatatcgatggaaagaatatctgaactttattcaaaactttatgatataaatatatccgctatgcgcttcttttctatatacggataccgtgaaatgaagaaaaggatgtatgcaaatcttgtctcacaattcctctgggatatgcacagcaaaaaatccccaatcatatacggagatggggaacagagacgtgatttcgtgtttgttgatgatgttgtagacgcacttatcctagcagctgaaaaatcggatggatttcaagtttataatgtcgggactggcgttaattattccctaaatgaactcgtacaaaagctgaacaaatacctcggttctaacattgaaccgaagtacgtggagaacccaatggccaagacctatgtccacgagacgcttgcagatactaataaagcagagaaaatgatcgggttcagggctaagatctctctcgatgaaggaattaagagattaatatcatactatggatacgcatga

SEQ ID NO: 64951 - protein, 307 aa, Thermoplasma volcanium GSS1
MAIENKEILVTGGAGFIGSNLVARLSEKNHVYVLDSLQTGSLHNIDGLSNVEFIKDYAKNVSNYCINPDYIFHIGVYSSSPMYRSNPFLVSEAIHDMIAILELAKKSKTPVVFASTSSIYNGVKPPHRENVTPLVSDYYTEARISMERISELYSKLYDINISAMRFFSIYGYREMKKRMYANLVSQFLWDMHSKKSPIIYGDGEQRRDFVFVDDVVDALILAAEKSDGFQVYNVGTGVNYSLNELVQKLNKYLGSNIEPKYVENPMAKTYVHETLADTNKAEKMIGFRAKISLDEGIKRLISYYGYA

SEQ ID NO: 64952 - DNA, 954 bp, Pyrococcus abyssi GE5
  CDS (1)..(954): transl_table=11
gtgaaagttctggtgactggaggtgctggcttcataggttctcacttggtcgacaggttgatggaagatggatacgaggttagggttctcgatgaccttagtgctggtagccttgaaaatttgaatagatggcttgaaaacgaaaattttgaattcataaggggtgacatgagggactataagatagtgaaggaagcagttgatgacgtcgaggttgttttccacttagcagcgaaccctgaagttagaattagctctcaaagtccagagttgctttacgagacgaacgtcctaataacgtacaacctacttcaggccattagggagtcaaacgtgaagttcctcgtcttcacgagttcttccaccgtttacggagatgcgaatgttcttccaaccccagagagctatggtcctttggaacctataagcgtctatggtggagcaaaattggccgctgaagctttaataagtggttacgcccatatattcggtttcagggccctaatctttaggttagcaaatataattgggaaaagatcaaatcatggcgtaatctatgatttcataaacaagttaaagagaaatccaaatgagcttgaaatactcggggatgggaagcagaggaagagctatcttcacgttagcgataccataaacggtatccttcacatcttcgaatatttcaaaaggcagaacaaaatcttcgacgtctacaacttgggaaacgaggattggataactgtcaaggaaatagcggagatagtaagtgaggagatgggactttctccgaagttcaagtttactgggggagtcgatggtggaaggggctggaaaggtgatgtgaagttcatgcttcttagcatagagaaggccaagaaaactggatggaggccaaagatgaacagttacgaagctgttagaagaaccgtgagggagttgctgggggtgttgtga

SEQ ID NO: 64953 - protein, 317 aa, Pyrococcus abyssi GE5
MKVLVTGGAGFIGSHLVDRLMEDGYEVRVLDDLSAGSLENLNRWLENENFEFIRGDMRDYKIVKEAVDDVEVVFHLAANPEVRISSQSPELLYETNVLITYNLLQAIRESNVKFLVFTSSSTVYGDANVLPTPESYGPLEPISVYGGAKLAAEALISGYAHIFGFRALIFRLANIIGKRSNHGVIYDFINKLKRNPNELEILGDGKQRKSYLHVSDTINGILHIFEYFKRQNKIFDVYNLGNEDWITVKEIAEIVSEEMGLSPKFKFTGGVDGGRGWKGDVKFMLLSIEKAKKTGWRPKMNSYEAVRRTVRELLGVL

SEQ ID NO: 64954 - DNA, 921 bp, Pyrococcus horikoshii OT3
  CDS (1)..(921): transl_table=11
atgaaaaacaagctcatagtaattactggaggggctggatttataggttctcatttggctgaagcattaaaagatgaaaatgacgtgattataatagacaatctatattccggtagaatcgagaacattccagaaggtgtcaagttcataagggctgatgtcagggattatgaaagcatagctgaagttataagtgaagccgattatgtctttcatgaggccgctcaaattagtgtcaaagaaagtatcgaagaccccgtatttacggaggaggtaaatgttataggaactataaatgttttaagggctttatcccagggagatgggaaattaatatttgcatcttctgcggccgtttatggtgaacccaaggaactaccaattactgaagatacgttaactaatcctatttctccttatggaattacaaagctggctgcggaacattactgcagagtatatcaaagcttatatggaattccagtagtcatcctaaggtattttaacgtctacggccctaggcaaagttctgcttatgctggagtgataagtatcttcttagaaagggcaataaaaggggaacctttgataatttttggagatgggaaacagacaagagatttcatctacgttaaggatgttgttgaggccaatatccttgttgctaagaaaaggagtgctaatggaaggatttttaatgtcgcgactggaaaggagacaacaatcctcgagcttgcaatgaaaataatagatatgacttcctcttcgtcttcaattttattttatccaccgagacctggtgatatcaggagaagtgttgccaaaatagaaagaataaagaaacttggctttaagcctaggtattcccttgaggagggtctcaaggagacttttaaatggtttacatctcgtactcaatga

SEQ ID NO: 64955 - protein, 306 aa, Pyrococcus horikoshii OT3
MKNKLIVITGGAGFIGSHLAEALKDENDVIIIDNLYSGRIENIPEGVKFIRADVRDYESIAEVISEADYVFHEAAQISVKESIEDPVFTEEVNVIGTINVLRALSQGDGKLIFASSAAVYGEPKELPITEDTLTNPISPYGITKLAAEHYCRVYQSLYGIPVVILRYFNVYGPRQSSAYAGVISIFLERAIKGEPLIIFGDGKQTRDFIYVKDVVEANILVAKKRSANGRIFNVATGKETTILELAMKIIDMTSSSSSILFYPPRPGDIRRSVAKIERIKKLGFKPRYSLEEGLKETFKWFTSRTQ

SEQ ID NO: 64956 - DNA, 1140 bp, Arabidopsis thaliana
  CDS (1)..(1140)
atgggcaagattatcttggttgtttctcttactgctttatgcatttttatgctcaagcacgcaccgagtttcacatcaccaaccgcgttctctcgtagcgaggaaggtgtgactcatgtgttagtcactggtggtgctggatatatcggatcacatgctgcgttgaggctcttaaaagattcataccgtgtaaccattgtggacaatctttctcggggaaatcttggtgccgtcaaggttttacaaggattgttcccagaacccgggaggcttcaatttatttatgctgacttaggagatgccaaagctgttgataaaatcttctcagagaacgcgtttgatgctgttatgcattttgctgcagtagcatatgttggagagagcactctagatcctctaaagtattaccacaacattacatcaaacacattagtagttcttgaagctgtggctagacataaagtgaagaagttgatatattcaagcacatgtgccacttatggagaacctgacaagatgcctattgttgaagttactccacaggtccccattaacccttatggaaaagctaagaagatggctgaagatatgatcctggatttctctaaaaactctgacatggcagtcatgatcctaagatactttaacgtgataggttcagatccagaaggtagactaggagaagctccaaagcccgagctacgtgaacacggacggatttcgggtgcctgtttcgatgcagctcgtggcgtgattccaggccttcaggtcaaaggaacagactacaaaacaggagatggaacttgtgttcgtgactacatagatgttactgaccttgtagatgctcacgtaaaagctctcgagaaagctaagcctagaaatgtgggaatatacaatgtaggtacaggaaaaggaagatcggtgaaagagtttgtggaagcatgtaagaaagcgacaggagtagatatcaaagtagattttttgcctcgaagacctggagattacgcagaggtttacagtgatccagcaaagattctgagagatcttaattggtctgctcgttacactaatcttcaagaaagtcttgaggttgcttggaagtggcaaaagactcatccccatggatatgcttcttcttaa

SEQ ID NO: 64957 - protein, 379 aa, Arabidopsis thaliana
MGKIILVVSLTALCIFMLKHAPSFTSPTAFSRSEEGVTHVLVTGGAGYIGSHAALRLLKDSYRVTIVDNLSRGNLGAVKVLQGLFPEPGRLQFIYADLGDAKAVDKIFSENAFDAVMHFAAVAYVGESTLDPLKYYHNITSNTLVVLEAVARHKVKKLIYSSTCATYGEPDKMPIVEVTPQVPINPYGKAKKMAEDMILDFSKNSDMAVMILRYFNVIGSDPEGRLGEAPKPELREHGRISGACFDAARGVIPGLQVKGTDYKTGDGTCVRDYIDVTDLVDAHVKALEKAKPRNVGIYNVGTGKGRSVKEFVEACKKATGVDIKVDFLPRRPGDYAEVYSDPAKILRDLNWSARYTNLQESLEVAWKWQKTHPHGYASS

SEQ ID NO: 64958 - DNA, 1311 bp, Arabidopsis thaliana
  CDS (1)..(1311)
atgctaaattcgtctggagtaagaactcaacgaagaagcccaagacctttgtctctaggaggtagaaagattattactccaacaaaatttgcttatgatcatcataatcctgataaagttttggattttgtagaaatggattgcttagaacccaaaacaaagaacaatctcactggaaagcttctcttagtagcttcactcttaattttagccattattgtgatcagtcaatcttcaagtttcacatctccaagcgcgttttctcaaagagaggaaggagtgactcatgtgttagtcactggtggtgctggttatatcgggtcacatgcggctttaagacttcttagagattcataccgcgtaaccattgtggacaatctttcgcgtggaaatcttggtgcggttaagactttacagcaattattcccgcagacaggaagacttcagttcatttatgctgacttaggagatcccttagcggtcgagaaaatcttctcggagaatgcttttgacgctgtaatgcattttgctgcggtagcttatgtcggagaaagcactctttatcctctaaaatattaccataacattacatcaaacacgttaggagttcttgaagctatggctagacataaagtaaagaaactgatatattctagcacttgtgctacatatggagagcctgaaaaaatgccgattactgaagacactccacaggtaccgattaatccatacggaaaagctaaaaagatggcagaggatatgatcttggatttctcaaagaactctgacatggcggttatgatcttaagatacttcaatgtgattggttcagatccaggaggtagattaggagaagcgccaagacccgaacttcgtgagcaaggaaggatttctggtgcttgtttcgatgcagctcgtggtttcattcccggactacaagtgaaaggaacggattacaaaacatcggacggtacttgcattagagactatatagatgttactgacctcgtggatgctcacgtgaaggctctcgagaaagctcagcctcgaaaagtcggtatctacaatgttggaaccggaaaagggagatcggttaaagaattcgttgaggcatgtaagaaggcgacaggagttgagatcaaagtagatttcttgcctcgacgaccgggagattacgcagaggtttacagtgatccaacaaagattttgaaagatttgaattggactgctcgattcactaatcttcaagatagtcttcaagttgcttggagatggcaaaaaattcatcctcatggatataattcttattaa

SEQ ID NO: 64959 - protein, 436 aa, Arabidopsis thaliana
MLNSSGVRTQRRSPRPLSLGGRKIITPTKFAYDHHNPDKVLDFVEMDCLEPKTKNNLTGKLLLVASLLILAIIVISQSSSFTSPSAFSQREEGVTHVLVTGGAGYIGSHAALRLLRDSYRVTIVDNLSRGNLGAVKTLQQLFPQTGRLQFIYADLGDPLAVEKIFSENAFDAVMHFAAVAYVGESTLYPLKYYHNITSNTLGVLEAMARHKVKKLIYSSTCATYGEPEKMPITEDTPQVPINPYGKAKKMAEDMILDFSKNSDMAVMILRYFNVIGSDPGGRLGEAPRPELREQGRISGACFDAARGFIPGLQVKGTDYKTSDGTCIRDYIDVTDLVDAHVKALEKAQPRKVGIYNVGTGKGRSVKEFVEACKKATGVEIKVDFLPRRPGDYAEVYSDPTKILKDLNWTARFTNLQDSLQVAWRWQKIHPHGYNSY

SEQ ID NO: 64960 - DNA, 1035 bp, Helicobacter pylori 26695
  CDS (1)..(1035): transl_table=11
atggcattattattcacaggagcgtgcgggtatataggctcgcataccgcaagggcgtttttagaaaaaaccaaagaaaatatcattattgtagatgacttaagcaccggttttttagagcacctcaaagcgttagagcattattaccctaatagggttgtgtttattcaagcgaatttgaatgaaacgcacaaattagacgcctttttgaataagcagcagctaaaagatcccattgaagccatcttgcactttggggctaaaatctcagtagaagaatccacgcacttgcctttagaatactacaccaacaacacgctcaacactttagagcttgtcaaactttgcttaaaacatgcaatcaagcgttttattttttcttctacggccgtggtttatggcgaatctagttcaagtttgaatgaagaaagccccttaaaccccattaatccttatggagcgtctaaaatgatgagcgaaagaatcttgttagacacttctaaaatagcggattttaaatgcgttattttgcgctatttcaatgtggctggggcatgcatgcacaatgattataccaccccttacacgctagggcaacgcacgctcaacgccacgcatttgatcaaaatcgcatgcgaatgcgcggtggggaaaaggaaaaaaatggggatttttggcactaactaccccacaagagatggcacttgcattagggattatatccatgtagatgatttggctaacgcacatttagcgagctatcaaacccttttagaaaaaaataagagcgagatctataatgtcggctacaatcaaggccatagcgtgaaagaagtgatagaaaaggtcaaagaaatctcaaacaacgattttttagtggaaattttagacaaacgacagggcgatccagcaagccttattgccaataacgctaaaatcttacaaaacacctctttcaaacccctttataacaacctagacaccattatcaaaagcgctctagattgggaagaacaccttttgaggtttcaataa

SEQ ID NO: 64961 - protein, 344 aa, Helicobacter pylori 26695
MALLFTGACGYIGSHTARAFLEKTKENIIIVDDLSTGFLEHLKALEHYYPNRVVFIQANLNETHKLDAFLNKQQLKDPIEAILHFGAKISVEESTHLPLEYYTNNTLNTLELVKLCLKHAIKRFIFSSTAVVYGESSSSLNEESPLNPINPYGASKMMSERILLDTSKIADFKCVILRYFNVAGACMHNDYTTPYTLGQRTLNATHLIKIACECAVGKRKKMGIFGTNYPTRDGTCIRDYIHVDDLANAHLASYQTLLEKNKSEIYNVGYNQGHSVKEVIEKVKEISNNDFLVEILDKRQGDPASLIANNAKILQNTSFKPLYNNLDTIIKSALDWEEHLLRFQ

SEQ ID NO: 64962 - DNA, 1068 bp, Borrelia burgdorferi B31
  CDS (1)..(1068): transl_table=11
atgaagatttttttaaccggaattgcagggtttattggatttcatgtagctaaaaagcttgtggaaaaagggcatgaagttttgggaatagacgtattaaatgattattatgaactcaaatttaagcatgaaaggttagaagctttagggttttgttctaaggatgttaaaacgcataagattattaagagtgaaaaatataataatttatcttttgcttatcttgatatactaaataaggataaactgctagaactttttaaagatcataagtttacacatgtttgccatttggctgctcaagcgggcattagagatagtcttgaaaatcctgatagctatgtttcaataaatattgttgggttttttaatgttttggatgtatgtagagtttataaagaaaacatcgagcattttgtttatgcatcaacgtcatcggtttatggcataaatgaaaatatgccgtctagtgaagattctattacggatcaccctttaaatttatatgcagctagtaaaaaatctaatgagatgatggcgcatgcttatagtgcatcttttaatattcccacaacagggcttagatttttcacagtttatgggacttatggaagacccgatatggctttatatttattttcagatggaattaaaaatggcaaggctattaatatttttaataatgggaatatggctagagattttacatatgtgggtgacattgcagacggtgtttacaaagttttgaaaaatccggctaagagtgattgtaattttgacgttaaaaatccaaattcatcaacttcttcttttccttacagaatatataatataggaactggacacgcaactaaactgctagattttattagcgagcttgaagcaaattttgataaaaaggccttaaaaaattatatgcctatgcaaaaagcagatgttgtagaaagttgttgtgatattttaaagcttaaaaatgatgttgggtatgaggctaaagtttctattaaagaaggaataaaagaattttcacagtggtataaaatgctagagtctaccaagaagacttga

SEQ ID NO: 64963 - protein, 355 aa, Borrelia burgdorferi B31
MKIFLTGIAGFIGFHVAKKLVEKGHEVLGIDVLNDYYELKFKHERLEALGFCSKDVKTHKIIKSEKYNNLSFAYLDILNKDKLLELFKDHKFTHVCHLAAQAGIRDSLENPDSYVSINIVGFFNVLDVCRVYKENIEHFVYASTSSVYGINENMPSSEDSITDHPLNLYAASKKSNEMMAHAYSASFNIPTTGLRFFTVYGTYGRPDMALYLFSDGIKNGKAINIFNNGNMARDFTYVGDIADGVYKVLKNPAKSDCNFDVKNPNSSTSSFPYRIYNIGTGHATKLLDFISELEANFDKKALKNYMPMQKADVVESCCDILKLKNDVGYEAKVSIKEGIKEFSQWYKMLESTKKT

SEQ ID NO: 64964 - DNA, 933 bp, Aquifex aeolicus VF5
  CDS (1)..(933): transl_table=11
atgaaattcctaatcacaggcggtgcgggttttatcggttcaaatttagcttttgcgcttcaagaaaggtatcccgaagcgaagatttacgtgcttgataacttttcttccgggcattttaagaacttaatcggatttaaagggcaggttattacgggagatatttcagatccttctttatgggattacgtaaggaaaaacttccactttgacgtgatatttcacgaagcggctataacggacacaacggtggaagatcaatactttatgatgaaaacgaatgcggattctttcaggtacattctggaccttgcggttgagtggaatgcaaaagtcatatacgcctcctccgcaggggtctatgggaactctccgcctcccatgagggaagacaagggacttgaacctgaaaacatatacgggttttcaaaactcatgatggatcacatagctatggactatatggaaaggtatcccgagatgaacatagtggggttgaggtacttcaacgtttacggtccgagggaggactacaaaggaaaaaccgcgagtatgatttaccagcttgcggtgaagatgataaaaggggaaagaccgagactctttaaatggggagaacagaggagggacttcgtttacataaaagacgtaattaaggcaaaccttcttgcccttgaaaagaacgtctctggtatatttaacgtgggtacgggaagggcaaggagtttcaacgaaatcgtttctatcctcaacaaagaactcgggacgaattacgaaattgagtactttgactgtccttacgatttttatcagaaattcacagaagcagacctcacaaaaataagggaagccctcggatacgaacctgagtattccttagaagaagggataaaggattacctcccttacataattaagagagttaaaaaatga

SEQ ID NO: 64965 - protein, 310 aa, Aquifex aeolicus VF5
MKFLITGGAGFIGSNLAFALQERYPEAKIYVLDNFSSGHFKNLIGFKGQVITGDISDPSLWDYVRKNFHFDVIFHEAAITDTTVEDQYFMMKTNADSFRYILDLAVEWNAKVIYASSAGVYGNSPPPMREDKGLEPENIYGFSKLMMDHIAMDYMERYPEMNIVGLRYFNVYGPREDYKGKTASMIYQLAVKMIKGERPRLFKWGEQRRDFVYIKDVIKANLLALEKNVSGIFNVGTGRARSFNEIVSILNKELGTNYEIEYFDCPYDFYQKFTEADLTKIREALGYEPEYSLEEGIKDYLPYIIKRVKK

SEQ ID NO: 64966 - DNA, 984 bp, Aquifex aeolicus VF5
  CDS (1)..(984): transl_table=11
atgaaaaaagttctcgtcacgggaggagcgggttacataggttctcatgtagttaaggctctgggagagaaggggtacgaggttctcatctacgacaacctctcaacgggaaacgagtgggcggttctctacggaaaactcgtaaaggcagatcttgcggataaggaaactttaagaagggtgtttgaagagttcaaaccagacgcggttatgcactttgccgcttacatagtagtgcccgaaagcgtaaaagagcccttaaagtattacagaaacaacgttgtgaataccataaacctgctggaggtgatgcaagagttcggagtaaataagtttgtgttttcttcctccgcggcggtttacggtatacccgaaagtattcctgtaaaggaagacgcacccttgaaccccataaatccttacggagagacaaaggcaaccgttgagaggattttaagggacttaaaaaattcaggaaaggattttaattacgtatctttaaggtacttcaacgtggcgggagcggaccccgagggaaaaattggctttgcatacccaaaccccacgcacctaataataagggcggtgaagacggcggcgggagagtttgacagacttgaaatttacggaactgattatcctactcccgacggcacgtgtataagggattacatacacgtaacggaccttgcggaggcacacattctcgcccttgaatacctcttttccggaggaaagagcgaggttctgaactgcggatacgggcacggctactcagtccttgaggtggtaaacgcagttaaaaaggtgacgggggtggattttaaggttgtggaagctccgaggagagagggagacccgcctgctctggtggcggacaacaagaaaattaaaagggttcttaactgggaacctaagtacgacgaccttgagttcataattaaaaccgcttgggaatgggagaaaaagtttaaattaaaataa

SEQ ID NO: 64967 - protein, 327 aa, Aquifex aeolicus VF5
MKKVLVTGGAGYIGSHVVKALGEKGYEVLIYDNLSTGNEWAVLYGKLVKADLADKETLRRVFEEFKPDAVMHFAAYIVVPESVKEPLKYYRNNVVNTINLLEVMQEFGVNKFVFSSSAAVYGIPESIPVKEDAPLNPINPYGETKATVERILRDLKNSGKDFNYVSLRYFNVAGADPEGKIGFAYPNPTHLIIRAVKTAAGEFDRLEIYGTDYPTPDGTCIRDYIHVTDLAEAHILALEYLFSGGKSEVLNCGYGHGYSVLEVVNAVKKVTGVDFKVVEAPRREGDPPALVADNKKIKRVLNWEPKYDDLEFIIKTAWEWEKKFKLK

SEQ ID NO: 64968 - DNA, 1035 bp, Helicobacter pylori J99
  CDS (1)..(1035): transl_table=11
atggcattattattcacaggggcgtgcgggtatataggctcgcataccgcaagggtgtttttagaaaaaaccaaagaaaacatcattattatagacgatctcagcaccggttttttagagcatatcaaagcgttagagcgttactaccctaatagggttgcgtttattcaagcgaatttgaatgaaacgcaaaaattagacgcttttttaaataagcaacagctaaaagatcccattgaagctgtcttgcattttggggctaaaatctcagtagaagaatccatgcgcttgcctttagaatactacaccaacaacacgctcaacactttagggcttgtcaaactttgcttaaaacatgcaatcaagcgttttattttttcttctacggccgtggtttatggcgagtctggttcaagcttgagtgaagaaagccccttaaaccccattaatccttatggagcgtctaaaatgatgagcgaaaggattttgttagacgcttctaaagtggcggattttaaatgcgttatcttgcgctatttcaatgtggctggggcatgcatgcacaatgattataccaccccctacactttggggcagcgcacgcttaacgccacgcatttgatcaaaatcgcatgcgaatgcgcggtggggaaaaggaaaaaaatggggatttttggcactaactaccccacgagagacggcacttgcattagggattatatccatgtagatgatttggctaacgcgcatttagcgagctatcacactcttttagaaaaaaataagagcgaaatctataatgtcggctacaatcaaggccatagcgtgaaagaagtgatagaaaaggttaaagaaatctcaaataaggattttttagtggaaattttagacaaacgacagggcgatccagcaagccttatcgctaataattctaaaatcttacaaaacacccctttcaaacccctttataacaacctagacaccattatcaaaagcgctctatcttgggaagaacaccttttgaaatttcaataa

SEQ ID NO: 64969 - protein, 344 aa, Helicobacter pylori J99
MALLFTGACGYIGSHTARVFLEKTKENIIIIDDLSTGFLEHIKALERYYPNRVAFIQANLNETQKLDAFLNKQQLKDPIEAVLHFGAKISVEESMRLPLEYYTNNTLNTLGLVKLCLKHAIKRFIFSSTAVVYGESGSSLSEESPLNPINPYGASKMMSERILLDASKVADFKCVILRYFNVAGACMHNDYTTPYTLGQRTLNATHLIKIACECAVGKRKKMGIFGTNYPTRDGTCIRDYIHVDDLANAHLASYHTLLEKNKSEIYNVGYNQGHSVKEVIEKVKEISNKDFLVEILDKRQGDPASLIANNSKILQNTPFKPLYNNLDTIIKSALSWEEHLLKFQ

SEQ ID NO: 64970 - DNA, 930 bp, Thermotoga maritima MSB8
  CDS (1)..(930): transl_table=11
atgaacattctggtaacaggcggagcgggcttcataggatcccacgtggtggacaaactgatagaaaacggatacggtgtcattgtggtggacaatctatcttctggaaaggttgaaaacctcaacagaaacgcactgttttatgaacagagtatagaggacgaagaaatgatggagcggatcttctctctacacagacccgagtatgtctttcacctcgccgctcaggctagtgtcgccatctctgttagggaacccgccagagacgcaaaaacgaacatcatcggatctcttgtgcttcttgaaaaatccatcaagtacggtgttaaaaaattcatcttttcgtccaccggtggggcgatatacggagagaatgtgaaggtctttccaacaccggaaacggagatacctcatccgatatccccttatggcatagcgaagtacagcaccgagatgtatctggaattcttcgcgagagagtacgggctgaagtacacagttctcagatacgccaacgtttacgggccaagacaggatccgtacggtgaagcgggcgtggtggccatcttcactgaaaggatgctcaggggagaggaagttcacatattcggtgatggagagtacgtcagagactacgtttacgttgatgacgtggtcagagcgaatcttctcgccatggagaaaggcgacaacgaagtcttcaacataggaacgggaaggggcacaaccgtgaaccagctcttcaaactgctgaaagagatcactggctacgataaagagcctgtctataaaccaccgcgtaagggcgacgtgagaaagagcattctcgattacacgaaggcgaaggaaaagctcggctgggaacccaaagtttcccttgaggagggattgaagctcaccgttgagtatttcagaaaaacccttgagtga

SEQ ID NO: 64971 - protein, 309 aa, Thermotoga maritima MSB8
MNILVTGGAGFIGSHVVDKLIENGYGVIVVDNLSSGKVENLNRNALFYEQSIEDEEMMERIFSLHRPEYVFHLAAQASVAISVREPARDAKTNIIGSLVLLEKSIKYGVKKFIFSSTGGAIYGENVKVFPTPETEIPHPISPYGIAKYSTEMYLEFFAREYGLKYTVLRYANVYGPRQDPYGEAGVVAIFTERMLRGEEVHIFGDGEYVRDYVYVDDVVRANLLAMEKGDNEVFNIGTGRGTTVNQLFKLLKEITGYDKEPVYKPPRKGDVRKSILDYTKAKEKLGWEPKVSLEEGLKLTVEYFRKTLE

SEQ ID NO: 64972 - DNA, 1041 bp, Thermotoga maritima MSB8
  CDS (1)..(1041): transl_table=11
atgatggggaaaacagagtacttggattattacagtgggaagagagttcttgtcacaggtggtgctggagcggttggatcgaatctggttagaagactgttagatttaggagcttttgtgatagttatagataacctgagttccgggtatacctggcttcttcctcaagatgccccgaatctgctgttcatagagggtgatataacaaacgatgtcgacttaaagagagtgttcaacgaggaaccggagataatatttcaccttgcggcattttttgccaatcagaattccgttgattatcctgaaaaggatctttgggtaaatggatttggcactttgaaacttctggaatacaccagaatatatgggaaagttgaaaggttcgtctatgcatcttcaggctgttccatttatcctagcgatgctcccatgcctttcaaggaagatctgcctatatcctcctggatgagcacgccttatcagattacgaaggctctgggggaactttactgcaattacttctacaaaatgtacgacattcccattacaaaagcacgcttcttcaactcctttggccccggcgaagtccctggacagtacaggaacgttatcccaaatttcatatactgggcaatgcttggtaaaccgttacccatcacaggtacgggtgaagagacgagggatttcacttacgtaggtgatattgttgacggattgttgaggatgggatattacagagaagccataggtgaggctttcaatctcgcagccggaagggaagtgaagataaagtatctcgccgagaaagtgaacgaactcaccggaaataccgctggtattgttttcaaaccacgaagaaaatgggataccaagccaagaatgctcgcatccaacgaaaaagcaaagaaagtccttggttttaatcctgatccagatttcgacggaaggctcgctgagactgtagaatggtttaagcaaaattgggaacttataaaaaaatctgctgaatttggaccaggcgtcagctcggctgtgaggtga

SEQ ID NO: 64973 - protein, 346 aa, Thermotoga maritima MSB8
MMGKTEYLDYYSGKRVLVTGGAGAVGSNLVRRLLDLGAFVIVIDNLSSGYTWLLPQDAPNLLFIEGDITNDVDLKRVFNEEPEIIFHLAAFFANQNSVDYPEKDLWVNGFGTLKLLEYTRIYGKVERFVYASSGCSIYPSDAPMPFKEDLPISSWMSTPYQITKALGELYCNYFYKMYDIPITKARFFNSFGPGEVPGQYRNVIPNFIYWAMLGKPLPITGTGEETRDFTYVGDIVDGLLRMGYYREAIGEAFNLAAGREVKIKYLAEKVNELTGNTAGIVFKPRRKWDTKPRMLASNEKAKKVLGFNPDPDFDGRLAETVEWFKQNWELIKKSAEFGPGVSSAVR

SEQ ID NO: 64974 - DNA, 948 bp, Bacillus halodurans C-125
  CDS (1)..(948): transl_table=11
atgagaattcttgttactggtgccgccggattcattggctcccacctctgtgaacaattgcttatgaacgaaaaggtgtctgttgttggggttgacggacatattgattcctctttgtgtaaagttaaggaacgcaatgttcgaaatttactaaaacatcctcgctttactttactcaaacaagatttattaacgatcgacttagaaccattggttgaccaggtcgatgtgatttaccacttgtccggcatacctggggtacgatcgagctgggggacagacttcaaaaagtatgtcactcataatatagtagccactcaacaactattagaagcgtgtcgtcgtcattcactcgaaaagtttatttatatctcaacttcgtcggtgtatgggcaaaaaaacgggaaagtaggtgaaaaagcatctcccactcctctctctccatacggtgtgtctaaattaacaggcgaacacttatgcaacgtctattacaggaatttttctatcccgacggtcattttacgctattttaccgtatacggtcctagacagcgtcaagatatggcttttcaccgctttataaaagcgataatagacaatcaaccgattcctatttttggagatggtaatcaatcacgggattttacgtatattgatgattgtatcgctgcaacgtgtgccgtactccatgcggatgtcatcggtgaaacgatcaatataggcggtaaagagcgagcaaccgttttacagatcatttctatgcttgaatccatttttcaaaaagatgccaagcttcaatttttagaaaaaccttttggtgaaccgatgtccacttgggctgatatttcaaaagcggaaaagcttttgcgctactctcccaacgttcctttattacaaggaatagaaaaagaggtggacgatttgttggatctatatcagatcgattag

SEQ ID NO: 64975 - protein, 315 aa, Bacillus halodurans C-125
MRILVTGAAGFIGSHLCEQLLMNEKVSVVGVDGHIDSSLCKVKERNVRNLLKHPRFTLLKQDLLTIDLEPLVDQVDVIYHLSGIPGVRSSWGTDFKKYVTHNIVATQQLLEACRRHSLEKFIYISTSSVYGQKNGKVGEKASPTPLSPYGVSKLTGEHLCNVYYRNFSIPTVILRYFTVYGPRQRQDMAFHRFIKAIIDNQPIPIFGDGNQSRDFTYIDDCIAATCAVLHADVIGETINIGGKERATVLQIISMLESIFQKDAKLQFLEKPFGEPMSTWADISKAEKLLRYSPNVPLLQGIEKEVDDLLDLYQID

SEQ ID NO: 64976 - DNA, 927 bp, Bacillus halodurans C-125
  CDS (1)..(927): transl_table=11
atgacaaaaaaagtattagttacaggtggagctggttttatagggtcacacattgtagaattactactaaataaaggatatgaagtagttgtagttgataatttaacaaccggtcaattcgagaatatctctagttttaatgtaccattttacaaaacggatatcgtgtctagtgagcttaaagacattttcagcaaagaaaagccaaactatgttatccaccatgctgcgcaagtcgacgtaacaaaatccattaatcttccgacatatgatgcagaaacaaatataattggaaccataaatttattatcgtgttgttgtcaatatgaagtcgacaaagttatctatgcttcttcatgtgccgtatatggggatactggagattcctccattacagaagatttccctatccagcccatctcgttttacgggatttctaaatctgtacctgaaatgtatattcgccaatttcatgatctctatggtttgaagtatacaatctttcgttatgcaaacgtttatggtccgagacaaacatcaaaaggagaaggtggagtcatttccatctttactacaaaagccttaaaaagagaacaaccgatcatttacggtaatggggaacaaactcgtgattttatttatgtagaagatatagcaaaagctaatgctttagcacttgatataggggacaatgaaatctttaatatcggaacgaatcaaaagacgagtattaatgaattgtataacaaagtaaacgtagtccgtccgtttgccccctccgctaaatatacttcaccgagggaaggcgatattttacacagcaggctaagttatgtgaaggcaaagaaaatactaggatggaaaccatctgtttcccttgagcgagggattcaagagacgctaaaatactacgaacagaaaatctaa

SEQ ID NO: 64977 - protein, 308 aa, Bacillus halodurans C-125
MTKKVLVTGGAGFIGSHIVELLLNKGYEVVVVDNLTTGQFENISSFNVPFYKTDIVSSELKDIFSKEKPNYVIHHAAQVDVTKSINLPTYDAETNIIGTINLLSCCCQYEVDKVIYASSCAVYGDTGDSSITEDFPIQPISFYGISKSVPEMYIRQFHDLYGLKYTIFRYANVYGPRQTSKGEGGVISIFTTKALKREQPIIYGNGEQTRDFIYVEDIAKANALALDIGDNEIFNIGTNQKTSINELYNKVNVVRPFAPSAKYTSPREGDILHSRLSYVKAKKILGWKPSVSLERGIQETLKYYEQKI

SEQ ID NO: 64978 - DNA, 936 bp, Bacillus halodurans C-125
  CDS (1)..(936): transl_table=11
atgggaaaagtgttagtgacagggggagctggcttcatcggctcccatttagttgatcttttaatcgctgaaggaacagaagtggtcattgtcgacaatttaagttcgggaagccttaaacatgttcatccttctagtcaccttttcaaattagatattttggatgagcgagtggcggatgtttttcaggaacatcctgatattgatcggattgttcacttagccgctcaaagcaaggtagggccatccgtgcttaaccctacttatgatgcacaagtgaatattcaaggaacgatccgcttgttagagtttagccggaaatatggagtgaagcaatttgtttttgcatcctcagcagcaatctacggcccttctcacactttaccgattcgagaggagttcccagcactaccgctatctccctatggaacctctaaatatgcggcagaagcctatgtgaaaacatacgggcgcctgtatggactaaatgttcatgtattacgatttgcaaacgtttatggaccgaggcaaacagctgagacagaggccggagttatttcgatttttatcgaaaagctgttgaaaaatgagcaaccgattattttcggtgatggtaagcagacgagggactttattttcgtattggacgtcgtgaatgccattcgttcctgcttagaaacagaaacgaatcaagaggtagacccagtttataatgttagcacaggtttgcaaacgagcgtggaagatctattaaaggagttgtgcgctcaattaaatgtaacctacgcacctgcctttgaacaggaacggtccggagacattaagcatagctgtttggatcaacaaaagctacagaaacatttgacatggaatcctcgaattgcgctcaatgaaggtttagctaaaacgattgcttattaccaaacacgggagtga

SEQ ID NO: 64979 - protein, 311 aa, Bacillus halodurans C-125
MGKVLVTGGAGFIGSHLVDLLIAEGTEVVIVDNLSSGSLKHVHPSSHLFKLDILDERVADVFQEHPDIDRIVHLAAQSKVGPSVLNPTYDAQVNIQGTIRLLEFSRKYGVKQFVFASSAAIYGPSHTLPIREEFPALPLSPYGTSKYAAEAYVKTYGRLYGLNVHVLRFANVYGPRQTAETEAGVISIFIEKLLKNEQPIIFGDGKQTRDFIFVLDVVNAIRSCLETETNQEVDPVYNVSTGLQTSVEDLLKELCAQLNVTYAPAFEQERSGDIKHSCLDQQKLQKHLTWNPRIALNEGLAKTIAYYQTRE

SEQ ID NO: 64980 - DNA, 1032 bp, Bacillus halodurans C-125
  CDS (1)..(1032): transl_table=11
atgaaaatcctagtcacaggcgctgccggcttcatcggcatgtacgtagcgaaacgccttctcgaagaagggcactttgtcgttgggatcgataatttaaatgattattatgatcctcagttgaaaaatgatcgtttgttacagctgcgagagcttgggaattttgaatttcacaagatggatttaaccgagcgtgaccgattgcgtcagctattcttagataaagagattacccatgtcatcaatcttgcggcacaagcaggggtacggtacagtttgaaaaacccgcatgcgtatattgattcgaatcttgttggctttacgaatctattagagtcgtgtcgggaactcaatgtgaagcatttgatctatgcgtcttcaagctcggtatacggtgcgaatcggaaaatgccattcgctacttcggatgaagtgaatcatcctgttagcttatatgctgcgaccaaaaaggcgaatgagcttttagctcactcctatagtcacctttatcacattccgactacaggactccgcttctttacggtttacgggccgtggggacgtccagatatggcgtatttctcatttacgaaaaatattgtcgaaggccaaacgattaaagtctttaatcacggagaaatgatgcgggattttacctatatcgatgatatcgtcgatggggttgtcgcgctccttgaacagccgccgcaagccgatccgaattgggactttgaacatcctatggccagctcgagttatgctccatataaaatctacaacatcggaaacaatcagccagtgaagctgatggactttatcgaaacgttagaaaagcatttaggcatcgaagcgaaaaaagagtttttgccgatgcagcctggagatgtacaagctacatatgcggatattgatgatttgcagcaggctacaggctttacaccatccacctccattgacgaaggcttaaaaaagtttgtcgactggtttaaaacatattacaatgtagaagcaggtgtccttatccagaaatag

SEQ ID NO: 64981 - protein, 343 aa, Bacillus halodurans C-125
MKILVTGAAGFIGMYVAKRLLEEGHFVVGIDNLNDYYDPQLKNDRLLQLRELGNFEFHKMDLTERDRLRQLFLDKEITHVINLAAQAGVRYSLKNPHAYIDSNLVGFTNLLESCRELNVKHLIYASSSSVYGANRKMPFATSDEVNHPVSLYAATKKANELLAHSYSHLYHIPTTGLRFFTVYGPWGRPDMAYFSFTKNIVEGQTIKVFNHGEMMRDFTYIDDIVDGVVALLEQPPQADPNWDFEHPMASSSYAPYKIYNIGNNQPVKLMDFIETLEKHLGIEAKKEFLPMQPGDVQATYADIDDLQQATGFTPSTSIDEGLKKFVDWFKTYYNVEAGVLIQK

SEQ ID NO: 64982 - DNA, 930 bp, Pseudomonas aeruginosa PAO1
  CDS (1)..(930): transl_table=11
atgtttgaacgccccatcctgatcaccggcggcgccggtttcatcggctcccacctgaccgacgcgctgctggcgcgcggctaccgcgtgcgtgtgctggacaacctgtccaccggcaagcgcgacaacctgcccctggacgacgaacgggtagagctgctcgaaggcgacgccgccgacgcggcgaccctggcggccgccctgaagggctgcgcggcggtcgcccacctggccgcggtcgcctcggtacaggcctcggtggacgacccggtcgccacccaccagagcaatttcatcgccaccctgaacctctgcgaagcgatgcgcgagcagggcgtgaagcgcgtggtgttcgcttccagcgcagcggtctacgggcagaacggcgaaggcacggcgatcgacgaagacaccccgaagtcgccgctgacgccctacgcgtcggacaagctggccagcgagtactacctcgatttctatcgccgccagcatgggctggaaccggcgatcttccgcttcttcaacgtctacgggccacgccaggacccgtcctcgccctattccggggtgatcagcatattcaccgagcgcgccctgaaggggacgccgatcaccgtgttcggcgacggcgagcagacccgcgacttcatctacgtcgccgacctggtcgatttcctggtccaggcgctggaggcgacggcggtggaacccggggcggtgaacgtcggcctgaatcgcagcatcagcctgaagcagttgctggcagagatcggccaggtactcggtggcctgccgccggtgacccacgccgacgcgcgagccggtgacatcaggcattcgcgggcgaacaacgagcgcctgctgcggcgtttccgcttcgaccagccgacgccgatgggcgtgggcctggcgcgcctgctcggccgctga

SEQ ID NO: 64983 - protein, 309 aa, Pseudomonas aeruginosa PAO1
MFERPILITGGAGFIGSHLTDALLARGYRVRVLDNLSTGKRDNLPLDDERVELLEGDAADAATLAAALKGCAAVAHLAAVASVQASVDDPVATHQSNFIATLNLCEAMREQGVKRVVFASSAAVYGQNGEGTAIDEDTPKSPLTPYASDKLASEYYLDFYRRQHGLEPAIFRFFNVYGPRQDPSSPYSGVISIFTERALKGTPITVFGDGEQTRDFIYVADLVDFLVQALEATAVEPGAVNVGLNRSISLKQLLAEIGQVLGGLPPVTHADARAGDIRHSRANNERLLRRFRFDQPTPMGVGLARLLGR

SEQ ID NO: 64984 - DNA, 942 bp, Lactococcus lactis subsp. lactis Il1403
  CDS (1)..(942): transl_table=11
atgataacaaagagtaacatactaataacaggtggagcaggttttattggctcaagtttagcgaacgaattactacctcaaaataagattactgttattgataatctttcgatgggagattttaataatcttcatgaaacaagtaatcttacaaaaattttaggtgatgtcactgataaaaatctcctggtaaaagttttggaagaaaatgattttgattatatttttcatttagcagcaattgcttcggttgccgattcagttgcacggccgtatgaaactcatcaagttaattttgatagtacgatgacacttctcgagatcttacgtcaaaataaaaaatcattgaaacgatttgttttttcttcaagcgcagcagtttatggtgatgagccaacacttcctaagcaggaagagggcacaatccgcccccttactccttatgcaattgataaatttgcatctgaaaaaatgacaatgatttataataatttatatgatgttcctaccagtgcaacacgctttttcaatgtttatggaccaaatcaaaatcccaattcaccctattcaggatttatttccattcttgttgaccgtttgcgagaaaatacagaattgactatttttggagatggagaacagtctcgagattttgtatatatagaagatgttattcaagcattattactaatagcgacctctgaacaatcctttggagaagtctataatgtcgggactggggtcaaaaattcaataaacgatttaacgaaatttgctcaaaaatttacaaataaagagttatctatcaaatttgatgatgtgcgacaaggagatatcaaagactcagtttccgatatttcaaaacttaaggacataggatactcacctaaatttgatttatctaatggtatgaaaaagtacctcaactatgaatttaaataa

SEQ ID NO: 64985 - protein, 313 aa, Lactococcus lactis subsp. lactis Il1403
MITKSNILITGGAGFIGSSLANELLPQNKITVIDNLSMGDFNNLHETSNLTKILGDVTDKNLLVKVLEENDFDYIFHLAAIASVADSVARPYETHQVNFDSTMTLLEILRQNKKSLKRFVFSSSAAVYGDEPTLPKQEEGTIRPLTPYAIDKFASEKMTMIYNNLYDVPTSATRFFNVYGPNQNPNSPYSGFISILVDRLRENTELTIFGDGEQSRDFVYIEDVIQALLLIATSEQSFGEVYNVGTGVKNSINDLTKFAQKFTNKELSIKFDDVRQGDIKDSVSDISKLKDIGYSPKFDLSNGMKKYLNYEFK

SEQ ID NO: 64986 - DNA, 981 bp, Lactococcus lactis subsp. lactis Il1403
  CDS (1)..(981): transl_table=11
atgacggttttagttcttggtggagcaggatacgtgggaagtcacgcggtagatatgcttcttaaacgtggttacgatgtggcagtggtggataatttagtgacaggccaccgtgaatctgttccagcaaatgtacgcttttacgagggtgatgtacgtgatcaagctttcttagcagatgtttttgaaaaagaaaatattgaaggaatcatgcacttttgtgcttactctttagtgggtgagtcaatgcaaaaacctttaatgtattttaataataatgttggtggtgctcaagtaattctagaaacgatggaagaattcggagtaaaacatattgttttttcaagtacagcagctacatttggaattccagaaaaaagtccaatttcagaaaaaacacctcaaaaaccaattaatccttatggtgaaagcaaattaatcatggaaaaaatgatgaaatggcaatcgcaagcaactgatatgacttatgtcgctttacgttatttcaatgttgcaggggctaaggatgatggttcaattggtgaagctcataaaaatgaaacacatttgattccaattattttgcaaactgcacttggtcaaagagagttcattactatttatggtgatgactatcacacgcctgatggaacttgtattcgtgattatattgatatggaagatttgattgaagcacacatcaaagcactagagtatcttaaagcgggcggtcagtctgaccaatttaatctcggttcaagtaagggttattcaaatcttgaagtgcttgaaaccgcacgaaaagtaacaggtaaagaaattccaagccaaatgggtgaacgccgtgcaggagacccagatgagctggttgctgattcaacaaaagctggtgaaattttgggttggaaagcacaaaatgatttagagcacattattacgaacgcttggaaatggcaccaaagtcatccaaaaggttactag

SEQ ID NO: 64987 - protein, 326 aa, Lactococcus lactis subsp. lactis Il1403
MTVLVLGGAGYVGSHAVDMLLKRGYDVAVVDNLVTGHRESVPANVRFYEGDVRDQAFLADVFEKENIEGIMHFCAYSLVGESMQKPLMYFNNNVGGAQVILETMEEFGVKHIVFSSTAATFGIPEKSPISEKTPQKPINPYGESKLIMEKMMKWQSQATDMTYVALRYFNVAGAKDDGSIGEAHKNETHLIPIILQTALGQREFITIYGDDYHTPDGTCIRDYIDMEDLIEAHIKALEYLKAGGQSDQFNLGSSKGYSNLEVLETARKVTGKEIPSQMGERRAGDPDELVADSTKAGEILGWKAQNDLEHIITNAWKWHQSHPKGY

SEQ ID NO: 64988 - DNA, 951 bp, Methanothermobacter thermautotrophicus str. Delta H
  CDS (1)..(951): transl_table=11
atgagagatatggatgtagctgtaaccggaggacttggatttataggttcacacctcacagatgaactccttgagaggggaaaccgtgtcaccgtaatcgatgacctatcaaccggaagcccggataacctcagggacccccaccatgaggaccttgagataattgaggggagcataaatgatctggaccttgagaaggtatttcagggcaaggactacgtcttccaccaggcagccctggccagtgtccccgagagtgtgagggaccccctcaggtgtcaccgtgtcaatgccacagggaccctcagggtgctgatggcctcctccagggcaggtgtccggaaggttgtgaacgcatcaacctctgctgtctatgggaacaacccggagattcccctgagggaggacgccagaccaatgcccctatcaccctacgcagtgtccaaggtgacgggggagtactactgccaggtatttgaggaccaggggcttgaaaccgtctccctgaggtacttcaatgtctacggaccccgccagaggcctgattcacagtacgctgcagtcatccccaggttcatcgacgccctcctcagtggcaggtcccctgagatctacggggatggagagcagagccgtgacttcatatacgtcggtgacgttgtgagggccaacatcttcctggcagagtcccgtggatcaggggtttacaatgtggccggtggaagttccgttacagtcaacaggctcttcgatataatttcagggatccttgagtcagatgcagaaccagaataccttgatgagaggcccggagacgtgaggcactcccttgcagacacgtcccgtctcgctgcagcaggtttcaggccagaggttggacttgaggaggggcttatgaggaccgttgagtggttcctggaaagactgaagataggatcctcctatcagtga

SEQ ID NO: 64989 - protein, 316 aa, Methanothermobacter thermautotrophicus str. Delta H
MRDMDVAVTGGLGFIGSHLTDELLERGNRVTVIDDLSTGSPDNLRDPHHEDLEIIEGSINDLDLEKVFQGKDYVFHQAALASVPESVRDPLRCHRVNATGTLRVLMASSRAGVRKVVNASTSAVYGNNPEIPLREDARPMPLSPYAVSKVTGEYYCQVFEDQGLETVSLRYFNVYGPRQRPDSQYAAVIPRFIDALLSGRSPEIYGDGEQSRDFIYVGDVVRANIFLAESRGSGVYNVAGGSSVTVNRLFDIISGILESDAEPEYLDERPGDVRHSLADTSRLAAAGFRPEVGLEEGLMRTVEWFLERLKIGSSYQ

SEQ ID NO: 64990 - DNA, 978 bp, Methanothermobacter thermautotrophicus str. Delta H
  CDS (1)..(978): transl_table=11
atgatactaatcgttggcggagcaggatacatcgggtcacatgtcaataaatttctatcagagaggggatacgaaaccctcatccttgataacctcacaaggggccacagggattttgttaagtggggtgaattcatagagggtaacctgggtgataggagactccttgacaggacctttgaaacccatgacgtggatgcggtcatgcacttcgcagcattcacagatgtcggtgaatcggtcctcaaaccaggaaggtactaccataacaacgtcgtgaacaccataaacctcctggattccatggtggaccatggcgtcagggacttcatattttcatccacctgtgcagtctacgggaaccccatggagataccaataagcgaggaacaccccctcaaccccataagcccctatggcagatccaaactcatggttgaggagatactgggggactacagggatgcctatggtctcaactatgtctcgctccgctacttcaatgcagccggagcagaccctgaaggagaggtgggggagcttcataaccctgaaacgcacctcatacccatcgtcctggatgttgccctgggtctgcgggacgccgtgcggatattcggcacagattacccaacacccgacggaacatgtgtgagggactacatccacgttatggacctggcagatgcccactggagggcgctcagataccttgagggtggagaaagcggggttttcaaccttggaaacgggaacggcttctcagtcatggaggttatagagacctgcagggaggtcacaggtgccagtataaatgctgttgaggatgacagaagaccaggtgatccaccggaactcgtgggcagtgccggtagggccaggagggtccttggctggaggccggaattcacagaactcgaggatataatagaaaccgcatggaactggcattcaaggatcagaggggggatctcatga

SEQ ID NO: 64991 - protein, 325 aa, Methanothermobacter thermautotrophicus str. Delta H
MILIVGGAGYIGSHVNKFLSERGYETLILDNLTRGHRDFVKWGEFIEGNLGDRRLLDRTFETHDVDAVMHFAAFTDVGESVLKPGRYYHNNVVNTINLLDSMVDHGVRDFIFSSTCAVYGNPMEIPISEEHPLNPISPYGRSKLMVEEILGDYRDAYGLNYVSLRYFNAAGADPEGEVGELHNPETHLIPIVLDVALGLRDAVRIFGTDYPTPDGTCVRDYIHVMDLADAHWRALRYLEGGESGVFNLGNGNGFSVMEVIETCREVTGASINAVEDDRRPGDPPELVGSAGRARRVLGWRPEFTELEDIIETAWNWHSRIRGGIS

SEQ ID NO: 64992 - DNA, 987 bp, Halobacterium salinarum NRC-1
  CDS (1)..(987): transl_table=11
atgcgaatcctcgttacaggtggtgccggatttatcggcggccacctcgcggaacggtttgtctccagggggcacgatgttgtcgtgctcgacaatttcgatccgttctacgatacgcgcattaaggaccataccgttgaggtctgccaaaatcttgcagatgacggcgatgggtcgtaccggctcgtcgaaggtgacgtccgggatgcggaactcgtcgaagagctcgtggctgacgtcgactacgtctatcaccaagcgggccaagccggtgttcggccgagcgtcgaggatccacggaagtataacgaggtcaacgtcgacgggacgctgaacgtcctcgacgctgcgcggaagacggagatcgagcgcgtcgtgttcgcgtcgtcgtcgtcagtgtacggtaagcccgagtatctgccgtacgacgaagtgcatccgacgacgccggtcagcccgtacggggcgtcgaagctcgccgcggagcgatacgtctgtgcgtacagcgaggtctacgatctgccgacagtcgccctccgctactttaccgtgtatgggccacggatgcggccaaacatggcgatttcgaacttcgtctcgcggtgtctgaacggcgaaccgccggtcgtatacggggacggcacgcagacgcgtgacttcacgtacatcgaggacgtcgtcgacgcgaacgaggcactgctcacggacgacgcagccgacggcgaagtattgaacatcgggagcacggacaatattgatattctaacgctcgcagaggaaattcgggaccaggtcgccccagagctggacatcgagttcgccgagcgattcgaggcagacgccgagcatacgcacgcggacatctcgaaggctaacgaactgctcggctacgagcccagccggacgattcgagagggagtccaggaattcgtcgagtggtaccgcgcgaaccgggactggtacgagccgctagtgctggagagctaa

SEQ ID NO: 64993 - protein, 328 aa, Halobacterium salinarum NRC-1
MRILVTGGAGFIGGHLAERFVSRGHDVVVLDNFDPFYDTRIKDHTVEVCQNLADDGDGSYRLVEGDVRDAELVEELVADVDYVYHQAGQAGVRPSVEDPRKYNEVNVDGTLNVLDAARKTEIERVVFASSSSVYGKPEYLPYDEVHPTTPVSPYGASKLAAERYVCAYSEVYDLPTVALRYFTVYGPRMRPNMAISNFVSRCLNGEPPVVYGDGTQTRDFTYIEDVVDANEALLTDDAADGEVLNIGSTDNIDILTLAEEIRDQVAPELDIEFAERFEADAEHTHADISKANELLGYEPSRTIREGVQEFVEWYRANRDWYEPLVLES

SEQ ID NO: 64994 - DNA, 930 bp, Halobacterium salinarum NRC-1
  CDS (1)..(930): transl_table=11
atgccgactgcactcgtgaccggtgtcgcgggattcattgggtcacatctcgcggccgcgcttctggaccgcggctacgacgttcggggcgtcgacaactttgccacggggcacgaccagaacctcgaaccactccgtggtaccggagatttctcgttctacgaggcggacattcgcgacgctgatctcgtcgctgatgtcacaaatggtgtcgactacgtcttccaccaggccgcagattcctccgtcccgcgcagcgtcgaggaccccgtcactacgactgacgtcaactgcacggggacagccactgtcatcgacgccgcccgcgaggctgacgttgataccgttgtcgtcgcctcctccgctgcaatttacggctccactgaaacattcccgaaggtcgagtcgatgaccgagcaacccgaatcgccgtatgcgctctcgaagcactacacggagaagctagcacttcaggccagcgagctctacgacatcgacacggccgcgctccgctacttcaacatctatgggccacgccaggatccgaatggtgactacgctgcggtcatcccgaagttcatctcgctgatgctggacggcgagcgcccggtcatctatggggacggcgagcagtcccgtgatttcacgttcatcgacaacgccatccaggcgaacatccgcgccgccgaaggtgatgtcaccggcgaggcgttcaacgtcggctgtggtggccgcgtcaccgtcaacgagctcgtcgacgtgctcaacgacctcctcgacacggacatcgaccccatctatgacgacccacggccgggcgacgtgcggcactctcacgctgacatctcgaaggcccgcgagcttctgagctacgagcccgaggtggggttctctgagggactcgagcagacgattccgtactatcggtag

SEQ ID NO: 64995 - protein, 309 aa, Halobacterium salinarum NRC-1
MPTALVTGVAGFIGSHLAAALLDRGYDVRGVDNFATGHDQNLEPLRGTGDFSFYEADIRDADLVADVTNGVDYVFHQAADSSVPRSVEDPVTTTDVNCTGTATVIDAAREADVDTVVVASSAAIYGSTETFPKVESMTEQPESPYALSKHYTEKLALQASELYDIDTAALRYFNIYGPRQDPNGDYAAVIPKFISLMLDGERPVIYGDGEQSRDFTFIDNAIQANIRAAEGDVTGEAFNVGCGGRVTVNELVDVLNDLLDTDIDPIYDDPRPGDVRHSHADISKARELLSYEPEVGFSEGLEQTIPYYR

SEQ ID NO: 64996 - DNA, 945 bp, Halobacterium salinarum NRC-1
  CDS (1)..(945): transl_table=11
atggaactcactgggaagcggatcgtcgtgacgggcggtgcaggactcgtgggcagccacgcagcgggcgcgctggccggcgacaacgacgtgctcgtggccgacgacctctcgaagggcagccgtgaggcggttccggacggcgtcgagttccgacgccgggacatgtgtgaccccgacgacgtggcggacgtcatcacgccggacgtggacatcgtgttccacttcgcggcgtacacggacacgaactacgagcagccccgacagctgttcgaggagaacggggcgatgacgtacaacgtgctcgaacggatggcggcggtcggcgtcgaccggttcgcgttcacgtcgtcgtcgacggtgtacggcgaagcgccgatgcccacgcccgaggattacgcgcccctggagccgatctcggtctatggcgcgtcgaagctggccgacgagggactgatctcgacgtacgcccacgctcacgggatcacgtcgtgggtgtatcggttcgcgaacatcgtggggccgcgccagcgcggcaccgtcgtcccggatttcattcagaagctgcgggcggacccggagacgctgacgatcctgggggacggccgtcaggagaagtcatacctgcacgtcgaggactgcgtggacgccatgacacacgtgatcgagcacgccccgtcgcggccgctgaacgtgttcaacctggggacgcggaccaccacgtcggtcaccgcgatcgcggacctcgtcagcgacgagctcggcgtcgatccggcctacgagtacacgggcggcgaccgcggctggaccggcgacgtgccgcggatgcggctgtcaatcgagaagctggccgcgctggggtgggagccgacacgagcgagcgacgaggcagtgcggacggcggccgcggagctggcggcggaactcagtggggacgaagcgtag

SEQ ID NO: 64997 - protein, 314 aa, Halobacterium salinarum NRC-1
MELTGKRIVVTGGAGLVGSHAAGALAGDNDVLVADDLSKGSREAVPDGVEFRRRDMCDPDDVADVITPDVDIVFHFAAYTDTNYEQPRQLFEENGAMTYNVLERMAAVGVDRFAFTSSSTVYGEAPMPTPEDYAPLEPISVYGASKLADEGLISTYAHAHGITSWVYRFANIVGPRQRGTVVPDFIQKLRADPETLTILGDGRQEKSYLHVEDCVDAMTHVIEHAPSRPLNVFNLGTRTTTSVTAIADLVSDELGVDPAYEYTGGDRGWTGDVPRMRLSIEKLAALGWEPTRASDEAVRTAAAELAAELSGDEA

SEQ ID NO: 64998 - DNA, 972 bp, Campylobacter jejuni subsp. jejuni NCTC 11168
  CDS (1)..(972): transl_table=11
gtgagaaatattttagttacaggtgctgatggttttataggttctcatctttgtgaaagtttggtcaaaaaaggttttaaagtcagagctttaagtcagtataattcttttaatttttggggacatttagaaaaaagtccttttttaaaagacatggaagttataagtggagatttaagagacagttttttttgcgaaaaaatcaccaaaaatatagatgcgatctttcatcttggcgctttaatcgctatcccctactcctacacagccccacaaagctatgtggataccaatgtcaatggcactttaaatatgctcgaagcagctaaaaaaaacgagatttcacattttatccacacctcaacaagcgaagtttatggcacagccttttatgtacctatcgatgaaaaacaccctttacaacctcaaagcccttattctgcaagcaaaatcgctgcagatatgatggcgctgagttattataattcttttaatttaaatgtcaatattgcacgcccttttaacacctatggaccaagacaaagcgcaagggctatcatacctaccatcatcacacaaattttaagtggagcaaaggaaatcaaactaggagatttaagccctaaaagggatttaaattttgtgctagatacttgcgagggttttatctctcttttaaatttaaaacattttggagaagtttataatataggctcaggagtggaatactccatgcaagaagtacttgatctcatacaaaaaattttagattctaaagtaaaaatcatccaagatgaacaaagattgcgtcctaaaaatagcgaagtttttagactttgttgcgatgcaaacaagcttaaaaaagctacaaattggcaaagcaaaataagtctagaagaaggcttgagacaaagcatagagtattttaaagaaaatttagaaaattataaaagcgagctttataatgtttaa

SEQ ID NO: 64999 - protein, 323 aa, Campylobacter jejuni subsp. jejuni NCTC 11168
MRNILVTGADGFIGSHLCESLVKKGFKVRALSQYNSFNFWGHLEKSPFLKDMEVISGDLRDSFFCEKITKNIDAIFHLGALIAIPYSYTAPQSYVDTNVNGTLNMLEAAKKNEISHFIHTSTSEVYGTAFYVPIDEKHPLQPQSPYSASKIAADMMALSYYNSFNLNVNIARPFNTYGPRQSARAIIPTIITQILSGAKEIKLGDLSPKRDLNFVLDTCEGFISLLNLKHFGEVYNIGSGVEYSMQEVLDLIQKILDSKVKIIQDEQRLRPKNSEVFRLCCDANKLKKATNWQSKISLEEGLRQSIEYFKENLENYKSELYNV

SEQ ID NO: 65000 - DNA, 1185 bp, Deinococcus radiodurans R1
  CDS (1)..(1185): transl_table=11
atgaagcttctggtcgttggcggtgcgggatatatcggttcacatacggtgcggcaactgcgcgcggcggggcatgaggtcgcggtgttcgacaacctctccagcggccatgccgaggcgctgccgggcgaggtcgaactcattcgcggcgacctgcttgacgccgccagcatccgcgcagcgctggaggcgcaaaagcccgacgccatcatccactttgccgcgctgatcgaggtgggcgagagcatgcgcgcgccgggacgctactaccgcaacaacgtggtgggcaccctcaacctgcttcagagcatcgtggagacgcgcaaggtgccgctggtcttttcgtccaccgccgccgtgtacggcacgaccgacgcggtgccgattcccgaagacgccgccatgcagccagagagcgtgtacggcgagacgaaacggatgtccgagcagatgattcacgccttccacgtcgcgcacggcctgccctacaccgtgctgcgctacttcaacgtgtgcggcgcggcgcccggcggcgacatcggcgaggcgcaccccaacaagacgcacctcatcgaactcgcctgcctgaccgcgctcgggcagcgcgagaagatgatgattttcggcgacgactaccccacccccgacggcacctgcatccgcgactacgtgcacgtgcaggacctcgccgacgcacacgtgctggcggtggaggcgctgcacgccggaaaaaccgacgccgccacctacaacgtgggcctgggccacggcttttccgtgcgcgaggtgctcgacgcggtggacgcggtggtcggcactcccttgcagcgcgaacttgccccgcgccgcgcgggcgacccgccccggctggtggccgacgcctcgcgcatcgtggaccaactggggtttgcgcccaagttcaccgacctgcgcgacattgtgcagacggcgtgggactggcaccggacgcacccgcagggtttggggagcaataataaagacccctcacccctgcctttggcaggccctctgcttcgcagctttacaagtctccccttggtagagggtcaaacagcgcaacacaagcagaggacggagatttccccgccctttcttcttccactgctctactcctcttcctccaccaccgcgcttccccgcgtcgcgtcgcgcagggccgcctga

SEQ ID NO: 65001 - protein, 394 aa, Deinococcus radiodurans R1
MKLLVVGGAGYIGSHTVRQLRAAGHEVAVFDNLSSGHAEALPGEVELIRGDLLDAASIRAALEAQKPDAIIHFAALIEVGESMRAPGRYYRNNVVGTLNLLQSIVETRKVPLVFSSTAAVYGTTDAVPIPEDAAMQPESVYGETKRMSEQMIHAFHVAHGLPYTVLRYFNVCGAAPGGDIGEAHPNKTHLIELACLTALGQREKMMIFGDDYPTPDGTCIRDYVHVQDLADAHVLAVEALHAGKTDAATYNVGLGHGFSVREVLDAVDAVVGTPLQRELAPRRAGDPPRLVADASRIVDQLGFAPKFTDLRDIVQTAWDWHRTHPQGLGSNNKDPSPLPLAGPLLRSFTSLPLVEGQTAQHKQRTEISPPFLLPLLYSSSSTTALPRVASRRAA

SEQ ID NO: 65002 - DNA, 933 bp, Sulfolobus solfataricus P2
  CDS (1)..(933): transl_table=11
ttgttgatgaaaatacttataagtggaggagcgggattcttaggttctcatctaacagaggcattgttagaaaaaggagaggaaataacaatagttgatgatctatcaaccgcaaaatactttaatatacgaaaagatgtagaatttattaagaaaaaagttgaggaatttgagacagaaaaaaagtacgacgtcgtcatccatttggcagctagaccttcaccggaggactacatagaacatccagtagatacagctctttctaattcactaggtacttacaaaatgctcgaaatagccagaaaaagtaatgcaagatttatatacacatcttcatctgaagtatatggttctgcctcaataattccgacccctgaaacgtattggggttacgtaaatcctataggaataaggagctgttatgacgaaagcaagagattctcagaagctttgataatggcttaccacagacaatataagttagatacaagaatccagaggccttttaatgtatatggccctggtctaagagaagatggaacttatggtagagtggtttcaagatttatttatcaagcactaaaaggagaggacgtaacagtgttcggagatgggaatcaaactagagcttttctatatatatctgactgggttgatgctacaataaaattaatatacaaagatggactagaaggtgaagtatttaatataggttcagacaaagaaataaagattattgagttggctaatatgataattaagcttaccggtagcaaatctagaattaaatatcttccccctagaccagatgacccacctaggagagcagctgacataactaaggctaaggaaaaattgggctggtatcctaaaatttccttagaagagggattaaaacttaccataaattggtttaagggtgtattaaaatga

SEQ ID NO: 65003 - protein, 310 aa, Sulfolobus solfataricus P2
MLMKILISGGAGFLGSHLTEALLEKGEEITIVDDLSTAKYFNIRKDVEFIKKKVEEFETEKKYDVVIHLAARPSPEDYIEHPVDTALSNSLGTYKMLEIARKSNARFIYTSSSEVYGSASIIPTPETYWGYVNPIGIRSCYDESKRFSEALIMAYHRQYKLDTRIQRPFNVYGPGLREDGTYGRVVSRFIYQALKGEDVTVFGDGNQTRAFLYISDWVDATIKLIYKDGLEGEVFNIGSDKEIKIIELANMIIKLTGSKSRIKYLPPRPDDPPRRAADITKAKEKLGWYPKISLEEGLKLTINWFKGVLK

SEQ ID NO: 65004 - DNA, 984 bp, Clostridium acetobutylicum ATCC 824
  CDS (1)..(984): transl_table=11
atgaacgtattagtttgcggaggagcaggttatataggaagccatatggcagcttatcttcttgaaaatggtcataatgtagttattgtagataatcttaccactggtcataaggaatctatattaaacaataagctttatgtaggagacttaagagatgaggattttttaaacaaggtctttgatgaaaataaaatagatgctgttatagattttgctgctaactctctagttggggaaagtgtagcaaatccattaaagtattttgataacaatattcaatcagttgttaaacttttagaagctatgaaaaatcatgatgtaaagtacatagtattttcatctactgctgcaacctatggagaacctgataatatccctatattagaaggcgataaaacttttccaacaaatccttatggagaatcaaagcttgcagtagaaaaaatattaaaatggtgtgacaatgcatatggaataaagtatactgcattaagatattttaacgcctgtggtgctcatataagcggaaatataggtgaagatcacaatcctgaaactcatttaataccattaattcttcaagtggctttgggaaaaagggataaaataatgatatacggtgatgactacgatactgaagatggaacttgcgtaagagattatgttcatgtttcagatttagcttctgcacaccttttagcacttgaaagattaaaaaacggcggcaaaagtgcaatatataatttaggaaatggaaaaggcttttcagtaaaacaagtagttgaagcaactagaaaggtaaccggaataaatataaaagcagagataggtgaaagacgtgcaggtgatcctggaactttaatagcatcttcagatagggctatcttagaacttggttggaagccaaaatttaattctcttgaaactataatagaaacagcttggaaatggcacaaaaatcatccaaatggctataaataa

SEQ ID NO: 65005 - protein, 327 aa, Clostridium acetobutylicum ATCC 824
MNVLVCGGAGYIGSHMAAYLLENGHNVVIVDNLTTGHKESILNNKLYVGDLRDEDFLNKVFDENKIDAVIDFAANSLVGESVANPLKYFDNNIQSVVKLLEAMKNHDVKYIVFSSTAATYGEPDNIPILEGDKTFPTNPYGESKLAVEKILKWCDNAYGIKYTALRYFNACGAHISGNIGEDHNPETHLIPLILQVALGKRDKIMIYGDDYDTEDGTCVRDYVHVSDLASAHLLALERLKNGGKSAIYNLGNGKGFSVKQVVEATRKVTGINIKAEIGERRAGDPGTLIASSDRAILELGWKPKFNSLETIIETAWKWHKNHPNGYK

SEQ ID NO: 65006 - DNA, 999 bp, Clostridium acetobutylicum ATCC 824
  CDS (1)..(999): transl_table=11
gtgaatatacttgtaactggaggcgcaggatttattggaagatgggttgttaagaagcttttagatgatgggaatacggttacagcattagataatctatctaatggaagtattgaaaacattgaggaatttaaaggtgaaaattttaaatttatcgaaggagatataaaaaataaagatgatttagatagaattttcgaggataagtatgatataatttatcatcttgcagcatctattgtagtgcaagagagtattgatgatccagagaaaactttttttaacgatacagtgggtacctttaacatccttgagagagctaaaaaacaaatgtttggacagcatgggaaaatgaatggaagtatatggaatatagatgaaaacgatgaagtttacccatgcaaggttgtatttatgagtacttgcatggtttatgacatttcaggagaaactggaattgatgaacagcacagcgtaaaacccgtatcaccttatggaggaagtaagatagcagctgaaaacatggtgctttcttattttaatgcgtataagcttccggctgtggttataagaccgtttaatacatatggaccatttcaaaaatcgaatggtgaaggaggagttgtatctatattcctgaagaatttcattgacaataagcctataaatatttatggatctggaaagcaaacaagagatcttttgtttgtaaaagactgtgctgattttgtagttaatgcaggatataaaagtgaagttgatggagaaataataaatgcaggcacaggaaatgatataactataaatgagcttgctaaccttatagctggtaaaaaagtttctgttaaccatgtagagcatattcatcctcaaagtgaaattatgaagttgaaatgtaactattctaaagcaaagaatttaatgggatgggaacctcattatacattggaagaaggaatagctgaaaccaagtcttggcttgcttcgacaattaaatag

SEQ ID NO: 65007 - protein, 332 aa, Clostridium acetobutylicum ATCC 824
MNILVTGGAGFIGRWVVKKLLDDGNTVTALDNLSNGSIENIEEFKGENFKFIEGDIKNKDDLDRIFEDKYDIIYHLAASIVVQESIDDPEKTFFNDTVGTFNILERAKKQMFGQHGKMNGSIWNIDENDEVYPCKVVFMSTCMVYDISGETGIDEQHSVKPVSPYGGSKIAAENMVLSYFNAYKLPAVVIRPFNTYGPFQKSNGEGGVVSIFLKNFIDNKPINIYGSGKQTRDLLFVKDCADFVVNAGYKSEVDGEIINAGTGNDITINELANLIAGKKVSVNHVEHIHPQSEIMKLKCNYSKAKNLMGWEPHYTLEEGIAETKSWLASTIK

SEQ ID NO: 65008 - DNA, 906 bp, Clostridium acetobutylicum ATCC 824
  CDS (1)..(906): transl_table=11
atgaatatattagtaacaggtggtgctggatttataggatcacatgtggttaaatcgctactagaacatggtcataaagtttcagttatagataatatggtacatggaaattcgagcaatttgccagatgaagtcaatatatacaaatatgatatatcagaagctgaaatagaaaatgcatttaaaatagaaagacctgaagttgttatacataatgcagcccaaataagtgttgcagattctgtaaaagatccattgtatgatgctaaggtaaatgttttaggtagcataaatatacttgagatgtgcagaaagtatgcagtaagaaaagtaatctatccagcatctgctgctatcttcggagaacctaagtatcttccaatagatgaaaaacatccacttaatatgatatcttcctatggtgtttcaaagcatacggtagaacactatctaaatgtatataaaaagctttacaatattaattatacagtgttaaggtattcaaatgtttatggaccgggacaagatagtagtggagaaggtggagtagtttcaatttttgcggagaaacttacaaagggtgaacctctttgcatatatggaaacggaaatcaaataagagattttgtatatgtaaaagatgtaacagaagctaatattctcgctttaaattcattagataatgacatatataatgtttctacaaatactaaaacaaccataaatgatttagctaagctaatgtgtgaagcttatggaaaagaagtggaaataatgcataagggtgagagagcaggagatatctttgaaagttatatgtcttatgataaaatatataatgcatgcggatggaagcctaaatacgatttaaagctaggtataaaggaaacaattcaaagcttttaa

SEQ ID NO: 65009 - protein, 301 aa, Clostridium acetobutylicum ATCC 824
MNILVTGGAGFIGSHVVKSLLEHGHKVSVIDNMVHGNSSNLPDEVNIYKYDISEAEIENAFKIERPEVVIHNAAQISVADSVKDPLYDAKVNVLGSINILEMCRKYAVRKVIYPASAAIFGEPKYLPIDEKHPLNMISSYGVSKHTVEHYLNVYKKLYNINYTVLRYSNVYGPGQDSSGEGGVVSIFAEKLTKGEPLCIYGNGNQIRDFVYVKDVTEANILALNSLDNDIYNVSTNTKTTINDLAKLMCEAYGKEVEIMHKGERAGDIFESYMSYDKIYNACGWKPKYDLKLGIKETIQSF

SEQ ID NO: 65010 - DNA, 990 bp, Clostridium acetobutylicum ATCC 824
  CDS (1)..(990): transl_table=11
atgtcaattttagtttgtggtggtgcaggttatatcggatctcatactgtacatgaattaatcgaaagtggtaaagaagttgttatcgttgataatctccaaagtggacatttacaggctgtaaataaaaaggccaaattctataaaggagatattagggacagtgaatttttagataaagttttttcagaaaacaaaattcagtcaataattcactttgcagctaattctctagttggagaaagtatggaaaagcctcttctctacttcaacaacaatgtatatggtatgcaaattttacttgaaagcatggttaaacataatattaaaaatatagtattctcctctaccgctgctgtctatggagaacccaaaaaaattcctatattagaatcagatgatacaaatccaacaaacacttatggtgaaacaaaactaactatggaaaaaatgatgaaatggtcaagcaaagcttacggtattaactatgtagcactcagatatttcaatgttgctggtgctctagatgatggtagtataggtgaagatcacaatccagaaacacatttaataccacttatacttcaagttcctcttaaaaaacgtccatttataactgtgtttggaacagattatccaacaccagacggtacatgtatcagagattatatacacgttatagatttagctgctgctcatattaaagctgtagaatatttggaaaacggcggaaaaagcagtatatttaacttaggtaacggagtaggctttagcgtaaaagaaatgattgatgctgccagggaggttactaaacaaaatatcaaagtggttcttggagaaagacgttctggcgatccagcacaattagttgcttcaagtcaaaaagcaaaagaagttttaggctggtcacctaaattcacaaatgttaaagatataataaaagatgcctggaaatggcacgaaactcatccaaatggttttgatgcttag

SEQ ID NO: 65011 - protein, 329 aa, Clostridium acetobutylicum ATCC 824
MSILVCGGAGYIGSHTVHELIESGKEVVIVDNLQSGHLQAVNKKAKFYKGDIRDSEFLDKVFSENKIQSIIHFAANSLVGESMEKPLLYFNNNVYGMQILLESMVKHNIKNIVFSSTAAVYGEPKKIPILESDDTNPTNTYGETKLTMEKMMKWSSKAYGINYVALRYFNVAGALDDGSIGEDHNPETHLIPLILQVPLKKRPFITVFGTDYPTPDGTCIRDYIHVIDLAAAHIKAVEYLENGGKSSIFNLGNGVGFSVKEMIDAAREVTKQNIKVVLGERRSGDPAQLVASSQKAKEVLGWSPKFTNVKDIIKDAWKWHETHPNGFDA

SEQ ID NO: 65012 - DNA, 1071 bp, Agrobacterium tumefaciens str. C58
  CDS (1)..(1071): transl_table=11
gtgtaccgctcgaaattggcctggaaaaaaccatcgtctatttcgatgcactgctcgccggcaggaaagtggcggaggccgtatgagatggcccgcacaatcctcgtcacgggcggggccggatttataggcagccacatctgcaaggcgctggcacaatccggcttcaagcccattgcttacgataatctctcgaccggtcacgcggattccgttcgctgggggcccttgatcgaaggtgacattctcgatggcgtcctgctgaaagccacacttcgggaattctctccggccttcgtcatccattgtgcggccaacgcctatgtcggcgaatccgtcgaggatccgcgcaaatattatcgcaacaatgtcggcggcagcctgtcgctgctggatgcctgtctcgaccagaatattggcgggctggtgttttcttccagctgcgccacctatggcgtgccgcagcaattgccgatccgtgaggaaacggcacagatgccggtcaatccttacgggcgcaccaagctgatcttcgaaatggcgctggaggattatgccgccgcctatggtctgcgtttcgtggcactgcgttatttcaatgcggccggtgccgacccggacggcgagctttacgaacgccatgaaccggagacccatctgatcccccgggcgctgatggccgccgctgcaaggctgccgcaactcgatgtcttcggcgcggattatgacaccagcgacggcacctgcattcgcgactatatccatgtcagtgatctcgccgatgcccatctggccgccgtcaactacctttcggatggcggcgagacgctgcgtgtcaatctcggctcgggtcacggtacgtcagtcggcgatatcatccgggcgatccaccgggtgaccggacaggaagtgccagtgcatttcggcgcaagacgtgccggcgatccgcccgcgctctttgctgacatcaggcgcgcggaagagacgctgggcttcaccccgaagcgttcggatatcgacaccatcatccgcacggccggtcccggcttcggactggaggcgcggtcatga

SEQ ID NO: 65013 - protein, 356 aa, Agrobacterium tumefaciens str. C58
MYRSKLAWKKPSSISMHCSPAGKWRRPYEMARTILVTGGAGFIGSHICKALAQSGFKPIAYDNLSTGHADSVRWGPLIEGDILDGVLLKATLREFSPAFVIHCAANAYVGESVEDPRKYYRNNVGGSLSLLDACLDQNIGGLVFSSSCATYGVPQQLPIREETAQMPVNPYGRTKLIFEMALEDYAAAYGLRFVALRYFNAAGADPDGELYERHEPETHLIPRALMAAAARLPQLDVFGADYDTSDGTCIRDYIHVSDLADAHLAAVNYLSDGGETLRVNLGSGHGTSVGDIIRAIHRVTGQEVPVHFGARRAGDPPALFADIRRAEETLGFTPKRSDIDTIIRTAGPGFGLEARS

SEQ ID NO: 65014 - DNA, 951 bp, Bacillus subtilis subsp. subtilis str. 168
  CDS (1)..(951): transl_table=11
atgaaaatactcgtcacaggagcagcgggctttatcggctcccacctctgcgaagaattactaaaagataagaaacataacgttatcggaatcgatgactttatcggtcctactccattttccttgaaattaaaaaaccttaaaaacctgctgccggaaaagcgatttacgttcataaaggaaaatctgctgacagccgatcttgcttccttactggaaggagtggacgtcatctttcatttggcggccataccgggtgtccgctcaagctggggcaatcattttcacccatatgccgcacataatatccaagcgctccaaaggctcctcgaggcgtgccgggaacattctattcaaacgttcgtctttgcatccacctcttccgtctatggcgaaaaacaaggaaaagtcagcgaaaacacgtcgctttctcctttatctccgtacggggtaacaaagcttacgggagaaaagctttgccatgtgtataaacagagctttggcattccaattgtgattctccgtttttttaccgtatacgggccaagacagcggccggatatggcttttcaccggctcattaagcagcaccttcagcaaaagccgcttaccatcttcggtgatgggcagcagtcaagagatttcacttatatcagcgactgtgtcaaaggcatcaccgctgttcttgggaaaccccaccttattggtgaaacagtaaatatcggcggcgcagagcgtgcctcagtcttaaaagttgtctccctcattgaggatatttccgggagaaaagcaacactgcacttttcggacaaaatagcaggggaaccgagcaacacgtgggcggatatttcaaaagcaaaacagctcttgcattatgatcccgccacatccttaaaggatggcttgaccaacgaaatcgcctatttatcgtcgctgtatcagggggaataa

SEQ ID NO: 65015 - protein, 316 aa, Bacillus subtilis subsp. subtilis str. 168
MKILVTGAAGFIGSHLCEELLKDKKHNVIGIDDFIGPTPFSLKLKNLKNLLPEKRFTFIKENLLTADLASLLEGVDVIFHLAAIPGVRSSWGNHFHPYAAHNIQALQRLLEACREHSIQTFVFASTSSVYGEKQGKVSENTSLSPLSPYGVTKLTGEKLCHVYKQSFGIPIVILRFFTVYGPRQRPDMAFHRLIKQHLQQKPLTIFGDGQQSRDFTYISDCVKGITAVLGKPHLIGETVNIGGAERASVLKVVSLIEDISGRKATLHFSDKIAGEPSNTWADISKAKQLLHYDPATSLKDGLTNEIAYLSSLYQGE

SEQ ID NO: 65016 - DNA, 924 bp, Thermoplasma acidophilum DSM 1728
  CDS (1)..(924): transl_table=11
atggatataagggggaaggagattctggtcaccggcggtgccggtttcataggttcaaaccttgtcataaggcttgctaaggagaaccatgtttatgttctagatgaccttcagactggttcgctacgcaatctctcgtccgtttacgatggtatagattttgtaaaggatcgtgttgcaaacgtgaacgattactgcttcgatccagattatatattccatatcgggctttattcatcttcacccatgtacaaggacaatcctcatcttgtgggcgaactcataaaggacatggtttctgttctagaacttgcgaaaaggaagaagagtactgtggtttatgcttccacatcctccatatacaatggcgtgaaacccccgcacagggaagatgtgataccattcgtcacggacttctatacagaggctaggtatgcgactgagaggatcagcgaactttattcaaagctttacggaatcaacatatctgcgatgagattcttctccgtatacggatacaatgaaagatccaagaagaagttcgcaaacctcgtttcgcagttcatatgggatatgcacgatggcaaacagccagtgatatacggcgatggcgaacagaaaagagacttcgtgtttgtggacgacgtggttgacgctctgatcaacgcagctgtttacaacactggcttcaacgtgtacaatgtaggaaccggaaagaactactcgctcaatgaacttgtgcaaaaactgaacgatcacatgcacactgatatcaaggccaaatatgtggagaacccaatggccaaaacatatgtccacgaaacccttgcggataccaagaaatctgaagaaaagataaaattcaaggccaagatcagcctcgacgaaggcatagataagctcatgaaatattacggatactga

SEQ ID NO: 65017 - protein, 307 aa, Thermoplasma acidophilum DSM 1728
MDIRGKEILVTGGAGFIGSNLVIRLAKENHVYVLDDLQTGSLRNLSSVYDGIDFVKDRVANVNDYCFDPDYIFHIGLYSSSPMYKDNPHLVGELIKDMVSVLELAKRKKSTVVYASTSSIYNGVKPPHREDVIPFVTDFYTEARYATERISELYSKLYGINISAMRFFSVYGYNERSKKKFANLVSQFIWDMHDGKQPVIYGDGEQKRDFVFVDDVVDALINAAVYNTGFNVYNVGTGKNYSLNELVQKLNDHMHTDIKAKYVENPMAKTYVHETLADTKKSEEKIKFKAKISLDEGIDKLMKYYGY

SEQ ID NO: 65018 - DNA, 984 bp, Caulobacter crescentus CB15
  CDS (1)..(984): transl_table=11
atgcaaacagttctggtgactggcggcgccggctatgtcggctcgcattgctgcctggccttggccgaggcgggttttcgcccggtcgtgttcgatgatctgtcgaacggccatcgcgagcatgtccagtggggccctctggaagtgggcgacatccgagacgccgcgcgcctggacgcggtgttcgccgcctatgcgccggtggcggtgctgcacttcgcggcgcgcatcgaggtgggcgagtccgtcaagaaccccggcgccttcttcgacaccaatgtcggcgggacgatcacgctgatcgaggcggcgcggcgagccggcgtgaaggtggtggtgttctcctccacctgcgcgaccttcggcgatccggtcgacctgccgatgaaagagacccacccgcaggcgcctctcaacccctatggccgcagcaagctgatggtcgagcaggccctggccgactacgatcgctatgtcgggctcaagagcgcggtaatgcgctatttcaacgccgccggcgccgacccgcagggccgtatcggcgagtggcacgagcccgagacccacgctgtaccgctggcgatccaggtggcgctcggccagcgaccgcgcttcacgatcttcggcgacgactatgacacgcgcgacggtacggccgtacgcgactacgtccatgtcctcgacctggcggatgctcacgtcgcggccctcaagcgcctgctcgtgggggggtcatcagagacctacaatctcgggacaggaaccgggacgacggtccgcgaattggtcgacggcgtgggtaaggtggccggcgcgccccttccggttgagatcgcatcgcgacgccccggcgatgcgccggtgctggtcggtgatcacgccaaggcgcgagccgaactcggatggaaggcttcccgaagtctggacgagatcctctcgaccgcctggcggtggcatcgcgggcgccttgaacaggaaccctga

SEQ ID NO: 65019 - protein, 327 aa, Caulobacter crescentus CB15
MQTVLVTGGAGYVGSHCCLALAEAGFRPVVFDDLSNGHREHVQWGPLEVGDIRDAARLDAVFAAYAPVAVLHFAARIEVGESVKNPGAFFDTNVGGTITLIEAARRAGVKVVVFSSTCATFGDPVDLPMKETHPQAPLNPYGRSKLMVEQALADYDRYVGLKSAVMRYFNAAGADPQGRIGEWHEPETHAVPLAIQVALGQRPRFTIFGDDYDTRDGTAVRDYVHVLDLADAHVAALKRLLVGGSSETYNLGTGTGTTVRELVDGVGKVAGAPLPVEIASRRPGDAPVLVGDHAKARAELGWKASRSLDEILSTAWRWHRGRLEQEP

SEQ ID NO: 65020 - DNA, 1002 bp, Caulobacter crescentus CB15
  CDS (1)..(1002): transl_table=11
atgagccgccgcatcgtcctggtcaccggcggcgccggcttcatcggttcgaacatcgtcgcgcgcctctgcgaggatccggcgctggatgtcgttgtctgcgaccgcctgcgcgatgcggccagcggcaagtggcgcaacatcgccaagcatgcgatcgccgacttcgtcgcgcccgagcagctgttcgactggctcgctaagcgcggcggtgaggtcgaactggtggtccacatgggcgcggtctcgtcgaccaccgaggtcgacgcggacaagatcgtgcagtccaacttcgtcctgtcacgcgacctgtgggactggtgcgcccagcatggcaagcgcctgatctacgcctcgtccgccgccacctatggcgacggcgcgctgggctttgacggcaaggacgatctggcgtcgctgcaggccctgcggccgctgaacgcctatggttggtccaaggctttgttcgacatctacgccgtgcgcgaggcccagcgcgggcgtgcgccggcccaatgggcggggctgaagttcttcaacgtctacgggcccaatgaggaccacaagggcggcatgaagtcggtcgcggcccagatctggccgcgcatcgcggcgggcgagggcgtcaagctcttcaagtcgcatcacccggattacgaggacggcggccagcttcgcgacttcgtttatgtccgcgacgtggtcgacgtcgtcggctggctggccaagagccccgccgtgaacggcgtcttcaacctcggctcgggccaggcgcgttcgttccgtgatctggcggtggccacgttcgaggccgcgggtcgtgcgcccgacatcacctatatcgacatgcccgaggtgctgcgcggcaagtatcagtactacacccaggccgacatgagccgcctgcgcgcggccggctacaacgcgccgatgaccgcgctggaagacggcgtggccgactatgtggcgggctatctgaacaccgaagatccctatcgctga

SEQ ID NO: 65021 - protein, 333 aa, Caulobacter crescentus CB15
MSRRIVLVTGGAGFIGSNIVARLCEDPALDVVVCDRLRDAASGKWRNIAKHAIADFVAPEQLFDWLAKRGGEVELVVHMGAVSSTTEVDADKIVQSNFVLSRDLWDWCAQHGKRLIYASSAATYGDGALGFDGKDDLASLQALRPLNAYGWSKALFDIYAVREAQRGRAPAQWAGLKFFNVYGPNEDHKGGMKSVAAQIWPRIAAGEGVKLFKSHHPDYEDGGQLRDFVYVRDVVDVVGWLAKSPAVNGVFNLGSGQARSFRDLAVATFEAAGRAPDITYIDMPEVLRGKYQYYTQADMSRLRAAGYNAPMTALEDGVADYVAGYLNTEDPYR

SEQ ID NO: 65022 - DNA, 975 bp, Caulobacter crescentus CB15
  CDS (1)..(975): transl_table=11
atgagcaaggcgcccatcatcgtcacgggcgcggccggcttcgtgggctaccacgtggccgagcgcctgctcgatcgcggcgagaccgtgatcggcgtcgatgtcttcaacgcctactacgacccggccctcaaggaggcccgcgcggcgcgcctggacggccgcgacggctttacgatgctccgtatggacatcgccgaccatgaggccttggccgacctggtgaaggcctccggcgcccagaaggtgatccacctggccgcccaggccggcgttcgctactcgatcgaaaacccgttcgcctatgagcgcagcaacctggccggccatctgtcggtgctggaggcctgccgccacgccggcgtcgagcatctggtctatgcgagctcgtcaagcgtctatggtgatcgcccgctgaacggcgacggcttcagggagagcgaccccgccgagaccccggtgtcgctgtacgccgccaccaagcgctcgtgcgagttactcagccagagctacgcaaagctctacggcttcccgcaatcaggcctgcggttcttcaccgtctatggcccgtggggtcgcccggacatggcctatttcagcttcaccgagaagatgctgaagggcgagacgatcgaggtctatggcgagggcaagatggcccgcgacttcacctatatcgacgacatcgtcgatgggatcctcggcgtcctcgacaacccgccggccaagggcgggcacgaggtctacaacatcggcgacaacgaccctgtcggcctgatggacatgatcaacacgctggaagcggcgctggggatcgaagccaacaaggtcttccgtcctatgcagccgggcgacgtcaccgccacctatgccaatatcgacaaactgcacgccctctgcggctacaagcccaaggtcaagctcgctgaagggttggcgcggtttgtggactggcggaggggcgctagagtttag

SEQ ID NO: 65023 - protein, 324 aa, Caulobacter crescentus CB15
MSKAPIIVTGAAGFVGYHVAERLLDRGETVIGVDVFNAYYDPALKEARAARLDGRDGFTMLRMDIADHEALADLVKASGAQKVIHLAAQAGVRYSIENPFAYERSNLAGHLSVLEACRHAGVEHLVYASSSSVYGDRPLNGDGFRESDPAETPVSLYAATKRSCELLSQSYAKLYGFPQSGLRFFTVYGPWGRPDMAYFSFTEKMLKGETIEVYGEGKMARDFTYIDDIVDGILGVLDNPPAKGGHEVYNIGDNDPVGLMDMINTLEAALGIEANKVFRPMQPGDVTATYANIDKLHALCGYKPKVKLAEGLARFVDWRRGARV

SEQ ID NO: 65024 - DNA, 987 bp, Sinorhizobium meliloti 1021
  CDS (1)..(987): transl_table=11
atggttgcgccacgtatcctcgtcaccggtggcgccggctatatcggcagtcacaccgcaaagctattgcgcctggagggtatcgagcccgtcgtctacgacaatctgacgaccgggaaccgttccgccgtgcgctggggaccattcgttcagggagatatcctggacgggaggcgcctgatcgaagtcatcgaggcccaccagccggatgccgtcatccacttcgccgcctccgcctatgttggcgaatccgtcgccgatcccgcgaaatactacaacaacaacgtccgcggcacgctgtcgctcctcgatgcatgtcgccagacgggtgtcgacaaggtgatcttctcatcgagctgcgccacctatggcgtaccggcggtactgcccatcgacgaagcgacgccgcaggcaccgatcaacccctatggtaagacgaaactggtggccgagcacatgctcgccgactatgcggccgcctttgcgctgaattatgtttcgctgcgctatttcaacgcatgtggcgctgatcctgagggtgacctcggcgaatggcacgacccggaaacgcacctcattccgcgggcgctcatggccgcggcaggcaggattccgcatctggagattttcggcgaggactacgataccccggacggaacctgcgtacgcgactatatccacgttgccgatcttgcgagcgctcatgtgctggcataccggcatctcgccaagggcggcgggaacgtcgcgctcaacctcggtaccgggcgcggcttctcaataaaggaagtcctgcgaacgatcggcgaaattaccgggcatgacgtcccggtcgtgtttcgccgccgtcgtgccggagatccgccggctctctatgcggatgctgggcttgcttgccggacgctcggcttcctgccgcgatattccgatctcgagacgatcgtgcgaacggcggccccgttcttcgggctggaggtccggtcatga

SEQ ID NO: 65025 - protein, 328 aa, Sinorhizobium meliloti 1021
MVAPRILVTGGAGYIGSHTAKLLRLEGIEPVVYDNLTTGNRSAVRWGPFVQGDILDGRRLIEVIEAHQPDAVIHFAASAYVGESVADPAKYYNNNVRGTLSLLDACRQTGVDKVIFSSSCATYGVPAVLPIDEATPQAPINPYGKTKLVAEHMLADYAAAFALNYVSLRYFNACGADPEGDLGEWHDPETHLIPRALMAAAGRIPHLEIFGEDYDTPDGTCVRDYIHVADLASAHVLAYRHLAKGGGNVALNLGTGRGFSIKEVLRTIGEITGHDVPVVFRRRRAGDPPALYADAGLACRTLGFLPRYSDLETIVRTAAPFFGLEVRS

SEQ ID NO: 65026 - DNA, 1023 bp, Synechocystis sp. PCC 6803
  CDS (1)..(1023): transl_table=11
atgacccagtcttccccacccaaaatcttagttacaggaggagcgggttatattggctccagtgttgtccgccagctcggtgaagcaggatacagcatagtcgtatatgacaattgttcgactggttttcccagttcaatactctatggtcaacttgtcattggcgatcttgccgacaccgaacgtcttcatcaggtatttcatgagcatgagatacttgcggtaatgcattttgctggtagcttaatagttccagaatctttaattcatcctcttaactactacgcaaacaatactagtaacactctcagtttaatacgatgttgtcagatatttggtgtaaaccgactgattttttcaagtactgctgctgtttatggtaactcctcgtctaatcccatatctgaagccgagattccctgtccaataaatccctatggtcgatcaaaattagccagtgaatggataattcaagattatgcaaagtcctctgctctacaatatgtaattctacgttactttaatgttgcaggagctgatccagaggggcgtttagggcaaatgtcgaagacaactacccatttagtacggtcggtttgtgacgcaattctgaatcttaaaccctcgctagatatttttggcacagattttccaacccgtgatggcaccgctgttcgtgactatattcacgtagaagacttagctaaggcccatctagatgctcttcgttatttagaaaacgggggagaaagtcaaattctgaattgtggttatggtcaaggctatagcgtacgagaggtggttgatcgagctaaagcaatctctggggttgattttttggtcagagaaacagaaagacgtttgggcgatccagcttcagttatagcctgtgcagactctattcgccaagtgttaaattggacaccaaagtacaataacttagatattattcttcgcaccgcattagcttgggaaattaaacgaaataatttaaataacagacgtattcataatattatttga

SEQ ID NO: 65027 - protein, 340 aa, Synechocystis sp. PCC 6803
MTQSSPPKILVTGGAGYIGSSVVRQLGEAGYSIVVYDNCSTGFPSSILYGQLVIGDLADTERLHQVFHEHEILAVMHFAGSLIVPESLIHPLNYYANNTSNTLSLIRCCQIFGVNRLIFSSTAAVYGNSSSNPISEAEIPCPINPYGRSKLASEWIIQDYAKSSALQYVILRYFNVAGADPEGRLGQMSKTTTHLVRSVCDAILNLKPSLDIFGTDFPTRDGTAVRDYIHVEDLAKAHLDALRYLENGGESQILNCGYGQGYSVREVVDRAKAISGVDFLVRETERRLGDPASVIACADSIRQVLNWTPKYNNLDIILRTALAWEIKRNNLNNRRIHNII

SEQ ID NO: 65028 - DNA, 1017 bp, Synechocystis sp. PCC 6803
  CDS (1)..(1017): transl_table=11
atggccacgcaacaaacaattttggtcaccggaggggcgggttacatcggctcccatggggtgcttgccctacaacaggcgggctttgacgtccttatctacgataacctcagctacggtcacaaggaactagtgcaacccctgggggtggaattggtagtcggccatactggcgatcgccaaaaactagaccaactttttgccactaggaatattgctgctgtcatgcattttgccgccttcatcgccgtgggagaatcggtgcaaaagccggacatttattaccaaaacaacgtagtgggtactctcaccctcctggaagccatgctagcggcgggcattaagaaatttgtcttttcctccacctgtgcggtctatggcatgccgaaggaaattcccatgacggaaagccatcccattgatcccctcagtccctatgccgccagcaaacgcatggtggaacaaattttggctgactttgaccaagcttacggcttcaaatcagttatttttcgctactttaatgcttccggcgcagacccccaaggacgcttaggagaagaccataaccccgaaacccatctaattcccctggccctgttgacagctttgaaacaacgtccccaactttccgtttttggtactgattatgacaccctcgacggcaccgccttacgggattacatccatgtctgtgacctggcgatcgcccatgtattaggcttgcaatacctgctagaaggaggggaaagcaatatctttaacctcggtaatggcaacggcttttccgtgcgtcaagtaattgaagttgccaaagcggtgacgggattagatattccctatcagctatgtccccgccgtcccggtgatgcccccatcctggtcggtagtagtgctaaagcgcgggaaatccttggctggaatccccagtaccctgacttacataccatcattgaccatgcctggcagtggcaccaaaggcgccatggagattacaaaaaaagcaataaaatttga

SEQ ID NO: 65029 - protein, 338 aa, Synechocystis sp. PCC 6803
MATQQTILVTGGAGYIGSHGVLALQQAGFDVLIYDNLSYGHKELVQPLGVELVVGHTGDRQKLDQLFATRNIAAVMHFAAFIAVGESVQKPDIYYQNNVVGTLTLLEAMLAAGIKKFVFSSTCAVYGMPKEIPMTESHPIDPLSPYAASKRMVEQILADFDQAYGFKSVIFRYFNASGADPQGRLGEDHNPETHLIPLALLTALKQRPQLSVFGTDYDTLDGTALRDYIHVCDLAIAHVLGLQYLLEGGESNIFNLGNGNGFSVRQVIEVAKAVTGLDIPYQLCPRRPGDAPILVGSSAKAREILGWNPQYPDLHTIIDHAWQWHQRRHGDYKKSNKI

SEQ ID NO: 65030 - DNA, 984 bp, Listeria monocytogenes EGD-e
  CDS (1)..(984): transl_table=11
atgggtattgctgtacttggtggcgctggctatatcggttcacatgcagtagatgagttaattactcgcggatatgaagtagtagttattgataatttaagaacagggcatagggaatccattcataaaaaggcaaaattttatgaaggagatattcgtgataaagcatttttaagttcagtttttgaaaaagaaaaagtagatggtgtgattcattttgctgctagttcacttgtaggagaatcgatggaagtaccgctggattatttaaataataatgtctatggtacgcaaatcgttttagaagtgatggaggaatttgatgtgaagcatatcgtcttttcttccagtgcggctacatacggtgaaccagaacgcgtgccaattacggaagatatgccaacaaatccggaaagtacttatggcgaaacaaagctaatcatggaaaaaatgatgaaatggtgcgataaagcatacggcatgaaatttgttgcactccgttattttaatgtcgctggtgcaaaagcagatggttcgattggggaagatcacaaaccagaatcgcatctagtgccaattattttacaagttgcgcttggtcaacgagaaaaattagcgatctacggtgatgactataatacaccagatggtacttgtattcgtgactatgtacaagtagaagatttaatagacgcacatattagagcgctagaatacttgaaaaatgggggagaaagtaatattttcaatcttggtagcagtaacggtttttctgtgaaagaaatgcttgaagcagctcgtactgtaacaggaaaagaaatccctgctgaagtagtaccacgtcgtgcaggagacccaggaacgttaattgcttctagtgataaagcgcgcgaaattcttggttgggagccaacttatacagatgtaaaagatattatcgccactgcttggaaatggcacgtatctcatccaaatggctattaa

SEQ ID NO: 65031 - protein, 327 aa, Listeria monocytogenes EGD-e
MGIAVLGGAGYIGSHAVDELITRGYEVVVIDNLRTGHRESIHKKAKFYEGDIRDKAFLSSVFEKEKVDGVIHFAASSLVGESMEVPLDYLNNNVYGTQIVLEVMEEFDVKHIVFSSSAATYGEPERVPITEDMPTNPESTYGETKLIMEKMMKWCDKAYGMKFVALRYFNVAGAKADGSIGEDHKPESHLVPIILQVALGQREKLAIYGDDYNTPDGTCIRDYVQVEDLIDAHIRALEYLKNGGESNIFNLGSSNGFSVKEMLEAARTVTGKEIPAEVVPRRAGDPGTLIASSDKAREILGWEPTYTDVKDIIATAWKWHVSHPNGY

SEQ ID NO: 65032 - DNA, 987 bp, Listeria innocua Clip11262
  CDS (1)..(987): transl_table=11
atgatgagtattgttgtacttggtggagcgggctatattggttctcatgctgtagatgagctgattaatcgaggttatgaggtagttgtggtagataatttaaggacaggtcataaggaatctattcacaaaaaagcaaaattttatgaaggtgatatccgggataaagcttttttaagtactgtttttgaaaaagaatctattgatagtgtgattcatttcgccgcgagttcgcttgttggtgaatcaatggaagttcctttagaatatttgaataataatgtttacggtacgcaagttcttttagaagttatggaacaatttggcgttaaacatattgtattttcttctagtgctgcgacatacggggaaccagagcgagttccaatcacagaagatatgccgacaagtccagaaagcacttacggtgagacaaagctaattatggaaaaaatgatgaaatggtgcgataaagcttacggaatgaagtttgtcgcgttacgttattttaatgtcgctggtgctaaagcggatggatcaattggtgaggatcataaaccagaaactcacttagtaccgattattttacaagttgctcttggtcaacgagaaaaattagcaatttatggtgatgattataatacacctgatggtacatgtattcgtgattatgtccaagtagaagatttaattgatgcgcatatccgcgcgcttgaatatttgaaaaaaggtggagaaagtaatattttcaacctcggcagcagcaatggcttttcagtgaaagaaatgcttgaagcagctcgaattgtaactggtaaagaaattccagctgaagtggtaccgcgccgggctggtgacccagggacgcttgttgcttctagcgataaagcgcgtgaaatccttggctggcaaccaacgtatacggatgtaaaagatattattgctactgcttggaactggcacgtgtcacatccaaatggctattaa

SEQ ID NO: 65033 - protein, 328 aa, Listeria innocua Clip11262
MMSIVVLGGAGYIGSHAVDELINRGYEVVVVDNLRTGHKESIHKKAKFYEGDIRDKAFLSTVFEKESIDSVIHFAASSLVGESMEVPLEYLNNNVYGTQVLLEVMEQFGVKHIVFSSSAATYGEPERVPITEDMPTSPESTYGETKLIMEKMMKWCDKAYGMKFVALRYFNVAGAKADGSIGEDHKPETHLVPIILQVALGQREKLAIYGDDYNTPDGTCIRDYVQVEDLIDAHIRALEYLKKGGESNIFNLGSSNGFSVKEMLEAARIVTGKEIPAEVVPRRAGDPGTLVASSDKAREILGWQPTYTDVKDIIATAWNWHVSHPNGY

SEQ ID NO: 65034 - DNA, 951 bp, Nostoc sp. PCC 7120
  CDS (1)..(951): transl_table=11
atggcgaaaattatagttactggagcagcaggatttattgcttctcacctggtagaaaccctactcaaacaaggtgaagaggtaatcgggattgatgaagtgaatgattactacgatcccttattaaaacgtaaaaatattgcccatttacaatcgtttcctaacttcaccttcattgagggagatattcagtttctagattggccgtccctactccaagatgtgactgtggtctaccatcaggcggcgcaggcgggagttagggcaagttggggtaatggtttccgtgcttatactgagcgcaatattaatgctacacaagttttgttggaagcagctaaggatgctcaacaattaactaggttagtctttgcatctacttctagtgtgtatggggatgcggaaaccttacctactcacgaagggattccgcctcaaccggtttctccttatggcattactaagttagctgccgagcgtttgtgtgggctatatcacaaaaatttcggtgtaccgtttgtggctctacgttactttactgtatatggccctagacagcgccctgatatggctttccataagttttttaaatctgttttacaggatgaggcgattcctgtttacggagatggacagcaaactcgtgactttacttttgtgagtgatgctgtagcggcaaatttagcggctgctagtgtaccggctgctgtaggagaaatttttaatattggtggtggtagtagggtggttttggctgaggtcttagacacgatggaacaaatcgttggtcagccaattaagagaaatcacatagaaaaggcaatgggtgatgcacgtcacacggctgctgatgtgtcgaaggcacggaaaattttaggatatgagccaaaggtttctttgagggagggtttgagcttagaatggcagtgggtgaaggctttgtacacctag

SEQ ID NO: 65035 - protein, 316 aa, Nostoc sp. PCC 7120
MAKIIVTGAAGFIASHLVETLLKQGEEVIGIDEVNDYYDPLLKRKNIAHLQSFPNFTFIEGDIQFLDWPSLLQDVTVVYHQAAQAGVRASWGNGFRAYTERNINATQVLLEAAKDAQQLTRLVFASTSSVYGDAETLPTHEGIPPQPVSPYGITKLAAERLCGLYHKNFGVPFVALRYFTVYGPRQRPDMAFHKFFKSVLQDEAIPVYGDGQQTRDFTFVSDAVAANLAAASVPAAVGEIFNIGGGSRVVLAEVLDTMEQIVGQPIKRNHIEKAMGDARHTAADVSKARKILGYEPKVSLREGLSLEWQWVKALYT

SEQ ID NO: 65036 - DNA, 1044 bp, Caenorhabditis elegans
  CDS (1)..(1044)
atgcacattctcgtcaccggagccgctggattcattggcagtcacacagtgctcgagctgctcaattctggatacacagtactttgcattgacaatttcgccaacgcaatttccgatgagcacggaaatgcgatttcattgaaaagagttgctcagttgactggaaaagatgttccattccagaatgttgatgtatgtgatgaagcagcattggaaaaagtgttctctgagaataaatttgatggaattattcatttagcagcgttgaaggctgtcggagaatcagtggccaagccacttcaatattattccaataatttggttgccagcttgaatttgattcagatgtgcctaaaatacaacgtgaaaaactttgtcttttcctcgtcagccaccgtctacggacccccatccgaactcccaatcaccgaaaaatcccaaaccggccagggaattactaatccatatggtcaaactaaatacatgatggaacaaattttaattgacgtcggaaaagcgaatcccgaatggaatgtggttcttcttcgttactttaatccagttggagcacacaaatcagggctcattggagaagatccaaagggtgtaccgaataatttaatgccatacgtcagtcaggtggctattggaaaactgccagtactcactatttatggagatcaatttgatactgttgatggaactggtgttcgggattatattcatgttgttgatcttgctaaaggacatgttaaggcttttgatagaattaagaccgtcggaaacattggaaccgagatttacaatcttggaaccggtgtcggttactcggttcgtcagatggttgatgcgttgaaaaaggtcagcggacgtgatattccggttaagatcggagtcccccgtcccggagacgttgcatcagtctactgcgacccctcacttgctcaggagaagctcggatggcgtgccgagactggtctcgaagagatgtgtgcagatctatggaattggcagacaaagaatccacaaggattctccgcataa

SEQ ID NO: 65037 - protein, 347 aa, Caenorhabditis elegans
MHILVTGAAGFIGSHTVLELLNSGYTVLCIDNFANAISDEHGNAISLKRVAQLTGKDVPFQNVDVCDEAALEKVFSENKFDGIIHLAALKAVGESVAKPLQYYSNNLVASLNLIQMCLKYNVKNFVFSSSATVYGPPSELPITEKSQTGQGITNPYGQTKYMMEQILIDVGKANPEWNVVLLRYFNPVGAHKSGLIGEDPKGVPNNLMPYVSQVAIGKLPVLTIYGDQFDTVDGTGVRDYIHVVDLAKGHVKAFDRIKTVGNIGTEIYNLGTGVGYSVRQMVDALKKVSGRDIPVKIGVPRPGDVASVYCDPSLAQEKLGWRAETGLEEMCADLWNWQTKNPQGFSA

SEQ ID NO: 65038 - DNA, 1032 bp, Agrobacterium tumefaciens str. C58
  CDS (1)..(1032): transl_table=11
atggctgttctggtcacgggtggggccggttatataggaagccacatggtgtgggctttgctcgatgccggggaagaggtcgttgtcgtcgaccggctttccacggggtcgcgctgggcagtcgcgccagcggcgcgtttttatcttggagatgcggccgaccgcgccttgctcgatcaggtttttgaagaaaaccacatcgagaccatcttccacttcgccgggtccgtcagcgttcccgagtcgatcagccagccgctggaatattacgaaaacaataccggcacgacccgcgcgcttgttgccgcggcggttcgcagcggcatccgcaatttcatcttctcctcgacagccgccgtctatggaaaccagccctttgatggtcccgttcctgaaacggcgatcctgagcccggaaaatccctacggcctgtcgaaactcgcgtccgaaatcatgctgcgcgatgtcgtgcaggcgcatgatttcaactatgtggcgctgcgttatttcaacgttgccggagccgacccgcagggccgcgccgggccttcgccgacgggcgttgcaaaccttatcaaggttgcatgcgaagccgcgaccggccgccgcgaccgggtggaggtttacgggacggattacccgaccgccgatggaaccggcgttcgcgactatattcatgtcagcgatctgattgatgcgcatatgctggccatggcgcatctgcgcgccggcggcggtacacgaaccctgaactgcggttatggtgtcggttattcggttctggacgtcctccaggccgtacagcgcgaatccgcatgtgaattcgcggtcatccattgtccccgccgtccgggtgacattgcggccatggtggcggattcgtcgcgtatccagtcggaattaggctggcgtcctcgcttcaacgatctggcgaccatcgttcgcactgcgcttcaatgggaagccaagcgtcaggcccagcaaagcggcagaataccgccgatgcggcgcaagctggcagcgataggctga

SEQ ID NO: 65039 - protein, 343 aa, Agrobacterium tumefaciens str. C58
MAVLVTGGAGYIGSHMVWALLDAGEEVVVVDRLSTGSRWAVAPAARFYLGDAADRALLDQVFEENHIETIFHFAGSVSVPESISQPLEYYENNTGTTRALVAAAVRSGIRNFIFSSTAAVYGNQPFDGPVPETAILSPENPYGLSKLASEIMLRDVVQAHDFNYVALRYFNVAGADPQGRAGPSPTGVANLIKVACEAATGRRDRVEVYGTDYPTADGTGVRDYIHVSDLIDAHMLAMAHLRAGGGTRTLNCGYGVGYSVLDVLQAVQRESACEFAVIHCPRRPGDIAAMVADSSRIQSELGWRPRFNDLATIVRTALQWEAKRQAQQSGRIPPMRRKLAAIG

SEQ ID NO: 65040 - DNA, 987 bp, Agrobacterium tumefaciens str. C58
  CDS (1)..(987): transl_table=11
ttgatgaagaagaaagtccttgtcgtcggcggtgccggctatatcggttctcacacctgccttctcctgtctgagcgaggatatgaaccggttgttttcgacaatctctccaacgggcatgaggaatttgtccgctgggggcctttcgaacagggcgatattcgcgaccgggcgcggctggacgaggtcttcgccaagcaccgaccggaagccgtccttcacttcgccgcgcttatcgaagtcggcgaatctgtcaagcaaccggtcgctttttacgacaataacgtcatcggctcgctcaacctgctttccgccgccatcgatgccggtgtcacgtcgttcgttttctcctccacttgcgcgacctacggattgccggaacaggtgccgatcgacgagacacaccggcaggcgccgatcaatccctatggccgcaccaaatgggtggtggagcaggcgctgaaggattacagcacctatgaggggctgcgctcggtgatgctgcgttatttcaacgctgcgggcgcagatttcgaaggccgcatcggcgaatggcacaagccggaaacccacgcgatcccgcttgccatcgaagctgcactcggacggcgccagggcttcaaggtgttcggcacggattacgacacacgcgacggcacctgcgtgcgcgactatatccacattctcgatcttgccgatgcgcatgtgcgggcagtggactacctgctggatggcggcgagactgtcgaactcaacctcggcaccggcaccggcaccacggtaaaggagctgctagcggcaatttcggaagtctccggccgccccttccccgtggaatataccggacggcgcgatggcgactccaccaccctcgttgccaataacgacaaggccagagaggttctcggctgggaaccgcgttattctctatcggatatcataaaatctgcctgggcgtggcattcctcccgtaatgccggggactga

SEQ ID NO: 65041 - protein, 328 aa, Agrobacterium tumefaciens str. C58
MMKKKVLVVGGAGYIGSHTCLLLSERGYEPVVFDNLSNGHEEFVRWGPFEQGDIRDRARLDEVFAKHRPEAVLHFAALIEVGESVKQPVAFYDNNVIGSLNLLSAAIDAGVTSFVFSSTCATYGLPEQVPIDETHRQAPINPYGRTKWVVEQALKDYSTYEGLRSVMLRYFNAAGADFEGRIGEWHKPETHAIPLAIEAALGRRQGFKVFGTDYDTRDGTCVRDYIHILDLADAHVRAVDYLLDGGETVELNLGTGTGTTVKELLAAISEVSGRPFPVEYTGRRDGDSTTLVANNDKAREVLGWEPRYSLSDIIKSAWAWHSSRNAGD

SEQ ID NO: 65042 - DNA, 987 bp, Brucella melitensis 16M
  CDS (1)..(987): transl_table=11
atgtccgcgaacaacgtcctcgtcgtcggtggcgccggattcatcggcagccacacggccaagcttctggccgggcagggctatgcacccgtcgtctacgacaatctttcgacgggccatcaatccgccgtccggtggggcgactttgtcgagggcgacattcttgaccaggcgcgtctggtcgagacaatggaaaaatatgcgccggtcgcggtaatccatttcgccgcctcggcctatgtcggggaatcggtggaggaccccgccaaatattatcgcaacaatgtaggcggaacgcagtcgcttctcgacgcctgccgtctgacgcgcacgcaaaacgttatcttctcctccagttgcgccacctatggcgtgcccagccggcttcccatcggggagggcgaggcccagaatccgatcaacccttatgggcgcacaaagttgatcgccgagcacatgctggccgattatgcggtggcctacgggctgcgttatgtggcgctacgctatttcaatgcatccggtgccgatatcgacggtgaactgggcgaaaagcacgaccctgaaacacatctcatcccgcgcgccatgatggccgccgctggcaggctcgacgttctggaagtctatggcgacgattacgagacgccggacggcacctgcatccgcgactatatccatgtcatcgatctcgcgcgggcgcatgtgctggcggtcgagcatctgaaggaagccgggggcaatctggccgttaatctgggtaccgggcgtggcacgtcaagtcgtgagatcgtgcagtccattggccgcctgacgggccgtagcgtgccggtcgccatgcgcgcgcgccgtgccggcgatccgccagcgctctatgccgacccggcacttgctgccgaaaagctcggcttccatacggtctattccgatctggacactatcatccgcaccgctgccccacacttcggactggaggttaggggatga

SEQ ID NO: 65043 - protein, 328 aa, Brucella melitensis 16M
MSANNVLVVGGAGFIGSHTAKLLAGQGYAPVVYDNLSTGHQSAVRWGDFVEGDILDQARLVETMEKYAPVAVIHFAASAYVGESVEDPAKYYRNNVGGTQSLLDACRLTRTQNVIFSSSCATYGVPSRLPIGEGEAQNPINPYGRTKLIAEHMLADYAVAYGLRYVALRYFNASGADIDGELGEKHDPETHLIPRAMMAAAGRLDVLEVYGDDYETPDGTCIRDYIHVIDLARAHVLAVEHLKEAGGNLAVNLGTGRGTSSREIVQSIGRLTGRSVPVAMRARRAGDPPALYADPALAAEKLGFHTVYSDLDTIIRTAAPHFGLEVRG

SEQ ID NO: 65044 - DNA, 945 bp, Pyrobaculum aerophilum str. IM2
  CDS (1)..(945): transl_table=11
atgagaattgtggtcacgggcggcgctgggtttataggcagccatttagtggataggctagtggaagagggacatgaggttgttgtcgtggacaatttatccagcggaagaagggagtttgtcaataaggcagccgagctgtatatcagagatttaaaagaaagcgactggggcgttgggatacgcggagacgtcgtttttcactttgcggcaaacccagaggtacgcctgtccaccactgagcccgttgtgcattttaatgaaaacgtgttggccacatttaacgtattggagtgggccaggcaaaccggcgttaagtccgtgatatttgcctcttcctcgacagtttacggcgacgccgaggtgatcccaacgccggaagaggcgccttacaagcccatttctgtatatggagcggcgaaggccgcgggagaggttatgtgcgccacttatgcgaggctttacggcgttaaatgccttgctattagatatgctaatattatagggccgcggctccgccacggcgtgatttatgactttatcatgaagcttaagagaaatccaaatgtcctcgaagtcttaggcgatggcactcagaggaaaagctacctctatataaaagacgcaattgacgccacaatactggcgtggaaaaaattcgaggaaataaaagagcctttcctagccctaaacgtgggcaatttagacgcaattaaagtgctcgacatagctcaaatagtcgccgaagtcctcggcttaaggcctgagattaaactcgtcccaactactccagacggccgcgggtggcccggcgacgttaaatacatgactctttctattacaaaactaatgaaaatgacgggctggaggccgacaatgacaagcggcgaggcggtgagaaaaaccgcggaggatttggctaaagagctatggcagacacgttaa

SEQ ID NO: 65045 - protein, 314 aa, Pyrobaculum aerophilum str. IM2
MRIVVTGGAGFIGSHLVDRLVEEGHEVVVVDNLSSGRREFVNKAAELYIRDLKESDWGVGIRGDVVFHFAANPEVRLSTTEPVVHFNENVLATFNVLEWARQTGVKSVIFASSSTVYGDAEVIPTPEEAPYKPISVYGAAKAAGEVMCATYARLYGVKCLAIRYANIIGPRLRHGVIYDFIMKLKRNPNVLEVLGDGTQRKSYLYIKDAIDATILAWKKFEEIKEPFLALNVGNLDAIKVLDIAQIVAEVLGLRPEIKLVPTTPDGRGWPGDVKYMTLSITKLMKMTGWRPTMTSGEAVRKTAEDLAKELWQTR

SEQ ID NO: 65046 - DNA, 987 bp, Clostridium perfringens str. 13
  CDS (1)..(987): transl_table=11
atggcaattttagtttgtggtggtgctggctatataggtagccatatggttgcagaattaattgaaaacaataaagaagttgttatcttagataacttcgaaaagggacatgaagatgctattcttggcggaaaactttataaaggtgatttaagagatagaaaaatattagacaagatttttactgaaaataacatagaagctgttattgactttgctgcctactctcttgttggagaaagtatgacagagcctttaaaatacttcaataataacgtttcaggaactataagtttattagaggctatgagagatcataatgtaaaatacatagttttctcttcaacagctgctacttatggagaacctgaaaatattcctatattagaaactgataaaaatcttcctacaaatgcttatggagaatctaagcttcttgttgaaaagattttaaaatggtgtgatactgcttatggaataaaatacactgctttaagatacttcaatgctgctggcgctcatgttaacggaaaaattggagaagatcactctcctgaaactcatttaattcctttaatattacaagttgcattaggaaaaagagataaaataatgatgtttggagatgattatgatactaaagatggtacttgtgtaagagattatatccatgtatcagatttagcatcagctcactcattagcactagaaagattaatgaatggtggagaaagcagaatatacaatcttggtaatggtactggatttactgtaaaagaagttgtagaagttgcaagaaaagtaactggacatccaattccagctgaggtagctcctagaagagctggagacccagctatattaatagcttcatcagataaagctattgaagaattaaattggaaacctaaattcaattcattagaaacaataattgaaactgcttggaattggcataaaaaccatccaaatggatatgaaaaataa

SEQ ID NO: 65047 - protein, 328 aa, Clostridium perfringens str. 13
MAILVCGGAGYIGSHMVAELIENNKEVVILDNFEKGHEDAILGGKLYKGDLRDRKILDKIFTENNIEAVIDFAAYSLVGESMTEPLKYFNNNVSGTISLLEAMRDHNVKYIVFSSTAATYGEPENIPILETDKNLPTNAYGESKLLVEKILKWCDTAYGIKYTALRYFNAAGAHVNGKIGEDHSPETHLIPLILQVALGKRDKIMMFGDDYDTKDGTCVRDYIHVSDLASAHSLALERLMNGGESRIYNLGNGTGFTVKEVVEVARKVTGHPIPAEVAPRRAGDPAILIASSDKAIEELNWKPKFNSLETIIETAWNWHKNHPNGYEK

SEQ ID NO: 65048 - DNA, 1056 bp, Arabidopsis thaliana
  CDS (1)..(1056)
atgggttcttctgtggaacagaacattttggtgactggtggtgctggattcattggaacacatactgttgttcagcttttgaatcagggttttaaggttacgatcattgataatcttgataactctgtcgttgaagctgttcatagggttagggaacttgttggtcctgatctctctaccaagcttgaattcaatctgggtgatctaagaaacaaaggagatattgagaaactcttttccaatcagagatttgatgctgtgattcactttgctggtcttaaagctgtgggagaaagtgttggaaaccctcgtcgttactttgataataacttagttggaactatcaatctatatgagaccatggcaaaatacaactgcaaaatgatggtgttttcgtcgtctgcaacagtttatggtcaacctgaaatagtcccatgtgtggaagactttgagttacaggctatgaatccttatggtcgtactaagctgtttcttgaagagatagctagagacattcacgctgcggaaccagaatggaagataattcttctgaggtacttcaatccggttggagctcacgagagtggaagaattggagaagatccaaagggcataccgaataatctcatgccttatatccaacaagtggcggttggaagattacctgaactcaatgtatttggacatgattatcctaccatggatggtagcgcggttagagactacatccatgtaatggatttagcagatggccatgtggctgcgttaaacaaattgttttcagactcaaagattggctgtactgcttataatcttggcactggtcaaggaacttctgtcttagaaatggtttcttcttttgaaaaagcttctggcaagaaaatacctatcaagctatgtccaagaagagctggagatgcaacagctgtttatgcttcaactcagaaagctgagaaggaacttggctggaaggcaaaatatggagttgatgagatgtgcagagatcaatggaactgggcaaataagaatccatggggtttccagaagaagccttga

SEQ ID NO: 65049 - protein, 351 aa, Arabidopsis thaliana
MGSSVEQNILVTGGAGFIGTHTVVQLLNQGFKVTIIDNLDNSVVEAVHRVRELVGPDLSTKLEFNLGDLRNKGDIEKLFSNQRFDAVIHFAGLKAVGESVGNPRRYFDNNLVGTINLYETMAKYNCKMMVFSSSATVYGQPEIVPCVEDFELQAMNPYGRTKLFLEEIARDIHAAEPEWKIILLRYFNPVGAHESGRIGEDPKGIPNNLMPYIQQVAVGRLPELNVFGHDYPTMDGSAVRDYIHVMDLADGHVAALNKLFSDSKIGCTAYNLGTGQGTSVLEMVSSFEKASGKKIPIKLCPRRAGDATAVYASTQKAEKELGWKAKYGVDEMCRDQWNWANKNPWGFQKKP

SEQ ID NO: 65050 - DNA, 951 bp, Pyrococcus furiosus DSM 3638
  CDS (1)..(951): transl_table=11
atgaaggtattagtcactggaggggcaggatttattggttcacaccttgtagatgccttaatggaaaggggctatagagttagagtcctcgacgatttaagtgcggggagtcttaagaacatagaacagtggttagataacagcagatttgagttcataaaaggggatatgagagatccaaatattgtaaaagaagctgtagaagacgttgatattgtctatcatctagcagcaaacccagaagttaggataagtgctcaaagcccagagcttctctacgagacaaacgttctaataacatacaacctcctccaggcaataaaagattcaaacgttaagtatctcatctttacatcatcttccacggtatatggagatgcgaaagtcattccaacaccagaagattatggtcccctagagccaataagcgtctatggaggtgcaaagctggctgcagaggccttaattagtggatatgcccacatattcgaattccatgcagtagtatttaggcttgcaaacataataggggcaagggcgaatcatggagtaatttacgacttcataaacaaactcaagaagaatcctgaggttttagaaattcttggagacggaactcagagaaaaagctacctccacgtaagtgatactgtcgagggaatgcttcacatctttgagtactttaaaaaagaaggaaaaatctacgatgtttataacctaggtaatgaagactggattacagttaaggaaatagctgaaattgtaagtgaagaaatgggcctaaatccagaattccggttcacgggtggagttgacggtggaagaggctggaaaggggatgtaaagttcatgttactcgacataactaaagcaaaatccactggttggaagcccaaaatgaatagctacgaggctgtgagaagaactgttagggagcttctaaaggcctga

SEQ ID NO: 65051 - protein, 316 aa, Pyrococcus furiosus DSM 3638
MKVLVTGGAGFIGSHLVDALMERGYRVRVLDDLSAGSLKNIEQWLDNSRFEFIKGDMRDPNIVKEAVEDVDIVYHLAANPEVRISAQSPELLYETNVLITYNLLQAIKDSNVKYLIFTSSSTVYGDAKVIPTPEDYGPLEPISVYGGAKLAAEALISGYAHIFEFHAVVFRLANIIGARANHGVIYDFINKLKKNPEVLEILGDGTQRKSYLHVSDTVEGMLHIFEYFKKEGKIYDVYNLGNEDWITVKEIAEIVSEEMGLNPEFRFTGGVDGGRGWKGDVKFMLLDITKAKSTGWKPKMNSYEAVRRTVRELLKA

SEQ ID NO: 65052 - DNA, 1011 bp, Pyrococcus furiosus DSM 3638
  CDS (1)..(1011): transl_table=11
atgatggacccgataaagtcagatgtaagagaaattgtaagagcattagatagtgctaattttgagggtaagactgctctggttacaggtggtgctggttttttgggatcttggctttgtgatgtgttaatcgagttgggagcaaaggtttattgtgttgataactttgccagtggtcgttgggaaaacatctctcatctaacaagtgaggagaattttgtatttatagagcacgatgtttcgaaacccttggaaatcagagaaaaacttgattttatctttcatttcgcctcaagggcatcaccttttgaattcgagcactatcctctagagataatagatgcaaacacccttggaactaggaatatgcttgaattggctaaaaagaataatgcgagatttatctttgcctcaacgagcgaaatttatggtcatcctgaagttgtcccaactcctgaaacgtattggggttacgtgaatccaattggcattagaagttgctatgatgagtcaaagagacttggagaggctctcacgatggcttattataggcagttcaatgttgatgtgagaatagttaggatttttaatacgtatgggccaagaatgcgagctgatggagtttatggtagggtagtcccaaggtttataagtcaagccttgaatgaagagccaattactgtttttggagatgggagccagacaaggagtttttgttatgtaactgatctcataacgggagtattgaagtttgccgctgtggagaacggtagaggggaagttgtgaatttgggcaatccccgggagattagtattcttgagcttgcttatctcataaagaagcttactaattctgattcgccaatagaatttcatccactacctcctgatgatcctcctaggaggtgtccagacataagtaaagcacaaaaactgctaaactggaaaccaaaggtcgaactcgaagaagggctcaaaaagacaataaaatggtttggggggaaaatttaa

SEQ ID NO: 65053 - protein, 336 aa, Pyrococcus furiosus DSM 3638
MMDPIKSDVREIVRALDSANFEGKTALVTGGAGFLGSWLCDVLIELGAKVYCVDNFASGRWENISHLTSEENFVFIEHDVSKPLEIREKLDFIFHFASRASPFEFEHYPLEIIDANTLGTRNMLELAKKNNARFIFASTSEIYGHPEVVPTPETYWGYVNPIGIRSCYDESKRLGEALTMAYYRQFNVDVRIVRIFNTYGPRMRADGVYGRVVPRFISQALNEEPITVFGDGSQTRSFCYVTDLITGVLKFAAVENGRGEVVNLGNPREISILELAYLIKKLTNSDSPIEFHPLPPDDPPRRCPDISKAQKLLNWKPKVELEEGLKKTIKWFGGKI

SEQ ID NO: 65054 - DNA, 924 bp, Pyrococcus furiosus DSM 3638
  CDS (1)..(924): transl_table=11
atgaagaataagttagttgttgtaacgggaggagcggggttcataggatcccacatagctgaggccttggttgaagagaatgaagttattgttattgataacctgtactctggaaaaattgaaaacatcccccagggtgcaaaattcattgaggctgatataagggattactcttcaatagctgagataataagggaagccgactatgttttccatgaggctgctcaaataagcgttgaggagagtgttagggatcctatctttacggatgaagtcaacgttattggaactttgaatattttgaaagccctaagtgaggggtcaggaaagataatttttgcatcttctgctgctgtttatggagagaataagaaccttccacttaaggaggattatctaccgaagccgatatctccatatggagttagcaaattggcaggagagcattatgttagggtattttacgagctctatggagtccctggtgttattcttcgttattttaacgtttatggtccaaggcagagttcagcatatgctggagtgataagcattttcatgaagaatgcccttaaaaatgaacctttagttatctttggagacggaaagcaaacgagggactttatatatgtaaaagacgtcgttcaggccaatttattagttgctgagaaagagagagccaatggaaagattttcaacgttgccactggaaaggaaacatcgatacttgagctggccttaaagattatagacctcacaagctcctcttctcaaattttatttgctcctgaacggcctggggatataaagagaagtgttgcagatataaatgaaattagaaagcttggattcgagccttcttattctctagaggaggggttaaaggaaacacttgaatggtttaaaaaatggaaatacttttaa

SEQ ID NO: 65055 - protein, 307 aa, Pyrococcus furiosus DSM 3638
MKNKLVVVTGGAGFIGSHIAEALVEENEVIVIDNLYSGKIENIPQGAKFIEADIRDYSSIAEIIREADYVFHEAAQISVEESVRDPIFTDEVNVIGTLNILKALSEGSGKIIFASSAAVYGENKNLPLKEDYLPKPISPYGVSKLAGEHYVRVFYELYGVPGVILRYFNVYGPRQSSAYAGVISIFMKNALKNEPLVIFGDGKQTRDFIYVKDVVQANLLVAEKERANGKIFNVATGKETSILELALKIIDLTSSSSQILFAPERPGDIKRSVADINEIRKLGFEPSYSLEEGLKETLEWFKKWKYF

SEQ ID NO: 65056 - DNA, 936 bp, Corynebacterium glutamicum ATCC 13032
  CDS (1)..(936): transl_table=11
atgcgcacagtagttaccggcggtgccggcttcatcggatcccatctcgttgaccttttgatcaaggaaggccacgaggtcgttgtgatcgataacctctcccgcggacgcctggagaatctctccgatgcggaagccaccggaaaactcacctttgtggaagccgatcttctcgacgttgatttcaacgagtttctaggaacccacaagcctgaggttattttccacctggcagcgcaaatcgatgtgcgccactctgttgtagatcctcttcacgacgccgaaaccaacattttgtccaccatccgcatcgctgacgctgcccgccagcacggtgttcgcaaggttgtctttacctcctcaggcggttccatttacggtgagccttcggaattcccagttgatgaaaccgtgccagtggatccacattccccttatgcggcatccaaggtgtccggtgaaatttacctgaacaccttccgccacctgtacggcttagactgttctcacatcgcaccggcaaatgtttacggcccacgccaagatccacacggtgaagcaggagttgtggccattttcgcgctgcgacttctgggaggcctggacaccaaggtattcggcgacggcggaaacacccgcgactacgtctacgtcggtgacgtagttcgtgctttctacctggcttctggggaaatcggtgggggagagcgcttcaacattggcacctctgtggaaacctctgaccgccagctgcacaccctcgtggccactgcggcaggttccaaagatgatcctgaatatgcacctgcacgtctcggcgatgtgccacgcagtgcactcagcttcggcaaggccaaagaggtgcttggttgggagcctgaggtgaacatcgaacaaggtgtggccaagactgtggagtacttccgcactcactag

SEQ ID NO: 65057 - protein, 311 aa, Corynebacterium glutamicum ATCC 13032
MRTVVTGGAGFIGSHLVDLLIKEGHEVVVIDNLSRGRLENLSDAEATGKLTFVEADLLDVDFNEFLGTHKPEVIFHLAAQIDVRHSVVDPLHDAETNILSTIRIADAARQHGVRKVVFTSSGGSIYGEPSEFPVDETVPVDPHSPYAASKVSGEIYLNTFRHLYGLDCSHIAPANVYGPRQDPHGEAGVVAIFALRLLGGLDTKVFGDGGNTRDYVYVGDVVRAFYLASGEIGGGERFNIGTSVETSDRQLHTLVATAAGSKDDPEYAPARLGDVPRSALSFGKAKEVLGWEPEVNIEQGVAKTVEYFRTH

SEQ ID NO: 65058 - DNA, 990 bp, Fusobacterium nucleatum subsp. nucleatum ATCC 25586
  CDS (1)..(990): transl_table=11
atgtctatattagtttgtggaggagcaggctatattggtagccatgttgttaaatatttgttagaaaaaaatgaagatgttgttgttgttgatagcttaatcacaggacatattgatgctgttgatgaaaaagcacatttagagcttggagatttaaaagatgaagaatttttaaatagagtttttgaaaaatatcaaatagatggggttatagattttgctgctttctctttggttggagaaagtgtgggggaacctttaaagtattttgaaaataatttctatggtactctttgcctattaaaagttatgaaaaataataatgttgataagatagtattttcttctactgctgcaacttatggtgaggctgaaaatatgcctatacttgaaactgatagaacagagcctactaacccttatggagaaagtaaactagctgttgaaaaaatgtttaaatggtgtgctaatgcttatggattaaaatatactgctttaagatacttcaatgttgctggtgcatatccaagtggagaaattggagaagctcacacttgtgaaactcatttaattccattgattttacaagttgcattagggcaaagagaaaaaatatctatctatggagatgactatcctactcctgatggaacttgcataagagactatattcatgtaatggacttagcagatgctcattatcttgctttaaatagattaagaaatggtggagatagccaaatatttaacttaggaaatggggaaggtttctctgtaaaagaagttatagaagttacaagaaaggttacaggatatcctattcccgcagaagttagtcctagaagagcaggagaccctgcaagacttatagcttcatctaaaaaagctattgatgaattaaaatggaaacctaaatatgataaattagaacaaattattgaaactgcttggaactggcataaaaatcatccaaatggatatgaagattaa

SEQ ID NO: 65059 - protein, 329 aa, Fusobacterium nucleatum subsp. nucleatum ATCC 25586
MSILVCGGAGYIGSHVVKYLLEKNEDVVVVDSLITGHIDAVDEKAHLELGDLKDEEFLNRVFEKYQIDGVIDFAAFSLVGESVGEPLKYFENNFYGTLCLLKVMKNNNVDKIVFSSTAATYGEAENMPILETDRTEPTNPYGESKLAVEKMFKWCANAYGLKYTALRYFNVAGAYPSGEIGEAHTCETHLIPLILQVALGQREKISIYGDDYPTPDGTCIRDYIHVMDLADAHYLALNRLRNGGDSQIFNLGNGEGFSVKEVIEVTRKVTGYPIPAEVSPRRAGDPARLIASSKKAIDELKWKPKYDKLEQIIETAWNWHKNHPNGYED

SEQ ID NO: 65060 - DNA, 975 bp, Fusobacterium nucleatum subsp. nucleatum ATCC 25586
  CDS (1)..(975): transl_table=11
atgcaaacaatcctagttacagggggggcagggtatattggttctcatgctgttgtagaattattagataataattataatgttgtagttattgatacattagaaaacggatttaaagaatttgtggataaaagagctaaattttaccaagggaatgttcaagattatgaactaatgtctagaatatttcaagaaaataagatagaagctgttatgcattttgctggttatataagagttccagaaagtgtagatgatcctaataaatattatttaaacaatacttatacaactatgtgtttaatacaatcaatggtaaaacataatattaaaaacataattttttcttcaacagcagcagtctatggagaaattacagaagataaccctattgatgaaaagcattcaacaatccctattaatccatatggtgcaagtaaattaatgtctgaaaggattatcagggactgtgccaaagcatacggattaaactattctatttttagatattttaatgttgctggagcacatgaaaaataccctattggtcaaaagggagcaggagtaacatcacttataactttaactttacaagctgcaaaagattcaaatagaattttagaagtttttggtgatgattttccaacaaaagatggtaccggaattagagactatattcatgtagtggatttggtaaaagcacatgtcttatctctgaaattactatttaaaaatgaaagcaatattttcaatcttggtaatggaaatggtttttccgtattagaaactgttgaagcagctcgtaaagtaactaataaagaaattatatgtaaaatagctgctagaagaaaaggtgatcctgcatgtgttattgcttcttcagaaaaagccaaaaaaatattaggttggaaagctcaatatactaatgttgagaaaattattgaaacaggttggcattttgtagaaaaacaataa

SEQ ID NO: 65061 - protein, 324 aa, Fusobacterium nucleatum subsp. nucleatum ATCC 25586
MQTILVTGGAGYIGSHAVVELLDNNYNVVVIDTLENGFKEFVDKRAKFYQGNVQDYELMSRIFQENKIEAVMHFAGYIRVPESVDDPNKYYLNNTYTTMCLIQSMVKHNIKNIIFSSTAAVYGEITEDNPIDEKHSTIPINPYGASKLMSERIIRDCAKAYGLNYSIFRYFNVAGAHEKYPIGQKGAGVTSLITLTLQAAKDSNRILEVFGDDFPTKDGTGIRDYIHVVDLVKAHVLSLKLLFKNESNIFNLGNGNGFSVLETVEAARKVTNKEIICKIAARRKGDPACVIASSEKAKKILGWKAQYTNVEKIIETGWHFVEKQ

SEQ ID NO: 65062 - DNA, 930 bp, Methanopyrus kandleri AV19
  CDS (1)..(930): transl_table=11
ttgatcctggtgaccggaggagccgggttcataggttcgcacgtcgtggaggagctcgtcgatcgaggccacgacgtggtggttttggacaacttcagcgtgggttgtgaggagaacctccgtgaggtccgggacgatatcgagatcgtacgtgccgacgtgacggatcctagggccgtggagcgaacgtttcgggagtaccgaccggaggccgtgattcacctggccgcccaggtcaacgtacgctactccatggagtcgcccttcgtcgacgccaggatcaacgcattgggtaccctgaacctcgtctcgttggccgccgagcacgacgtcgagagattcgtatacgcgtcctcgggtggggcggtgtacggggaaccggagtacttacccgtggatgaggaacatcccacgcgaccgatatcgaactacggcgtctcgaagctcgcaggtgagtactacgtccgtgtgtacgccgagcgggacgggttcgagtacgtcatcctacgatacgctaacgtttacggtcctcggcaggatcccaggggcgaggcaggggttatccctatcttcctattacgggccgcccgaggtgagccgctcacgatcttcggggacggtgagcaaacccgtgacttcgttttcgtcgaggacgtagctcgggtcacggccgaggcggtggagcgtggtgatggtgtgtacaacataggtaccggccgtgagacctccgtgaacgacatcgtgaacgccgtgaaggcggtcacaggggtcgacgtggaagtagtgtacgaggatccgcggccgggcgaggttcgtcggatatacctcgacccgagccgcgcccgggaggagctggggttcgagccacgcgtcgacctagaggaggggatcgagcgaacctgggagtggatccgtcggaaaatcgcgtag

SEQ ID NO: 65063 - protein, 309 aa, Methanopyrus kandleri AV19
MILVTGGAGFIGSHVVEELVDRGHDVVVLDNFSVGCEENLREVRDDIEIVRADVTDPRAVERTFREYRPEAVIHLAAQVNVRYSMESPFVDARINALGTLNLVSLAAEHDVERFVYASSGGAVYGEPEYLPVDEEHPTRPISNYGVSKLAGEYYVRVYAERDGFEYVILRYANVYGPRQDPRGEAGVIPIFLLRAARGEPLTIFGDGEQTRDFVFVEDVARVTAEAVERGDGVYNIGTGRETSVNDIVNAVKAVTGVDVEVVYEDPRPGEVRRIYLDPSRAREELGFEPRVDLEEGIERTWEWIRRKIA

SEQ ID NO: 65064 - DNA, 936 bp, Methanosarcina acetivorans C2A
  CDS (1)..(936): transl_table=11
ataaatatcttagtaactggcggagcaggctttattggttcccatttgatagagaaattgcttggtgaaggcaacgaagtcatatgtttggataattttgataattattacgatcctcaaataaaaagaaataatgtggaactttttctggagaatgaaaactttcagctcatcgaaggagatattagagataaagttcttttggaagaaattgtccagacagttgattacgtttttcatgaggctgcccaggcaggcatcagaatatcagttaaagaacccatgagacctcatgaaattaacgcgacaggtactctaaatttactggaagctacccttaattccaatgttaagaaaattattaatgcctcttcatcttcagtttacggaaaagtggaatatctcccttttgatgaaaaccatcccaaccatccagtatcaccttatggagtttcaaaactgctggccgaacattactgtagggtttttgaggaactctatggcttaaaaagtgtatctctgcgctattttacggtttacggaccaaggatgagaccggaccttgcaatcaacatttttactaaagccgccctgaagaatgaaacagtcgccattttcggagatggaaaaaaaaccagggatttcacctatattgatgacatcgtgagggcaaacctgatctgcatgaaaaaaggcagcgatgtttacaatattggtagcgggcattctatcaccatcaatgaacttgcctcgaaaattattgagatcaacgaaagcgaatcggaaattgtttacacggattctatgaaaggagacgcagaacacactctgtcaaattctaaaaaagcatggaaggagatcgggtggaaacctgaagtaacgatagaagatggtcttgagaggtatgcaaaatggatctcgaactctcagttgtga

SEQ ID NO: 65065 - protein, 311 aa, Methanosarcina acetivorans C2A
MNILVTGGAGFIGSHLIEKLLGEGNEVICLDNFDNYYDPQIKRNNVELFLENENFQLIEGDIRDKVLLEEIVQTVDYVFHEAAQAGIRISVKEPMRPHEINATGTLNLLEATLNSNVKKIINASSSSVYGKVEYLPFDENHPNHPVSPYGVSKLLAEHYCRVFEELYGLKSVSLRYFTVYGPRMRPDLAINIFTKAALKNETVAIFGDGKKTRDFTYIDDIVRANLICMKKGSDVYNIGSGHSITINELASKIIEINESESEIVYTDSMKGDAEHTLSNSKKAWKEIGWKPEVTIEDGLERYAKWISNSQL

SEQ ID NO: 65066 - DNA, 963 bp, Methanosarcina acetivorans C2A
  CDS (1)..(963): transl_table=11
ttgaagatcttcatgctttcagagaacagaatacttgtaacaggaggagccgggttcatagggagcaatctggtagaccgcctattagaaaaaggaaacttggttgttgttttcgataaccttagttccggcaagctggaatttatagagcagcactttgaaaatccggatttttcccttgtaagaggagaccttcttgatcctgaggctatcgaaagagcctgtacggatgttgacatggtataccatgtagctgcaaatccagatgtcaaactcggagcttcagatacaaaagtccatctggatcagaatatcctggcaacctacaacctcctcgaagctatgagaaaaggcaatgcaaaaaaaattgcatttacctcgacatccacagtctacggggaagcaagcgtgatgcccaccccggaggattatggccctcttatcccaatatccctctacggggcttcaaaacttgcctgtgaagctctcatcacttcgtactctcacaccttcgatatgcaggcttggattttccggtttgcaaatattgtcggaccgcgcagcacacacggaatcactgttgattttataaagaagctgaaggagaatcccggcaggctcgagattcttggagacggaaaacaggaaaaatcctaccttcatgtgtcggagtgtgttgatgctatcctttttgcaatagagaaaagcaaagaagaggtaaatatcttcaatatcggttccgaagacacaatcagtgctacagaaatagggcaagtcgttactgaagagatgggcctttccgatgtagagttcgtatataccggaggaagcaggggctggaaaggcgatgtgccaagaatgaggctcgggattgagaaactaaaagcaataggttggaaacctgtctatacgtcggagaacagtgtaagggaaacagcaagggcattactttccggaaactga

SEQ ID NO: 65067 - protein, 320 aa, Methanosarcina acetivorans C2A
MKIFMLSENRILVTGGAGFIGSNLVDRLLEKGNLVVVFDNLSSGKLEFIEQHFENPDFSLVRGDLLDPEAIERACTDVDMVYHVAANPDVKLGASDTKVHLDQNILATYNLLEAMRKGNAKKIAFTSTSTVYGEASVMPTPEDYGPLIPISLYGASKLACEALITSYSHTFDMQAWIFRFANIVGPRSTHGITVDFIKKLKENPGRLEILGDGKQEKSYLHVSECVDAILFAIEKSKEEVNIFNIGSEDTISATEIGQVVTEEMGLSDVEFVYTGGSRGWKGDVPRMRLGIEKLKAIGWKPVYTSENSVRETARALLSGN

SEQ ID NO: 65068 - DNA, 897 bp, Methanosarcina acetivorans C2A
  CDS (1)..(897): transl_table=11
atgaaagtgctgattacaggaggagcaggtttcataggctcccatatagctgagtatttcgcagaagcaggacatagtgtgagaatacttgataatctaactacgggtttttcacgaaatatccctcagcatagaaatgtcgaattcattcagggagatatctgtgatccctcttcggtcgaaaaggctgtctcgggaatggactgtgtttttcatgaagcagctctcgtatcggtgcctcttagttgtgaaaagccagttgaggctttccggataaatactcttggaacacttaatgtattgcaggcatgcgtcagggcaggagtcgaaaaattcgtgaccgcatcctcagctgcagtttatggaaacaaccctgaacttcctaaaagggagaatatgtatcctgaacctgcttcaccctatgcaatctccaagcttgacggagaatatctggcaagaatgttttatgaagaacacgggcttcggactacttgcctgcgctacttcaatgtctatggtccgcgtcaggatcccaaatccccgtacgccgctgtgatccctatttttttggaaagagcaaaggctggaaaagaccttgtcatttacggtgacgggcttcagagcagggacttcgttcatgtaaaagatgttgtaatggcaaacgtagcagccctcgagcatggggatggccaggtcttcaatgtggctatgggaaaaagtgtaacagtcctcgagcttgctgagaatattattgaactgaccggctcctcaagccagataatccatgccgaatcaagggcaggagatgtccgggattccagggcggatgtctcaaaaatttccgggtggtggaaaggcgagatcgaactgggacagggattaaagagtttgatttaa

SEQ ID NO: 65069 - protein, 298 aa, Methanosarcina acetivorans C2A
MKVLITGGAGFIGSHIAEYFAEAGHSVRILDNLTTGFSRNIPQHRNVEFIQGDICDPSSVEKAVSGMDCVFHEAALVSVPLSCEKPVEAFRINTLGTLNVLQACVRAGVEKFVTASSAAVYGNNPELPKRENMYPEPASPYAISKLDGEYLARMFYEEHGLRTTCLRYFNVYGPRQDPKSPYAAVIPIFLERAKAGKDLVIYGDGLQSRDFVHVKDVVMANVAALEHGDGQVFNVAMGKSVTVLELAENIIELTGSSSQIIHAESRAGDVRDSRADVSKISGWWKGEIELGQGLKSLI

SEQ ID NO: 65070 - DNA, 990 bp, Thermoanaerobacter tengcongensis MB4
  CDS (1)..(990): transl_table=11
atggcgattctggtttgtggtggagcaggttatattggaagtcatgcagtttatgctttattaaaaaggaatgaggaagtagttgtggtagacaacctcgccacagggcacagtgaatctgttttaggaggaaaattatacataggagatttaagggatgaagattttttagacaaagttttttcagaaaatgatattgaggctgtaatgcactttgcagcttcttcacttgttggagaaagcgttgaaaatccctttaagtactatgagaacaatgtatgcgggactttatctcttctaaaggctatgaaaaaacatggtgtcaaaaaaattgtattttcttcaactgcagcagtgtacggtgaacctgagagaattccaatagaggaagaggacaggaccgaacctacgaatccttatggggagacaaagctcgctattgaaaagatgttaaaatgggcggatgccgcttatgggattaagtacgtggcgcttcgttattttaatgtcgcgggagctcttgaaacaggtgaaattggagaagaccattctcctgagacacaccttattcccattatactccaggtagctttggggaaaagagataaagtaatgatttatggagatgactaccctacaaaagacggcacacctataagagattatatacatgtcatggacttagtagatgcacacattttggctttggagaagttaagaaaagaaaataaaagcgaagtttacaatctaggtaatggggaaggctttactgtaaaagaagtcatagaggttgcgaggaaagtgacaggacatcctattccagcagaagttacaggaaggcgcccaggagaccctgcagttttagttgcatcttccgaaaaagcgatgaaagatctggggtggaggcctaaatatgcttctttagaagagataattaaaagtgcctggatgtggcataaaaaccatccaaatggctttaaaagggattga

SEQ ID NO: 65071 - protein, 329 aa, Thermoanaerobacter tengcongensis MB4
MAILVCGGAGYIGSHAVYALLKRNEEVVVVDNLATGHSESVLGGKLYIGDLRDEDFLDKVFSENDIEAVMHFAASSLVGESVENPFKYYENNVCGTLSLLKAMKKHGVKKIVFSSTAAVYGEPERIPIEEEDRTEPTNPYGETKLAIEKMLKWADAAYGIKYVALRYFNVAGALETGEIGEDHSPETHLIPIILQVALGKRDKVMIYGDDYPTKDGTPIRDYIHVMDLVDAHILALEKLRKENKSEVYNLGNGEGFTVKEVIEVARKVTGHPIPAEVTGRRPGDPAVLVASSEKAMKDLGWRPKYASLEEIIKSAWMWHKNHPNGFKRD

SEQ ID NO: 65072 - DNA, 966 bp, Streptomyces coelicolor A3(2)
  CDS (1)..(966)
atgagcgggaagtacctggtgacaggtggtgccggatacgtcggcagcgtcgtcgcccagcacttggtggaggcggggcacgaggtcgtcgtgctcgacaatctgtcgaccggcttccgtgagggtgtgccggcgggtgcctcgttcgtcgagggcgacatccgggacgccgccaagtggctggacggctcgttcgacggcgtgctgcacttcgccgccttctcccaggtcggcgagtcggtcgtgaagcccgagaagtactgggacaacaacgtcggtggcaccatggcgctgctggaggccatgcggggcgcgggtgtgcggcggctcgtcttctcctccacggccgccacgtacggcgagcccgagcaggttcccatcgtcgagtccgcgccgacgaggcccaccaatccgtacggcgcctcgaagctcgccgtcgaccacatgatcaccggcgaggcggcggcccacgggctgggcgcggtctcgctgcgctacttcaacgtcgcgggcgcgtacggggagtacggcgagcgccacgaccccgagtcgcatctgattccgctggtccttcaagtggcgcagggcaggcgggaggccatctccgtctacggcgacgactacccgacgccggacggcacctgtgtgcgcgactacatccacgtcgccgacctggccgaggcccacctgctggccgtggcggccgccgccccgggcgagcacctcatctgcaacctgggcaacggcaacggcttctccgtccgcgaggtcgtcgagaccgtgcggcgggtgacgggccatccgatccccgagatcatggccccgcgccggggcggcgacccggcggtcctggtcgcgtcggccggcaccgcccgcgagaagctgggctggaacccgtcccgcgcggacctcgcgggcatcgtgtcggacgcgtgggagttcgcgcagcggcgcgcgggccagtag

SEQ ID NO: 65073 - protein, 321 aa, Streptomyces coelicolor A3(2)
MSGKYLVTGGAGYVGSVVAQHLVEAGHEVVVLDNLSTGFREGVPAGASFVEGDIRDAAKWLDGSFDGVLHFAAFSQVGESVVKPEKYWDNNVGGTMALLEAMRGAGVRRLVFSSTAATYGEPEQVPIVESAPTRPTNPYGASKLAVDHMITGEAAAHGLGAVSLRYFNVAGAYGEYGERHDPESHLIPLVLQVAQGRREAISVYGDDYPTPDGTCVRDYIHVADLAEAHLLAVAAAAPGEHLICNLGNGNGFSVREVVETVRRVTGHPIPEIMAPRRGGDPAVLVASAGTAREKLGWNPSRADLAGIVSDAWEFAQRRAGQ

SEQ ID NO: 65074 - DNA, 1005 bp, Streptomyces coelicolor A3(2)
  CDS (1)..(1005)
atgcgcgtactggtcaccggcagcgccggtttcatcgggtcccatgtcgtcgaggccctgcgggagcacgggcacgagcccgtgggctacgacgtccgcgaggaccccggcgccgacgtgcgcgatccggcggccctggcgcgagcactcgccggggtggacgccgtgtgccaccaggcggcgatggtcggcctcggcaacgggttcgccgacgcggcggagtacgtctcccgcaacgatctcggcaccgccgtcctgctcgccgcgacggccggggcgggcgtgcggcggctggtgctcgccgggtcgatggtcgtctacggggagggccgttacacgtgcgcgcggcacggcgtggtgcggccgggaccgcgcgccgtcgccgacctggacgcgggccggttcgagcccacctgcccccggtgcggcgcggacctggccccgggcctggtcggcgaggacgccccggccgacccgcgcaacgtgtacgccacgaccaagctggcccaggagcacctggccgccgcctgggcccggacgaccggcgcgacggcggtgtcactgcgctaccacaacgtgtacggcccccggatgccccgcgacaccccgtacgccggcgtcgcctccttcttccgctccgcgctggcccgcggcgaggcgccgcgcgtcttcgaggacggccgccagcgccgggacttcgtgcacgtgcgggacgtggccgccgcgaacgtcgccgcgctggagtccgcccggccgccggagggcgccctcagcgcctacaacaccggcagcggtgagccgcacaccgtgggtgagatggccgtcgccctgtccgccgcgcacggcggccccgagcccgtcgtcaccggcgagtaccgcctcggcgacgtccggcacatcaccgcggactccgcgcgcctgcggaccgacctggactggcggccccgggtcggattcgcggagggcatgcgggagttcgcccgggacgggctgcgcggggactga

SEQ ID NO: 65075 - protein, 334 aa, Streptomyces coelicolor A3(2)
MRVLVTGSAGFIGSHVVEALREHGHEPVGYDVREDPGADVRDPAALARALAGVDAVCHQAAMVGLGNGFADAAEYVSRNDLGTAVLLAATAGAGVRRLVLAGSMVVYGEGRYTCARHGVVRPGPRAVADLDAGRFEPTCPRCGADLAPGLVGEDAPADPRNVYATTKLAQEHLAAAWARTTGATAVSLRYHNVYGPRMPRDTPYAGVASFFRSALARGEAPRVFEDGRQRRDFVHVRDVAAANVAALESARPPEGALSAYNTGSGEPHTVGEMAVALSAAHGGPEPVVTGEYRLGDVRHITADSARLRTDLDWRPRVGFAEGMREFARDGLRGD

SEQ ID NO: 65076 - DNA, 951 bp, Methanosarcina mazei Go1
  CDS (1)..(951): transl_table=11
atgcctgcgaagaaaagagtacttgtaaccggaggagccggttttataggaagcaatctggtagaccgccttttagaaaaagaaagtgaagtcattgttttcgataatctcagttccggaaaaatggattttatagagaaccaccttgaaaatccggatttttcctttataaaaggagaccttcttgatccagaagctatcgaaaaagtctgcaaggatactgatatggtataccatgtggctgcaaatcctgatgtaaaacttggcgcttcggacacgaaagtccatctggaccagaatatcctggcaacctacaatctcctggaggctatgagaaaaggcagtgcaaaaaagattgcatttacttctacgtccacggtctatggtgaagccagtattatgcctactccggaaaactacggcccccttatccccatatccctttatggagcttcaaagctcgcctgtgaagccctcattacctcgtactcccataccttcgatatgcaggcgtggattttccgttttgcaaatattgtagggcctcgtagcactcacgggattactgttgattttataaaaaagcttaaagaaaatcctcgcaaacttgagatactgggagacggaaaacaggaaaaatcctatttacatgtctcagaatgtgttaatgcgatcctttttgcaatagaaaaaagtaaagaagaagtgaatatcttcaatatcggctctgaggatacaatcagcgctacagagatagggaaaatcgttgttgaagagatggggctttcggatgtggaatttacatataccggaggaagcagaggctggaaaggagatgttccaagaatgaggcttgggattgaaaagttaaaagccataggatggaagcctgaatatacttctgaaaggagtgtaagagagactgccagagcagtgattgataaaaggtga

SEQ ID NO: 65077 - protein, 316 aa, Methanosarcina mazei Go1
MPAKKRVLVTGGAGFIGSNLVDRLLEKESEVIVFDNLSSGKMDFIENHLENPDFSFIKGDLLDPEAIEKVCKDTDMVYHVAANPDVKLGASDTKVHLDQNILATYNLLEAMRKGSAKKIAFTSTSTVYGEASIMPTPENYGPLIPISLYGASKLACEALITSYSHTFDMQAWIFRFANIVGPRSTHGITVDFIKKLKENPRKLEILGDGKQEKSYLHVSECVNAILFAIEKSKEEVNIFNIGSEDTISATEIGKIVVEEMGLSDVEFTYTGGSRGWKGDVPRMRLGIEKLKAIGWKPEYTSERSVRETARAVIDKR

SEQ ID NO: 65078 - DNA, 1005 bp, Methanosarcina mazei Go1
  CDS (1)..(1005): transl_table=11
atgtctaaaatagtgatcacaggcggtgcgggttttataggctcccatattgcagaaaacctcgcaaaagatggtcatgagattgttattgtcgataatcttgatccttactattctgttgacctgaaaaagaaaaatctgaatattgcccttaacagcggggatgccacttttattaatgctgatgtcaccgacctttcaggaataaaagatgtcattgacagcacagtagattacgtttaccacgaagctgcccaggcaggcgtcaggatttcggtagaggacccttttaagccaaacgatgtaaacgtgcatggcactctgaacgtgctcaaagcctctcttgacgcgggcgtaaaaaaggtcatcaatgcttcctcatcttccgtctacggcaaagtaaaatacctgcccttcgacgaacagcacccaacagagccagtatccccatacggcgtcagtaaattggctgcagagcactactgcagggtattttacgaagtatacggcctcccgaccacctcattacgctacttcacagtatacggtccaagaatgaggccagaccttgcaatctcaatcttcacccggaaaatgcttgcaaacgaacccatcaccgtctttggtgacggggaacagacacgggacttcacatacatcgaagacgtcgtggaagctaacaaaagactcctttacaacagggcaaccgacggtaaagtcctgaacatcggaggcggaaaccggatcagtgtaaacaacctgatagaaaacttaaggtttatcaccggctcaacctctgaaatcataaacgccgacaagcaaaaaggagacacagaagacacacttgcaaatgttgaccttggaaataatatgataggatacacaccattattcaacatcaataaaggcctgaacaaattcgtagactggtttaaaaccgaaaatcaatgccgtgatccggaacaatcccttttaagtcagtccgctccgcaacttctaaagtaa

SEQ ID NO: 65079 - protein, 334 aa, Methanosarcina mazei Go1
MSKIVITGGAGFIGSHIAENLAKDGHEIVIVDNLDPYYSVDLKKKNLNIALNSGDATFINADVTDLSGIKDVIDSTVDYVYHEAAQAGVRISVEDPFKPNDVNVHGTLNVLKASLDAGVKKVINASSSSVYGKVKYLPFDEQHPTEPVSPYGVSKLAAEHYCRVFYEVYGLPTTSLRYFTVYGPRMRPDLAISIFTRKMLANEPITVFGDGEQTRDFTYIEDVVEANKRLLYNRATDGKVLNIGGGNRISVNNLIENLRFITGSTSEIINADKQKGDTEDTLANVDLGNNMIGYTPLFNINKGLNKFVDWFKTENQCRDPEQSLLSQSAPQLLK

SEQ ID NO: 65080 - DNA, 765 bp, Methanosarcina mazei Go1
  CDS (1)..(765): transl_table=11
atgaaagtgctgattacaggaggagcaggtttcataggctcccatatagctgagtattttgcagaagcaggccatagtgtaagaattcttgacaatttcgctaccggtttttctaaaaatatccctcagcacaaaaatgtcgaatttattcagggggatatatgtgatccttcttcggtcgaaaaggctatctcaggtatggactgcgtttttaatgaagctgcccttgtatcagtgccgcttagctgtgaaaaaccagtcgaggcttttcggataaatactttgggaacgcttaatgtattgcaggcatgcgtgagggaaggagtcgaaaagtttgtaacagcatcttcagctgcagtttacgggaacaatcctgtcctccctaaaagtgaaggcatgtatccggagccagcttcaccttacgcgatctccaaacttgacggggaattcctggcaaagatgttttacgaagaacatgggctcaggactacctgtttacgttactttaatgtctatgggcctcgccaggacccaaagtctccatatgcagctgtaatccccattttccttgaaaaggcaaaagcaggaaaagaccttgttattcatggcgacggacttcagagcagggattttgtacatgtcagggatgttgtcagggcaaatgtagcagctcttgaaaatggagacggccaggtattcaacctactttccgcagtaaaatttctgaattttatattttttaaattatgcaagtactttttataa

SEQ ID NO: 65081 - protein, 254 aa, Methanosarcina mazei Go1
MKVLITGGAGFIGSHIAEYFAEAGHSVRILDNFATGFSKNIPQHKNVEFIQGDICDPSSVEKAISGMDCVFNEAALVSVPLSCEKPVEAFRINTLGTLNVLQACVREGVEKFVTASSAAVYGNNPVLPKSEGMYPEPASPYAISKLDGEFLAKMFYEEHGLRTTCLRYFNVYGPRQDPKSPYAAVIPIFLEKAKAGKDLVIHGDGLQSRDFVHVRDVVRANVAALENGDGQVFNLLSAVKFLNFIFFKLCKYFL

SEQ ID NO: 65082 - DNA, 1152 bp, Xanthomonas campestris pv. campestris str. ATCC 33913
  CDS (1)..(1152): transl_table=11
atgagaatcctggtcaccggcggtaccggctacatcggctcccacacctgcgttgaattggcgcggcgcgggcatgaaatctgcatcgtcgacaatctgagtaattcatccgagcgcgtgctcgatcacctggcccacctgattggcgcgcgcccggcatttcattgcatggacgtgcgtgcgcccgagcttgccgagctgatgcagcgcgagcggatcgaggcggtgatccacttcgccgcgctcaaggcggtgggtgaatcggtgcgcgagccgctgcgctacttcaacaacaatgtcaccggcacgctggcgctgctgcgtgcgatgcgcagcgcgggggtggccaacctggtgttcagttcgtccgccaccgtgtacggcgacgagaacagcagcccgatcgaggaacacgcgccgttgaaggcgatcaacccgtatgggcgcaccaagctgatgatggaagaaatgatcggcgacctgagcgcggcctggccgcaattcaacgccgcactgctgcgctacttcaacccggtgggtgcgcatcccagcggatatctcggcgaagacccgcgtggcgtgccgaacaatctgatgccgtacatcgcccaggtggcagtgggccgccgcgatgcgctgcaggtgttcggcgacgactaccccacccctgacggcaccggcgtgcgcgactatctgcacgtgatggatctggcgcgcgcgcatgtggatgccatcgagtatctgcaccacgagcgccaggggctggtggtcaacctgggcaccggccggggccacagcgtgctggaagttgccgccgcattcgagcgggccagcgggcggcgtattccgctgcagtttgcaccgcggcgcgatggcgacgtggcggtgtattacgccagcaccgcgctggccaaccgactgctcggctggaaggcgcaatacgacctggagcgcatgtgcgccgatacctggcgctggcagtcgctgcatccggaaggctatgcgcaatcgcgcctggtgcgcccgcgcgccaccgcgccgatgggcgaacgcgtggcgccgctgcgcaagctgctgcccggcagcgatgggcgccgccgtcacgagcccgcacgtgccttgctgcccgcacacgggcattccggcgcctga

SEQ ID NO: 65083 - protein, 383 aa, Xanthomonas campestris pv. campestris str. ATCC 33913
MRILVTGGTGYIGSHTCVELARRGHEICIVDNLSNSSERVLDHLAHLIGARPAFHCMDVRAPELAELMQRERIEAVIHFAALKAVGESVREPLRYFNNNVTGTLALLRAMRSAGVANLVFSSSATVYGDENSSPIEEHAPLKAINPYGRTKLMMEEMIGDLSAAWPQFNAALLRYFNPVGAHPSGYLGEDPRGVPNNLMPYIAQVAVGRRDALQVFGDDYPTPDGTGVRDYLHVMDLARAHVDAIEYLHHERQGLVVNLGTGRGHSVLEVAAAFERASGRRIPLQFAPRRDGDVAVYYASTALANRLLGWKAQYDLERMCADTWRWQSLHPEGYAQSRLVRPRATAPMGERVAPLRKLLPGSDGRRRHEPARALLPAHGHSGA

SEQ ID NO: 65084 - DNA, 999 bp, Chlorobium tepidum TLS
  CDS (1)..(999): transl_table=11
atgattatcatcaccggcggcgcggggttcatcggcagcgccatgctctgggaactcaaccgcaacggcaccgatgaggtactcatcgtcgatgacctcggaagagcgtccgaggggagatggctcaacctccggggcctacgctacaccgatttcattcacaaggacgacctgcccgacctgctcgaacacgaccgcctgcccaaaatcgacgccgtgattcacatgggagccatcagctccaccaccgaacaggacgccaaccttctgctgcgcaacaactacgaatactcgaagatgctcgcctcgtggtgcgcaaaaaagggcgtgcgttttatctatgcgtcaagcgcggcaaccttcggcgacggctccgaaggatacagtgacggcatcgaggtgctcgaccggctaagaccactgaacatgtacggctactcgaagcatctgttcgactgctgggcgctgcgcaacggcatccttgaaaaagcggcggggctcaagttcttcaacgtctacgggcccaacgaataccacaaggaggacatgaccagcgtcgtcttcaaggcgttccaccagatcggcgacaatggcaaggtaaggcttttcagatcgcacaatccacagtacgccgatggcgagcagctgcgcgacttcgtctatgtgaaggattgcacgaaaatcatgcaatggctgctcgaaacgccctcggcgacgggactgttcaacatcggcaccgggcaggcgcgcagcttcagggatttggtcatagcaaccttcacggcgatggatcgccccgtcagcatcgagtttatcgatatgcccgaaacgattcgggacaaataccagtattatacctgtgcggactctgcccatctcaggcaggctggctacaccggccagatgacgccgctcgaagagggagtgcgagattatgtgcagaactatctgagcaaaccctcgccgcatcttgatacattggcttttgaacggcaataa

SEQ ID NO: 65085 - protein, 332 aa, Chlorobium tepidum TLS
MIIITGGAGFIGSAMLWELNRNGTDEVLIVDDLGRASEGRWLNLRGLRYTDFIHKDDLPDLLEHDRLPKIDAVIHMGAISSTTEQDANLLLRNNYEYSKMLASWCAKKGVRFIYASSAATFGDGSEGYSDGIEVLDRLRPLNMYGYSKHLFDCWALRNGILEKAAGLKFFNVYGPNEYHKEDMTSVVFKAFHQIGDNGKVRLFRSHNPQYADGEQLRDFVYVKDCTKIMQWLLETPSATGLFNIGTGQARSFRDLVIATFTAMDRPVSIEFIDMPETIRDKYQYYTCADSAHLRQAGYTGQMTPLEEGVRDYVQNYLSKPSPHLDTLAFERQ

SEQ ID NO: 65086 - DNA, 1017 bp, Thermosynechococcus elongatus BP-1
  CDS (1)..(1017): transl_table=11
atggatgttttagtaacgggcgtagctggattcattggtcatggggcggctctggcactcctacggcggggcgatcgcgtgattggcttggataatttgaatgactactatgatgttaaccttaagaaatctcgcctagaacacctgaacatttctagccaaccgggtcagtttatttttcgaaaaattgatttagttgatcgcctgggggtgaaccaactctttgcagacttttctccgcaaaaggtaattcacctggcagcccaagcaggcgtgcgttattccctagaaaatccttttgcctacattgatagtaatatcgttggttttctccacattttagaggcctgtcgccaccaccgcgtagagcatttggtctacgccagtagttccagtgtttatggcgcgaataaaaagctgcctttttccgttcacgataacgttgatcatccactgagcctgtatgcggcaaccaagaaggccaacgaactcatggcacacacctacagccacctctataatattccgacaacgggactgcgcttttttaccgtctatggcccttggggtcgccctgacatggcactgtttaagtttactagggcaattctgaataatgaacccctacccgtctttaactatgggaaacatcgccgtgactttacctacattgatgacattgtcgaaggtattctgcgcgtcttagatcggccggcagctcccaaccctgcttggtgtggcgaaacaccagatcccgccaccagtttagcaccctggcgagtgtacaacattggcgctcatcgtcccattgagcttctccgctacattgagcttttggaggagtaccttggcaaaaaggctctcatcacttttttacccttgcagccgggagatgtgcctgatacctatgccgatgtaaccgccctcaaagaagatacaggttatgaacccatcacccctgttgagattggtgtacaacggtttgtggaatggtatcgtgactactatcgtgtttaa

SEQ ID NO: 65087 - protein, 338 aa, Thermosynechococcus elongatus BP-1
MDVLVTGVAGFIGHGAALALLRRGDRVIGLDNLNDYYDVNLKKSRLEHLNISSQPGQFIFRKIDLVDRLGVNQLFADFSPQKVIHLAAQAGVRYSLENPFAYIDSNIVGFLHILEACRHHRVEHLVYASSSSVYGANKKLPFSVHDNVDHPLSLYAATKKANELMAHTYSHLYNIPTTGLRFFTVYGPWGRPDMALFKFTRAILNNEPLPVFNYGKHRRDFTYIDDIVEGILRVLDRPAAPNPAWCGETPDPATSLAPWRVYNIGAHRPIELLRYIELLEEYLGKKALITFLPLQPGDVPDTYADVTALKEDTGYEPITPVEIGVQRFVEWYRDYYRV

SEQ ID NO: 65088 - DNA, 996 bp, Streptococcus agalactiae 2603V/R
  CDS (1)..(996): transl_table=11
atggcagttctgattttaggtggcgccggctacattggctcgcatatggttgatcagttaatcacacaaggaaaagagaaagttattgttgttgataacttggtaacaggtcatcgtcaagcggtgcattcagatgcgattttttatgaaggagatttatccgataaaacgtttatgcgtcaagtttttagggaaaatcctgatgtagatgctgttatccattttgcggcattttcactagttgctgagtcaatggaaaatcctttaaaatattttgataataacactgctggaatgataaaacttttagaagtaatgaatgaatgtgatatcaaaaatattgtcttttcatcaacagctgcaacatatggtattccagaacaagttcctattttagaaacagctcctcaaaatcctattaatccttatggcgaaagtaagcttatgatggaaacaattatgaaatgggctgatcaagcctacggtattaagtttgtcgctctacgttacttcaacgttgctggagataaaccggatggctcaattggggaagatcataaaccagaaacacatttgttaccaatcattcttcaagttgctcaaggagtacgtgacaaaataatgatttttggagatgattacaatactccagatggaactaatgttcgagattatgtgcatccatttgatttggcagatgctcatatattagcagttgattaccttcgccaagggaatgaatcaaacgtgtttaatctcggatcttcgacaggtttttctaaccttcagatgttagaggcagctcgtcgtattactgggaaagaaattcctgctcaaaaggcagctcgtcgtccaggagatccagatacgcttattgcttcctcagagaaagctcgtcaaatccttgggtgggagcctaaatttgataatattgataaaattatttcatcggcatgggcatggcattctagtcatccaaatggctacgaagattaa

SEQ ID NO: 65089 - protein, 331 aa, Streptococcus agalactiae 2603V/R
MAVLILGGAGYIGSHMVDQLITQGKEKVIVVDNLVTGHRQAVHSDAIFYEGDLSDKTFMRQVFRENPDVDAVIHFAAFSLVAESMENPLKYFDNNTAGMIKLLEVMNECDIKNIVFSSTAATYGIPEQVPILETAPQNPINPYGESKLMMETIMKWADQAYGIKFVALRYFNVAGDKPDGSIGEDHKPETHLLPIILQVAQGVRDKIMIFGDDYNTPDGTNVRDYVHPFDLADAHILAVDYLRQGNESNVFNLGSSTGFSNLQMLEAARRITGKEIPAQKAARRPGDPDTLIASSEKARQILGWEPKFDNIDKIISSAWAWHSSHPNGYED

SEQ ID NO: 65090 - DNA, 930 bp, Oceanobacillus iheyensis HTE831
  CDS (1)..(930): transl_table=11
ttgacaaaatatttagttactggcggcgcaggattcgtaggatcaaatatcgtaaggaagcttatttcaaacggggaatcggttagattgctagataatttcagtacaggaaacaagaacaatatagcagatattaacgatcaagtagagataattagcggagactttacaaataaagcagtagttaaagaagctatgaaaggtgtagatattatcttacatcaaggggctattccttctgttcctaaatcaatcgacaatccaatattatctaattatgcaaatgtgaacggtacacttactcttttaaacgctgccgttgaggaaggtgtcagtcgatttgtatacgcagcttcttcttccgcttatggcaataataaaaggttaccgaaacaagaagatatgattgctaatcctatgtcaccttatgcagttagtaaatatacgggtgaactatattgtaaagttttttatgaaatatacggattagaaacgatttccttacgttattttaatgtattcggcccaagacaaaatccacattcaaaatatgctgcggtcattccagcatttatagaatcaatcattcaaaatcaatcacctattatatacggtgatggtacacaatcaagagatttcacttatatcgataatgttgtatctgctaatctacttgccgctaccgcgaaaaatttaaaaggggaagtagttaatatcggtactggaacccaaatacagctaaatgatttggtggatcgtattaacaatattttaggaaaaaacatttctgctatccatacgaaggatcgtgcaggtgacgttaaacattccttagctgacatacagcgcgctaaagatataataaactatgaaccaataactacatttgatgatggtttaataaaaacagtagaatggtttgacaaataa

SEQ ID NO: 65091 - protein, 309 aa, Oceanobacillus iheyensis HTE831
MTKYLVTGGAGFVGSNIVRKLISNGESVRLLDNFSTGNKNNIADINDQVEIISGDFTNKAVVKEAMKGVDIILHQGAIPSVPKSIDNPILSNYANVNGTLTLLNAAVEEGVSRFVYAASSSAYGNNKRLPKQEDMIANPMSPYAVSKYTGELYCKVFYEIYGLETISLRYFNVFGPRQNPHSKYAAVIPAFIESIIQNQSPIIYGDGTQSRDFTYIDNVVSANLLAATAKNLKGEVVNIGTGTQIQLNDLVDRINNILGKNISAIHTKDRAGDVKHSLADIQRAKDIINYEPITTFDDGLIKTVEWFDK

SEQ ID NO: 65092 - DNA, 1023 bp, Oceanobacillus iheyensis HTE831
  CDS (1)..(1023): transl_table=11
ttgactaaagaaaacaaggtttacttaataaccggagcagcgggatttatcggacatttcttatctcgaagactattagatcaagggtttaacgtaatcggattagataatgtaaatgattattatgatgtgaaccttaaagaaacaaggcttaaattattacaaccctacaataattttacgtttattaaaggtgatatttcggataaggaattagtacttagtatatttgaagagtacaagccttcaatcgtagtgaatttagcagcacaggctggggttcgttattctatagagaacccagatgtatatatgcaaagtaatgtaattggtttttataatatcttagaggcgtgtcgccatcatcttgtagaccacttaatttatgcatcatcaagttcagtatatggtgctaataaaaaagtgccgtttgaagagacggactttgtagataatccggtctcactatatgcatctacgaaaaagtcaaatgaattaatggctcatacatatagtcacctgtatggtattcctgcgactggactacgtttctttacggtctatggaccaatgggcagacctgatatggcttactttggctttacgaataagttattccatggagaacctattcaaatctttaacaacggagattttgaaaatgacttgtatcgtgacttcacatatattgatgatattgtggagggaattgagcgtttgattcctcatagcccagtaggagaagtacaacataaggtatacaatattggaaatagtaatccagaaaaactcatggtatttattgagacattagagaagtgcttaagcaattctcttggtgaaaaagtagaatttgaaaagcattttgaacctatcaaaccaggtgatgtacccgcaacgtatgcatctacgaaacaattatatgatgctgtagggtttagaccgcaaacttctattgaagaaggcttgcagcagtttacagactggtatgtggagtattatggagttaaagtagaagtataa

SEQ ID NO: 65093 - protein, 340 aa, Oceanobacillus iheyensis HTE831
MTKENKVYLITGAAGFIGHFLSRRLLDQGFNVIGLDNVNDYYDVNLKETRLKLLQPYNNFTFIKGDISDKELVLSIFEEYKPSIVVNLAAQAGVRYSIENPDVYMQSNVIGFYNILEACRHHLVDHLIYASSSSVYGANKKVPFEETDFVDNPVSLYASTKKSNELMAHTYSHLYGIPATGLRFFTVYGPMGRPDMAYFGFTNKLFHGEPIQIFNNGDFENDLYRDFTYIDDIVEGIERLIPHSPVGEVQHKVYNIGNSNPEKLMVFIETLEKCLSNSLGEKVEFEKHFEPIKPGDVPATYASTKQLYDAVGFRPQTSIEEGLQQFTDWYVEYYGVKVEV

SEQ ID NO: 65094 - DNA, 1014 bp, Bifidobacterium longum NCC2705
  CDS (1)..(1014): transl_table=11
atgacagttctcgtcaccggcggctgcggctacatcggcgctcatgtcgttcacgcactccatcaggccggcgaaaaggtcgttgtcgtcgacgatctgagctacggcaagcccactcgcatcgaaggctcccgcctgtacggcatggatatcgccaccccgggcgccggtgagcgtttggccgaaatcctcgatgccgaaggcgtcgactccgtgatccactttgccgctcgcaagcaggtcggcgaatccgtggagaagccgctgtggtactaccagcagaacatcaacggcatgctcaacgtgctcaccggcatgacccagtccaagaacgccaagaagctcgtcttctcctcttccgccgccacctatggtgtgccgccggtcgatgtggtgcctgaggacgtcgtcccgatgctgccgatcaacccctacggccagaccaagctgttcggcgagtggatggcacgcgcctgcgagcagccgttcggcatccgcttctgcgcgctgcgctacttcaacgtggccggctgcggtccggtggagcttgaggatccggccatcctgaacctcatcccgatgctgttcaatcgcctcaagcagggcaaggctcccgccatcttcggcgacgactacccgactccggacggcacctgcgtgcgcgactacatccacgtctccgacttggccgacgcccacatcgccgccctcaagtacctcgaccgtgacaagcgcaagtacgacgccttcaacgtcggcaccggcgaaggcacctccgtgcgccagatcgtcgacgaagtcaagaaggtcaccggtctgccgttcaccgaggctgtcatggcccgccgcgccggcgacccgccgcacctgatcggctccccgaagcgcatcaacgaggagatgggctggcatgccaagtacgacgtggaagacatcgtcaagtccgcgtgggatgcctggcaggccaaccccgaacaccacatcgacgtcgacacctggaagcaggctgactga

SEQ ID NO: 65095 - protein, 337 aa, Bifidobacterium longum NCC2705
MTVLVTGGCGYIGAHVVHALHQAGEKVVVVDDLSYGKPTRIEGSRLYGMDIATPGAGERLAEILDAEGVDSVIHFAARKQVGESVEKPLWYYQQNINGMLNVLTGMTQSKNAKKLVFSSSAATYGVPPVDVVPEDVVPMLPINPYGQTKLFGEWMARACEQPFGIRFCALRYFNVAGCGPVELEDPAILNLIPMLFNRLKQGKAPAIFGDDYPTPDGTCVRDYIHVSDLADAHIAALKYLDRDKRKYDAFNVGTGEGTSVRQIVDEVKKVTGLPFTEAVMARRAGDPPHLIGSPKRINEEMGWHAKYDVEDIVKSAWDAWQANPEHHIDVDTWKQAD

SEQ ID NO: 65096 - DNA, 987 bp, Brucella suis 1330
  CDS (1)..(987): transl_table=11
atgtccgcgaacaacgtcctcgtcgtcggtggcgccggattcatcggcagccacacggccaagcttctggccgggcagggctatgcacccgtcgtctacgacaatctttcgacgggccatcaatccgccgtccggtggggcgactttgtcgagggcgacattcttgaccaggcgcgtctggtcgagacaatggaaaaatatgcgccggtcgcggtaatccatttcgccgcctcggcctatgtcggggaatcggtggaggaccccgccaaatattatcgcaacaatgtaggcggaacgcagtcgcttctcgacgcctgccgtctgacgcgcacgcaaaacgttatcttctcctccagttgcgccacctatggcgtgcccagccggcttcccatcggggagggcgaggcccagaatccgatcaacccttatgggcgcacaaagttgatcgccgagcacatgctggccgattatgcggtggcctacgggctgcgttatgtggcgctacgctatttcaatgcatccggtgccgatatcgacggtgaactgggcgaaaagcacgaccctgaaacacatctcatcccgcgcgccatgatggccgccgctggcaggctcgacgttctggaagtctatggcgacgattacgagacgccggacggcacctgcatccgcgactatatccatgtcaccgatctcgcgcgggcgcatgtgctggcggtcgagcatctgaaggaagccgggggcaatctggccgttaatctgggtaccgggcgtggcacgtcaattcgtgagatcgtgcagtccattggccgcctgacgggccgtagcgtgccggtcgccatgcgcgcgcgccgtgccggcgatccgccagcgctctatgccgacccggcacttgctgccgaaaagctcggcttccatacggtctattccgatctggacactatcatccgcaccgctgccccacacttcggactggaggttaggggatga

SEQ ID NO: 65097 - protein, 328 aa, Brucella suis 1330
MSANNVLVVGGAGFIGSHTAKLLAGQGYAPVVYDNLSTGHQSAVRWGDFVEGDILDQARLVETMEKYAPVAVIHFAASAYVGESVEDPAKYYRNNVGGTQSLLDACRLTRTQNVIFSSSCATYGVPSRLPIGEGEAQNPINPYGRTKLIAEHMLADYAVAYGLRYVALRYFNASGADIDGELGEKHDPETHLIPRAMMAAAGRLDVLEVYGDDYETPDGTCIRDYIHVTDLARAHVLAVEHLKEAGGNLAVNLGTGRGTSIREIVQSIGRLTGRSVPVAMRARRAGDPPALYADPALAAEKLGFHTVYSDLDTIIRTAAPHFGLEVRG

SEQ ID NO: 65098 - DNA, 990 bp, Leptospira interrogans serovar Lai str. 56601
  CDS (1)..(990): transl_table=11
atgaaagcgttagttacaggcggagcagggtttattggaagtcatcttgtagatcttctattggaaaatcaatttgaggttaccgttctggataatttcagtacgggaagggcatttaatttaaatcacgtaaaagagaaaattaatttagttgaatgtgatctatcgattcaagaagattggatcaaaaagtttcaatcagttgattatgtatttcatcttgcggcgctcgcggacattgttcctagtattcaaaaccctgaaggttattttcaatcaaatgtaactggtactctgaatgttcttcaagcaagtagacattacggagtgaagcggtttgtttatgctgcttcttcttcttgttatggaattccagagctttatccaactcctgagacttcgccaattctacctcaatacccatatgcacttacaaaaagaatgggggaagagttagtcatgcactgggcacaagtttataaatttcccgctctatcattaaggttttttaatgtttacggacctagatctagaacttctggaacttacggtgccgtatttggagtttttttagctcaaaagttggcagggaaacctttcactgtagttggggatggaaaacaaactagggattttacttatgtgagagacgtagtagaagcagtttttgctgctgcccaaagtgataaagtaggtgaaatttataatgttggaagtggtgcaacgatttcagtcaatcgaattgtagaacttttgaaaggagaagttacttatattccaaaacgaccgggtgaaccagatagcacttttgccgatattgcaaaaattaaaaaagatttaaaatggtcccctaagatttctatagaaacagggattggcgaattattaaaaaatatagattattggagagaggctccagtatggacgcctgacaaaatagaaaaggctacatccgattggtttaagtatcttggcggatctaattcataa

SEQ ID NO: 65099 - protein, 329 aa, Leptospira interrogans serovar Lai str. 56601
MKALVTGGAGFIGSHLVDLLLENQFEVTVLDNFSTGRAFNLNHVKEKINLVECDLSIQEDWIKKFQSVDYVFHLAALADIVPSIQNPEGYFQSNVTGTLNVLQASRHYGVKRFVYAASSSCYGIPELYPTPETSPILPQYPYALTKRMGEELVMHWAQVYKFPALSLRFFNVYGPRSRTSGTYGAVFGVFLAQKLAGKPFTVVGDGKQTRDFTYVRDVVEAVFAAAQSDKVGEIYNVGSGATISVNRIVELLKGEVTYIPKRPGEPDSTFADIAKIKKDLKWSPKISIETGIGELLKNIDYWREAPVWTPDKIEKATSDWFKYLGGSNS

SEQ ID NO: 65100 - DNA, 981 bp, Leptospira interrogans serovar Lai str. 56601
  CDS (1)..(981): transl_table=11
ttgaattctatggcaaaaaagaaatgtatcgttaccggtggtgcggggcttatcggttctaatctagttcaagaacttaatagactaggaatcgatgatattctagttgtggatcatttgggaacttcttccaagtggaaaaatttagtcggaaaaagatattcagattatctggaaaaaaaaacattcttagaacatacaactcgaaactttctattaaaagattatgatattttgtttcatttgggagcctgttcttctactacagagacagacgcttcttatttagtggaaaataactttgaatatacaaaacttcttgccgaagaatctttaaaaaacggagttcgatttgtatatgcttcttccgccgctacctatggagacggagccaatggatacgatgataaaactcccattgacttactcaaacctttaaatatgtacggatattcaaaacatatgtttgatttatacgctcaaagaagagggtttttaaatcgaattactggaatcaaatatttcaatgtatttggatatggagaaggacataagggggatatgagaagtgtagttcttaaggggtacgaacaaatcaaaaaagaaggtaaaatccgtctttttaaatcgtataaacctgaatataaagacggagaacaaaaaagagattttttatacgcaaaagatgccgcaaaaatcaccgcctatttggcatttggcgatcataacggaatttacaatttaggaagaggaattgcagaaacctggaacgacctagtattcgcaatttttgatactttaaaactttctatcaatatagaatatattgaaatgccagagactcttaaatcaaaataccaatattatacttgtgcagataccacaaaacttttaaaaaccggttattcggaaggttttactcaattgaaggacgcagtcagtgaatatgtaaccctcctcgatgaagaagagggtacataa

SEQ ID NO: 65101 - protein, 326 aa, Leptospira interrogans serovar Lai str. 56601
MNSMAKKKCIVTGGAGLIGSNLVQELNRLGIDDILVVDHLGTSSKWKNLVGKRYSDYLEKKTFLEHTTRNFLLKDYDILFHLGACSSTTETDASYLVENNFEYTKLLAEESLKNGVRFVYASSAATYGDGANGYDDKTPIDLLKPLNMYGYSKHMFDLYAQRRGFLNRITGIKYFNVFGYGEGHKGDMRSVVLKGYEQIKKEGKIRLFKSYKPEYKDGEQKRDFLYAKDAAKITAYLAFGDHNGIYNLGRGIAETWNDLVFAIFDTLKLSINIEYIEMPETLKSKYQYYTCADTTKLLKTGYSEGFTQLKDAVSEYVTLLDEEEGT

SEQ ID NO: 65102 - DNA, 972 bp, Leptospira interrogans serovar Lai str. 56601
  CDS (1)..(972): transl_table=11
gtgaggttattgattaccggaggcgccggttatataggaagtcacgtagttgcccttcttcttgaaaaaaaacacgaacttgtaatcgtagataatctagaaaaagggaacagatctaatcttttttctgaaacacaattgattcaggggaatatccaagacgaatctgtgttggaaaatgcattttcaaaacctatcgacgcggtttttcattttgctgcatggaaggctgcgggcgaatctatgaccgatccttctaaatatgctctgaataatatcaacggaactctcaaacttcttacttttatggaaaaggccggaacgaatcagtttatcttttcttcctcggcggctgtttatggttctccggaatatcttcctattgatgagaaacaccccgttcgtccggaaaattattacggttatacaaaacttgcgatcgaacagaatttaaaatggtacgaaactctcaaaggatttaaatttgctgcattacgttattttaatgctgctggttatgatccaaaaggaagagttcgaggattagaaagaactcctgcaaatcttcttcctattattatggaagccgcagtagggataagaaaagattttgaggtgtttggcacggattatgaaactccggatggaagttgtgtacgcgattatattcatgtgaccgacttggcaaaggcgcacgttttgagtttggattatctagattctgaaaagaaatctctcacggtcaatttaggttctgaaaagggatattccgttttagaaatggttcgtcttgcggaggaggtggtcggaagatcgattcctcataaaatttcgggaagaagggctggagatcccgcaaaacttttggcttcttctgcaatggctcaacgtttattacaatgggtcccagaatacagtgaggccaaaacacttcttaaaacgatgtgggacgtatatcaaaatccggcttag

SEQ ID NO: 65103 - protein, 323 aa, Leptospira interrogans serovar Lai str. 56601
MRLLITGGAGYIGSHVVALLLEKKHELVIVDNLEKGNRSNLFSETQLIQGNIQDESVLENAFSKPIDAVFHFAAWKAAGESMTDPSKYALNNINGTLKLLTFMEKAGTNQFIFSSSAAVYGSPEYLPIDEKHPVRPENYYGYTKLAIEQNLKWYETLKGFKFAALRYFNAAGYDPKGRVRGLERTPANLLPIIMEAAVGIRKDFEVFGTDYETPDGSCVRDYIHVTDLAKAHVLSLDYLDSEKKSLTVNLGSEKGYSVLEMVRLAEEVVGRSIPHKISGRRAGDPAKLLASSAMAQRLLQWVPEYSEAKTLLKTMWDVYQNPA

SEQ ID NO: 65104 - DNA, 1023 bp, Shewanella oneidensis MR-1
  CDS (1)..(1023): transl_table=11
atgacacgttacgaacaaattaaacaagaactgctaaattctcccaaaacttggctaataacaggtgttgcaggttttatcggttcaaatttattagaacaattgcttaaattaaatcaaactgttattggattggataattttgcaactggccgtcaacataatctcgacgaagtgcaatcacttgtcacatcagaacaatggatgcgttttagcttcataaatggagatattcgcgattatgctatttgtgaagctgtagtaaatggcgttgattatgtgcttcatcaagctgctctgggatctgtaccacgctcaatcgctgatccaattaccactaatgctgcaaatatcactggctttcttaacatgcttcaagctgcaaaagaggctgaagtaaaaagctttacttatgctgcttccagttcaacttatggtgatcatcctgctttgcccaaagttgaacagaatattggtaatccgctttctccttatgctgtaacgaaatatgtgaatgagctctatgctagtgtatatgctcgtacttatggatttgaaacgatagggttaagatattttaatgtgtttggtcggcgtcaagatcctaatggtgcctatgcagccgtaattcctaagtggacatcttctatgataaaaggggaagacgtttttattaatggggatggcgaaacgagtcgagatttttgttatatcgataacgtagtacaaatgaacatattagctgcaacagcagcgtcagaagctaaaaatgaagtttataatgtcgcagttggtgatagaacaaccttgaatgatctttactttgctataaaggattcattaaatgcgaatggcattaatgttaatcaaaacccaaactatcgtgattttagagctggggatgtgagacattcacaagctgatgtaagtaaagccgttactagactaggttatcaatatacacataagatacttgaaggtatctcagaagcgatgccttggtacaaggagtttttggcataa

SEQ ID NO: 65105 - protein, 340 aa, Shewanella oneidensis MR-1
MTRYEQIKQELLNSPKTWLITGVAGFIGSNLLEQLLKLNQTVIGLDNFATGRQHNLDEVQSLVTSEQWMRFSFINGDIRDYAICEAVVNGVDYVLHQAALGSVPRSIADPITTNAANITGFLNMLQAAKEAEVKSFTYAASSSTYGDHPALPKVEQNIGNPLSPYAVTKYVNELYASVYARTYGFETIGLRYFNVFGRRQDPNGAYAAVIPKWTSSMIKGEDVFINGDGETSRDFCYIDNVVQMNILAATAASEAKNEVYNVAVGDRTTLNDLYFAIKDSLNANGINVNQNPNYRDFRAGDVRHSQADVSKAVTRLGYQYTHKILEGISEAMPWYKEFLA

SEQ ID NO: 65106 - DNA, 1008 bp, Shewanella oneidensis MR-1
  CDS (1)..(1008): transl_table=11
atgaaatacttagtcacaggcgcggcagggtttatcggcgccaacgtcagtaagcgcctctgcgcaatgggccatgaggtggtcggtattgataatctcaatgactactatgatgtggcgctcaagttagctcgactcgcaccgctcgaagcattaagcaactttcattttatcaaactggatctcgccgatagagaaggcatcgcaaaactgtttgcacaacagggctttcaacgggttatccatcttgccgcgcaagccggagtgcgctactccctagataacccccttgcttatgccgatagcaatcttgtcggtcaccttacaattttagaaggttgtcgccaccataagattgaacaccttgtgtatgcttcttcgtcttcggtttatggattgaatcaaaaaatgccgttttcgaccgaggacagcgtcgatcatccgatttccctctacgcggcaaccaaaaaagctaacgaattgatgtcgcacacttactcgcatttgtaccagctacccacaacaggtttacgctttttcaccgtgtatggcccttgggggcgacccgatatggccttgtttaaatttaccaaagcgattctcgccggtgaaacgattgatgtgtataaccatggcgatcttagccgtgattttacctatatcgatgatatcgttgagggcattattcgggtacaagacaagccacccagtccaactccagactggcgtgttgaaacggggacgccagccaacagcagcgcgccctatcgcgtattcaacataggtaatggcagcccagtgcaattgctcgactttattaccgcactcgagcgcgcgctaggcatcgaggcgaaaaagcaatttttacccatgcagcccggcgatgtgcatgccacatgggccgataccgaagatctatttaaggccgtgggatacaaatcccaagttgatattgatactggcgtggcaaaatttgtggattggtaccgcaatttttacgcgcaataa

SEQ ID NO: 65107 - protein, 335 aa, Shewanella oneidensis MR-1
MKYLVTGAAGFIGANVSKRLCAMGHEVVGIDNLNDYYDVALKLARLAPLEALSNFHFIKLDLADREGIAKLFAQQGFQRVIHLAAQAGVRYSLDNPLAYADSNLVGHLTILEGCRHHKIEHLVYASSSSVYGLNQKMPFSTEDSVDHPISLYAATKKANELMSHTYSHLYQLPTTGLRFFTVYGPWGRPDMALFKFTKAILAGETIDVYNHGDLSRDFTYIDDIVEGIIRVQDKPPSPTPDWRVETGTPANSSAPYRVFNIGNGSPVQLLDFITALERALGIEAKKQFLPMQPGDVHATWADTEDLFKAVGYKSQVDIDTGVAKFVDWYRNFYAQ

SEQ ID NO: 65108 - DNA, 1065 bp, Streptococcus mutans UA159
  CDS (1)..(1065): transl_table=11
atgcaggtgtctgcgtcaagtttccttttttgctctgtcgtttacgggcttggtatcttaattatggctattttagttttaggtggagctggttatattggttcacacatggttgaccgtcttattgaaaaaggtgaggaagaggttgttgtcgttgatagtttggtgacgggtcaccgtgcagcagtacacccagctgctaagttttatcaaggtgatttagcagatcgagagtttatgagtatggtttttagagaaaatcctgatgtggatgccgttattcactttgcagcttattctttggttgcagagtccatgaaaaagcccctcaagtattttgacaacaacaccgcaggcatgattaaactcttggaagtcatgagtgaatttggtgtcaaatatatcgtcttttcatcaacagcagcaacctatggtattcctgatgaaattccaatcaaggaaacaacaccgcagcgtccgattaatccatacggtgagagtaaactcatgatggaaaccattatgaaatggtctgaccgggcctacggtatcaagtttgtgccacttcgctatttcaatgtggctggtgcaaaaccagatggctcaatcggtgaagatcacagtcctgaaacacatctactgccaatcattttgcaggttgctcaaggcgtgcgtgagaaaatcatgatttttggtgatgattataacacgccagatggtaccaatgtgcgcgattatgtacacccttttgatttggcggatgctcacctgcttgctcttaactatctgcgccaaggcaatccatcaacggcctttaacttgggatcatcaacaggattttcaaatcttcaaattttagaagccgctcgtaaagttacgggacagaaaatccctgcagaaaaagcagctcgccgttcgggagatccagatactttgattgcatcttcagaaaaagcacgtgaggtgcttggctggaaaccgcaatttgatgacattgaaaaaatcattgcctccgcttgggcatggcattccagctatccaaagggttatgatgacagagactga

SEQ ID NO: 65109 - protein, 354 aa, Streptococcus mutans UA159
MQVSASSFLFCSVVYGLGILIMAILVLGGAGYIGSHMVDRLIEKGEEEVVVVDSLVTGHRAAVHPAAKFYQGDLADREFMSMVFRENPDVDAVIHFAAYSLVAESMKKPLKYFDNNTAGMIKLLEVMSEFGVKYIVFSSTAATYGIPDEIPIKETTPQRPINPYGESKLMMETIMKWSDRAYGIKFVPLRYFNVAGAKPDGSIGEDHSPETHLLPIILQVAQGVREKIMIFGDDYNTPDGTNVRDYVHPFDLADAHLLALNYLRQGNPSTAFNLGSSTGFSNLQILEAARKVTGQKIPAEKAARRSGDPDTLIASSEKAREVLGWKPQFDDIEKIIASAWAWHSSYPKGYDDRD

SEQ ID NO: 65110 - DNA, 1017 bp, Streptococcus mutans UA159
  CDS (1)..(1017): transl_table=11
atgacgaaaattctagtaacagggggcgctggttatctgggttctcatacttgtgttgaattattaaaccaagattatcggcttgttgttgtggataatttgctgcattctagtttcaaaagtttaacagccattaaagagattactggcaaagactttactttttatcaggcagatattagagataagaaaagtcttgaagccatttttgaaaaggaagccattactgcggtcatccatttcgcaggacttaaaattgtgaatgaatctacttctattccgcttgattattatgctaacaatttttcgggaaccattacactcttacaagttatgcagcagttttcctgtaaaaattttatcttttcatcctcagccagcgtttatggaaataaagcacctgctccagtttcagaagaggcgccacgttcggtgatgaccccttatggtcgtacaaagatgatgattgaagatgtgttaatggatgtgtctgtttcagatagtgcttggaatattgtcattttgcgctattttaaccccattggtgctcacagttcaggtgagttaggcgaagatcctcaaggtttgccaactaatcttttaccttatataagccaagttgctcttggaaaattagatagggtgcgggtttttggtggtgattatgataccaaagatgggactggtattcgtgattatattcatgttgtcgatcttgctagaggccatgttgcagctttacaaaaactagttgctggttcgggtctttcaatttataatctaggaactggaaaaggaacttctgttttagagcttattcaagaaatgggagaaattgttggacatcccattccttataaaatcgttggcaggcgtgcaggagatattgctgtttcttatgctgatgtctctaaagctgagaaagagctgaattggcatgcccgatatgatttaaaacggatgtgccaagactcttggcgctggcaaaaaaagtaccctaatggatttagagagtaa

SEQ ID NO: 65111 - protein, 338 aa, Streptococcus mutans UA159
MTKILVTGGAGYLGSHTCVELLNQDYRLVVVDNLLHSSFKSLTAIKEITGKDFTFYQADIRDKKSLEAIFEKEAITAVIHFAGLKIVNESTSIPLDYYANNFSGTITLLQVMQQFSCKNFIFSSSASVYGNKAPAPVSEEAPRSVMTPYGRTKMMIEDVLMDVSVSDSAWNIVILRYFNPIGAHSSGELGEDPQGLPTNLLPYISQVALGKLDRVRVFGGDYDTKDGTGIRDYIHVVDLARGHVAALQKLVAGSGLSIYNLGTGKGTSVLELIQEMGEIVGHPIPYKIVGRRAGDIAVSYADVSKAEKELNWHARYDLKRMCQDSWRWQKKYPNGFRE

SEQ ID NO: 65112 - DNA, 936 bp, Corynebacterium efficiens YS-314
  CDS (1)..(936): transl_table=11
atgcgtactgtagttaccggcggcgccggcttcatcggatcccatctcgtcgacctcctgatcgcccatggtcatgaggtggtggtgatcgacaacctctcccgcggtcgcgtggagaacctccgtgacgccgaggccaccggaaaactcaccttcgtcgaggcggatctgctggacgtggacttcaatgagttcctcgccgagcacacccccgaggtcatcttccacctcgccgcgcagatcgacgtccgcgcctccgtcgccgacccgcttcacgacgccgaaaccaacatcctctccaccatccgcatcgctgacgcagcccgaagccatggtgtgcgcaaggtggtgttcacctcctccggcggctccatctacggcgagccctccgagttccccgtcagcgaggatgtccccgtcgatccccattccccgtatgccgcctccaaggtctccggtgagatctacctcaacacctaccgccacctctacggcctggactgctcccacatcgccccggccaatgtctacggcccacgccaggatccccacggcgaggccggtgtggtggccatcttctcccagcgtctgctggccggtgaacccacccgcgtgtttggcgacggcggcaacacccgcgactatgtctacgtcggcgatgtggtccgcgccttctacctggcttccggcgagatcggcggcggcatgcgtttcaacatcggcacctccgtggagacctccgaccgccagctgcacaccctggtcgcggaagccgccggcgcacaggacgatccggaatacgcgccggcccgcctcggcgatgtgccccgcagcgccctgtccttcgcccgcgccaaggaggtcctgggctgggaacctgaggtggacatcaagcagggcgtggccaacaccgtggagtacttccgccacaattag

SEQ ID NO: 65113 - protein, 311 aa, Corynebacterium efficiens YS-314
MRTVVTGGAGFIGSHLVDLLIAHGHEVVVIDNLSRGRVENLRDAEATGKLTFVEADLLDVDFNEFLAEHTPEVIFHLAAQIDVRASVADPLHDAETNILSTIRIADAARSHGVRKVVFTSSGGSIYGEPSEFPVSEDVPVDPHSPYAASKVSGEIYLNTYRHLYGLDCSHIAPANVYGPRQDPHGEAGVVAIFSQRLLAGEPTRVFGDGGNTRDYVYVGDVVRAFYLASGEIGGGMRFNIGTSVETSDRQLHTLVAEAAGAQDDPEYAPARLGDVPRSALSFARAKEVLGWEPEVDIKQGVANTVEYFRHN

SEQ ID NO: 65114 - DNA, 924 bp, Corynebacterium efficiens YS-314
  CDS (1)..(924): transl_table=11
ttgaaaattctcgtcacaggtggcgctggtttcattggctcaaaccttgtaaaacagctccaaaaagacggtgtatccgatgttgctgttattgatgatttttcgacgggttttcgaaaaaaccttgatggtctagacatcacattgttcgaaggttctattttagatcgggaactactagcggaagcgacccgaggtgctcacgcagtagttcacctcgcagcgcgcccatccgtaccacgatcgattcaagatcccgtcgcttcacaccatgcgaatgcaacaggaaccctatatgttcttgaggctgcccgcgtagaaaatgcccacgtcacgctggcatcgtcttcttcggtttatggcgctaataaggttctgcccaaatcagaaaagctccgtgcgatgccaatcagcccatatgcagttagcaaactggcgactgagacctatgctttggcatatagtgctgtctatgatctcccggtgcttccctttaggtttttcaatgtgtacggtccaggacaggctgctgggcacgcctacgcggcagtaattcctgcgtttgtagatgcggctctaaagggtcttccactaccgatccaaggtgatggtttgcaaactagagactttacattcgtggacacagtaactcagaccatttctcgggctgcgagagaacacatccgatcagaagattccgtaaacctcgcttttggaacgaggcactcacttctggatgtcatcgaggtaatggaggaaatactgggttctcccctagatcgggaccataaagagtctcgaaccggtgatgtgagagattcacaagctgcaaacgaccaattaatctctctcttccctgagattaaccccgtgggcctctccgagggtatcgctaaaaccatcgagtggttcaggaagaagtaa

SEQ ID NO: 65115 - protein, 307 aa, Corynebacterium efficiens YS-314
MKILVTGGAGFIGSNLVKQLQKDGVSDVAVIDDFSTGFRKNLDGLDITLFEGSILDRELLAEATRGAHAVVHLAARPSVPRSIQDPVASHHANATGTLYVLEAARVENAHVTLASSSSVYGANKVLPKSEKLRAMPISPYAVSKLATETYALAYSAVYDLPVLPFRFFNVYGPGQAAGHAYAAVIPAFVDAALKGLPLPIQGDGLQTRDFTFVDTVTQTISRAAREHIRSEDSVNLAFGTRHSLLDVIEVMEEILGSPLDRDHKESRTGDVRDSQAANDQLISLFPEINPVGLSEGIAKTIEWFRKK

SEQ ID NO: 65116 - DNA, 987 bp, Corynebacterium efficiens YS-314
  CDS (1)..(987): transl_table=11
atgaaactcctggtcaccggcggggcgggttatgtcggtagtgtctgcgctgccgtcctcgttgaacgtggacatgatgtcaccgttatcgataatttcaccaccggcaaccgcgaggccgtcccggcctccgccacgctggtggagggcgatgtccgtgacgtagccgatgaggtactggctgccggggggttcgacggggtggtgcacttcgccgcgcgttccctggtgggtgaatccgtggatcacccggccgactactggcagcataatatggtcacctccctgaccctgctcgatgcgatgcgcgcccacggggtggacaacctggtattttcctccacggcggccacctacggtgagccggaacaggttcccatcaccgaggacatgcccaccgcccccacgaatccctatggggcatccaagctggccatcgactatgccatcacctcctatgcccgggcttatgggctgggggccaccagcctgcgctatttcaacgtggcgggagcctatgggaacatcggtgaaaaccgggaggtggaaacccatctgatccccctggtgctgcaggttgccctgggccaccgggagaagatcttcatgttcggtgacgactggcccaccgcagatggcaccgcggtacgcgattacatccacatccacgatctggccgaggcacatgtcctggccctggagtccaacgtcggtggaacccaccgcatcttcaatctcggatcgggtgatggttacagcgtcagacaggtggtggagatgtgccgtgaggttaccggacacccgatccccgccgaggtggcgccccggcgcgccggagacccggcggtgctgatcgcgtcctcggagaaggcacaacgggaactcgggtggaaccccacccgcaccgatctgcgcaccatcgtggaggatgcctgggcattcacctcacagctcggcgaacgcgcgcacagcgcccaccgcggttaa

SEQ ID NO: 65117 - protein, 328 aa, Corynebacterium efficiens YS-314
MKLLVTGGAGYVGSVCAAVLVERGHDVTVIDNFTTGNREAVPASATLVEGDVRDVADEVLAAGGFDGVVHFAARSLVGESVDHPADYWQHNMVTSLTLLDAMRAHGVDNLVFSSTAATYGEPEQVPITEDMPTAPTNPYGASKLAIDYAITSYARAYGLGATSLRYFNVAGAYGNIGENREVETHLIPLVLQVALGHREKIFMFGDDWPTADGTAVRDYIHIHDLAEAHVLALESNVGGTHRIFNLGSGDGYSVRQVVEMCREVTGHPIPAEVAPRRAGDPAVLIASSEKAQRELGWNPTRTDLRTIVEDAWAFTSQLGERAHSAHRG

SEQ ID NO: 65118 - DNA, 933 bp, Pseudomonas putida KT2440
  CDS (1)..(933): transl_table=11
atggctgacgcccccatcctgatcaccggcggtgccggcttcattggctcccacctgtgcgatgcgttgttggacaaaggctacgccgtacgcattctcgacgacttctccaccggccggcgaagcaatctgcaggtcgatcacccacggctggaactgatcgaaggtgatgttgccgatgcagggctggtcactcaggctgcggctggctgccgtgctgtggtgcatctggcggcggtagcgtcggttcaggcatcggtcgaagacccggtgcgtacccaccagagtaacttcatcggtaccctcaacgtttgcgaagccatgcgcgtgcatggcgtgcgccgggtgctcttcgcctccagcgcagcggtgtacggcaacaatggtgaaggggaatcgatttccgaagacacgccaaaggcgccgttgaccccttatgccgtggacaagctggccagtgagcagtacctggacttctaccgtcgccagcatggtctggagccggtggtgtttcgcttcttcaacatcttcgggccacggcaggacccttcctcaccgtattccggggtgatcagcatcttctgcgagcgtgctgtgcagggcttgccgattacagtgttcggtgacggcgaacagacccgggacttcctttatgtgggcgacctggtgcaggtgatggtgcaggcactggagcagccgcaggtcgaggagggggcggtgaacatcgggctgaaccaggcgacctcactgaaccagttgctggccgcgctggagaaggttgtggggagcttgccagcgatcagctatgcggcggcgcgatcgggtgatatccgccattcgcgagcagataaccagcggctgttggcgcggttcgagtttgcgcaggtgacgccgatggttgaaggcctgacaaagcttctcggtaaaggctga

SEQ ID NO: 65119 - protein, 310 aa, Pseudomonas putida KT2440
MADAPILITGGAGFIGSHLCDALLDKGYAVRILDDFSTGRRSNLQVDHPRLELIEGDVADAGLVTQAAAGCRAVVHLAAVASVQASVEDPVRTHQSNFIGTLNVCEAMRVHGVRRVLFASSAAVYGNNGEGESISEDTPKAPLTPYAVDKLASEQYLDFYRRQHGLEPVVFRFFNIFGPRQDPSSPYSGVISIFCERAVQGLPITVFGDGEQTRDFLYVGDLVQVMVQALEQPQVEEGAVNIGLNQATSLNQLLAALEKVVGSLPAISYAAARSGDIRHSRADNQRLLARFEFAQVTPMVEGLTKLLGKG

SEQ ID NO: 65120 - DNA, 966 bp, Pseudomonas putida KT2440
  CDS (1)..(966): transl_table=11
atgaaatatctggttgtgggtggtgcgggctacattggctcgcacatggtcaagcacctgctcgccgccggccatgaagtgctggtggcggacctggtctcacctggccccggtatccagtgggccaagctcgacatcgccgacgaagccgcactggatgtgctgtttggcgtgtgtcgcttcgatgcggtgttccacttcgcctcgttcattcaagtgggcgagtcggtcagtgcccccggcaagtactaccagaacaacgtcgcagccaccctttccctgctgcaggccatggtcaatgccggcatcaggcacctggtgttttcttcgagtgccgccgtatacggcaacccgcagtacgtgccgatcgatgaagcacacaccaaggggccgatcaacccgtatgggttgagcaaatggatggtcgagcagattcttgaggacttcgaccgggcctatggtttgaagtcggtaagcctgcgctatttcaatgcagcgggcgctgacccggaaggccagctaggcgagcgtcacgagccggaaacccatctgatcccgttgatcctgcaggctgcatctggccggcgcgaggcggtgacagtgtttggtcgcgactacgacacgccggatggcacctgcatacgcgactacgtgcatgtggcagacctggcggctgcccatgcactggcagtggattatctactggacggtggcgagcgtgccgcgttcaacctgggcaatggcctgggcttttcggtgcagcaggtgatcgatacggcccgggccgtgaccgggcgacagatcactgcccttgacgcacagcgccgcgccggcgacccgccacggctggtggcggatgcgagcaaggccatgcaggtgctgggctggcgccctgcattcgcctcactggagcagattgtgcggcatgcgtggcagtgggagttgcagtatccctggaggcgctga

SEQ ID NO: 65121 - protein, 321 aa, Pseudomonas putida KT2440
MKYLVVGGAGYIGSHMVKHLLAAGHEVLVADLVSPGPGIQWAKLDIADEAALDVLFGVCRFDAVFHFASFIQVGESVSAPGKYYQNNVAATLSLLQAMVNAGIRHLVFSSSAAVYGNPQYVPIDEAHTKGPINPYGLSKWMVEQILEDFDRAYGLKSVSLRYFNAAGADPEGQLGERHEPETHLIPLILQAASGRREAVTVFGRDYDTPDGTCIRDYVHVADLAAAHALAVDYLLDGGERAAFNLGNGLGFSVQQVIDTARAVTGRQITALDAQRRAGDPPRLVADASKAMQVLGWRPAFASLEQIVRHAWQWELQYPWRR

SEQ ID NO: 65122 - DNA, 1029 bp, Bradyrhizobium japonicum USDA 110
  CDS (1)..(1029)
atgaaatgcatcgtcactggcggcgccggtttcatcggcagtcacctcgttgatcgcctcctcgatgacggccacgaggtgatcgcgctcgacaatttcgtcatcggacgttccgaaaatctgtcgtcgcgcgccgattcgagccggctgaagatcgtccgtgccgacgtcactgaccgcgagtcgatcagcccgtatttctccggtatcgattgggtgtttcacctcgcggcactcgccgacatcgttccctcgatcgaatcgccgatcccgtatcaccgcgcaaatgtcgacggcacggtcaacgttctcgaggctgcgcgggaggcaggcgtcagccgcttcgtgtatgcggcgtcgtcgtcctgctacggcatccccgacatctatccgacgccggagagcgccgagatccggccgatgtacccctacgcgctcaccaagaatctcggcgagcagtgcgtcatgcactggtgccaggtctacaagcttccggcggtggcgctccgtctgttcaacgtgttcgggccacgccatcgcaccacggggacctatggtgccgtgttcggcgtgttcatggcgcagaagctcgccggcaagcctttcacggtggtcggcgacggcgagcagacccgcgatttcaccttcgtcagcgatgtcgccgacgccttcgtcacggcagcgcgttccgacgtctcgcacgagatcttcaacgtcggctcggacaacacctacagcgtcaaccggctggtcgagttgctcggcggcgacaaggtccacattcccaagcgccccggcgagcccgactgcacctacgccgacatcaccaagatcaagcgggtcctgaagtggacgccgaaggtgaaattcgaggacggcgtcgcgacgatgctgaagtcgatggaccagtacaaggacgctcccctgtggacggtggacaagattgccgacgccaccaaggactggttcaaatatctcggtgacgacagcgattcggcgcccggtaccccgcagaaggcaagctattga

SEQ ID NO: 65123 - protein, 342 aa, Bradyrhizobium japonicum USDA 110
MKCIVTGGAGFIGSHLVDRLLDDGHEVIALDNFVIGRSENLSSRADSSRLKIVRADVTDRESISPYFSGIDWVFHLAALADIVPSIESPIPYHRANVDGTVNVLEAAREAGVSRFVYAASSSCYGIPDIYPTPESAEIRPMYPYALTKNLGEQCVMHWCQVYKLPAVALRLFNVFGPRHRTTGTYGAVFGVFMAQKLAGKPFTVVGDGEQTRDFTFVSDVADAFVTAARSDVSHEIFNVGSDNTYSVNRLVELLGGDKVHIPKRPGEPDCTYADITKIKRVLKWTPKVKFEDGVATMLKSMDQYKDAPLWTVDKIADATKDWFKYLGDDSDSAPGTPQKASY

SEQ ID NO: 65124 - DNA, 981 bp, Bradyrhizobium japonicum USDA 110
  CDS (1)..(981)
atgttgctggtgaccggcggagccggttttatcgggtcgaatgtcgtggctgcgttgaacgacgccggccgcagcgacgtcgccgtctgtgatttcctcggcaccgacggcaagtggcgcaatctcgccaagcgccagcttgtggatatcgcccccccggccgagctgcccgactggctgaacggccgcaggctcgacgccgtgatccatctcggggcgatttccgcgaccaccgcgaccgacggcgacctcgtgttcgaaaccaatttccgcctctccatgcgcctgctcgactggtgcacggcgaatgcggtgccgctgatctacgcctcctcggccgccacctatggcgacggcgaggcaggctttgacgacgatgcgtcgctgcccgcgttgaagaaactccggccgatgaacctctacggctggagcaagcatatgttcgatctcgccgtggccgaacgggtcgcgcgcggcgagaagctcccgccgcaatgggccggcctgaaattcttcaacgtgttcggccccaacgagtaccacaagggctcgatgatgagcgtgctggcgcggcgcttcgacgacgtcaaggcgggccgcgtcgtgcaattgttcaagtcgcatcgcgaaggcattgccgacggcgaccagcgtcgcgatttcatctatgtcgacgacgtcgtgcgcgtcatcatgtggctgctggcaacgccctcggtgtccgggctgttcaacgtcggcaccggcaaggcgcgcagcttcaaggatctgatgctggctgcctatgcggcgctcggggcgaggcccaacatcgaatatatcgacatgcccgaacagatccgcaacagctatcaatacttcacccagagcgaggtcgatcgcctctgccgcgccggctataacggcggcttcacgacgctcgaggatgcggtgaaggcctatgtcggggattatctcgaccggcccgaccgcttccgctga

SEQ ID NO: 65125 - protein, 326 aa, Bradyrhizobium japonicum USDA 110
MLLVTGGAGFIGSNVVAALNDAGRSDVAVCDFLGTDGKWRNLAKRQLVDIAPPAELPDWLNGRRLDAVIHLGAISATTATDGDLVFETNFRLSMRLLDWCTANAVPLIYASSAATYGDGEAGFDDDASLPALKKLRPMNLYGWSKHMFDLAVAERVARGEKLPPQWAGLKFFNVFGPNEYHKGSMMSVLARRFDDVKAGRVVQLFKSHREGIADGDQRRDFIYVDDVVRVIMWLLATPSVSGLFNVGTGKARSFKDLMLAAYAALGARPNIEYIDMPEQIRNSYQYFTQSEVDRLCRAGYNGGFTTLEDAVKAYVGDYLDRPDRFR

SEQ ID NO: 65126 - DNA, 1023 bp, Bradyrhizobium japonicum USDA 110
  CDS (1)..(1023)
atgagatcaatgactgttctagtcaccggcggcgccggctatatcggaagtcacacggtcctggcgctggcggaagccggcgaggacgtcgtcgtgatcgacgatctctccaccggtttctccgcctatctgccggagggcgtgccgctgttcattggcgacgccggcgacgagaacctgctcgagggtgtgatcgcccagcacaacatcgagagcatcatccatttcgcgggctcggtggtcgtgccggattcgatgcgcgatccgctcggctactaccgcaacaacttcatgaccgcgcgcaacctgctcaacgtcgcggtcaagcgcggcattggccgtttcatcttctcctcgaccgcagcggtctacggcgatcctgaccaggtgccggtgcccgagcacgcgccgacgcggccgctgtcgccctacggctcgtccaagctgatgaccgagatcatgctgcacgacgtcgccgccgcctacggcatgcagtacgtgaccttgcgttatttcaacgtcgcgggcgccgatccgcaggcccgcatcggccttgccaccgtcggtgccacgcatctgctcaagatcgcagtcgaggccgcgaccggccagcgcgccaagatcgacgtgttcggcaccgactatccgaccccggacggcagctgcatccgcgacttcatccacgtcacggacctgtcgcaggcgcaccgctcggcgctggcttacctgcgcaatggcggcgcctcgacgacgctgaattgcggctatggccgcggctattcggtgctggagaccatcgacgcggtgcgccgggtttcgggccgcagcttcgccgtgcaatacgctccgcgccggcccggcgacatcatgaccatggtcgccgacaccagccgcatccgcggcctgctcgactggaagccgcaatatgacgacctcgagaccatcgcagcccatgcgctggcctgggaggacaagctgtaccgcgagcgccacggcgagctccgccacgccgtctcggcctag

SEQ ID NO: 65127 - protein, 340 aa, Bradyrhizobium japonicum USDA 110
MRSMTVLVTGGAGYIGSHTVLALAEAGEDVVVIDDLSTGFSAYLPEGVPLFIGDAGDENLLEGVIAQHNIESIIHFAGSVVVPDSMRDPLGYYRNNFMTARNLLNVAVKRGIGRFIFSSTAAVYGDPDQVPVPEHAPTRPLSPYGSSKLMTEIMLHDVAAAYGMQYVTLRYFNVAGADPQARIGLATVGATHLLKIAVEAATGQRAKIDVFGTDYPTPDGSCIRDFIHVTDLSQAHRSALAYLRNGGASTTLNCGYGRGYSVLETIDAVRRVSGRSFAVQYAPRRPGDIMTMVADTSRIRGLLDWKPQYDDLETIAAHALAWEDKLYRERHGELRHAVSA

SEQ ID NO: 65128 - DNA, 993 bp, Bradyrhizobium japonicum USDA 110
  CDS (1)..(993)
atgaccgaccgaccgaccgtcctcgtcacagggggcgcgggctatattggctcgcatgcctgccgcgcactgtctgccgccggctatcagcccgtcgtttatgacaatctctcgacaggtcatcgcagcttcgtcgccggccccctggtgatcggcgaccttctcgacgatgcagcgttggcgcgcgcctttgccgaccacaaggtcacggcggtgatgcatttcgcggcggcgagcctcgtcggcgaatccatgaccgatccgcagaagtactacatcaacaatgtgcagggcacgctgtcgctgctccaggcgatgcgcaacgccggctgccatcgcatcgtgttctcctcgaccggcgccgtctacggcaacgccgattccaaggagctgccggaagactttccctgcgcgccgatcaatccctatggcgcctcgaaatggatgatcgagcgcatgctcgccgactatcgcgcggcctatggcttcggcgcgttctgcctgcgctatttcaacgccagcggcgccgatccggccggcggcatcggcgaactgcgcgacaacgagacccatctcattccgcgggccatgatggccctgcagggtcatgtcgacttcgctgtgttcggcgacgactacgacacgcccgacggcaccgcgatccgcgactacatccatgtcaccgacctcgccgccgcgcatgtcgcggcgctgaagctgctggaacagggacatgccggcggcagcttcaatctcggcaccggctccggcttttcggtgcgcgagatcctcaacgccatcaggcaggagaccgggcgcgaggtgccgcacaccgtcaagccgcgccgcgccggcgatcccacctatctggtcgccgacccgtccgccgcgcgaaaagttctgaacttcgtgccgcgtcactctgacctgcctacggtcatccgcaccgcctgggcctggcaccagaaggcacatccgttcaggtcgcgttag

SEQ ID NO: 65129 - protein, 330 aa, Bradyrhizobium japonicum USDA 110
MTDRPTVLVTGGAGYIGSHACRALSAAGYQPVVYDNLSTGHRSFVAGPLVIGDLLDDAALARAFADHKVTAVMHFAAASLVGESMTDPQKYYINNVQGTLSLLQAMRNAGCHRIVFSSTGAVYGNADSKELPEDFPCAPINPYGASKWMIERMLADYRAAYGFGAFCLRYFNASGADPAGGIGELRDNETHLIPRAMMALQGHVDFAVFGDDYDTPDGTAIRDYIHVTDLAAAHVAALKLLEQGHAGGSFNLGTGSGFSVREILNAIRQETGREVPHTVKPRRAGDPTYLVADPSAARKVLNFVPRHSDLPTVIRTAWAWHQKAHPFRSR

SEQ ID NO: 65130 - DNA, 999 bp, Clostridium tetani E88
  CDS (1)..(999): transl_table=11
ttgggaggaataaatttgagtattttaatatgtggtggcgcaggatacatcggaagtcatatggtagctagacttttagaagaaaaagaagacataattatattagataattttcaaaaaggacataggaaggctatattaggggggaaagtatataaaggagatattaggaacaaagccttactagataaaatatttaatgagaactcaatagaaggagttatagattttgcagctagttctttagttagagagagtgtagaaaaacctttagagtattttgataacaatataggtggtactatagtattattaaaaagtatgatagaacataacgtgaaaaatatcgtattttcatctacagcagcaacctacggagaaccagaaaatatacctataagggaagaagataaaactaatcctactaacccctacggtgagtctaaattagctgtagaaaaaatattaaaatggtgtgataaagcttatggattaaaatacactgttttaaggtattttaatgcagcgggagcatatgacacaggaaagataggagaagaccataggccagaaactcatttaattcctataataatagaagtagctttaggaaaaagggataaaatacaagtatttgggaatgattataatacaaaggatggaacttgtataagagactatgttcacgttatggatcttacagaggctcatctcttagccatgaataaattaaagaatggaggaaaaagcggaatttataatctaggaaatggagaaggattttcagtaaaggaagtaatagatatggtccaaaaagttacaggtagaaaaataaagtgggaagtagcaaatagaagaaagggagatccgagagtattaatagcatcttctgaaaaggcaaaaacacagttaggttggcacccaaaatataattctttagaaaagattatagaaacagcttggaaatggcataaaaataacccagatggttatatgtag

SEQ ID NO: 65131 - protein, 332 aa, Clostridium tetani E88
MGGINLSILICGGAGYIGSHMVARLLEEKEDIIILDNFQKGHRKAILGGKVYKGDIRNKALLDKIFNENSIEGVIDFAASSLVRESVEKPLEYFDNNIGGTIVLLKSMIEHNVKNIVFSSTAATYGEPENIPIREEDKTNPTNPYGESKLAVEKILKWCDKAYGLKYTVLRYFNAAGAYDTGKIGEDHRPETHLIPIIIEVALGKRDKIQVFGNDYNTKDGTCIRDYVHVMDLTEAHLLAMNKLKNGGKSGIYNLGNGEGFSVKEVIDMVQKVTGRKIKWEVANRRKGDPRVLIASSEKAKTQLGWHPKYNSLEKIIETAWKWHKNNPDGYM

SEQ ID NO: 65132 - DNA, 996 bp, Lactobacillus plantarum WCFS1
  CDS (1)..(996): transl_table=11
atgtcaattttagttttagggggagctggctacattggttctcacatggtcgatcggttagtagaacacggtacggacgtcgtggtcgttgataatttggtcacgggacaccgcgctgctgttaattcggcggccaagttttatcagggtgatttgcgggatgcggattttttgaatcacgtttttgatactgaggacattgaagctgtcgtgcattttgccgccttttcaatcgtaccagaatcaatgagtaagccactgaagtactttgataacaatactggtgggatgatcacgttacttgaaacgatgcaggcccatgatgtgaagcaaatcgtcttctcatcaacggccgctacttatgggacacctaagcagattccaattaaagaaactgatccacagttaccaatcaacccgtatggcgctagcaagttaatgatggaacaaattatgcactgggcggacgttgcctatggtattaagtttgtcgcgttacgttactttaacgttgcgggtgccaagccagatggcagtattggcgaagatcatggccccgaaacacatctggttccaatcattttacaagttgcgcaaggaaaacgcgatgaacttaaaatcttcggcgatgactataatacgccggatgggacgaatgtgcgtgactatgtgcatgttgtcgacttagctgatgcacatatcttggctttgaagtacttggctgcaggaaatgacagtaatgcctttaacctgggttcttcaactggtttctctaacaaacaaatgttagcggctgctcgtgaagttaccgggcaaccaattccagctaagctagcaccacggcggcctggtgatccagactcattggttgcggcgagtgataaggcgcgtgacgtgctaggttggcaaccaaattatgacaatgttaacgatattattgaaacagcgtgggcttggacgcagaagcatcccaatggctacgatgatcgtgactag

SEQ ID NO: 65133 - protein, 331 aa, Lactobacillus plantarum WCFS1
MSILVLGGAGYIGSHMVDRLVEHGTDVVVVDNLVTGHRAAVNSAAKFYQGDLRDADFLNHVFDTEDIEAVVHFAAFSIVPESMSKPLKYFDNNTGGMITLLETMQAHDVKQIVFSSTAATYGTPKQIPIKETDPQLPINPYGASKLMMEQIMHWADVAYGIKFVALRYFNVAGAKPDGSIGEDHGPETHLVPIILQVAQGKRDELKIFGDDYNTPDGTNVRDYVHVVDLADAHILALKYLAAGNDSNAFNLGSSTGFSNKQMLAAAREVTGQPIPAKLAPRRPGDPDSLVAASDKARDVLGWQPNYDNVNDIIETAWAWTQKHPNGYDDRD

SEQ ID NO: 65134 - DNA, 948 bp, Lactobacillus plantarum WCFS1
  CDS (1)..(948): transl_table=11
atgaaagcattagtaactggaggagcaggatttattggttcccaccttgtggatcacttggtctcagaaggtttggacgttgtcgtagttgataacttgtccatgggggacttgcataatattaagtatcaggatgaagtcactatttatgttgaagatgtccgcaacgaaaaattcatgcaacaattgctacaggaagaacggcctgattatatttactttttagcagctgttgctagtgttgccgattcgattgaacgtccagctgaaacccattcagtgaatcaaactgcagtattcaatatgttggaatatattcggaagactaatttaccaattaaacagttcctatttacgtcttcggcagctgtttacggtaatcttccagaattacctaagaaagaagactcacgagttgatccattatcaccatatgcgattgataagtatgctacggaacgttttgtactagcatatggtgaactttatgatttaccaactgtctgtgtgcgtttcttcaatgtttatggccctggtcaaaatcccagttcgccatattcaggggtgctgtcgatcttgaccgattgtctcaataacaagaagccatttaccttgtacggagacgggagtcagacgcgagattttgtgtatgttgaagatgttatccaagcattatggttgataacgaaaagtgatactgagcatgaagtctttaatatcgctaatggtaatgaagccagcttaaatgctattattgaaacatatgagaaggttgcagaaacgtcattgcagattaaaaaggcgccagggcgtgaaggggaagtaaaacgttcggtggccaacatcggtaagttaattaagttgggatacacgacgaagtggtcgttagaagcgggcttgagcaaatattgggaaggggcgcaacaacgtgaagcaagtcgaaattaa

SEQ ID NO: 65135 - protein, 315 aa, Lactobacillus plantarum WCFS1
MKALVTGGAGFIGSHLVDHLVSEGLDVVVVDNLSMGDLHNIKYQDEVTIYVEDVRNEKFMQQLLQEERPDYIYFLAAVASVADSIERPAETHSVNQTAVFNMLEYIRKTNLPIKQFLFTSSAAVYGNLPELPKKEDSRVDPLSPYAIDKYATERFVLAYGELYDLPTVCVRFFNVYGPGQNPSSPYSGVLSILTDCLNNKKPFTLYGDGSQTRDFVYVEDVIQALWLITKSDTEHEVFNIANGNEASLNAIIETYEKVAETSLQIKKAPGREGEVKRSVANIGKLIKLGYTTKWSLEAGLSKYWEGAQQREASRN

SEQ ID NO: 65136 - DNA, 942 bp, Lactobacillus plantarum WCFS1
  CDS (1)..(942): transl_table=11
atgaaggcattggtaacgggaggtgcggggttcattggctcgcacttggttgatcatttagttgaatctggctttgaggtggtggtggtagacgatctgtcaatgggggccatcagcaatatcaagcattgggaacagattacgatatacgtcgcggatgtctgtgacgataaattcatgcaacaattgttagcagacgaacggccagactatatttattttctggcagcgattgcaagtgtggcggattcgattgagcggccggcagaaacgcatgctgtcaatcataccgcggtatttaacttgctcgagcatattcgccaaattcgcttgcctattaagcaatttctattcacttcttcggcggcggtttatggcaatctacctgaattaccaaaacgcgaggattcgcgcgtcgcacccgtgtcaccgtatgctattgataagtatgcgactgaacgttttgtattggcatacggtgagttgtacgatttgccgaccgtttgtgtgcggttcttcaacgtttatggaccgcgtcagaatccaagctcaccgtattcgggggttttgtcgattttgacggattgtttgaaaacacagcgaccatttacattattcggtgatggaacgcagacccgtgattttgtatatgtaagtgatgttatcaaggcattatggttgattacagaacatcaagtgcaacatgaagtgatcaatattgccaatggcttagaaactagtttaaatggcattattcagatgtatcaagagattgctggtcaacaacttgaaatcaaacgggccgagcagcggggtggtgaagttgatcattcagttgcaagtattggcaagttggcacgcttaaattatgaatcagagtggccgttgagaagaggattaaccaagtactgggaaggggaatgtgagcatgcacgaagttga

SEQ ID NO: 65137 - protein, 313 aa, Lactobacillus plantarum WCFS1
MKALVTGGAGFIGSHLVDHLVESGFEVVVVDDLSMGAISNIKHWEQITIYVADVCDDKFMQQLLADERPDYIYFLAAIASVADSIERPAETHAVNHTAVFNLLEHIRQIRLPIKQFLFTSSAAVYGNLPELPKREDSRVAPVSPYAIDKYATERFVLAYGELYDLPTVCVRFFNVYGPRQNPSSPYSGVLSILTDCLKTQRPFTLFGDGTQTRDFVYVSDVIKALWLITEHQVQHEVINIANGLETSLNGIIQMYQEIAGQQLEIKRAEQRGGEVDHSVASIGKLARLNYESEWPLRRGLTKYWEGECEHARS

SEQ ID NO: 65138 - DNA, 1005 bp, Lactobacillus plantarum WCFS1
  CDS (1)..(1005): transl_table=11
atggcagttttagttttaggtggtgccggctacatcggttcacacgcagttgatcggttggttgcaaaggggtatgacgtggcggttgttgataacttggtcacggggcaccgggcagcggtcaatgaacacgcgcgtttttatgaaggtgatgtccgggatacggcgttcatgaataccgtgtttgaccaagaaaacgttgaaggtgtcattcattttgcagctttctcagttgttcctgaatcgatgaaagatccgctcaagtactttgataacaacacggcagggatggttaagttgctcaaagtgatggctaagcacgatgtgaagaaaatcgtcttctcatcgaccgcagcaacttatggtgaacctaagcaggtgccaatcaaggaatcggacccacaagtgccaactaacccatacggtgaaagtaaattagcgatggaaaagatcatgcactggtcagatgtggcttacgggattaaattcgtggccttacgttactttaacgtggcgggggctaagcctgacggcagcatcggcgaagatcacgcaccagaaacgcatctcgtcccaattattttacaagtagctgctggtgaacgggatcaattacaaatcttcggtgacgactatccaactccagacgggaccaatgttcgggactatgttcacgttgtcgatttagctgatgcacatatcttagccttggaatacctaaagcaggggcacgatagcgatgcgtttaacttgggttcttcaacgggcttctccaacaaacaaatgttggacgctgctcgtgaagtcactggtaagccaattccagcagtcatggcaccacgccgcgctggtgatccaagcacattggttgcagctagcgacaaggcacgtactgttttaggttggacacctcagtatgatgatgtgaaagaaattatcaagacggcttggacttggaaagaaagtcatccggccggctatgatgatcggggaggccaagcataa

SEQ ID NO: 65139 - protein, 334 aa, Lactobacillus plantarum WCFS1
MAVLVLGGAGYIGSHAVDRLVAKGYDVAVVDNLVTGHRAAVNEHARFYEGDVRDTAFMNTVFDQENVEGVIHFAAFSVVPESMKDPLKYFDNNTAGMVKLLKVMAKHDVKKIVFSSTAATYGEPKQVPIKESDPQVPTNPYGESKLAMEKIMHWSDVAYGIKFVALRYFNVAGAKPDGSIGEDHAPETHLVPIILQVAAGERDQLQIFGDDYPTPDGTNVRDYVHVVDLADAHILALEYLKQGHDSDAFNLGSSTGFSNKQMLDAAREVTGKPIPAVMAPRRAGDPSTLVAASDKARTVLGWTPQYDDVKEIIKTAWTWKESHPAGYDDRGGQA

SEQ ID NO: 65140 - DNA, 930 bp, Pseudomonas syringae pv. tomato str. DC3000
  CDS (1)..(930): transl_table=11
atgtctgacgctcctgttctgatcactggaggtgcgggtttcatcggctcgcacctgaccgacgcattgctcgccagcgggcacagcgtgcgcatcctcgacaacctttcggcgggcaagcgcagcaacctgccgctggacaatccacgggttgaactgatcgaaggcgatgtggccgatgccgaactggtcaagcgtgtggcgcagggctgcaaggcggtcgttcatctggcggcggtggcctcggtgcaggcgtcagtcgatgacccggtgcgcacccatcaaagcaatttcatcggcacgctgaatgtctgcgaagcgatgcgcgaggcgggtatcaagcgggtgatcttcgcgtccagcgcagcggtttacggcaacaatggcgaaggcgaagcgatcaccgaagacaccaccaaagcaccgctgaccccttatgcttcggacaaactggccagcgagttctacctggacttctaccgccgccagcatggcctggagccggtgatctttcgcttcttcaacatcttcggcccgcgccaggacccgtcgtcgccgtattccggcgtcatcagcatctttgccgagcgcctccagaacggcttgccgatcctcgtgtttggcgatggcgagcagacacgcgatttcttctacgtgggcgatctgctcaagctgctgttgcaggctctgtcacgagacagcgccatcgaaggcgcgatcaacgtcggattgaacaacaccacctcgctcaatgaactgttgtcggcactgtcgcacgtggttggcaaacagccgcaagtcacctaccaggcgccacgttcgggagacatcaaacactcccgcgccagtaatcggcgactgctggaacacttcaccctcgatgaagtcactcccttgaagcgcgggcttgagttgctgatagggcagtga

SEQ ID NO: 65141 - protein, 309 aa, Pseudomonas syringae pv. tomato str. DC3000
MSDAPVLITGGAGFIGSHLTDALLASGHSVRILDNLSAGKRSNLPLDNPRVELIEGDVADAELVKRVAQGCKAVVHLAAVASVQASVDDPVRTHQSNFIGTLNVCEAMREAGIKRVIFASSAAVYGNNGEGEAITEDTTKAPLTPYASDKLASEFYLDFYRRQHGLEPVIFRFFNIFGPRQDPSSPYSGVISIFAERLQNGLPILVFGDGEQTRDFFYVGDLLKLLLQALSRDSAIEGAINVGLNNTTSLNELLSALSHVVGKQPQVTYQAPRSGDIKHSRASNRRLLEHFTLDEVTPLKRGLELLIGQ

SEQ ID NO: 65142 - DNA, 999 bp, Pseudomonas syringae pv. tomato str. DC3000
  CDS (1)..(999): transl_table=11
atgacggtgctcgtgacaggcgccgccggattcattggcttccacgttgccaaacatctgtgtgagcagggtattgaagttgtcggcatcgataacctgaacgattactacagcgtcgaactgaaacattcacgactggccatccttgagcgcatgccaggtttcgtcttcaaaaggctggacattacggatgcaacgggtctgtccactctgttcgaacacaataccttcgaacaggtcattcacctcgccgcccaggcgggtgtgcgctattcgatggagcaacccgacgcctacatccaatccaatctggtcggtttcagcaacgtgctcgaggcctgccgccagcaccgcccctcgcacctgatttatgcctccagcagttcggtctacggggccaatacgcgcctgccgtttcgggtggaggatgccgtcgacaggccgctctccctctatgcggccacaaagcgcgccaatgagctggcggcttacagctactgccacctgtacggcttgcgagctaccgggctgcgctttttcacggtttacggcccctggggtcgaccggacatggcgctgttcaagttcacccaagccatgctccgcgaagagcctgtggacatttacaaccatggtgagatggcgcgggatttcacctacatcgacgacatcgtggaaagcatcctacgcctgcgtctgcgcccgcccgagccagcgggcggtgagcctgcacatcagctcttcaacatcggacgcggccagcccgtcaagctgctggagttcgtcgattgcctggaaaaggcgctgggcctcaaggcccagcgtcgctatctccctctgcaggcaggcgatgtactgcagacctgggctgacgttaccgccttggcccgttggatcgatttccagccgcacgtctcggtcgacagcggtgtgagcgcgttcgttgagtggtaccgagagcattatcaatccggaccgcctccgctatctctccaataa

SEQ ID NO: 65143 - protein, 332 aa, Pseudomonas syringae pv. tomato str. DC3000
MTVLVTGAAGFIGFHVAKHLCEQGIEVVGIDNLNDYYSVELKHSRLAILERMPGFVFKRLDITDATGLSTLFEHNTFEQVIHLAAQAGVRYSMEQPDAYIQSNLVGFSNVLEACRQHRPSHLIYASSSSVYGANTRLPFRVEDAVDRPLSLYAATKRANELAAYSYCHLYGLRATGLRFFTVYGPWGRPDMALFKFTQAMLREEPVDIYNHGEMARDFTYIDDIVESILRLRLRPPEPAGGEPAHQLFNIGRGQPVKLLEFVDCLEKALGLKAQRRYLPLQAGDVLQTWADVTALARWIDFQPHVSVDSGVSAFVEWYREHYQSGPPPLSLQ

SEQ ID NO: 65144 - DNA, 1011 bp, Vibrio parahaemolyticus RIMD 2210633
  CDS (1)..(1011): transl_table=11
atgaagtacttagttacaggtgcggcaggttttattggtagtgcaactattagaaaactaaactcattaggatatgaggttataggtattgacaatatcaatgactattatgatgttgagttaaagtatgcaagattgaattttataaaaaatccattatttcgattctttaatatggatatatcaaataaaaataaaaatgaaatagaacgtttatttgagaaagaaaagtttgacagagttatccatcttgccgcacaggctggtgttagatattcacttgtaaacccacattgttacgctgaatcgaatttaagtggatttttaaacgtcttagaagcttgtcgtaaaagccatatcaagcatttcatatatgcatcttccagctccgtttacggcttaaacaagaaagtgcctttctctacatcggataatgttgatcaccccgtttctttatatgcagcgactaaaaaatctaatgaattgatggcgcatagttattctcatctctatcaacttcctacaacaggcttacgtttttttactgtgtatggttcttggggacgtccagatatggcgccttttatctttactgagaaaataattaacggtcagtctattgatattaataataacggtgatatgtggagggactttacccatattaatgacattgtcgaagggatagtcagaatttctgatgtcataccaagaattaatcagcgatggcagtttgaaaatagtactccagcggatagttctgctccttattctatttacaatattggttatggttcaccgatttgtttgatggattttatcaaagcaatagaaaatgaactcggaatagaagcaaagaaaaattatcgagagatgcagccaggagatgtataccaaacctatgctgatacaacagctttctatcaagccactggttaccggccgtcagtttccgtagaagaaggcattgccgagtttgtcgcttggtaccggaatttttataacaagtaa

SEQ ID NO: 65145 - protein, 336 aa, Vibrio parahaemolyticus RIMD 2210633
MKYLVTGAAGFIGSATIRKLNSLGYEVIGIDNINDYYDVELKYARLNFIKNPLFRFFNMDISNKNKNEIERLFEKEKFDRVIHLAAQAGVRYSLVNPHCYAESNLSGFLNVLEACRKSHIKHFIYASSSSVYGLNKKVPFSTSDNVDHPVSLYAATKKSNELMAHSYSHLYQLPTTGLRFFTVYGSWGRPDMAPFIFTEKIINGQSIDINNNGDMWRDFTHINDIVEGIVRISDVIPRINQRWQFENSTPADSSAPYSIYNIGYGSPICLMDFIKAIENELGIEAKKNYREMQPGDVYQTYADTTAFYQATGYRPSVSVEEGIAEFVAWYRNFYNK

SEQ ID NO: 65146 - DNA, 1074 bp, Bacteroides thetaiotaomicron VPI-5482
  CDS (1)..(1074): transl_table=11
atggtaacatacaatgttagtttagagaacaaagtggttctagtgacgggtgcagccggttttattggagccaatttggtaaaacgtttgctgaatgagtttgataccgtgaaagtcatcggtattgataatattaccgaatactatgacgtacgtttaaagtatgaacgcttacaagaattgtctgcttacggtgacagatttgttttcataaaagacagtattgctaaaaaggaaattgttgagtctattttcactaactaccatcctcaggtagtcgtgaaccttgctgcacaagccggtgtacgctatagcatcactaaccctgatgcctatattgaaagtaatcttattggattttataacatcttagagtcctgtcgtcatcatagcgtggagcatttagtatatgcttcttccagtagtgtgtatgggtgcaataagaaagtgccttatagtaccgatgataaggtagataatccagtatcactttacgctgctactaaaaagagcaatgagttaatggctcatgcttatagcaagctctataacataccaagcacaggtctgcgattcttcaccgtttacggtccctgcggtcgtcctgatatggcttattttagctttaccaacaagctattaaagggtgagaccatacaaatttataattacggcaattgtaagcgcgactttacttatatagacgatattgtagaaggcatagttcgtattatgcagcatgcaccggagaaacggaatggtgaggatggacttccggtgccaccgtataaggtatataacattgggaataactcacctgaaaatcttcttgatttcgttactatccttcaggatgaacttatccgtgcaggtgtacttcccaactactatgactttgaatcctacaaagaactagtaccgatgcaacctggagatgtgcctgtgacatatgctgatactactcctttgcagcaagattttggatttaaaccgtcaacatcattacgtgagggattgaggaagtttgcagggtggtatgctaagtattatggcacattcaaataccatccatag

SEQ ID NO: 65147 - protein, 357 aa, Bacteroides thetaiotaomicron VPI-5482
MVTYNVSLENKVVLVTGAAGFIGANLVKRLLNEFDTVKVIGIDNITEYYDVRLKYERLQELSAYGDRFVFIKDSIAKKEIVESIFTNYHPQVVVNLAAQAGVRYSITNPDAYIESNLIGFYNILESCRHHSVEHLVYASSSSVYGCNKKVPYSTDDKVDNPVSLYAATKKSNELMAHAYSKLYNIPSTGLRFFTVYGPCGRPDMAYFSFTNKLLKGETIQIYNYGNCKRDFTYIDDIVEGIVRIMQHAPEKRNGEDGLPVPPYKVYNIGNNSPENLLDFVTILQDELIRAGVLPNYYDFESYKELVPMQPGDVPVTYADTTPLQQDFGFKPSTSLREGLRKFAGWYAKYYGTFKYHP

SEQ ID NO: 65148 - DNA, 1065 bp, Bacteroides thetaiotaomicron VPI-5482
  CDS (1)..(1065): transl_table=11
atggtaacatacaatgttagtttagagaacaaagtggttttggtgactggtgcagccggttttatcggagccaatttggtgaaacgtttgctaaatgagtttgatagcgtgaaagtcatcggtattgatagtattaccgaatactatgacgtacgtttaaagtatgaacgcttacaagaattgtctgcttacggtgacagatttgttttcataaaagacagtattgctaaaaaggaaattgttgagtctattttcactaactaccatcctcaggtagtcgtgaatcttgctgcacaagctggtgtacgttatagcatcactaaccctgatgcttatattgaaagtaaccttattggattttataacatcttagagtcctgtcgtcatcatagcgtggagcatttagtatatgcttcttccagtagtgtgtatggaagcaataagaaagtgccttatagtaccgatgataaggtggacaatcctgtatcactctatgctgctactaaaaagagcaatgagttaatggctcatgcttatagcaagctctataacataccaagcacaggtctgcgattcttcaccgtttacggtccctgcggtcgtccagatatggcatattttggctttaccaacaaacttcgtgagggtaagaccatccaaatattcaattacggcaactgtaaacgcgacttcacctatgttgatgatattgtagagggtattgtctgtatcatgcagcatgctcctgagaagaaaaatggcgaggacggacttccaatcccaccatacaaggtatataatattggtaacaactcacctgagaatctccttgatttcgtgaccattcttcaagaagagctcatagcagccaaggtacttcctgatgattacgattttgagacacacaaagaattagtgccaatgcagccaggtgatgtttctgtcacctatgctgacacaacttcattggaacaagattttggcttcaagccatcaatctcactacgtaagggcttaagggctttcgctcaatggtactcgaagtactataagtgtgaagagtag

SEQ ID NO: 65149 - protein, 354 aa, Bacteroides thetaiotaomicron VPI-5482
MVTYNVSLENKVVLVTGAAGFIGANLVKRLLNEFDSVKVIGIDSITEYYDVRLKYERLQELSAYGDRFVFIKDSIAKKEIVESIFTNYHPQVVVNLAAQAGVRYSITNPDAYIESNLIGFYNILESCRHHSVEHLVYASSSSVYGSNKKVPYSTDDKVDNPVSLYAATKKSNELMAHAYSKLYNIPSTGLRFFTVYGPCGRPDMAYFGFTNKLREGKTIQIFNYGNCKRDFTYVDDIVEGIVCIMQHAPEKKNGEDGLPIPPYKVYNIGNNSPENLLDFVTILQEELIAAKVLPDDYDFETHKELVPMQPGDVSVTYADTTSLEQDFGFKPSISLRKGLRAFAQWYSKYYKCEE

SEQ ID NO: 65150 - DNA, 1062 bp, Bacteroides thetaiotaomicron VPI-5482
  CDS (1)..(1062): transl_table=11
atgaaagtattagttacaggggctgctggatttattggtagttttacttcaaaaaagctgttagagcaaggacatgaagttgtgggtttggataatctgaatgattattatgatactagtttgaaatatggacgtttggcgaatttagggattaataaagatgaaataggttggtataaatatactcgaagttcttattatacagccttcaactttattcgtatgaatcttgaagataggcaagcagtacaaatgttgtttgcaaatggcgattttgattgtgtatgtaatttggctgctcaagcaggggtgcgctattctattgagaatccttatgcatatattgaaagtaacatagatggctttttgaatatattggaagggtgccgaaattcaaaggttagccatcttatttatgccagctcaagtagtgtttatggtttaaatggtaatgtacctttttcagagaaagatagtattgctcatcctgttagtttgtacgctgcttcaaagaaagctgatgaattaatggctcatgcatatagccatttatataatattccgactactggattgcgcttctttaccgtttatggtccatggggacggccagatatgtctccattcttatttgctgatgcaattcttcatcatcgggctattaaagtttttaataacggaaatatgtttcgtgactttacgtatattgatgatataatcgaaggaataatcagggttatgcaacatgttccaataggtaataagaattggaagcctgaaaacccttcccctgattcttcttcagcaccttataaaatatataatattggaaactctcgtcctgtgaaactaatggattttatccaagctattgaaaatgcgataggtagagaggcggaaaaaatatatcttccgatgcagcctggagatgtatatcaaacgtatgccgatataactagtcttgagcatgatacaggatttaagccagatacatctttgcttgagggagtgaggaaaacaatagattggtattgtgatttttataaattagatagtaaatag

SEQ ID NO: 65151 - protein, 353 aa, Bacteroides thetaiotaomicron VPI-5482
MKVLVTGAAGFIGSFTSKKLLEQGHEVVGLDNLNDYYDTSLKYGRLANLGINKDEIGWYKYTRSSYYTAFNFIRMNLEDRQAVQMLFANGDFDCVCNLAAQAGVRYSIENPYAYIESNIDGFLNILEGCRNSKVSHLIYASSSSVYGLNGNVPFSEKDSIAHPVSLYAASKKADELMAHAYSHLYNIPTTGLRFFTVYGPWGRPDMSPFLFADAILHHRAIKVFNNGNMFRDFTYIDDIIEGIIRVMQHVPIGNKNWKPENPSPDSSSAPYKIYNIGNSRPVKLMDFIQAIENAIGREAEKIYLPMQPGDVYQTYADITSLEHDTGFKPDTSLLEGVRKTIDWYCDFYKLDSK

SEQ ID NO: 65152 - DNA, 960 bp, Enterococcus faecalis V583
  CDS (1)..(960): transl_table=11
gtgaagaaactattaattactggaggagctggctttattggttctaatttggctaatttttatagtcaacagtatcaagtttttgtgattgatgatttgtccatggggcgagtgtcaaatttgcaacaaactgagcagttggtttttattaaaggaagtgtgacggatcagcaattattggacgaagtactttcaaagcattcgtttgagtatatctttcatcttgcggccgtggcaagcgtggcaagttctgtggcacagcctctagagacccatgaggtcaattttttaagtgtattgaaaatactggaatcaataaaaaaatatcaaaaaaagctcaaacgttttgtttttgcttcgtcagcagccgtttacggtgcagagccaacgttgcctaaaagagaaacttcggtgatttgccctttgagtccctatgctattgataagtttgctgctgaacgttatgttctcaatgaataccatttacacggggtacccacgagcgcagttcgcttctttaacgtctatggtctcaatcaaaatcctgcttcaccctattctggtgtcctgtccattttgatggatcgttatatccaattagagcaagggcaagtgagccaatttcaaatatttggagatggtcagcaaacacgtgactttatctacattgaggatgtcctaactgcattaaatttagtagcaaccaaaagtgaagcgttgggacatgtttataatgtgggtaccgaagttgccatttcccttaatcaattaattgaagaaatgaaccaattagtgggactttctttgccagtttcttatcaaaaggaacgagatggcgatataaaatattctctttcagatagttctgctttgaaaggcttaggtttttcgcccgtttattcaattcaagaaggacttcaaaaatatcttaagtttacccataatacccaaaatagataa

SEQ ID NO: 65153 - protein, 319 aa, Enterococcus faecalis V583
MKKLLITGGAGFIGSNLANFYSQQYQVFVIDDLSMGRVSNLQQTEQLVFIKGSVTDQQLLDEVLSKHSFEYIFHLAAVASVASSVAQPLETHEVNFLSVLKILESIKKYQKKLKRFVFASSAAVYGAEPTLPKRETSVICPLSPYAIDKFAAERYVLNEYHLHGVPTSAVRFFNVYGLNQNPASPYSGVLSILMDRYIQLEQGQVSQFQIFGDGQQTRDFIYIEDVLTALNLVATKSEALGHVYNVGTEVAISLNQLIEEMNQLVGLSLPVSYQKERDGDIKYSLSDSSALKGLGFSPVYSIQEGLQKYLKFTHNTQNR

SEQ ID NO: 65154 - DNA, 990 bp, Enterococcus faecalis V583
  CDS (1)..(990): transl_table=11
atgtctattttagtattaggtggcgcaggctacatcggctcacatgccgtcgatcaattaatttcaaaaggctatgccgttgttgttgttgataatttattaacggggcatcgttcagcagttcatgaacaagcgactttctatgaaggcgatattcgtgataaagcttttttacgtagtgtctttgaaaaggaatcaattgaaggggtgttgcactttgcggccaattctttagtaggagaatccgtggagaaaccgttaatgtatttcaataacaatgttcacggcactcaaattgccttggaagtcatgcaagaattcggagtgaaacacattgttttttcttccacagcggccacttatggcgaaccaaaagcaatgcctattacagaagaaaccccaacgaatcctaaaaacccgtatggggaaagtaaattaatgatggaaaaaatcatgaaatggtgcgacaacgcttatgaaatgaaatatgttgctttgcgttattttaatgttgcaggagcaaaaaaagatgcctcaattggtgaggatcacacgccagaaacgcatattgtgccaattattttacaagtggcattgggccaacgagcagagctaagtatttttggggatgattatgatacaccagatggcacgtgcattcgagattatgtttacattgaagacttgattgcagcacatattttggctttagaatacttgaaaaatggcggcgaaagtgacgtctttaacctgggtagcaacaacggctattctgttaaagaaatgttagatgctgctcgcgaagtgacaggtcaagaaattcctgcgacaatcgccccacgccgagcaggggatcctagtacgttaattgcttctagtgaaaaagccaaacgagttttaggctggcaaccagaagtaactgaggtcaaggatattatcgccaccgcttggcaatggcatgtgaaacatcctcaaggctataatgaatag

SEQ ID NO: 65155 - protein, 329 aa, Enterococcus faecalis V583
MSILVLGGAGYIGSHAVDQLISKGYAVVVVDNLLTGHRSAVHEQATFYEGDIRDKAFLRSVFEKESIEGVLHFAANSLVGESVEKPLMYFNNNVHGTQIALEVMQEFGVKHIVFSSTAATYGEPKAMPITEETPTNPKNPYGESKLMMEKIMKWCDNAYEMKYVALRYFNVAGAKKDASIGEDHTPETHIVPIILQVALGQRAELSIFGDDYDTPDGTCIRDYVYIEDLIAAHILALEYLKNGGESDVFNLGSNNGYSVKEMLDAAREVTGQEIPATIAPRRAGDPSTLIASSEKAKRVLGWQPEVTEVKDIIATAWQWHVKHPQGYNE

SEQ ID NO: 65156 - DNA, 975 bp, Enterococcus faecalis V583
  CDS (1)..(975): transl_table=11
gtgggaaacttgaggaactttttaatcacaggcggcgccggctttatcggctcaaccttagcaaattattatagtaaagacaatcaagttgtggtcattgatgatttatcaatgggccaaactgaaaatttaaacgcatctgaaaacatcacgttcattgaaggtagcgtgactgatcaacaattaatggaaaaagtattacaagagtatcagttcgattacatttttcacttagccgcgattgctagtgtagcagactcagtagcacgtccagtggaaacacaccaagtgaattttgagagtgtgttacaattactggaattaattcggaaataccagaaagatttaaaacgtttggtgtttgcttcttctgcagcggtttacggcgatgagccaactttaccaaaacaggaagaatcagtaattcgtccgttaacgccttatgctgtggataaatttgcttctgaaaaatatgtgttaaactattgtcatttatatgatgttccaacaagcgctgttcgcttctttaacgtttatgggccaaaccaaaaccctaattcgccttattctggcgttatttcgattgtgatggactcttacaaacgcttattagccaatcaagaagtgacattcaatatctttggcgatggaaaacaatctcgtgattttgtctttgttgaggacgtggttcaagcattgaatcttgtcgctcattctgaccaatcacttggggaagtgtataatgtcgggactgggaaagcaaccgatttaaatgagttaatttcttctttaaatgatattatgaaagtcactttgccagttgaatacaaagaagcgcgagctggggacatcaaagattccttagcggatatatctaaattacgtgccattggttatgaaccgaaatatagtattcaatctggtttggataaatatgttaagtatgaactaaaagcggaaggtaagcagagatga

SEQ ID NO: 65157 - protein, 324 aa, Enterococcus faecalis V583
MGNLRNFLITGGAGFIGSTLANYYSKDNQVVVIDDLSMGQTENLNASENITFIEGSVTDQQLMEKVLQEYQFDYIFHLAAIASVADSVARPVETHQVNFESVLQLLELIRKYQKDLKRLVFASSAAVYGDEPTLPKQEESVIRPLTPYAVDKFASEKYVLNYCHLYDVPTSAVRFFNVYGPNQNPNSPYSGVISIVMDSYKRLLANQEVTFNIFGDGKQSRDFVFVEDVVQALNLVAHSDQSLGEVYNVGTGKATDLNELISSLNDIMKVTLPVEYKEARAGDIKDSLADISKLRAIGYEPKYSIQSGLDKYVKYELKAEGKQR

SEQ ID NO: 65158 - DNA, 993 bp, Enterococcus faecalis V583
  CDS (1)..(993): transl_table=11
atgtctattttagtattaggtggcgcaggctacattggctcacatgccgtcgatcaattaatttcaaaaggatatgccgttattgttgttgataatttattaacgggatatcgttcagcagttcatgaacaagcgactttctatgaaggcgatattcgtgataaagcttttttacgtagcgtctttgaaaaggaatcaattgaaggggtgttgcactttgcggccaattctttagtaggagaatccgtggagaaaccgttaatgtatttcaataacaatgttcacggcactcaaattgcgttggaagtcatgcaagaattcggggtgaaacacattgttttttcttccacagcggccacttatggcgaaccaaaagcaatgcctattacagaagaaaccccaacgaatcctaaaaatccgtatggggaaagtaaattaatgatggaaaaaatcatgaaatggtgcgacaacgcttatgaaatgaaatatgttgctttgcgttattttaatgttgcaggagcaaaaaaagatgcctcaattggtgaggatcacacgccagaaacgcatattgtgccaattattttacaagtggcattaggccaacgagcagagctaagtatttttggggatgattatgatacaccagatggcacgtgcattcgagattatgtttacattgaagacttgattgcagcacatattttggctttagaatacttgaaaaatggtggcgaaagtgacgtctttaacctgggtagcaacaacggctattctgttaaagaaatgttagatgctgctcgcgaagtgacaggccaagaaattcctgcaacaatcgccccacgccgagcaggggatcctagtacgttaattgcttctagtgaaaaagccaaacgagttttaggctggcaaccagaagtaactgaggtcaaggatattatcgccaccgcttggcaatggcatcaagctcatccacatggatatcaagaaaagtaa

SEQ ID NO: 65159 - protein, 330 aa, Enterococcus faecalis V583
MSILVLGGAGYIGSHAVDQLISKGYAVIVVDNLLTGYRSAVHEQATFYEGDIRDKAFLRSVFEKESIEGVLHFAANSLVGESVEKPLMYFNNNVHGTQIALEVMQEFGVKHIVFSSTAATYGEPKAMPITEETPTNPKNPYGESKLMMEKIMKWCDNAYEMKYVALRYFNVAGAKKDASIGEDHTPETHIVPIILQVALGQRAELSIFGDDYDTPDGTCIRDYVYIEDLIAAHILALEYLKNGGESDVFNLGSNNGYSVKEMLDAAREVTGQEIPATIAPRRAGDPSTLIASSEKAKRVLGWQPEVTEVKDIIATAWQWHQAHPHGYQEK

SEQ ID NO: 65160 - DNA, 1035 bp, Coxiella burnetii RSA 493
  CDS (1)..(1035): transl_table=11
atgaggaaacctattgcgatagtgaccggaggagctggttttattggcagccatatggttgatctgttattggattgtggttttcaggtgcgcgtgatcgacaatttaaagggcggtcatcgacgtaacttagaacatcgggcgaataatcctgatttaactttcgaaattaaggatatttgtgagttgtcagcgccgcatccgctgtttgaaaatgttgattatgttttccacttcgccggcattggtgatatcgttccttctattgaaaaccccattgattatttacaaactaatgtgatgggtacggtgcgcgtgttagaatgcgcgcgcgcggcgaatgtcaaaaaattggtttatgcagcttcttcgtcttgttatggtttggcggatgtgcctacacgagaagatcatcccattgctccccaatatccttatgctttatctaaatacctcggagaggaagcggcttttcactggtttcaagtttacggcttgcctgtgaattctattcgtatttttaatgcttacgggactcgtgtgcgaacaacaggcgtctatggtgctgtatttggtgtattttttaaacaaaaattagccgataaacccttcactgtggtaggcgatgggacccaacggcgtgatttcctttatgtcaccgatgttgcgcgagcatttttaaaggcagcagaaaccaggaaagtcggagaaacttggaatttaggtgctggtaatccgcagtctatcaatcggctggtggagttaattggtggggaagttgaatatataccaaaacgacccggggaaccggattgtacatgggctgatatcagtaaaattaaacgcgatttaggttgggaaccgacaataacctttgctgatggtgttagtcgtatgatgagtgaaattggtgtctggcatgatgcgcccctttggaataaagagtccattgctaatgcaacggcgacatggtttaaatacttagggaaaaataaaaaggaaaaagctgatgttgctgaaacgataccgtcataa

SEQ ID NO: 65161 - protein, 344 aa, Coxiella burnetii RSA 493
MRKPIAIVTGGAGFIGSHMVDLLLDCGFQVRVIDNLKGGHRRNLEHRANNPDLTFEIKDICELSAPHPLFENVDYVFHFAGIGDIVPSIENPIDYLQTNVMGTVRVLECARAANVKKLVYAASSSCYGLADVPTREDHPIAPQYPYALSKYLGEEAAFHWFQVYGLPVNSIRIFNAYGTRVRTTGVYGAVFGVFFKQKLADKPFTVVGDGTQRRDFLYVTDVARAFLKAAETRKVGETWNLGAGNPQSINRLVELIGGEVEYIPKRPGEPDCTWADISKIKRDLGWEPTITFADGVSRMMSEIGVWHDAPLWNKESIANATATWFKYLGKNKKEKADVAETIPS

SEQ ID NO: 65162 - DNA, 993 bp, Coxiella burnetii RSA 493
  CDS (1)..(993): transl_table=11
atggatattcgaggtaaaaaatttgtagtcattggtggcgccggtttgattggttcgcatacagtggatcggcttttgcaagaagatgtggccgaagtcattatttacgacaattttgtgcgaggaactcgggaaaatttggctcaggcactgcgtgatccacggactaaaatttatgatattggtggtgatattaatcaaaccgatattttaaatacagcattaaaaggggttgatggtgtttttcattttgccgcgctgtggttgttgcaatgttatgaatatcctcgttccgcctttcagacaaatattcagggaacgtttaatgtattagaaacgtgtgtggcgcagggcgttaaaagattagttttttcttcttcagcttcggtgtatggagatgcgttagaagagccaatgaccgaagcacatccatttaatagtcggactttttacggggctactaaaattgctggcgaagcgatggcgacggcttatcaccatcgttatgggttgccttttgtcggattgcgctacatgaatgtctatggtccgcgtcaagattatcgcggggcttatattgcagtgattatgaaaatgctagatgcgttggataaaggacaaccgatgacgctctatggagatggatcacaggcttatgattttgtgtacgttgaagattgtgctgcagcgaatatttgtgcgatgaaagcggatacggtggatgaatattacaatgtgggtaccggaaaacgcacaagtattttagagcttgctaaagaaattcaaaaaatcactggaacttccgataacattcaatttttaccgcaaggaactacttttgtaaaaaatcgcattggttgtcctaaaaaagcagcggagcaaattggttttaaggcagaagtgggtttaaccgaaggattacaaagattaattgaatggcgtcgttcgcatattgctgaggtagagcaacgtcgagaggtggccatttcatga

SEQ ID NO: 65163 - protein, 330 aa, Coxiella burnetii RSA 493
MDIRGKKFVVIGGAGLIGSHTVDRLLQEDVAEVIIYDNFVRGTRENLAQALRDPRTKIYDIGGDINQTDILNTALKGVDGVFHFAALWLLQCYEYPRSAFQTNIQGTFNVLETCVAQGVKRLVFSSSASVYGDALEEPMTEAHPFNSRTFYGATKIAGEAMATAYHHRYGLPFVGLRYMNVYGPRQDYRGAYIAVIMKMLDALDKGQPMTLYGDGSQAYDFVYVEDCAAANICAMKADTVDEYYNVGTGKRTSILELAKEIQKITGTSDNIQFLPQGTTFVKNRIGCPKKAAEQIGFKAEVGLTEGLQRLIEWRRSHIAEVEQRREVAIS

SEQ ID NO: 65164 - DNA, 1005 bp, Coxiella burnetii RSA 493
  CDS (1)..(1005): transl_table=11
atgcgaacattagtcacgggctgcgcaggttttattgggtttcatttaactaagcgtttattagcacgaggcgatcatatcctcgggctcgataatttaaatgattattacgatgtgaatttaaaagaagcccgtttagcgcaattgaaagaattcccccatttcagttttcataaattagaccttgctgaccgacaaggaatgactgatttattccaaaaacacttatttgatactgttgtgcatttagcggcacaagccggtgtccgttattccctgactaatccttacgcttatgtagattcaaatttagtgggtttcgcgcatattttggaagggtgccgacaccaatccgttaaacacctggtttttgcttcttccagctctgtttatggcgccaatgagaaatatcccttttctgaaagtgataacgtggatcatcctattgctttatacgcagcatcaaaaaaagccaacgaattaatggcgcacagttatgcgcatttgtttcagctcccttgcaccggtctgcgattttttactgtgtatggtccgtgggggcgaccggatatggcgctgtttaaatttacgcgtaatttattagcggacaaacctatcgatgtttacaatcacggcaaaatgtcgcgtgattttacgtatatcgacgatatcgttgacggtattttactaactttagatcatccacctgaaccgaattctgcttactccgcaaatcaacctaatccagccaaaagcaacgcaccttatcgaatttataatatcggcagtaataatcctattctattgacgaatttcattgctattttggaaaagacattaaataaaaaagcgattaaaaatttcctaccccttcaaccgggtgatgttcccgaaacgtatgctgatgtttctcaattggaaaaagattttcaatatcggccaagaactcctttacaaaagggtgttaaaaattttgttgaatggtatttgcaatacttttcttag

SEQ ID NO: 65165 - protein, 334 aa, Coxiella burnetii RSA 493
MRTLVTGCAGFIGFHLTKRLLARGDHILGLDNLNDYYDVNLKEARLAQLKEFPHFSFHKLDLADRQGMTDLFQKHLFDTVVHLAAQAGVRYSLTNPYAYVDSNLVGFAHILEGCRHQSVKHLVFASSSSVYGANEKYPFSESDNVDHPIALYAASKKANELMAHSYAHLFQLPCTGLRFFTVYGPWGRPDMALFKFTRNLLADKPIDVYNHGKMSRDFTYIDDIVDGILLTLDHPPEPNSAYSANQPNPAKSNAPYRIYNIGSNNPILLTNFIAILEKTLNKKAIKNFLPLQPGDVPETYADVSQLEKDFQYRPRTPLQKGVKNFVEWYLQYFS

SEQ ID NO: 65166 - DNA, 960 bp, Streptomyces avermitilis MA-4680
  CDS (1)..(960)
atgagtgggaagtacctggtcaccggcggtgccggctatgtcggcagcgtggtcgcgcagcacctgatcgaggccggccacgaggtcgtcgtcctcgacaacctctcgaccggcttccgcgagggcgtgccggcgggcgcctccttcgtcgagggcgacatccgcgacgccgccaagtggctggactcctccttcgacgcggtcctgcacttcgccgcgttctcgcaggtcggcgagtcggtcgtgaagcccgagaagtactgggacaacaacgtcggcggcacgctggccctgctggccgcgatgcgcgaggccggcgtacgcaagctggtcttctcctcgacggccgcgacctacggcgagccggaggaggtgccgatcgtcgagacggcgccgaccaggcccaccaacccctacggcgcctcgaagctcgcggtcgaccacatgatcaccggtgaggccggggcccacgggctcgccgcggtcagcctgcgctacttcaacgtggccggcgcgtacggcagctgcggtgagcggcacgaccccgagtcgcacctcatcccgctcgtgctccaggtcgcccagggccgccgcgacgccatctccgtctacggcgacgactacccgacgccggacggcacctgcgtccgcgactacatccacgtcgcggacctggccgaggcccacctgctcgcgctggacgcggccacgcccggcgagcacctggtctgcaacctcggcaacggcaacggcttctccgtccgcgaggtcatcgagaccgtccgccaggtcaccgggcacccgatcccggagatcgtggccccgcgccgcgccggcgacccggcggtgctcgtggcctccgcggccacggcccgcgagcgactcggctggaacccggcccgcgcggatctcgcgggcatcgtcgcggacgcctgggcgttcgctcagcacaaggagtaa

SEQ ID NO: 65167 - protein, 319 aa, Streptomyces avermitilis MA-4680
MSGKYLVTGGAGYVGSVVAQHLIEAGHEVVVLDNLSTGFREGVPAGASFVEGDIRDAAKWLDSSFDAVLHFAAFSQVGESVVKPEKYWDNNVGGTLALLAAMREAGVRKLVFSSTAATYGEPEEVPIVETAPTRPTNPYGASKLAVDHMITGEAGAHGLAAVSLRYFNVAGAYGSCGERHDPESHLIPLVLQVAQGRRDAISVYGDDYPTPDGTCVRDYIHVADLAEAHLLALDAATPGEHLVCNLGNGNGFSVREVIETVRQVTGHPIPEIVAPRRAGDPAVLVASAATARERLGWNPARADLAGIVADAWAFAQHKE

SEQ ID NO: 65168 - DNA, 1002 bp, Streptomyces avermitilis MA-4680
  CDS (1)..(1002)
atgcgtgtactggtcaccggcggagccggattcatcgggtcccatgtcgtcgaggcgctcggggcgcgcgggcacgagcccgtcgtgttcgacgtgcgcgaggacgcgggcgcggacgtccgggaccgggacgcggtcgcccgcgccctggccggcgtggacgccgtgtgccatcaggcagccatggtcggactcggcaacggattcaccgacgcggcggagtacgtctcccgcaacgacctcggtaccgcggtgctgctcaccggcatggcggaggcgggcgtacggcggctcgtgctcgccgggtcgatggtggtctatggggaggggcggtacctgtgcgagtggcacggagtggtccggcccggaccgcggaccgtcgccgacctgacggccgggcgcttcgagcccgtctgcccggcctgcggtgaggcgctgtctcccggactggtgggcgaggacgcgccggtggacccgcggaacgtgtacgccacgaccaagctcgcccaggaacacctggcggcggcgtgggcccggtcgacggacggaacggccgtgtcgctgcggtaccacaacgtgtacgggccccggatgccccgcgacaccccgtacgcgggcgtcgcctccttcttccgctcggcgctcgcccggggagaggcaccgcacgtgttcgaggacggcgcgcagcggcgggacttcgtgcacgtacgggatgtggcggcggcgaacgtggccgcgctggaagcgagttcacccgtcggcgcgctcacggtctacaacaccggcagcggcgagccgcacacggtcggcgcgatggcccgggcgttggccgccgcgtacggcgggcccgagcccgtcgtcaccggggagtaccggctgggcgacgtacgccacatcacggccgactcctcccggctgcgggccgagctggggtggaaggcggagaccgggttcgaggacgggatgcgggagttcgcgcgggcgcggttgcgcgacgagtga

SEQ ID NO: 65169 - protein, 333 aa, Streptomyces avermitilis MA-4680
MRVLVTGGAGFIGSHVVEALGARGHEPVVFDVREDAGADVRDRDAVARALAGVDAVCHQAAMVGLGNGFTDAAEYVSRNDLGTAVLLTGMAEAGVRRLVLAGSMVVYGEGRYLCEWHGVVRPGPRTVADLTAGRFEPVCPACGEALSPGLVGEDAPVDPRNVYATTKLAQEHLAAAWARSTDGTAVSLRYHNVYGPRMPRDTPYAGVASFFRSALARGEAPHVFEDGAQRRDFVHVRDVAAANVAALEASSPVGALTVYNTGSGEPHTVGAMARALAAAYGGPEPVVTGEYRLGDVRHITADSSRLRAELGWKAETGFEDGMREFARARLRDE

SEQ ID NO: 65170 - DNA, 981 bp, Streptomyces avermitilis MA-4680
  CDS (1)..(981)
atgacctggctgatcaccggcggcgccggttacatcggggcgcatgtcgtgcgagcgatgcgcgaagcgggcgaccgggcgatggtgtacgacgacttgtccacgggcatcgcggagcgcgtccccgacggcgtgccgctggtggtgggctcgacgctggacggcggcctgctgcgccgcacgctcgcggagcacgcggtgaccggtgtcgtgcatctggcggcgaagaagcaggtcggcgagtcggtggagctgcccctgcactactaccgggagaacgtggagggcctgcgggtactgctggaggccgtcacggacgcctcggtcccctccttcgtgttctcgtcctccgcggccgtgtacggcatgccggacgtggacctggtgcgggaggagacgccgtgcgtgccgatgtcgccgtacggcgagacgaagctcgccggtgagtggctggtgcgcgcgacaggccgggcgacgggcctgtccacggcatcgctgcgctatttcaacgtggcgggggcggcgacgccggagctggccgacgccggggtcttcaacctggtccccatggtcttcgagaagctcacggagggcgccgcgccccgcatcttcggcgacgactatccgacgccggacggcacctgcgtacgcgactacatccatgtggtcgacctggcggaggcccatgtggccgcggcccgtgcgctggaggcgtcgccgggcgcgggcctgacgctcaacatcggccgcggcgagggtgtttcggtgcgcgagatggtcgaccgcatcaacgcgctcacgggctacgacaccccgccgaccgtcgtggcgcgccgccccggcgacccggcccgggtggtggcctcggcggaccgtatcgccgtggagctgggctggaaggcgaagtacgacgtccaggacatgatcacgtcggcatgggagggctgggtgcggctgcatccgggggcgacgcggggatag

SEQ ID NO: 65171 - protein, 326 aa, Streptomyces avermitilis MA-4680
MTWLITGGAGYIGAHVVRAMREAGDRAMVYDDLSTGIAERVPDGVPLVVGSTLDGGLLRRTLAEHAVTGVVHLAAKKQVGESVELPLHYYRENVEGLRVLLEAVTDASVPSFVFSSSAAVYGMPDVDLVREETPCVPMSPYGETKLAGEWLVRATGRATGLSTASLRYFNVAGAATPELADAGVFNLVPMVFEKLTEGAAPRIFGDDYPTPDGTCVRDYIHVVDLAEAHVAAARALEASPGAGLTLNIGRGEGVSVREMVDRINALTGYDTPPTVVARRPGDPARVVASADRIAVELGWKAKYDVQDMITSAWEGWVRLHPGATRG

SEQ ID NO: 65172 - DNA, 966 bp, Bacillus cereus ATCC 14579
  CDS (1)..(966): transl_table=11
atgagtaagaaatgtttaattacaggtggggccggatttatcgggtcgcatttagctgaagagttgatgagaagaggttatgaggtcactgttgtggataacttttataaaggtaaaaataagtaccataaagagttaatgaaagaaatccgtgttattccaataagtgttttagataaaaattctatttatgaattagtagatcagcatgatgtcgtgtttcatttagcagcaattttaggtgtgaaaacaacaatggaaaaaagtatagagctcatagaaacgaattttgatgggacaagaaatgttttacaagcagcgttaaaaggaaagaagaaagtagtttttgcttctacttcagaagtatatggtaaggccaagccgcctttctctgaagagggagatcgattgtacggggcaacttctaaaattcgttggagttatgcagtttgtaaaacgttggaagagacattatgtttagggtacgcattagaaggtttaccagtaacgattgttcgatactttaatatttatggtccaagagcgaaagatggtccatatgcaggagtaatcccgcgatttatccgcgcggcactgcaaggagaagacattctcgtatatggagatggaaagcagacacgttgttttacgtatgtaagtgatgcggtagaggcaacgattcgggcaatggatgagaaggtaaatggtgagattattaatataggttctgagaatgaaaagagcataaaagaagtagcagaagtaattaaaaaattaacgaattcttcttcgaagattgtccaagtgccttttgaagaagtatatcctcatggttttgaagaaattccaaatagaagaccagatgtaacaaaattaaaagagcttgttcaatttcaggcgaaagtaacgtgggaaaacggattgaaggaaacaattaagtggtttcgtgaacaaaacaatggctaa

SEQ ID NO: 65173 - protein, 321 aa, Bacillus cereus ATCC 14579
MSKKCLITGGAGFIGSHLAEELMRRGYEVTVVDNFYKGKNKYHKELMKEIRVIPISVLDKNSIYELVDQHDVVFHLAAILGVKTTMEKSIELIETNFDGTRNVLQAALKGKKKVVFASTSEVYGKAKPPFSEEGDRLYGATSKIRWSYAVCKTLEETLCLGYALEGLPVTIVRYFNIYGPRAKDGPYAGVIPRFIRAALQGEDILVYGDGKQTRCFTYVSDAVEATIRAMDEKVNGEIINIGSENEKSIKEVAEVIKKLTNSSSKIVQVPFEEVYPHGFEEIPNRRPDVTKLKELVQFQAKVTWENGLKETIKWFREQNNG

SEQ ID NO: 65174 - DNA, 906 bp, Bacillus cereus ATCC 14579
  CDS (1)..(906): transl_table=11
atgaaaatagctgttactggtggaacgggttttctaggtcaatacgttgttgaaagcattaaaaatgatgggaatacgcctatcattttaacaagaagtattggtaataaagcgataaatgattacgaatacagagtttcggattatactttggaagacttgataaatcaattaaatgatgtagatgcagtggtgcatcttgcagccacaagaggtagccaagggaagatatctgagtttcatgataatgaaattctaacacaaaatttatacgatgcatgctatgaaaataatattagtaatattgtgtatgcatctacaatatcagcctactctgatgaaacgtccctaccgtggaatgagaaggagttaccgttacctgatttaatgtacggtgttagtaagttggcctgtgagcatattggaaatatttattctagaaaaaaagggctttgtattaaaaacttgaggttcgcccatttatatgggtttaatgaaaaaaataattatatgattaatagatttttcagacaagcatttcatggtgaacaattaactttacatgctaatagtgttgcaaaaagagagtttctatatgcaaaagatgcagcaaaatctgtaatttatgcattaaaacaagagaaggtttcaggtacttttaatataggtagcggggatgctttaacaaattatgaagttgcaaatacaattaataatgcgtttggaaacaaagataatttattagtgaaaaatcctaatgctaatgaaggaatacattcttcttatatggatagtagtaaagcaaaggaattactagatttttcaacagattataattttgctacagctgtagaagaaatacatttattaatgcgggggttggatgatgtaccgttatggtattaa

SEQ ID NO: 65175 - protein, 301 aa, Bacillus cereus ATCC 14579
MKIAVTGGTGFLGQYVVESIKNDGNTPIILTRSIGNKAINDYEYRVSDYTLEDLINQLNDVDAVVHLAATRGSQGKISEFHDNEILTQNLYDACYENNISNIVYASTISAYSDETSLPWNEKELPLPDLMYGVSKLACEHIGNIYSRKKGLCIKNLRFAHLYGFNEKNNYMINRFFRQAFHGEQLTLHANSVAKREFLYAKDAAKSVIYALKQEKVSGTFNIGSGDALTNYEVANTINNAFGNKDNLLVKNPNANEGIHSSYMDSSKAKELLDFSTDYNFATAVEEIHLLMRGLDDVPLWY

SEQ ID NO: 65176 - DNA, 1008 bp, Nitrosomonas europaea ATCC 19718
  CDS (1)..(1008): transl_table=11
ttgaaagtacttattaccggttcagccggctttattggatctacactggcgctgcggctgcttgagcgtggtgacaccgttatcggtatcgataaccataacgattattatgatcccaaattaaaggaagatcgccttgcccgatttgctgatcaccccgattacactcatttgcgcctggatctggcggatcgtgaaggtatcaaaacctgttttgaaacttacaagccgcaacgggtggtgaatctggcagcccaggccggggtgcgctattccattgaaaacccgcttgcctatatcgacagcaacatcgttggttttgctcatattctcgaaggttgccgccataacgatgtcgagcacctggtgtatgccagcagctccagtgtctatggtgccaacacgatgatgccattctcggtacatcacaacatcgatcatccactcagtctctatgcagccagcaagaaatcgaacgagctgatggcacatacctacagccatttatataatctgccgactaccggcttgcgctttttcactgtctatggcccctggggacgcccggatatggcgttgttcaaatttaccagagcgatgctggccggagagaaaattccagtcttcaactatggcaaacatcgcagagatttcacttatgtcgatgacattgtggaaggggtcattcgtgtgctggatcagcccgctcgatccaatccagcctggagtggagcaaacccggatgccggcaccagcctggccccctggcgtgtctataacataggtaacaacagcccggtggagctgatggattacattgctgcactggaaaaagcgcttggcaaaaaagccgagatggaaatgctgcctttgcagcccggggatgtaccggatacttatgccgatgtttccgatctcgtcgaacaatttgattacaaacctgctactccggttgagcaagggatagccaactttgtgacgtggtatcgcaattacttcaatctgtag

SEQ ID NO: 65177 - protein, 335 aa, Nitrosomonas europaea ATCC 19718
MKVLITGSAGFIGSTLALRLLERGDTVIGIDNHNDYYDPKLKEDRLARFADHPDYTHLRLDLADREGIKTCFETYKPQRVVNLAAQAGVRYSIENPLAYIDSNIVGFAHILEGCRHNDVEHLVYASSSSVYGANTMMPFSVHHNIDHPLSLYAASKKSNELMAHTYSHLYNLPTTGLRFFTVYGPWGRPDMALFKFTRAMLAGEKIPVFNYGKHRRDFTYVDDIVEGVIRVLDQPARSNPAWSGANPDAGTSLAPWRVYNIGNNSPVELMDYIAALEKALGKKAEMEMLPLQPGDVPDTYADVSDLVEQFDYKPATPVEQGIANFVTWYRNYFNL

SEQ ID NO: 65178 - DNA, 1038 bp, Helicobacter hepaticus ATCC 51449
  CDS (1)..(1038): transl_table=11
atgccttatcttttgcttacaggtgcaagtggctacatcggttctcatactgcttattgtcttttgaaaaatacaaattatcatattcttatcgttgatgatttaagcacaggctttaaagaaaacattgcttatctccaagaatgctttgaggagcgagtgagttttgtgcaaagcaatatcaacgatatatccaaaatgcgcactttgctcttgcactataaatttgaggcagtgattcactttgcggcttcgcttattgttggagaatctgtgctcaaaccccttgaatactatacaaacaacacccttaatactacaaatcttattgccttgtgcatagaatgcggcataacaaaatttatctttagctctacagcagcagtatatggagagccacatacttcacttatccctattgatgagaatgccccacttttacctattaatccttatggaagctcaaaaatgatgagcgagcgaatcttatacgatacttcacttgcattcaaaaactttaattatgtagcattgcgatattttaatgtcgcaggagcgagtatggataacacgccacagattctctcaaaccataaaggcttggggcaaaggagcaaaaatgctactcatcttatcaaagtcgcttgtgagtgtgcttgtggcaaaagagaatctatgagtatctttggcacagattatcccacaaaggacggcacttgtatccgcgattatattcatattgatgatttagcaagtgcgcatcttgaagctcttacatttttacagcatacacaaacttccaatatttttaatgtaggctattgcaaaggatatagtgtaaaagaagtaattgatgttgtcaaagaaatcagcggaatggattttaaagttatagaatctgctcgtagagagggcgaccctattgagctaagtgccaaaaatgaaaagattctctcccttacgcaatggaaaccaaaatataatgatttaagagtgattgtcaaaagtgcttatgaatgggagtgttcattgaaataa

SEQ ID NO: 65179 - protein, 345 aa, Helicobacter hepaticus ATCC 51449
MPYLLLTGASGYIGSHTAYCLLKNTNYHILIVDDLSTGFKENIAYLQECFEERVSFVQSNINDISKMRTLLLHYKFEAVIHFAASLIVGESVLKPLEYYTNNTLNTTNLIALCIECGITKFIFSSTAAVYGEPHTSLIPIDENAPLLPINPYGSSKMMSERILYDTSLAFKNFNYVALRYFNVAGASMDNTPQILSNHKGLGQRSKNATHLIKVACECACGKRESMSIFGTDYPTKDGTCIRDYIHIDDLASAHLEALTFLQHTQTSNIFNVGYCKGYSVKEVIDVVKEISGMDFKVIESARREGDPIELSAKNEKILSLTQWKPKYNDLRVIVKSAYEWECSLK

SEQ ID NO: 65180 - DNA, 939 bp, Helicobacter hepaticus ATCC 51449
  CDS (1)..(939): transl_table=11
atgctaaataaaaaaatattagttacaggcggagcaggatttttgggctcacatttgtgtgaaaaacttttaaatcgtggtgatgaggtgctttgtgtggataatcttttcacaggcacaaaacaaaatattatacatttactctcaaatccccgttttgaatttatgcgccacgatgtaacttttcctctctatgtagaagttgatgaaatttataatctcgcttgccctgcttctccagtgcattatcaatttgacccagtgcaaacaactaaaacttccgttatgggagcaatcaatatgctaggacttgcaaagagagtgaaagcgaagattctgcaagcaagcacgagtgaagtttatggcgatcctgaaatccacccacaagtagaatcctacaaaggctcagtgaatcctattggtataagggcgtgttatgatgagggaaagcgatgtgcagaaacacttttttttgattatcaaaggcagcataatttaaatattaaagtaatgagaatttttaatacctatggacctagaatgcacccaaacgatgggcgtgtagtgagtaattttatcattcaagcactcaaaggcgaagatgttacgatttatggcgaaggcaagcaaactcgtagtttttgctatgtagatgatttgattgagggtatgataagacttatggatagtagagatggattctatggacctgtaaatatagggaatccacgtgaatttagtatgattgaacttgcaaatgcagtgctagagctcactcactctaaatccaaacttgttttttcacccttacctcaagatgacccaaaacaacggcaacccgatattagccttgctcaaaatgagctagggtggaatccaaatgttgagcttaaagaagggctaataaaaacaattgcgtattttaaggaaattatatga

SEQ ID NO: 65181 - protein, 312 aa, Helicobacter hepaticus ATCC 51449
MLNKKILVTGGAGFLGSHLCEKLLNRGDEVLCVDNLFTGTKQNIIHLLSNPRFEFMRHDVTFPLYVEVDEIYNLACPASPVHYQFDPVQTTKTSVMGAINMLGLAKRVKAKILQASTSEVYGDPEIHPQVESYKGSVNPIGIRACYDEGKRCAETLFFDYQRQHNLNIKVMRIFNTYGPRMHPNDGRVVSNFIIQALKGEDVTIYGEGKQTRSFCYVDDLIEGMIRLMDSRDGFYGPVNIGNPREFSMIELANAVLELTHSKSKLVFSPLPQDDPKQRQPDISLAQNELGWNPNVELKEGLIKTIAYFKEII

SEQ ID NO: 65182 - DNA, 1008 bp, Helicobacter hepaticus ATCC 51449
  CDS (1)..(1008): transl_table=11
atgaaatacatttatgatgaccttgcagaaaaaaaaatactcattacaggtggagctggattcattggaagcaatctcgccttttattttcaaaaacatcacccacttgctcaagtatatgtatttgataagtttcgtaatgatgagactttccctagtggcaacccaacaacacttggacattttaagaatcttattggttttaaagacaaagtgattgtaggcgatattaataatcctagcgatttagaaaagcttaaatcttatgattttgacattatctttcatcaagctgctatttctgataccaccgtgcttaatcaagagcttgttatgaaaactaatcacgaatcattcttgcgcttgcttgatattgccactcaatcccaagcaatggttatctatgcttcatcggctggaacttatggtaattctcctgcacccaatagtgtaggaagcggcgaaatgccggaaaatatttatggatattctaaactctgtatggacgaaagtgtaaggaggattcttacttcaaatcctagttatcctattattggattaagatattttaatgtttatggagagagggaattttataaaggcaaaactgcctcaatgattttgcaacttggactacaagcacttaaacataaaaaagtgagactctttaaatatggtgagcaaaagcgagattttgtctatattaaagatgttattcaagctaatatcaaagccatagaatctatgcaaagtggtatttataatgtcggcagtggcgaggcaagaagctttaatgatattattgcgtgtcttaaagatggaattggagattttgaagtggaatattttgataatccttatgcttttttccaaactcatacacaagctgatattgcttctacaaaagaacatctctcttatatgccacgttttagtcttgaagaaggcataaagacataccttaaagaaatcaaagcaatttttgaacgtgaaaatccaaaaatataa

SEQ ID NO: 65183 - protein, 335 aa, Helicobacter hepaticus ATCC 51449
MKYIYDDLAEKKILITGGAGFIGSNLAFYFQKHHPLAQVYVFDKFRNDETFPSGNPTTLGHFKNLIGFKDKVIVGDINNPSDLEKLKSYDFDIIFHQAAISDTTVLNQELVMKTNHESFLRLLDIATQSQAMVIYASSAGTYGNSPAPNSVGSGEMPENIYGYSKLCMDESVRRILTSNPSYPIIGLRYFNVYGEREFYKGKTASMILQLGLQALKHKKVRLFKYGEQKRDFVYIKDVIQANIKAIESMQSGIYNVGSGEARSFNDIIACLKDGIGDFEVEYFDNPYAFFQTHTQADIASTKEHLSYMPRFSLEEGIKTYLKEIKAIFERENPKI

SEQ ID NO: 65184 - DNA, 1149 bp, Ruegeria sp. PR1b
  CDS (1)..(1149): transl_table=11
atgccgcaatggataatgatctgcttcatgaagggccgctttcgtgttgtgatgccgctcgggcaccgcctgttggcgctgttgttgcaccaatgtctgagacacgcaagcggcaggccggtgtcgcccgggccggggcaagatggacttttgcggatgcggcagatagaggcgggactggaacatgaggaagggtcgcaggacgtgagagcacttgttatcggcggttgcgggtttattggctcccatgtggtggatgtattgcatcaggccgggatggggttgcgggtacttgatcggcgaccagaggcgtttcgcgcgccggttcccggggtggagtatgtctattgcgacatgcaggaccgggcgcagctctttgaggcggtctccggcgtggatgcggtggtgcatttggccagcaccacggtgccggcgacctcgaacctggatccggtggccgatgtgtccggcaatctggtcaccaccctgtccctgttggaggtgatgcgggcggcaggggtgcgccggatggtctatctctcgtccggggggaccgtctacggcgtgccgcagcaggatctggtgtctgaggatcacccgctcaatccgatcagctcttatgggatcgtcaaggtggcggtcgaaaaatatctcttcatggagcatcagctgcatgggttggaatatgtggtgctgcgggcctccaacccctatgggccgcgccaggggcacaggggcattcagggattgatcggaacccatctgtggcgcctgtcccggcaggaggagatcgaggtctggggcgatggcagcatcgtgcgggactttttgcatgtgagggatctggcgcaattgtgccttctggcgatgacctccggcaagagcggtattttcaatgccgggcgcgggcagggggcttcggttgccgaggtggtggagcagatctgtgccacggtggccgcctccggcggcaggtcagtggcgccgatctataagcccggtcgcaactttgacgtgccacgggtggtgctggacacgacgcgggcccgggcggagctgggctggcaggcggaaatcacgctgcaagacgggattgcggaaacctgggactgggtgcaggcgcaggcgcgccagcaaggtcagggctga

SEQ ID NO: 65185 - protein, 382 aa, Ruegeria sp. PR1b
MPQWIMICFMKGRFRVVMPLGHRLLALLLHQCLRHASGRPVSPGPGQDGLLRMRQIEAGLEHEEGSQDVRALVIGGCGFIGSHVVDVLHQAGMGLRVLDRRPEAFRAPVPGVEYVYCDMQDRAQLFEAVSGVDAVVHLASTTVPATSNLDPVADVSGNLVTTLSLLEVMRAAGVRRMVYLSSGGTVYGVPQQDLVSEDHPLNPISSYGIVKVAVEKYLFMEHQLHGLEYVVLRASNPYGPRQGHRGIQGLIGTHLWRLSRQEEIEVWGDGSIVRDFLHVRDLAQLCLLAMTSGKSGIFNAGRGQGASVAEVVEQICATVAASGGRSVAPIYKPGRNFDVPRVVLDTTRARAELGWQAEITLQDGIAETWDWVQAQARQQGQG

SEQ ID NO: 65186 - DNA, 1116 bp, Rhodopirellula baltica SH 1
  CDS (1)..(1116): transl_table=11
ttgctgttgaggaacgtccgcaaccgcaagccaagcgtgacacattggctcgaggatcgagttcattccattcaggccggatgccgcttcgaatcacaatgcatccaatcgaattacatgtcatcatcgctcgagtccgccgttgctcaaattgctggcacgcgttgtttggtcactggcgccgcgggattcatcggttcgcaaatggttgagcggttgctcgatgccggagcggaagtggtcgcgttggacaacctcagcaccggattcaagcataacctgacgccatttttggaaggtccgcaacgggatcgtctgacctttgtcgaaggtgacgccgcagaccgggcgtgtgtgcaacggtcagtggaaggcgtggaccacatttttcacttcgcagcgatggccagtgtgccgcgcagcatgcgagagcccggcatgtgccatgactggaccaccaccagcaccgttgagttgctggccgccggttctgccgcgggtgtgaagcgtttcgttttgtcgtctaccagcgccgtttatggcaactcaccgtatgttgccaaacgcgaagacgatatgcccgcgccattgtcgccatacgctgccgcgaagttgtcctccgagaactactgccaagtctttcaacgtgagtttccaatcgagaccgtcgtgttgcgatacttcaacgtctttggtccgcggcaagacccgaagagcgagtacagcgctgtgatccctcgttttgtctcgatgattctcagcggcgaacgccctgtcatttacggcgacggtcagcaatctcgcgattttgtgtttgttcgtgatgttgccaatgcgaacatgttggcggcaactgttgctgacgcggccggcggaatcttcaatgtcggccgaggacagcgaaccacgttgctggagttgctcgacactctacgtgaactgctagagggtgacattcaaccaattcacgagccaccgcgtgccggcgacgtgcgagactcattggcagatacaaaccaaatccgatctcgcctcggttttgaaccaacggtcgacatgaccgaagggttacgccaaagcattgaatactaccgtgggctttgctcgcccacctaa

SEQ ID NO: 65187 - protein, 371 aa, Rhodopirellula baltica SH 1
MLLRNVRNRKPSVTHWLEDRVHSIQAGCRFESQCIQSNYMSSSLESAVAQIAGTRCLVTGAAGFIGSQMVERLLDAGAEVVALDNLSTGFKHNLTPFLEGPQRDRLTFVEGDAADRACVQRSVEGVDHIFHFAAMASVPRSMREPGMCHDWTTTSTVELLAAGSAAGVKRFVLSSTSAVYGNSPYVAKREDDMPAPLSPYAAAKLSSENYCQVFQREFPIETVVLRYFNVFGPRQDPKSEYSAVIPRFVSMILSGERPVIYGDGQQSRDFVFVRDVANANMLAATVADAAGGIFNVGRGQRTTLLELLDTLRELLEGDIQPIHEPPRAGDVRDSLADTNQIRSRLGFEPTVDMTEGLRQSIEYYRGLCSPT

SEQ ID NO: 65188 - DNA, 1218 bp, Rhodopirellula baltica SH 1
  CDS (1)..(1218): transl_table=11
gtgctcttcattggatcgattccaatgagttatcgtcttgatggctcgtcgccgccaatgtcaatttttctcgaaccatctccttttcaagattcttccatgaaagtttttgtcgtcggcggtgccgggtacatcggatcgcacgcggtcgcattgttgctcgacgctggtcacgaagtcgtcgtgttcgacaatctgtcgcgcggacatgccaaatcggttccggaaggtttgctggttgagggcgacctgaacgatcaggcgaaactgacatcgctgttaaaagagcactcgatcgatgcggtgatgcacttcgccgccttcgcggaagttggtgagtccgttcgtgatcctgcgatctactaccaaaacaatgtcgtcgctacgttgtcattgctggaagcgatgcgtgcggcggacgtcaagaagattgtgttcagcagcaccacggcaacgtacgggcaaccggataccgtgccgattcccgagacgactccacaaaatccgatcaacccctacggattttccaagttggtcatcgagaaagcgttggcggactacgcccacgcatacggtttcgcctatgcggcactgcgatacttcaacgcggccggtgctcgacccgatggaacgattggcgagcatcatgaccctgagtcgcatttgattcccattgtcttgcaggttgctttggggcagcgtgagtcgatctcgatcttcggcgacgattaccccacgccagacggaacttgcattcgcgattacatccacgtcgatgatttgggcgatgctcacttgcgagctctcgatcgactgaaaccgggcgaaggcatccaagtcaatctcggcaccggcagaggaacgagcgtccgcgagattgtggatgcgtgtcgtgcagtgactgggcaccccattcctgaagtcatgggcgagcgacgtcctggcgatccggcggagttgattgccgatgcgaagttggcgggagaagttctagggtggaagcctcgttacactgacatccaagacatcgtgaagacagcatggaattggcaccaaacgcacccccaggttacgacaccgtttgagcgaccgctttcgccatcgaaccgcggtcaggatcgagttttcacggcaacccgattccgtcgcagtacgtaccaatcggaggggcgagtttgccctgtgatctcctccgactggttgtcgtcgtcgaattga

SEQ ID NO: 65189 - protein, 405 aa, Rhodopirellula baltica SH 1
MLFIGSIPMSYRLDGSSPPMSIFLEPSPFQDSSMKVFVVGGAGYIGSHAVALLLDAGHEVVVFDNLSRGHAKSVPEGLLVEGDLNDQAKLTSLLKEHSIDAVMHFAAFAEVGESVRDPAIYYQNNVVATLSLLEAMRAADVKKIVFSSTTATYGQPDTVPIPETTPQNPINPYGFSKLVIEKALADYAHAYGFAYAALRYFNAAGARPDGTIGEHHDPESHLIPIVLQVALGQRESISIFGDDYPTPDGTCIRDYIHVDDLGDAHLRALDRLKPGEGIQVNLGTGRGTSVREIVDACRAVTGHPIPEVMGERRPGDPAELIADAKLAGEVLGWKPRYTDIQDIVKTAWNWHQTHPQVTTPFERPLSPSNRGQDRVFTATRFRRSTYQSEGRVCPVISSDWLSSSN

SEQ ID NO: 65190 - DNA, 1026 bp, Prochlorococcus marinus subsp. marinus str. CCMP1375
  CDS (1)..(1026): transl_table=11
atgcgacctgtccttattactggtgcagctggttttattggagcagcactagtaaaaaaactattgagcgagggtgaaagggttattggtatagataatattaatgaatattatgatacttctttaaaatacgcccgcttacaatatatagagagtagctctcaagaatacctaaaaaattgggtttttcataaattaggtattgagaatattgatgaaataaaagagatttttactaaagaatcgcctcgtatagtagttaatttagcagcacaggctggtgttagatattctttagataatcctcatgcctatgttcagagtaatctcgttggcttttgtaatttattagagatgtgtaggcattatgaagttgaaaacttgatatatgcttcaagtagctctgtttacggaggtaatactaatcttccttttaatgaaactcaggcagtaaatcatcctgtaagtttttatgcagccactaaaaaatctaatgaattaatggcacatacctatagtcatctatatgacttacctgctactgggttacgcttttttaccgtatatggaccttggggcaggcctgacatggcccctatgaagtttgctaaggccatacttgaaggagaccctattcaagtatttaattttggccgtatgaaaagagacttcacttatattgatgatgttgtagaaagtatttttagatgttgttatttgcaagctactgttaataataattttgataagtcaaaccctgatccttgcacttctttcgctccgcatagaatttttaatgttggcaatagtcaacctacagagttagatatttttattaatttactagagaaatctttatctactaaagctataagggatttgcttcccatgcaaccaggggatgttgtggctacagctgctgacactcagaaattaaaagattggacaggcttctctcctagcacatctcttgaggatggtattcaatgttttgcagaatggtatctttctttttaccaaagctag

SEQ ID NO: 65191 - protein, 341 aa, Prochlorococcus marinus subsp. marinus str. CCMP1375
MRPVLITGAAGFIGAALVKKLLSEGERVIGIDNINEYYDTSLKYARLQYIESSSQEYLKNWVFHKLGIENIDEIKEIFTKESPRIVVNLAAQAGVRYSLDNPHAYVQSNLVGFCNLLEMCRHYEVENLIYASSSSVYGGNTNLPFNETQAVNHPVSFYAATKKSNELMAHTYSHLYDLPATGLRFFTVYGPWGRPDMAPMKFAKAILEGDPIQVFNFGRMKRDFTYIDDVVESIFRCCYLQATVNNNFDKSNPDPCTSFAPHRIFNVGNSQPTELDIFINLLEKSLSTKAIRDLLPMQPGDVVATAADTQKLKDWTGFSPSTSLEDGIQCFAEWYLSFYQS

SEQ ID NO: 65192 - DNA, 936 bp, Candidatus Blochmannia floridanus
  CDS (1)..(936): transl_table=11
atgattatagttaccggaggggcaggttttattggaagaaatcttattagaagattgaacaaaattcaaaggacagatatcttggttgttgataatttacgaaatggaaaaaaatataaaaatttagtaggattgcatatttctgattacatagataagcactgttttataaaaagattattaaataattctaattatttaaaaaatatagaagtaatatttcatgaaggagcttgttcgaacacttatgaatggaatggaagatatttaatgaataacaattatcaatattctaaatcattacttaattattctgttgaaaattcgattccttttatatatgcatcttctgcttctgtttacggaaaaaatatttattcttctaatacatttgataataatgaaaaccctttgaatatttacggttattctaaatttttatttgatcaatatgttcgaagtgttttaacaaaagtttcttctcaagtttgtggattgcggtactttaatgtttatggaccttatgaaaatcataaaggggctatggcaagtattatttttaatatatatcaaaaaatcatacatagaaaaatccctgttttatttattggtagtagagattttaaacgagattttatatatatagatgatgttgtaaatattaatatatggatgtgggttaataaaatatctggtatttttgattgtggaactggtgtttctgaatcttttacattactcgctgatattgtgttaaaatttttgaattatgattcaattcaatatgttcctatgccttataaaataagacaacattatcaaacatttacaaaagcaaatatttcttatttaagaaatataggatatgatttttcttttattaaattaagtgaaggtattcatcgatatttaaattggttaattcataataattaa

SEQ ID NO: 65193 - protein, 311 aa, Candidatus Blochmannia floridanus
MIIVTGGAGFIGRNLIRRLNKIQRTDILVVDNLRNGKKYKNLVGLHISDYIDKHCFIKRLLNNSNYLKNIEVIFHEGACSNTYEWNGRYLMNNNYQYSKSLLNYSVENSIPFIYASSASVYGKNIYSSNTFDNNENPLNIYGYSKFLFDQYVRSVLTKVSSQVCGLRYFNVYGPYENHKGAMASIIFNIYQKIIHRKIPVLFIGSRDFKRDFIYIDDVVNINIWMWVNKISGIFDCGTGVSESFTLLADIVLKFLNYDSIQYVPMPYKIRQHYQTFTKANISYLRNIGYDFSFIKLSEGIHRYLNWLIHNN

SEQ ID NO: 65194 - DNA, 978 bp, Bordetella bronchiseptica RB50
  CDS (1)..(978): transl_table=11
atgaagctcgagggcgcaaaaatcctggtcattggcggggccgggtttatcggcagcttcgtcgtggcagaactgctcaagcatccggtggcggaagtcgttatttatgacaactttgcgcgcggcaagcagagcaatatcgacgaatatctcagcgaccctcgctgccgcatttaccccaatggcggcgacatccgcgatatcgatttgctcaacgacgcgatgcaaggcatggacggcgtcgtccacctggccgcgatgtggttgctgcactgcaaggatttcccgcgcacggcattccacgtcaacatcgagggcaccttcaatgtgctcgaagcgtgtgtgcgcaacaacgtgaagcgactggtgtactcgtcctccgcctccgtctacggcgacgcggtggaggtgccgatgaccgaggagcatccgttcaacaaccgcaatttctatggcgccagcaagatcgccggcgaggccatgtgccacgcctttcacgaccgctatggcctgagctatgtggggttgcgctacatgaacgtgtatggtccgcaccaggatcagacagcggcatacaccggcgtgattcccatcatgctcaacaagatcgacgccaacgaggcgccggtcatcaatggcgacggcacccaggcctatgatttcgtctacgtcgaagacgttgctcgctgcaacgtgctggcactgacgtccgaggcgaccgaccagttctataacgtcggcaccggcgtacagacgtcgatcaaggaactgtgcgacacaattctcgacatgaaggattccggcttgcaggtccagtatcgtccctatagcgaagacgatgcgcgccgcatggtacagaaccgcatcggttgccccgtcaaggccagccgcgacctgggcttcacgtaccagtatgccttgaccgaagggctgcagaaactgatcgactggcgtgccaagaatggagcgcagtcgtga

SEQ ID NO: 65195 - protein, 325 aa, Bordetella bronchiseptica RB50
MKLEGAKILVIGGAGFIGSFVVAELLKHPVAEVVIYDNFARGKQSNIDEYLSDPRCRIYPNGGDIRDIDLLNDAMQGMDGVVHLAAMWLLHCKDFPRTAFHVNIEGTFNVLEACVRNNVKRLVYSSSASVYGDAVEVPMTEEHPFNNRNFYGASKIAGEAMCHAFHDRYGLSYVGLRYMNVYGPHQDQTAAYTGVIPIMLNKIDANEAPVINGDGTQAYDFVYVEDVARCNVLALTSEATDQFYNVGTGVQTSIKELCDTILDMKDSGLQVQYRPYSEDDARRMVQNRIGCPVKASRDLGFTYQYALTEGLQKLIDWRAKNGAQS

SEQ ID NO: 65196 - DNA, 1023 bp, Prochlorococcus marinus str. MIT 9313
  CDS (1)..(1023): transl_table=11
atgagtcgatgcgttgttgttaccggtgctgcaggattcattggtgctgccctcgttcagaggctgttagcccagggtgaccgtgtcattggcattgacaacctgaatgactactacgatccgtctttgaagcgggcacgacttgctcaggttgaagcggcttcccttaaagcgtcttggactttttatccaatagccttggaagatggtgcagctatagaggaactgtttaaggctgagaagcctgaggtggtcgttaatttggcggctcaggcaggggttcgctactcattggagaatccggcggcctacattcaggccaatttggtgggcttcggtcatatccttgagggatgtcggcatcatggagtgcagcacttggtgtatgcctccagtagctcggtatatggtggcaatcgcaacttgccttttcacgagcaacagcctgtgaatcacccggtgagtctctatgcagccaccaagaaggccaacgaattgatggctcacacctatagccatttgtatggcttgcctgctacaggattgcgcttttttactgtgtacggaccttggggccgcccggacatggctccgatgctcttcgccaaggcgattcttgccggcgagcccatcaaggtgttcaattacggcaagatgcagcgtgatttcacttatatcgacgatatcgttgaagggctacttcggtgttgcgacaagcctgctaccgcaaatttaggcttcgatccgcggaaccctgatccagccaccgctgctgtgccccaccgtcttttcaatattggtaatagccagcccattgagttgatgcattttattgagttcttggagaactctctcgggagggaagcggtgaaggacttccagccgatgcaacctggtgatgtgatggccaccgctgctgatacatctgctcttgaggcctgggtggattttcggccgtcgaccccaatcgcagagggggtggagtgcttttctcagtggtatcgaagcttttatgaggtttga

SEQ ID NO: 65197 - protein, 340 aa, Prochlorococcus marinus str. MIT 9313
MSRCVVVTGAAGFIGAALVQRLLAQGDRVIGIDNLNDYYDPSLKRARLAQVEAASLKASWTFYPIALEDGAAIEELFKAEKPEVVVNLAAQAGVRYSLENPAAYIQANLVGFGHILEGCRHHGVQHLVYASSSSVYGGNRNLPFHEQQPVNHPVSLYAATKKANELMAHTYSHLYGLPATGLRFFTVYGPWGRPDMAPMLFAKAILAGEPIKVFNYGKMQRDFTYIDDIVEGLLRCCDKPATANLGFDPRNPDPATAAVPHRLFNIGNSQPIELMHFIEFLENSLGREAVKDFQPMQPGDVMATAADTSALEAWVDFRPSTPIAEGVECFSQWYRSFYEV

SEQ ID NO: 65198 - DNA, 972 bp, Chromobacterium violaceum ATCC 12472
  CDS (1)..(972): transl_table=11
atgacaaagattctggtgaccggcgccgccggttttattggtcgggcagtatgcgagaagctgctggagcggcgagatgttcaggttgtcggaatcgataatctgaatgactactacgcggtcgagctcaagcatgccaggctggcgactctgcagggacggtccaatttcagttttcatcggcaggacatcgcggactggcctgcgatggaacgcttgttctcggctgaaaaattcgattatgtcattcatctggcagcccaggccggggtgcgttattcgctgcagaatccccatgcttatgcggaaagcaatttgttgggctttaccaatgtactggaggcctgccgtcgccatccagtcaagcacttggtttttgccggatcatccagtgtttacggaagcggttcggctgtgccgttttcggaggatcagcgagccgatcatccggtcagcttttatgctgccaccaaacgcgcgaacgagttgatggccgccagctattctcatttgtatcgactgcctacgaccagcttgcgtttctttacggtctatggcccatgggggcggccggacatggctccttggctgtttaccgatgccattctgaacggtcggccgatcaaggtgttcaatcacggaaagatgcagcgtgacttcacctatatcgacgatatcgttgagggggtggtgcgggtgatggagcacgttccgtccggcgagttgccgcatacgattttcaatatcggcaatcaccagccggtggagctgatgaccttcatccaactgaccgagaaatattgcggcagagaggcaatcaaggagtacctgcccatgcaggatggtgatgtgccgatcacttacgccgaaacatctcgtttgagagatgcggtgggtttcacgccatccacttcgcttgaggttggtatggcccgttttgtcgaatggttcaggaattatcatgcggtttga

SEQ ID NO: 65199 - protein, 323 aa, Chromobacterium violaceum ATCC 12472
MTKILVTGAAGFIGRAVCEKLLERRDVQVVGIDNLNDYYAVELKHARLATLQGRSNFSFHRQDIADWPAMERLFSAEKFDYVIHLAAQAGVRYSLQNPHAYAESNLLGFTNVLEACRRHPVKHLVFAGSSSVYGSGSAVPFSEDQRADHPVSFYAATKRANELMAASYSHLYRLPTTSLRFFTVYGPWGRPDMAPWLFTDAILNGRPIKVFNHGKMQRDFTYIDDIVEGVVRVMEHVPSGELPHTIFNIGNHQPVELMTFIQLTEKYCGREAIKEYLPMQDGDVPITYAETSRLRDAVGFTPSTSLEVGMARFVEWFRNYHAV

SEQ ID NO: 65200 - DNA, 1002 bp, Wolinella succinogenes DSM 1740
  CDS (1)..(1002): transl_table=11
atgcaatacattgatgatagcttagagaataaaaccattttaatcacaggcggtgcaggctttgtcgggagcaatctcgccttctatttccaaaaacaccaccctaaagctagggtgatcgtctttgatagctttcggagtggcgagatgttccctgaggggaatcttaaaagtttaggacacttcaagaatctcctaggattcacgggtgaggtgatcgcgggtgacatcaattcaccgcaagacctcaagcgccttgaggcctatcctctggactatgtttttcatgaggcagcgatctcagacaccaccgtgatgaatcaggagctcatgattcggagcaacaccaacgcctttaaagacctcctcgatctttgcgtcaagaagggagcaagcctcatctacgcctctagcgcagggacttatggcaacaccaaagcccctaatagcgtgggggccaatgaggttcctgagaatgtctatgggtttagcaagctcatgatggataatctcgcctacacctacatgagagagtatccaaacctacaaatcgtaggacttcgatacttcaatgtctatggcgagcgggagtttcacaagggtaagaccgcctcaatgattcttcaattaggacttcaggcgctagagcaccaaagggtgcgactctttaaatttggtgagcagaagcgggattttgtctatatcaaagatgtagtgcaggccaatgttaaagccatgaagagccaaaagagcggagtttataatgtgggctatggcaaggcgcgcacctataatgatatcgttgaggcattgcgtgtggaacttggagcgtttgaggtggagtatatcgacaacccctatcgattcttccaaaatcacaccgaggccaacatcgcccccaccaagcaattccttggctatgagccgcgattctctttggaggcgggcgtgaagagctacgtggacgagatcaaaagaatccacgaggagaataagaagtga

SEQ ID NO: 65201 - protein, 333 aa, Wolinella succinogenes DSM 1740
MQYIDDSLENKTILITGGAGFVGSNLAFYFQKHHPKARVIVFDSFRSGEMFPEGNLKSLGHFKNLLGFTGEVIAGDINSPQDLKRLEAYPLDYVFHEAAISDTTVMNQELMIRSNTNAFKDLLDLCVKKGASLIYASSAGTYGNTKAPNSVGANEVPENVYGFSKLMMDNLAYTYMREYPNLQIVGLRYFNVYGEREFHKGKTASMILQLGLQALEHQRVRLFKFGEQKRDFVYIKDVVQANVKAMKSQKSGVYNVGYGKARTYNDIVEALRVELGAFEVEYIDNPYRFFQNHTEANIAPTKQFLGYEPRFSLEAGVKSYVDEIKRIHEENKK

SEQ ID NO: 65202 - DNA, 1005 bp, Gloeobacter violaceus PCC 7421
  CDS (1)..(1005): transl_table=11
gtgtggagctgcacgacgaggcaaagcgcgatgattttggtgacaggcggcgccggctacatcggctcccacgtggttcttgctctgcaggccgcgggcttcgagatactggtgtacgacaacctggtttacggccatgccgagtttgttccggccccgatgctgattcgcggcgaccttgaagatcgcgtggggctcgcgcgcctgtttgccgcgcatccgatcgaggcggtcatccacatggcggcttacgcctacgtgggcgaatcggtcaccaaacccgccgtctactaccgcaacaacgtccacggcacgctctgcctgctggaggcgatggtcgaagccgacgtcaagcaaatcgtcttctcctctacctgcgccacctacggcgaacccgaacagatcccgatcaccgaaacccatccccagcgccccatcaatccctacggattcaccaagctggtggtcgagcggatgctgcgcgacttcgaccgcgcctacggcctgagatcggttgtttttcgctacttcaacgccgcgggcgccgacccggacgcccgggtcggcgaagaccacgaccctgagacccacatcattccgctggtgctcgatgtcgccatcggccgtcggccccacatcaccgtcttcggctccgactacgaaacccccgacggcacctgcgtgcgcgactacatccatgtcagcgacctggccgacgcccatgtgctggggctcaagtacctcaaatccggcggcccgaccgaggtattcaacctgggcaacggcagcggcttttcggtgcaacaggtgatcgacacggccggacaagtcgccggacgtgagatcgccgtgcagatgggtgcgcgccgccccggcgacccggcgacgctggtgggttccgcagagcgcgcccgcgcaattctgggctggcagccgcgctttgcggatttgcagaccatcgtcagcaccgcctggacctggcaccagaaacgcttcggcggctaa

SEQ ID NO: 65203 - protein, 334 aa, Gloeobacter violaceus PCC 7421
MWSCTTRQSAMILVTGGAGYIGSHVVLALQAAGFEILVYDNLVYGHAEFVPAPMLIRGDLEDRVGLARLFAAHPIEAVIHMAAYAYVGESVTKPAVYYRNNVHGTLCLLEAMVEADVKQIVFSSTCATYGEPEQIPITETHPQRPINPYGFTKLVVERMLRDFDRAYGLRSVVFRYFNAAGADPDARVGEDHDPETHIIPLVLDVAIGRRPHITVFGSDYETPDGTCVRDYIHVSDLADAHVLGLKYLKSGGPTEVFNLGNGSGFSVQQVIDTAGQVAGREIAVQMGARRPGDPATLVGSAERARAILGWQPRFADLQTIVSTAWTWHQKRFGG

SEQ ID NO: 65204 - DNA, 1011 bp, Vibrio vulnificus YJ016
  CDS (1)..(1011): transl_table=11
atgaacatactggtcaccggtggcagcggttatattggcagccacacctgtattcagatgatcgaagcaggaatgacgcccatcattttggacaatctttataacagcaaattgctggtgctcgatcgcattgaacaggtcactggcgtgcgccccgctttctatcaaggtgacattcgtgacagcgagattctgcaacacgtctttgctcagcacgatatccagggcgtcatccactttgcaggcctaaaggcagtaggagaatcggttgaaaaacctctgatgtattatgataacaatgtgtcaggcaccctaaatctcgtacgagaaatggataaagctggtgttaagagccttattttcagttcgtcagccaccgtctatggtgatccagcctccgtaccaatccgtgaagatttcccaacctcagccaccaacccttatgggcggagcaaattgatggtggaagagtgtctgactgacttccacaaagccaatcctgattggagcatcactctgctgcgttatttcaatcccgttggcgctcacgagtcgggtttgctcggtgaggatcctcaaggcattccaaataacttattgccctttgtggctcaagttgcggttggtcgacgcgaaaagctaggcgtatttggtgacgactatccaacacccgatggcactggggttcgtgattacattcacgtcattgaccttgcagacggtcatttggcggctttgaataaagtggggcagcaagcaggattgcatatctttaaccttggtactggccaaggaaacagcgtacttgaaatggtcgctgcttttgaaaaagcggctcagcgtccgattccatacgaaatcaaacctcgccgtgccggtgatattgctgaatgctgggccgatccagcctatgcagaacaagtattgggatggaaagcgacacgctcactagagaccatggtggtagatacttggcgttggcaatccaacaacccaaatggctatgagtaa

SEQ ID NO: 65205 - protein, 336 aa, Vibrio vulnificus YJ016
MNILVTGGSGYIGSHTCIQMIEAGMTPIILDNLYNSKLLVLDRIEQVTGVRPAFYQGDIRDSEILQHVFAQHDIQGVIHFAGLKAVGESVEKPLMYYDNNVSGTLNLVREMDKAGVKSLIFSSSATVYGDPASVPIREDFPTSATNPYGRSKLMVEECLTDFHKANPDWSITLLRYFNPVGAHESGLLGEDPQGIPNNLLPFVAQVAVGRREKLGVFGDDYPTPDGTGVRDYIHVIDLADGHLAALNKVGQQAGLHIFNLGTGQGNSVLEMVAAFEKAAQRPIPYEIKPRRAGDIAECWADPAYAEQVLGWKATRSLETMVVDTWRWQSNNPNGYE

SEQ ID NO: 65206 - DNA, 981 bp, Rhodopseudomonas palustris CGA009
  CDS (1)..(981): transl_table=11
atgctgctggtcaccgggggcgccgggttcatcggatcgaatctggtcgcggcgctgaacgaggccgggcgggccgacgtggccgtgtccgatttcctcggccatgacggcaaatggaaaaaccttgccaagcgtcagttggccgatttcgtgccgccggcggaactcgccgactggctgaagggccgcaagctcgacgctgtcttccacatgggcgcgatctccgcgaccaccgccaccgacggcgacatggtgatggagaacaatttccggctatcgctgcggctgctcgactggtgcaccgagaccggcacgccgctgatctacgcctcgtccgcggcgacctatggcgatggcgaacacggcttcgatgacgatttctcgctggtcgcgctgaagcagctgcggccgatgaatctgtacggctggagcaagcatctgttcgacttggtggtagcggagcgcttagccaagggcgacaagctgccgccgcaatgggccggcttgaaattcttcaacgtgttcggcccgaacgagtatcacaaggataccatggccagcgtgctggcgcggcggttcgacgacatcaagtccggccgggttgtgcagttgttcaagtcgcaccgagaaggcatctccgacggcgaccagcgccgcgactttatctatgtcgacgacgtcgtgcgggtgatgatgtggctgttcgcttcgcccagcgtcagcggcatcttcaacgtcggcaccagccatgcccggagcttccgcgacttgatcctggccgcctatgcggcgctcggcacgccgccgcagatcgagtacatcgatatgccggaacagattcgcggcagctatcagtatttcacccagagcgagggcgaccggctgcgtgccgctggctacaatggcggcttcaccccgctcgaagaggcggtcgcgtcttacgtcacaggttacctcgaccgcagcgatcgcttccgctga

SEQ ID NO: 65207 - protein, 326 aa, Rhodopseudomonas palustris CGA009
MLLVTGGAGFIGSNLVAALNEAGRADVAVSDFLGHDGKWKNLAKRQLADFVPPAELADWLKGRKLDAVFHMGAISATTATDGDMVMENNFRLSLRLLDWCTETGTPLIYASSAATYGDGEHGFDDDFSLVALKQLRPMNLYGWSKHLFDLVVAERLAKGDKLPPQWAGLKFFNVFGPNEYHKDTMASVLARRFDDIKSGRVVQLFKSHREGISDGDQRRDFIYVDDVVRVMMWLFASPSVSGIFNVGTSHARSFRDLILAAYAALGTPPQIEYIDMPEQIRGSYQYFTQSEGDRLRAAGYNGGFTPLEEAVASYVTGYLDRSDRFR

SEQ ID NO: 65208 - DNA, 1014 bp, Rhodopseudomonas palustris CGA009
  CDS (1)..(1014): transl_table=11
atgaccgtactcgtcaccggcggcgccggttacatcggaagccacacggttctggcgctggtcgaggccggcgaaagcgtggtggtgatcgacaatctctcaaccggcttttcgcagttcgtgcctgaaggcgttccgctgttcatcggcgatgctggcgacgaaaatctggtcgacggcgtgatcgcgtcgcatcgcgtcgatgccatcatccattttgccggctcggtgatcgtctcggcctcgatgcgcgatccgctcggctactaccgcaacaacacctcgacctcacgcagcctgctcagcgcagccacgcggcgtggcgtcaagaacttcatcttctcctcgacggctgcggtttacggcaatccagaccgcattccggtcggagaagatgcgccgacgcggccgctatcgccctatggccgctccaagctgatgaccgagatcatgctgcatgacgcggcggaggcctacggcgtcaactacgtggcgctgcgctacttcaacgtcgccggcgccgatccgttgggccgggttggtctcgccaccgagggcgccacgcacctaatcaagatcgccgtggaagccgcgaccgggcagcgcagccggatcgacgtctacggcaccgactatccgacgacggacggcagttgcattcgcgacttcattcacgtcaccgatcttgccgaagcgcacggcgccgcgctcggttacttgcgcgcgggtggcggcccggtgacgctgaactgcggctacggccacggctattcggtgttcgaaaccatcgacgcggtgaagcgcgtcgcgggccgcaacttcgccgtcgccgcggcatcgcgccggcccggcgacatcatgacgatgatcgccgacaccagccgaatccgccgcacgctggattggatcccgcgctacgacgatctcgacaccattgcggcacacgctttgggatgggaggaaaagctcctgcgccagcgccaagcggttgaattgcaagcaattccggcctga

SEQ ID NO: 65209 - protein, 337 aa, Rhodopseudomonas palustris CGA009
MTVLVTGGAGYIGSHTVLALVEAGESVVVIDNLSTGFSQFVPEGVPLFIGDAGDENLVDGVIASHRVDAIIHFAGSVIVSASMRDPLGYYRNNTSTSRSLLSAATRRGVKNFIFSSTAAVYGNPDRIPVGEDAPTRPLSPYGRSKLMTEIMLHDAAEAYGVNYVALRYFNVAGADPLGRVGLATEGATHLIKIAVEAATGQRSRIDVYGTDYPTTDGSCIRDFIHVTDLAEAHGAALGYLRAGGGPVTLNCGYGHGYSVFETIDAVKRVAGRNFAVAAASRRPGDIMTMIADTSRIRRTLDWIPRYDDLDTIAAHALGWEEKLLRQRQAVELQAIPA

SEQ ID NO: 65210 - DNA, 984 bp, Rhodopseudomonas palustris CGA009
  CDS (1)..(984): transl_table=11
atgaccagacgccacatcctcgtgaccggcggtgccggctacatcggcagccacatgacgctcgccctgctcggcgccggcgaacggccgctggtgatcgacaatctctccaccggatcgcgcgcgatcgtgccgaccgacgtgccgttcttcgagggcaatgtcggcgatgccgacttcgtcggccggatcatggacgaacacccgatcgaggcgatcattcatttcgccgccagcatcgtggtaccggaatcggtcacccagcccctcgcctactacggcaacaacaccgccaacgcgcgcacactgctcgaatgcgcggtcaatcatggcgtgccgcatgtggtgttctcatcgacggccgcagtctatggcgagccggaccgcacgcccgtcgaagaagatgatccgacgcgtccgatcaatccttacggccgctccaagctgatggtcgaatggatgctggccgatatcgcgcaggcgtatccgttcagctacgcggcgctgcgctacttcaacgtcgccggcgccgatccgcaaggccgcgccggacaatcaacgccgaacgcgacccatctgatcaagatcgcggtgcaggccgcgctcggcaagcgttccgggctcgacgtttacggcaccgactattccaccccggacggctcatgcatccgcgactatgtgcatgtgtcggatctggcacaggcgcatctcgatgcgctcgattatctgcgggccggcaagccgagcatcacctgtaacatcggctacgccaacggctactccgtgctcgacgtgatcaacgtggtgaagcgcgtgtcgggcgtcgatttcgaagtacggatcaagggccgccgcgccggcgaccctgcggcgctgatcgccgccaatcagcgcgcccggaccgcgctgagctggacgccgcgctacgacgatctcgagcagatcgtgcgcgacgcgctcgcctgggagcgccgtctcggctga

SEQ ID NO: 65211 - protein, 327 aa, Rhodopseudomonas palustris CGA009
MTRRHILVTGGAGYIGSHMTLALLGAGERPLVIDNLSTGSRAIVPTDVPFFEGNVGDADFVGRIMDEHPIEAIIHFAASIVVPESVTQPLAYYGNNTANARTLLECAVNHGVPHVVFSSTAAVYGEPDRTPVEEDDPTRPINPYGRSKLMVEWMLADIAQAYPFSYAALRYFNVAGADPQGRAGQSTPNATHLIKIAVQAALGKRSGLDVYGTDYSTPDGSCIRDYVHVSDLAQAHLDALDYLRAGKPSITCNIGYANGYSVLDVINVVKRVSGVDFEVRIKGRRAGDPAALIAANQRARTALSWTPRYDDLEQIVRDALAWERRLG

SEQ ID NO: 65212 - DNA, 981 bp, Geobacter sulfurreducens PCA
  CDS (1)..(981): transl_table=11
atgcctgttctggtcaccggcggtgccggctatattggaagccatgtggtccgccagctctcggaggccggctatacggtggtggtctacgacaatctttccactggcttccccgatgcccttgtccacggagaacggctcgtgacgggcgatttgtccgacaccgcccggctcgacgcgcttttcgtggagtacggtttttcaacggtgctccactttgccgcctccatcattgcgcccgagtcggtcacagctccgctcaagtattacggcaacaatacgcgaaataccctgaacctcctcggtgcctgcgtgaagcacggtgtcgagcgtttcatcttctccagcaccgcggcggtctacggtatcccggacagcggcgtcgccgccgaggagagtgccactgtgcccatcaacccctacggcacgtcaaagctcatgagcgagtggatgctgcgcgatgtctgtgccgcccacggcatgcgctcggtggccctgcgctacttcaacgtggcaggcgccgatccccaggcacgcatgggacagagaacgccggaggcgacccacctcatcaaggtttcctgccaggctgccttggggctgcgggacaaggtgtgcatcttcggcaccgactacccgactccggacggcaccggaatccgggattacatccacgtggaggatcttgcctctgctcatctggccgccctgtcgtacctggaaaaaggtggcgagtcgacccgtatcaatgttggctatggcagcggatccagtgtccgggaagtgatcgacatggtccgccgggtgtcgggagttcatttccttgccgaggaggctccccggcggccgggcgacccacccagtctcgtggcacgggcggatcgagccaggacgctgctcggctggactccccgctacgataatcttgaaaccatcgttgccgatgcctggcgctgggaaaagaaaatcagcggcaactag

SEQ ID NO: 65213 - protein, 326 aa, Geobacter sulfurreducens PCA
MPVLVTGGAGYIGSHVVRQLSEAGYTVVVYDNLSTGFPDALVHGERLVTGDLSDTARLDALFVEYGFSTVLHFAASIIAPESVTAPLKYYGNNTRNTLNLLGACVKHGVERFIFSSTAAVYGIPDSGVAAEESATVPINPYGTSKLMSEWMLRDVCAAHGMRSVALRYFNVAGADPQARMGQRTPEATHLIKVSCQAALGLRDKVCIFGTDYPTPDGTGIRDYIHVEDLASAHLAALSYLEKGGESTRINVGYGSGSSVREVIDMVRRVSGVHFLAEEAPRRPGDPPSLVARADRARTLLGWTPRYDNLETIVADAWRWEKKISGN

SEQ ID NO: 65214 - DNA, 825 bp, Danio rerio
  CDS (1)..(825)
atgagctgcagtgaccggcggactgtgctcgtcactggaggagctggattcattgggtctcatctgatctgcgctctggctgggcggtttcctcactggaggatcatcaacgttgataatctccagtattgctccaacctgaagaacctgcgttcagtccaggccagcagctcttacagcttcattccgggtgatgtgtgtgatcctctgttcatcaagcatctgttttccactgaacacatcgatgtggtcttccactgcgctgctgaaactcatgtagagaactcgtttgtgtgtccgtcgcgcttcatgcgtgtgaatgtggacggcactgcggtgctggtgcgggcggcgctggaggccagtgtgcagcgcttcatctacatcagcactgatgaggtgtacggtgacagcgtagaccagccctttgatgagctgagtcctaaaagacccacaaacccctactccagatccaaagctgcagccgagagcatcgtcaccagctactggctcaaacacaagtttccagccgtgatcacgaggagcagtaatgtgtacgggccgcggcagcatcatgagaaggtcattcccagattcctctcgctcctgcagcagcagcagaagtgcactatccagggctccggcctgcagtcaagacacttcctgtatgtctctgacgtcaccgacgccttcctgacggtgatggagaagggcattctgggagaaatctacaacatcgggaccggctttgagattcccatcattcagctggccagagaactggtccaaatggtgagagcagacagtgaagagcgtctctgctga

SEQ ID NO: 65215 - protein, 274 aa, Danio rerio
MSCSDRRTVLVTGGAGFIGSHLICALAGRFPHWRIINVDNLQYCSNLKNLRSVQASSSYSFIPGDVCDPLFIKHLFSTEHIDVVFHCAAETHVENSFVCPSRFMRVNVDGTAVLVRAALEASVQRFIYISTDEVYGDSVDQPFDELSPKRPTNPYSRSKAAAESIVTSYWLKHKFPAVITRSSNVYGPRQHHEKVIPRFLSLLQQQQKCTIQGSGLQSRHFLYVSDVTDAFLTVMEKGILGEIYNIGTGFEIPIIQLARELVQMVRADSEERLC

SEQ ID NO: 65216 - DNA, 993 bp, Lactobacillus johnsonii NCC 533
  CDS (1)..(993): transl_table=11
atgcgagtattagttatcggcggagctggttacattggctctcacgctgttagaaaattaattgaagaaggaaacgatgttgttgtccttgattctctctacactggtcacagaaaagctgtcgacaagagagctaaattctatcaaggtgacattgaagatactaatttagtaagcaaaatcttacgtgatgaaaatattgacgcagtaatgcactttgctgcttactcattagttggtgaatcagttaagaaacctttgaaatactacgataataatgtttctggaatgatttcactacttcaagctatggaagatgctaaagttaaatatttagtcttctcttctagtgctgctacttatggtattcctgaaaaattaccaattactgaagacactccattaaatccaattaacccatatggtgaaactaagatgatgatggaaaagattatgcactgggctgacaaggctaatggtattaagtcaatcgcccttcgttacttcaatgtagctggtgcttcaagtgatggttcaatcggtgaagatcacggacctgaaactcacttgattcctaacattttaaagagtgctattgcaggcgacggtaacttcactatttttggggatgactataacactaaagatggtactaacgtccgtgactatgttcaagttgaggacctaattgatgctcatatcttagcccttaaacacgtgatggacactaataaatctgatgtctttaacttaggtactgcccaaggatactctaacttagaaattcttgaagctgctaagaaagttactggtatcgacattccttacactattggtgcaagaagaggcggagaccctgactccttagttgctgattcaagcaaagctcgtaaagttttaggctggaagccaaaacatgaagatgttgatgacgtaattgccactgcttggaactggcacaagagtcacccaaagggttacgaagataaataa

SEQ ID NO: 65217 - protein, 330 aa, Lactobacillus johnsonii NCC 533
MRVLVIGGAGYIGSHAVRKLIEEGNDVVVLDSLYTGHRKAVDKRAKFYQGDIEDTNLVSKILRDENIDAVMHFAAYSLVGESVKKPLKYYDNNVSGMISLLQAMEDAKVKYLVFSSSAATYGIPEKLPITEDTPLNPINPYGETKMMMEKIMHWADKANGIKSIALRYFNVAGASSDGSIGEDHGPETHLIPNILKSAIAGDGNFTIFGDDYNTKDGTNVRDYVQVEDLIDAHILALKHVMDTNKSDVFNLGTAQGYSNLEILEAAKKVTGIDIPYTIGARRGGDPDSLVADSSKARKVLGWKPKHEDVDDVIATAWNWHKSHPKGYEDK

SEQ ID NO: 65218 - DNA, 969 bp, Bdellovibrio bacteriovorus HD100
  CDS (1)..(969): transl_table=11
atgattattgtaacaggcgcaaacggttttattggcagtgtgatggtgtgggaactgaaccaaaaaggtcttaccgatatcatcgcggtggactcggtaggtctttccgaacgcaatcttcttcgcaaacaaaaaatcaccaagttccttttgaaggatgatctgtggccgttccttgaaaccgaggaagccaagaaacaagtcacttggatcatccacatgggcgcctgctcttccacgacagaaaccaacaaagagttcctgtgggagaacaacacttactacacacaaagaatctttgaatggtgcgcagaacatggcaagtccatgatctatgcttccagcgctgcaacttacggagctggcgaactgggctttgacgacaccaccgatcctgaaaaactgcgcccactgaatctgtacggtgaatccaaagtcctgtttgaccgctgggcggtgaaacagacgaaaacgcctccacactggtacggccttaagttcttcaacgtctttggtccgaatgaataccacaaaggcgcgatgtccagcgtggcattcaaagcttacaatcagatcaaggacaccggcgctttggggttgttcaagtccgcagacccgaactacaaggacggcgaattcatgcgtgacttcgtttacgtcaaggatgttacgggctggatggccgagttgatggagaaaaaaccaacgaacggcgtttataacatgggcttcggcaagccgcgcacctggctggatcttgccggtggtgttttcaaagccatgggtaaagacatgaaaatcaactggctggaaatgcctgaaaacatccgtggtcagtatcagtacttcaccgaagctaaaaccgacaagtggctggccgcaggcatgagcccggcaaaatggcctttggaaaaagccgtcgctgattatattcagaactatttgtccaaagacgacaaagacctgtaa

SEQ ID NO: 65219 - protein, 322 aa, Bdellovibrio bacteriovorus HD100
MIIVTGANGFIGSVMVWELNQKGLTDIIAVDSVGLSERNLLRKQKITKFLLKDDLWPFLETEEAKKQVTWIIHMGACSSTTETNKEFLWENNTYYTQRIFEWCAEHGKSMIYASSAATYGAGELGFDDTTDPEKLRPLNLYGESKVLFDRWAVKQTKTPPHWYGLKFFNVFGPNEYHKGAMSSVAFKAYNQIKDTGALGLFKSADPNYKDGEFMRDFVYVKDVTGWMAELMEKKPTNGVYNMGFGKPRTWLDLAGGVFKAMGKDMKINWLEMPENIRGQYQYFTEAKTDKWLAAGMSPAKWPLEKAVADYIQNYLSKDDKDL

SEQ ID NO: 65220 - DNA, 1020 bp, Treponema denticola ATCC 35405
  CDS (1)..(1020): transl_table=11
ttgattaaaagagtattggttacaggaggagccggatttataggctcccacatcgttgcagatttatgcgaaaaaggctatgagcctattattttggataatttttctaattcttcacctaaaataattcccgtattggaaaaaatatgctctaaaaaattggagcttgtacaaatagatataaaggacaaggaaaagctttttaacttttttaaaagtacctctattgatgcagtaattcaccttgccgcatataaggccgtaggggagtccgtagaaaagcccttaaaatactatgaaaacaatatttccgggcttgtcaatcttttgcttgccatgcaggagcacaaggtaaaaaattttatattcagttcttcggctacagtctacggcgacgcaaaagttgtgccaatacctgaaaattctcctatttctgctgcaaatccttacggaagaacaaagcttatgtccgaagaaattttaaaggatacggccttttcggataaggatttgagtattattgctttgcgttattttaatcccataggagcccataaaagtgccgatataggggaacttccttccggtattcccaataaccttttcccatatatcgctcaagtagctttgggcaaactgcctcatttaaacgttttcggaaacgactatgacacccctgacggtacctgtatccgcgactatatccatattttggatcttgcgtcgggacatactgtcgccatagaaaaaatcgcctcaggttttaagggctttgatgtctataacctcggaacaggaatcggttattcggttttagacatagtaaacgcctttaaaaaagcctccggtatcgatcttcccgttaaaccggctgcccgccgtgcaggagatgttccgcgttcctgtgcaaaccccgacaaggccaacaaagagcttaactggaaggcaaaatacaaccttgaagaaatgtgcaaagacggctgggcttggtataaaaaacaccccgaaggctttgtgtaa

SEQ ID NO: 65221 - protein, 339 aa, Treponema denticola ATCC 35405
MIKRVLVTGGAGFIGSHIVADLCEKGYEPIILDNFSNSSPKIIPVLEKICSKKLELVQIDIKDKEKLFNFFKSTSIDAVIHLAAYKAVGESVEKPLKYYENNISGLVNLLLAMQEHKVKNFIFSSSATVYGDAKVVPIPENSPISAANPYGRTKLMSEEILKDTAFSDKDLSIIALRYFNPIGAHKSADIGELPSGIPNNLFPYIAQVALGKLPHLNVFGNDYDTPDGTCIRDYIHILDLASGHTVAIEKIASGFKGFDVYNLGTGIGYSVLDIVNAFKKASGIDLPVKPAARRAGDVPRSCANPDKANKELNWKAKYNLEEMCKDGWAWYKKHPEGFV

SEQ ID NO: 65222 - DNA, 966 bp, Bacillus cereus ATCC 10987
  CDS (1)..(966): transl_table=11
atgagtaagaaatgtttaattacaggtggagcaggatttattggatcacatttagctgaagagctggtgaaaagaggttatgatgtcactatcgttgataatttctataaagggaaaaataaatatcatgatgagttaatgaaagaaattcgggttattccaataagtgttttagatcgaaattctatttatgaattagtgaatcaacatgatgtagtgtttcatttagcagcaattttaggtgtgaaaacgacaatggaaaagagcatagagcttattgaaacgaattttgatggaacgagaaacattttacaagcagcgctaaaaggaaagaagaaagttgtttttgcgtctacttcagaagtatatggtaaggcaaagccacccttttctgaagtaggagatcgattatacggtgcaacttctaaaatacgttggagttatgcagtttgtaaaacgttagaagaaacattatgtttaggatacggtttagaaggcttacctgtaacgattgttcgttattttaatatttatggtccaagagcgaaagatggtccgtatgcaggggtaatcccgcgatttatccgcgcagcactgcaaggagaagacattctcgtatatggagatggaaaacagacacgttgttttacgtatgtaagtgatgcggtagaggcaacgattcgagcaatggatgagaaggtaaatggtgagattattaatataggttctgagaatgaaaagagtataaaagaagtagcagaagtaattaaaaagctaacgaaatcttcttcaaagattgttcaagttcctttcgaagaggtatatccacatggctttgaagaaattccaaatagaagaccagatgtaacgaaattaagagaacttgttcaatttcaagcgaaagtaacgtgggaacaagggttgaaagaaactattaaatggtttcgtgaagaaaacaatggctaa

SEQ ID NO: 65223 - protein, 321 aa, Bacillus cereus ATCC 10987
MSKKCLITGGAGFIGSHLAEELVKRGYDVTIVDNFYKGKNKYHDELMKEIRVIPISVLDRNSIYELVNQHDVVFHLAAILGVKTTMEKSIELIETNFDGTRNILQAALKGKKKVVFASTSEVYGKAKPPFSEVGDRLYGATSKIRWSYAVCKTLEETLCLGYGLEGLPVTIVRYFNIYGPRAKDGPYAGVIPRFIRAALQGEDILVYGDGKQTRCFTYVSDAVEATIRAMDEKVNGEIINIGSENEKSIKEVAEVIKKLTKSSSKIVQVPFEEVYPHGFEEIPNRRPDVTKLRELVQFQAKVTWEQGLKETIKWFREENNG

SEQ ID NO: 65224 - DNA, 993 bp, Bacillus cereus ATCC 10987
  CDS (1)..(993): transl_table=11
atgaattcaatcctaatctgcggcggagctggttatatcggttcgcacgctgtgaaaaggttagtagacgaaggtttatctgtagtagtagtagataacttacaaacgggtcatgaggatgcaattacggaaggcgcgaagttttataatggcgaccttcgtgataaagcatttttaagagatgtgtttacacaagaaaatattgaggcggttatgcatttcgcagctgattctttagtgggagttagtatggagaagcctctgcaatattataataacaatgtatatggtgcactttgtttattagaggtaatggatgagtttaaggtagataagtttattttctcttctactgcggcgacgtatggtgaggtagatgtagaccttattactgaggaaacgatgacaaatccaacgaatacgtatggagagacgaagttagcaatcgagaagatgcttcattggtatagccaagcttctaatttacgttataagattttcagatactttaacgtggctggtgcaactccaaatggtattattggggaagatcaccgtccagagacgcatttaattcctcttgtattgcaagtggcgttaggtcaacgtgagaagattatgatgtttggtgatgattataatacaccagacggtacttgtatccgtgattatattcacgttgaagatttagtagcagctcacttcttaggtcttaaagatctacaaaacggcggagaaagtgatttctataacttaggaaatggtaatggtttcagtgttaaagaaatcgttgatgcagttcgtgaagttacaaatcatgaaattccagctgaagtagcaccgcgccgtgcgggagatccagcacgtttagttgcttcttctcagaaagcgaaagagaagttaggttgggatcctcagtatgtaaatgtgaagacaatcattgagcatgcttggaattggcatcagaagaaacctaatgggtatgataagtaa

SEQ ID NO: 65225 - protein, 330 aa, Bacillus cereus ATCC 10987
MNSILICGGAGYIGSHAVKRLVDEGLSVVVVDNLQTGHEDAITEGAKFYNGDLRDKAFLRDVFTQENIEAVMHFAADSLVGVSMEKPLQYYNNNVYGALCLLEVMDEFKVDKFIFSSTAATYGEVDVDLITEETMTNPTNTYGETKLAIEKMLHWYSQASNLRYKIFRYFNVAGATPNGIIGEDHRPETHLIPLVLQVALGQREKIMMFGDDYNTPDGTCIRDYIHVEDLVAAHFLGLKDLQNGGESDFYNLGNGNGFSVKEIVDAVREVTNHEIPAEVAPRRAGDPARLVASSQKAKEKLGWDPQYVNVKTIIEHAWNWHQKKPNGYDK

SEQ ID NO: 65226 - DNA, 1026 bp, Bacillus cereus ATCC 10987
  CDS (1)..(1026): transl_table=11
ttgaactacaggcctctagataatagtaaaacatatcttattactggagcagctggttttgtaggatactttttatctaaaaaattattagatcaaggttgcaaagtaataggtattgataatataaatgactattatgatgtaaatcttaaatatgctcgtttagaacaattaaagccctatgaaaaatttatttttattaaaggtgatatttctgataaggatatgattactaagctctttgaagagtacaagcctaatattgtagtgaatttggctgcgcaagctggtgtgagatattcaattgaaaatccagatgtatacattcaaagtaatatcattggtttttataatattcttgaagcatgcagacatttccctgttgagcatcttgtatacgcatcatcaagttctgtttatggagctaataaaaaggtaccatttgaggaaacagattttgtagacaatccagtctcgctttatgcttctactaagaaatcaaatgagttaatggctcatacgtatagtcacttgtacaaaatccctgcaactggacttcgtttctttacagtgtatggtccattggggcgcccggatatggcttattttggctttactgataaatattttgctggcgattcgattaaaatatttaataatggtgattttgaaaacgacctgtatcgtgattttacttatatcgatgatatcgttgaaggaattcaacgacttttaagtaatccacctaaaggtgatgttgagcataaggtatttaatattggaaataataaccctgaaaaactaatggtgtttatcgaaacattggagaaagtactaggtaaagctttaggaagagaagtggcatttgaaaaggtatttgagcctatcaaaccaggagatgtaccagctacttatgcatctacagatttattacagaaggctgtagattttaaacctgaaacttctatagaaaaaggtttacaagaattcgctaattggtatatagagtattataaagtgaaataa

SEQ ID NO: 65227 - protein, 341 aa, Bacillus cereus ATCC 10987
MNYRPLDNSKTYLITGAAGFVGYFLSKKLLDQGCKVIGIDNINDYYDVNLKYARLEQLKPYEKFIFIKGDISDKDMITKLFEEYKPNIVVNLAAQAGVRYSIENPDVYIQSNIIGFYNILEACRHFPVEHLVYASSSSVYGANKKVPFEETDFVDNPVSLYASTKKSNELMAHTYSHLYKIPATGLRFFTVYGPLGRPDMAYFGFTDKYFAGDSIKIFNNGDFENDLYRDFTYIDDIVEGIQRLLSNPPKGDVEHKVFNIGNNNPEKLMVFIETLEKVLGKALGREVAFEKVFEPIKPGDVPATYASTDLLQKAVDFKPETSIEKGLQEFANWYIEYYKVK

SEQ ID NO: 65228 - DNA, 921 bp, Methanococcus maripaludis S2
  CDS (1)..(921): transl_table=11
atgattaaaaaatatacttactactttatttttggtgaaattttgaaaattttagtaactggcggtgcaggatttatcggaagccatattgtagatatgttaattgaaaacggtcatgatgtatcaattttggataatttaagtactggaaacgagaaaaatttaaattcttcagcaaaatttatcaatggagatattttagataaaaatttagatttaactggatttgaatgcgtaattcatgaagcagcacagattaatgttagaacatccgttgaaaatccgagtttagacgcaaatataaatattcttggaacagttaacattttagaaaaaatgaaagaatatggtgttaaaaagattatattttcttcatcaggcggtgcagtttatggagaacccgaatatttgcctgttgatgaaaaacatagtttaaaaccgttatctccttacggtttaagtaaattctgtgcagaagagtacattaaactttacaatatgctttatgatatcgaatactgcattttaagatattctaatgtttacggggaaaggcaggatccactcggtgaggcgggtgtaatttcaatttttattgataaaatgaaaaaaggggaagttccggtaatttatggggatggaaaccagacaagagattttgtaaatgttaaagacgttgcaagagcaaatttaatggccttgaattggaaaaatgagatcgtaaatattggttcgggaaaagaaacatccgtaaatgaactttttaaaataatttcttctgaaattggttttgacaaagatccaatttacaaaaaagaaagagaaggcgaagtttacaaaatttatatcgattattctaaagctaaaagtctgggttggatgcctgaagttgaattggatgacgggattaaaaagatttaa

SEQ ID NO: 65229 - protein, 306 aa, Methanococcus maripaludis S2
MIKKYTYYFIFGEILKILVTGGAGFIGSHIVDMLIENGHDVSILDNLSTGNEKNLNSSAKFINGDILDKNLDLTGFECVIHEAAQINVRTSVENPSLDANINILGTVNILEKMKEYGVKKIIFSSSGGAVYGEPEYLPVDEKHSLKPLSPYGLSKFCAEEYIKLYNMLYDIEYCILRYSNVYGERQDPLGEAGVISIFIDKMKKGEVPVIYGDGNQTRDFVNVKDVARANLMALNWKNEIVNIGSGKETSVNELFKIISSEIGFDKDPIYKKEREGEVYKIYIDYSKAKSLGWMPEVELDDGIKKI

SEQ ID NO: 65230 - DNA, 942 bp, Yersinia pestis biovar Medievalis str. 91001
  CDS (1)..(942): transl_table=11
gtgaatacgatgattatcgttacaggcggcgcaggtttcattggcagcaatatagttaaggctctgaataatattggctacaaagatattctggtggttgataacctcaaagacggcactaaattcgtcaatctggttgatctggatatcgctgattacatggataaagaagattttgtcgccagtattgttgcgggtgatgacatgggcgatatcgatgctattttccacgaaggcgcgtgttcttccaccaccgagtgggatggcaagtacatgatggataacaactatcagtattctaaagatatccttcacttctgtctggatcgtagtattcctttcttatacgcctcttctgccgccacttacggtgggcgcactgacaactttattgaagatcgtcagtacgaacagccacttaacgtttatggctattccaaattcttgtttgatcagtatgtgcgtgaaattctgccacaagccgattcgcaaatttgtggattccgttatttcaacgtttatggtccacgtgaaggccataagggcagcatggccagcgtcgctttccatctgaataaccaaattaatgcaggtgaaaggcctaagttattcgcgggtagcgaaaactttaaacgtgatttcatttatgtgggtgatgttgctgacgttaatctgtggttctggcaaaacggcgtatccggtattttcaactgcggtactggccgggcagagtctttccaggctgtcgctgatgcagtggtggattatcaccaaagtgggccagtcgaatacatcgagttccctgaaaaactgaaaggccgctatcaggcatatacacaagccgatctcactaaattacgggctgccggttatggtaaaccgtttaaaacggtcgctgaaggcgttaaagaatatctggcctggctcaatcgctcagtctaa

SEQ ID NO: 65231 - protein, 313 aa, Yersinia pestis biovar Medievalis str. 91001
MNTMIIVTGGAGFIGSNIVKALNNIGYKDILVVDNLKDGTKFVNLVDLDIADYMDKEDFVASIVAGDDMGDIDAIFHEGACSSTTEWDGKYMMDNNYQYSKDILHFCLDRSIPFLYASSAATYGGRTDNFIEDRQYEQPLNVYGYSKFLFDQYVREILPQADSQICGFRYFNVYGPREGHKGSMASVAFHLNNQINAGERPKLFAGSENFKRDFIYVGDVADVNLWFWQNGVSGIFNCGTGRAESFQAVADAVVDYHQSGPVEYIEFPEKLKGRYQAYTQADLTKLRAAGYGKPFKTVAEGVKEYLAWLNRSV

SEQ ID NO: 65232 - DNA, 999 bp, Gibberella zeae PH-1
  CDS (1)..(999)
atgactatcgttacgacaatccgcagctccatacccagacgatccatcttggttacaggtggtgcaggcttcatcggctcccaccttgtcgaagcgctgctcgccgacggttactggaaggttgtcgttatcgacaacttcgatgagttctactctccagagatcaagcgggccaacctcgcaggccttctacagcaccccaaccttacagtctacgaggccgatattcgcgatataccagccttaacggccatcttcgctgataacgacttttctgttgtcgttcatctcgctgctcgcgcaggagttctcccctctcttcaagttccagacctttactttgacgtcaatgtcactggtacgatgaacctgctgcaatgctgcaaagactttggtgtcaagcaatttgtctttggatcatcctccagtgtctatggcttgggagcaaaggcccccttctccgaatctcagaaaactacacagcccatctccccatatgccgcatcaaaatcagcaggcgaactactgtgccacacctggtctcatctctaccagatacgctgtgtctgtctgagattcttcaccgtctacggtccccgtcaacgcccagatcttgccatccacaagttcaccagactcatccaccagggcaagccaatcccacttttcggtgatgggtcatccatcagagactacacctatatcgacgatatcatcgatggtatcttcggtgctatcgactatgaaggctcaatgtttgaggccatcaacctcggagagtcacagactatcacgctgatcgacctcatcagtgcaatcgagggaacattgggacgtaaggcgcttattgattggcgaggggaacaacctggagacatgccgcttacctatgcggacatttccaaggcgggctcaatcatcgggtacaaacccaagactcaggtgcagcagggcattgtcaagtttgttgcgtggtatctaaaccacaacgaggtttag

SEQ ID NO: 65233 - protein, 332 aa, Gibberella zeae PH-1
MTIVTTIRSSIPRRSILVTGGAGFIGSHLVEALLADGYWKVVVIDNFDEFYSPEIKRANLAGLLQHPNLTVYEADIRDIPALTAIFADNDFSVVVHLAARAGVLPSLQVPDLYFDVNVTGTMNLLQCCKDFGVKQFVFGSSSSVYGLGAKAPFSESQKTTQPISPYAASKSAGELLCHTWSHLYQIRCVCLRFFTVYGPRQRPDLAIHKFTRLIHQGKPIPLFGDGSSIRDYTYIDDIIDGIFGAIDYEGSMFEAINLGESQTITLIDLISAIEGTLGRKALIDWRGEQPGDMPLTYADISKAGSIIGYKPKTQVQQGIVKFVAWYLNHNEV

SEQ ID NO: 65234 - DNA, 1065 bp, Oryza sativa (japonica cultivar-group)
  CDS (1)..(1065)
atggtttcggccttgttgcggacgatcctggtgacgggcggcgccggctacatcggcagccacaccgtcctccagcttctccaactcggcttccgcgttgtcgtcctcgacaacctcgacaacgcctccgagctcgccatcctccgcgtcagggaactcgccggacacaacgccaacaacctcgacttccgcaaggttgacctccgcgacaagcaagcgttggaccaaatcttctcctctcaaaggtttgaggctgtcatccattttgccgggctgaaagctgttggcgagagcgtgcagaagcccctgctttactacgacaacaacctcatcggcaccatcactctcctgcaggtcatggccgcacatggctgcaccaagctggtgttctcatcatccgcaactgtctacgggtggcccaaggaggtgccctgcactgaagaatccccactttgtgcaatgaacccctacggcagaacaaagctggtaatcgaagacatgtgccgggatctgcatgcctcagacccaaactggaagatcatactgctccgatacttcaaccctgttggagctcacccaagcgggtacattggtgaggacccctgcggcatcccaaacaacctcatgcccttcgtccagcaggtcgctgttggcaggaggccggcccttaccgtctatggaaccgactacaacaccaaggatggaactggggttcgtgactatatccatgttgttgatctagcggatggtcatatcgccgcgttaaggaagctctatgaagattctgatagaataggatgtgaggtgtacaatctgggcactggaaaggggacatctgtgctggaaatggttgcagcattcgagaaagcttctggaaagaaaatcccgcttgtatttgctggacgaaggcctggagatgccgagatcgtttacgctcaaactgccaaagctgagaaggaactgaaatggaaggcaaaatacggggtagaggagatgtgcagggacctgtggaattgggcgagcaagaacccctacgggtatggatcgccggacagtagcaactga

SEQ ID NO: 65235 - protein, 354 aa, Oryza sativa (japonica cultivar-group)
MVSALLRTILVTGGAGYIGSHTVLQLLQLGFRVVVLDNLDNASELAILRVRELAGHNANNLDFRKVDLRDKQALDQIFSSQRFEAVIHFAGLKAVGESVQKPLLYYDNNLIGTITLLQVMAAHGCTKLVFSSSATVYGWPKEVPCTEESPLCAMNPYGRTKLVIEDMCRDLHASDPNWKIILLRYFNPVGAHPSGYIGEDPCGIPNNLMPFVQQVAVGRRPALTVYGTDYNTKDGTGVRDYIHVVDLADGHIAALRKLYEDSDRIGCEVYNLGTGKGTSVLEMVAAFEKASGKKIPLVFAGRRPGDAEIVYAQTAKAEKELKWKAKYGVEEMCRDLWNWASKNPYGYGSPDSSN

SEQ ID NO: 65236 - DNA, 990 bp, Leptospira interrogans serovar Copenhageni str. Fiocruz L1-130
  CDS (1)..(990): transl_table=11
atgaaagcgttagttacaggcggagcagggtttattggaagtcatcttgtagatcttctattggaaaatcaatttgaggttaccgttctggataatttcagtacgggaagggcgtttaatttaaatcacgtaaaagagaaaattgatttagttgaatgtgatctatcgattcaagaagattggatcaaaaagtttcaatcagttgattatgtatttcatcttgcggcgctcgcggacattgttcctagtattcaaaaccctgaaggttattttcaatcaaatgtaactggtactctgaatgttcttcaagctagtagacattacggagtgaagcggtttgtttatgctgcttcttcttcttgttatggaattccggagctttatccaactcctgagacttcgccaattctacctcaatacccatatgcacttacaaaaagaatgggggaagagttagtcatgcactgggtacaagtttataaatttcccgctctatcattaaggttttttaatgtttacggacctagatctagaacttctggaacttatggtgccgtatttggagtttttttagctcaaaagttggcagggaaacctttcactgtagttggggatggaaaacaaactagagattttacttatgtgcaagacgttgcggaagcggtttttgctgctgcccaaagtgataaagtaggtgaaatttataatgttggaagtggtgcaacgatttcagtcaatcgaattgtagaacttttgaaaggagaagttacttatattccaaaacgaccgggtgaaccagatagcacttttgccgatattgcaaaaattaaaaaagatttaaaatggtcccctaagatttctatagaaacagggattggcgaattattaaaaaatatagattattggagagaagctccagtatggacgcctgataagatagaaaaagcgacatccgattggtttaagtatcttggcggatctaattcataa

SEQ ID NO: 65237 - protein, 329 aa, Leptospira interrogans serovar Copenhageni str. Fiocruz L1-130
MKALVTGGAGFIGSHLVDLLLENQFEVTVLDNFSTGRAFNLNHVKEKIDLVECDLSIQEDWIKKFQSVDYVFHLAALADIVPSIQNPEGYFQSNVTGTLNVLQASRHYGVKRFVYAASSSCYGIPELYPTPETSPILPQYPYALTKRMGEELVMHWVQVYKFPALSLRFFNVYGPRSRTSGTYGAVFGVFLAQKLAGKPFTVVGDGKQTRDFTYVQDVAEAVFAAAQSDKVGEIYNVGSGATISVNRIVELLKGEVTYIPKRPGEPDSTFADIAKIKKDLKWSPKISIETGIGELLKNIDYWREAPVWTPDKIEKATSDWFKYLGGSNS

SEQ ID NO: 65238 - DNA, 930 bp, Thermus thermophilus HB27
  CDS (1)..(930): transl_table=11
gtgttggtgacgggcggcgccggtttcatcggaagccacatcgtggaggacctcctcgccaggggcctggaggtggcggtcctggacaacctggccacgggcaagcgggaaaacgtgcccaaaggcgtccccttcttccgggtggacctaagggacaaagaaggggtggaaagggccttccgggagttccgccccacccacgtctcccaccaggcggcccaggcctcggtgaaggtgagcgtggaggacccggtcctggactttgaggtgaacctcctgggggggctcaacctcctcgaggcctgccgccagtacggcgtggagaagctcgtcttcgcctccacgggcggggccatctacggggaggtgcccgagggggaaagggccgaggagacctggcccccccgccccaagagcccctacgccgcgagcaaggcggcctttgagcactacctctccgtctacgggcaaagctacgggctcaagtgggtctccctgcgctacggcaacgtgtacggccccaggcaggacccctacggggaggcaggggtggtggccatcttcgccgagcggatcctcaagggcctacccgtgaccctctacgcccggaagactcccggggacgaggggtgcgtgcgggactacgtttacgtgggggacgtggccgaggcccacgccctcgccctcttctccctggaagggatctacaacgtggggaccggggaggggcacaccacgagggaggtcctcatggccgtggccgaggccgcggggaaggcccccgaggtccagcccgcccccccgcgccccggggacctagaacggagcgtcctctcccccctcaagctcatggcccacggctggcggcccaaggtggggttccaggagggcatccgcctcaccgtagaccacttccggggcgccgtatag

SEQ ID NO: 65239 - protein, 309 aa, Thermus thermophilus HB27
MLVTGGAGFIGSHIVEDLLARGLEVAVLDNLATGKRENVPKGVPFFRVDLRDKEGVERAFREFRPTHVSHQAAQASVKVSVEDPVLDFEVNLLGGLNLLEACRQYGVEKLVFASTGGAIYGEVPEGERAEETWPPRPKSPYAASKAAFEHYLSVYGQSYGLKWVSLRYGNVYGPRQDPYGEAGVVAIFAERILKGLPVTLYARKTPGDEGCVRDYVYVGDVAEAHALALFSLEGIYNVGTGEGHTTREVLMAVAEAAGKAPEVQPAPPRPGDLERSVLSPLKLMAHGWRPKVGFQEGIRLTVDHFRGAV

SEQ ID NO: 65240 - DNA, 987 bp, Parachlamydia sp. UWE25
  CDS (1)..(987): transl_table=11
atgaaaatatatgatgatcaattaatagtaatcacaggtggagctggatttattggctcttgtcttgttcgctatttgaataacaaaggaatgacgaatctcttgattgttgatgaacttgggcacagtgaaaaatggaaaaatcttgttggtaaaaaatttgccgacatcattcctaaacatcaattatttaattggttaaatggaaaagaatccttgattgaagcgttcgttcatttaggagcttgttcaaatacattagagaaagatgctagttaccttttagaaaataattaccgctatacagttcaattagctgagtatgcgttaaaacatgagcatcgctttatttacgcttcttcagcagccacttacggggatggcttaaagggatttcaagataaagaaaacgagttgtactcgcttgaacctttaaatatgtacggcttttctaaacagctttttgatcaatgggcttatacagaaggagccttagaaaaaattgtgggattaaaatactttaatgtatttggtcctaatgaatatcacaaagggcgaatggcctcagctgtgaataaaatggtaccagaaattttaaagggtgaaacagtcaaactttttaaatcgagcgagcctcatctttatgcagacggagagcaaaaaagagattttatttatgtcaaagatgttgttagaatcacgtgtgcatttttagaaaacgacgttggaggtttatataatgttggtagcggggaagcttctacatggaattccttaacacatgctgtttttaaagctctcgattgtcctgtcaaaattgaatatgttgacatgccaaaagaattggttgggaaatatcaaaattacagtcgtgcagatacaaaaaagcttgaaacgatactaaaagatcaatctcatcccatgcttttggaagctgctattgaagattatgtaaaaaactatttggtgacgaagaaaatatggtag

SEQ ID NO: 65241 - protein, 328 aa, Parachlamydia sp. UWE25
MKIYDDQLIVITGGAGFIGSCLVRYLNNKGMTNLLIVDELGHSEKWKNLVGKKFADIIPKHQLFNWLNGKESLIEAFVHLGACSNTLEKDASYLLENNYRYTVQLAEYALKHEHRFIYASSAATYGDGLKGFQDKENELYSLEPLNMYGFSKQLFDQWAYTEGALEKIVGLKYFNVFGPNEYHKGRMASAVNKMVPEILKGETVKLFKSSEPHLYADGEQKRDFIYVKDVVRITCAFLENDVGGLYNVGSGEASTWNSLTHAVFKALDCPVKIEYVDMPKELVGKYQNYSRADTKKLETILKDQSHPMLLEAAIEDYVKNYLVTKKIW

SEQ ID NO: 65242 - DNA, 1026 bp, Desulfovibrio vulgaris subsp. vulgaris str. Hildenborough
  CDS (1)..(1026): transl_table=11
atgagcacgttcgactccgtcctgcaggacatcaacgccagcccgcgcacatggcttgtcacgggcgtagccgggttcatcggctccaacctgctggagaccctgctcaggcagggacagcgcgtggtgggcctcgacaatttcctcaccggctaccagcgcaacctcgacatggtgcgcgacctcgtgggcgaagagcgttgggcgtcgttccgcttcatcgagggcgacatccgcgacctcgccacctgccacgaagcctgcaagggcgtcgaccatgtgctgcatcaggcggccctcgggtcggtaccgcgctccatcgacgaccccatcctctccaacgagtgcaacatcaccggtttcgtcaacatgctggtggccgcccgtgatgccggcgccaagagcttcgtctacgcggcgtccagttccacctacggtgacgaaccgacgctgcccaaggtcgaggacatcatcggcaagccgctttcgccctacgccgtcaccaagtacgtcaacgaactctacgccgacgtgttcgcgcgctgctacggcttcaccgccatcgggctgcgctacttcaacgtcttcgggcagcgccaggaccccttcggtgcctacgcagccgtcatcccccagtggttcgccagcctgctgcgcggcgagaccgtgttcgtgaacggcgacggcgagaccagccgcgacttctgctacatcgacaacgtggtgcaggccaacatcctcgcttcgctggcccctgccgaagcacgcgacaaggtgtacaacgtggccttcggccagcgcaccacactgaacgaactcttcgacctcattcgcgaagaggtggtgcgtcacaagcccgaagccgccggggccacctgcgtgcatcgcgacttccgcgcgggagacgtgcgtcactcgctggccgacatcacccgcgcacagacgcttctgggctacgccccggtgtacgacgtgcgcgaggggctgcgactggctggcgactggtacgccgccaacctgaagtag

SEQ ID NO: 65243 - protein, 341 aa, Desulfovibrio vulgaris subsp. vulgaris str. Hildenborough
MSTFDSVLQDINASPRTWLVTGVAGFIGSNLLETLLRQGQRVVGLDNFLTGYQRNLDMVRDLVGEERWASFRFIEGDIRDLATCHEACKGVDHVLHQAALGSVPRSIDDPILSNECNITGFVNMLVAARDAGAKSFVYAASSSTYGDEPTLPKVEDIIGKPLSPYAVTKYVNELYADVFARCYGFTAIGLRYFNVFGQRQDPFGAYAAVIPQWFASLLRGETVFVNGDGETSRDFCYIDNVVQANILASLAPAEARDKVYNVAFGQRTTLNELFDLIREEVVRHKPEAAGATCVHRDFRAGDVRHSLADITRAQTLLGYAPVYDVREGLRLAGDWYAANLK

SEQ ID NO: 65244 - DNA, 996 bp, Desulfovibrio vulgaris subsp. vulgaris str. Hildenborough
  CDS (1)..(996): transl_table=11
atgaccgtaagcggctgttgcagcaatgttctggtttgtggcggcgcgggatatataggctcgcatatggtgcgggctcttgtcgagcacgggtatgtgcctatcatcttcgacaacctgtcaacgggccatgcagagtcggtgggggatgtcgacctcgtgcgtggcgacttgctcgacaggcaggccttgcggaggctgttcgcagagcactcgttcgatgccgtcatgcatttttcggcaaagagcctcgtcggggagtccatgaccgaccccggcatctacttcgtcaacaacgtcgtcggcaccatcaatctgctcgaggccatgcgtgaggctggcgtctcccgtctggtgttctcgtcttctgcggcggtcttcggcaatcccctgacggcgcgcatcgccgaagaccacccccggcagccggtcaacccctacgggcgcagcaagctcatgatcgaacaggccctgcgcgactacgccaacgcctacgggatgcggtctgtgtcgttgcgatatttcaatgcggcaggggccgatgaggctggcgacatcggcgagtcgcacaagcccgagacgcacctcatccccaacgtgttgcgcgctgcccttggcaccgggcctgaactgaagattttcggcgatgactacgatacgcccgacggcacatgcgtccgtgactacatccatgtggccgacctgtgcgacgcccacctgcgtgccctgtcctacatgcaactcaagccgggagcccatgccttcaacctcggcaacggcaatggcttctcggtcaagcaggtcgtggaggccgcctggcgcgtgacaggtcgtgacgtgccccatagcatggccccgcgccgccccggcgacccggcgtggctggtcgctgacagcaccctcgcagagcgtgaactgggctggaagccgtcgttcacggatatcgacgccatcatcgattccgcgtggcgctggcaccagaaaccgcgatactga

SEQ ID NO: 65245 - protein, 331 aa, Desulfovibrio vulgaris subsp. vulgaris str. Hildenborough
MTVSGCCSNVLVCGGAGYIGSHMVRALVEHGYVPIIFDNLSTGHAESVGDVDLVRGDLLDRQALRRLFAEHSFDAVMHFSAKSLVGESMTDPGIYFVNNVVGTINLLEAMREAGVSRLVFSSSAAVFGNPLTARIAEDHPRQPVNPYGRSKLMIEQALRDYANAYGMRSVSLRYFNAAGADEAGDIGESHKPETHLIPNVLRAALGTGPELKIFGDDYDTPDGTCVRDYIHVADLCDAHLRALSYMQLKPGAHAFNLGNGNGFSVKQVVEAAWRVTGRDVPHSMAPRRPGDPAWLVADSTLAERELGWKPSFTDIDAIIDSAWRWHQKPRY

SEQ ID NO: 65246 - DNA, 984 bp, Listeria monocytogenes str. 4b F2365
  CDS (1)..(984): transl_table=11
atgagtattgttgtacttggtggcgctggctatatcggttcacatgcagtagatgagttaattactcgcggatatgaagtagtagttattgataatttaagaacagggcacaaggaatccattcatacaaaggcaaaattttatgaaggagatattcgagataaggcatttttaagttcagtttttgaaaaagaaaaggtagatggtgtgattcactttgctgctagttcacttgtaggagaatcgatggaagtaccgcttgtttatttaaataataatgtttatggtacgcaaattgtcttagaagtgatggagcaatttggtgtgaagcatattgtcttttcttctagcgctgcaacatatggtgagccagaacgagtaccgattacggaagatatgccaacaaatccggaaagtacttacggcgaaacgaagctaatcatggaaaaaatgatgaaatggtgcgataaagcgtatgatatgaaatatgttgcactccggtattttaatgttgctggcgccaaagcggatggttcaattggggaagatcacaaaccagaatcacacttagtcccaattattttacaagttgcgcttggtcaacgagaaaaattagcgatttacggtgacgactacaatacgcctgatggtacttgtattcgtgattatgtacaagtagaagatttaattgacgcgcatattaaagcgctagaatacttgaaaaatggcggggaaagtaatattttcaaccttggtagcagtaacggtttttcagtgaaagaaatgcttgaagcagctcgtactgtaacaggtaaagaaattccagctgaagttgtaccacgccgtgcaggagatccaggaacgttaattgcttcaagtgataaagcgcgtgaaattcttggttgggagccaacttatacagacgtaaaagatattatcgccactgcttggaaatggcacgtatctcatccaaatggctattaa

SEQ ID NO: 65247 - protein, 327 aa, Listeria monocytogenes str. 4b F2365
MSIVVLGGAGYIGSHAVDELITRGYEVVVIDNLRTGHKESIHTKAKFYEGDIRDKAFLSSVFEKEKVDGVIHFAASSLVGESMEVPLVYLNNNVYGTQIVLEVMEQFGVKHIVFSSSAATYGEPERVPITEDMPTNPESTYGETKLIMEKMMKWCDKAYDMKYVALRYFNVAGAKADGSIGEDHKPESHLVPIILQVALGQREKLAIYGDDYNTPDGTCIRDYVQVEDLIDAHIKALEYLKNGGESNIFNLGSSNGFSVKEMLEAARTVTGKEIPAEVVPRRAGDPGTLIASSDKAREILGWEPTYTDVKDIIATAWKWHVSHPNGY

SEQ ID NO: 65248 - DNA, 993 bp, Mycoplasma mobile 163K
  CDS (1)..(993): transl_table=4
atgacttatttagtaattggaggcgctggttatattggcagccacacagtttatgaattgattgaaaataataacaaagttgttattttagataatttaacaactggatcaaattcttctattcatccagaagctaaattttatgaaggagattttaaagacaaaaaaattttaaataaaatttttgatgaaaataaagaaattgaaattgtaataaattttgctgcatcaattgttgtaagtgaaagtgtttatgaaccacttaaatattatttgaataatacttatggagtaatgattttgcttgaatctatgaaagaaaataataaaaagtttttaattttttcttctactgcagctgtttatggacaaaaatcaaatttaccgattagagaagatgaggatttaaatcctattaatccatatggttcttccaaacaaatgtctgaaaaaattattcaggattatgctcatgtaaatgattttaaatttgcaattttgcgttattttaatgtagcaggtgcacatcaaaataactctataggtttagttccaaaaaaaggccataaagtttctcatcttatcccttctatttcatcttttgttttcaatgaattagactctctaaaaatttttggaaataattatgacacaaaagatggaacttgtataagagattatattcatgttcaagatttagctcatgctcattttcttgctgcaaaatacatttttgaaaataaaactaatttaattgtaaatgttggatctgaaaaaggattttcagtattagaagttgttaaaacttttgaaaaacaacttaataaaaaattaaattatgaaattaatcctaaaagagatggagaccctgcttttttagttgcttcaacaacaaaaattgcaaaaatattgaattttaaaccaaaattcagtttggaagagattgttaaaacagaacttgcttgaagaaaaaaaattttaaaggataaataa

SEQ ID NO: 65249 - protein, 330 aa, Mycoplasma mobile 163K
MTYLVIGGAGYIGSHTVYELIENNNKVVILDNLTTGSNSSIHPEAKFYEGDFKDKKILNKIFDENKEIEIVINFAASIVVSESVYEPLKYYLNNTYGVMILLESMKENNKKFLIFSSTAAVYGQKSNLPIREDEDLNPINPYGSSKQMSEKIIQDYAHVNDFKFAILRYFNVAGAHQNNSIGLVPKKGHKVSHLIPSISSFVFNELDSLKIFGNNYDTKDGTCIRDYIHVQDLAHAHFLAAKYIFENKTNLIVNVGSEKGFSVLEVVKTFEKQLNKKLNYEINPKRDGDPAFLVASTTKIAKILNFKPKFSLEEIVKTELAWRKKILKDK

SEQ ID NO: 65250 - DNA, 930 bp, Picrophilus torridus DSM 9790
  CDS (1)..(930): transl_table=11
atgaaaggaaaaaagatattaataactggtggcgcgggctttataggatcaaacatggttgaaaggcttgtaaatgacaatgatgtaacggtaatagattttacagacaatattaaatacataaaggatttccttcataataagaacttccattttattaataatgatcttctaaaatatgaaattaaggataaatttgatattataatacaccttgccgcaaactcggatgtaagatccggatcaaatgatcctatgctggatttcaatgaaaacgttgttttaacccaaaatttacttgaatacatgagaagatacgatgttaatgaaatgatcttttcatcatcatcaacggtttatggtgaggcatcaataatgccaacaccagaaagctacggaccatgcatgccaatatcatcatacggcgcatcaaagcttgccaatgaggcttttatatcagcatattcgcattactatggtattaaggcctcaatgtttagatttgcaaacgttgttggtaaaaattcaacacatggcgttatacatgattttataatgaaattaaaaaacaatccaaacgagcttgaaatacttggagacggaacgcagaggaaatcatacatacacgtttcagactgcataaatgcaatgctgctaatacatgaaaggattcaaaaaactgatgtaattaatcttggaaaccatggaacaacatctgtaaaaaccatagcagattatgttacatctgcaatgaatcttgaaaacgttagatacaattacaccggtggatacaacggccgtggatggaagggcgacataaagtatgcagagctattcatagaaaagatggagtcattcggccataggaacaaatatgacagcgatcaaagcgttaggctggcagtctctgaaatattaaaacagtattaa

SEQ ID NO: 65251 - protein, 309 aa, Picrophilus torridus DSM 9790
MKGKKILITGGAGFIGSNMVERLVNDNDVTVIDFTDNIKYIKDFLHNKNFHFINNDLLKYEIKDKFDIIIHLAANSDVRSGSNDPMLDFNENVVLTQNLLEYMRRYDVNEMIFSSSSTVYGEASIMPTPESYGPCMPISSYGASKLANEAFISAYSHYYGIKASMFRFANVVGKNSTHGVIHDFIMKLKNNPNELEILGDGTQRKSYIHVSDCINAMLLIHERIQKTDVINLGNHGTTSVKTIADYVTSAMNLENVRYNYTGGYNGRGWKGDIKYAELFIEKMESFGHRNKYDSDQSVRLAVSEILKQY

SEQ ID NO: 65252 - DNA, 966 bp, Bacillus thuringiensis serovar konkukian str. 97-27
  CDS (1)..(966): transl_table=11
atgagtaagaaatgtttaattacaggcggagcaggatttattggatcacatttagctgaagagttagtgggaagaggttataatgtcacgattgttgataacttccataaagggaaaaataaatatcatgatgagttaatgaaagaaattcgggttattccaataagtgtcttagacaaaaattctatttatgaactcgtaaaccaacatgatgttgtgtttcatttagcagcaattttaggtgtgaaaacgacaatggaaaagagtatagagctaattgaaacgaattttgatggaacgagaaacattttacaagcagcgctaaaaggaaaaaagaaagtagtttttgcgtctacttcagaagtatatggtaaggcaaagccacccttttctgaagaaggagaccgattatacggtgcaacttctaaaatacgttggagttatgcaatttgtaaaacgttagaagaaacattatgtttaggatacgctttagaaggtttacctgtaacgattgttcgttattttaatatttatggtccacgagcgaaagatggtccgtatgcaggggtaatcccgcgatttattagtgcggccctgcagggagaagacattctcgtatatggagatggagagcaaacacgttgctttacgtatgtaagtgatgcggtagaggcaacgattcgggcaatggatgagaaggtaaatggtgagattattaatataggttctgagaatgaaaaaagtataaaagaagtagcagaggtcattaaaaaattaacggattcttcttcaaagattgtgcaagtaccttttgaagaagtatatccacatggttttgaagaaattccaaatagaagaccagacgtaacaaaattaaaagatcttgttcaatttcaggcgaaagtaacgtgggaagacggattgaaggaaacaattaagtggtttcgtgaagaagacaatggctaa

SEQ ID NO: 65253 - protein, 321 aa, Bacillus thuringiensis serovar konkukian str. 97-27
MSKKCLITGGAGFIGSHLAEELVGRGYNVTIVDNFHKGKNKYHDELMKEIRVIPISVLDKNSIYELVNQHDVVFHLAAILGVKTTMEKSIELIETNFDGTRNILQAALKGKKKVVFASTSEVYGKAKPPFSEEGDRLYGATSKIRWSYAICKTLEETLCLGYALEGLPVTIVRYFNIYGPRAKDGPYAGVIPRFISAALQGEDILVYGDGEQTRCFTYVSDAVEATIRAMDEKVNGEIINIGSENEKSIKEVAEVIKKLTDSSSKIVQVPFEEVYPHGFEEIPNRRPDVTKLKDLVQFQAKVTWEDGLKETIKWFREEDNG

SEQ ID NO: 65254 - DNA, 972 bp, Staphylococcus aureus subsp. aureus MRSA252
  CDS (1)..(972): transl_table=11
ttggaaaaagttttgataactggtggggctggttttattgggtcacatttagtagatgatttgcaacaagattatgatgtttatgttctagataactatagaacaggtaaacgagaaaatattaaaagtttggctgacgatcatgtgtttgaattagatattcgtgaatatgatgcagttgaacaaatcatgaagacatatcaatttgattatgttattcatttagcagcattagttagtgtcgctgagtcggttgagaaacctatcttatctcaagaaataaacgtcgtagcaacgttgaaattattagaaaccattaaaaaatataacagtcatataaaacgattcatctttgcatcatctgcagccgtttatggtgatttacctgatttacctaaaagtgatcaatcattaattctaccattatcaccatatgcaatagataaatattacggcgaacgtacgacattaaattattgctcgctatataacattccaacagctgttgttaaattctttaatgtatttgggccaaggcaagatcctaagtctcaatattcaggtgtgatttcaaaaatgttcgattcatttgaacataacaagccttttacattttttggcgatggtctgcaaacgagagactttgtttatgtttatgatgttgttcaatctgtgcgcttaattatggagcataaagatgcggttggacatggttataacattggtacgggtacatttacgaatttgctagaggtttatcgcattattggtgaattatatggaaaatcagtcgagcatgattttaaagaagcaagaaagggagatattaagcattcttatgcagatatttctaatttaaaagcattaggatttgttcctaaatacactgtggaaacaggcttaaaggattactttaattttgaggtagataatattgaagaagttacagcgaaagaagtggaaatgtcgtga

SEQ ID NO: 65255 - protein, 323 aa, Staphylococcus aureus subsp. aureus MRSA252
MEKVLITGGAGFIGSHLVDDLQQDYDVYVLDNYRTGKRENIKSLADDHVFELDIREYDAVEQIMKTYQFDYVIHLAALVSVAESVEKPILSQEINVVATLKLLETIKKYNSHIKRFIFASSAAVYGDLPDLPKSDQSLILPLSPYAIDKYYGERTTLNYCSLYNIPTAVVKFFNVFGPRQDPKSQYSGVISKMFDSFEHNKPFTFFGDGLQTRDFVYVYDVVQSVRLIMEHKDAVGHGYNIGTGTFTNLLEVYRIIGELYGKSVEHDFKEARKGDIKHSYADISNLKALGFVPKYTVETGLKDYFNFEVDNIEEVTAKEVEMS

SEQ ID NO: 65256 - DNA, 933 bp, Erwinia carotovora subsp. atroseptica SCRI1043
  CDS (1)..(933)
atgattatcgttactggcggtgccggttttatcggcagcaatatcgtaaaatctctgaatgacatcggctaccgggacattctggttgtcgataacctgaaagacggcaccaagttcgtcaatctggtcgatctggacatagcagattacgtggataaggaagatttcgtcgccagcatcgttgcgggtgacgatctgggcgatatcgaggccgtattccatgaaggtgcctgctcctccaccaccgagtgggatggcaaatacatgatggataacaactatcagtattccaaagatgtgctgcactactgcctcgatcgcagtattccgttcctgtatgcctcttcggccgcgacctacggcggtcgtaacgataacttcatcgaagaccgccaatacgagcagcctctgaacgtctatggctactccaagttcctgttcgatcagtacgtgcgtgagattctgccggaagcggaatcgcagatctgcggcttccgctatttcaacgtctatggaccgcgcgaaggtcacaaaggcagcatggcgagcgtggcgttccacctgaacaaccagattaatcagggtgaaaatccgaagctgttctctggtagcgaaaacttcaaacgtgacttcatttacgtcggtgatgtcgcggccgtcaatctgtggttctggcaaaacggtgtttcgggcatcttcaactgcggtaccggtcgtgccgaatccttccaggccgttgccgacgccacactcgccttccataacaaaggcggcgtggagtacatcgaattccctgagaaactgaaaggccgctatcaggcctatacgcaggccgacctcaccaacttgcgggccgcgggctacgataagccgttcaaaaccgtcgccgaaggcgtagcggaatatatgacttggctgaaccgtaccgtttaa

SEQ ID NO: 65257 - protein, 310 aa, Erwinia carotovora subsp. atroseptica SCRI1043
MIIVTGGAGFIGSNIVKSLNDIGYRDILVVDNLKDGTKFVNLVDLDIADYVDKEDFVASIVAGDDLGDIEAVFHEGACSSTTEWDGKYMMDNNYQYSKDVLHYCLDRSIPFLYASSAATYGGRNDNFIEDRQYEQPLNVYGYSKFLFDQYVREILPEAESQICGFRYFNVYGPREGHKGSMASVAFHLNNQINQGENPKLFSGSENFKRDFIYVGDVAAVNLWFWQNGVSGIFNCGTGRAESFQAVADATLAFHNKGGVEYIEFPEKLKGRYQAYTQADLTNLRAAGYDKPFKTVAEGVAEYMTWLNRTV

SEQ ID NO: 65258 - DNA, 1038 bp, Desulfotalea psychrophila LSv54
  CDS (1)..(1038): transl_table=11
atgacaagataccaagaggtacaacaggaattaaaagatagccccaagacctggcttatcacaggtgttgcaggatttattggctctaaccttttagagactcttcttggcctggggcaaaaagttgtgggtctcgataattttgttacaggataccagcataaccttgatgaagttgaaggggcggtgacagatgctcaatggcaaaactttcgttttattgaaggggatatttgtagtcttgatgcctgccaagaagcctgtcagggcgttgactatgtgctccagcaggcagctcttggttctgtgcctcgttccattgttgacccgattaccaccaacaataccaatatcagtgggtttttgaatatgcttgtggcggctcgtgatgctgaggtgaaaagctttacctatgccgcctccagctctacctatggtgaccacccagccctgcctaaggtagaggagaatataggtaatcccctctctccctatgctgtaaccaaatatgtcaatgagctctacgcctctgtctttgccagaacctatagttttaagaccataggtcttcgctactttaatattctgggtaaacgtcaggatcccaatggtgcctatgcggctgtcattcccctctggactgcggccatgattaatgatgaaactgtttttatcaatggtgatggagagaccagccgtgatttttgctttatagagaatgcagtacaggcaaatatccttgctgcaacagcgacagaagaggctagggacaatgtctacaatgttgccgttggcgataggacaacactcaatgaactgttcaacctcataaagcataatcttgcagatcatggcatagtctataacctagatccgagctatcgtgactttcgtgcaggtgatgtgcggcattctcaggcagataccactaagataaaaaggcttttgggatatagtccacagtataaaattggtgcgggaatagagaaggctatgggctggtatgtgcagagtctttccgtctccgggcataaataa

SEQ ID NO: 65259 - protein, 345 aa, Desulfotalea psychrophila LSv54
MTRYQEVQQELKDSPKTWLITGVAGFIGSNLLETLLGLGQKVVGLDNFVTGYQHNLDEVEGAVTDAQWQNFRFIEGDICSLDACQEACQGVDYVLQQAALGSVPRSIVDPITTNNTNISGFLNMLVAARDAEVKSFTYAASSSTYGDHPALPKVEENIGNPLSPYAVTKYVNELYASVFARTYSFKTIGLRYFNILGKRQDPNGAYAAVIPLWTAAMINDETVFINGDGETSRDFCFIENAVQANILAATATEEARDNVYNVAVGDRTTLNELFNLIKHNLADHGIVYNLDPSYRDFRAGDVRHSQADTTKIKRLLGYSPQYKIGAGIEKAMGWYVQSLSVSGHK

SEQ ID NO: 65260 - DNA, 879 bp, Symbiobacterium thermophilum IAM 14863
  CDS (1)..(879): transl_table=11
gtggcgcggtttctcgtgaccggcgcggccgggttcattggatcgcacctggtggaggcgctccgcgcggcggggcacgacgtggtcggggtcgaccggcggcccggggcggacgtggtgggcgacctgctcacgctggacctggcgccgctcctggacggcgtcgagtacgtggtgcacctcgccgggcagcccggcgtgcgggagagctggagccagtttcccgcctacctggcgggaaacctgcagaccacccagcggctgctggagtccctccgggaccggcccctgaagaagttcgtcctcgcgtccacgtcctcggtgtacggcgaggtgccgatgccggcccgggaggacgggccggccatgccggtctcgccctacggcctcaccaagctggcggcggagaagctgtgcgacctgtacggccgcaccgccgggattccatgggtcgcgctgcgctacttcaccgtctacggtccccgccagcggccggacatggcgttcagccgctggttcaacgccgcgctggacggcgaacccatccagatctacggcgacggcagccagctccgggacttcacctacgtggccgacgcggtgaccgccacccagcgggcggcgctgaacccggtggtgggggtgcccatcaacgtgggcggcggcagcgcggtcacggtgcgggaggcgatccggctgatcgccgccatcaccggccggccgatccggatccggcagctgcccccggccccgggcgacatgcgggagacccgtgccgacacggagcggctctggcgggaggtgggctttcggccctccacccccctggaggaggggctctggcagcagtatcgttggcacctggcgcagcgggcgtga

SEQ ID NO: 65261 - protein, 292 aa, Symbiobacterium thermophilum IAM 14863
MARFLVTGAAGFIGSHLVEALRAAGHDVVGVDRRPGADVVGDLLTLDLAPLLDGVEYVVHLAGQPGVRESWSQFPAYLAGNLQTTQRLLESLRDRPLKKFVLASTSSVYGEVPMPAREDGPAMPVSPYGLTKLAAEKLCDLYGRTAGIPWVALRYFTVYGPRQRPDMAFSRWFNAALDGEPIQIYGDGSQLRDFTYVADAVTATQRAALNPVVGVPINVGGGSAVTVREAIRLIAAITGRPIRIRQLPPAPGDMRETRADTERLWREVGFRPSTPLEEGLWQQYRWHLAQRA

SEQ ID NO: 65262 - DNA, 987 bp, Symbiobacterium thermophilum IAM 14863
  CDS (1)..(987): transl_table=11
gtggttggtggagctggatacgtcggcagtcatgttgttcgggcgctgttggaggcaggtcatgaaccggttgtttatgataatctctcgactggacacatggaggcggtatgcgatagcgaagtcataattggcgatgttggtgatcgcgacaaactgcggacagtgttgcaggcacggcgcttcgatggggtcgttcacttggcggccgccagcttagtggcggagtccatgcgggaaccctcggtctattttcgcaacaacgtgagcgctagtattgtgctgtttgatgagctgattagagctgacgtaccatgggtagtcctctcctctaccgcagcggtatacggagagcctgaggtggttcccattccggaagagcatcccaccagaccgactaatccttatggtgaatcgaagttgatgttggagcgaatattgaagtggtatgatgtggcatatggcttcaagcacatatcgctccgatactttaacgctgccggtgctcacccgtcaggacagattggagaagaccacatgccagagacgcacctcatccccatcgtcttgcaggtcgctctcggcttacgggatttcgtaactgtgtttggcattgactatcccactccggatggttctgccgttcgggactatgttcatgtttgtgatctggccgatgcccatgtgcgagctatcaccagactctgtgcgactgggaccagtagcgtctataaccttggtagtgcgcgcgggtactcggttcgtgagattgttgacgtggctcagcaggttgtggggatgccgattaagtctgtggtcgccgaccggcgggcaggtgaccctcctattcttgtggctgacaatcgaaaggcgctaagcgagttgcagtggatgccgcagtttgacttggaggcgattgttgagactgcttggcggtggcatcgcgaccaccctcagggttatggaaataggagatcatcgatttga

SEQ ID NO: 65263 - protein, 328 aa, Symbiobacterium thermophilum IAM 14863
MVGGAGYVGSHVVRALLEAGHEPVVYDNLSTGHMEAVCDSEVIIGDVGDRDKLRTVLQARRFDGVVHLAAASLVAESMREPSVYFRNNVSASIVLFDELIRADVPWVVLSSTAAVYGEPEVVPIPEEHPTRPTNPYGESKLMLERILKWYDVAYGFKHISLRYFNAAGAHPSGQIGEDHMPETHLIPIVLQVALGLRDFVTVFGIDYPTPDGSAVRDYVHVCDLADAHVRAITRLCATGTSSVYNLGSARGYSVREIVDVAQQVVGMPIKSVVADRRAGDPPILVADNRKALSELQWMPQFDLEAIVETAWRWHRDHPQGYGNRRSSI

SEQ ID NO: 65264 - DNA, 966 bp, Symbiobacterium thermophilum IAM 14863
  CDS (1)..(966): transl_table=11
atggggtgtgtgatgaggactgttcttattacaggcggagctgggttcgttggttcacatgtagttgagcggtttctagctgaaggccttcgggtcgttgtggtggacaatctgactaccggtgttcgtgagcacgtacctccaggtgcagagttccataatatcgatatcctgacccctgagtttacttcattggttgggaaagtaaagcccgataccattgtacatctagccgcccaggtgagcgtggcggtatcggtcagagatcccgtgttggatgcggatgtaaacgtaggtggtacactgcgtgttcttgaagcggcgcgggaacaccaggtgccgaactttgtcttttcctcctcagcagccgtttatggaatacctagttcactccctgttacggaggacgctccgttcagccccttaagcccctacggaatagctaaggtagcggccgaagggtatatccgagcgtactgtttcttgcatggattgaaagctgtcgtgatgcggtattcaaacgtatttggtccacgccaaaaggcggctggcgacggcggagtcgtggccaactttgttgaggcaatcttgcgaggtcatccaccggtcttcttcggagatggtgggcagacgcgtgacttcatttacgtgaaggatgtcgctgatgctaccctgaaagcgatcgactaccttgataagtcgggcacatcggagtacctcgttgtaaacataagcagcggtgttgaaaccagtctgcgtacgctttataccctcctttgtgagcttgtgaagcaggccccggaacccattcttacacctccaagagaaggggacattcggcacagttgtcttgacaaccgaaaagcacgtgagtacctaggttggttgcccggatactcactggaacaagggatcctggagaccgtgactgctgcgcggctcgcagggcagggagcgaggttgtga

SEQ ID NO: 65265 - protein, 321 aa, Symbiobacterium thermophilum IAM 14863
MGCVMRTVLITGGAGFVGSHVVERFLAEGLRVVVVDNLTTGVREHVPPGAEFHNIDILTPEFTSLVGKVKPDTIVHLAAQVSVAVSVRDPVLDADVNVGGTLRVLEAAREHQVPNFVFSSSAAVYGIPSSLPVTEDAPFSPLSPYGIAKVAAEGYIRAYCFLHGLKAVVMRYSNVFGPRQKAAGDGGVVANFVEAILRGHPPVFFGDGGQTRDFIYVKDVADATLKAIDYLDKSGTSEYLVVNISSGVETSLRTLYTLLCELVKQAPEPILTPPREGDIRHSCLDNRKAREYLGWLPGYSLEQGILETVTAARLAGQGARL

SEQ ID NO: 65266 - DNA, 966 bp, Bacillus cereus ZK
  CDS (1)..(966): transl_table=11
atgagtaagaaatgtttaattacagggggagcaggatttattggatcccatttagctgaagagttggtgagaagaggttataatgtcacgattgtagataacttctataaagggaaaaataaatatcatgatgagttaatgaaagaaattcgggttattccaataagtgtcttagacaaaaattctatttatgaactcgtaaaccaacatgatgttgtgtttcatttagcagcaattttaggtgtgaaaacgacaatggaaaagagtatagagctaattgaaacgaattttgatggaacgagaaacattttacaagcagcgctaaaaggaaaaaagaaagtagtttttgcgtctacttcagaagtatatggtaaggcaaagccacccttctctgaagaaggagatcgattatacggtgcaacttctaaaatacgttggagttatgcaatttgtaaaacgttagaagaaacattatgtttaggatacgctttagaaggtttacctgtaacgattgttcgttattttaatatttatggcccacgagcgaaagatggtccgtatgcaggggtaatcccgcgatttattagtgcggccctgcagggagaagacattctcgtatatggagatggagagcaaacacgttgctttacgtatgtaagtgatgcggtagaggcaacgattcgggcaatggatgagaaggtaaatggtgagattattaatataggttctgagaatgaaaaaagtataaaagaagtagcagaggtcattaaaaaattaacggattcttcttcaaagattgtgcaagtaccttttgaagaagtatatccacatggttttgaagaaattccaaatagaagaccagacgtaacaaaattaaaagatcttgttcaatttcaggcgaaagtaacgtgggaagacggattgaaggaaacaattaagtggtttcgtgaagaagacaatggctaa

SEQ ID NO: 65267 - protein, 321 aa, Bacillus cereus ZK
MSKKCLITGGAGFIGSHLAEELVRRGYNVTIVDNFYKGKNKYHDELMKEIRVIPISVLDKNSIYELVNQHDVVFHLAAILGVKTTMEKSIELIETNFDGTRNILQAALKGKKKVVFASTSEVYGKAKPPFSEEGDRLYGATSKIRWSYAICKTLEETLCLGYALEGLPVTIVRYFNIYGPRAKDGPYAGVIPRFISAALQGEDILVYGDGEQTRCFTYVSDAVEATIRAMDEKVNGEIINIGSENEKSIKEVAEVIKKLTDSSSKIVQVPFEEVYPHGFEEIPNRRPDVTKLKDLVQFQAKVTWEDGLKETIKWFREEDNG

SEQ ID NO: 65268 - DNA, 927 bp, Mannheimia succiniciproducens MBEL55E
  CDS (1)..(927): transl_table=11
atgattatcgtaaccggtggcgccggcatgattggcgccaatatcgtaaaagcgttaaacgatatggggcgcaaagatattttagtagtggataacctgaaagacgggacaaaattcattaatcttgtcgatttggatatcgcggattattgcgataaagaagattttatttcttccgtcattgcaggtgacgatttaggtgatatcgacgccgtgttccatgaaggcgcctgctcggcgaccaccgaatgggacggtaaatatttaatgcataacaactatgaatattccaaagagttgctgcattactgcttagatcgcgaaattccgttcttctacgcatcaagcgccgccacttacggcgataaaacggatttcatcgaagaacgcgaattcgaagggccgttaaacgcctacggttattcaaaattcttattcgaccaatatgttcgcgccattctgcctgaagccaactcaccggtttgcggctttaaatatttcaatgtatacgggccgcgcgaacagcacaaaggttcaatggcgagcgtcgcgttccacttaaataaccagattttaaaaggcgaaaatccgaaattatttgccggttccgaacatttcctgcgagatttcgtttatgtgggcgatgtagcggaagttaacctttgggcatgggaaaacggtgtttccggcatctttaacctgggcaccggcaatgcagaaagttttaaagccgtggccgaagcggtagtgaaattccatggtaaaggcgaaatcgaaaccattccgttcccggaccatttaaaatcccgctatcaggaatatacacaggcgaatctaaccaaactacgcgccgccggttgcgattttaaatttaaaaacgttgccgaaggtgttgccgaatatatggcctggctgaatcgtaaataa

SEQ ID NO: 65269 - protein, 308 aa, Mannheimia succiniciproducens MBEL55E
MIIVTGGAGMIGANIVKALNDMGRKDILVVDNLKDGTKFINLVDLDIADYCDKEDFISSVIAGDDLGDIDAVFHEGACSATTEWDGKYLMHNNYEYSKELLHYCLDREIPFFYASSAATYGDKTDFIEEREFEGPLNAYGYSKFLFDQYVRAILPEANSPVCGFKYFNVYGPREQHKGSMASVAFHLNNQILKGENPKLFAGSEHFLRDFVYVGDVAEVNLWAWENGVSGIFNLGTGNAESFKAVAEAVVKFHGKGEIETIPFPDHLKSRYQEYTQANLTKLRAAGCDFKFKNVAEGVAEYMAWLNRK

SEQ ID NO: 65270 - DNA, 987 bp, Bacillus licheniformis ATCC 14580
  CDS (1)..(987): transl_table=11
atgacatccgtactcgtaacaggaggagccggatacatcggcagccacaccgtactcgaattgacaaagcaaaaccgctccgtcgtcgtgcttgacaatttatctaccggacacagggaagccgtcagcggggtcagcttttacgaaggcgatatcgctgatgcggcacttgtcaaagccatcatcaaacatcatgatgtcgatgctgtcatccatttcgccgccaaaagccttgtgtccgaatcgatcgaaaagcctgagatatactttagggaaaacacgctaaagtcttgtgcatttttcgaaacggccatcaaggaaggcgtcaataacatcgtcttttcgtcaaccgccgccgtatacggcatcccggagaaagccccgattaaagaggctgctcccctctcccctgtcaatccttacggggaatcgaagctgatgatcgaaaaatatctgcactgggtcggaaaaacgcacggtgtcaaatgggccgccctccgctacttcaacgccgccggcgccgctttaaacggagcgatcggcgaggaccacgatcccgaaagccacctcattcccctcgtcctgcagacggctttgggacagcgaaagcagctgtccattttcggagaagattattcgacgccagacggaacctgcatcagggattatattcacgtcctcgatctggcttccgcccacctggctgcccttgatggattatatgaagacagactgaagcaaaatgtttataatgtagggacaggggccggacattccgtaaaagaaatcattgaaaccgcggaaaacatgacagagcgaagcattgcagcaaaaacggacgagcgcagagcgggagatccgccagtgctggtggcggacagccggacactggtggaagataccggatggaagccgcaatacagcgatttgcaaaccatcattcaaagcgcatggcaatggcacaaagcgcatccggacggtttttga

SEQ ID NO: 65271 - protein, 328 aa, Bacillus licheniformis ATCC 14580
MTSVLVTGGAGYIGSHTVLELTKQNRSVVVLDNLSTGHREAVSGVSFYEGDIADAALVKAIIKHHDVDAVIHFAAKSLVSESIEKPEIYFRENTLKSCAFFETAIKEGVNNIVFSSTAAVYGIPEKAPIKEAAPLSPVNPYGESKLMIEKYLHWVGKTHGVKWAALRYFNAAGAALNGAIGEDHDPESHLIPLVLQTALGQRKQLSIFGEDYSTPDGTCIRDYIHVLDLASAHLAALDGLYEDRLKQNVYNVGTGAGHSVKEIIETAENMTERSIAAKTDERRAGDPPVLVADSRTLVEDTGWKPQYSDLQTIIQSAWQWHKAHPDGF

SEQ ID NO: 65272 - DNA, 930 bp, Bacillus licheniformis ATCC 14580
  CDS (1)..(930): transl_table=11
atggaaaaagtactagtgacaggcggatgcggatttatcggctcgcatattgctgaacagcttctaaaagaaaattaccgggtttcaattcttgataatttaactacgggacaccgctccaacattgacggtctcccaattgacttttatgagcaggatatcacgaagccggaagtcatcgacgtcatcaaaagcattgatcccgattatattgttcatttagctgcacaagtaagcgtagcggagtctgtcagcgattttttaaatgatgaaaacatcaatatcagaggatcgctccatatcattaaagcagctggtgaatgcaatgtgaaaaagatcgtctttgcatcatcagcggctgtttatggaaatccggattacctgcctgtcgacacccgtcaccaaacaaacccaggctcaccctacgggctgacgaagcttacagtggagaactatttaaaactggcttatgatctatatggaaccgagtattgcattttgcggtacagcaacgtgtacgggccgcgccaggatgcaaaaggagagggcggcgttgtatcgattttctccgatttgctgaccagcggcaaggctccggtaatttttggagacggagaacaatcacgcgattttatttatgtcggtgatgtagcttgtgccaacgtaaaggcgctaaaagctcaatcaaacgtttgtttaaatgtttcaaacggcttttccatcacggtcaatgagctgtttacagagatgaaaaaagcgacgaactctgagctttctccgatttatcaagatgaacggccgggggatatccgccacagcacactgtgtaatgaagaaacaaagaaaatcttaaactgggaaccaaaaatgccgcttgctgaaggactggaaaagaccatttcatattataaaaaagaaatgaatacgtaa

SEQ ID NO: 65273 - protein, 309 aa, Bacillus licheniformis ATCC 14580
MEKVLVTGGCGFIGSHIAEQLLKENYRVSILDNLTTGHRSNIDGLPIDFYEQDITKPEVIDVIKSIDPDYIVHLAAQVSVAESVSDFLNDENINIRGSLHIIKAAGECNVKKIVFASSAAVYGNPDYLPVDTRHQTNPGSPYGLTKLTVENYLKLAYDLYGTEYCILRYSNVYGPRQDAKGEGGVVSIFSDLLTSGKAPVIFGDGEQSRDFIYVGDVACANVKALKAQSNVCLNVSNGFSITVNELFTEMKKATNSELSPIYQDERPGDIRHSTLCNEETKKILNWEPKMPLAEGLEKTISYYKKEMNT

SEQ ID NO: 65274 - DNA, 990 bp, Bacillus licheniformis ATCC 14580
  CDS (1)..(990): transl_table=11
ttggcaatattagtatgcggaggggcgggctatattggaagccatgctgtagcggaactgttaagccgcaatgaagatgtcgtaattattgataacctgcaaactggacatgaagaggcggctttaaagggagcttctttctataatggagatctgcgcgatgaagcatttctaagaaaggtgtttcaggaaaacgacattgaggctgtcatgcatttcgcggccgattcattggttggagaaagcgtaacagatcctctcaaatattatgacaacaacgtttacggagctgtttgcctgttaaaggtcatgaaagagttcgatgtgaagcaaattgttttctcatcaaccgctgcaacatacggagaaccggatcgggtgccgattatggaaacagatccgacggatccgacaaacccgtacggggaaacgaagcttgcaattgaaaaaatgctgaagtggtctgaaaaggcatacggaatccgtcatgtcgtccttcgctactttaatgttgccggggcgcatgtagacggcttgatcggcgaggaccaccagcctgaaacgcacctgattccgatcattcttcaagtcgcgctaggcaaacgggacaagattatgattttcggcgacgactatccgactccggatggcacgtgcatcagagactacatccatgtgatggatctggtcgacgcgcatattctcgctgtcgagaggcttcgaaacggcggagaaagcgccgtatacaatctcggaaacggaacgggcttctcagtcaaagaagtcgttgaaactgcccggaaagtgacaggctgtccgataccggcggaggttgcagagcgccgcgcaggagacccggcacagctgatcgcctcttcggaaaaagcggtgaaagagcttggatggcagccgaagtacgccgaactggaaacgatcattgacagcgcgtggaagtggtttaaagcacatccgaacggctatcaaagctag

SEQ ID NO: 65275 - protein, 329 aa, Bacillus licheniformis ATCC 14580
MAILVCGGAGYIGSHAVAELLSRNEDVVIIDNLQTGHEEAALKGASFYNGDLRDEAFLRKVFQENDIEAVMHFAADSLVGESVTDPLKYYDNNVYGAVCLLKVMKEFDVKQIVFSSTAATYGEPDRVPIMETDPTDPTNPYGETKLAIEKMLKWSEKAYGIRHVVLRYFNVAGAHVDGLIGEDHQPETHLIPIILQVALGKRDKIMIFGDDYPTPDGTCIRDYIHVMDLVDAHILAVERLRNGGESAVYNLGNGTGFSVKEVVETARKVTGCPIPAEVAERRAGDPAQLIASSEKAVKELGWQPKYAELETIIDSAWKWFKAHPNGYQS

SEQ ID NO: 65276 - DNA, 993 bp, Burkholderia mallei ATCC 23344
  CDS (1)..(993): transl_table=11
atgaccctcatcgttaccggcgcggccggcttcatcggcgcgaacatcgtcaaggcgctgaacgagcgcggcgagacgcgcatcatcgcggtcgacaacctgacgcgcgcggacaagttcaagaatctcgtcgattgcgagatcgatgactatctcgacaagaccgagttcgtcgagcgcttcgcgcgcggcgatttcggcaaggtgcgcgcggtgtttcatgaaggcgcctgctcggacacgatggaaaccgacggccgctacatgatggacaacaacttccgctacagccgcgcggtgctcgacgcgtgcctcgcgcagggcacgcagttcctgtatgcgtcgtcggccgcgatctacggcggctcgagccgcttcgtcgaggcgcgcgagttcgaggcgccgctcaatgtgtacggctattcgaagttcctgttcgatcaggtgatccgccgcgtgatgccgagcgcgaagagccagatcgcgggcttccgctatttcaacgtgtacgggccgcgcgagtcgcacaaggggcgcatggcgtcggttgcgttccacaacttcaaccagtttcgcgccgagggcaaggtcaagctcttcggcgagtacaacggctatggcccgggcgagcagacgcgcgatttcgtgtcggtcgaggacgtcgcgaaggtgaacctgcatttcttcgatcacccgcagaagtcgggcatcttcaatctcggtaccggccgcgcgcagccgttcaacgacatcgcgacgacggtcgtcaacacgctgcgcgcgctcgaaggccagcccgcgctcacgcttgccgagcaggtcgagcaggggctcgtcgaatacgtgccgttcccggacgcgctgcgcggcaagtaccagtgcttcacgcaagccgatcagacgaagctgcgcgcggccggctacgacgcgccgttcctgacggtgcaggaaggcgtcgatcgctacgttcgttggctgttcggccagctgtaa

SEQ ID NO: 65277 - protein, 330 aa, Burkholderia mallei ATCC 23344
MTLIVTGAAGFIGANIVKALNERGETRIIAVDNLTRADKFKNLVDCEIDDYLDKTEFVERFARGDFGKVRAVFHEGACSDTMETDGRYMMDNNFRYSRAVLDACLAQGTQFLYASSAAIYGGSSRFVEAREFEAPLNVYGYSKFLFDQVIRRVMPSAKSQIAGFRYFNVYGPRESHKGRMASVAFHNFNQFRAEGKVKLFGEYNGYGPGEQTRDFVSVEDVAKVNLHFFDHPQKSGIFNLGTGRAQPFNDIATTVVNTLRALEGQPALTLAEQVEQGLVEYVPFPDALRGKYQCFTQADQTKLRAAGYDAPFLTVQEGVDRYVRWLFGQL

SEQ ID NO: 65278 - DNA, 1011 bp, Methylococcus capsulatus str. Bath
  CDS (1)..(1011): transl_table=11
atgagaatactgatcaccggcaccgccggcttcatcggatcgcacctggcccacaaactgctggaccggggtgatgaaatcatcggcatagacaacgtcaacgattactacgacgtcagcctcaaagaagcacgcctcgcccggctccatgcccgccccggcttcagcgaggcacgtatcgccctggaggaacgcgacaagctgttcgcgacgttcgcccgccaccgtcccgaacgtgtggtgaacctggccgcccaggccggcgtgcgctattcactggaaaacccgcatgcctacgtcgacgccaatctggtcggcttctgcaacatcctggaagcctgccgccactatgaggtggaacacctggtctatgcttcctccagttcggtctacggcgccaacaccgccatgccgttttcggtccatcacaacctcgaccatccggtcagcctttatgccgcgaccaagaaggccaatgaattgatggcccatacctacagccatctgttcgggcttcccaccacgggccttcgcttcttcacagtctacggcccgtgggggcggccggacatggccctgttcaagttcacccgcaacatcctggcgggacagccgatcgacgtctacaactacgggcaccaccggcgggatttcacctacatcgacgacatcgtggaaggggtagtacagaccctggacaaagtggctgcgcccgatccggcatggcgtggcgaccggcccgaccccggcaccagccgggccccctaccggctgtacaacatcggcaacaacgaaccggtcgagcttttgcgcttcatcgaggtgctcgagcactgtctgggatgcaaagccgagatgaacctgctgcccatgcaggacggcgacgtgcccgacacctatgccgacgtggacgatctgatgcgcgataccggttaccggccggcaaccccgatcgaaaccggcatcgcgcgcttcgtcgagtggtaccgggattattacggcgtccgctga

SEQ ID NO: 65279 - protein, 336 aa, Methylococcus capsulatus str. Bath
MRILITGTAGFIGSHLAHKLLDRGDEIIGIDNVNDYYDVSLKEARLARLHARPGFSEARIALEERDKLFATFARHRPERVVNLAAQAGVRYSLENPHAYVDANLVGFCNILEACRHYEVEHLVYASSSSVYGANTAMPFSVHHNLDHPVSLYAATKKANELMAHTYSHLFGLPTTGLRFFTVYGPWGRPDMALFKFTRNILAGQPIDVYNYGHHRRDFTYIDDIVEGVVQTLDKVAAPDPAWRGDRPDPGTSRAPYRLYNIGNNEPVELLRFIEVLEHCLGCKAEMNLLPMQDGDVPDTYADVDDLMRDTGYRPATPIETGIARFVEWYRDYYGVR

SEQ ID NO: 65280 - DNA, 1026 bp, Methylococcus capsulatus str. Bath
  CDS (1)..(1026): transl_table=11
atgaaacgtaaaggcatactcgtcaccggcggcgccggctatatcggcagccatgtcgtcaaaaccctgggcgaagcgggcgaacgcctggtcgtgctggacaacctgtcgaccggcttccgcgatgccgtcctgtatggcgacttcatcgaaggcgacaccggcgacgacgtcctgctggacaagatcatgcgggactacgaggtcgaggccgtcatgcatttcgccgcccacaccattgtgccggaatcggtcgaaaacccgctgaagtattacggcaacaacacctgcaagacccgcaccctgctggaatcctgccggaaggccggggtcagccatttcatcttctcctcgaccgcggccgtttatggcatcccagagggcgaatttgcgctggaaacctcgccactcgcgccgatcaacccttacggcagctccaagctaatgagcgagatcatgctgcgcgacctgtccaccgccagccccttgcgccatgtggtgctgcgctatttcaacgtcgccggctcggaccccgaaggccgcatcggccagagcacggccaaggccacccttctgatcaaggtcgcggccgaggtcgccaccggcaagcgcgatcgcctgtgcatcttcggcaccgactatccgacaccggacggcaccggcatccgcgactacatccacgtgtcggacctggccgatgcccatgtcgccgccctcgcctatttgcgcgctggcggcgaatccaggacgctcaactgcggctatggccacggctacagcgtgagggagatcatcgataccatgaatcgcgtcaacggcacccccatcgcggtcgaagaacgaccgcgccggcccggagaccctccccgcctggttgccggcgtggagcgcatccgcgaaatcctggaatggacgccccgttacgacgacatcgaactgatcgtgcggacctccctcgaatgggagcgcaagctcgccgcccggaaggcgcctgaggtctgtcaacgggaaagtccggcccggtaa

SEQ ID NO: 65281 - protein, 341 aa, Methylococcus capsulatus str. Bath
MKRKGILVTGGAGYIGSHVVKTLGEAGERLVVLDNLSTGFRDAVLYGDFIEGDTGDDVLLDKIMRDYEVEAVMHFAAHTIVPESVENPLKYYGNNTCKTRTLLESCRKAGVSHFIFSSTAAVYGIPEGEFALETSPLAPINPYGSSKLMSEIMLRDLSTASPLRHVVLRYFNVAGSDPEGRIGQSTAKATLLIKVAAEVATGKRDRLCIFGTDYPTPDGTGIRDYIHVSDLADAHVAALAYLRAGGESRTLNCGYGHGYSVREIIDTMNRVNGTPIAVEERPRRPGDPPRLVAGVERIREILEWTPRYDDIELIVRTSLEWERKLAARKAPEVCQRESPAR

SEQ ID NO: 65282 - DNA, 1005 bp, Photobacterium profundum SS9
  CDS (1)..(1005): transl_table=11
atgaaatatttagtaactggtgctgcaggttttattggtagtgctgtctctgagcgcctttgcgcccaaggtcatgaggtcattggtatcgataatctgaatgattactacgatgtctcattaaaacacgcacgccttgatcgtgcggagcatgataaatttacatttgtagaattagatctggctgatcgcgacggtatggctgcgttatttgctgatcagcagtttgaccgtgttattcatttggcggcgcaagcaggcgtgcgttattcaattgataacccaatggcttacgctgatagtaaccttgttgggcacctcgcgattcttgaaggctgccgtcataacaaggtaaagcacttggtatatgcttcatcgagttcggtttacggcctgaaccaaaaaatgccatttaataccagtgatagcgtcgatcatccgatttctctctatgctgcgacaaaaaaatcgaatgagctgatggcacacacgtattcacatttatacgatgttccaaccactgggctgcgtttctttactgtttatggtccgtgggggcgtcctgatatggcgctgtttaagttcaccaaagcgattgtcgatggcgagacaattgatgtgtacaacaacggtgatatgcgccgtgattttacctatatcgatgatattgtcgaaggtgtaatgcgtattcaagatgtgatcccacagaagaacccagattggacagttgaagctggttcgcccgcaacaagctctgcaccttataaagtgtataacattggtcacggtagccctgtaaagctcatggattatattgaagcgcttgaagatgcactaggtattgaagcgaagaaaaactttatgccaatgcagcctggagatgtatacgcgacctatgctgatactgaggacctatttaagacgattaattaccagccggcagtgaaagtgaaagagggcgtgaaagcgttcgttgattggtatcgtgcattctacaaatgctaa

SEQ ID NO: 65283 - protein, 334 aa, Photobacterium profundum SS9
MKYLVTGAAGFIGSAVSERLCAQGHEVIGIDNLNDYYDVSLKHARLDRAEHDKFTFVELDLADRDGMAALFADQQFDRVIHLAAQAGVRYSIDNPMAYADSNLVGHLAILEGCRHNKVKHLVYASSSSVYGLNQKMPFNTSDSVDHPISLYAATKKSNELMAHTYSHLYDVPTTGLRFFTVYGPWGRPDMALFKFTKAIVDGETIDVYNNGDMRRDFTYIDDIVEGVMRIQDVIPQKNPDWTVEAGSPATSSAPYKVYNIGHGSPVKLMDYIEALEDALGIEAKKNFMPMQPGDVYATYADTEDLFKTINYQPAVKVKEGVKAFVDWYRAFYKC

SEQ ID NO: 65284 - DNA, 945 bp, Photobacterium profundum SS9
  CDS (1)..(945): transl_table=11
atgattattgtaactggtggcgccggtatgatcggcagtaacatcgtcaaaaccttaaatgagcaaggtcataacgacattttagtcgttgaccacttaaaagacggcaccaaattcgccaatctggttgatttagatattgccgattacatggatagagatgattttatcacccaaatcatggcaggtgatgactttggacctatcgaagccattttccacgaaggcgcttgttcagcgacgacagagtgggatggcaaatacatgatgctaaacaactatgagtattcaaaagaattactgcatttttgtttagagcgccagatcccatttttatatgcttcttcagcagccacgtatggcggtcgtgaccatgatttcattgaagagaagcaatatgaaggcgcactcaatgtttacggttattcaaagcagcaattcgacaactatgtccgccgtatttggttagacgccgaagaacgtagcgagaaactgtctcagatcacaggtttccgttacttcaacgtgtatggtcctcgtgaacaacataaaggcagcatggcctctgtcgcattccacctacacactcaaattactgaaggcaaaaaccccaagttatttgaaggttcaaatattttcaaacgagattttgtctatgtgggcgacgtttgtaaaatgaacctatggttcttagaaaatagcgtttcggggatttttaactgcggaaccggtaatgcggaatcattccaagccgttgctgatgcagtcatcaagcaccacggaaaaggcgaagtagaaatagtgcctttccctgcacatttagaagggcgctaccaaaaatatacacaagcagatctcacgaaagtacgtgctgctggctatgatgcgccatttaaatcagttgccgaaggtgtcgctgagtacatggctatattgaataaatag

SEQ ID NO: 65285 - protein, 314 aa, Photobacterium profundum SS9
MIIVTGGAGMIGSNIVKTLNEQGHNDILVVDHLKDGTKFANLVDLDIADYMDRDDFITQIMAGDDFGPIEAIFHEGACSATTEWDGKYMMLNNYEYSKELLHFCLERQIPFLYASSAATYGGRDHDFIEEKQYEGALNVYGYSKQQFDNYVRRIWLDAEERSEKLSQITGFRYFNVYGPREQHKGSMASVAFHLHTQITEGKNPKLFEGSNIFKRDFVYVGDVCKMNLWFLENSVSGIFNCGTGNAESFQAVADAVIKHHGKGEVEIVPFPAHLEGRYQKYTQADLTKVRAAGYDAPFKSVAEGVAEYMAILNK

SEQ ID NO: 65286 - DNA, 1008 bp, Photobacterium profundum SS9
  CDS (1)..(1008): transl_table=11
atgaattttcttgttactggcgcagcaggttttattggtgctgctgtatgtaaaaaacttattctagatggatgtaatgttataggtttagataataagtgtgattattatgatgttaatttgaaagaagctcgtctttcggaactgtctcaatatggtgattttacttttttaaaagaggatttatgtaataatgatggtataaattcaatttttttagagaataagtttgatcgcgttatccacttaggtgctcaagctggagttcgttattctatcgaaaatccaatggcttatgctgattcaaatattattggtcatttaaatatattggaagcatgccgtcatcataaaattgaacaccttgtatatgcatcttcaagctctgtatatggattaaacgaaaagacaccgtttgagacctctgattctgttgaccatccagtatcattgtatgcagcaacgaagaaatccaatgagttgatgagccatagctattctcatttatataatatccccacaacagggctacgctttttcactgtttatggtccttgggggcgccccgatatggcaccctttatctttactaaaaagattctagacggtgacactatcgatattaataataacggtgaaatgtggcgcgactttacttatatcgacgatattgttgaaggtgtaatacgtatcgctgatgtgattcctacccgaaatgatgaatggaaggttgaaactggtacgccagcatcaagctctgcgccttatgcagtatacaatattggacatggtagccctattaatcttatggagtttatttctgagattgaaaatacgttaggaattgaagcgaagaaaaactatcgtggaatgcaagcgggcgatgtttataaaacgtatgccgatacctctgatttgtttgaagcgattggttatacacctaaagttggtgtgaaagaaggcgttgctgcgtttgtgaaatggtataaagaattttataacaaataa

SEQ ID NO: 65287 - protein, 335 aa, Photobacterium profundum SS9
MNFLVTGAAGFIGAAVCKKLILDGCNVIGLDNKCDYYDVNLKEARLSELSQYGDFTFLKEDLCNNDGINSIFLENKFDRVIHLGAQAGVRYSIENPMAYADSNIIGHLNILEACRHHKIEHLVYASSSSVYGLNEKTPFETSDSVDHPVSLYAATKKSNELMSHSYSHLYNIPTTGLRFFTVYGPWGRPDMAPFIFTKKILDGDTIDINNNGEMWRDFTYIDDIVEGVIRIADVIPTRNDEWKVETGTPASSSAPYAVYNIGHGSPINLMEFISEIENTLGIEAKKNYRGMQAGDVYKTYADTSDLFEAIGYTPKVGVKEGVAAFVKWYKEFYNK

SEQ ID NO: 65288 - DNA, 930 bp, Haloarcula marismortui ATCC 43049
  CDS (1)..(930): transl_table=11
atgtctacagataccttcagcggccgtcgggtactggtcaccggaggtggtggcttcatcgggagccatctggcgtcggcactggctgtggacaaccatgtgcgagtcctcgacgacttctcgacagggcggcgggcgaacctccccgatgacgtgaccgttatcgagggtgacgttcgggacagggagacgctcgatgcggcgatagagggcgtcgacgtcgtgtttcacgaggcggcgatggtcagcgtcccagagtcaatcgagcaaccggtcgactgccacgaactgaacggcacggcgaccgtcaacgtgttcgactgcgctcggcgacaggacacgcgggtggtgttcgcgtccagcgccgccgtgtacggcgtccctgacgacgttcccattggggaagacgcgccaaccgaaccaaatagtccgtacggcttcgaaaaatacctaggggagcagtacgcgcggttttacaccgaggagtacgggctaccgacggttccgctacggtacttcaacgtctacggtccacgcgggcttgacggagagtacgccggtgtcattggcacattcgtccgtcaggcccaggccggtgagccgctcacggtcgagggcgatgggacacagacgagggacttcgtccacgtcgacgacgttgtgcgtgcgaacctgctcgcagctacgacagacgccatcggccggccgttcaacgtcgggaccggacggagcattagcataaacgaactcgccgaaacggtccgagacgtcgtcggtacggacatcgcggtcgagcacgtccccggtcgcgcgaacgacatccaacagagcgaagcagacctcggtgacgcacgcgaactgctcgggtacgaaccgtccctgcccctccggaaggggctcgaagtgacgctcgacgccgaacagacgtga

SEQ ID NO: 65289 - protein, 309 aa, Haloarcula marismortui ATCC 43049
MSTDTFSGRRVLVTGGGGFIGSHLASALAVDNHVRVLDDFSTGRRANLPDDVTVIEGDVRDRETLDAAIEGVDVVFHEAAMVSVPESIEQPVDCHELNGTATVNVFDCARRQDTRVVFASSAAVYGVPDDVPIGEDAPTEPNSPYGFEKYLGEQYARFYTEEYGLPTVPLRYFNVYGPRGLDGEYAGVIGTFVRQAQAGEPLTVEGDGTQTRDFVHVDDVVRANLLAATTDAIGRPFNVGTGRSISINELAETVRDVVGTDIAVEHVPGRANDIQQSEADLGDARELLGYEPSLPLRKGLEVTLDAEQT

SEQ ID NO: 65290 - DNA, 918 bp, Haloarcula marismortui ATCC 43049
  CDS (1)..(918): transl_table=11
atggaaaatcagcgcgttctggtgactggcggtggggggtttatcggggcaaacctcgcaaacaaactggccgagaacaacgatgtcgtcgccctggatgacggctatcttggcacgcctgagaacgtatcagaagacgtagagtacgtcgaacagagtgtcctcgacgacgacctgccgactgacgtggacgtggtgtttcacctcgcggcactctcctcctacgcgatgcacgaggacaatccgacccacggcgctcgcgtgaacgtcgaggggttcgtcaacacggtcgagcaggcccgggacgacggctgtgacaccatcgtctacgcctcgacgtcctcaatctacggcagtcggaccgagccctcgccggaagacatggacgtgacggtcaacaccggctacgaggcctcgaagatggcccgggagacgtacgcggagtacttccagaaccactacgaccttacgctggccgggatgcgcttcttttcggtgtatcagggctacggcggcgcggaggaacacaaaggcgagtacgctaacgtcatcgcccagttcgccgacgaccttgccagcggcgacgcgccgaagctgtacggcaacggcgagcagacccgcgatttcacccacgtcgacgacatcgtccgcgggctcgtcctggccgccgaacacgaactgaacgacgtgtacaacctcggtaccggcgaggcctacgacttcaacaccgtcgtggagatgctgaacgacgagctcggaacggacatcgagccggagtacatcgagaacccgatccccgaggacgtgtacgtccacgacacctgtgccgacttctcgaagatgcacgaggcgacgggctgggaaccggagaccagcttcgaagagggcatcgagctggtctgtgcgccgtatacgtag

SEQ ID NO: 65291 - protein, 305 aa, Haloarcula marismortui ATCC 43049
MENQRVLVTGGGGFIGANLANKLAENNDVVALDDGYLGTPENVSEDVEYVEQSVLDDDLPTDVDVVFHLAALSSYAMHEDNPTHGARVNVEGFVNTVEQARDDGCDTIVYASTSSIYGSRTEPSPEDMDVTVNTGYEASKMARETYAEYFQNHYDLTLAGMRFFSVYQGYGGAEEHKGEYANVIAQFADDLASGDAPKLYGNGEQTRDFTHVDDIVRGLVLAAEHELNDVYNLGTGEAYDFNTVVEMLNDELGTDIEPEYIENPIPEDVYVHDTCADFSKMHEATGWEPETSFEEGIELVCAPYT

SEQ ID NO: 65292 - DNA, 927 bp, Haloarcula marismortui ATCC 43049
  CDS (1)..(927): transl_table=11
atggacgtatcagagaagcgaatagtcgttaccggcggggcaggctttatcgggtcgcatctggtcgagcgcctcgttccggacaacgacgtcgtcgtcgtcgacaacgaagcgaacggacaatccgagtgggtccatgaggacgcgacctatctggatggtgacctcaccgaccccggcgccgtcgccgaggctatcaccagcgatgtcgacctcgtcgtccatctagcggcgtcgaaactggtcgacacggacacgccccgccggcagttcgaggacaacagcgacatcacgtacaacattctcgaacagatgcaggaagccggcgtcgaaaacctcgtgtttacgtcgtcatctacagtatacggcgaagcgccgcgaccgactccagaggattacgcgccgcttgagccaatcagtgtctacggcgcgacgaaactcgcagaggagtcgctcgtctcgacgtacgcccacagccacgacatccagtcctgggtgttccggtttgcgaacatcgtcggcccgcgccttcgcggggcggtcatccccgacttcatcgagaagctcaccgaagactcgtcgacgctgacgattctcggtgacggccgtcaagagaagtcctatatgcacatctccgagtgcatcgacgcgatgctgttcgccgtcgaacacgccgacaaggaccacaacgtgttcaatctcgggacgcggacgaccacatcggtcgaccgcatcgccactatcgtcgctgacgagatggatatcgaccccgagtacgagtacaccggcggtgaccgcggctggacgggtgacgtgccgcgaatgcgcctctccgtcgacaagctctcagcactgggctgggagcccgaacagtcgagcgacgacgcggtgcgacagtcgacccgcgaactgctcgaagaactctga

SEQ ID NO: 65293 - protein, 308 aa, Haloarcula marismortui ATCC 43049
MDVSEKRIVVTGGAGFIGSHLVERLVPDNDVVVVDNEANGQSEWVHEDATYLDGDLTDPGAVAEAITSDVDLVVHLAASKLVDTDTPRRQFEDNSDITYNILEQMQEAGVENLVFTSSSTVYGEAPRPTPEDYAPLEPISVYGATKLAEESLVSTYAHSHDIQSWVFRFANIVGPRLRGAVIPDFIEKLTEDSSTLTILGDGRQEKSYMHISECIDAMLFAVEHADKDHNVFNLGTRTTTSVDRIATIVADEMDIDPEYEYTGGDRGWTGDVPRMRLSVDKLSALGWEPEQSSDDAVRQSTRELLEEL

SEQ ID NO: 65294 - DNA, 1005 bp, Haloarcula marismortui ATCC 43049
  CDS (1)..(1005): transl_table=11
atgggcaccatccagataatgcaaatactggtcacagggggtgccgggttcatcggcggtcacctggcacagcggttcgccgccgacggccacgatgtcgtcgtgctggacaaccgcgacccgttctacgatctagatatcaaacaacacaacgtcgatgccggacaggaggccgcccggaacagcgacgggagctacgagttcatcgagggcgatgtacgtgacgcggagcttgtcacagatctcgtcgccgacgccgactacgtctaccatcaggccgcccaggccggcgtccgcccaagcgtcaagaacccccgcaagtacgacgaggtcaacgtcaacggcacgctgaacctcctcgatgcctgccgcgacgagggcatcgaacggttcgtgatggcttcctcctcctccgtctacgggaagccacagtacctgccctacgacgagcaacatcccacgacacccgtctcgccctacggcgcgtcgaagctcgccgccgaacggtacgcctgcgcctacagcgaagtgtacgacctctctacggtagctcttcgctatttcaccgtctacggcccccggatgcgcccgaacatggcgatctcgaacttcgtctcccggtgccacaacggcgagcccccggtcatctacggcgatggcacgcaaacacgcgatttcacctacatcgaagatgtcatcgacgcgaacatgacgctgctgcatgaagacgccgccgacgggaaggccgtgaacatcgggtcgacggacaacatcgagatcaagacgctcgcgacggagatccgcgaccagatcgacccggacctcgatctggtctacgaggaacgccacgacgccgacgccgaacacacccacgccgcgaccgaccgtgccgaggaactgctcggctacgacccggaccacaccattcgggagggcgtcgcgaagttcatcgactggtaccgcgacaaccgcgactggtacgaaccgctcgttcgacagtcctga

SEQ ID NO: 65295 - protein, 334 aa, Haloarcula marismortui ATCC 43049
MGTIQIMQILVTGGAGFIGGHLAQRFAADGHDVVVLDNRDPFYDLDIKQHNVDAGQEAARNSDGSYEFIEGDVRDAELVTDLVADADYVYHQAAQAGVRPSVKNPRKYDEVNVNGTLNLLDACRDEGIERFVMASSSSVYGKPQYLPYDEQHPTTPVSPYGASKLAAERYACAYSEVYDLSTVALRYFTVYGPRMRPNMAISNFVSRCHNGEPPVIYGDGTQTRDFTYIEDVIDANMTLLHEDAADGKAVNIGSTDNIEIKTLATEIRDQIDPDLDLVYEERHDADAEHTHAATDRAEELLGYDPDHTIREGVAKFIDWYRDNRDWYEPLVRQS

SEQ ID NO: 65296 - DNA, 1002 bp, Streptococcus thermophilus LMG 18311
  CDS (1)..(1002): transl_table=11
atggcaattttagtattaggtggagctggttatatcggttctcacatggttgatcgcttagttgaaaaaggtcaagaaaaagtagtagtagtagatagtttggtaacaggtcaccgtgctgccgttcatccagatgctattttttatcaaggcgatctttctgatcaggattttatgagaaaggtcttcaaagaaaaccctgatgttgatgctgttattcactttgcggcctattctttggttggtgaatcaatggaaaaaccactcaaatattttgataacaacacagctggaatgattaaattgcttgaggttatgaacgaatgcggtgttaaatacattgtcttctcatcaacagcagcaacttacggaattccagaagaaattccaattcttgaaacaacaccacaaaatcctatcaacccatatggtgaaagtaagttgatgatggaaaccattatgaagtggtcagaccaagcttacggcatcaagtatgtccctcttcgttactttaatgtggcgggtgccaaacctgatggttcgattggtgaggaccacgatccagaaactcaccttctaccgattattcttcaagtagctcaaggtgttcgtgaaaaaatcatgatctttggggatgactacaatactccagacgggactaacgttcgtgactatgtgcatccattcgacttggcggacgctcacctccttgctgttgaatatcttcgtaaaggtaatgaatctacagcctttaacttaggttcatcaacaggtttctcaaaccttcaaattcttgaagcagctcgtaaggtaactggtaaagagattccagctgaaaaagctgatcgtcgtcctggtgatcctgatatattgattgcttcatctgaaaaagcacgtacagttcttggatggaaaccacaatttgataacatcgaaaaaatcatcgcaagtgcttgggcatggcattctagccatccaaaagggtacgatgatcgaggataa

SEQ ID NO: 65297 - protein, 333 aa, Streptococcus thermophilus LMG 18311
MAILVLGGAGYIGSHMVDRLVEKGQEKVVVVDSLVTGHRAAVHPDAIFYQGDLSDQDFMRKVFKENPDVDAVIHFAAYSLVGESMEKPLKYFDNNTAGMIKLLEVMNECGVKYIVFSSTAATYGIPEEIPILETTPQNPINPYGESKLMMETIMKWSDQAYGIKYVPLRYFNVAGAKPDGSIGEDHDPETHLLPIILQVAQGVREKIMIFGDDYNTPDGTNVRDYVHPFDLADAHLLAVEYLRKGNESTAFNLGSSTGFSNLQILEAARKVTGKEIPAEKADRRPGDPDILIASSEKARTVLGWKPQFDNIEKIIASAWAWHSSHPKGYDDRG

SEQ ID NO: 65298 - DNA, 1014 bp, Streptococcus thermophilus CNRZ1066
  CDS (1)..(1014): transl_table=11
atgtctattttaattacaggaggagctggctacatcggtagtcacaccactgtcgaactccttaatgcaggttttgatgtcgtcttggttgatgacttttcaaacagctctccagcagtccttgaacgcttggaaaagattacaggtaagaagttcccattctatcaaggttcaattttagatacagaatttttggataaggtttttacaaaagaagatattgaattggtcattcactttgcggcctttaaagcagttggtgagtctgttaaaaaacctttgaaatattataaaaacaatatcagtggtaccatcaccctccttgaaaaaatgaaggaatacgatgtcaaaaacattgtcttcagctcaagtgcaacagtatatggaactaataatccttctccgatgacggaagatatgccaacatcagctatcaacccatacggttacactaagttgatgatggaacaaattcttacagacgtagctgcttcagatccgtcatggtctgtaacaaatcttcgttatttcaatcctatcggagctcatgagagtggtttgattggtgaattgccaaacggtattccaaacaatcttatgccatatattacacaagttgctatcggtaaacttcctgagcttaatgtctttggtgatgattatccgactccggatggtacaggtgtccgtgactacattcacgttcttgacttggcatcaggtcacttggctgccgtcaaatataatttgagccacaaaggtgctgagattttcaacttgggtactggacacggttatagtgttttggatctcgttaagacattcgaagctgaaaacaaggttactatcccttaccgtattcaagggcgtcgcgctggtgatattgcgacttgctatgcgtctcctgaaaaggccaaagaagttctcggctgggaagctaagaagaccttgaaagatatggtcagagattcttggcgttggcaaacaacaaatccaaatggttatgaagactaa

SEQ ID NO: 65299 - protein, 337 aa, Streptococcus thermophilus CNRZ1066
MSILITGGAGYIGSHTTVELLNAGFDVVLVDDFSNSSPAVLERLEKITGKKFPFYQGSILDTEFLDKVFTKEDIELVIHFAAFKAVGESVKKPLKYYKNNISGTITLLEKMKEYDVKNIVFSSSATVYGTNNPSPMTEDMPTSAINPYGYTKLMMEQILTDVAASDPSWSVTNLRYFNPIGAHESGLIGELPNGIPNNLMPYITQVAIGKLPELNVFGDDYPTPDGTGVRDYIHVLDLASGHLAAVKYNLSHKGAEIFNLGTGHGYSVLDLVKTFEAENKVTIPYRIQGRRAGDIATCYASPEKAKEVLGWEAKKTLKDMVRDSWRWQTTNPNGYED

SEQ ID NO: 65300 - DNA, 1002 bp, Streptococcus thermophilus CNRZ1066
  CDS (1)..(1002): transl_table=11
atggcaattttagtattaggtggagctggttatatcggttctcacatggttgatcgcttagttgaaaaaggtcaagaaaaagtagtagtagtagatagtttggtaacaggtcaccgtgctgccgtacatccagatgctattttctatcaaggcgatctttctgatcaggattttatgagaaaggtcttcaaagaaaaccctgatgttgatgctgttattcactttgcggcctattctttggttggtgaatcaatggaaaaaccactcaaatattttgataacaacacagctggaatggttaaattgcttgaggttatgaacgaatgcggtgttaaatacattgtcttctcatcaacagcagcaacttacggaattccagaagaaattccaattcttgaaacaacaccacaaaatcctatcaacccatatggtgaaagtaagttgatgatggaaaccattatgaagtggtcagaccaagcttacggcatcaagtatgtccctcttcgttactttaatgtggcgggtgccaaacctgatggttcgattggtgaggaccacgatccagaaactcaccttctaccgattattcttcaagtagctcaaggtgttcgtgaaaaaatcatgatctttggggatgactacaatactccagacgggactaacgttcgtgactatgtgcatccattcgacttggcggacgctcacctccttgctgttgaatatcttcgtaaaggtaatgaatctacagcctttaacttaggttcatcaacaggtttctcaaaccttcaaattcttgaagcagctcgtaaggtaactggtaaagagattccagctgaaaaagctgatcgtcgtcctggtgatcctgatatattgattgcttcatctgaaaaagcacgtacagttcttggatggaaaccacaatttgataacatcgaaaaaatcatcgcaagtgcttgggcatggcattctagccatccaaaagggtacgatgatcgaggataa

SEQ ID NO: 65301 - protein, 333 aa, Streptococcus thermophilus CNRZ1066
MAILVLGGAGYIGSHMVDRLVEKGQEKVVVVDSLVTGHRAAVHPDAIFYQGDLSDQDFMRKVFKENPDVDAVIHFAAYSLVGESMEKPLKYFDNNTAGMVKLLEVMNECGVKYIVFSSTAATYGIPEEIPILETTPQNPINPYGESKLMMETIMKWSDQAYGIKYVPLRYFNVAGAKPDGSIGEDHDPETHLLPIILQVAQGVREKIMIFGDDYNTPDGTNVRDYVHPFDLADAHLLAVEYLRKGNESTAFNLGSSTGFSNLQILEAARKVTGKEIPAEKADRRPGDPDILIASSEKARTVLGWKPQFDNIEKIIASAWAWHSSHPKGYDDRG

SEQ ID NO: 65302 - DNA, 936 bp, Thermus thermophilus HB8
  CDS (1)..(936): transl_table=11
atgcgcgtgctggtgacgggcggcgccggtttcatcggaagccacatcgtggaggacctcctcgccaggggcctggaggtggcggtcctggacaacctggccacgggcaagcgggaaaacgtgcccaaaggcgtccccttcttccgggtggacctaagggacaaggagggggtggaaagggccttccgggagttccgccccacccacgtctcccaccaggcggcccaagcctcggtgaaggtgagcgtggaggacccggtcctggactttgaggtgaacctcctgggggggcttaacctcctcgaggcctgccgccagtacggcgtggagaagctcgtcttcgcctccacgggcggggccatctacggggaggtgcccgagggggaaagggccgaggagacctggcccccccgcccaaaaagcccctacgccgcgagcaaggcggcctttgagcactacctctccgtctacgggcaaagctacgggctcaagtgggtctccctgcgctacggcaacgtgtacggccccaggcaggacccccacggggaggcaggggtggtggccatcttcgccgagcgggtcctcaagggcctgcccgtgaccctctacgcccggaagacccccggggacgaggggtgcgtgcgggactacgtttacgtgggggacgtggccgaggcccacgccctcgccctcttctccttggaagggatctacaacgtggggaccggggaggggcacaccacgagggaggtcctcatggcggtggccgaggccgcggggaaggcccccgaggtccagcccgcccccccgcgccccggggacctggaacggagcgtcctctcccccctcaagctcatggcccacggctggcggcccaaggtggggttccaggagggcatccgcctcaccgtggaccacttccggggcgccgtatag

SEQ ID NO: 65303 - protein, 311 aa, Thermus thermophilus HB8
MRVLVTGGAGFIGSHIVEDLLARGLEVAVLDNLATGKRENVPKGVPFFRVDLRDKEGVERAFREFRPTHVSHQAAQASVKVSVEDPVLDFEVNLLGGLNLLEACRQYGVEKLVFASTGGAIYGEVPEGERAEETWPPRPKSPYAASKAAFEHYLSVYGQSYGLKWVSLRYGNVYGPRQDPHGEAGVVAIFAERVLKGLPVTLYARKTPGDEGCVRDYVYVGDVAEAHALALFSLEGIYNVGTGEGHTTREVLMAVAEAAGKAPEVQPAPPRPGDLERSVLSPLKLMAHGWRPKVGFQEGIRLTVDHFRGAV

SEQ ID NO: 65304 - DNA, 957 bp, Geobacillus kaustophilus HTA426
  CDS (1)..(957): transl_table=11
gtgaacattctcgtcaccggtgcggccggatttatcggctcccatttatgcgaaaaactgctggaaaacgacgagcatcatgtgattggcgtcgacggctttctcggaccgacgccggcgccgctaaaagcgaagaacattgcccatttgcagtctcatccacggtttacctttcttgagctggatttgttgacagccgatttgccgtccttgctgcaaaacgtcgaagcggtctaccacttagccggcatgcccggtgtgcgaacgagctgggggacggagtttgccgcctatgctgcacacaacatttccactacccagcggttgcttgaggcatgcaaagaccggccactcaaacggttcatctacgcttcgacctcatccgtctacggcgagcggagcggcccgttgtcggaaacgcttgaaccggccccgctctccccatatggcattacgaagctcaccggcgaacatttatgccgcgtctattttcgcgagttcgccgtaccgatcgtcattttgcgctatttcaccgtctatggcccgcgccagcgcccggacatgtcgtttcaccgcttcatccgccagctgctcgctggacaaccgctcaccgtgttcggcgacggaacacaatcgcgcgatttcacctatatttctgactgcgttgatggaacgatcgccgcgctcgagcgggatggcgtcattggagaaacgatcaatatcggcggaaaagaacgagcatcggtcaatgaggtgatccgtctgctggaaacgctgacgggaaaacaagcgatcattcagtataccccctccgcccgcggagagccgaaacaaacgtgggccgacttggcaaaagcggagcggctgctcgggtacaagccggttgtaacgcttgagggcggcctacaaaaagagatcgaatacatccgttcgctgtatgagggtgagcattcatga

SEQ ID NO: 65305 - protein, 318 aa, Geobacillus kaustophilus HTA426
MNILVTGAAGFIGSHLCEKLLENDEHHVIGVDGFLGPTPAPLKAKNIAHLQSHPRFTFLELDLLTADLPSLLQNVEAVYHLAGMPGVRTSWGTEFAAYAAHNISTTQRLLEACKDRPLKRFIYASTSSVYGERSGPLSETLEPAPLSPYGITKLTGEHLCRVYFREFAVPIVILRYFTVYGPRQRPDMSFHRFIRQLLAGQPLTVFGDGTQSRDFTYISDCVDGTIAALERDGVIGETINIGGKERASVNEVIRLLETLTGKQAIIQYTPSARGEPKQTWADLAKAERLLGYKPVVTLEGGLQKEIEYIRSLYEGEHS

SEQ ID NO: 65306 - DNA, 987 bp, Geobacillus kaustophilus HTA426
  CDS (1)..(987): transl_table=11
atgattttggtttgcggaggggcagggtatatcggcagccatgcggtgtaccgtctgcttgaaaaaggggagcgcgtggtcgtggtggataacttgcagacggggcaccgggaggcggttcaccctgatgcggtgttttgccaaggcgatattcgcgaccgcgattttttgcgcgaggtgtttcgccagcacgacattgaggcggtcattcattttgcggcgaactcattggtcggcgaaagcatggaagagccgctgaaatattacgacaacaatgtgtacggcacacaagtgctgcttgaagtgatgagagaatttggcgtcaagcaaatcgtcttttcttcaaccgccgcggtgtatggggagccgaaacaaatcccgatcgtcgaaaccgacccgacggaaccgacgaacgcgtatggagaaacgaagctggcgatggaaaaaatgatgaaatgggcggaccgcgcctatggcatccgctcgatttcgctccgctactttaatgtcgccggggcgtacggcacgacaatcggtgaggaccacaacccggagacgcatctgattccattgattttaaaagtgccgcttggccagcgcgaggaaatctacattttcggcgatgactacgacacgcccgacggcacgtgcatccgcgactacattcatgtgcttgatctcgtcgatgcccattggctggcgctcgagaaattgcggagcggggcagacagcgatgtatacaatttaggcaacggaaatggatttagcgtcaaagaagtgatcgaagcggctcggcaagtgaccggacacccgatccccgcccgcgtcgtggcgcggcgcccgggcgatccggcgagacttgtcgcttcatcggaaaaagcaaagcgcgagctcggctgggagccgaaatacccgtccattacggatatcgtcgcgtcggcatgggaatggcatcaagcgcggccaaacggatatcggggtgtgtaa

SEQ ID NO: 65307 - protein, 328 aa, Geobacillus kaustophilus HTA426
MILVCGGAGYIGSHAVYRLLEKGERVVVVDNLQTGHREAVHPDAVFCQGDIRDRDFLREVFRQHDIEAVIHFAANSLVGESMEEPLKYYDNNVYGTQVLLEVMREFGVKQIVFSSTAAVYGEPKQIPIVETDPTEPTNAYGETKLAMEKMMKWADRAYGIRSISLRYFNVAGAYGTTIGEDHNPETHLIPLILKVPLGQREEIYIFGDDYDTPDGTCIRDYIHVLDLVDAHWLALEKLRSGADSDVYNLGNGNGFSVKEVIEAARQVTGHPIPARVVARRPGDPARLVASSEKAKRELGWEPKYPSITDIVASAWEWHQARPNGYRGV

SEQ ID NO: 65308 - DNA, 972 bp, Geobacillus kaustophilus HTA426
  CDS (1)..(972): transl_table=11
atgattcttgttgtcggcggagccggttatatcggcagtcatttagtgaaagagttagtggaaaaagagcaagtaattgtgcttgataacttatcgactggtcatcgctatttagtggatgaccgcgcggtgtttgtgcaaggggatttagggaacaaagcggaccttgaaccgatttttggaaaatacccgattcaagccgtcatgcattttgcggcgaacagcttagtcggcgaatcggtggtgaatccgctgaaatattatcaaaacaacgttgccgctaccttaacgttactagagacgatgctaaagtataatgtgaaaaactttatcttctcgtcaaccgcggcgacgtatgggattccgaatgtcgaattgattacggaagattgcccaacaaatccaattaatccatacggccgctcaaagttgatgatcgagcaaattttagcggattttgcttctgcgtatggtttgaactatgtcgtccttcgctactttaacgcggctggggcgcacgagtcaggagaaattggcgaagaccataacccggaaacgcatttaattccgcttgtcttgcagcatttgttaggccagcgcgacaaaatttccgtcttcggtacggactatgatacaccagacgggacatgcattcgtgactatatccatgttaccgacttagcgaaggcgcatattttagcgctggaagcattgttgtcaggcaaaaagaaaaccgctgtttacaatcttggcaacggcttaggctattccgtcaaagaagtgattgaaacatgtgaaaaagtaaccggccgcaaagcggtaatcgaatacactgaccgccgcccaggcgacccggcgcgccttgtcgcatcctcgcaaaaaatttatgaagagttgggatggaaagcggaatattcattagaacaaatcatcgaaagcgcgtggaagtggcatagccgaaatactaagtaa

SEQ ID NO: 65309 - protein, 323 aa, Geobacillus kaustophilus HTA426
MILVVGGAGYIGSHLVKELVEKEQVIVLDNLSTGHRYLVDDRAVFVQGDLGNKADLEPIFGKYPIQAVMHFAANSLVGESVVNPLKYYQNNVAATLTLLETMLKYNVKNFIFSSTAATYGIPNVELITEDCPTNPINPYGRSKLMIEQILADFASAYGLNYVVLRYFNAAGAHESGEIGEDHNPETHLIPLVLQHLLGQRDKISVFGTDYDTPDGTCIRDYIHVTDLAKAHILALEALLSGKKKTAVYNLGNGLGYSVKEVIETCEKVTGRKAVIEYTDRRPGDPARLVASSQKIYEELGWKAEYSLEQIIESAWKWHSRNTK

SEQ ID NO: 65310 - DNA, 1008 bp, Azoarcus sp. EbN1
  CDS (1)..(1008): transl_table=11
atgaaagttctcatcaccggcgcagccggcttcatcggcatgcatgtctgccaagtgctgctcgcgcgcggggacgaggtcgtcggcctggataacctcaatgattattacgacccgcgcctgaaggaagaccgcctcgcgcgcctcgcgccgcatccgcgtttccgtttcatcaagctcgacgttgccgaccgcgacgccatggagcgcctctttgccgcggaacggttcgagcgcgtcgtccacctcgcggcgcaggcgggcgtgcgctattcgctgcagaatccgcacgcgtacgtcgacagcaacctggtcggcttcatgaacgttctcgaaggttgccgccacggcggcgtgcggcatttggtgtatgcgagcagctcgagcgtctacggcggcaacacgaagatgccgttctccgagcacgacagcgtcgaccaccccgtcagcatctacgccgcgaccaagaaagccaacgagctgatggcgcacacttacagccacctttacggcctgccgaccaccgggctgcgctttttcaccgtctacgggccgtggggccgccccgacatggcgctgttcctgttcacgcgggcaatcctcgaaggccgcccgatcgacgtcttcaaccacgggcggatgatgcgcgacttcacctacatcgacgacatcgtcgaaggcgtcgtccgcacgctcgaccgcgtcgccgaacccgatccgggtttcgacgcgctgcagcccgaccccgcccgcagcaacgcgccgtaccgcgtgttcaacatcggcaaccacgatccggtcgagctgatggcgttcatcgaagcgatcgaggacgcgatcggcaggaaggcggagaagaacttcctgccgctgcaggacggcgacgtgccggcgacgtatgccgataccgcggagctgaatgcctggacggggttcaagccggggacgagcgtgcgggacggagtggggcagttcgttgcctggtatcgcgactattaccgctcctga

SEQ ID NO: 65311 - protein, 335 aa, Azoarcus sp. EbN1
MKVLITGAAGFIGMHVCQVLLARGDEVVGLDNLNDYYDPRLKEDRLARLAPHPRFRFIKLDVADRDAMERLFAAERFERVVHLAAQAGVRYSLQNPHAYVDSNLVGFMNVLEGCRHGGVRHLVYASSSSVYGGNTKMPFSEHDSVDHPVSIYAATKKANELMAHTYSHLYGLPTTGLRFFTVYGPWGRPDMALFLFTRAILEGRPIDVFNHGRMMRDFTYIDDIVEGVVRTLDRVAEPDPGFDALQPDPARSNAPYRVFNIGNHDPVELMAFIEAIEDAIGRKAEKNFLPLQDGDVPATYADTAELNAWTGFKPGTSVRDGVGQFVAWYRDYYRS

SEQ ID NO: 65312 - DNA, 960 bp, Azoarcus sp. EbN1
  CDS (1)..(960): transl_table=11
atgatcatcgtcacaggcggcgccggcttcatcggcagcaacatcgtgcaggggctcaacgcccgcggcatcaccgacatcctggtcgtcgacgacctcaccgacgggcacaagtgcctgaacctcgcggacgccgacatccacgactacatggacaaggacgatttcctgcgccgcgtcgaggcgaacgaggatttcggaccggtcgaggcgattttccacgaaggcgcatgctcctcgacgacggagtgggatggccgcttcgtgatggcggtgaactacgaatacacgaagtcgctgctcggctgggcggtcgcgcggaaagtgccgttgctgtacgcgtcgtcggcgtcggtctacggcatggggccgacgttccgcgaatcgcgcgagttcgagcatccgctgaacatgtacgcctactcgaagttcctgttcgactgccatctgcgcaggttcgcgccgggcatcgacagccaggtcgtcggcctgcgctacttcaacgtctacggcccgcgcgagcagcacaagggcagcatggcgagcgtcgcgtaccatttccacaaccagctgaacgacagcggccgcctgcgcctgttcgaaggcgccgacggctacggcccgggcgagcagcagcgcgacttcatccacgtcgatgacgtcgtcgcggtgaacctgtggctgctcgacaaccccggggtgcgcggcatcttcaacgtcggcaccggccgcgcacagagcttcaacgaagtcgcccatgccgcgctgagctggcacaagggcagcaccgccggcggcggcatcgactacatcgcgttcccggaacacctgagaggccgctaccagagctacacgcaggccgacatcacggcgctgcgccaggcgggctacgagggcgagttcatgccggtcgaagtcggcgtgccgcgctacctggaatggctcgcgctgcgcgactga

SEQ ID NO: 65313 - protein, 319 aa, Azoarcus sp. EbN1
MIIVTGGAGFIGSNIVQGLNARGITDILVVDDLTDGHKCLNLADADIHDYMDKDDFLRRVEANEDFGPVEAIFHEGACSSTTEWDGRFVMAVNYEYTKSLLGWAVARKVPLLYASSASVYGMGPTFRESREFEHPLNMYAYSKFLFDCHLRRFAPGIDSQVVGLRYFNVYGPREQHKGSMASVAYHFHNQLNDSGRLRLFEGADGYGPGEQQRDFIHVDDVVAVNLWLLDNPGVRGIFNVGTGRAQSFNEVAHAALSWHKGSTAGGGIDYIAFPEHLRGRYQSYTQADITALRQAGYEGEFMPVEVGVPRYLEWLALRD

SEQ ID NO: 65314 - DNA, 972 bp, Francisella tularensis subsp. tularensis Schu 4
  CDS (1)..(972): transl_table=11
gtggcttacgataatgttaaatttcctcatggttcgttttttttggtgactggaggtgcgggttttattggctctaatttatgtgaagttttacttagtaagggttatagagttaggtgtttagatgatctctcaaatggtcactatcacaatgttgagccgtttttaactaattctaattatgagtttataaaaggtgatattagagatttagatacttgcatgaaagcttgtgaaggtattgattatgttctacatcaagctgcttggggaagcgtaccaagaagtattgagatgccattagtgtatgaagatataaatgttaaaggtgcattaaatatgcttgaagcggctagacaaaataacgttaaaaaatttgtctatgcttctagttcatcagtatatggtgatgagccaaatttacctaaaaaagaaggtagagaaggaaatgttttatcaccctatgcatttacaaagaaagctaatgaagagtgggcgagactatacacaaagttatatggtctagatacttatggtctaagatattttaatgttttcggtagaagacaagatcctaatggtgcgtatgcagcagttatacctaaatttatcaaacagttattaaatgatgaagcgccaactataaatggagatggtaaacagtcgagagattttacatatatagagaatgttattgaggcaaatcttaaagcatgtttagcagatagtaagtatgccggagagtcttttaatatagcttatggaggtagagagtatcttatagatttgtactataatctttgtgatgccttgggtaaaaaaatagagccaaattttggtccagatagagcgggtgatattaagcatagtaatgctgatatttcgaaggctaggaatatgctcggatataatccggaatatgattttgaattaggcataaagcatgctgttgagtggtatttaattaattaa

SEQ ID NO: 65315 - protein, 323 aa, Francisella tularensis subsp. tularensis Schu 4
MAYDNVKFPHGSFFLVTGGAGFIGSNLCEVLLSKGYRVRCLDDLSNGHYHNVEPFLTNSNYEFIKGDIRDLDTCMKACEGIDYVLHQAAWGSVPRSIEMPLVYEDINVKGALNMLEAARQNNVKKFVYASSSSVYGDEPNLPKKEGREGNVLSPYAFTKKANEEWARLYTKLYGLDTYGLRYFNVFGRRQDPNGAYAAVIPKFIKQLLNDEAPTINGDGKQSRDFTYIENVIEANLKACLADSKYAGESFNIAYGGREYLIDLYYNLCDALGKKIEPNFGPDRAGDIKHSNADISKARNMLGYNPEYDFELGIKHAVEWYLIN

SEQ ID NO: 65316 - DNA, 999 bp, Synechococcus elongatus PCC 6301
  CDS (1)..(999): transl_table=11
gtggcaggggcaaccattctggtgacgggcggcgcgggctatatcggctcccatacggtgcgggcactgcaagcccagggttaccagccgatcgtgctcgacaacctcagcaatggccaacgggcgatcgcagcagaggtcctacaggtgccgttgattgtgggagacacccgcgatcgcctcttgctcgaccgcctctttgcagagcatccgattcaggcagtgattcactttgctgcctcgatcgaagttggagagtcggtgcgcgatcccggcaacttctacgccaacaacgtcagcggtagcttgaccttgctgcaggcaatggtggcagcaggctgtcagcagctcgtgttttcttcgacctgtgcgacctacggattgccgcaggtgattccgattcccgaagatcatccccaagccccgatcaatccctacggtcgcagcaagtggatggtggagcagtttctgcaggattttcaggctgcctacggcttgcgatcggtgatcttccgctacttcaatgccgctggggctgatcccaagggggatttgggcgaggcccacgatccagaaacccatttgattcccttggtgctccaagccgccgccggtcagcgtcccagcattcaggtctatggcacggactacccgacatcggacggcacctgcatccgcgactacatccatgtctgtgatttggccgatgcccacgtacggggcctgacttacttagcggacgggggagctaccaccgcctttaacttgggcaacggcaatggcttctcagtcaaggaagtgattgccaccgcagagcgggtcacccagcgatcgattccggtgcaattgagcgatcgccgccctggtgatgcgatcgcccttgtcggtagcagcgataaagctcgccagatcctcggttgggagccgcaatttcccagcttagagacgatgattcagcatgcatggcagtggcagcaacgctgcgatcgcccctcgtga

SEQ ID NO: 65317 - protein, 332 aa, Synechococcus elongatus PCC 6301
MAGATILVTGGAGYIGSHTVRALQAQGYQPIVLDNLSNGQRAIAAEVLQVPLIVGDTRDRLLLDRLFAEHPIQAVIHFAASIEVGESVRDPGNFYANNVSGSLTLLQAMVAAGCQQLVFSSTCATYGLPQVIPIPEDHPQAPINPYGRSKWMVEQFLQDFQAAYGLRSVIFRYFNAAGADPKGDLGEAHDPETHLIPLVLQAAAGQRPSIQVYGTDYPTSDGTCIRDYIHVCDLADAHVRGLTYLADGGATTAFNLGNGNGFSVKEVIATAERVTQRSIPVQLSDRRPGDAIALVGSSDKARQILGWEPQFPSLETMIQHAWQWQQRCDRPS

SEQ ID NO: 65318 - DNA, 933 bp, Bacillus clausii KSM-K16
  CDS (1)..(933): transl_table=11
gtggcaacttacctaattacagggggagctggctttattggctctaatattgctaaagcacttgtggcaaagggagagaaagtcaaaattttagacaattttaatacaggaaaaaaagacaacatcgctgaatttattgatgacgtggaagtcatcgacggggactttacaaacgagaaaacggtccaatctgcgttaaagcaggttgatgttgtttttcatcaaggagcgattccgtctgtgccgaaatcgattcaaaacccgattgaatcgaaccatgccaatgtctctggtacgcttcagctcttgcaaggtgcggttgaagcaagagtaagtcgatttatttatgcggcatcgtcatccgcttatggggactcggaaacattgcctaaacatgaacaattgcctggcaaccctatgtccccctatgcggtcagcaaatacacaggcgagctttattgtaaagttttctataacctttatggtttggaaaccgtttcgcttcgctactttaatgtctttggccctcgtcaagaccccaattccaaatatgcagccgttatcccaagctttataaaggcaatgctaaacgacaaaccaccgactatttttggcgacggcacacaatcacgtgactttacgtttattgacaatgtcgttgctgccaatttattagcagccaatgcccctaaactacaaggagaatcggtaaacatagggggaggagccagcattgacctcaactccctggtagatgaaatcaatgtactcttaggcaaacaaattcaggcaaattatgggtctgaacggccaggggacgtaaaacattcccttgccgatatccaccttgccgaaaagctcattgcctaccgccctaccgtttcatttcaggaaggattaagacagactgtcgagtggtttaaacaccactga

SEQ ID NO: 65319 - protein, 310 aa, Bacillus clausii KSM-K16
MATYLITGGAGFIGSNIAKALVAKGEKVKILDNFNTGKKDNIAEFIDDVEVIDGDFTNEKTVQSALKQVDVVFHQGAIPSVPKSIQNPIESNHANVSGTLQLLQGAVEARVSRFIYAASSSAYGDSETLPKHEQLPGNPMSPYAVSKYTGELYCKVFYNLYGLETVSLRYFNVFGPRQDPNSKYAAVIPSFIKAMLNDKPPTIFGDGTQSRDFTFIDNVVAANLLAANAPKLQGESVNIGGGASIDLNSLVDEINVLLGKQIQANYGSERPGDVKHSLADIHLAEKLIAYRPTVSFQEGLRQTVEWFKHH

SEQ ID NO: 65320 - DNA, 1017 bp, Bacillus clausii KSM-K16
  CDS (1)..(1017): transl_table=11
atgtccattctcgttacaggcggtgccggctacattggcagccacacttgcgttgaacttttaacagaaggctatgacgttatcatagttgataatttttccaacagcggacctgatacggttaaccgcattgaagaaattactagcaaaaaagtgaagacttatgacattaatttgcttgattcctctcgtttagaaacggttttcgctgaaaacaacattgaagcggtgatccattttgccggtttaaaagctgtcggcgaatcggtcgaaaaaccgcttcattattatgaaacgaacatcggcagcacgattcaattatgcaaaacgatggaaaaatatggtgtatacaaactcgttttcagttcatcagcaaccgtgtacggattgcctgaacaagttccaattgaagaaaacgcgccgttaaaagccgtcaacccttacggcaataccaaaatcattattgaggacatgctacgtgatttagcgacttctaataacaactggcgcatttcactactacgctattttaacccaatcggcgcccataaaagcggcctgattggcgaagagccaagcgggatcccaaataatttgatgccttatattacccaggttgctgccggcgtgcgtgaacaactgtctgtttttggcgatgattacccgacaaaagatgggacatgcatccgcgactacatccatgttgttgaccttgctttgggccacttgcaagcgctcaaaaaaatcgaaacatatacaggtgtgcaagcatataacttgggaacaggcaccggctacagcgttcttgaagtggttgacgcctttgaaaaagcgactggcatcacgattccgaaaaaaatcggcccccgtcgtccaggtgatgcccctgtcagctatgccgaccccacgaaagcaagaaccgaacttcagtgggaagcaaagcggacgcttatagaaatgtgtgaagactcttggcgttggcaagtccaccgcaaagcacagcttgaaagcaagtaa

SEQ ID NO: 65321 - protein, 338 aa, Bacillus clausii KSM-K16
MSILVTGGAGYIGSHTCVELLTEGYDVIIVDNFSNSGPDTVNRIEEITSKKVKTYDINLLDSSRLETVFAENNIEAVIHFAGLKAVGESVEKPLHYYETNIGSTIQLCKTMEKYGVYKLVFSSSATVYGLPEQVPIEENAPLKAVNPYGNTKIIIEDMLRDLATSNNNWRISLLRYFNPIGAHKSGLIGEEPSGIPNNLMPYITQVAAGVREQLSVFGDDYPTKDGTCIRDYIHVVDLALGHLQALKKIETYTGVQAYNLGTGTGYSVLEVVDAFEKATGITIPKKIGPRRPGDAPVSYADPTKARTELQWEAKRTLIEMCEDSWRWQVHRKAQLESK

SEQ ID NO: 65322 - DNA, 987 bp, Campylobacter jejuni RM1221
  CDS (1)..(987): transl_table=11
atgaaaattcttattagcggtggtgcaggttatataggttctcatactttaagacaatttttaaaaacagatcatgaaatttgtgttttagataatctttctaagggttctaaaatcgcaatagaagatttgcaaaaaataagagcttttaaatttttcgaacaagatttaagtgattttcaaggcgtaaaagcattgtttgagagagaaaaatttgacgctattgtgcattttgcagcaagcattgaagtttttgaaagtatgcaaaatcctttaaaatattatatgaacaacactgttaatacgacaaatctcatcgaaacttgtttgcaaactggagtaaataaatttatattttcttcaacggcagccacttatggcgaaccacaaactcctgttgtgagcgaaacaagccctttggcacctattaatccttatgggcgtagtaagcttatgagtgaagaggttttgcgtgatgcaagtatggcaaatcctgaatttaagcattgtattttaagatattttaatgttgcaggtgcttgtatggattatactttaggacaacgctatccaaaagcaacattactcataaaagttgcagctgaatgtgccgcaggaaaacgtgataaacttttcatatttggcgatgattatgatacaaaagatggtacttgcataagagattttatccatgtagatgatatttcaagtgcgcatttagcgactttggattatttacaagagaatgaaagtaatgtttttaatgtaggttatgggcatggttttagtgtcaaagaagtgattgaagcgatgaaaaaagttagtggagtggattttaaagtagaacttgccccacgccgtgcaggtgatcctagtgtgttgatttctgatgcaagtaaaatcagaaatcttacttcttggcagcctaaatatgatgatttagagcttatttgcaaatctgcttttgattgggaaaaacagtgttaa

SEQ ID NO: 65323 - protein, 328 aa, Campylobacter jejuni RM1221
MKILISGGAGYIGSHTLRQFLKTDHEICVLDNLSKGSKIAIEDLQKIRAFKFFEQDLSDFQGVKALFEREKFDAIVHFAASIEVFESMQNPLKYYMNNTVNTTNLIETCLQTGVNKFIFSSTAATYGEPQTPVVSETSPLAPINPYGRSKLMSEEVLRDASMANPEFKHCILRYFNVAGACMDYTLGQRYPKATLLIKVAAECAAGKRDKLFIFGDDYDTKDGTCIRDFIHVDDISSAHLATLDYLQENESNVFNVGYGHGFSVKEVIEAMKKVSGVDFKVELAPRRAGDPSVLISDASKIRNLTSWQPKYDDLELICKSAFDWEKQC

SEQ ID NO: 65324 - DNA, 939 bp, Dehalococcoides ethenogenes 195
  CDS (1)..(939): transl_table=11
atgcctgaagtgttagtcaccggcgggtgcggttttatcggcagtcatctggtagatgccctgctgtcacagggatttaaggtaagggtaatggacaacctttcaaacggttcactcgaaaaccttaagtgcggccaaagggataaactggaaataataaacggaaaccttacggacaaatttctgctggattcagccgtaaaaggctgcgaaacggtatttcacctggctgcccatgccaatgtccagaatagcgccaaagataccggcatagaccttgagaataatactctggctacccataacctgctggaagccatgcgccgaaaccgggtggacaggctggtatttgcttccagtgcggcggtgtacggggagagcggtctgacggtactggatgaggattacgggccgcttttgcctatttccctgtatggtgccagcaaactggcaggcgaagggctgataagtgcttacagccatctctacgggctgaaagccaccatgttccgctttgccaatattgtgggcagcagacggcacagcggggtgatatatgattttgtcagccgtcttcgccagaacccgtccagtctgttagtgctgggtgacggaagccagagcaagccttatctgcacgttagtgactgtgttgccggtatgttgctggggtttgaaaaatcaaccaaaaatttgggtttatataatctgggtacgcctgattcggtggcagtcagggatattgcctgtctggtcgcctcggaaatggggcttaagaatgtttgctacagctatagcggtggggaacgcggctggcagggggatgcccctcaggtacgctttgatatcagccgtatccgcactttgggctttaaacctaagtttacttcacttcaagccgtcaaactggcaatcaaagaaactctgaaggagatttga

SEQ ID NO: 65325 - protein, 312 aa, Dehalococcoides ethenogenes 195
MPEVLVTGGCGFIGSHLVDALLSQGFKVRVMDNLSNGSLENLKCGQRDKLEIINGNLTDKFLLDSAVKGCETVFHLAAHANVQNSAKDTGIDLENNTLATHNLLEAMRRNRVDRLVFASSAAVYGESGLTVLDEDYGPLLPISLYGASKLAGEGLISAYSHLYGLKATMFRFANIVGSRRHSGVIYDFVSRLRQNPSSLLVLGDGSQSKPYLHVSDCVAGMLLGFEKSTKNLGLYNLGTPDSVAVRDIACLVASEMGLKNVCYSYSGGERGWQGDAPQVRFDISRIRTLGFKPKFTSLQAVKLAIKETLKEI

SEQ ID NO: 65326 - DNA, 921 bp, Rhodobacter sphaeroides 2.4.1
  CDS (1)..(921)
atgcgggtcttcggccgacggcccgaggccttccgtccgccgcttgccggcgtcgattatgtcatgggcgactacagcgacccggctctggtgttccgggcgctgcacgacgtcgaggcggtgctccatctggcgagcgcgacggtgcccgcgaccgcgaacctcaacccggggctcgacatcgaagccaatcttctggcgacggtgcggcttctcgacgtgatgcgcgcgacgggcaagcggcggctcgtgttcctctcgtccggcggcacggtctatggcgtgccgcaggccgatccggtgcccgaggagcatccgctgcgccccatcggatcctacggcatcgtgaaggtcgcgatcgagagctacatccgcatggagcaggcgctctacgggctggcgcccgtggtgctgcgcgcctcgaacccctacgggccgcgacagggccacaccggcgtgcaggggatcatcggcacccacctgtggcgcgccgcgcgcggcgagccggtcgagatctggggcgacgggcaggtgacgcgcgacttcatccatgtccgcgatctggcggcgctctgcgttgcgaccctgcgctcggacacctgcggcttcttcaacgcgggcagcggcaccggcacctcggtggccgagatcgtggccgggatcgaccgcaccgtccaggcttcgggcggcccgcccgtccgcgcgctccgccagcccggccgcggctacgacgtgccccgtgtggtgctcgacatctcccgcgcgcgcgcagccttcgactgggccccgcgcatcggcctcgaggaggggctggccgagacctggcgctgggtctgcacgaccctcgcccatgaaaccgccgccgaagcccccccaccccgcgcgaagctcgcccgctcgcgccgcagcgcgcgcttctga

SEQ ID NO: 65327 - protein, 306 aa, Rhodobacter sphaeroides 2.4.1
MRVFGRRPEAFRPPLAGVDYVMGDYSDPALVFRALHDVEAVLHLASATVPATANLNPGLDIEANLLATVRLLDVMRATGKRRLVFLSSGGTVYGVPQADPVPEEHPLRPIGSYGIVKVAIESYIRMEQALYGLAPVVLRASNPYGPRQGHTGVQGIIGTHLWRAARGEPVEIWGDGQVTRDFIHVRDLAALCVATLRSDTCGFFNAGSGTGTSVAEIVAGIDRTVQASGGPPVRALRQPGRGYDVPRVVLDISRARAAFDWAPRIGLEEGLAETWRWVCTTLAHETAAEAPPPRAKLARSRRSARF

SEQ ID NO: 65328 - DNA, 993 bp, Rhodobacter sphaeroides 2.4.1
  CDS (1)..(993)
atgcctgacacgattctggtgacgggtggggcgggcttcatcggctcgcacacctgcaaggcgctggcgcgcgcgggccatcgcccggtgagcttcgacaatctctcgacgggccacgccgatgccgtgcgcttcggcccgctggtgcagggcgacgtgcgcgatccgaatgcggtcgaggccgcgctgcgcgcccatggtgcgaaggcggtgatccatttcgcggcctcggcctatgtgggcgagtccatggcggacccggcgaaatattacgacaacaatgtgggcggcatgatcggcctcgtgcagggctgccgcgccgcgggcgtctcgcgcatcgtcttctcctcgagctgcgcgacctacgggacgcccgaccggctgccgatccgcgagacgacgccgcagcggccgatcaatccctatggccgcaccaagctcatcggcgaagagatcctgcgcgatctcggcgtcgaggggatgcgccatgtggcgctgcgctacttcaatgcggccggcgccgacccggaaggcgagctcggcgaacggcacgatcccgagacgcacctcctgccgctcgcgctgcgcgcggcctcggggcagggcgggccgctctcgatcttcggcaccgattatccgacgcccgacggcacctgcatccgcgactatatccatgtggcggatctggcccgcgcccatgtgctggcactcggccggctgatggcgggcggcgagagccttgcggtgaacctcggcacgggccgcggccagtcggtgcgcgagatcgtggccgcgatcgagcggatcacagggcgcgcggtgccggtccggctcgaggcgcggcgcccgggcgacccggcagagttggtggccgaccccgcgctggcggcgtccgaactcggcttccgcacgcaattgtcggatatcggatccatcgtgcgccacgccgcgccctggttcggactggagcccgcccatgtcgaagcggcatga

SEQ ID NO: 65329 - protein, 330 aa, Rhodobacter sphaeroides 2.4.1
MPDTILVTGGAGFIGSHTCKALARAGHRPVSFDNLSTGHADAVRFGPLVQGDVRDPNAVEAALRAHGAKAVIHFAASAYVGESMADPAKYYDNNVGGMIGLVQGCRAAGVSRIVFSSSCATYGTPDRLPIRETTPQRPINPYGRTKLIGEEILRDLGVEGMRHVALRYFNAAGADPEGELGERHDPETHLLPLALRAASGQGGPLSIFGTDYPTPDGTCIRDYIHVADLARAHVLALGRLMAGGESLAVNLGTGRGQSVREIVAAIERITGRAVPVRLEARRPGDPAELVADPALAASELGFRTQLSDIGSIVRHAAPWFGLEPAHVEAA

SEQ ID NO: 65330 - DNA, 987 bp, Rhodobacter sphaeroides 2.4.1
  CDS (1)..(987)
atggcgcagcgggttctggtgacgggaggggcgggctacatcggctcgcacgcctgcaaggtcttgaagcgggccgggttcgagcccgtcaccttcgacaatctctcgacggggtgggagcaggccgtgaagttcggcccgctcgcccgcggcgacctgatggaccgcgcgagcatcgacgcggcgctcgagacctggaaacccgtggcggtgatgcatttcgcggcgctctcgctcgtgggcgagtcgatgcgcgatcccggcacctactggcgcgtgaacgtgaccggcgcgctcaacctgctcgaggcgacggtggcggccggggtgaagaacttcgtcttctcctcgacctgcgccacctacggcgatcaggacggcgtggtgctcgacgaggatacgccgcagcgcccgatcaacgcctatggcgcctccaagcgcgccatcgaggagatggtggcgaatttcggcgcggccttcgggctcaaccacacgatcttccgctatttcaacgtggcgggcgccgaccccgagggcgaggtcggcgagcagcacgatcccgagacgcatctgatcccgctcatgctcgatgcggtggcgggccggcggcccgcgctcaccgtcttcggcaccgactatcccacgcgcgacggcacctgcatccgcgactatgtgcatgtgatggatctggcccaggcccatgtgctgggcctgaaccgcctgctcgacggcggcccgaaccgggtcttctgcctcggcaccgggcgcggcttctcggtgcgcgaggtgatcgaacaatcgcgcgccgtaaccaaccgcgaagtgcccatcctgttcggcgaccgccggtcgggcgatgcggcggccctcgtctgcggctcggagcgcgcggtgcgtgaactgggatgggagcccgagctttcgaccctgccgcacatgatcgccgatgcctggcgctggcatcgggccccgaaattccacgaatga

SEQ ID NO: 65331 - protein, 328 aa, Rhodobacter sphaeroides 2.4.1
MAQRVLVTGGAGYIGSHACKVLKRAGFEPVTFDNLSTGWEQAVKFGPLARGDLMDRASIDAALETWKPVAVMHFAALSLVGESMRDPGTYWRVNVTGALNLLEATVAAGVKNFVFSSTCATYGDQDGVVLDEDTPQRPINAYGASKRAIEEMVANFGAAFGLNHTIFRYFNVAGADPEGEVGEQHDPETHLIPLMLDAVAGRRPALTVFGTDYPTRDGTCIRDYVHVMDLAQAHVLGLNRLLDGGPNRVFCLGTGRGFSVREVIEQSRAVTNREVPILFGDRRSGDAAALVCGSERAVRELGWEPELSTLPHMIADAWRWHRAPKFHE

SEQ ID NO: 65332 - DNA, 993 bp, Lactobacillus gasseri
  CDS (1)..(993)
atgcgagtattagttatcggtggggccggttatatcggctctcacgctgttagaaagttaattgaagaaggtaacgatgtcgttgtccttgattctctctacactggccacagaaaggctgttgacaagaaagctaagttttaccaaggcgatattgaagatactaatttagtaagcaagatcttacgtgatgaaaacattgatgctgtaatgcacttcgccgcttactcattagttcctgaatcagttaagaaaccattgaagtactacgacaataacgtttcaggtatgatttctcttctgcaagcaatggacgacgctaaagttaagtacttagtattctcatcttctgctgcaacttatggcattccaaagacattgccaattactgaagatacaccgcttgatccaatcaatccatacggtgaaactaagatgatgatggaaaagattatgcactgggctgacaaggctgacggcattaagtcaattgctctgcgctactttaatgtggctggcgcttcaagcgatggttcaattggtgaagaccatggtcctgaaactcacttaattccaaacatcttaaagagtgctatttctggtgatggcaatttcactatttttggtgacgactatgacactaaagacggtactaatgtccgcgactatgttcaagttgaagacttaattgacgctcacatcttagcacttaagcatgtaatggaaactaacaagtctgatgtctttaacttaggtactgctcaaggttactcaaacttagaaatccttgaagctgctaagaaagttactggcattgacattccttacactattggaccaagaagaggtggagatcctgattccttagttgctgactcaagcaaggctcgtaaagtcttaggctggaagccaaagcatgaaaatgttgacgatgtaatcgcaactgcttggaactggcacaagagccacccaaagggttacgaagataagtaa

SEQ ID NO: 65333 - protein, 330 aa, Lactobacillus gasseri
MRVLVIGGAGYIGSHAVRKLIEEGNDVVVLDSLYTGHRKAVDKKAKFYQGDIEDTNLVSKILRDENIDAVMHFAAYSLVPESVKKPLKYYDNNVSGMISLLQAMDDAKVKYLVFSSSAATYGIPKTLPITEDTPLDPINPYGETKMMMEKIMHWADKADGIKSIALRYFNVAGASSDGSIGEDHGPETHLIPNILKSAISGDGNFTIFGDDYDTKDGTNVRDYVQVEDLIDAHILALKHVMETNKSDVFNLGTAQGYSNLEILEAAKKVTGIDIPYTIGPRRGGDPDSLVADSSKARKVLGWKPKHENVDDVIATAWNWHKSHPKGYEDK

SEQ ID NO: 65334 - DNA, 981 bp, Magnetospirillum magnetotacticum MS-1
  CDS (1)..(981)
atgctcctcgtgaccggtggtgcgggctatgtgggttcgcacactcttcaccacctcatcagaaacggttattcccccgaatccattatcgtggttgataatttgtgtcgcggcagccgcgacgccgttccccatggcgtgcacttcgccgaagtggatctgctagataccgaagtcctggttgaattgttccggcgccacgacgtttcagccgtcatccatttcgccggtttcgcctatgtggatgaaagcatggcggacccgacagcctattacaggacgaatgtagtcgccggactctctttgttggaagccatggtccgggtcggctgccgggccatcgtgttctcgtccacctgcgcgacctatggcactccttcttcggtccccattgccgagagtgagccgcaaattccgatcaatccctatggggaaaccaagttagttttcgaacgggccttggagtggtacgaacgctgccacgggattcgtcatgtcatcttgcgctatttcaatgctgccggtgccgcctatggggtggggtcatatggcaatcatgatgtgcgaatgatccctgcggccgtcttggcggcgatggggcgcaggccaccagtgaagatcttcggtaccgattacgagacctctgacgggacatgtgttcgcgactacgtccacgtggccgatctggccgaaggccattgcttggcgctcgaacacctgcgggaggatggcgcttcgaccgccctcaatctgggaagtggccggggaagtagtgttctcaacattcttgaggcggtgcaccgtatcggcggtaggccggtccccaatgaaaagtcgccgcgccgtctttgcgatcctccgactctgatcgccgacacccgtctggcgcaaagaatattgggctggcatccggcgtacactctggacgacatcatttccagcgtgtggcattggcaccaatccatggtcatggcgaggtag

SEQ ID NO: 65335 - protein, 326 aa, Magnetospirillum magnetotacticum MS-1
MLLVTGGAGYVGSHTLHHLIRNGYSPESIIVVDNLCRGSRDAVPHGVHFAEVDLLDTEVLVELFRRHDVSAVIHFAGFAYVDESMADPTAYYRTNVVAGLSLLEAMVRVGCRAIVFSSTCATYGTPSSVPIAESEPQIPINPYGETKLVFERALEWYERCHGIRHVILRYFNAAGAAYGVGSYGNHDVRMIPAAVLAAMGRRPPVKIFGTDYETSDGTCVRDYVHVADLAEGHCLALEHLREDGASTALNLGSGRGSSVLNILEAVHRIGGRPVPNEKSPRRLCDPPTLIADTRLAQRILGWHPAYTLDDIISSVWHWHQSMVMAR

SEQ ID NO: 65336 - DNA, 999 bp, Magnetospirillum magnetotacticum MS-1
  CDS (1)..(999)
atggagcgccccatgatcctcgtcaccggcggagccggcttcatcggttccaacatcctggcggccctcgaggagaagggggcgggcaagctggtggtctgcgaccgcctgcggtcgggctcgaaatggcagaacatcgccaagcgcgaactgtccgacatcgtccatcccgagcagatcttcgatttcctccaggccaatgccaagcatatggaggtggtgatccatatgggcgccatctcggccaccaccgagaccgacgccgacaagatcctcgccaacaacttctcgctgtctttggcgctgtggaagtggtgcgcgctgcacaatgtgcgcttcatctacgcctcgtcggcggccacctatggcgacggcaatcagggctttgacgacgatgcctccatggagcatctggccaaattgcggccgctcaacgcctatggctggtccaagcatctgttcgaccgccgtgtggcgcgtaaggtgtgggccggatcgcgcaagccgccgcaatgggcgggcctcaaattcttcaacgtctacggccccaatgaataccacaagggcaaccagcagagcgtggtggcccaggtctatccccacgccgagaaagacgccgcctaccagttgttcaagtcgcacaatcccaaatatcccgatggcggccaattgcgcgacttcatctgggtgggcgacgtggtggacgtggtcatgtggctgatcgagaatcccaaggtcagcggattgttcaatgtgggcaccggcaaggcgcggtcctttctcgatctcgccaatgcggtctaccgcgccgtgggacgcgagccgcagatcaagttccgcgacacccccatcgagatccgcgacaagtaccagtatttcacccaggccaagatggagcgcctgcatcgcgcgggctatgccaagcccttcacctcgctggaagacggcgtcgagatgtatgtgaagcgctatctcgcggctgcggattcgtaccgctga

SEQ ID NO: 65337 - protein, 332 aa, Magnetospirillum magnetotacticum MS-1
MERPMILVTGGAGFIGSNILAALEEKGAGKLVVCDRLRSGSKWQNIAKRELSDIVHPEQIFDFLQANAKHMEVVIHMGAISATTETDADKILANNFSLSLALWKWCALHNVRFIYASSAATYGDGNQGFDDDASMEHLAKLRPLNAYGWSKHLFDRRVARKVWAGSRKPPQWAGLKFFNVYGPNEYHKGNQQSVVAQVYPHAEKDAAYQLFKSHNPKYPDGGQLRDFIWVGDVVDVVMWLIENPKVSGLFNVGTGKARSFLDLANAVYRAVGREPQIKFRDTPIEIRDKYQYFTQAKMERLHRAGYAKPFTSLEDGVEMYVKRYLAAADSYR

SEQ ID NO: 65338 - DNA, 984 bp, Magnetospirillum magnetotacticum MS-1
  CDS (1)..(984)
atggatctggcgggcaagcgcatcctggtcacgggaggagccggcttcatcggctcggccattatcgatcaactggcgaccgaaggctgctctgagatcgtggcggtggataatttcgtgcgcggcaggaaggagaaccttgacgcggccctggcgcgcggcaatgtccggctggtggacggcgatatccgcgaccgctccctgatggatggtctggtggcgggaagcgacctgatcttccacatggccgccctgcgcatcacccattgcgccgccgaaccgaggctggcgctggaagtgatggtggattcggtcttcgacctgctggaactggcggtcaagcacaaggtcgaaaagatcgtggcggcctcgtcggcctccatctacggtctggcctcgcacttccccaccaccgaggcggaaaacccctacgacaaccgcaccctctacggcgccgccaaggccttcaatgaaggtctgctcaagtcgttcgccgatatgtacggcatccggtattgcgccatgcgttatttcaacgcctatggcccgcgcatggacattcacggcaaatataccgaagtgctgatccgctggatggaacgcatcgacggcgggcaaaagccgctgatcttcggcgacgggctccaaaccatggacttcgttcatgtggacgacatcgccagggccaatatcctggccgccaagtccgactgcgtcgaggacgccttcaacgtcgccagccagaccgagaccagcctgcgccaattggccgatctgctgtgcaaggtcatgggacgcgaaggtctcgagcccgaatacggcccagaacgctctgtcaatcccgtgccgcgccgcctggccgatatctccaaggcccgggccctgctgggctttgaacctcgcgtcaacctcgaagacggccttcgcggcctggtggactggtggcggaccgagcgggcccgcttcgagcagcccgccggatga

SEQ ID NO: 65339 - protein, 327 aa, Magnetospirillum magnetotacticum MS-1
MDLAGKRILVTGGAGFIGSAIIDQLATEGCSEIVAVDNFVRGRKENLDAALARGNVRLVDGDIRDRSLMDGLVAGSDLIFHMAALRITHCAAEPRLALEVMVDSVFDLLELAVKHKVEKIVAASSASIYGLASHFPTTEAENPYDNRTLYGAAKAFNEGLLKSFADMYGIRYCAMRYFNAYGPRMDIHGKYTEVLIRWMERIDGGQKPLIFGDGLQTMDFVHVDDIARANILAAKSDCVEDAFNVASQTETSLRQLADLLCKVMGREGLEPEYGPERSVNPVPRRLADISKARALLGFEPRVNLEDGLRGLVDWWRTERARFEQPAG

SEQ ID NO: 65340 - DNA, 900 bp, Magnetospirillum magnetotacticum MS-1
  CDS (1)..(900)
atgaatccgtccgtcgctctcgttaccggtgccgctggctttctcggcagccacactatcgaggccctgttggcccaaggccatcgggttcggggcctcgatctgcccggcgcccggtttgaagacagcctgggcgcgctgctcgatcatcccggcctgtccctggataagcgcgacctgctcgacattcccgccgacgatcccatcttcgccggggtggatgtcatctatcactgcgctgggatcgccgaccatgtgccctcactgcaggtgcccgagcgctacatgcaggccaatgtgatggcggtggtccgggtgctggaggcggcccgccatcacaaggtgcgcaaggtgatcaacgcttcgtcggcggcggtctatggcatcgcggcggctccgaccgccgaggatcatcccatcaatccggtcaatccctacggcctgaccaagtggatggccgaggaggcatgcgcccactggtccaaggtgttcggcgtggcgaccttgagcttccgtatcttcaattgctatggcccgcgcgccaccgccagtggccccatcggcttcttcctgaagaaggctgccgctggcgaggcgctgaccgtgaccggtgacggcacccaggagcgcgacttcattcatgtgagcgacgtggtcgccgcctttctggccggggcggcgagcgagaagagcagcgccgcctacaatctcgggtcgggtcggcccgagaccgtcaaccgcctggccgagctggtggggggcgccatcacctatattcccgcccgaccgggcgagcccaaggtcattctggccgacaccacccgcatccgggccgaactcggctgggagcccaaggtctccctggccgcggggatcgccgccctgaagacggtgggttaa

SEQ ID NO: 65341 - protein, 299 aa, Magnetospirillum magnetotacticum MS-1
MNPSVALVTGAAGFLGSHTIEALLAQGHRVRGLDLPGARFEDSLGALLDHPGLSLDKRDLLDIPADDPIFAGVDVIYHCAGIADHVPSLQVPERYMQANVMAVVRVLEAARHHKVRKVINASSAAVYGIAAAPTAEDHPINPVNPYGLTKWMAEEACAHWSKVFGVATLSFRIFNCYGPRATASGPIGFFLKKAAAGEALTVTGDGTQERDFIHVSDVVAAFLAGAASEKSSAAYNLGSGRPETVNRLAELVGGAITYIPARPGEPKVILADTTRIRAELGWEPKVSLAAGIAALKTVG

SEQ ID NO: 65342 - DNA, 990 bp, Magnetospirillum magnetotacticum MS-1
  CDS (1)..(990)
atggctgatccccgtccggttctcatcgccggcggggcgggctatatcggcagtcatgtggccctggcgctggccgatgctggccgtcccgtggtgattctcgacgatctgtccacgggcaggcaagccctggtgccggagggtgccgtcttcgtgcggggcgatatgggtgaccgcgccctggtccgccgtcttctggccgaacatggctgtagcggcgtgatgatgttcgccggttccatcatcgtttccgaatccttccgcgagcccctgccctactggcgcaacaatgccggaagcggacttgcctttgtggaaacatgtgtcgaagccggaatccgacatttcgtctattcctcgaccgctgccgtatacggcacgccagacacgctgcccatctcggaaagcgcggccctgcgccccatcagcccctatgggcgttccaagctggcggtggagtgggcgctgtccgacatctgtgaaacggcgcccacgcggtttgcggcgctgcgttacttcaatgtggctggggcggatcatcgggggcgtagcggccaggtctctcccgtggcgactcacctgatcaagatcgccgtcgaggcggcattgggccgccgagagggcatggccatctatggcgacgattatccgaccgccgacgggacctgtatccgcgactacatccacgtcaccgatctggcggaagcccatgttctggcgcttgcccatctggaacgggggggagagtcgctgatcgccaattgcggctacggtcacggcttttccgtgcgcgaggtcatcgacgtcgtccgccgcgtgtcggggcgcgacttccccgttcacagttccgagcgccggcgtggcgaccctccggcattggtggcggattccggcctgctgaaggcaaaactcggttgggtggcacggcgcgacgatctggaactgatggttcgttcggcgctggaatgggaagctaagcagcagccatga

SEQ ID NO: 65343 - protein, 329 aa, Magnetospirillum magnetotacticum MS-1
MADPRPVLIAGGAGYIGSHVALALADAGRPVVILDDLSTGRQALVPEGAVFVRGDMGDRALVRRLLAEHGCSGVMMFAGSIIVSESFREPLPYWRNNAGSGLAFVETCVEAGIRHFVYSSTAAVYGTPDTLPISESAALRPISPYGRSKLAVEWALSDICETAPTRFAALRYFNVAGADHRGRSGQVSPVATHLIKIAVEAALGRREGMAIYGDDYPTADGTCIRDYIHVTDLAEAHVLALAHLERGGESLIANCGYGHGFSVREVIDVVRRVSGRDFPVHSSERRRGDPPALVADSGLLKAKLGWVARRDDLELMVRSALEWEAKQQP

SEQ ID NO: 65344 - DNA, 1005 bp, Leuconostoc mesenteroides subsp. mesenteroides ATCC 8293
  CDS (1)..(1005)
atggcagtattagtacttggtggtgcaggatatattggctcacacatggtgaaacggttggttgaagcaggacgcgacgtggtggttgtggacgccttgttcactggacaccgcgcagcagttaatccagcagcgacattttatcaagttgacattcgtgataaggcagaattgtcggcagtgtttgataaagaaaacattgaacaagtggttcattttgcagccttttcaattgtgccagagtcagtggcaaacccgctgaaatattttgacaacaatactagtggcatgattacgttgttggaagtgatgaaagcacatgacgtcaaacaaatcgtcttttcatcaaccgccgcaacttatggtaatccggtgcatattccgattaaggaaactgatccgcaaaatccgattaacccctatggtgaatcaaagttgatgatggaaaaaatcatgaactggtccgaccaagctgacggggttaaatgggtcgcgttgcgctatttcaatgtggctggtgcagcagaagatggcacgattggtgaagaccacaatccagaaacacacttggtaccaattattttgcaagctggtttgggacaacgtgattatattgaaatgtttggcgatgactataatacaccagacggctttaatgtacgagattatgtgcatgtcttagacttggcagacgcgcatatcttggcattgcagtatttagctgatggtcatgagtcaaatcagtttaacttaggatcagcgactggattttcagtgaaagagatggttgaggcggcacgggaagcaacaggggttgatattccagctaaaattgggccacgtcgagcgggtgatcctgatattttgattgccaattcagataaggcacgagaggtgctgggctgggcaccaaagtatgataatgtgcaagacattatcaagacagcttggcagtggcatcagagtcatcctaagggttatgatgaacgacatgaggatcaataa

SEQ ID NO: 65345 - protein, 334 aa, Leuconostoc mesenteroides subsp. mesenteroides ATCC 8293
MAVLVLGGAGYIGSHMVKRLVEAGRDVVVVDALFTGHRAAVNPAATFYQVDIRDKAELSAVFDKENIEQVVHFAAFSIVPESVANPLKYFDNNTSGMITLLEVMKAHDVKQIVFSSTAATYGNPVHIPIKETDPQNPINPYGESKLMMEKIMNWSDQADGVKWVALRYFNVAGAAEDGTIGEDHNPETHLVPIILQAGLGQRDYIEMFGDDYNTPDGFNVRDYVHVLDLADAHILALQYLADGHESNQFNLGSATGFSVKEMVEAAREATGVDIPAKIGPRRAGDPDILIANSDKAREVLGWAPKYDNVQDIIKTAWQWHQSHPKGYDERHEDQ

SEQ ID NO: 65346 - DNA, 993 bp, Leuconostoc mesenteroides subsp. mesenteroides ATCC 8293
  CDS (1)..(993)
atggctattttagttcttggtggagccggttatatcggttcacacatggttaagcgtttgatagaagcggatcgcgacgtcgttgttgttgatgcattgtttacggggcaccgcgaagcggttaatccaaaagcaaaattttatcaagttgatattcgtgataagacagcattgtcggaagtgtttgacaaagaaaatatcgaacaagttgttcactttgcagccttttcaattgttccagaatctgtagcaaacccactaaagtactttgataataatactagtggtatgattactttgctagaagtgatgaaagaacacgatgttaaacaaattgtgttctcgtcaacggcagctacttatggtaatcctgttaatattcctattaaagaaacagatccgcaacgaccaattaatccttatggtgagtcaaagttaatgatggaaaaaatcatggcttggtctgatcaagcggatggtgttaagtgggttgcattgcgctactttaacgtagctggtgctgccgaagatggtacaattggagaagatcacgcgcctgaaacacatttagtaccaattattttgcaagccggtttaggtcaacgtgaatatattgagatgtttggtgatgattacaatactcctgacggtttcaatgttcgtgattatgtccatgtgttggatttggctgatgctcatattttggcattgaagtatttagccgatggaaacgattcaaaccaatttaacttgggatctgctactggattctctgttaaagaaatggtagaagcagctagatcagctactggtgttgatattcccgccaagattggtccccgccgagctggtgaccctgatattctgattgctaattcagacaaagcacgtgatgtgcttggctgggctcctaagtatgataatgtacaagatattatcaaaacagcctggaattggcacaaaaaccatccatcaggatataatgacaagtaa

SEQ ID NO: 65347 - protein, 330 aa, Leuconostoc mesenteroides subsp. mesenteroides ATCC 8293
MAILVLGGAGYIGSHMVKRLIEADRDVVVVDALFTGHREAVNPKAKFYQVDIRDKTALSEVFDKENIEQVVHFAAFSIVPESVANPLKYFDNNTSGMITLLEVMKEHDVKQIVFSSTAATYGNPVNIPIKETDPQRPINPYGESKLMMEKIMAWSDQADGVKWVALRYFNVAGAAEDGTIGEDHAPETHLVPIILQAGLGQREYIEMFGDDYNTPDGFNVRDYVHVLDLADAHILALKYLADGNDSNQFNLGSATGFSVKEMVEAARSATGVDIPAKIGPRRAGDPDILIANSDKARDVLGWAPKYDNVQDIIKTAWNWHKNHPSGYNDK

SEQ ID NO: 65348 - DNA, 948 bp, Nostoc punctiforme PCC 73102
  CDS (1)..(948)
atggctaaaattatcgttactggagcagcgggctttattggttctcaccttgtatacatcttgctacaacaaggggaagaagtaattgggattgatgaattcaatgattattgcgatcccatgttgaagcgcaagaatgttgcacacttacatagctcacctggctttacattaatcgaagcagatattcagtttttagattggcaggaactcttaaaagatgttgatgtcgtttaccatcaagcagcacaagcaggtgtcagggcaagttggggtaaggcttttcgaggttacacggaacggaatattaatgctacgcaagttttgctagaagcggctaaagatgcaaaacacttgaaaagattagtgtttgcttcttcgtcaagtgtatatggtgatgcagaaactttacccactcacgaaggaatttgccctgaacctgtttctccttacggcattactaagctagcggctgaaactctgtgcagactatatcacaaaaactttggtgtgccatatgtatcattgcgctatttcacagtctatggccctaaacaacgcccagatatggcatttcataagttctttaaatccattttgcaggatgaggcgattcctatttacggcgatggccagcaaacgcgggagtttacatttgttggtgatatagtcgcggccaatttagccgctgcttccacaccccaagcagtgggagaaatttttaatatcggtggtggtagcagggtggttttagcagaagtcttagatacgattgaagaaatcgttggcaaaccaatcaaaagaaaccacatagaaaaagcgatgggagatgcacgccacactgctgctgatgtatctaaagcgcagaaaattctgggatatcagccacaagtctccctgagagatggcttgacacaggaatggcggtggattaagtctttgtattaa

SEQ ID NO: 65349 - protein, 315 aa, Nostoc punctiforme PCC 73102
MAKIIVTGAAGFIGSHLVYILLQQGEEVIGIDEFNDYCDPMLKRKNVAHLHSSPGFTLIEADIQFLDWQELLKDVDVVYHQAAQAGVRASWGKAFRGYTERNINATQVLLEAAKDAKHLKRLVFASSSSVYGDAETLPTHEGICPEPVSPYGITKLAAETLCRLYHKNFGVPYVSLRYFTVYGPKQRPDMAFHKFFKSILQDEAIPIYGDGQQTREFTFVGDIVAANLAAASTPQAVGEIFNIGGGSRVVLAEVLDTIEEIVGKPIKRNHIEKAMGDARHTAADVSKAQKILGYQPQVSLRDGLTQEWRWIKSLY

SEQ ID NO: 65350 - DNA, 1017 bp, Nostoc punctiforme PCC 73102
  CDS (1)..(1017)
atgaaaaagaaaatattggtaactggcggtgctggttacattggctcccatgtagttcgtcaattgggggaagctggttatgatgtcgtagtctacgacaactgctctacaagttcaccagcatccgtactacacgggaaattaattattggcgatttagtagacaccgggcatctttatcaagtttttgcccagcatgaattcagcgcagtcttacacttcgccgctagtctgattgttccagaatcagtagctcatcccctcgactactacgcaaacaacacccgcaacactttaaatttgctgcgctgctgtagcgttatgggtgttaacaagttcattttttccagcacagccgcagtgtatggggaagtagaagaaaatcctgttactgagttgaaccctacacagccgattaatccttacgggcgttcaaagttgatgagtgaatggctgatccaggactatgcggcagcatcttcaatgcgctacgtaattctacgttactttaatgtagcaggttctgaaccacgtggactattggggcaaatgtctccgaatgccactcacttaattcgggctgcttgtgatgcggcactcaagcgtaagccagaagtacgaatttttggtactgattttcctacgcctgatggaaccgcaatccgagactatatccacgtagaggatttggcgactgctcatttagatgctttggattatttagaaaaaagaggtgaaagccaaattttcaactgcggttatgggcaaggatacagcgtgcgacaagttattgagagagtcaaggctatttctggtgtcgattttcccgttattgccgcaccacgtcgtccgggcgatcctgcctgtgttgaagcttgtgctgataaaatccgtagagttttgggttggcaaccaaagcacaatgatttagacgaaattatcgatacaactattacttgggaaaaacataagagtaacttggcaagacaaaagcatctaaatatggcatacgcataa

SEQ ID NO: 65351 - protein, 338 aa, Nostoc punctiforme PCC 73102
MKKKILVTGGAGYIGSHVVRQLGEAGYDVVVYDNCSTSSPASVLHGKLIIGDLVDTGHLYQVFAQHEFSAVLHFAASLIVPESVAHPLDYYANNTRNTLNLLRCCSVMGVNKFIFSSTAAVYGEVEENPVTELNPTQPINPYGRSKLMSEWLIQDYAAASSMRYVILRYFNVAGSEPRGLLGQMSPNATHLIRAACDAALKRKPEVRIFGTDFPTPDGTAIRDYIHVEDLATAHLDALDYLEKRGESQIFNCGYGQGYSVRQVIERVKAISGVDFPVIAAPRRPGDPACVEACADKIRRVLGWQPKHNDLDEIIDTTITWEKHKSNLARQKHLNMAYA

SEQ ID NO: 65352 - DNA, 999 bp, Nostoc punctiforme PCC 73102
  CDS (1)..(999)
atgtcgtctggaaagcctaccattttggttacggggggagctggatacattggttctcatacggtgctagctttgaagcaagcgggttataacgttgtcatccttgataatctggtctatgggcatcgtgacctggtagaaaagattttacaggtagaactggtagtaggggatacaggcgatcgcgccttgctagatcacctatttaaaacccgcgatattgctgctgtgatgcacttttctgcctacgcctacgtaggagaatcagtaactgacccggctaaatactaccgcaataacgttgttggtactttgaccctgttagaagcgatgctgacagcatctgtaaagaaatttgtcttttcttctacctgtgctacctacggcgtgccagaatttgtaccgattccagaaaaccatccccaaaacccgattaatccttatggcgctacaaagctgatggtagagcggattctttctgattttgatgttgcttatggttttcaatcagtgcgtttccgctattttaatgctgctggtgctaatcccaatggcttactcggcgaggatcacaacccagaaacccatttgattcccttagtgctaatgacagctttaggcaaacgaaaatccatctcaattttcggcaccgattaccccacgcccgatggtacttgtattcgtgattatattcatgttaacgacttagcagatgcccatattttgggattggaatatttattaaaaggtggcgatagcgaagtttttaatttgggcaatggtagcggcttctccgtcagagaagtaattgccgccgccgaacaagtgacaggaacttcgataccagtagaagaacacgatcgccgtcccggagatcccccaattctcattggcactagcgagaaagccagaacaatcttaggctggcaacctcagtatccatccatcgaagatattgtcgctcatgcgtggcagtggcatcaaaagcgacataagtag

SEQ ID NO: 65353 - protein, 332 aa, Nostoc punctiforme PCC 73102
MSSGKPTILVTGGAGYIGSHTVLALKQAGYNVVILDNLVYGHRDLVEKILQVELVVGDTGDRALLDHLFKTRDIAAVMHFSAYAYVGESVTDPAKYYRNNVVGTLTLLEAMLTASVKKFVFSSTCATYGVPEFVPIPENHPQNPINPYGATKLMVERILSDFDVAYGFQSVRFRYFNAAGANPNGLLGEDHNPETHLIPLVLMTALGKRKSISIFGTDYPTPDGTCIRDYIHVNDLADAHILGLEYLLKGGDSEVFNLGNGSGFSVREVIAAAEQVTGTSIPVEEHDRRPGDPPILIGTSEKARTILGWQPQYPSIEDIVAHAWQWHQKRHK

SEQ ID NO: 65354 - DNA, 987 bp, Nostoc punctiforme PCC 73102
  CDS (1)..(987)
atgtcaactattttagtcacaggaggagccggatatattggctcccatgctgcattagctctgaaaaacgcaggttatgaagtaatcgttttggataatctgtcgaacggacatcgagaacttgtagaagaagttttacaggtaaaattgattgttggagatatgagcgatcgctctcttctcgatgacatattttcaactcacaacataactgcggttatgcatttcgctgcttacatcgcagtgggtgaatctgttaccgacccagccaaatattaccaaaataatgttgcaggcactctgacacttttagaagcaatgcttgctgcgtcagttaacaaatttattttttcttctacttgcgctctttatggtgtaccaaagttcgttccccttaccgaagaacatccgcaagatcccattagtccctacgctattagcaagtggatggtagaaagaattttatctgattttgatacagcctataatttaaagtctgtacgtttccgttactttaacgccgcaggtgctgaccctaataggttgttgggtgaagaccacgaacctgaaactcatctcataccgttagtactactaactgcttttgggaagcgtgaatctattttgattttcggtacagattaccctaccccagacggaacttgtatccgcgattatattcatgtgactgacttggcacaagcccatattttaggtttagaatatctactcaaaggtggagaaagcgaagtatttaatctaggaaatggcagtggtttttcagtcagagaagtaatagaaactgctaaagagataacaggcaaagaaattaaaatagaagaacgcgatcgcagaccaggtgaccctcctattttagttggcagcagcgacaaagcaactaaaatcttgggttggcatccagagtatcctaatttaaacgaaattattgcccatgcttggaaatggcatcaacaacgacataagtaa

SEQ ID NO: 65355 - protein, 328 aa, Nostoc punctiforme PCC 73102
MSTILVTGGAGYIGSHAALALKNAGYEVIVLDNLSNGHRELVEEVLQVKLIVGDMSDRSLLDDIFSTHNITAVMHFAAYIAVGESVTDPAKYYQNNVAGTLTLLEAMLAASVNKFIFSSTCALYGVPKFVPLTEEHPQDPISPYAISKWMVERILSDFDTAYNLKSVRFRYFNAAGADPNRLLGEDHEPETHLIPLVLLTAFGKRESILIFGTDYPTPDGTCIRDYIHVTDLAQAHILGLEYLLKGGESEVFNLGNGSGFSVREVIETAKEITGKEIKIEERDRRPGDPPILVGSSDKATKILGWHPEYPNLNEIIAHAWKWHQQRHK

SEQ ID NO: 65356 - DNA, 1017 bp, Haemophilus somnus 129PT
  CDS (1)..(1017)
atggcaatcttagttactggcggtgccggctatatcggttcgcatacggttgttgaattgttaaatcatcatgttgaaattgttgttttagataatttatcaaattcctcggaagtttctttacagcgagtacaacaaattaccggaaaaaatatcactttttatcaaggcgacattttagatcgaaaaatactacaacgcatattttcacaacataatattaaagcagttatccattttgccggattaaaagccgtgggagaaagcgtaaaaaaaccgttgcgttattatcaaaataatgtaattggttcgcttacgttactggaagaaatgctaaaagcaggcatatataacttagtttttagttcatcagcaactgtttatggagaccctgaaatcattccaattactgaaacttgtaaagttggcggaacgactaatccctatggtacatctaaatttatggtagaacgtattttacaagacgcagtgagtgcaaatccgcacttgagtgttgtcatacttcgctattttaatcctgtcggtgcgcatgaaagtggtttaattggtgaagatcctaatggtattccgaataatttattgccttatatcagtcaagtagcagtaggaaaattaccacagctttcagttttcggtagtgattatgatacacacgatggtacgggagtacgtgattatattcacgtagtggatcttgcaattggtcatttaaaagccttagagaaacaccaaaatgatccaggttgtcatatttataatctaggcacgggaattggatattccgttttggatatggtaaaagccttcgaaaaagcaaatgatattcaaattccttataagctagttgaacgccgtccaggggatatagcaacgtgttattccaatcctcaaaaagcattagaaaaattaggttggaaaactgagcgagatttaacacaaatgatgaaagacacgtggaattggcaaaaaaataatcctaatggttataaatcgtaa

SEQ ID NO: 65357 - protein, 338 aa, Haemophilus somnus 129PT
MAILVTGGAGYIGSHTVVELLNHHVEIVVLDNLSNSSEVSLQRVQQITGKNITFYQGDILDRKILQRIFSQHNIKAVIHFAGLKAVGESVKKPLRYYQNNVIGSLTLLEEMLKAGIYNLVFSSSATVYGDPEIIPITETCKVGGTTNPYGTSKFMVERILQDAVSANPHLSVVILRYFNPVGAHESGLIGEDPNGIPNNLLPYISQVAVGKLPQLSVFGSDYDTHDGTGVRDYIHVVDLAIGHLKALEKHQNDPGCHIYNLGTGIGYSVLDMVKAFEKANDIQIPYKLVERRPGDIATCYSNPQKALEKLGWKTERDLTQMMKDTWNWQKNNPNGYKS

SEQ ID NO: 65358 - DNA, 996 bp, Pseudomonas syringae pv. syringae B728a
  CDS (1)..(996)
atgacggtactggtgacaggtgctgcagggttcatcgggtttcatgtcgccaagcgtctgtgcgagctcggcgtagaggtcgtcggcatcgacaacctcaacgattactacagcgtcgagctcaaacaatcgcgcctggccctactccagcgcctgccaggtttcacgttccacaggctggacatcaccgatgccgaagggctgtccgcgctcttcgcgcaaaatggcttcgaacaggtcattcatctggcggctcaggccggtgtgcgttattcgcttgaacaaccgaatgtttacgcccaatccaatctggtcggctttatcaacgtgctcgaggcctgtcggcagtatcgaccggcgcacctgatctacgcgtcgagcagctcggtctacggcgccaatacgcgcatgccgtttcaggtcgaggatgcggtcgaccggccgctgtccctgtatgccgccaccaagcgcgccaacgaactcaccgcctacagctattgccacttgtacggcctgcgcgccacagggctgcgctttttcaccgtctacggcccctggggccggccggacatggcgctgttcaagttcaccaaagccatgctggccggccagcctgtggatatctacaaccacggcgaaatggcgcgggacttcacctacatcgacgacattgtcgaaagcatcctgcgcctgcgtctgctgccgcccgatgcggttggcagcgagccgccccatcaactcttcaacatcggacggggtcagcccgtcaagctgctggagttcgtcgattgcctggaggccgcgctaggcctgcgcgcggaacggcgctacctgcccttgcaagcgggcgacgtgctgcaaacctgggctgacgtcagtgcgctgagccaatggatcgactttcaaccacaggtctcggtcgacaccggcgtcagggccttcgtcgactggtatcgggagcactatcaggcccggatctgcgagccacttcaataa

SEQ ID NO: 65359 - protein, 331 aa, Pseudomonas syringae pv. syringae B728a
MTVLVTGAAGFIGFHVAKRLCELGVEVVGIDNLNDYYSVELKQSRLALLQRLPGFTFHRLDITDAEGLSALFAQNGFEQVIHLAAQAGVRYSLEQPNVYAQSNLVGFINVLEACRQYRPAHLIYASSSSVYGANTRMPFQVEDAVDRPLSLYAATKRANELTAYSYCHLYGLRATGLRFFTVYGPWGRPDMALFKFTKAMLAGQPVDIYNHGEMARDFTYIDDIVESILRLRLLPPDAVGSEPPHQLFNIGRGQPVKLLEFVDCLEAALGLRAERRYLPLQAGDVLQTWADVSALSQWIDFQPQVSVDTGVRAFVDWYREHYQARICEPLQ

SEQ ID NO: 65360 - DNA, 948 bp, Desulfovibrio desulfuricans G20
  CDS (1)..(948)
atggtctggaagctcaacaccatgggcatagacaatattctggtggtggataatctggccagtacggaaaaatggaagaatctcgtaaatctgcggtatgtcgattacatgcaccgcgatgcatttctcgatctgctgctggatgactgcctgccgtggaacgtgaagggcattgtgcatatgggcgcctgctcttccaccacggaacgcgacgctgattttctgatggagaacaactatcgctataccaaagccctgtgtgattttgccctgcagcatggcgcgcgttttatcaatgccagctcggcagccacctacggcgacggctcatgcgggtttgatgattccgtggaaaccatgcaccgcatcaagccgctgaacatgtacggctattccaaacagctgtttgacctgcgcgcccatgccgaaggcaagctggacagcatagccagcctgaaatttttcaatgtttacggtcccaacgaataccataaggacgatatgcgttcggtggtgtgtaaggctttttcacagataggttccgaaggggtcatgcgtcttttccgctcgtatcaccccgattatcccgacggcgggcagaagcgtgattttgtatacgtgaaagactgcgtggacgtgatgtggtggctgctggaaaatccttccgccaacgggctgttcaatatcggcaccggcaacgcccgtacgtggaacgatctggcgcgggcggtgttcagcgccatggacgtgcccgaacgcatcgaatacatcgatatgcccgagcagctgcgcggcaaataccagtattacacgcaggctcccgtgcagcggctggctgatgccggttgtccggtgacgttccgttcgctggaagacggtgttaaggattatgtgcagaattatcttgcagcggaagatccgtatctcgacccccgtgcaggggtatag

SEQ ID NO: 65361 - protein, 315 aa, Desulfovibrio desulfuricans G20
MVWKLNTMGIDNILVVDNLASTEKWKNLVNLRYVDYMHRDAFLDLLLDDCLPWNVKGIVHMGACSSTTERDADFLMENNYRYTKALCDFALQHGARFINASSAATYGDGSCGFDDSVETMHRIKPLNMYGYSKQLFDLRAHAEGKLDSIASLKFFNVYGPNEYHKDDMRSVVCKAFSQIGSEGVMRLFRSYHPDYPDGGQKRDFVYVKDCVDVMWWLLENPSANGLFNIGTGNARTWNDLARAVFSAMDVPERIEYIDMPEQLRGKYQYYTQAPVQRLADAGCPVTFRSLEDGVKDYVQNYLAAEDPYLDPRAGV

SEQ ID NO: 65362 - DNA, 984 bp, Desulfovibrio desulfuricans G20
  CDS (1)..(984)
atgcagcctcagaaggtgcttgtatgcggcggggccgggtatatcggttcacatatggtcagggcgcttatgcgtgccggacacctgcctgttgtttttgacaatctttccacaggacatcttgaatccatcgggcaggcggaatttgtgcgcggcgaccttttggatatgcaggccctgcggcgcgtgttcggtgaatactgctttgatgcggttatgcatttttctgccaaaagtctggtgggcgaatcggttgttcatcccgccctgtattataccaataatgtgacgggcacctgcaatctgctggaagccatgcgcgaaagcggcgttgggcggctggtgttttccagcacggcggccgtgtacggcgatccgcaggcacctgtcattgcagaagatcatccatgcttgccggtaaacccctacgggcggtccaagctcatggtggaaaccatgcttgccgaccatgcggccgcctatggcctgcgttctgtctctctgcggtacttcaatgcggcgggagctgacgaggacggcggcataggtgaggcgcattcgcccgaaacccatctgctgcccaacgtactgctggcggcattgggcagaaacgacggcctgaagatattcggcgatgattatacgacgccggacgggacgtgcgtacgcgactacatccatgtgacggacctgtgcagcgcgcatctggcggcgctggagtatatgacccttcatgccggtgccgcagtgttcaatctgggtaacggcaacggtttttccgtgcgcgaaattctggacgccgcctgccgtgtgacaggtgttgatattccctttaccgtggaaggacgcagggctggcgatcctcccatgctggtggccgatgctgcacgtgcccgtaccgcgctgggatggactcctgtttatacggatatagaccggatcattgaaaccgcatggcgctggcacagcgaccagcgttattga

SEQ ID NO: 65363 - protein, 327 aa, Desulfovibrio desulfuricans G20
MQPQKVLVCGGAGYIGSHMVRALMRAGHLPVVFDNLSTGHLESIGQAEFVRGDLLDMQALRRVFGEYCFDAVMHFSAKSLVGESVVHPALYYTNNVTGTCNLLEAMRESGVGRLVFSSTAAVYGDPQAPVIAEDHPCLPVNPYGRSKLMVETMLADHAAAYGLRSVSLRYFNAAGADEDGGIGEAHSPETHLLPNVLLAALGRNDGLKIFGDDYTTPDGTCVRDYIHVTDLCSAHLAALEYMTLHAGAAVFNLGNGNGFSVREILDAACRVTGVDIPFTVEGRRAGDPPMLVADAARARTALGWTPVYTDIDRIIETAWRWHSDQRY

SEQ ID NO: 65364 - DNA, 1017 bp, Haemophilus somnus 2336
  CDS (1)..(1017)
atggcaatcttagttaccggcggtgccggctatatcggttcgcatacggttgttgaattattgaatcatcattttgaaattgttgttttagataatttatcaaattcctcggaagtttctttacagcgagtacaacaaattaccggaaaaaatatcactttttatcaaggcgacattttagatcgagaaatactacagcgtattttttcaacacataaaattgaagcggtgatccattttgcaggattgaaagcggtaggagaaagcgtaaaaaaaccgttgcactattatcagaataatgtgaacggttcgattacgttactggaagaaatgctaaaagcaggcatatataacttagtttttagttcatcagcaactgtctatggagaccctgaaatcattccaattaccgaaacttgtaaagttggtggaacaactaatccttacggcacatctaaatttatggtagaacgtattttacaagacgcagtgagtgcaaatccgcacttgagtgttgtcatacttcgctattttaatcctgtcggtgcgcatgaaagtggtttaattggtgaagatcctaatggtattccaaataatttattgccttatatcagtcaagtagcagtaggaaaattaccacagctttcagttttcggtagtgattatgatacacacgatggtacaggtgtgcgtgattatattcatgtggtcgatcttgcaattgggcatctaaaagcactggagaaacaccaaaatgatccaggttgtcatatttataatctaggcacgggaattggatattccgttttggatatggtaaaagccttcgaaaaagcaaatgatattcaaattccttataagctagttgaacgccgcccaggggatatagcaacgtgttattccaatcctcaaaaagcattagaaaaattaggttggaaaactgagcgagatttaacacaaatgatgaaagatacgtggaattggcaaaaaaataatcctaatggttataaatcgtaa

SEQ ID NO: 65365 - protein, 338 aa, Haemophilus somnus 2336
MAILVTGGAGYIGSHTVVELLNHHFEIVVLDNLSNSSEVSLQRVQQITGKNITFYQGDILDREILQRIFSTHKIEAVIHFAGLKAVGESVKKPLHYYQNNVNGSITLLEEMLKAGIYNLVFSSSATVYGDPEIIPITETCKVGGTTNPYGTSKFMVERILQDAVSANPHLSVVILRYFNPVGAHESGLIGEDPNGIPNNLLPYISQVAVGKLPQLSVFGSDYDTHDGTGVRDYIHVVDLAIGHLKALEKHQNDPGCHIYNLGTGIGYSVLDMVKAFEKANDIQIPYKLVERRPGDIATCYSNPQKALEKLGWKTERDLTQMMKDTWNWQKNNPNGYKS

SEQ ID NO: 65366 - DNA, 927 bp, Actinobacillus pleuropneumoniae serovar 1 str. 4074
  CDS (1)..(927)
atgattatcgtaacaggcggctttggtatgatcggtagcaatatcgtcaaagcattaaatgaaatcggcagaaaagatattcttgttgtagataacttaaaaaacggcgaaaaattcgtaaatttagtagatttagatattgcggattattgtgataaagaagattttatcgcttcgatcattgccggcgatgatttcggcgagattgatgcggtattccacgaaggtgcttgctcagcaactaccgaatgggacggtaaatacttaatgcacaataactacgaatattcaaaagagttattacatttctgtttagatcaccaaattccgttcttctacgcatcaagtgcggcaacttacggcggtcgttcggataactttattgaagagcgtaaatttgaacagccgctcaatgcttacggctattcaaaattcctatttgacgaatatgtacgtcaagttttaccggaagcggattcgccggtatgcggttttaaatatttcaacgtgtacggcccgcgtgaacaacacaaaggctcaatggcaagcgtagcgttccacttaaacaatcaaatgttaaaaggtgaaaacccgaaattattcgagggatcagaaaccttcttacgtgatttcgtgtatgtggaagacgtagcgaaagtgaatatttgggcgtggcaaaacggtatttccggcatttataacctcggtaccggcaaagcggaatcattccaagcggtggcacaagcggtgatcgacttccacggcaaaggcgaaatcgaaaaaatcccattcccggatcatttaaaatctcgctaccaaaccttcacccaagcggatttaactaaactccgtgcagcaggctatacaggtacatttaaaaccgtagccgaaggtacgaaagaatatatggcgtggttaaatcgttaa

SEQ ID NO: 65367 - protein, 308 aa, Actinobacillus pleuropneumoniae serovar 1 str. 4074
MIIVTGGFGMIGSNIVKALNEIGRKDILVVDNLKNGEKFVNLVDLDIADYCDKEDFIASIIAGDDFGEIDAVFHEGACSATTEWDGKYLMHNNYEYSKELLHFCLDHQIPFFYASSAATYGGRSDNFIEERKFEQPLNAYGYSKFLFDEYVRQVLPEADSPVCGFKYFNVYGPREQHKGSMASVAFHLNNQMLKGENPKLFEGSETFLRDFVYVEDVAKVNIWAWQNGISGIYNLGTGKAESFQAVAQAVIDFHGKGEIEKIPFPDHLKSRYQTFTQADLTKLRAAGYTGTFKTVAEGTKEYMAWLNR

SEQ ID NO: 65368 - DNA, 993 bp, Pseudomonas aeruginosa UCBPP-PA14
  CDS (1)..(993)
atgagcatcatcgtcaccggcgccgccggcttcatcggcagcaatctgctgcaggcgctgaaccggcgcggcgagaccgacatcatcgcggtggacgatctcaccgacggcgagcagttccgcaacctggcggacgccgatatcgccgactacctggaccagaacgacttcctcgagcgttacgcccgcggcgacttcggcacggtccgcgcgctgttccaccagggtgcctgcgccagcaccctggaaagcaatggccgctacatgatggagaacaactaccgctacagttgccgcctgctggaaagcagcctggaactcggcgtgccgttcctctacgcctcgtcggcggcggtctacggagccggccggaccttccgcgaggcgcgccagtacgagcggccgctgaacgtctacggctattccaagttcctcttcgaccagcgtgtgcggcgggcgctgccgcaggcgcgcagccaggtggtcggcctgcgttacttcaacgtctacgggccgcgcgaggaacacaaggggcggatggcctcggtggcctaccactgctaccagcaattgcgccgcgacgggcgggtcgaactgttcggcgaacacggtggcttcccgcccggcggccacctgcgcgactttgtcgcggtggaggacgtggcgcgggtcaacctgcatttcttcgatcatccgcagcgttcgggaatcttcaacctcggcagcggccaggcgcggaccttcaacgaggtcgccctggcggtgatcaatagcgtccgcgccaatgccgaccagccgcccctgtcgctgcagcaggcggtggaaagcggcctgctcggctaccgcgagttccccgagtcgctgcgggcgcgctaccagagccacacctgcgccgacctggagctgctgcgcgaggcgggctaccgcgacgatttccagagcctggaagagggcgtcgccggctactgccgctggctggcgcgcagcgcctga

SEQ ID NO: 65369 - protein, 330 aa, Pseudomonas aeruginosa UCBPP-PA14
MSIIVTGAAGFIGSNLLQALNRRGETDIIAVDDLTDGEQFRNLADADIADYLDQNDFLERYARGDFGTVRALFHQGACASTLESNGRYMMENNYRYSCRLLESSLELGVPFLYASSAAVYGAGRTFREARQYERPLNVYGYSKFLFDQRVRRALPQARSQVVGLRYFNVYGPREEHKGRMASVAYHCYQQLRRDGRVELFGEHGGFPPGGHLRDFVAVEDVARVNLHFFDHPQRSGIFNLGSGQARTFNEVALAVINSVRANADQPPLSLQQAVESGLLGYREFPESLRARYQSHTCADLELLREAGYRDDFQSLEEGVAGYCRWLARSA

SEQ ID NO: 65370 - DNA, 1035 bp, Psychrobacter sp. 273-4
  CDS (1)..(1035)
atgatacagacacagacagtctatgaacaaattaagcaaacactggcaaatgagccaaaaacatggctcattacaggggttgcgggtttcataggatctaatctattagaaactttattattgctaaatcaaaaagtagtgggtttagataatttcgcgactgggtttcaacataatttagatgaagtccaaagcttagtgagcgcgcaacaatggcaaggctttacttttatagaaggtgatatacgtaacttagcagattgccaagcggcgtgtattggtatcgattatgtcttgcaccaagcagcgctaggttcggtcccacgctctatcgctgatcctattaatactaatgagactaatatttcaggctttttaaatatgctgaccgcagcacgtgatgcaaaggtcgctagctttacttatgcggctagtagctcaacgtatggtgatcatcctgcattacccaaggtcgaggatgccattggtaagcctttatcaccctatgcagtgactaaatatgtcaatgagctatatgccgatgtatttgctcgtacctatgacttcaatacgattggtctacgttatttcaatatatttggcaaacgccaaacgccagatggtgcttatgccgcagtgatacctaaatggacggcggctatgatagctggtgatgcggtctatatcaatggtgatggtgataccagtcgagactttaactttattgagaatgcggtacaagctaatattttgtcggcgactgctacggatgaagctaaaaacgaggtgtataacgtggcagtgggtggtcgtacaacgctcaatacactatttacggcgctacacgagaatctagccctcaatggggtgaattatactcaagaagcagtatatcgagattttagagcaggagatgtgcgtcatagtcaggctgatattagtaaaatacagaacgcattaggctatgcaccgcagtttgatattgttcagggtattgagaaagctatgccttggtatgttaagtttttaggttga

SEQ ID NO: 65371 - protein, 344 aa, Psychrobacter sp. 273-4
MIQTQTVYEQIKQTLANEPKTWLITGVAGFIGSNLLETLLLLNQKVVGLDNFATGFQHNLDEVQSLVSAQQWQGFTFIEGDIRNLADCQAACIGIDYVLHQAALGSVPRSIADPINTNETNISGFLNMLTAARDAKVASFTYAASSSTYGDHPALPKVEDAIGKPLSPYAVTKYVNELYADVFARTYDFNTIGLRYFNIFGKRQTPDGAYAAVIPKWTAAMIAGDAVYINGDGDTSRDFNFIENAVQANILSATATDEAKNEVYNVAVGGRTTLNTLFTALHENLALNGVNYTQEAVYRDFRAGDVRHSQADISKIQNALGYAPQFDIVQGIEKAMPWYVKFLG

SEQ ID NO: 65372 - DNA, 900 bp, Methanococcoides burtonii DSM 6242
  CDS (1)..(900)
atgaaacgaattcttattaccggaggagcaggacaggtaggaagttatcttgtggatcgatttcatgaagagaacgaagttaccattctcgacaattattcatccccaacaagaaaggacgtgcctgagggagtgtctgtgatcaaggccgacataagagatgatatttcagaacatatgagcaatacagatgtaataatccatactgctgcccagataagcgttgtaaggtcaatgaacgaacctttttttgatgcacagaacaatataatggggacattgaacctgcttgaagaagcacgtcatgcgaacattgaaaggttcgtgtatttcagttcggctgctacatacgggaacccgctgaaagtaccgataggtgaaacccacccacaggagccattatcaccatatggggcaagtaagcttgcaggagaaaaatattgcatcatgtataacaaagcatacggattgccaactacatgtataagaccttttaatatatacagccccagacaggatccatcaaatccatattccggagtgatctcgaagttcattgacaaggtatcaggaggagcatccccgactatatttggagatggagagcagaccagggacttcatatatgtacgggatatcgttgaccttgtggacctgatgatatccaaaagaacagccattggagaatcattcaatgcagctactggcagatcgaccaccatcaatgagcttgcagagataattatagatctattcggaaaagaactaaaggcagattataaggacccgctagaaggagatattaaacacagtgtagccgatatatcaaaggctgaaaagttaggatttgtcccgaaagtggatctaagaaaggggcttgagacctttttggagaaatga

SEQ ID NO: 65373 - protein, 299 aa, Methanococcoides burtonii DSM 6242
MKRILITGGAGQVGSYLVDRFHEENEVTILDNYSSPTRKDVPEGVSVIKADIRDDISEHMSNTDVIIHTAAQISVVRSMNEPFFDAQNNIMGTLNLLEEARHANIERFVYFSSAATYGNPLKVPIGETHPQEPLSPYGASKLAGEKYCIMYNKAYGLPTTCIRPFNIYSPRQDPSNPYSGVISKFIDKVSGGASPTIFGDGEQTRDFIYVRDIVDLVDLMISKRTAIGESFNAATGRSTTINELAEIIIDLFGKELKADYKDPLEGDIKHSVADISKAEKLGFVPKVDLRKGLETFLEK

SEQ ID NO: 65374 - DNA, 999 bp, Dechloromonas aromatica RCB
  CDS (1)..(999)
atgtacatcgtcgtcaccggcgccgccggctttatcggttccaacatcgtcaaggcacttaatgagcgtggtatcacgaacatcattgccgtcgataatctgaccaaggccgacaagttcaagaatctgatcgattgcgacatcgtcgactatctcgacaagaacgatttcatcgagcgcatccaggccggtcatttcgacggcgagatcgacgccatcctgcatgaaggggcttgttccgataccatggagacggatggccgttacatgatggagaacaactaccgttactcgatgattctgctcgattggtgtctggatcaggatgtccagttcctgtatgcatcgagcgcggcgacctatggttccagtggcaccttcaaggaagagcgccagtacgaaggcccgctcaacgtctatggctattccaaatttctgtttgaccagattgttcgccagcgtctggcccagaatccgtcatcgcaaatcgttggcttccgctatttcaacgtctacggcccgcgtgaaacgcacaagggaaggatggcttcggtggccttccacaacttcaaccagttccgcgctgacggcaaggtgaagctgttcgaaggctcgcacggttacccggatggtgaccagcagcgagatttcgtcttcgttggcgatgtggccaaggtcaatctgttcttcttggatcatccggaaaaatccggcattttcaatctggggtccggccgggcgcagagcttcaatgatgtcgccgtggcggcggtcaacggctgccgcaaggccaggagtgaaagtgcgttgtcgctggaagagttgcgggcacaaggcttgctggagtatgtcgccttccccgaggcgctgaagggcaagtatcaggcattcacgcaggccgatctgggcaaactgcgtgcagccggttacgacgcccctatggccacggttgaggagggcgtttcccaatatatcgagtggctccagcgcaatgtataa

SEQ ID NO: 65375 - protein, 332 aa, Dechloromonas aromatica RCB
MYIVVTGAAGFIGSNIVKALNERGITNIIAVDNLTKADKFKNLIDCDIVDYLDKNDFIERIQAGHFDGEIDAILHEGACSDTMETDGRYMMENNYRYSMILLDWCLDQDVQFLYASSAATYGSSGTFKEERQYEGPLNVYGYSKFLFDQIVRQRLAQNPSSQIVGFRYFNVYGPRETHKGRMASVAFHNFNQFRADGKVKLFEGSHGYPDGDQQRDFVFVGDVAKVNLFFLDHPEKSGIFNLGSGRAQSFNDVAVAAVNGCRKARSESALSLEELRAQGLLEYVAFPEALKGKYQAFTQADLGKLRAAGYDAPMATVEEGVSQYIEWLQRNV

SEQ ID NO: 65376 - DNA, 999 bp, Anabaena variabilis ATCC 29413
  CDS (1)..(999)
atgtcgcctggaaagcccagcatcttggtaacggggggagcaggatatattggttcgcacactgtcctggctctcaagcaagcaggttacgacgtggtaatactagataatttggtctatggacatcgtgatttagtagaaaaagttttacaagtagaattggtggtgggtgatacaggcgatcgctctttgttagatgagttatttaaatcccgtcattttgatgcagtgatgcacttttccgcttacgcttatgtaggcgaatctgttagtgatcctgccaagtactatcgcaataatgttttaggcacattaaccttattagaagcgatgctggctgcttcaattaataagtttgtcttttcttccacttgtgccacttatggagtgccaaaaagtgttcccattcccgaagatcatccccaagaccccatcaatccttatggtgcgactaagttaatggtggaaaggattttggcggatttcgatgtagcttatggtttgaaatcagtccgtttccgttactttaatgctgctggtgctaatcctgatggattgctaggtgaggatcacaaccccgaaactcatttaatccctctagtactactaacagctttaggtaaacgtaaatccatctctattttcggcactgattatcccacacccgatggcacttgtattcgggattatatccacgttaacgacttagccgatgcccacgttttgggattggaatatttgttaaaaggtggagatagcgaagtttttaacttgggtaatggccaaggtttctctgtcagagaagtaattgcagctggtgaacaagtcacaggattacccatagccgttgaagaatgcgatcgccgtcccggagatccccccagtctgattggtagtggtgagaaagccagaaaaatccttggctggcaaccaaattacccatcaatcaaagatattgttgcccatgcttggcaatggcatcagaagcggcatcaataa

SEQ ID NO: 65377 - protein, 332 aa, Anabaena variabilis ATCC 29413
MSPGKPSILVTGGAGYIGSHTVLALKQAGYDVVILDNLVYGHRDLVEKVLQVELVVGDTGDRSLLDELFKSRHFDAVMHFSAYAYVGESVSDPAKYYRNNVLGTLTLLEAMLAASINKFVFSSTCATYGVPKSVPIPEDHPQDPINPYGATKLMVERILADFDVAYGLKSVRFRYFNAAGANPDGLLGEDHNPETHLIPLVLLTALGKRKSISIFGTDYPTPDGTCIRDYIHVNDLADAHVLGLEYLLKGGDSEVFNLGNGQGFSVREVIAAGEQVTGLPIAVEECDRRPGDPPSLIGSGEKARKILGWQPNYPSIKDIVAHAWQWHQKRHQ

SEQ ID NO: 65378 - DNA, 951 bp, Anabaena variabilis ATCC 29413
  CDS (1)..(951)
atggcaaaaattatagttactggagcagcaggatttattggttcgcacctggtagaaaccctcctaaaacaaggtgaagaagtaatcgggattgatgaagtgaatgattactacgatcccttgttaaaacgtaaaaatatcgcctatttacaatcgtcgcctaacttcactttcattgaaggagatattcagtttctagattggccgtctctcctccaagatgtgactgtggtctaccatcaggcggcgcaggcgggagttagggcaagttggggtaaaggtttccgtgcttatactgagcgcaatattaatgcaacacaagttttgttggaagcagctaaggatgctcaacaattaactaggtttgtgtttgcatctacttctagtgtgtatggggatgcggaaaccttacctactcacgaaggaattcctcctcaaccggtttctccttatggaattactaagttagccgccgagcgtttgtgtggactgtatcacaaaaatttcggtgtgccgtttgtggctttacgttatttcactgtatatggccctagacagcgccctgatatggctttccataagttttttaaatcggttttacaggatgaagcgattcctgtttacggagatggacagcaaactcgtgactttacatttgtgagcgatgctgtagcggccaatttagcggctgctagtgtaccaactgctgtaggagaaatttttaatattggtggtggtagtagagtggttttggctgaggtcttagacacaatggaacaaattgttggtcagccaattaagagaaatcacatagaaaaggcaatgggtgatgcacgtcacacggctgctgatgtatctaaggcacggaaaattttaggatatgaaccacaggtttctttgagggagggtttgagcctagaatggcagtgggtgaaggctttgtacgcctag

SEQ ID NO: 65379 - protein, 316 aa, Anabaena variabilis ATCC 29413
MAKIIVTGAAGFIGSHLVETLLKQGEEVIGIDEVNDYYDPLLKRKNIAYLQSSPNFTFIEGDIQFLDWPSLLQDVTVVYHQAAQAGVRASWGKGFRAYTERNINATQVLLEAAKDAQQLTRFVFASTSSVYGDAETLPTHEGIPPQPVSPYGITKLAAERLCGLYHKNFGVPFVALRYFTVYGPRQRPDMAFHKFFKSVLQDEAIPVYGDGQQTRDFTFVSDAVAANLAAASVPTAVGEIFNIGGGSRVVLAEVLDTMEQIVGQPIKRNHIEKAMGDARHTAADVSKARKILGYEPQVSLREGLSLEWQWVKALYA

SEQ ID NO: 65380 - DNA, 1089 bp, Ralstonia eutropha JMP134
  CDS (1)..(1089)
atggaatccatcacctacgcgaatctgaggaccagtctggttgccaatccgtgcacgtggctggtcacaggagtggccggattcatcggcagcaatttgctggaggccttgctgcgcctgaaccagcgcgtggtcggcctggacaacttcttgaccggccaccgccgcaacctgcatgaagtgcaggcgctggtatctcccgcgcagtgggagaactttcaattcatcgaaggcgacatccgggaccttgaacagtgccggagcgccatgcgcttttgctccggggagcgcgaaggaacgcacggcgcgagcagccatccggtcgatttcgtgctgcaccaggccgcgctgggctccgtgccacgcagcctggaggaccccatcgcgacccacagcgtcaacatcagtggcttcctgaatatgctggtcgctgcgcgcgacgccgaggtacgcgctttcgtttacgcggcgagcagcagcacctacggcgatcaccccggcctgcccaagaccgaagacaggatcggcaagccattgagcccctacgcggtcacgaaatacgcgaacgagttgtatgccgacgtcttcaggcgctgctacagtttgcgtgccatcggactacgctacttcaatgtattcggtccacgccaggatccgaacggggcatacgcagccgtgattccgcggtggatttccgcgttgctgcggcgcgagaccgtctacatcaatggcgacggcgaaacgagccgcgacttctgttacgtggcgaatgctgtgcaggccaacctgcttgccgctctcagctgcagcggagacgcggaaagccagatctacaacgtcgccgtcggtgaccgcaccacgctgagtaccctgttccagcttctgcgcgacgggcttcgtccttatggcatccccgcggacacgcagccgacctatcgggccttccgtgcgggcgacgtgcgccacagccaggctgatatcggcaaggcacaacggttgctcggatatcagcccacccaccgcatcggtgacgggctggccgaggcaatgcactggtatgtgcagttgcaccggacgcaggacgcctga

SEQ ID NO: 65381 - protein, 362 aa, Ralstonia eutropha JMP134
MESITYANLRTSLVANPCTWLVTGVAGFIGSNLLEALLRLNQRVVGLDNFLTGHRRNLHEVQALVSPAQWENFQFIEGDIRDLEQCRSAMRFCSGEREGTHGASSHPVDFVLHQAALGSVPRSLEDPIATHSVNISGFLNMLVAARDAEVRAFVYAASSSTYGDHPGLPKTEDRIGKPLSPYAVTKYANELYADVFRRCYSLRAIGLRYFNVFGPRQDPNGAYAAVIPRWISALLRRETVYINGDGETSRDFCYVANAVQANLLAALSCSGDAESQIYNVAVGDRTTLSTLFQLLRDGLRPYGIPADTQPTYRAFRAGDVRHSQADIGKAQRLLGYQPTHRIGDGLAEAMHWYVQLHRTQDA

SEQ ID NO: 65382 - DNA, 996 bp, Ralstonia eutropha JMP134
  CDS (1)..(996)
atgaccatcatcgtcaccggcgctgcaggattcatcggcagcaacctcgtcaagggattgaacgcgcgcggcgagaaccacatcgtcgcggtcgacaatctgcaccgcgcggacaagttccacaatctggtggactgtgaaatccgcgactacctcgataaggacgatttcctgtcccggttcgagcggggcgagttcggccgggtacgcgctgttttccatcttggggcctgcaccgacacgatggagcaggacgggcgctacctgatggagaacaactatcgctacagcaagacgctgatggagctctgccttgcgcaggacacccagttcatctatgcctcgtctgcggcggtctacggcgagtcgcactcgtttcgcgaagcgcgcgagtacgagcggccgctgagcgtctacggctactccaagttcctgttcgaccaggccgtgcgcaacaggctcgatggcgcgctgtctcaagtggtcgggctgcgctatttcaacgtgtatggcccgggtgaggcgcacaaggcccgcatggcctcgatcgtgtgccagcagttcgagcaattccgtgccgaaggcaccgtcaagctgttcggcgagcacggcggccatgggccgggctgccagagccacgatttcgtttccatcgacgatgtggtcaaggtgaacctgttctttctcgatcatccgcgccgatcgggcatcttcaacgtcggttccggccatgcgcgctcattcaacgatgtcgcctgtgttgtcgtcaacaccctgcgcgcggcggaggacaagccgccgttggcccttgaggagctcgtgcaggaagggctgctggaatacttgcgattccccgatgcactgcgcgggcgctaccagagcttcacccaatcggacagttcgcgccttcgcgaagctggctacaccgctcctttcgttgcgatggaggaaggcgtggcacgctattgccagtggctgctcgaacgcggccagtga

SEQ ID NO: 65383 - protein, 331 aa, Ralstonia eutropha JMP134
MTIIVTGAAGFIGSNLVKGLNARGENHIVAVDNLHRADKFHNLVDCEIRDYLDKDDFLSRFERGEFGRVRAVFHLGACTDTMEQDGRYLMENNYRYSKTLMELCLAQDTQFIYASSAAVYGESHSFREAREYERPLSVYGYSKFLFDQAVRNRLDGALSQVVGLRYFNVYGPGEAHKARMASIVCQQFEQFRAEGTVKLFGEHGGHGPGCQSHDFVSIDDVVKVNLFFLDHPRRSGIFNVGSGHARSFNDVACVVVNTLRAAEDKPPLALEELVQEGLLEYLRFPDALRGRYQSFTQSDSSRLREAGYTAPFVAMEEGVARYCQWLLERGQ

SEQ ID NO: 65384 - DNA, 981 bp, Methylobacillus flagellatus KT
  CDS (1)..(981)
atgatagtcatcactggcggcgcaggcatgataggcagcatgatggcctggcatctcaataccgtgctgcaacgcgacgatatcgtgatcgtagaccgcattgcccaccctgagcaatggcaaaacctttgccatcgccgttatgccaattacctggacaaggacgagctgcttacctggctgcccaagatcggcaagatagatgccatcatccatatgggtgccatcagcgccaccacggaacgcgatttcaacaagctggtacaggacaatatccgctatagccaattgctgtggacgtggtgtgctgagaatgaggtgccattcctctacgcaagttccgctgcaacctatggcgggggtgagttcggctacgatgacgaagagtcggccatagaccagttgcgtcccctgaatggatatggctattcaaaacagtttttcgaccagtgggtattgcgccaatccagcgaagggctggcaacgccgccccagtggtgcgggttcaagttcttcaatgtatacggcccgaatgaatatcacaaggaacgcatggccagtgtcgcctttcacacgttcaatcaagtccgcgagcaaggcaatgtcaagctgttcaagagccacaagcccggcttcgaggatggcatgcaattgcgtgactttatctatgtgaaggatgcggttgccgtgatggcgcacttcctcgaacaaccccagcattccggcctgttcaatatcggtacgggtgaagcgcgcgccttcagagacctagccagcgcagtcatgatcagtatggggcgcgaacccagtattgaatacatcgacatgccacaggacctcatgggcaagtaccaatacttcacacaggccaatatcagcaagctacgcaatacaggctataccgctcccttccaaaccttggagcaaggcgtgcaggactatgtccagcaatacctgatgcaaacagacccttattgctga

SEQ ID NO: 65385 - protein, 326 aa, Methylobacillus flagellatus KT
MIVITGGAGMIGSMMAWHLNTVLQRDDIVIVDRIAHPEQWQNLCHRRYANYLDKDELLTWLPKIGKIDAIIHMGAISATTERDFNKLVQDNIRYSQLLWTWCAENEVPFLYASSAATYGGGEFGYDDEESAIDQLRPLNGYGYSKQFFDQWVLRQSSEGLATPPQWCGFKFFNVYGPNEYHKERMASVAFHTFNQVREQGNVKLFKSHKPGFEDGMQLRDFIYVKDAVAVMAHFLEQPQHSGLFNIGTGEARAFRDLASAVMISMGREPSIEYIDMPQDLMGKYQYFTQANISKLRNTGYTAPFQTLEQGVQDYVQQYLMQTDPYC

SEQ ID NO: 65386 - DNA, 981 bp, Crocosphaera watsonii WH 8501
  CDS (1)..(981)
atgaaaaacatattagtaacaggtgctgcaggatttattggtttttatgtctgccaagatattctcaataaaggagataatattttcggaattgataatcttaataattattatgatgtaaatcttaaaaaacatcgtcttcagcaattgaaaaactatgataaattctcattttatcagattaatattgctaatacaaatgacctggttaaattgtttaataataataattttgactatgttatacacctagctgctcaagctggtgttcgttattccttagaaaatccttatgcttacgttgatagtaacttagtgggttttgtcaatattcttgaaggatgccgtcatagtaaaataaaacatctagtatatgcttcatctagttcagtttatggggcgaataaaaaaatacctttttcaactaaggataatgtcgattttcccatcagtttatatgctgccacaaaaaaagcaaacgaattaatggcttatacttacagtcatctttatcaaataccaacaacaggattgcgttttttcacagtttatgggccatggggtcgcccagacatggcttatttcttatttacaaaagctataatggagggaagccctatcaaagtgtttaatcatggcaaaatgaagcgagattttacctacatcgatgatattgtcgaaggaattgtaagagtgagcgacaagatccctcaaggctcagaattgaataataatgtcccagcaaaagtctataatatagggaataatcaacctgttcaactaatgacttttatagaagtgctagaaaagtgtatcgggaagaaagctattaaagaatttttaccgatgcaaccaggggatgtaccgatgacttatgctgatatcgatgatttaattaaagatgttggctttagtccccgtacttctatcgaagagggactagataaatttgttaaatggtataattcctattacagttga

SEQ ID NO: 65387 - protein, 326 aa, Crocosphaera watsonii WH 8501
MKNILVTGAAGFIGFYVCQDILNKGDNIFGIDNLNNYYDVNLKKHRLQQLKNYDKFSFYQINIANTNDLVKLFNNNNFDYVIHLAAQAGVRYSLENPYAYVDSNLVGFVNILEGCRHSKIKHLVYASSSSVYGANKKIPFSTKDNVDFPISLYAATKKANELMAYTYSHLYQIPTTGLRFFTVYGPWGRPDMAYFLFTKAIMEGSPIKVFNHGKMKRDFTYIDDIVEGIVRVSDKIPQGSELNNNVPAKVYNIGNNQPVQLMTFIEVLEKCIGKKAIKEFLPMQPGDVPMTYADIDDLIKDVGFSPRTSIEEGLDKFVKWYNSYYS

SEQ ID NO: 65388 - DNA, 1005 bp, Crocosphaera watsonii WH 8501
  CDS (1)..(1005)
atgtccgatagcaaacccaccattttagtcacaggaggagccggatatatcggttcccatgctgttctatctttacaaaaagctggttataacgtcattgtctatgataacctttcctatggtcacccagaaattgtccaagatgttttaaaggttgaattaattgttggtgatacgaatgatcgcactctactagaccaaatattttctagtagaaatatcactgctgtcatgcactttgcggcttttattgctgtgggagaatcggttagagatcctgctatttattatcaaaataatgttgccggaaccttaactttattagaggcaatgatagctgctaatatcaagaagtttgttttttcttctacctgtgctatttatggtatgccccaagaaattcccatgacggaaaagcatcccaataaccctttaaatgcttatgcttctagtaaatatatggtggaacaaatcctcaaagattttgatcgagcttatggtttaaaatctgttgtgttccgctattttaacgcatcaggggctgatccttctggtaatttaggggaagatcatgatccagaaacccatttaattcctctcgctttattaactgctttgaaaaaaagagagcatctcttcatttttggcacagattatgaaacccctgatgggactgctgttagagactatattcatgttaatgatttagcatcggctcacgttttgggtttagactatcttttcaatggaggggaaagtgaaatgtttaatctgggtaacggtaacagattttctgtcagagaagttattgaaatggctaagaaagtaacaggggttgattttttggtgaaagaaaccgatcgccgtcctggagatgcaccaatcttagtaggaagcagcgaaaaagcaaaatctatcttaggctggcagcctcaatattttgagcttaaaactattgtcaatgatgcttggcaatggcataaaaagcgtcatggatactcataa

SEQ ID NO: 65389 - protein, 334 aa, Crocosphaera watsonii WH 8501
MSDSKPTILVTGGAGYIGSHAVLSLQKAGYNVIVYDNLSYGHPEIVQDVLKVELIVGDTNDRTLLDQIFSSRNITAVMHFAAFIAVGESVRDPAIYYQNNVAGTLTLLEAMIAANIKKFVFSSTCAIYGMPQEIPMTEKHPNNPLNAYASSKYMVEQILKDFDRAYGLKSVVFRYFNASGADPSGNLGEDHDPETHLIPLALLTALKKREHLFIFGTDYETPDGTAVRDYIHVNDLASAHVLGLDYLFNGGESEMFNLGNGNRFSVREVIEMAKKVTGVDFLVKETDRRPGDAPILVGSSEKAKSILGWQPQYFELKTIVNDAWQWHKKRHGYS

SEQ ID NO: 65390 - DNA, 921 bp, Exiguobacterium sp. 255-15
  CDS (1)..(921)
atgcaaatcggaattacaggaggagccggctttatcggggcggcgcttgcactacggcttcaagcaagcggtcacaccgtccatgtcatcgatgcgtttaccgactattatgatgtcgaattgaagctgacaagggcaaaacagttacaggctaacggaattgacgtctttgacggcaacgtccacgaagatttggcaacgtggtgtgccaaccactcgtttgccgccctgtttcatttagcagcattgccgggtgtcccgggttctttaactgaaccccatcgctatatcgaggatgatatcgcgatgacggtgaccgttctcgaagcagcccggacacacggtattccgcatgtattttttgcttcctcttcttccgtttacggcgaacagaccggtgccctactggagcagcaagcgacaggaaatgtgatgagtccttacgcggcagctaagtacagcgcggaaacgttttgccggacgtatcacaacctgtatgacatgaacgtgacgatttttcgcttttttacggtatacggtccttccggccggccggatatggcgttgttccgtttcatcgaacaggcgctggacggtcaaccgctgaccgtgttcggtgatccggttcgcgacttcacctatatcgacgacatcacccgcggaatggaacaggctctcgaagcaaaagcgacgggcatcttcaatctcggtgccaaccgcccggaatccgtccgtgatcttgccgcgatgctcagtgaacggttcaatgtccctgtccgttcggctcccgctcggataggtgacgtctcgatgacttggagtaacaccgatgcggcccggcagacgttcggttacgttccttcctttacgctcgctgatggaatcgaacagatgatcagatggcatctcgagcgtcggtga

SEQ ID NO: 65391 - protein, 306 aa, Exiguobacterium sp. 255-15
MQIGITGGAGFIGAALALRLQASGHTVHVIDAFTDYYDVELKLTRAKQLQANGIDVFDGNVHEDLATWCANHSFAALFHLAALPGVPGSLTEPHRYIEDDIAMTVTVLEAARTHGIPHVFFASSSSVYGEQTGALLEQQATGNVMSPYAAAKYSAETFCRTYHNLYDMNVTIFRFFTVYGPSGRPDMALFRFIEQALDGQPLTVFGDPVRDFTYIDDITRGMEQALEAKATGIFNLGANRPESVRDLAAMLSERFNVPVRSAPARIGDVSMTWSNTDAARQTFGYVPSFTLADGIEQMIRWHLERR

SEQ ID NO: 65392 - DNA, 999 bp, Exiguobacterium sp. 255-15
  CDS (1)..(999)
atggcagtactcgtagtaggtggagcaggatatataggatcacacgcagtctatcaactggtcgatgccggacaagatgttgttgtcatcgatcatttaaaatcgggacaccgggaagcggttcatccgaaagcccgtttttacgaaggggatattcgggatcgtgctttccttgacacggtgtttgagaaggaaacaatcgatcaggtcgtacattttgcggccttttcgttagtcggcgaatcgatggagcacccgctcgcttattttgataacaatgtctacggcacacaagtgttgctcgaagccatgatggcacatgacgtgaagcaaatcgtcttctcgtcgacagctgcgacatacggtgaacaggaacagatgccgattcttgagacggccacgacgaatccgacgaatgcttacggtgaaacgaagctgatgatggagaagatgatgcgttggtgtgaaacggcatatggtctgaactatgtcgcgctccgctactttaatgttgccggagcacgcgcaacgggtgaaatcggagaagatcatacaccggaaacccacctggttccgcttgtcctcgaagtcgccaacgggcagcggccggtgatttcgatttacggcgatgattatgcgacggaagatagcacgtgtatccgtgactatatccatgtcgaggatttaatcgatgcccacctgttggcactggaatatttaaaacaaggcaacacgagtgacgtctttaatctcggttcaagccgcggcttttcagtccgggaaatcattgaagcggcacgccgtgtaacgggacatgcgattccggaacaggttgtcgcacgacgcgccggagacccgagtacattgattgcgggatctgataaagcgaaaaaggttctcggctggacaccgcgccggacagaaatcgacaccatcattcaagatgcatggcgttggcatgaacagcgtccgcaaggctacaaaacacctgtacggtaa

SEQ ID NO: 65393 - protein, 332 aa, Exiguobacterium sp. 255-15
MAVLVVGGAGYIGSHAVYQLVDAGQDVVVIDHLKSGHREAVHPKARFYEGDIRDRAFLDTVFEKETIDQVVHFAAFSLVGESMEHPLAYFDNNVYGTQVLLEAMMAHDVKQIVFSSTAATYGEQEQMPILETATTNPTNAYGETKLMMEKMMRWCETAYGLNYVALRYFNVAGARATGEIGEDHTPETHLVPLVLEVANGQRPVISIYGDDYATEDSTCIRDYIHVEDLIDAHLLALEYLKQGNTSDVFNLGSSRGFSVREIIEAARRVTGHAIPEQVVARRAGDPSTLIAGSDKAKKVLGWTPRRTEIDTIIQDAWRWHEQRPQGYKTPVR

SEQ ID NO: 65394 - DNA, 921 bp, Rubrobacter xylanophilus DSM 9941
  CDS (1)..(921)
atgagggtactggtgaccggcggcgcagggtttatcggctcccacgtggccgagcagctcctctcgcgcggccacgaggtggccgtgctggacaacctctccaccggcaaacgcgagaacgtcccccccggcgcccgcttctacgaggcggacgtccgcgacggctgcgccggggtcttcgaggacttccgccccgaggccgtctcccaccaggcggcccagatggacgtgcgccgctcggtcgccgagccggacttcgacgccgaggtgaacgtgatcgggacggtccggctccttgaggcctgcgtccggggcggggtgcgccgggtggtcttcgcctccaccggcggggcgatctacggcgagcaggaggagttccccgccaccgagcggcacccgcagtacccgatctcgccctacggcgtctcgaagctggccggcgagcgctacctgcactactacaacgcccagtacgggctgccctacgcggccctgcgctactcgaacgtctacggtccccggcaggacccccacggggaggcgggggtggtggcgatcttctgcggccgcctggccgccggggagcgggccaccataaacggcaccggggagcagacccgcgactacgtctacgtgggcgacgtggcccgggcgaacgtgctcgccctggagaacgagctcccccccggcgcctacaacatcggcaccggggtcgagaccagcgtgaacgagctctacgagcggctgcggcggctctcgggccgggacgacctggaccccgagcacgggcccgccaagcccggtgagcagcagcgcagctgcgtggacccctccctggccgggcgggtgatgggctggcgcccggaggtgggcctggacgccggcctcaaggagaccctgcgcttcttcgggggcctgtag

SEQ ID NO: 65395 - protein, 306 aa, Rubrobacter xylanophilus DSM 9941
MRVLVTGGAGFIGSHVAEQLLSRGHEVAVLDNLSTGKRENVPPGARFYEADVRDGCAGVFEDFRPEAVSHQAAQMDVRRSVAEPDFDAEVNVIGTVRLLEACVRGGVRRVVFASTGGAIYGEQEEFPATERHPQYPISPYGVSKLAGERYLHYYNAQYGLPYAALRYSNVYGPRQDPHGEAGVVAIFCGRLAAGERATINGTGEQTRDYVYVGDVARANVLALENELPPGAYNIGTGVETSVNELYERLRRLSGRDDLDPEHGPAKPGEQQRSCVDPSLAGRVMGWRPEVGLDAGLKETLRFFGGL

SEQ ID NO: 65396 - DNA, 990 bp, Mesorhizobium sp. BNC1
  CDS (1)..(990)
atgacggttctggtaacgggcggcgccggctatatcggcagccacatggtatgggaactgctggaccatggcgaagaggtggtggtgctcgaccggctctccaccggtttcgattgggctgtgcccgaagccgccgaactcgtcgtgggcgatatcggcgaccaggcgctgctggaagaaacgataaagcgccgcaacgtggatgcggtgatccatttcgcgggctcgatcatcgtgccggaatccgtggccgatccgctgggctattacctcaacaataccgtcaagtcgcgggctctcatcgaaagcgccgtccggtgcggcgtcaagcatttcatcttttcctcgactgcggcggtctacggcacgccgcgaaagaacccggtcaccgaggacgaacccttgctgccggaatcgccttacggcacatccaagctgatgacggagatcatgctgcgcgatacggcggcggcccatgatttcgcctatacggctttgcgctacttcaacgtctcgggagcggacccgaagcgccggacgggacagtccacgaagggagcaacccatctcatcaaggtggcctgcgagaccgccacggggaagcgggcctccatggaggtattcggtaccgattatcccacgcctgacggcacctgcgtgcgcgattacatccatgtctcggatctggtgaacgcacactatctggcgctgcagcgcctgcggagcggaggcggcagcctggttgccaattgcggctatggcaggggttattccgtgcttgaggtcattgatgcggtgaagcaggtttccggcaaggacttcaaggtggtcgagagcggcaggcggcccggcgatgccgtcgccattgtggcgagcgcggagcgctgcttcgccgaactcggctggcgtcccgagcacgacgatctccgggagatcgtcagcgacgctctccgttgggaagagatcctggctaagcgcaaccgggtgtga

SEQ ID NO: 65397 - protein, 329 aa, Mesorhizobium sp. BNC1
MTVLVTGGAGYIGSHMVWELLDHGEEVVVLDRLSTGFDWAVPEAAELVVGDIGDQALLEETIKRRNVDAVIHFAGSIIVPESVADPLGYYLNNTVKSRALIESAVRCGVKHFIFSSTAAVYGTPRKNPVTEDEPLLPESPYGTSKLMTEIMLRDTAAAHDFAYTALRYFNVSGADPKRRTGQSTKGATHLIKVACETATGKRASMEVFGTDYPTPDGTCVRDYIHVSDLVNAHYLALQRLRSGGGSLVANCGYGRGYSVLEVIDAVKQVSGKDFKVVESGRRPGDAVAIVASAERCFAELGWRPEHDDLREIVSDALRWEEILAKRNRV

SEQ ID NO: 65398 - DNA, 903 bp, Rubrobacter xylanophilus DSM 9941
  CDS (1)..(903)
atggaccggctgctggccgagggctgcgaggtggtgggggtggacgctttcacccgctactacccgcgggagcggaagctgcgcaatctgtcctcggcggcggagagcggccgcttccggctggtggagggggaccttctggagctggacctcgggctgctgctgcgcggggtggaggccgtggcccacctggcgggcgagcccggggtccgcagcagctggggggcgggcttcgaggtctacctgcggcgcaacgtgctctgcaccgagcggctgctcgaggcggtctggagggccgggacgccgcgctttgtgctcgcctcctcctcctcggtctacggccccgacggcggcaggcccgtcgcggaggaccatcccctgcggcccgcctccccctacgggctctccaagctctccgccgaagagctcgtccggctctacgcccgcgagcggggggtgcgggggacggtgctccgctacttcaccgtctacggcccccgccagcggcccgagatggccctctcgcggtttatcgcggcggcgcacgccgggcggccggtggaggtcttcggcgacggggggcaggtcagggacatgacctacgtctcggacgcggtcgaggccaccgtggcggcgctggagcggggggcggggggcgcgtacaacgtcggcgggggggtgcgggtctcagtgcgggggatgctcgaggccgtccgggaggtgacggggcggccggtggaggcggtctacggcgaggccgcggcgggggacgtgcgctccacctgggccgactcccggcgggcggagcgcgagctcggctaccgtccgcgggtggggcttctggagggggtggccgcgcaggccgagtgggcggcccgggaggccctggcggccaccgcctga

SEQ ID NO: 65399 - protein, 300 aa, Rubrobacter xylanophilus DSM 9941
MDRLLAEGCEVVGVDAFTRYYPRERKLRNLSSAAESGRFRLVEGDLLELDLGLLLRGVEAVAHLAGEPGVRSSWGAGFEVYLRRNVLCTERLLEAVWRAGTPRFVLASSSSVYGPDGGRPVAEDHPLRPASPYGLSKLSAEELVRLYARERGVRGTVLRYFTVYGPRQRPEMALSRFIAAAHAGRPVEVFGDGGQVRDMTYVSDAVEATVAALERGAGGAYNVGGGVRVSVRGMLEAVREVTGRPVEAVYGEAAAGDVRSTWADSRRAERELGYRPRVGLLEGVAAQAEWAAREALAATA

SEQ ID NO: 65400 - DNA, 990 bp, Crocosphaera watsonii WH 8501
  CDS (1)..(990)
atgaaacattgcttagttacaggagcatccggttttattggcagtcacctgtgcgatcgtcttttggacttaggctaccaagtgacgggattagacagtttaattgtcggcaatccaaaaaacctagaaagtgccaaaactaacccacaattttccttccttcatcaagatgtagcagatttaaccccacaaaccttagaaaacatcgattggatttttcatttagccggactagctgacttagttccctcaatccaaaacccagaaaactattatcattccaatgttcacggcacttttgccctactcaatgcttgtcgtcaagcgaacattaaacgttttgtttataccgcttcgtctacctgttacggcattcctgacacctaccctaccccagaaacttatccctgttcccctgaacacccctatgccttaaccaaatatctcggggaacaattggtcatgcactgggctaaagtttataagcttccggctctgtccttacgcctatttaacgtctatggccctcgttctcgtaccactggagcttacggagccgtatttggggtatttttaaagcaaaaactcgctggtaaaccttttactgtcgttggggatggtaagcaaacccgtgattttaccttcgtgagtgatgtggttgaagcgtttgtcaaagcaggccaatctgacgttactaatgagattattaatgtgtgttcaggtcaaccccaaagtgtcctaagattggtcgagttactcggcggtgagatcacctatattccaaaaagaccaggggaacccgactgtacttggggagatattactaaagctaaaaccttattaggatgggaaccccaggtttcctttgccaatggcgttgcccaaatgttagaccatattgaattatggcgagaagctcccttgtggacaccagactccatcaacgaagcgacgaaggaatggtttgaatatttggggaaacagccataa

SEQ ID NO: 65401 - protein, 329 aa, Crocosphaera watsonii WH 8501
MKHCLVTGASGFIGSHLCDRLLDLGYQVTGLDSLIVGNPKNLESAKTNPQFSFLHQDVADLTPQTLENIDWIFHLAGLADLVPSIQNPENYYHSNVHGTFALLNACRQANIKRFVYTASSTCYGIPDTYPTPETYPCSPEHPYALTKYLGEQLVMHWAKVYKLPALSLRLFNVYGPRSRTTGAYGAVFGVFLKQKLAGKPFTVVGDGKQTRDFTFVSDVVEAFVKAGQSDVTNEIINVCSGQPQSVLRLVELLGGEITYIPKRPGEPDCTWGDITKAKTLLGWEPQVSFANGVAQMLDHIELWREAPLWTPDSINEATKEWFEYLGKQP

SEQ ID NO: 65402 - DNA, 1032 bp, Psychrobacter sp. 273-4
  CDS (1)..(1032)
atgaagcataaaattttagtcactggcggcgcaggatatatcggttcacatacttgtattgcactgcatgaagcaggctatgatgtcgtgatatatgacaatttatctaatagtagtcgtgaagcggtaaatcgcgtctctagccttattggacagcctatcgaatttatcgaaggtgatgttcgaaatactgagtcactcagacaagtatttgccgcgcagccattttttggcgtgattcactttgccggtctaaaagcggttggcgaatctgttgctaaaccactgatgtattatgataataatgtgagtggaacgattaacttacttgaaatcatgaaagagcatgacgttaaaaactttgttttttcttcatcagctacggtctatggcgatcctgaaacgctaccgattgatgaacgctcgaaacgctcttgtaccaatccttatgggcaaagtaagcttaccgttgagcatatcttggaagatttggcagcatcagataagagctggagtcttattcctttgagatactttaatcctgtcggggcacattcgtcagggagtattggtgaagatcctaatgatattccgaataatctaatgccttatatctctcaagtcgctgttggtaagcttgataagttaagcatttttggcaatgactatgctaccgtcgatggcactggggtacgtgattttattcatgtgactgacttggctgaagggcatgtagccgcgctcaattatttaaagcagcaaccccaaagtttgggttttttacctatcaatttagggacaggaaagggcacttcggtcttagagttgctcagagcgttttctgttgtatcgggtcagaatattccttttcaatttgttgatcgccgagcgggtgatatcgccagttgctatgccagtgctgataaagcaagagagctattaggatggcaagcaaccctttctatcacagatatgtgtcaagatacatggcgttggcaaagtatgaatccaaatggttataatctagtataa

SEQ ID NO: 65403 - protein, 343 aa, Psychrobacter sp. 273-4
MKHKILVTGGAGYIGSHTCIALHEAGYDVVIYDNLSNSSREAVNRVSSLIGQPIEFIEGDVRNTESLRQVFAAQPFFGVIHFAGLKAVGESVAKPLMYYDNNVSGTINLLEIMKEHDVKNFVFSSSATVYGDPETLPIDERSKRSCTNPYGQSKLTVEHILEDLAASDKSWSLIPLRYFNPVGAHSSGSIGEDPNDIPNNLMPYISQVAVGKLDKLSIFGNDYATVDGTGVRDFIHVTDLAEGHVAALNYLKQQPQSLGFLPINLGTGKGTSVLELLRAFSVVSGQNIPFQFVDRRAGDIASCYASADKARELLGWQATLSITDMCQDTWRWQSMNPNGYNLV

SEQ ID NO: 65404 - DNA, 891 bp, Methanococcoides burtonii DSM 6242
  CDS (1)..(891)
atgaacaatgatagcattgcaattacaggaagtagaggctttatagggactcggcttaccgcccaacttcgtttaaagggcttggacctgcttgagatctcacactcgttagattcgatcgatattactaattgggaacaagtgaagacgataccaaaaagggatgtgcttgttcaccttgccgggatgacaaatataccggaatcctttaaccatccacgagatgtttacacgataaatacattcggcacattgaatatgcttgagtggtgccgtttgaacgatgtaaagagatttatctatgccagtacttttgtttacgggaacccacaatacacacctgttgatgaaaagcatccaactctaccgaataacccatactcccagagcaaactgataggagaagagctttgcaacgcttattgcagggattatggtatcgatgtcatatcgttgcgtttattcaatgtctatggaccccaccagaaaggagattatctgatcccacatataatacgtcaactcgaatcaggaaaagtgtcactgaaagaccctttgcctaaaagggattttgtgtatattgacgatgttatagattcctttgaatgtgcattggatagtggtcttggtggatgcaatgtatttaatattgcaaacgggaagagcaattctgtaagagagatagcagatatgcttgcagagacttatttttttgagaaaggtcaaagagctgatattgattatacatgtgagaagcggcaaagtgaagtttccgacactattgcaaatatagaaaaagcaaagaatataatcaagtgggaaccgaaaacggatattaagaccggacttgcacaaaccttaaggacgtatctgaatgagtataaaaaataa

SEQ ID NO: 65405 - protein, 296 aa, Methanococcoides burtonii DSM 6242
MNNDSIAITGSRGFIGTRLTAQLRLKGLDLLEISHSLDSIDITNWEQVKTIPKRDVLVHLAGMTNIPESFNHPRDVYTINTFGTLNMLEWCRLNDVKRFIYASTFVYGNPQYTPVDEKHPTLPNNPYSQSKLIGEELCNAYCRDYGIDVISLRLFNVYGPHQKGDYLIPHIIRQLESGKVSLKDPLPKRDFVYIDDVIDSFECALDSGLGGCNVFNIANGKSNSVREIADMLAETYFFEKGQRADIDYTCEKRQSEVSDTIANIEKAKNIIKWEPKTDIKTGLAQTLRTYLNEYKK

SEQ ID NO: 65406 - DNA, 930 bp, Pseudomonas aeruginosa UCBPP-PA14
  CDS (1)..(930)
atgtttgaacgccccatcctgatcactggcggcgccggtttcatcggctcccacctgaccgacgcgctgctggcgcgcggctaccgcgtgcgtgtgctggacaacctgtccaccggcaagcgcgacaacctgcccctggacgacgaacgggtagagctgctcgaaggcgacgccgccgacgcggcgaccctggcggccgccctgaagggctgcgcggcggtcgcccacctggccgcggtcgcctcggtacaggcctcggtggacgacccggtcgccacccaccagagcaatttcatcgccaccctgaacctctgcgaagcgatgcgcgagcagggcgtgaagcgcgtggtgttcgcttccagcgcagcggtctacgggcagaacggcgaaggcacggcgatcgacgaagacaccccgaagtcgccgctgacgccctacgcgtcggacaagctggccagcgagtactacctcgatttctatcgccgccagcatgggctggaaccggcgatcttccgcttcttcaacgtctacgggccgcgccaggacccgtcctcgccctattccggggtgatcagcatattcaccgagcgcgccctgaaggggacgccgatcaccgtgttcggcgacggcgagcagacccgcgacttcatctacgtcgccgacctggtcgatttcctggtccaggcgctggaggcgacggcggtggagcccggggcggtgaacgtcggcctgaatcgcagcatcagcctgaagcagttgctggcggagatcggccaggtgctcggtggcctgccgccggtgacccacgccgacgcgcgagccggtgacatcaggcattcgcgggcgaacaacgagcgcctgctgcggcgtttctgcttcgaccagccgacgccgatgggcgtgggcctggcgcgcctgctcggccgctga

SEQ ID NO: 65407 - protein, 309 aa, Pseudomonas aeruginosa UCBPP-PA14
MFERPILITGGAGFIGSHLTDALLARGYRVRVLDNLSTGKRDNLPLDDERVELLEGDAADAATLAAALKGCAAVAHLAAVASVQASVDDPVATHQSNFIATLNLCEAMREQGVKRVVFASSAAVYGQNGEGTAIDEDTPKSPLTPYASDKLASEYYLDFYRRQHGLEPAIFRFFNVYGPRQDPSSPYSGVISIFTERALKGTPITVFGDGEQTRDFIYVADLVDFLVQALEATAVEPGAVNVGLNRSISLKQLLAEIGQVLGGLPPVTHADARAGDIRHSRANNERLLRRFCFDQPTPMGVGLARLLGR

SEQ ID NO: 65408 - DNA, 930 bp, Pseudomonas syringae pv. syringae B728a
  CDS (1)..(930)
atgtctgacgctcctgttctgatcactggaggtgcgggtttcatcggctcgcacctgaccgacgcattgcttgccagcgggcaggccgtgcgtatcctcgacaacctctcggcaggcaagcgcagcaatttgccgctcgacaatccgcgggtcgagctgatcgaaggagacgtggccgatgccgacctggtcaagcgcgcggcgcagggctgtaaagccgtcgtgcacctggcggcagtggcttcggtgcaggcgtcggtagacgacccggtgcgcacccaccagagcaacttcatcggtacgttgaatgtctgcgaggccatgcgcgaagcgggcatcaagcgcgtgatcttcgcatcaagcgcggcggtgtacggcaacaacggtgagggcgaagcgatcaccgaggacaccaccaaggcaccgctgaccccttacgcttcggacaagctggccagcgagtattacctggatttctaccgtcgccagcatggcctggaaccggtgatctttcgcttcttcaacattttcgggccacgccaggacccatcgtcgccgtactccggcgtgatcagcatctttgccgagcgtatccgcaaaggcctgccgatcagcgtgtttggcgacggcgagcagacgcgggatttctactatgtcggggatctgctcaagctgctgctgcaggccttgtcacgggaaagcgccatcgaaggcgcgatcaacgtcggcctgaacaagaccacgtcgctcaacgaactgctggctgcgcttgcgcaggtggtcggcaagcagccggaagtcacctaccaggcgccgcgctcgggcgatatcaaacattcccgcgccagcaaccagcgcctgctggaacacttcaccctcgacgagccaacgccgctggtgcgtgggctggagttgctgatggggcagtga

SEQ ID NO: 65409 - protein, 309 aa, Pseudomonas syringae pv. syringae B728a
MSDAPVLITGGAGFIGSHLTDALLASGQAVRILDNLSAGKRSNLPLDNPRVELIEGDVADADLVKRAAQGCKAVVHLAAVASVQASVDDPVRTHQSNFIGTLNVCEAMREAGIKRVIFASSAAVYGNNGEGEAITEDTTKAPLTPYASDKLASEYYLDFYRRQHGLEPVIFRFFNIFGPRQDPSSPYSGVISIFAERIRKGLPISVFGDGEQTRDFYYVGDLLKLLLQALSRESAIEGAINVGLNKTTSLNELLAALAQVVGKQPEVTYQAPRSGDIKHSRASNQRLLEHFTLDEPTPLVRGLELLMGQ

SEQ ID NO: 65410 - DNA, 1005 bp, Magnetospirillum magnetotacticum MS-1
  CDS (1)..(1005)
atgacccccactcatagcctgattaccggcggcgccggtttcatcggcagccatctggttgatcgcctcctggccgaaggccaccgggttaccgttatcgacaattgctcaaccggacggccgcagaatttggatcacgtcaagggtcatccgatgttgtcggcccattggctcgacatcaacgaccgcgatgccatcggaccgctgtttcagggtgttgaccgggtattccatctggccgcgctggcggacatcgtgccatccatccaaaacgccaccgactaccaccacgccaatgtggacggaaccttcgcggtgctggaggcggcgcgccacgccggagtgaagcgcttcatctacacggcgtcgtcgtcctgttacggtatccccgacgtcaccccgacaccggaaacggccgagatgcggccgatgtatccttatgccctgaccaagatggctggcgagttctacgccatgcattgggctcaatgttacggcctgcccgtggtgtccttgcgcctgttcaacgtctatggcccacggtcgcgcacctcggggacctatggcgccgtgttcggggtgttcctggcccagaagctggcgggcaagccctacaccatcgtcggcgatggcaaccaaagccgcgacttcaccttcgtcaccgatgtggccgacgccttcttcaccgcatcggaatccaatctcacgaatgtggtcatgaatgtgggctcgggcgggcattatagcgtcaaccggctggtcgaactgctgggcggcgacaaaacctatatcccaaagcgcccaggcgagcccgacatcaccttcgccgataccactcgcatccatgacctgctgggctggaaggccaaggtcagcctggaggagggggtgaagatcatcctggacaatatcgactattggcgcgaggcccccgtgtggacgcccgattccatcgccgatgccaccaaggattggttcaagtatctgggagccgatggcaaatga

SEQ ID NO: 65411 - protein, 334 aa, Magnetospirillum magnetotacticum MS-1
MTPTHSLITGGAGFIGSHLVDRLLAEGHRVTVIDNCSTGRPQNLDHVKGHPMLSAHWLDINDRDAIGPLFQGVDRVFHLAALADIVPSIQNATDYHHANVDGTFAVLEAARHAGVKRFIYTASSSCYGIPDVTPTPETAEMRPMYPYALTKMAGEFYAMHWAQCYGLPVVSLRLFNVYGPRSRTSGTYGAVFGVFLAQKLAGKPYTIVGDGNQSRDFTFVTDVADAFFTASESNLTNVVMNVGSGGHYSVNRLVELLGGDKTYIPKRPGEPDITFADTTRIHDLLGWKAKVSLEEGVKIILDNIDYWREAPVWTPDSIADATKDWFKYLGADGK

SEQ ID NO: 65412 - DNA, 990 bp, Burkholderia cepacia R18194
  CDS (1)..(990)
atgaaagtgctcgtgacaggcggagcgggctatatcggcagccatacctgcaaggcgctcgcggcagcgggacacgaaccggtcgcctacgacaatctgtcgaccggccatcgcgatgcggtgcgatggggaccgctcgtcaccgccgacattctcgaccgcgacgcgctgtcgaaggcgttcgccgcgcaccggcccgacgtcgtgatccatttcgccgcgctcgcgtacgtcggcgattcggtgctcgcgcccgaccgctattacacggtcaacgtcacgggcacctgcatgctgctgagcgcgatgcacgcggcgggcgtcggccggatcgtgatgtcgtcgtcgtgcgcgacgtacggcattccggacggcctgccgatctcggagcgcacgccgcagcggccgatcaatccgtacggcttcacgaagtacgcgatggaacggatggcggccgatttcgagcgtgcatacggattgaagtgggtcgcgctgcgctacttcaacgcggccggtgcggaccctgacggcgagatcggcgaatgccacgaaccggaaacgcacgcgctgccgctcgcgattcgcgcggcattcggcaccggccatgcgttccaggtaatgggcgccgactacccgacgcccgacggctcggcgattcgcgattacgtgcatgtcagcgacctcgccgacgcgcacctgaaagcgaccgcctatctgtgcggcggcggccacagcgtcgcactgaatctcggcaccggcaaaggaacgtcggtactcgacgcactgcgcgccgtcgaagccgtgacgggccgccgcgtgccgacggtaacggccgcgcgccgcccgggcgacccgcccgagctgtacgccgacgccacgaaagccgcgctcgtgctcggctggcggccgagtttcaccgcgatcgaaccgatggtcgaacacgccgcggcgtggtttcagaaagcactgcaattcgaatccggcaagtaa

SEQ ID NO: 65413 - protein, 329 aa, Burkholderia cepacia R18194
MKVLVTGGAGYIGSHTCKALAAAGHEPVAYDNLSTGHRDAVRWGPLVTADILDRDALSKAFAAHRPDVVIHFAALAYVGDSVLAPDRYYTVNVTGTCMLLSAMHAAGVGRIVMSSSCATYGIPDGLPISERTPQRPINPYGFTKYAMERMAADFERAYGLKWVALRYFNAAGADPDGEIGECHEPETHALPLAIRAAFGTGHAFQVMGADYPTPDGSAIRDYVHVSDLADAHLKATAYLCGGGHSVALNLGTGKGTSVLDALRAVEAVTGRRVPTVTAARRPGDPPELYADATKAALVLGWRPSFTAIEPMVEHAAAWFQKALQFESGK

SEQ ID NO: 65414 - DNA, 966 bp, Bacillus cereus G9241
  CDS (1)..(966): transl_table=11
atgagtaagaaatgtttaattacaggtggagcaggatttattggatcgcatttagctgaagagctggtgaaaagaggttatgatgtcactattgttgataacttctataaagggaaaaataaatatcatgatgagttaatgaaagaaattcgggttattccaataagtgttttagatcaaaattctatttatgaattagtaaaccaacatgatgtagtgtttcatttagcggcaattttaggtgtgaaaacgacaatggaaaagagtatagagcttattgaaacgaattttgatggaactagaaacattttacaagcagcgctaaaaggaaagaagaaagtagtttttgcgtctacttcagaagtatatggtaaggcaaagccgcccttttctgaagaaggagatcgattatacggtgcaacctctaaaatacgttggagttatgcaatttgtaaaacgttagaagaaacattatgtttaggatacgctttagaaggtttacctgtaacgattgttcgttattttaatatttatggtccaagagcgaaagatggtccgtatgcaggggtaatcccacgatttatccgcgcagcactgcaaggagaagacattctcgtatatggagatggaaaacagacacgttgttttacgtatgtaagtgatgcggtagaggcaacgattcgagcaatggatgagaaggtaaatggtgagattattaatataggttctgagaatgaaaagtgtataaaagaagtagcagcagtaataaaaaaattaacgaattcttcttcaaaaattgttcaagttcctttcgaagaggtatatccacatggctttgaagaaattccaaatagaagaccagatgtaacgaaattaagagaacttgttcaatttcaagcgaaagtaacgtgggaacaagggttgaaagaaactattaaatggtttcgtgaagaaaacaatggctaa

SEQ ID NO: 65415 - protein, 321 aa, Bacillus cereus G9241
MSKKCLITGGAGFIGSHLAEELVKRGYDVTIVDNFYKGKNKYHDELMKEIRVIPISVLDQNSIYELVNQHDVVFHLAAILGVKTTMEKSIELIETNFDGTRNILQAALKGKKKVVFASTSEVYGKAKPPFSEEGDRLYGATSKIRWSYAICKTLEETLCLGYALEGLPVTIVRYFNIYGPRAKDGPYAGVIPRFIRAALQGEDILVYGDGKQTRCFTYVSDAVEATIRAMDEKVNGEIINIGSENEKCIKEVAAVIKKLTNSSSKIVQVPFEEVYPHGFEEIPNRRPDVTKLRELVQFQAKVTWEQGLKETIKWFREENNG

SEQ ID NO: 65416 - DNA, 1011 bp, Pseudomonas fluorescens PfO-1
  CDS (1)..(1011)
atgaagatactcgtgactggcgcagccggtttcatcggctttcatgtcagccaggcgctgcttgcccgcggcgatgaagtcgttggcatcgataatctgaacgactattacgaagtggctctcaaggatgctcgcctcgcgcaattgacgccgcaggagggcttccggtttatccgcatggatatcggcgaccggactgcgatggcggaactgttcgagacagaaggctttgaaaaagttgtccatctcgcggcgcaagccggcgtgcggtactcgctggagaatcctcacgcgtatgcagacagcaaccttacaggcttcttgaacgttctcgagggctgtcgacaaactcacgtcaaacacttggtatatgcctcgtccagttcagtgtatggcgctaacgagagcatgcccttcgccgtgcaagacaacgttgaccatcccgtctcgctgtatgccgccacgaagaaagccaacgaactgatggcgcactcgtacagtcatctctatcggttgccgactaccggattgcgctttttcacggtctacggcccttggggccggccggacatgtcgccgttcctgttcgtgcgggcaatccttgaaggcaaaccgctgaaggttttcaattacggaaagcatcgccgagacttcacgtacatcgacgacatcgtcgacggcgtcatacgggtcctggaccatgtggctgcaccgaacgctcaatggtcaggactcaagccggatccggcctccagtgcggcgccctggaggctttacaacattggcaacagtcaaccggtcgaattgctggactacatcaagcacatcgaacaagcgctcggcaaaaccactcataaagagcttctgccgttgcagccgggcgatgtcgaacacacctatgccgatgtcgagcagttgaagatcgataccgggtatgcacccgacacgccgattgaaagcgggatacagcgctttgtgaactggtacaaggacttctacaacatcagctga

SEQ ID NO: 65417 - protein, 336 aa, Pseudomonas fluorescens PfO-1
MKILVTGAAGFIGFHVSQALLARGDEVVGIDNLNDYYEVALKDARLAQLTPQEGFRFIRMDIGDRTAMAELFETEGFEKVVHLAAQAGVRYSLENPHAYADSNLTGFLNVLEGCRQTHVKHLVYASSSSVYGANESMPFAVQDNVDHPVSLYAATKKANELMAHSYSHLYRLPTTGLRFFTVYGPWGRPDMSPFLFVRAILEGKPLKVFNYGKHRRDFTYIDDIVDGVIRVLDHVAAPNAQWSGLKPDPASSAAPWRLYNIGNSQPVELLDYIKHIEQALGKTTHKELLPLQPGDVEHTYADVEQLKIDTGYAPDTPIESGIQRFVNWYKDFYNIS

SEQ ID NO: 65418 - DNA, 1056 bp, Pseudomonas fluorescens PfO-1
  CDS (1)..(1056)
atgcgcaaaaccacgttgattactggcggagccggctacatcggctcgcatacggctctggccctcattaacgccggccacaaggtgctggtgctcgacaacctgtgcaacagctgtcgagagtgcatccggcgcctcgagcaactgaccctgacccgcgtcgacttcatcaagggcgatattcgcgatccggtcctgctcgacgatatcttcagccggtacgacatcgaggccgtggtgcactttgccagtctcaaatccgtcgaagaaagcgtgcgcaagccgctggactactacgccaacaatgttgccggtacgctcgacctgtgccaggcaatggcccgcaacaacgttttccaactggtgttcagctcatcggccacggtgtacggagaaccggcaaatacgccgattgccgaggatttcggcaccggcaaaccggtcaacccctatggccgcaccaagctcatgatcgaagagttgctgacggatctgtgcaactccgatccgcgctggagcattggattattgcgttacttcaacccgatcggcgcccacgaaagcggaatgatcggcgaagacccgagcggccgacccaacaacctgttgccttgcctgacccaggttgccataggccggatacccgaactcacggtgtacggcagcgactatcccaccgtggacgggacctgcgtgcgcgactacatccacgtggtcgacctggccatcggtcatctcaaggcactgcaagtgctacagcacgacaatggcattcatttctggaacctcggcacgggcgtcggctacagcgtgctacagatcatccacagtttcgaggacatcaccggcatcagcattccgtaccgcttcgcccctcgacgtctcggcgacatcgccaagtgctgggccgatccggccaaggcaggacgcgaactgggctggagcgcgcagcgcggcctggaacaaatgatcaccgatagctggcgctggcagtcgtgcaatccgcaggggtatcaatcttcattcaagattccggcacccgttgcggtgaagtga

SEQ ID NO: 65419 - protein, 351 aa, Pseudomonas fluorescens PfO-1
MRKTTLITGGAGYIGSHTALALINAGHKVLVLDNLCNSCRECIRRLEQLTLTRVDFIKGDIRDPVLLDDIFSRYDIEAVVHFASLKSVEESVRKPLDYYANNVAGTLDLCQAMARNNVFQLVFSSSATVYGEPANTPIAEDFGTGKPVNPYGRTKLMIEELLTDLCNSDPRWSIGLLRYFNPIGAHESGMIGEDPSGRPNNLLPCLTQVAIGRIPELTVYGSDYPTVDGTCVRDYIHVVDLAIGHLKALQVLQHDNGIHFWNLGTGVGYSVLQIIHSFEDITGISIPYRFAPRRLGDIAKCWADPAKAGRELGWSAQRGLEQMITDSWRWQSCNPQGYQSSFKIPAPVAVK

SEQ ID NO: 65420 - DNA, 993 bp, Rhodospirillum rubrum
  CDS (1)..(993)
atgacggcgaggtttagcgatctgtcgggacgaaacgccctcatcattggcggcctgggcttcatcggctccaatctggcgcggcgtctggttgatctgggggcttatgtcaccctgatcgacagcatgaatcccctctatggggggaacatgcataatatcgtcgatataaaagacaaggtgacggtcaatatctccgatgtccgcgatcgctacagcctgccgtggctggtgacgggaaaggatttcatcttcaatctggccggtcagaccagccatatggattcgatgagcgatcccttcaccgatctggaaatcaacgccaaatcacaattgtcgctgcttgaggtttgtcgggcccattgcccggaaacgaaaatcgttttcgcctcgacccgccagatttacgggcggccccagtatctgccggtggatgagcgccatccgattaaacccgtggacgtgaacggcatcaataaggcggcgggggaattctaccatatcctctatagcgaggtttatggcttgcggaccaccgtgctgcggctgaccaatacctatgggccacggatgcgggtcaaggacgcccgccaaaccttcctggggatctggtttcgcaaactgctggaaggtcagtccttcgaggtgtggggcggcgaccagaagcgcgattacacttatatcgatgatctggtcgatgccctgatgatctcgacgcttgatccggcctgcgacggcaagacctataacatcggcggcagcgaaatcctgtctttgcgcgagacggccgagatggtgatcggcaatcgtccgggggcgacttatgaaacccgcgtctatcccgaggaccgcaagaagatagatatcggcgattattattccgactatcggcttttcgaaacggcgaccgggtggagccccaaggtcggtttcgtggaagggtcgaaaaggaccttggactattaccgggacaatctttcctattatctgtag

SEQ ID NO: 65421 - protein, 330 aa, Rhodospirillum rubrum
MTARFSDLSGRNALIIGGLGFIGSNLARRLVDLGAYVTLIDSMNPLYGGNMHNIVDIKDKVTVNISDVRDRYSLPWLVTGKDFIFNLAGQTSHMDSMSDPFTDLEINAKSQLSLLEVCRAHCPETKIVFASTRQIYGRPQYLPVDERHPIKPVDVNGINKAAGEFYHILYSEVYGLRTTVLRLTNTYGPRMRVKDARQTFLGIWFRKLLEGQSFEVWGGDQKRDYTYIDDLVDALMISTLDPACDGKTYNIGGSEILSLRETAEMVIGNRPGATYETRVYPEDRKKIDIGDYYSDYRLFETATGWSPKVGFVEGSKRTLDYYRDNLSYYL

SEQ ID NO: 65422 - DNA, 984 bp, Rhodospirillum rubrum
  CDS (1)..(984)
atgattatcgttaccggtggcgccgggttcatcggctccaatattctggccgggctggaagagcgcggccatggcgacctcgttctggtcgaccgcctgcgcgatggcgtcaaatggcgcaatgtggccaagcgcgatctggccgatatcgtcgctcccgaagccttgcccgcctttctcgacggccatcgcggcgaggtttcggcgatccttcacatgggggcgatctcggcgacgaccgagcgcgacgccgatcgcatcattgaaaacaacttccgtctgtcgcgcgatctgtggctgtggtgcgcggccaatggcgcgcgcttcgtctatgccagcagcgccgccacctatggcgatggcgccctcgggttcgatgacgatttttccccggccgccctggcccgcctgcgtccgctcaacgcctatggctggtccaagcatctgttcgaccgcaaggtgcgtcattgggtcgactccgggccggtgccgccgcaatgggccgggctgaagttcttcaacgtctatgggcccaacgaaacccataaggggccgcaaagcagcgtcgtcagccagatccatccggtggcccggcgcggcgagtccttcgccctgttcaaatcccatgacccgcgctacgccgatggtggccagttgcgcgatttcgtctggatcggcgatgtcgtcgatatcgtcctctggctgcttgaaacgcccaaggtcagcggcctgttcaacgtgggcaccggccgcgcccgcagcttcgccgatctggccgccgccgtttatcgcgccctgggcgccgagccggcgctgacctatcgcgacatgcccgaggcgctgcgcgacaaataccagtatttcacccaggccgagatgggccggctgcgcgcggcgggctatcccgggcaggccacgcctttggaagagggggtgcggcgctatgttcaggactatctggaacaagccgatcccttccgctga

SEQ ID NO: 65423 - protein, 327 aa, Rhodospirillum rubrum
MIIVTGGAGFIGSNILAGLEERGHGDLVLVDRLRDGVKWRNVAKRDLADIVAPEALPAFLDGHRGEVSAILHMGAISATTERDADRIIENNFRLSRDLWLWCAANGARFVYASSAATYGDGALGFDDDFSPAALARLRPLNAYGWSKHLFDRKVRHWVDSGPVPPQWAGLKFFNVYGPNETHKGPQSSVVSQIHPVARRGESFALFKSHDPRYADGGQLRDFVWIGDVVDIVLWLLETPKVSGLFNVGTGRARSFADLAAAVYRALGAEPALTYRDMPEALRDKYQYFTQAEMGRLRAAGYPGQATPLEEGVRRYVQDYLEQADPFR

SEQ ID NO: 65424 - DNA, 996 bp, Ralstonia metallidurans CH34
  CDS (1)..(996)
atgaccatcatcgtgaccggcgctgccggctttatcggcagcaacatcgtcaagggcctgaacgagcgcggcgagacgaacatcatcgccgtggacaacctgacccgcgccgagaagttcaacaatctcgtcgactgcgagattgccgactacctggacaagaccgacttcgtcgcccgcttcgcgcgcggcgatttcggcaatgtccgcgcggtattccatgagggcgcctgctccgacacgatggagaccgacggtcgctacatgatggagaacaactaccgctacacgcttgccttgctggaggcgtgcctggagcagggtgcccagttcctgtacgcgtcgtcggcggccacttatggcgcttcgacgatgtttcgcgaggaccgtgactacgaaaagccgctgaacgtctacggctactccaagttcctgtttgaccaggtggtgcgccgtcgcctgccttccgcccattcgcagatcgtgggcttccgctacttcaacgtctacgggccgcgcgaattccacaagggccgcatggcgtcggtggcgttccatcacttcaaccagttccgcgccgaaggtacggtcaagctgtttggcgagtacaacggctatgcgccgggcacgcagagccgggacttcgtgtccgtggaggacgtggtcaaggttaatctgtacttcctggaccatcccgagaagtccggcatcttcaacctcggtactgggcggtcgcagccgttcaacgacatcgccgtctcggtggtcaatgcgctgcgcgagtcggaaggcaagccggcgctctcgctcgatgaaatggtgcaggaagggctggtcgagtacgtcaagttccctgatgccctgcgtggcaagtatcaatgcttcacgcagtcggatgtatcgcgcctgcgtggggctggctacagcgaccagttcctgaccgtgcaggaaggcgtcagccggtactgcaagtggctgctggagcgaagcgcctaa

SEQ ID NO: 65425 - protein, 331 aa, Ralstonia metallidurans CH34
MTIIVTGAAGFIGSNIVKGLNERGETNIIAVDNLTRAEKFNNLVDCEIADYLDKTDFVARFARGDFGNVRAVFHEGACSDTMETDGRYMMENNYRYTLALLEACLEQGAQFLYASSAATYGASTMFREDRDYEKPLNVYGYSKFLFDQVVRRRLPSAHSQIVGFRYFNVYGPREFHKGRMASVAFHHFNQFRAEGTVKLFGEYNGYAPGTQSRDFVSVEDVVKVNLYFLDHPEKSGIFNLGTGRSQPFNDIAVSVVNALRESEGKPALSLDEMVQEGLVEYVKFPDALRGKYQCFTQSDVSRLRGAGYSDQFLTVQEGVSRYCKWLLERSA

SEQ ID NO: 65426 - DNA, 993 bp, Burkholderia fungorum LB400
  CDS (1)..(993)
atgaccctcatcgtcaccggcgcggccggtttcatcggcagcaatctcgtgaaggcgctcaacgagcgcggtgaacagcgcatcatcgcggtggacaatctgacgcgcgcggacaaattcaaaaacctcgtcgactgcgagatcgacgactatctcgacaagaccgagttcgtcgaacgcttcaggcgcggcgacttcggtaaggtgcgcgcgattttccacgaaggcgcctgttcggacacgatggaaaccgacggccgctacatgatggacaacaacttccgctatagccgcgaggtgctcgacgtctgcctcgcgcagaacatccagttcctgtatgcatcctcggcggcgacgtacggcgggtcgagccgtttcgtcgaagagcgcgaagtcgagcagccgctgaacgtgtacggctactcgaaattcctgttcgatcaggtgatccgccgcgtgctgcccacggcgaagagccagattgccggcttccgttatttcaacgtgtacgggccgcgcgaaacgcataaggcgcgcatggcgtcggtggcgtttcacaacttcaaccagttccgcgccgagggcaaggtcaagctgttcggcgaatacaacggctacgcggcgggcgagcagacgcgcgacttcgtttcggttgaagacgtggtgaaggtcaacctgttcttcttcgacaatccggacaagtcgggcatcttcaacctgggcagcggccgcgcgcaaccgttcaacgacatcgccagcacggtggtcaacacgctgcgctcgctgaacaacgaaccggcgctgtcgctcgcggaacaggtgcagcgcgggctgatcgaatacatttcgttccccgatgcgttgcgcggcaaataccagtgcttcacgcaggcggatcagtcgaagttgcgcgcggccggctacgacgcgccgttcctgagcgtacaggaaggtgtcgatcgttacgtacgttggctgttcggccaggtgtaa

SEQ ID NO: 65427 - protein, 330 aa, Burkholderia fungorum LB400
MTLIVTGAAGFIGSNLVKALNERGEQRIIAVDNLTRADKFKNLVDCEIDDYLDKTEFVERFRRGDFGKVRAIFHEGACSDTMETDGRYMMDNNFRYSREVLDVCLAQNIQFLYASSAATYGGSSRFVEEREVEQPLNVYGYSKFLFDQVIRRVLPTAKSQIAGFRYFNVYGPRETHKARMASVAFHNFNQFRAEGKVKLFGEYNGYAAGEQTRDFVSVEDVVKVNLFFFDNPDKSGIFNLGSGRAQPFNDIASTVVNTLRSLNNEPALSLAEQVQRGLIEYISFPDALRGKYQCFTQADQSKLRAAGYDAPFLSVQEGVDRYVRWLFGQV

SEQ ID NO: 65428 - DNA, 948 bp, Enterococcus faecium
  CDS (1)..(948)
atgagctgttatcttatcaccggtggggctggcttcattggttctaccttagccaatcatttaggagaagaacatgtggtaatcgtcgtcgatgacttatcaatgggaaaagtagaaaatcttgatatgacgaaaaatatcacttttattgagggagatgtcgctgagaaatccttgatggaagagatcatgaaagctaataaatttgattatatctttcatttagcagcagttgctagtgtggcagattcagttgcccgaccagtagaaacacatcgtgtgaattttgaaagtgtattaatgattttagaattgatccgcaagtatcaacctgatttaaaacggatcgtgtttagttcttcagcggctgtttatggggatgaaccgactttaccaaaaaaagaagagtccgtgattcgcccattgacgccttatgcggttgataaattcgctgcagaacaatatgtgctagattattgtcatttatatgatgtacccggtagcgcagttcgttttttcaatgtctatggtccaaatcaaaatccgaattctccatacagtggtgtgatttctattctcgtagatcgctataagaaacaaatcgtaggagaagcaacttcatttacattatttggtgatggaagccagtctagagactttgtttatatagatgatgtaatccaagcattacttttagttgcgaatgaggaagctgcactggggaaacaattcaatgttggaacgggtaaagcaaccacacttttggaattgattcatgcaatcaatgaaattctcggtgtagaattgacacttgaatacaaagaagagcgttcgggtgatatccatgactctctagcagatattactaagatccagtcaattggctatcaaccgaaatatggtattttaagtggaatgactaattatttgaaaactgaaatcaattaa

SEQ ID NO: 65429 - protein, 315 aa, Enterococcus faecium
MSCYLITGGAGFIGSTLANHLGEEHVVIVVDDLSMGKVENLDMTKNITFIEGDVAEKSLMEEIMKANKFDYIFHLAAVASVADSVARPVETHRVNFESVLMILELIRKYQPDLKRIVFSSSAAVYGDEPTLPKKEESVIRPLTPYAVDKFAAEQYVLDYCHLYDVPGSAVRFFNVYGPNQNPNSPYSGVISILVDRYKKQIVGEATSFTLFGDGSQSRDFVYIDDVIQALLLVANEEAALGKQFNVGTGKATTLLELIHAINEILGVELTLEYKEERSGDIHDSLADITKIQSIGYQPKYGILSGMTNYLKTEIN

SEQ ID NO: 65430 - DNA, 990 bp, Enterococcus faecium
  CDS (1)..(990)
atgacaattttagtactaggcggagccggttatatcggttcgcacgctgtagaccagctagttcaaaaggggtatcaagtagctgtggtagataatttgctcacaggtcacaaacaagcagtacatccagatgctcatttttatgaaggagacatccgggataaagaatttctacgttccgtatttgaaaaggaaccgattgaaggagtaatccattttgctgcaagctctttagtaggagaatctgtcgaaaaaccattgatgtatttcaacaacaacgtatacggtatgcaaatcttacttgaagtcatgcacgagttcaacgtgaataaaatcgtattctcttctactgcagcaacttatggagagccgaaagagtctccaatcacagaagatacaccagctaatcctaaaaatccgtatggtgaaagtaaattgatgatggaaaaaatgatgaagtggtgtgaccaagcatatggcatgcgctatgtcgctttgcgctacttcaatgtagccggagcaaaagcagatgcatctatcggagaagatcatacaccagaaacgcatcttgtcccaatcattttacaagtagctcttggtcaaagaaaagccttggctgtttatggagacgattatgatacaccagatggaacatgtatcagagattatgttcaagtagaagatttgattgctgcacatattttagctttggaatacttgaaagaaggaaatgaaagcaacttcttcaatttaggcagcagcaaaggatactcagtcaaggaaatgctagaagcagctagagaagtgacaggaaaagaaattccagcagaaatagcaccaagaagagctggagatcctagccgattagtcgcttcaagtgaaaaagcgagagagattctgggctggaaacctgaatacacagatatcaaagcgattatcaaaacagcatgggattggcatgtcagccatccaaatggttatgaagaatag

SEQ ID NO: 65431 - protein, 329 aa, Enterococcus faecium
MTILVLGGAGYIGSHAVDQLVQKGYQVAVVDNLLTGHKQAVHPDAHFYEGDIRDKEFLRSVFEKEPIEGVIHFAASSLVGESVEKPLMYFNNNVYGMQILLEVMHEFNVNKIVFSSTAATYGEPKESPITEDTPANPKNPYGESKLMMEKMMKWCDQAYGMRYVALRYFNVAGAKADASIGEDHTPETHLVPIILQVALGQRKALAVYGDDYDTPDGTCIRDYVQVEDLIAAHILALEYLKEGNESNFFNLGSSKGYSVKEMLEAAREVTGKEIPAEIAPRRAGDPSRLVASSEKAREILGWKPEYTDIKAIIKTAWDWHVSHPNGYEE

SEQ ID NO: 65432 - DNA, 1008 bp, Magnetococcus sp. MC-1
  CDS (1)..(1008)
atgcgtgtattaattaccggagcagcgggttttattggctcggcactgagccgtaagctgcttgatcgcggggatgaggtgatcggtattgataacctcaatgattattatgatgtcacgctcaaacaggcgcggctggcgcgacatgtagagcaccctgcatacaccgatctacgtgtggatctggaggatagccaggctgtcgcccaggtttttgcaacccataaacctcagcgggtggtcaatttagccgctcaggctggggtacgctattcgctggttaatccccatgcttatatcaatgccaatgtggtgggttttctaaatattctggaaggatgccgtaaccatgatgtggaacacttggtctacgcctcgaccagttctgtttatggggccaataccaatatgcccttctctgagcatagtggtacccagcatccggtcagtctctacgcagcaaccaaaaaatccaatgagatgatggcccatgcctacagccatatctttcgactgccggtgacgggtttgcgttttttcacggtttatgggccgtggggacggcctgacatggcactgtttatgtttacccgtaaaatgctggcaggcgagcccattgatgtgtttaaccatgggcggcacatgcgggattttacctacattgacgatattgtgaatggtgttgagcgggtattggacaaaattgcgcaacccaacgaagcttggacgggacaaaatccagatcctgcaaccagtctctccccttaccgtatctataatatcggcaataacgaaccagtcgaactcatgcgctatattgaggtgttggagtctaccttgggcattgcagcgaagaagaattttctccccctacaaaaaggggatgttcccgacacctatgcggatgtcagtaatttggttgaagatataggctaccgtccacaaaccacggtggaggagggcatcggtaagtttgtcgcgtggtaccgcgactactaccaagtttag

SEQ ID NO: 65433 - protein, 335 aa, Magnetococcus sp. MC-1
MRVLITGAAGFIGSALSRKLLDRGDEVIGIDNLNDYYDVTLKQARLARHVEHPAYTDLRVDLEDSQAVAQVFATHKPQRVVNLAAQAGVRYSLVNPHAYINANVVGFLNILEGCRNHDVEHLVYASTSSVYGANTNMPFSEHSGTQHPVSLYAATKKSNEMMAHAYSHIFRLPVTGLRFFTVYGPWGRPDMALFMFTRKMLAGEPIDVFNHGRHMRDFTYIDDIVNGVERVLDKIAQPNEAWTGQNPDPATSLSPYRIYNIGNNEPVELMRYIEVLESTLGIAAKKNFLPLQKGDVPDTYADVSNLVEDIGYRPQTTVEEGIGKFVAWYRDYYQV

SEQ ID NO: 65434 - DNA, 957 bp, Magnetococcus sp. MC-1
  CDS (1)..(957)
atgtatattgtaacaggtggtgcgggttttattggagccaacattgtggcccagctcaatgcccaaggtattcgtgaaatcctggtggtggacaatctggaaaaagcggataaatttcttaacctacgcgatttagagatcgccgattttatggataaacgggagttccgcgagcatctggagcgggacatgtttgtcaacatgcccattcaggccattttccatcaaggcgcctgctccgataccatggagtatgatggtcgctatatgatggacaataactttacctactccaaggtgctgctgcaccgggcggtggagtggaaagtgccttttgtgtatgcctccagcgcggcaacctacggagccagcgcccgctttgtcgagtcaccggaaaatgagcgccccctcaatgtgtatggctactccaagctgctgtttgaccgctatgtacagcgcaatatgagcaaaattgagagcaccgtggtgggactgcgctattttaatgtgtacggcccccgtgaagggcacaaaggtaaaatggcctcgcaagcttttcaattgcgcaacaaggtgcttgccgatggtgaggcgaagctgtttgagggcaccaatggctatgccaacggcgagcaatcacgcgattttatctttgttgaagatgtggcccaggtcaatctgcatctggcccacagcagccagccgatcaaaggggtgtttaacctgggtacaggtaaaagccgcagctttaatgccgtcgcccaagcggtgatccatagccttggccaaggccgtattggctacttccccatgcccgcaggcttaaaagacaaatatcaaaactttacccaagccgacatgaccctgttccgggcgcaaaccggttataccgcgcctttcaccgagctagaagatggggtgaaaaaatatatgacggccttacaggaaaccccgtga

SEQ ID NO: 65435 - protein, 318 aa, Magnetococcus sp. MC-1
MYIVTGGAGFIGANIVAQLNAQGIREILVVDNLEKADKFLNLRDLEIADFMDKREFREHLERDMFVNMPIQAIFHQGACSDTMEYDGRYMMDNNFTYSKVLLHRAVEWKVPFVYASSAATYGASARFVESPENERPLNVYGYSKLLFDRYVQRNMSKIESTVVGLRYFNVYGPREGHKGKMASQAFQLRNKVLADGEAKLFEGTNGYANGEQSRDFIFVEDVAQVNLHLAHSSQPIKGVFNLGTGKSRSFNAVAQAVIHSLGQGRIGYFPMPAGLKDKYQNFTQADMTLFRAQTGYTAPFTELEDGVKKYMTALQETP

SEQ ID NO: 65436 - DNA, 933 bp, Magnetococcus sp. MC-1
  CDS (1)..(933)
atggcaacttacttgattaccggtggatgtggttttatcggatctcatctggcggatgccctgctggcccggggtgatggcgtacgaattttagatgatctctccaccggtaaacgggagaatgtgcaggggacctgtgagataatcctcggtgatgtggccgacagccaaaccgttcggcaggctatgcaaggggtagatggctgttttcatctggccgcagtggcttcggtggcgcgctccaatgaagattgggtaggcacccaccgcattaaccaaaccggctcggttaatgtgtttgatgccgcgcgacacgccaaagatgggcaacccgtaccggtggtgtacgcctcttcggcggcaacctatggcgcgtgccaaacactgcctattcacgaagatgccccccgtaaccccctaaccgcttatggcgccgataagctgggttcggaactgcacgcggtggtcgccagtggtgtgcatggtgtgccgacctgcggttttcgtttttttaatgtgtatggccccaggcaagatcccagctccccttactctggcgtgatctccatttttaccaaccgcatgcgggttggtcaggatgtcaccatctttggtgatggcggacagactcgggattttgtctatgtggccgatgtggtggcgcatctgctggcaggtatggaccgtgcgacgggtgaggctaaggtttacaatgtctgcaccggtcgagaaatcacccttttgcaacttgccctgatgattcggtcactgcttgatagcaagattgccattcaccatggagagccccgcgcgggggatattcgtgaatcgttgggggatccccgtcgcgcaaccgctgaattaggggttcgtgctgagattacgttggaagatggacttaaacggctgctggatagcttaaaaaacggttaa

SEQ ID NO: 65437 - protein, 310 aa, Magnetococcus sp. MC-1
MATYLITGGCGFIGSHLADALLARGDGVRILDDLSTGKRENVQGTCEIILGDVADSQTVRQAMQGVDGCFHLAAVASVARSNEDWVGTHRINQTGSVNVFDAARHAKDGQPVPVVYASSAATYGACQTLPIHEDAPRNPLTAYGADKLGSELHAVVASGVHGVPTCGFRFFNVYGPRQDPSSPYSGVISIFTNRMRVGQDVTIFGDGGQTRDFVYVADVVAHLLAGMDRATGEAKVYNVCTGREITLLQLALMIRSLLDSKIAIHHGEPRAGDIRESLGDPRRATAELGVRAEITLEDGLKRLLDSLKNG

SEQ ID NO: 65438 - DNA, 1080 bp, Magnetococcus sp. MC-1
  CDS (1)..(1080)
atgcagaaactttttaccgatgaaaccctgacgatcgaatccccgcaggcacggttgggagaatttatgaaggcgattttggtgacgggtggtgcagggtatataggcagtcatgtgtgtaaggtgttatcacaaagtggttttttaccgataacttacgataatttaagcgaggggcacccctgggccgtccgttgggggccgctggtggtcggggggcttgacgatggggctaaattggcaggtctctttgcacagtaccagccgcaagcggtgatccacttggcgggtcgtgcctatgtgggtgaatccatgacggacccggccctatactaccgcaataatgtgcaggccgcgttggtgctgttggaatgtatgcgtcaatatggttgtaaaaatatcatattttccagtagttgtgcgacctatggcgaacatcggcagatgcccataaccgaggcgatgtcccaacatcccatcaatccctatgggcgttctaagttgatgtttgagtggatgttgcaggactatcaggtgtatggcttgcagagtgtggccttacgctattttaatgccagtggtgccgatctggagggcgagattggtgagcagcaccaaccagaaccccacattataccccgcttgttagaagccgcccgtaagggtagcccctttaccatctatggtaccgattatgagagtgaggatggcacctgcgtgcgggattatatccatgtgagcgatctggcccaggcgcacctgttggcgttgcaatggttgtggcgggggggtgagagccgcgcttttaacctaggtaatggtcagggtttttccattcgacagttaattaaagtggccgagacagtgaccggcaaaagcatcgcggtgcagttgggtgcccgccgccctggcgatcccgccgtgttggtgggcagcgcagaaaaggcgcgggaagagctggggtggcagcctcaatatggtaccttggaaattattttaacgagtgcttggcgctggatgcagcggcgccaagatccccccgtggtagatgggatagaggagtccatcggtgaaccatga

SEQ ID NO: 65439 - protein, 359 aa, Magnetococcus sp. MC-1
MQKLFTDETLTIESPQARLGEFMKAILVTGGAGYIGSHVCKVLSQSGFLPITYDNLSEGHPWAVRWGPLVVGGLDDGAKLAGLFAQYQPQAVIHLAGRAYVGESMTDPALYYRNNVQAALVLLECMRQYGCKNIIFSSSCATYGEHRQMPITEAMSQHPINPYGRSKLMFEWMLQDYQVYGLQSVALRYFNASGADLEGEIGEQHQPEPHIIPRLLEAARKGSPFTIYGTDYESEDGTCVRDYIHVSDLAQAHLLALQWLWRGGESRAFNLGNGQGFSIRQLIKVAETVTGKSIAVQLGARRPGDPAVLVGSAEKAREELGWQPQYGTLEIILTSAWRWMQRRQDPPVVDGIEESIGEP

SEQ ID NO: 65440 - DNA, 990 bp, Magnetococcus sp. MC-1
  CDS (1)..(990)
atgatcgctctggtaacaggtggtgctggttttatcggtagccatctctgcgaaatgctccttgagcagggccacaccgtgcgcgccttggataatttttccaccggacgccgggccaatgtggcgcacctcatcaaccaccccaagtttaccctctacgaaggggatattcgcgatcctgaaacgctggtaacgccgtttcagggggtggagtgggtttttcatctggcggggctggcggatattgtgccctcggtagagaaccccacgacctattttgaggtcaatgtgcacggcaccctcaatgtgctggagtttgcccgccgcaaccaagccaagcggctggtttatgcggcttcttcctcctcctatggcattcccgagctctatcccaccccggaagagagccccattcagccccaatacccctacgccctaaccaaatatatgggtgaagagctggtgctacactgggccaatgtctataaaatgcccaacctctccttgcgtatgtttaatgtttatggtccgcgctcccgtaccaccggggcctatggtgcggtctttggggtcttcttggcgcaacgtttaaacaacaaaccctatacggtggtcggggatggccaacagagccgcgactttacctatgtaaccgatgtgtgtgcggccttttatgcggcggcccagtcgacgtgggtaggcgaagcctttaatgtgggcagtggcggccaccagaccatcaaccgcttggtggagctactggggggcgagatcacctatattcccaaacgcccaggcgagcccgattgcacctttgccgatacccgtaaaatccacgccaagctcaactggcaagcccaggttagctttgagcagggggtggccaatatgctggcttgtattgacgattggcgtgatgccccggtatgggagcccgcctcgattgccacagccaccgcctcctggtttaagcatctcggcaccccttga

SEQ ID NO: 65441 - protein, 329 aa, Magnetococcus sp. MC-1
MIALVTGGAGFIGSHLCEMLLEQGHTVRALDNFSTGRRANVAHLINHPKFTLYEGDIRDPETLVTPFQGVEWVFHLAGLADIVPSVENPTTYFEVNVHGTLNVLEFARRNQAKRLVYAASSSSYGIPELYPTPEESPIQPQYPYALTKYMGEELVLHWANVYKMPNLSLRMFNVYGPRSRTTGAYGAVFGVFLAQRLNNKPYTVVGDGQQSRDFTYVTDVCAAFYAAAQSTWVGEAFNVGSGGHQTINRLVELLGGEITYIPKRPGEPDCTFADTRKIHAKLNWQAQVSFEQGVANMLACIDDWRDAPVWEPASIATATASWFKHLGTP

SEQ ID NO: 65442 - DNA, 927 bp, Methanosarcina barkeri str. fusaro
  CDS (1)..(927)
ttgaaaactaaaaatgtagtagtcacaggtggtatgggtttcattggttcccatcttactgagaggctacttgaagataatgaagtaacagttattgataacgaatctacaggtaacattgaaaatataagacatctactagaccacgaaaatctaactgtaataaaaggcagtatagtagacttgaatttaacagaaattttcaaagacaaggattatgtttttcatcttgcagcaattcccagtgttccaagaagtgtaaaagatccttttagttcaaataactctaatatcacaggaacactgaatgttctgacagctgcaaaagatactggaattaagaaattaatattttcttcttcctcttcggtgtatggcgatacgccaactctcccaaaaagagaagatatgcccataaacccaatgtctccatatgcaattacaaaagcaaccggagaaatgtactgcagggtttttcaggatctttatgatctgccaacagttagtttaagatatttcaacgtttttggccctcggcaggacccaaattctcaatatgcagctgtaatcccaaaatttataactgcaattctaaacgatgagagtcccgtgatatacggagacggagaacaaagcagagacttcacttttgtcaaaaaagttgttgatgcgaatattctttcctgcgagtctaagaaaactggagttttcaatatagcatgtggtagaagaattacaattaatcagttagtcgattacgttaatgaaatactgggaaagaaaataaaatcgatacatgcagaaccaagaccaggggatattaagcactcattagcagatatatcaaaggctaaagaattcggatataatcccattggtaattttagggatgaacttaagacagtagcagaatggttcctgaactaa

SEQ ID NO: 65443 - protein, 308 aa, Methanosarcina barkeri str. fusaro
MKTKNVVVTGGMGFIGSHLTERLLEDNEVTVIDNESTGNIENIRHLLDHENLTVIKGSIVDLNLTEIFKDKDYVFHLAAIPSVPRSVKDPFSSNNSNITGTLNVLTAAKDTGIKKLIFSSSSSVYGDTPTLPKREDMPINPMSPYAITKATGEMYCRVFQDLYDLPTVSLRYFNVFGPRQDPNSQYAAVIPKFITAILNDESPVIYGDGEQSRDFTFVKKVVDANILSCESKKTGVFNIACGRRITINQLVDYVNEILGKKIKSIHAEPRPGDIKHSLADISKAKEFGYNPIGNFRDELKTVAEWFLN

SEQ ID NO: 65444 - DNA, 951 bp, Methanosarcina barkeri str. fusaro
  CDS (1)..(951)
atgcctgcaaaaaataaaatacttgtgacaggaggagccggttttataggaagccacctcacagatcgttttgtagaaaaagggaatagagttactgtttttgataaccttagctcaggaaaaatggaattcatagaagatcatcttgaaaatccgaattttactctgatagagggagatcttcttgatcaggatgtaattgaggaggcctgtagaggcattgatcttgtttgccatgtggctgcaaatccagatgtcaggctcggagcttcggataccagagttcacttgaatcagaatattcttgcgacttataatcttctggaggctatgaggaaaaaccatattaaaaagattgcatttacttccacctcgacagtttatggagaagcgagcattatccctactccagaagattacggccctcttatccctatatctctttacggcgcctccaaattggcctgtgaagctcttataacttcatattctcataccttcgacatgcaagcttggatatttcgctttgcaaatattgttggcccacgaagcacacatggaattaccgttgactttatacaaaaactgcaaaaaaattccgatatgctggagatccttggagatggcaagcaggaaaaatcctaccttcatgtgtcagaatgtgttgaagctatattgtttttaatagagaatagtgatgaaaaggtaaatatcttcaatattggctctgaggatacgatcagtgccacagagattggaaaagttgttatggaagagatggggctttctaatgttaaaattatctacaccggaggaaacaggggttggaaaggcgacgtgccaaggatgaagctggggattaaaaaaatgaagagtttgggctggaagccggtatatacgtcggagagaagtattagggacgcagcaaggatattacttggaagagtgtga

SEQ ID NO: 65445 - protein, 316 aa, Methanosarcina barkeri str. fusaro
MPAKNKILVTGGAGFIGSHLTDRFVEKGNRVTVFDNLSSGKMEFIEDHLENPNFTLIEGDLLDQDVIEEACRGIDLVCHVAANPDVRLGASDTRVHLNQNILATYNLLEAMRKNHIKKIAFTSTSTVYGEASIIPTPEDYGPLIPISLYGASKLACEALITSYSHTFDMQAWIFRFANIVGPRSTHGITVDFIQKLQKNSDMLEILGDGKQEKSYLHVSECVEAILFLIENSDEKVNIFNIGSEDTISATEIGKVVMEEMGLSNVKIIYTGGNRGWKGDVPRMKLGIKKMKSLGWKPVYTSERSIRDAARILLGRV

SEQ ID NO: 65446 - DNA, 897 bp, Methanosarcina barkeri str. fusaro
  CDS (1)..(897)
atgaaagtgctggttactggaggagcaggttttataggctcccatatagctgaatattttgcagaagcaggacacactgtcaggattttggataatcttgccacaggttttctcagaaatattccgcagtataaaaacgtcgagtttattaagggagacatctgtgattttcccttagtcgaaaaggcggctttgggcatggattatgtctttcacgaagctgcccttgtatcagtaccgttaagctgtgaaaaaccttctgaagctttccagattaacacgcttggaacccttaatgtactgcaggcctgcgttaaagctggtgtcaagaaatttgtaacagcgtcttcagctgcgatctatggaaataatcctgtccttccaaagcgagagagcatgtatcctgaaccggcttctccttatgctatttctaaacttgatggagaatatttggcaaggatgttttatgaaaatcatgggcttcgtaccacttgcctgcgttatttcaacgtctacggccctcgccaggacccaaaatctccatatgcagccgtcattccaattttccttgagagggcgaaactaggaaaggaccttgttatttatggagatgggcttcagagtcgagattttgttcatgttaaagatgtagtcagggcaaacgttgcagctcttgaacatggggatggtcaggtctttaatgtggctatgggaaaaagcgtgacagttcgggaacttgctgaaaatattaataaattaacggattcttctagcaggatcatacatgccgcttcaagggcaggtgatgttcgggactcaaaagccgatgtctcaaaaatctcagactggtggaaaggagagatcgagctgcaggaagggttaaaaagcctggtttaa

SEQ ID NO: 65447 - protein, 298 aa, Methanosarcina barkeri str. fusaro
MKVLVTGGAGFIGSHIAEYFAEAGHTVRILDNLATGFLRNIPQYKNVEFIKGDICDFPLVEKAALGMDYVFHEAALVSVPLSCEKPSEAFQINTLGTLNVLQACVKAGVKKFVTASSAAIYGNNPVLPKRESMYPEPASPYAISKLDGEYLARMFYENHGLRTTCLRYFNVYGPRQDPKSPYAAVIPIFLERAKLGKDLVIYGDGLQSRDFVHVKDVVRANVAALEHGDGQVFNVAMGKSVTVRELAENINKLTDSSSRIIHAASRAGDVRDSKADVSKISDWWKGEIELQEGLKSLV

SEQ ID NO: 65448 - DNA, 975 bp, Methanosarcina barkeri str. fusaro
  CDS (1)..(975)
atgggagaattttccatggctgcaaagaataaaatacttgtgacaggaggagccggttttatagggagccatcttgtagatcgttttatagaaaaaggaagtagggttactgtttttgataacctgagttcaggaaaaatggaatttatagaagatcattttgaaaacccagacttcaccctaataaaaggagaccttcttgaccaggaagcgataaaaaaggcctgtaaaggtattgactttgtttgtcacgtggccgcaaatcctgatgtcaggctcggagcctctgataccagagttcatttagatcagaatattctggcgacttataaccttctggaagcaatgaggaaaaacaatactaaaaaaattgcgtttacttccacctcaaccgtttatggggaagcgagtattatgcctactccggaagattacggcccccttattcctatatctctttacggtgcctctaaactggcttgcgaagccttcattacttcatattctcatacatttgatatgcaggcctggatatttcgcttcgcaaacattgttggcccacgcagtacacacgggattacggtagactttataaaaaagctgtggaataatgctagtttgctggaagtcctgggagatggcaaacaggaaaaatcctacctccatgtttcggagtgcgttgacgcgatattgtttttaatcgagaacagcgacgaaaaggtaaacatctttaatatcggctccgaagacaccatcagtgccacagagataggagaggctgttatagaagagatggggctttctaatgttgaatttacctatacaggagggaacagaggctggaaaggcgatgtgccaaagatgagattaggaattgaaaaaatgaaacgtttgggctggaaaccggtctatacatcagagagaagcattagggaaacggcgaaggcattacttgaggaaaagctagtagaataa

SEQ ID NO: 65449 - protein, 324 aa, Methanosarcina barkeri str. fusaro
MGEFSMAAKNKILVTGGAGFIGSHLVDRFIEKGSRVTVFDNLSSGKMEFIEDHFENPDFTLIKGDLLDQEAIKKACKGIDFVCHVAANPDVRLGASDTRVHLDQNILATYNLLEAMRKNNTKKIAFTSTSTVYGEASIMPTPEDYGPLIPISLYGASKLACEAFITSYSHTFDMQAWIFRFANIVGPRSTHGITVDFIKKLWNNASLLEVLGDGKQEKSYLHVSECVDAILFLIENSDEKVNIFNIGSEDTISATEIGEAVIEEMGLSNVEFTYTGGNRGWKGDVPKMRLGIEKMKRLGWKPVYTSERSIRETAKALLEEKLVE

SEQ ID NO: 65450 - DNA, 993 bp, Geobacter metallireducens GS-15
  CDS (1)..(993)
atgaagatattggtcaccggcggtgccggctacataggaagtcacgtggtgaaggcccttggcctggaggggcatgagctgctcgtgtacgacaacctctccacggggcacgagtgggcggtcatgtacggcactctcgtcaagggagatctggaggaccgggctctgctggaaaaggtcttccgcgagttccgtcccgacgcggtgatgcactttgccgcatccatccaggtggaggaatcggttcgccggccgcttctctactacggcaacaacacggccggcaccctgaatctcctcgatgtaatggtcaggacgggggtgcgatgcctggtgcattcctccactgcggcggtctacgggattccggatgtggtgccggtcgccgaaaccgctccccttgctcccatcaacccctacggctcatcaaaggccatggtggaaaaaattcttgccgaccttgcactggccgaggatttccgctacgtggccatccgctacttcaatgtggccggcgccgatgtggcgtgccgcctgggccaggcctaccgtgaggcgactcacctcatcacccgggcgctcaagaccgcccacggccagtacgaacggctccagatcttcgggaccgactaccagactcccgacggcacctgtatccgtgattacatccacgtggacgaccttgccgccgcccatgttctggccctggattacctgactgagggaggcgcgagcgagatcgtcaactgcggctacgggcacggattttcggtgcgtgaggtgatcgaggccgtggcgcatgttaccggcaccccttttccggtagaggaaacggggcggcggccgggtgacccgccggccctggtcgcggacagctccaaactccgatccctcatgaagtgggagccccaatacgacaatctcgacttcatcatcaggactgcctgggaatgggagctggctctcaagcggagggagtcatgtgcggcatag

SEQ ID NO: 65451 - protein, 330 aa, Geobacter metallireducens GS-15
MKILVTGGAGYIGSHVVKALGLEGHELLVYDNLSTGHEWAVMYGTLVKGDLEDRALLEKVFREFRPDAVMHFAASIQVEESVRRPLLYYGNNTAGTLNLLDVMVRTGVRCLVHSSTAAVYGIPDVVPVAETAPLAPINPYGSSKAMVEKILADLALAEDFRYVAIRYFNVAGADVACRLGQAYREATHLITRALKTAHGQYERLQIFGTDYQTPDGTCIRDYIHVDDLAAAHVLALDYLTEGGASEIVNCGYGHGFSVREVIEAVAHVTGTPFPVEETGRRPGDPPALVADSSKLRSLMKWEPQYDNLDFIIRTAWEWELALKRRESCAA

SEQ ID NO: 65452 - DNA, 981 bp, Geobacter metallireducens GS-15
  CDS (1)..(981)
atgactgttctcgttactggcggtgccgggtacatcgggagccatgtggtccgacagctttccgaggccggctataccgtggttgtctacgacaatctctccaccggcttcgccgacgccttggtgcatggcgagcggcttgttgtgggtgagctggctgattctgaccggcttgatgccctcttcgcagagcacgggttcaagacggtgctccatttcgcagcctccatcgtggcgcccgagtcggtgaccgatcccctcaagtattacagcaataatacccgcaataccctcaatctcctcacggcctgcgtgaagcatggggtcgagcggttcatcttctccagtaccgcggcggtgtacggcatgcccgagaacggcattgctgcggaagagagtcccacagtccccatcaacccctatggcacgtcgaagctcatgagtgaatggatgctccgcgacgtctgtgccgcccatggcatgcgctcggtggcgctacgctacttcaacgtggcgggggcagacccccaggcccggatgggacagcggaccccggaggcgacccacctcatcaaggtctccagccaggccgccctggggatgcgggagaaggtctccatcttcggcaccgactacgccacccccgacggcaccggcatccgcgactacatccacattgaggatcttgcctcagcccacctggctgccctggcgtatctggaaaggggcggggagacgacgcggatcaacgtcggttatggcaagggggccagcgtccgtgaggtgatcgagatggtgcgccgggtgtcaggagtccatttcccggccgaggaagctccccggcgtcccggcgatccggccatgctggtggcaaaggcggaccgggccaggacggtcctcggctggaccccgcactatgacgatcttgaaaccattgtcgccgatgcgtggcgatgggaagctaaactcaacaaacggtga

SEQ ID NO: 65453 - protein, 326 aa, Geobacter metallireducens GS-15
MTVLVTGGAGYIGSHVVRQLSEAGYTVVVYDNLSTGFADALVHGERLVVGELADSDRLDALFAEHGFKTVLHFAASIVAPESVTDPLKYYSNNTRNTLNLLTACVKHGVERFIFSSTAAVYGMPENGIAAEESPTVPINPYGTSKLMSEWMLRDVCAAHGMRSVALRYFNVAGADPQARMGQRTPEATHLIKVSSQAALGMREKVSIFGTDYATPDGTGIRDYIHIEDLASAHLAALAYLERGGETTRINVGYGKGASVREVIEMVRRVSGVHFPAEEAPRRPGDPAMLVAKADRARTVLGWTPHYDDLETIVADAWRWEAKLNKR

SEQ ID NO: 65454 - DNA, 1065 bp, Novosphingobium aromaticivorans DSM 12444
  CDS (1)..(1065)
atgagggacagcatgatcttcgatggatcgtccgaacgccgcggctcgatactggttacgggcggtgcaggctacatcggcagtcacgcggtactcgccttgctggatgctgggtggccggtcatcgtgctcgataacctgaccaccggctttcgctgggcggtcgacccgcgggcaagcttcgtcgaaggcgacgtcacggacagcgcccttgtgcgctctatcctgacctatcacgaagtcgccgcgatcatgcatttcgcagggtcggtggtggtaccggaatccgtcgtcgatccgctcaagtattacggcaacaacacggccgcgacctgttcgttgcttcgaaacgcggtggattgcggagtaccgcacatcgtattctcctcgactgccgcaacctacggcagtccagacgtggcgcaggtctgcgagaatacgcccacccggccgatcaatccctatggccgctcgaagctggtggtggaggcgatgctcgccgatgccgctgccgcatatccgatcaactactgtgcgctgcgctacttcaatgtggcgggcgccgatccggccggacgaaccggacaatcgacggccggcgcgacgcatctcatcaaggtctgcgtcgaggcggcgcttgggcggcgcgagctggtcgaggtctatggcacggattatgacacccacgacggcaccggcgtgcgcgactacatccatgtcagcgacctggccgacgcgcacgttcacgcgctgcacctgctgatggacgatcccgaggccagccacaccatgaactgcggctatggcaccggcttttcggtgctggacgtcctcgacgcggtcgagcgcatctccggccgcgagatccgacgggtcatgcgccctcggcgtcctggcgacccggctgcgctgatcgccgacaataacctgatcctgtctcgcacgcgctggcgcccccgccacgcccggctcggggatatcgtgcgccatgctctcgcctgggaagaccagcttgctcggcgtaagcctggtcaacctgtcggccagcgcgaaatcgccgcctga

SEQ ID NO: 65455 - protein, 354 aa, Novosphingobium aromaticivorans DSM 12444
MRDSMIFDGSSERRGSILVTGGAGYIGSHAVLALLDAGWPVIVLDNLTTGFRWAVDPRASFVEGDVTDSALVRSILTYHEVAAIMHFAGSVVVPESVVDPLKYYGNNTAATCSLLRNAVDCGVPHIVFSSTAATYGSPDVAQVCENTPTRPINPYGRSKLVVEAMLADAAAAYPINYCALRYFNVAGADPAGRTGQSTAGATHLIKVCVEAALGRRELVEVYGTDYDTHDGTGVRDYIHVSDLADAHVHALHLLMDDPEASHTMNCGYGTGFSVLDVLDAVERISGREIRRVMRPRRPGDPAALIADNNLILSRTRWRPRHARLGDIVRHALAWEDQLARRKPGQPVGQREIAA

SEQ ID NO: 65456 - DNA, 1002 bp, Novosphingobium aromaticivorans DSM 12444
  CDS (1)..(1002)
atgaccagggttcccgtgctcgtgaccggcggcgccggctatatcggcagccatgccgtcctcgcgctcaaggatgcgggttgggccgtgtcggtgatcgacaaccttaccaccggctttcgctttgccgtgcccgagggcgtgccgttctatgaaggcgacatcgaggatgccgggcttctggcccggatcatcgcggaacagggcatcaaggcagtcatgcacttcgccggctccattatcgtgccggaatcggtcgaaaacccgctgaagtactatcacaacaacacggccaagagccgcgcgctgatcgaggcggcggtgaagggtggcgtgccgcacttcatcttctcgtccaccgctgccacctatggcattcccgaagtctcgccggtgacggaggacagcccgcgtcgtccgatcaatccctatggcatgtcgaagctgatgaccgagaccatgctggccgacgtcgccgcagcgcacccgctgaatttctgtgtcctgcgatatttcaacgttgcgggggccgatccccaggcgcgcaccgggcagtcaacggcgggcgcgacgcatctcatcaaggtcgcggtcgaggccgcgctgggcaagcgtgcatcggtcggtgtctacggaaccgactatgcaacgccagatggcaccggcgtgcgcgattacatccatgtctccgatcttgccgccgcgcatgttctcgcgctggaggcgctgatcgccgcgcccgacgaatcgctcactatgaactgtggctatggccgtggcttttcggtccttgaagtgctcgatgcggtggaccgggtcaccaaccgcagaatcgcgcgcgaaatgcaggggcggcgggccggcgatcccgattcgctgatctcggacaaccgtcgcatcaggtcgaccctgccgtgggtgccgcaatatgccgacctcgacaccatcgttgcccatgccctggcgtgggagcgcaagctggacgggattcgcggtcagtaa

SEQ ID NO: 65457 - protein, 333 aa, Novosphingobium aromaticivorans DSM 12444
MTRVPVLVTGGAGYIGSHAVLALKDAGWAVSVIDNLTTGFRFAVPEGVPFYEGDIEDAGLLARIIAEQGIKAVMHFAGSIIVPESVENPLKYYHNNTAKSRALIEAAVKGGVPHFIFSSTAATYGIPEVSPVTEDSPRRPINPYGMSKLMTETMLADVAAAHPLNFCVLRYFNVAGADPQARTGQSTAGATHLIKVAVEAALGKRASVGVYGTDYATPDGTGVRDYIHVSDLAAAHVLALEALIAAPDESLTMNCGYGRGFSVLEVLDAVDRVTNRRIAREMQGRRAGDPDSLISDNRRIRSTLPWVPQYADLDTIVAHALAWERKLDGIRGQ

SEQ ID NO: 65458 - DNA, 921 bp, Ferroplasma acidarmanus
  CDS (1)..(921)
atgtcaataaagaacaaagaaattttagttaccgggggagctggatttataggatcaaacctggtaaatacattatcaaaggacaaccatgtatatgcactggatgatcttcaaacagggtcaatgcataatcttaaagattctatggacagaatagaatttattaaagaccgggtaaagaatataaatgattatgagataaatcctgattatattttccatataggcatatactcctcttccccaatgtataaaaataatccacatctaatagcaaatgccatagatgatcttattactgtacttgaatatgcaaaaaagaataaatctaaaatagtttatgcttcaacttcttccatatataatggaatagaggaacagaaagaagatgtaataccgaaggtatcagattattatacagaagccagaatagctatggaaagaatagccaacctttactgcaatctatatggcatggatgtctcagggatgagatttttctcggtgtatgggtataatgaaagatccaaaaaaatctatgcgaacctggtttcccagttcctatgggcaatgcatgacaacattgcacctgtattatacggtgatggggaacagaaaagagattttgtctttgttgaagaccttgtcaaagcactcatgcttgctgccgaaaataataaaaaattcaatgtgtacaatgtgggaacgggtaaaaattatacacttaatgaactggtaaaaatacttaacaaacatctgggaaaagacataaagcccgaatatatcgaaaatcccatgaaagacacatatgtttactatacccttgctgatattaaaaaaacagagcagaaaataggcttcaaagccagcatttccctcgatgagggaatagataaactcataaaatattataattattga

SEQ ID NO: 65459 - protein, 306 aa, Ferroplasma acidarmanus
MSIKNKEILVTGGAGFIGSNLVNTLSKDNHVYALDDLQTGSMHNLKDSMDRIEFIKDRVKNINDYEINPDYIFHIGIYSSSPMYKNNPHLIANAIDDLITVLEYAKKNKSKIVYASTSSIYNGIEEQKEDVIPKVSDYYTEARIAMERIANLYCNLYGMDVSGMRFFSVYGYNERSKKIYANLVSQFLWAMHDNIAPVLYGDGEQKRDFVFVEDLVKALMLAAENNKKFNVYNVGTGKNYTLNELVKILNKHLGKDIKPEYIENPMKDTYVYYTLADIKKTEQKIGFKASISLDEGIDKLIKYYNY

SEQ ID NO: 65460 - DNA, 957 bp, Ferroplasma acidarmanus
  CDS (1)..(957)
atgcaagggaaaaacatacttatcacaggaggagcaggattcataggttccaatatggtagaaaaactattgccagacaacaatataacaatactggacaacctaaataaccatgttgggaatcgtttcataacacaatttatggaaaacaaaaacttccattttataaatacagatctgctttcatttgattacggttcattgaagggcattgacacagttatacactttgcagccaactctgatgtcaggtatggttccgaagacccgacaaaagattttaaaaataacgttgttgcaacggaaaacatcctggaatacatgagaaaatatgatgttaaagatatactatttgcatcctcatccactgtgtacggagaagcatcaatcatgcctacaccggaaaattatgggccctatatgcccatatcatcatacggggcatccaagatgtccaatgaaggattcattacagcttactcccattattacggatttaaaggttctattttcagatttgcaaacatagtgggtaaaaattctacacatggagttatatacgattttataaataaattattgaaaaatcctggcgaactagaaatactgggcgatggtacacagaaaaaatcatacatgcatgtaaaagattgtgtggattcaatgatatacttccatgaaaaatccatgaaaactgatatcattaatctgggaaatcgtgaaacaacatcggtaaaaaccattgccgattacgtagtaaagagaatgggtctcaaaaatgtaaaataccgtttcacaggcggaataaatggaaggggatggaagggagatataaaaattacccaccttgctatagataagctcctatccacaggatggaagagcaggtataccagtgacgaatccgttgatgtggctgtccaggaaacaatagatcagctaaaaaataaaaattag

SEQ ID NO: 65461 - protein, 318 aa, Ferroplasma acidarmanus
MQGKNILITGGAGFIGSNMVEKLLPDNNITILDNLNNHVGNRFITQFMENKNFHFINTDLLSFDYGSLKGIDTVIHFAANSDVRYGSEDPTKDFKNNVVATENILEYMRKYDVKDILFASSSTVYGEASIMPTPENYGPYMPISSYGASKMSNEGFITAYSHYYGFKGSIFRFANIVGKNSTHGVIYDFINKLLKNPGELEILGDGTQKKSYMHVKDCVDSMIYFHEKSMKTDIINLGNRETTSVKTIADYVVKRMGLKNVKYRFTGGINGRGWKGDIKITHLAIDKLLSTGWKSRYTSDESVDVAVQETIDQLKNKN

SEQ ID NO: 65462 - DNA, 945 bp, Cytophaga hutchinsonii
  CDS (1)..(945)
atgaaggtattagttacgggtggtgcaggatatgtgggtacagagttggtattgaaacttgctaaagatccgagtatttctaaagttgttgtattcgataatctatccagagagaattataatttatttatcaattctgcacagcgtatagcaaaagataaaattcagtttgaattcggtgacttattggattcaagaaaaatccggaaaatattggctgatattgatgttgtctatcatttggctgcccgtgtttctacgccgtttgcaaatgcagacagccatttgtatgagcaggtaaaccactggggcacggctgaactggtttacgccattgaggaaattaaaacggtgcagaaattgatttacgtaagcagctgttcggtttacggttcaggaaaagaattgattgatgaaaactccgttgtaaatcctaaaacgatctatggtgtttcaaaaatgcgcggcgaagaacatgtatcacgtttgggcaataaaatgaatgccgttatcatacgtttaggtaatgtatacggctattcatcttccatgcgttttgatgcggtgatcaataagttcatgtttgaatctcactacaaaaaccgaatttctattcatggcaatgggcgccaaagccgctcgtttattcatgttgacaaagcggttgattcattagtaaaaattacgtcaacggatattccttccggtacctataacttaacagaacggaaccttgagatttacgatctgattgatcaggtaaaggatctatatcctacacttgaatttattttcatcaatcagcatcttgaattaagagaacaaaagatcaatccggaaacgaaattgctgaagtatattccgttgcagcaaacagatttcacagcagaattagcagccttcagagatcatttcacctttcagacaacaagtgttccagcatag

SEQ ID NO: 65463 - protein, 314 aa, Cytophaga hutchinsonii
MKVLVTGGAGYVGTELVLKLAKDPSISKVVVFDNLSRENYNLFINSAQRIAKDKIQFEFGDLLDSRKIRKILADIDVVYHLAARVSTPFANADSHLYEQVNHWGTAELVYAIEEIKTVQKLIYVSSCSVYGSGKELIDENSVVNPKTIYGVSKMRGEEHVSRLGNKMNAVIIRLGNVYGYSSSMRFDAVINKFMFESHYKNRISIHGNGRQSRSFIHVDKAVDSLVKITSTDIPSGTYNLTERNLEIYDLIDQVKDLYPTLEFIFINQHLELREQKINPETKLLKYIPLQQTDFTAELAAFRDHFTFQTTSVPA

SEQ ID NO: 65464 - DNA, 963 bp, Cytophaga hutchinsonii
  CDS (1)..(963)
atggttgttacaggtgcggctggatttatcggaagctgcttaattcaacgcttaaatgagttgaattttaattttatcgttgcagtagatcattttgaaaatcccgaaaagaaaaagaatctggaaaataaaaagattcaggagtatgtggaccgtgatgattttttcgattggctggataaaaacaacaaacatgttgaattcatctttcatataggcgcacgcactgatacaactgaattcgacaaagcaatctttgacagactgaatgttgcctattcaaaaaacatgtggaacgcctgtatcaagtatcagataccccttgtctatgcttcttctgctgcaacgtatggtaatggtgagtttggctacgatgataatgagcagaaaatcccgcaattaaaaccattgaatccatatggtgattctaaaaatgattttgatatctgggcattacaacaggagaaacaaccattcttctgggcaggcttaaaattctttaacgtttacggaccgaatgaatatcataaaagcagaatggcttcggtgatcttccatgcgtttcatcagataaaaaattccggaaagatgaaattgttccgttcacacaaagcagaatatacagatggcggacagatgcgtgactttgtgtatgtgaaagatgtctgcaacgtaatcatcttcctgatgaatcaccgcaaaaacagcggcatctataacttaggaagcggtacagccagaacattccttgatcttgccaaaaatacgtttaaaaatatggaggtaacggaaaatatttctttcattgatacgcccatagatatccgtgataaatatcaatactttacagaagccaatatgggcaaacttaaaagcattggctatacggatacattccataccctggaagaaggtattaaagattatgtaaaaaattacctgataccaaataaatactggtag

SEQ ID NO: 65465 - protein, 320 aa, Cytophaga hutchinsonii
MVVTGAAGFIGSCLIQRLNELNFNFIVAVDHFENPEKKKNLENKKIQEYVDRDDFFDWLDKNNKHVEFIFHIGARTDTTEFDKAIFDRLNVAYSKNMWNACIKYQIPLVYASSAATYGNGEFGYDDNEQKIPQLKPLNPYGDSKNDFDIWALQQEKQPFFWAGLKFFNVYGPNEYHKSRMASVIFHAFHQIKNSGKMKLFRSHKAEYTDGGQMRDFVYVKDVCNVIIFLMNHRKNSGIYNLGSGTARTFLDLAKNTFKNMEVTENISFIDTPIDIRDKYQYFTEANMGKLKSIGYTDTFHTLEEGIKDYVKNYLIPNKYW

SEQ ID NO: 65466 - DNA, 960 bp, Cytophaga hutchinsonii
  CDS (1)..(960)
atgaaaagaatattgattacaggcggagcagggtttatcggttcaaacctgacagaagcgttattgaacagaagtgatgttgagctggtgcgtgtactggataatttttcaacaggataccagcacaacatacatgaatttttgacccaccccaaatatgaatttgttgagggcgatatccgtaactatgaagatgtagttaaagcagtagagggaatcgaagtgatcagccatcaggctgcacttggttctgtaccgcgttcgctaaaagatcctatgaccagtaataatgcaaacgtgctgggttccatgaatgtttttcatgctgcaaaagaatcaggtgcagaccgtgtcgtgtacgcatcttcctcttcggtttatggagatgatccgggttcacctaaggaagaagaccgtttgggtaatgtgttgtctccgtacgctgcaagtaagcgcagtattgaactgtatgcaaaggcgttcagcaacgtctatccatttcgttttattgctatgcgttacttcaatgtgtttggtcccaggcaaaatgcgcagggagcatatgctgccgtaatacctcaattcataactgcattattaaatgggcagcaggctacaatcttcggagatggctcccagacacgcgattttacctttattgataatgtattacaaatgaatataaaagcactgtctacagataatgcagatgcgtttaacagatattataatgtagcctgcggctcaacaacttccttgaaccgtgtatatgctatacttgcaggctgtgccggctcagacattaagccccattatacggatccaagacaaggagatataaaagacagtctggccaatatcagtttagcgcaaaagcacattggatataaacccgaaatacagattgaagaaggattaattaaaaccttcgactggtttaaaaagaatcaaggtgaataa

SEQ ID NO: 65467 - protein, 319 aa, Cytophaga hutchinsonii
MKRILITGGAGFIGSNLTEALLNRSDVELVRVLDNFSTGYQHNIHEFLTHPKYEFVEGDIRNYEDVVKAVEGIEVISHQAALGSVPRSLKDPMTSNNANVLGSMNVFHAAKESGADRVVYASSSSVYGDDPGSPKEEDRLGNVLSPYAASKRSIELYAKAFSNVYPFRFIAMRYFNVFGPRQNAQGAYAAVIPQFITALLNGQQATIFGDGSQTRDFTFIDNVLQMNIKALSTDNADAFNRYYNVACGSTTSLNRVYAILAGCAGSDIKPHYTDPRQGDIKDSLANISLAQKHIGYKPEIQIEEGLIKTFDWFKKNQGE

SEQ ID NO: 65468 - DNA, 1002 bp, Cytophaga hutchinsonii
  CDS (1)..(1002)
atgtcaacagttttagttacaggtggtgcaggatatatcggttcgcatgctgtgcgtgcattagccaatttaaattatcaggttattgtgctggataatcttatttacggacatagagaagccatcgtaaacagtgaagtacgttttgttgaaggggacattgccaataaagccttggttattgatattcttaaaacatataaggtagatgcagtcatgcactttgctgcatttgcttatgtgggtgagtctgtaacagagccgacaaaatattacaacaataacttagctgcttccattaccctgcttgatgctatgcgtgaagcaggctgtaaaaatattattttttcttctacctgcgcttcttatggttcgcctaaatacatgcctattgatgaggctcatccgcaagaacccattaatccatatggcgcgagcaagtggatgcttgagcgtgtaatcaaagattaccaccatgcttacgggatcaattatgccttcttacggtattttaatgcatctggctgttcggcagatggtttgatcggcgaagatcacgatccggaaccgcatttaattccattgatcttaaaagcgatcaaaggggaacgcgatgcgattactgtatttggtacagattatgaaacaccggatggtacctgtgtacgtgactatattcacgttgaagaccttgcagatgcacacattaaagcgtttacttatctattgtctggtaaaggtccggttatctgtaatttaggtacgggagttggttattcagttaaagagatgatcgatgcagcggagcgggctacaggtaaaaaggtaccggtaaaatatggtgaacgcagagcaggtgatccaagtcatctggttgcgaatgctgaaaaagcctggaaagaactgggctggaaagcacgttacgtaaatattgaagaaatcatcgcaacggcctggaaatgggagaatggcgaacgtagcggccgttatggaaaaaattaa

SEQ ID NO: 65469 - protein, 333 aa, Cytophaga hutchinsonii
MSTVLVTGGAGYIGSHAVRALANLNYQVIVLDNLIYGHREAIVNSEVRFVEGDIANKALVIDILKTYKVDAVMHFAAFAYVGESVTEPTKYYNNNLAASITLLDAMREAGCKNIIFSSTCASYGSPKYMPIDEAHPQEPINPYGASKWMLERVIKDYHHAYGINYAFLRYFNASGCSADGLIGEDHDPEPHLIPLILKAIKGERDAITVFGTDYETPDGTCVRDYIHVEDLADAHIKAFTYLLSGKGPVICNLGTGVGYSVKEMIDAAERATGKKVPVKYGERRAGDPSHLVANAEKAWKELGWKARYVNIEEIIATAWKWENGERSGRYGKN

SEQ ID NO: 65470 - DNA, 1044 bp, Clostridium thermocellum ATCC 27405
  CDS (1)..(1044)
atgtcaaaaatagacttaagaaataagattatatttattacaggtgttgctggttttattggagcttattttgctaagcaattacttgatacagtggatggtattacaattataggtattgacaatatgaatgattattatgatgttaaattaaaagaaagtcgtttagaaagtttgtgtaataattcaaaattcatttttgtgaaaggaaacattgcagataaagaattaattaataatatttttaatacataccatccacagattgtagttaatttagctgcgcaggctggagttagatatagcattactaacccagatgcttatattgaatcgaatataataggtttttacaatatacttgaggcctgccgtcattcatatgacgaaggtaaagttccagttgaacaccttgtttatgcgagcagttcatctgtttatggttcaaacaagaaagtaccatattctactgaagacaaagtagactatcctgtttcactgtatgcagcaacaaaaaagtctaatgagttaatggcttatacatatagtaaattgtacaatataccatcgacaggattacgcttctttactgtttatggtcctgcgggacgaccggatatggcgtattttagctttacaaataagttagcacaaggtaaaaagattcagatttttaactatggtgacatgtaccgtgattttacatatattgatgatatagttaagggtattgtgcttgtgctccaaaaggttcctgaacctatggaagatggagtaagatacaagatttacaatatcggaaataacaaaccagaaaatttaatgcatttcgtggaagtattggagaaatgtctgatggaggaaggcattattacaaagcctggtgaaaaagaactacttcctatgcagcctggtgatgtataccaaacatatgctgatgtagatgatttagttcgagattttggatttaagccaagcacaagtcttgaagaaggattgagtaagtttgctaagtggtatcgtgaattttatatgcagaaataa

SEQ ID NO: 65471 - protein, 347 aa, Clostridium thermocellum ATCC 27405
MSKIDLRNKIIFITGVAGFIGAYFAKQLLDTVDGITIIGIDNMNDYYDVKLKESRLESLCNNSKFIFVKGNIADKELINNIFNTYHPQIVVNLAAQAGVRYSITNPDAYIESNIIGFYNILEACRHSYDEGKVPVEHLVYASSSSVYGSNKKVPYSTEDKVDYPVSLYAATKKSNELMAYTYSKLYNIPSTGLRFFTVYGPAGRPDMAYFSFTNKLAQGKKIQIFNYGDMYRDFTYIDDIVKGIVLVLQKVPEPMEDGVRYKIYNIGNNKPENLMHFVEVLEKCLMEEGIITKPGEKELLPMQPGDVYQTYADVDDLVRDFGFKPSTSLEEGLSKFAKWYREFYMQK

SEQ ID NO: 65472 - DNA, 1065 bp, Clostridium thermocellum ATCC 27405
  CDS (1)..(1065)
atgcaaaaacaaggtgcatatggctttgtcatcttgggtggcataataaacaatagaggaaaggttgtgtttgaagtggcagtattggttacaggaggagcaggttatattggaagccacacagtggcggaacttgtagaaaagaaggaagaggtaatagttgtcgataaccttgaaaaaggccacagggatgctgtggcaggagcgaaacttattgtaggtgatttaagggataaagaatttgtgaaaaaagtatttttggaaaacgatattgaagcggttatccattttgcggcttatattgaagtaggcgaaagcgtccaaaatcccttaaaatattataacaacaatgttatcgcaactttaaaccttcttacggcaatggaagaggcaaaagtcgacaaaattgtattttcttccacggcggcaacctatggtgagccggaaaacataccgatcttggagactgacagaacccttcccaccaatccgtacggtgaaaccaagctggctgttgaaaaggctcttaagtggtgtgacagagcttatggtattaaatacattgccttgaggtattttaatgccagcggtgcccatgaaagcggagaaataggcgaggaccattctcccgaaagccatttgattccccttgttatccaggcagccctgggtaaaagggaatccataaagatattcggaaatgattataatactccggacggaacatgtataagggattacatacacgtttccgaccttgcaaacgcccactatcttgcgttgcaaaggctcagagaaggcaaggaaagcgcggtttacaatcttggaaacggaaaaggtttttccgtaaaagaggttattgatgtggtacgaaaagtcacgggaagaccgataaaagttgaagacgctccgagaagacccggagacccggcagtactggttgcttcatcggaaaaaatcaaaaaggagctgaactggcagccacgcatggctgatctcgagacaattgtaagcactgcgtggaaatggcacttatcccatccgaacggctataatgacaaataa

SEQ ID NO: 65473 - protein, 354 aa, Clostridium thermocellum ATCC 27405
MQKQGAYGFVILGGIINNRGKVVFEVAVLVTGGAGYIGSHTVAELVEKKEEVIVVDNLEKGHRDAVAGAKLIVGDLRDKEFVKKVFLENDIEAVIHFAAYIEVGESVQNPLKYYNNNVIATLNLLTAMEEAKVDKIVFSSTAATYGEPENIPILETDRTLPTNPYGETKLAVEKALKWCDRAYGIKYIALRYFNASGAHESGEIGEDHSPESHLIPLVIQAALGKRESIKIFGNDYNTPDGTCIRDYIHVSDLANAHYLALQRLREGKESAVYNLGNGKGFSVKEVIDVVRKVTGRPIKVEDAPRRPGDPAVLVASSEKIKKELNWQPRMADLETIVSTAWKWHLSHPNGYNDK

SEQ ID NO: 65474 - DNA, 1020 bp, Microbulbifer degradans 2-40
  CDS (1)..(1020)
atgacagttttagtgacgggtggcgcgggctatattggcagccacacatgcatagaattaattgaagcgggcttcgatgtagtggttgtggataacctgcgcaactctaaatctgagtctttgaagcgtgtagaaaaaatagtgggtaaaaccataccgtttcacaaagtagatatttgcgataaagcggcgctaagcgacgtattcgctagctataaggtgtcgtctgttattcactttgcgggtttgaaggctgtgggtgaatcctgcgagatgccactagagtattaccgcaataacgtgggcggcacggtaaccttgtgcgaagtgatggatgagcacagcgtacacaatttgttgtttagctcgtcggccaccgtatatggcgaccccgcaagcgtgcctattttagagagctttcccacaggtgctaccaacccatacggccgcagtaagttgatcgtagaagaaatattgcgcgacgtatgcaaaatacccaacagcaattggcgcataagtttgctgcgctactttaacccaattggtgcacacataagtggcacaattggcgaagacccgcagggtatacctaacaacctattgccttatgtggcgcaggtagccgtgggtaaattgcctaagttaggcgtatttggcagcgattacgatacggtagatggcaccggcgtgcgcgattacattcacgtagtagacctagccaagggccatgttaaagccctgcaaaagctagagaaaagcgagcctgcagcctacacctataaccttggtactggtcagggttacagcgtattacaagtggttgaagcgtttgaaaaagcgagcggtaagaaagtaccttacgaattaaaaccccgtcggcctggcgatatagctgagtgttacgccgaccctgcgttggcggcatcggaactgggctggaaagcagagtttggtattgagcgcatggtggaagacacctggcgctggcagtcttcgaacccacagggctacgaaggctag

SEQ ID NO: 65475 - protein, 339 aa, Microbulbifer degradans 2-40
MTVLVTGGAGYIGSHTCIELIEAGFDVVVVDNLRNSKSESLKRVEKIVGKTIPFHKVDICDKAALSDVFASYKVSSVIHFAGLKAVGESCEMPLEYYRNNVGGTVTLCEVMDEHSVHNLLFSSSATVYGDPASVPILESFPTGATNPYGRSKLIVEEILRDVCKIPNSNWRISLLRYFNPIGAHISGTIGEDPQGIPNNLLPYVAQVAVGKLPKLGVFGSDYDTVDGTGVRDYIHVVDLAKGHVKALQKLEKSEPAAYTYNLGTGQGYSVLQVVEAFEKASGKKVPYELKPRRPGDIAECYADPALAASELGWKAEFGIERMVEDTWRWQSSNPQGYEG

SEQ ID NO: 65476 - DNA, 1008 bp, Microbulbifer degradans 2-40
  CDS (1)..(1008)
atgaaagtattggttaccggcgcagccggctttattggctaccacttaagcgaacgcctcctggcccgtggcgacaccgttgtaggtatcgacaacattaacgattactacgaccccaacattaaactcgcgcgcctcgagcgcttaaataagcacgaagcgtttgagttccaaaagctcgacttggccgatcgcggcggcatggaaaccttgtttagcaaccaccagtttgatcgcgtagtgaacttagcggcgcaagccggtgtgcgttactctatcgaaaacccacacgcctatgtcgattccaacatagtgggctttttgaatatactggaaggctgtcgccacaccaacgtaccacacctaagctatgcatcttcaagctctgtatatggcgccaatacgttgcagccattctctgagcaccacaacgtggaccacccagttgcgctttacgcagcaagtaaaaaagccaacgaacttatggcgcactcgtacagcagcctttataagttacctaccacaggcctgcgcttctttaccgtttacggcccttggggtcgcccagatatggcgctatttttgtttaccaaaggcattttggaaggtaagccaattaatattttcaataatggcgaaatgtaccgtgacttcacctacattgatgacattattgaaggcgttgtgcgggttaccaataaaattgctgagcccaacccgctgtggaccggcgacaagccagacccagcaactagttatgcgccatttaaggtgtataacattggcaacaacaaccccgttaaattaatggattttgttgaagccattgaaaacgagctaggcataaaagccatcaaaaacatgatgccgatgcaagccggtgatgttccaggcaccagcgccgacgtacaatcgttaatggatgatgtgggcttcaagccagaaatcaccgttcaacaaggcattaagcagtttgttggctggtataaagaatattttaaagtataa

SEQ ID NO: 65477 - protein, 335 aa, Microbulbifer degradans 2-40
MKVLVTGAAGFIGYHLSERLLARGDTVVGIDNINDYYDPNIKLARLERLNKHEAFEFQKLDLADRGGMETLFSNHQFDRVVNLAAQAGVRYSIENPHAYVDSNIVGFLNILEGCRHTNVPHLSYASSSSVYGANTLQPFSEHHNVDHPVALYAASKKANELMAHSYSSLYKLPTTGLRFFTVYGPWGRPDMALFLFTKGILEGKPINIFNNGEMYRDFTYIDDIIEGVVRVTNKIAEPNPLWTGDKPDPATSYAPFKVYNIGNNNPVKLMDFVEAIENELGIKAIKNMMPMQAGDVPGTSADVQSLMDDVGFKPEITVQQGIKQFVGWYKEYFKV

SEQ ID NO: 65478 - DNA, 999 bp, Oenococcus oeni PSU-1
  CDS (1)..(999)
atgaatgtattagttacaggcggcgccggatatattggttctcatactgtcgatcgtttgcttgctcacggcgatcgggtgtcagttgtggataatctttggaccggtcatcgccaagcggttccggatcaggctaaattttatgaagccgacgtccgcgataaaacagctcttaaaaaaattttcgatgagaacgattttgatgcagtcgttcattttgccgctttaactcaagtcggcgagtcgatgaaaaaaccacttttttattttgacaataatactttcggtgtgatttctttgcttgaagcaatgcgtgatcacaatgttaaaaagatcgttttctcttcatccgctgcgacatatggagttccaaaacataacccgattaccgaagatgaaatacaaaagccaattaatccttatggattgacaaagctacagatggaacaaattatggcttggtccgatcaagcttatggaattaaaggggttgcccttcgatatttcaatgttgccggagccaaggccgatggttcaattggcgaagatcacaatccggaaacgcatatgattccaaatattttaatggtcgcccagggcaagaaagataaaatggttatttttggggatgactacaatactcctgatggtacaaacgttcgtgattacgtacatgttgttgatttggcagatgctcatgttctggctttggaatatttgcaacgagaaaataaatccaatcgtttcaatttgggaacagaaatgggcatgtcaaataaacaattaatcagtgccgccaaaaaggtgactggaattgattttaaagttgagattggcccccgccgcgccggtgatccggacgctttggttgctagcccgaaaaaagccaaggaagtacttggctgggatcctaaattaagtaacgttgaggatgaaattaaatctgcctggaattggatgactaaacatccaaatggctatgatgataaagaacaatga

SEQ ID NO: 65479 - protein, 332 aa, Oenococcus oeni PSU-1
MNVLVTGGAGYIGSHTVDRLLAHGDRVSVVDNLWTGHRQAVPDQAKFYEADVRDKTALKKIFDENDFDAVVHFAALTQVGESMKKPLFYFDNNTFGVISLLEAMRDHNVKKIVFSSSAATYGVPKHNPITEDEIQKPINPYGLTKLQMEQIMAWSDQAYGIKGVALRYFNVAGAKADGSIGEDHNPETHMIPNILMVAQGKKDKMVIFGDDYNTPDGTNVRDYVHVVDLADAHVLALEYLQRENKSNRFNLGTEMGMSNKQLISAAKKVTGIDFKVEIGPRRAGDPDALVASPKKAKEVLGWDPKLSNVEDEIKSAWNWMTKHPNGYDDKEQ

SEQ ID NO: 65480 - DNA, 1005 bp, Pediococcus pentosaceus ATCC 25745
  CDS (1)..(1005)
atggcggtcttagttttaggtggtgccggttatatcggctcccatgcagttgatcgattaattacgaaaggttacgatgtagcggttgttgataacttggttactggacaccgcgcagccgtaaaccagcaagctcgtttttacgaaggtgatgtacgagatgctgaatttatggattcagtcttcaccaaagaaaacgtagaaggggtaattcattttgctgcgttttccgtggtccctgaatcaatgaaaaatcctttgaagtattttgataataatactgctgggatggttaaacttcttgaagtaatggctaaacatgatgtgaaacggattgtattttcatctacagcggctacttatggcgaaccagaacgggtgccaattcaagaatctgatccacaagttccaactaatccatatggtgaaagtaagttagcaatggaaaaaatcatgcattggtcagatgtggctgatggcattaagtttgtggctttgcgctactttaacgttgctggtgccaaaccagatggcagtattggggaagatcatcaaccagaaacacacttagtacctattatcttacaagtggctgctggtgaacgggatcagttgcaaatttttggggatgactatcctactgctgatggtactaatgtacgcgattacgtccacgtcgttgatttggctgatgctcatattttagctctagaatatctcaaacaaggtcatgatagtaacgcattcaatctcggatcttcaacaggcttctccaatcgtcaaatgttagaagctgctcgggaagtgacaggaaaggaaattccagctgttatggcaccaagacgagctggcgaccctagtactttaatcgcagcgagtgataaagcacgtgaaattttaggttggcaacctcaatatgatgatgttaaggaaattatcaaaactgcttggaattggaaagtcaaccatccagctggatacgatgaccgaggaggacaagcctaa

SEQ ID NO: 65481 - protein, 334 aa, Pediococcus pentosaceus ATCC 25745
MAVLVLGGAGYIGSHAVDRLITKGYDVAVVDNLVTGHRAAVNQQARFYEGDVRDAEFMDSVFTKENVEGVIHFAAFSVVPESMKNPLKYFDNNTAGMVKLLEVMAKHDVKRIVFSSTAATYGEPERVPIQESDPQVPTNPYGESKLAMEKIMHWSDVADGIKFVALRYFNVAGAKPDGSIGEDHQPETHLVPIILQVAAGERDQLQIFGDDYPTADGTNVRDYVHVVDLADAHILALEYLKQGHDSNAFNLGSSTGFSNRQMLEAAREVTGKEIPAVMAPRRAGDPSTLIAASDKAREILGWQPQYDDVKEIIKTAWNWKVNHPAGYDDRGGQA

SEQ ID NO: 65482 - DNA, 993 bp, Pediococcus pentosaceus ATCC 25745
  CDS (1)..(993)
atgagtattcttgtagttggaggagccggatatattggttcacatatggttaagcgattagtcgaacaaaatcgagatgtagtcgttgtggataacttatcaactggtcatcgtggcgcagtggataaaggcgtaaaattttatgagggcgatatccgagatcatgcctttttaaaggaagtctttgatcaagaagcaattgacacagttgtgcattttgctgcattttcaattgttcctgaatccatggaaaaaccgcttaagtattttgataataatacggcaggaatggttgctcttcttgaagaaatgcgggatcacgatgtaaaacgcattattttctcatctacagctgctacttatggagttcctgaaaagtctccgatcgaagaaaccgaccgtcaagcccctatcaatccttacggtgaaagtaaattaatgatggaaaaaatcattaaatgggcggatcaagcttatggaatcaaatttgtagccctccgctactttaacgtagcaggagcctatccagatggttcaattggcgaagatcatggaccagaaactcatttaacaccaattatcttgcaagtggctttaggcaaacgtgaccaattacaaatttttggagatgactatcatactccagatggtacgaacgtacgtgactatgtgcacgttttagatcttgcggatgctcatattttagcaatcgattatcttaaagcaggtaatgatagcgacgtcttcaatttaggttcatcaactggtttctcagttaaagaaatggttgaagcagcacgtgaagcaactggtgaagccattccagctaaaattgcggctcgtcgtcctggagatccagattcattaattgctgcaagtcaaaaagcacgcaaaatcttaaaatggaatcctcaatatgatgacgttaaagaaatcattaaaactgcgtggaattggactcagaaacatcccaatggttatgaagaccactaa

SEQ ID NO: 65483 - protein, 330 aa, Pediococcus pentosaceus ATCC 25745
MSILVVGGAGYIGSHMVKRLVEQNRDVVVVDNLSTGHRGAVDKGVKFYEGDIRDHAFLKEVFDQEAIDTVVHFAAFSIVPESMEKPLKYFDNNTAGMVALLEEMRDHDVKRIIFSSTAATYGVPEKSPIEETDRQAPINPYGESKLMMEKIIKWADQAYGIKFVALRYFNVAGAYPDGSIGEDHGPETHLTPIILQVALGKRDQLQIFGDDYHTPDGTNVRDYVHVLDLADAHILAIDYLKAGNDSDVFNLGSSTGFSVKEMVEAAREATGEAIPAKIAARRPGDPDSLIAASQKARKILKWNPQYDDVKEIIKTAWNWTQKHPNGYEDH

SEQ ID NO: 65484 - DNA, 951 bp, Trichodesmium erythraeum IMS101
  CDS (1)..(951)
atgagtaatactatagttacaggagtaggtggatttattggatctcatttagcagaaactctattaaatcaagataacaaagtaataggaatagatgagtttaataattactataaccctactttgaagcgtcagaatatttctcaatttcaagaccatcccgcttttcaattaatagaaaatgatattcagtctttaaattggtcagaattacttgtagatgtagacataatttatcatcaagctgctcaagctggagttcgtgctagttggggtggaggtttttttgattatacagaacgtaatatagatgcgactcaaataattttagaagctgctaaagatgctcctaatttgaaaagattagtttatgcttctagttcttctgtatatggtaatgctgaaactttccccaccccagaaactgtttgtcctcaaccagtatctccttatggaattactaagttagcagcagaacaattaggcaagttatatcatcataattttggtgtgccctgcgtctatttacgctactttacagtatatggtccccggcaaagacctgacatggcatttcataaattttttaagtggattttacaagatgaacctatttctatttatggagatgctcagcaaactagagactttacctttatcagcgatgcagtcgcagctaacttattagccgctacagtaccattagcagtaggtgaggtatttaatataggtgggggtagtcgggtagtattagcagaagttattaatatcatggagcaaatagtaggacgtccaattaaaaaaaattttgtagaaaaagctaggggagatgctcgtcatactagtgccgatgtttctaaagcacagaaaattttgggctatcaaccccagatttctttggccgaaggtttgaagcgagagtgggagtggatacgatcgctttattcataa

SEQ ID NO: 65485 - protein, 316 aa, Trichodesmium erythraeum IMS101
MSNTIVTGVGGFIGSHLAETLLNQDNKVIGIDEFNNYYNPTLKRQNISQFQDHPAFQLIENDIQSLNWSELLVDVDIIYHQAAQAGVRASWGGGFFDYTERNIDATQIILEAAKDAPNLKRLVYASSSSVYGNAETFPTPETVCPQPVSPYGITKLAAEQLGKLYHHNFGVPCVYLRYFTVYGPRQRPDMAFHKFFKWILQDEPISIYGDAQQTRDFTFISDAVAANLLAATVPLAVGEVFNIGGGSRVVLAEVINIMEQIVGRPIKKNFVEKARGDARHTSADVSKAQKILGYQPQISLAEGLKREWEWIRSLYS

SEQ ID NO: 65486 - DNA, 1002 bp, Trichodesmium erythraeum IMS101
  CDS (1)..(1002)
atgtcacaaaccaagccaacgattttagtgagtgggggagcaggatatattggttcccatgcagttcaggctttacaaaatgcaggttatgatatagtgattttggataacctcgtctatggacatcgggacattgtagaaaatgtcctgaaggtagaaatgattgttggggatactagcgatcgctctttattagataaaatttttgctactcacaacattgctgcagtaatgcattttgcagcatatatttttgtcggtgaatcagtaaaggatccgcagaaatattaccacaataatgtagttgggacactaacattattagaagcgatgcttaaagcatccataaaaaagtttgttttctcttcaactgctgctatttatgggaaaccacaaaccattcctattcccgaggatcatccgaaaaatccaattaacccttatggtgcaagtaagcggatgatagagcaaatacttgcagattttgagatcgcttatgattttaagtcggtttgttttcgctactttaatgcagcaggagcacatcctaatggtttgactggggaagatcataacccggaaactcatttaattcctctggtattgtttgcagcattgggcaagcgagattctatatcaatttttggcacaaattataagactcctgatggtacttgtattcgagattatattcatgtgtgtgatttagcggatgctcatgttttggggttagaatatttgttgaatggtggtgagagcaatatttttaatttgggcaatggtaatgggttttcggttagggaagtgatagagactgtgaagcaagtaactggtagagagtttaaagtggaggagcgcgatcgccgacctggagatccacctattttggtagggagtagtgagaaagccaggaaagtgttgggttggtctccgaaatatccagaggttaaggaaatagttagtcatgcttggcagtggcatcaaaaacgacatgggaaatga

SEQ ID NO: 65487 - protein, 333 aa, Trichodesmium erythraeum IMS101
MSQTKPTILVSGGAGYIGSHAVQALQNAGYDIVILDNLVYGHRDIVENVLKVEMIVGDTSDRSLLDKIFATHNIAAVMHFAAYIFVGESVKDPQKYYHNNVVGTLTLLEAMLKASIKKFVFSSTAAIYGKPQTIPIPEDHPKNPINPYGASKRMIEQILADFEIAYDFKSVCFRYFNAAGAHPNGLTGEDHNPETHLIPLVLFAALGKRDSISIFGTNYKTPDGTCIRDYIHVCDLADAHVLGLEYLLNGGESNIFNLGNGNGFSVREVIETVKQVTGREFKVEERDRRPGDPPILVGSSEKARKVLGWSPKYPEVKEIVSHAWQWHQKRHGK

SEQ ID NO: 65488 - DNA, 1014 bp, Moorella thermoacetica ATCC 39073
  CDS (1)..(1014)
atggctaaggtactggttaccggcggggcgggatatatcggcagccacgtggtgaaggctctaggggagaggggttaccgggtgctgacctacgacagcctggtaacgggtcacccctgggcggtcttatacggcgacctggtggtgggcgaccttttggacgccgccaaactggaagcggttatccgggacttccggcccgatgccgtcatgcactttgccgcccacatcgtcgtccccgagtccgtggcccagcccttgaagtattacataaacaatgtacaaggcactctgaatctcctcgcctgtatgcagaagagcggcgttaataagctcattttctcttccagcgccgccgtctacggcatcccggagcgcatcccggtgccggaagaagcccccctgcaccccatcaacccttacggccacagcaaggccatggtggagaggatactgcaggacctgtccgccgccggtgggataacctacgtatccctccggtatttcaatgttgccggtgccgaccgggacgggagaattggcgaggggaaagaagacgccacccacctcatcacactggctacccggacggcggcgggcaagagaccttatttaagcgtcttcggcacggactatcccaccccggacggcacctgcatacgcgactatatccacgtcgaggacctggcggcagcccacgtcctggccctggagtaccttttggacggcgggaagagcgaggtgttcaactgcggctacggccggggctactccgtcctggaggtgattgcagcggccaaaaaggtgaccggtgtagacttcccggtgcgctacgaaggccggcggccgggcgacccgccggctctggtggccgacgccaggaaaatccgcgagcgcctgggctgggtaccggcttacgacaacctggagggcattatctattccgcctggcagtgggaacggaagaggaatagcgtcccggctaggcccgcgactatctcaaccaggcggtga

SEQ ID NO: 65489 - protein, 337 aa, Moorella thermoacetica ATCC 39073
MAKVLVTGGAGYIGSHVVKALGERGYRVLTYDSLVTGHPWAVLYGDLVVGDLLDAAKLEAVIRDFRPDAVMHFAAHIVVPESVAQPLKYYINNVQGTLNLLACMQKSGVNKLIFSSSAAVYGIPERIPVPEEAPLHPINPYGHSKAMVERILQDLSAAGGITYVSLRYFNVAGADRDGRIGEGKEDATHLITLATRTAAGKRPYLSVFGTDYPTPDGTCIRDYIHVEDLAAAHVLALEYLLDGGKSEVFNCGYGRGYSVLEVIAAAKKVTGVDFPVRYEGRRPGDPPALVADARKIRERLGWVPAYDNLEGIIYSAWQWERKRNSVPARPATISTRR

SEQ ID NO: 65490 - DNA, 1029 bp, Thiobacillus denitrificans ATCC 25259
  CDS (1)..(1029)
atgtccgcgttcgacgcgctcaaggctgagctcgtggccgaaccgaagacctggctggtgacgggggccgccggcttcatcggcagcaatctcgtcgaagccctgctgaggctcgatcagcgtgtcgtcggcctcgacaacttcgccaccgggcacgaaaagaacctcgcgcaggtgcaggcgagcgtcggccctgcacgctgggcgaacctgagcttcaagcgcggcgacatccgcgacctcatcacctgtcatgacgcctgcaagggcgtcgactacgtactgcatcaggccgccctcggctcggtgccgcgttcgatcgaggatccgatctcgacccacgccgccaacaacaccggctttctcaacatgctggttgcggcgcgcgacgcccgggtcaagcgtttcgtctacgccgcatcgagctcgacctacggcgaccacccggcgctgcccaaggtcgaggacatcatcggcaagccgctgtcgccgtacgcggtgaccaagctcgtgaacgagctctacgccgacgtgttcggccgctgctatggcatggagtcgatcggcctcagatatttcaacatcttcggccgccgtcaggatccccagggcgcgtacgccgccgtcatcccgaaatgggtcgccagcatgatccacggcgagccggtctacatcaacggcgacggcgagaccagccgcgacttctgctacatcgacaacgtcatccaggccaacctgctcgccgcgacgagcccgcacgccgacgccgcgaaccaggtctacaacatcgcggtcggcgaccgcacgacgctcaacgaattgttcgaggcgatccgctcgctgctggcgccgcgcttcccccatctcgccgacgtgaagccggtctaccgtgacttccgctcgggcgacgtgcgtcattcgcttgccgacatttccaaggcgcgcacgcggctcggctacgcgccgagccatcgcatcgcagacggcctcgccgaggcgatggactggtacgtgcaggacctcgcctaa

SEQ ID NO: 65491 - protein, 342 aa, Thiobacillus denitrificans ATCC 25259
MSAFDALKAELVAEPKTWLVTGAAGFIGSNLVEALLRLDQRVVGLDNFATGHEKNLAQVQASVGPARWANLSFKRGDIRDLITCHDACKGVDYVLHQAALGSVPRSIEDPISTHAANNTGFLNMLVAARDARVKRFVYAASSSTYGDHPALPKVEDIIGKPLSPYAVTKLVNELYADVFGRCYGMESIGLRYFNIFGRRQDPQGAYAAVIPKWVASMIHGEPVYINGDGETSRDFCYIDNVIQANLLAATSPHADAANQVYNIAVGDRTTLNELFEAIRSLLAPRFPHLADVKPVYRDFRSGDVRHSLADISKARTRLGYAPSHRIADGLAEAMDWYVQDLA

SEQ ID NO: 65492 - DNA, 999 bp, Thiobacillus denitrificans ATCC 25259
  CDS (1)..(999)
atgagccagtacaccgtggtcaccggcgccgccggtttcatcggcgccaacatcgtcaaggcgctgaacgagcgcggcgagacgaacatcatcgcagtcgacaacctcaccaaggccgacaagttcaagaacctgaccgactgtgaaatcgccgactatctcgacaagaccgaatttctcagcgtggtcgaagagggtgtgctcgacggcagcgtcgcggcgatcttccacgagggcgcctgctccgacacaatggagaccgacggccgctacatgatggacaacaactaccgctattcgggcgcgttgctgaagttctgccaggatgaaggcgcgcagttcctgtacgcctcgtcggcgagcgtctacggcagcgggcgggtgttttccgaatcgcgcgagtgcgagtcgccgctcaacgtctacggctactcgaagttcctgttcgaccagagcgtgcgccggctgtgggcagagcgcacggcgcagatcgcgggcttccgctacttcaacgtctacgggccgcgcgagcagcacaagggccgcatggcctcggtcgccttccacttcttcaaccagtaccgtgccgagggccgggtgaagctgttcgaggggtgcgacggctatccgaacggcgagcagcgccgcgacttcgtctcggtcgaggacgtcgtgcgggtcaacatgtggttcctcgaccatcccgaggtgtcgggcatcttcaacgtcggaaccgggcgctgccagagcttcaacgacgtcgccgttgccacggtcaacgcctgccgcgcggccgagggccaggatgcgttgacgctcgacgagatgcaggctcaggggctcatcggctacgtagccttccccgaggcgctcaagggcaagtaccagagctataccgaagcggatacggcggccctgcgtcgcgccggctacgacggctcgttctacagtgtcgaagagggaactgcacgctacatcgagcgtctgctgcagtcatga

SEQ ID NO: 65493 - protein, 332 aa, Thiobacillus denitrificans ATCC 25259
MSQYTVVTGAAGFIGANIVKALNERGETNIIAVDNLTKADKFKNLTDCEIADYLDKTEFLSVVEEGVLDGSVAAIFHEGACSDTMETDGRYMMDNNYRYSGALLKFCQDEGAQFLYASSASVYGSGRVFSESRECESPLNVYGYSKFLFDQSVRRLWAERTAQIAGFRYFNVYGPREQHKGRMASVAFHFFNQYRAEGRVKLFEGCDGYPNGEQRRDFVSVEDVVRVNMWFLDHPEVSGIFNVGTGRCQSFNDVAVATVNACRAAEGQDALTLDEMQAQGLIGYVAFPEALKGKYQSYTEADTAALRRAGYDGSFYSVEEGTARYIERLLQS
